United States Patent 9,675,668 (MODIFIED POLYNUCLEOTIDES ENCODING HEPATITIS A VIRUS CELLULAR RECEPTOR 2) - sequence listing, part 22

SEQ ID NO: 46533 - DNA, 372 bp, Artificial Sequence
  Description of Artificial Sequence: Synthetic coding sequence
atgtacgagatcgccgcccccaacgtggccttcatgaccctgcggagtatgtgcaacacgtccaaaatggtgacatgtgccaagattttcttctatttcttggtgttcttttcactaagccagaacgtgcccaccatcggcgtgatcgcggtggttctggccacacacctctgcgatgaggtttctttggcgggctttgggtacgatttgaaccagcctaggaccccactgcattatttcgatagtcagtgtatggccgccatgaacttccagaccatgcataatgttacgaccgagaccaaatttttgttgaaacttgtgaaggaaggggtggttaaggatctgtcaggcggcatcgacagggaattttag

SEQ ID NO: 46534 - DNA, 1173 bp, Artificial Sequence
  Description of Artificial Sequence: Synthetic coding sequence
atgcccagcgagtacacctacgtgaagctgcggagcgactgcagccgtcccagtctgcagtggtatacccgcgcccagagcaaaatgcgccggccaagcctcctcctgaaagatattctgaaatgcactctgttggtttttggtgtctggatcctttacattctcaagctcaactacaccactgaggagtgcgacatgaaaaaaatgcactacgtagaccccgaccacgtcaagcgcgcacagaagtacgcccagcaggtcctgcaaaaagagtgccgccctaagttcgctaaaaccagcatggctctcctcttcgaacatagatatagcgtagaccttctacccttcgtgcagaaggctcccaaagactcagaggctgagtcaaagtacgacccaccattcggattccggaagttttctagcaaagtgcagaccctgctagagctgctacccgagcacgatctgcctgagcacttgaaagctaaaacctgcaggagatgtgtggtgataggttccggggggattttacatggtctcgaactcggacacaccctcaatcagttcgacgtggtcatccgtcttaacagcgcccctgtcgagggctattcggagcacgttggcaataagaccaccataagaatgacatatccggagggggcacctctttctgaccttgagtattactcaaacgacctcttcgtggccgtcttgttcaagtccgtggactttaactggcttcaagctatggtgaaaaaggaaaccttgcctttttgggtgcggctgtttttttggaagcaggtggctgagaagattcctcttcagcctaagcactttaggattctcaatcccgtgattatcaaagaaacagcttttgatatcctacagtattcagaaccacagagcaggttttggggccgcgacaagaatgtgcccactatcggcgtcattgcagtggttctcgccacccatctgtgcgatgaagttagcctggcaggattcggctacgatctaaatcagccaaggacaccactgcactactttgacagtcagtgtatggccgccatgaatttccaaaccatgcacaacgtcacgaccgaaacaaagttcctgctcaagttggtcaaggagggggtcgtaaaagacctgagcggggggattgacagagagttctag

SEQ ID NO: 46535 - DNA, 1188 bp, Artificial Sequence
  Description of Artificial Sequence: Synthetic coding sequence
atggccagcgtgcccatgcccagcgagtacacctacgtgaagctgcgatcagattgttcccgaccctctctgcaatggtacacaagagcccagtctaagatgcggcggccatctctgttgctgaaggatattctgaaatgcaccctgctggtgttcggtgtttggatactttacatactgaagctcaactatactactgaagaatgtgacatgaaaaagatgcactacgtggatcccgaccacgtgaagagggcccaaaagtacgctcaacaggttcttcaaaaagaatgccggcctaaattcgcgaaaacgagcatggcacttctgtttgagcaccgttactccgtggacctgctccctttcgtgcaaaaagctcctaaggacagcgaggcagagtcgaagtatgatccgcctttcggttttagaaagttctcttcgaaggtgcagacgctgctcgaattgcttcccgagcatgatttgcctgagcacctgaaggctaagacatgtaggcgctgtgtggtgattggcagcgggggcatcttacacgggctcgagcttggacacacgctcaatcagttcgatgtggtcatacggttgaactcagcacctgtcgaggggtactctgagcatgtgggaaacaaaaccacaatcagaatgacatatcccgaaggtgcacccctgagcgacctggagtattactcgaatgacctgttcgtcgcagtgctgttcaaatccgtggattttaactggcttcaggctatggtgaagaaggaaacgctgccgttttgggtgagactgtttttttggaaacaggttgccgaaaaaattccactacagcctaagcacttccgtatcctgaaccccgtcataataaaggagaccgccttcgatattcttcagtactccgagccacaatcgcgcttctggggcagggataaaaacgttcccaccatcggagtcatagctgtcgtgttagccacacacttgtgcgatgaagtctccctcgcaggctttggttatgacctaaaccagcccaggactcctctccattattttgattcacagtgtatggcagccatgaatttccagacaatgcacaacgtgaccacagagaccaagttcctacttaagctcgtcaaggaaggcgtggtcaaagacctgtctggaggcattgacagggaattctag

SEQ ID NO: 46536 - DNA, 420 bp, Artificial Sequence
  Description of Artificial Sequence: Synthetic coding sequence
atgcccagcgagtacacctacgtgaagctgcggagcgactgcagcaggccctcactccagtggtatacaagggctcaaagcaagatgaggagaccatcgctgttgctgaaagatatcttgaagtgcaccctgttggtattcggcgtgtggattctgtacattctcaagctaaattataccactgaggagtgcgatatgaaaaaaatgcattacgttgacccagaccatgttaagagagcgcagaagtacgcccaacaggttctccagaaggaatgccgcccgaaattcgcaaaaacttccatggccctcctgtttgaacaccgatacagtgtggacctgctgccctttgtgcaaaaggctcctaaagactctgaggctgagagcaaatacgaccccccattcggatttcgcaaattttag

SEQ ID NO: 46537 - DNA, 663 bp, Artificial Sequence
  Description of Artificial Sequence: Synthetic coding sequence
atgcggaccaaggccgccggctgcgccgagcggcggcccctgcagccccggaccgaggccgccgctgcacccgctggcagggcaatgcccagcgagtatacatacgtcaaactgagatccgactgtagccggccatccctgcagtggtacacaagggcacagtctaagatgcgccgcccctctctcctactcaaggacatcttaaaatgtactctcttggttttcggagtgtggattctctacatcctcaagctgaattacaccactgaagagtgcgacatgaagaagatgcactacgtggaccccgaccacgtaaagacactgtccccatgtggatggcattgtgttcaactgattatggcccgatggacccaacccttattacacaggctattgtctgactctgctgacctgcacagagccttcaaggggagcagagctctgccggccgaagcattttccgaacctcggcatcagcatctccagaccgaatctttcctaagcttagttttacttcccgcgtttcaggcatttctagggtacctcagggcacctgagggagcggccttggcactgcgacatttcctgctgtcatgcgagctctgggcttcttcaggcggaggccgagagcagttaaagcaaatgccggtgcagctgacatag

SEQ ID NO: 46538 - DNA, 1803 bp, Artificial Sequence
  Description of Artificial Sequence: Synthetic coding sequence
atgcggagctgcctgtggcggtgccggcacctgagccagggcgtgcagtggtccctgttgctggctgtgctggttttctttctgttcgcgctcccttcttttatcaaagagcctcagacaaagccatctagacaccagaggacagagaatatcaaggaacgctccctacagtcactggcaaagccaaagagtcaagctccgacaagagcacgccgaacgacgatatacgcggaaccagttcccgagaacaatgccctgaacacacagacacagccaaaggcacacactacaggtgatcggggaaaggaggctaatcaggccccacctgaagagcaagacaaggtgcctcataccgcccaacgcgcagcgtggaagagtcccgagaaggaaaaaaccatggtcaacacactgtcgccacgcggtcaggacgccgggatggctagcgggaggaccgaggcccagtcttggaaatcccaagacacaaagaccacacaaggaaatgggggccagacccgaaagctaaccgcctccagaactgttagcgagaaacaccaaggcaaggcggcaacgacagcaaagacattgatcccaaagtcacaacatcggatgttagcacctaccggcgcagtctccactcggacacggcagaagggcgtaaccactgcggtcatcccccccaaagagaaaaaaccacaagcaactccgcctcctgccccctttcagtcccctacaacgcagaggaatcagaggcttaaagctgccaactttaagagtgagcccagatgggatttcgaagaaaagtactcatttgagatcggggggttgcagacaacatgtcctgactctgtcaaaatcaaggcatcaaagagtttgtggctccagaaactgttcctccctaacctgactctgttcttggattcccgtcattttaatcaatccgaatgggacaggctggagcatttcgctccacctttcgggttcatggaattgaattactctttggtgcagaaagtggtcactcgcttcccacctgtgccgcaacaacagctcttgctggccagcctgccggccggctccctcaggtgtatcacctgcgccgttgtgggcaatggcggaattcttaacaattcccatatgggacaggagatagactcccacgactatgttttccggttgagcggtgccctaatcaagggctacgaacaggacgttgggactagaacctcattttacgggtttacagcctttagccttacacagagcttgctaattctggggaatagaggcttcaaaaacgtccctcttggcaaagacgtgcgttatctgcactttttggaagggacccgggactacgaatggttggaagctctcctaatgaaccagactgttatgtccaaaaaccttttttggttccggcaccgaccccaggaggcttttagagaagcactgcatatggatcgctacctactgctccatccagattttcttcggtacatgaagaataggttcttgaggagcaagactctggatggtgctcactggagaatctataggcccaccaccggtgctttgctgttactgactgctttgcagctctgcgaccaagtgagtgcctacggattcatcaccgaaggtcacgagcggttcagtgatcactactacgacactagttggaaaagactcatcttctacataaaccacgatttcaaattggagcgagaggtatggaaacgcctgcacgacgagggcattatcaggctgtatcagcgtccgggacccgggacggcaaaggcaaagaactag

SEQ ID NO: 46539 - DNA, 1416 bp, Artificial Sequence
  Description of Artificial Sequence: Synthetic coding sequence
atgcggagctgcctgtggcggtgccggcacctgagccagggcgtgcaatggtctctgttgctggctgtgctggtgttctttctgtttgctttgccatcatttattaaagaaccccaaacaaagcctagtcggcatcagaggacagaaaatatcaaagaacgtagcctgcagtcactggcgaagcctaaaagccaggcccctacacgggccagaaggacgaccatctatgccgagcctgtaccagagaataacgcactcaatacacagactcagccgaaagcgcacaccacaggagatagaggaaaggaagccaaccaggcaccacccgaggagcaggataaagtcccccatacagcccagcgtgctgcatggaaatcgccagagaaggaaaagactatggtgaatactctgtcaccccgcggccaggatgcgggaatggctagcggacggacagaggctcagagctggaagagccaggatacaaagacaacacaaggaaacggcgggcagactcggaaactgacggcctctcggaccgtgtccgagaaacatcaagggaaggccgcgaccactgctaaaacccttattcccaagtcacagcataggatgctcgccccgacaggggccgtcagcaccagaaccaggcaaaaaggtgtgacgaccgctgtgatcccccctaaagagaagaaacctcaagcaacaccccccccagctccttttcaaagtcccacaacacagcgaaaccagaggctcaaggccgccaattttaaatctgagccaagatgggattttgaggaaaaatactcgttcgaaataggcggtctgcagaccacttgtcccgactcagtaaagatcaaggccagcaagtcgctttggctccaaaagctgtttctgcccaatctcactttgtttctagattctcgacatttcaaccagtcagaatgggatcgcctcgagcatttcgccccgccttttggcttcatggagctgaactactcactggttcagaaggtcgttacacggttcccaccagtgccgcagcagcaactacttctcgcctctctgcctgcaggctcactgcggtgtatcacatgcgcagtggtaggtaatggcgggattctcaataatagccatatgggccaggaaatcgattcccacgattacgtgttccgtctatctggtgctttgataaagggatacgaacaggatgttggcacgcgcaccagtttctacggctttactgcattttctctgacccagtcgctcctgatcctgggtaatcgaggctttaaaaacgttccccttggcaaggcccaaactcctggttccttctctggtagtcccgcacacggacaagtcccggtcgccgctcctcgcctaagccctatacatgaagagcaggtttctgaagtgtag

SEQ ID NO: 46540 - DNA, 2238 bp, Artificial Sequence
  Description of Artificial Sequence: Synthetic coding sequence
atgggcgtgcccttcttcagcagcctgcggtgcatggtggacctgggtccatgttgggccgggggcctcaccgccgaaatgaagctactgttagccttggccggcctgctcgccattctagctacaccccagcccagtgaaggggccgcccctgccgtgctgggcgaagtggatacttcgcttgtcctttcgtccatggaagaagctaaacagttggttgataaggcctataaggaaaggcgcgagagtattaagcagagattacgctcgggaagcgcttcgccaatggaacttctatcgtacttcaagcaaccagtggctgcaaccaggaccgctgtccgtgccgccgactacttgcatgttgccttagaccttctggagaggaaattgcgatccctttggaggagaccgttcaatgtgaccgatgtactgaccccagctcagctcaatgtcctttccaagtcctccggatgcgcctaccaggacgtgggagtgacatgtcccgagcaggataaataccggacaatcactggcatgtgcaacaataggaggtcccctactctcggcgcttcgaatcgtgccttcgtgagatggctgccagccgaatacgaagatggcttcagtctgccatacgggtggacccctggcgtgaaaagaaatggctttccagtagcacttgcccgcgctgtgtccaatgaaatcgtacgctttccaaccgaccagctgacaccggaccaggagaggtccctgatgtttatgcaatgggggcagcttctggatcacgatctagattttacccctgaacctgcagcccgagcctctttcgtcacaggggttaattgcgaaacttcgtgcgtgcagcagccaccctgttttcctctgaagatcccgcccaatgatccacggattaaaaaccaggctgattgtattcccttctttcgctcatgcccagcatgtcctgggtctaatatcactatccgaaaccagattaacgctctaactagctttgtggatgccagcatggtctacggatcggaggaacccctggcacgtaacctccgcaatatgtccaaccagctgggtctcctcgccgtgaaccaacggttccaggataacgggagggccttgctcccctttgataatcttcatgatgacccttgccttctgacaaataggagtgcccgcattccatgctttctcgccggcgatacaagatcatccgagatgcccgaactcaccagtatgcacacccttttgcttagagagcacaacaggctggccacagagcttaagagtctgaacccacgctgggatggcgaaagactctaccaagaggccagaaagatcgtgggcgcaatggtacaaatcataacataccgagattacctgcctctcgtcttgggaccaaccgccatgaggaaatatctgccgacgtacaggtcatacaacgatagcgtggaccctagaattgcgaatgtgttcacaaatgcttttcgctacggtcataccctaatccagccattcatgttccgtttggacaaccgttatcaaccaatggaaccaaacccaagggtccctctgagcagagtgtttttcgctagttggcgggtagtgcttgaaggcgggatcgacccaatactgcgcggcttaatggctacaccggccaagctcaaccgccaaaatcagattgctgttgacgaaattagggaacgtctcttcgagcaggtaatgagaattgggctcgatttgcctgctctgaacatgcaacgttcccgcgaccacggacttcccggctacaatgcctggcgccggttctgcggattaccgcagccggagactgtcggccaattgggaacagttctcaggaacctcaagcttgcccgcaagctcatggaacaatacggcactccaaacaacatcgatatttggatggggggcgtgagcgaacctcttaagaggaaggggcgcgtgggtccactcctggcatgtattatcggcacacagtttcggaaacttcgtgacggcgaccggttttggtgggaaaacgaaggagttttctcaatgcagcaaaggcaagctctggcacaaatcagcctgccgcgcattatttgcgataataccggaattacaacagtgagcaaaaacaacatctttatgagcaacagctacccccgagacttcgtcaactgcagtacactgcccgctttgaacttggcgagttggcgggaagcgagctag

SEQ ID NO: 46541 - DNA, 918 bp, Artificial Sequence
  Description of Artificial Sequence: Synthetic coding sequence
atggcctgcatcctgaagcggaagagcgtgatcgccgtgagcttcattgcagcctttctgtttctgttggtcgtgcgtctggtgaatgaggttaactttccactgctcctgaactgctttggacaacctggcacgaagtggataccattttcttacacttaccgacgccccctgaggacccattacggatatataaacgtaaaaactcaggagcctcttcagctcgattgtgacttatgcgctatcgtctccaattccggccagatggtgggacagaaagtggggaatgagatcgaccgctcctcttgtatctggcggatgaacaacgcaccaacaaaaggctacgaggaagacgtgggaagaatgaccatgatccgggtagtgtctcatacgtccgtcccattgctgttaaaaaatcctgactatttttttaaggaagctaacactacgatctacgtaatatggggtccttttcgcaatatgagaaaggacggcaatgggattgtctataatatgttaaagaaaaccgtaggcatttaccctaacgcccagatttacgtgaccactgaaaagaggatgagttattgcgacggtgtgttcaaaaaagaaaccgggaaggaccgagtgcagtcaggtagttatctcagcacaggttggttcacctttctacttgcaatggatgcgtgttatggtattcacgtatatggcatgatcaacgacacatactgtaaaacagaagggtataggaaagttccttatcactactacgagcagggaagagatgagtgtgatgaatacttcctccacgagcatgccccgtacggggggcatagatttatcactgagaaaaaagtcttcgcgaagtgggctaagaaacaccgcatcatctttactcatccaaattggacgctttcttag

SEQ ID NO: 46542 - DNA, 915 bp, Artificial Sequence
  Description of Artificial Sequence: Synthetic coding sequence
gtgtgcatccggaagcggaagagcgtgatcgccgtgagcttcatcgctgcatttctgtttctgctcgtagtaagactggtcaatgaggtgaattttccactgctgctcaactgttttgggcaaccgggaactaagtggatcccgttttcctacacctatcgacgcccactgcgcactcactatggatatattaatgtgaagacgcaagagccgctgcagctcgattgtgacttgtgcgctatcgtgtccaactccggtcagatggtcggccagaaagttggcaacgagatcgacagatcaagctgcatctggcgcatgaacaatgcgcccacgaagggctacgaggaggatgttgggcgaatgacaatgatccgcgtggtcagtcacacgtctgtaccactgctgctgaagaatccagactacttcttcaaggaggctaacaccactatctacgtcatttggggaccattcagaaatatgcggaaggacggcaatggaatcgtgtacaacatgttgaagaagaccgtcgggatctacccgaacgcccagatctacgtaacaaccgaaaaacggatgagctattgtgatggcgttttcaagaaggaaacgggaaaagacagagttcagagtggctcttatttgtcgacaggttggtttactttccttcttgctatggatgcatgctacggcatacacgtatatggcatgattaatgatacatattgcaagacagagggatataggaaggtaccctaccattactacgagcaaggtcgagatgaatgcgatgagtattttctgcacgaacatgctccgtatggaggccatcggttcataactgagaaaaaagtcttcgcaaagtgggccaaaaagcaccgcatcatctttactcatcctaactggacactctcgtag

SEQ ID NO: 46543 - DNA, 633 bp, Artificial Sequence
  Description of Artificial Sequence: Synthetic coding sequence
atggcctgcatcctgaaggtgaccacctggatcgccgtgagcttcatcgcagctttcctctttctgctggtggtgaggctcgtgaatgaagttaacttccctctgctccttaattgcttcggccagccaggtacaaaatggattcctttctcatacacctataggaggcccctccgtacccactacggttacattaacgtgaagacccaggagcctttgcagctggattgtgacctgtgcgctatcgtgagcaattccggtcagatggtcggacagaaggtcggcaatgagattgatcggtctagttgcatctggcgcatgaacaatgcacccaccaaaggctatgaagaagacgtcggaagaatgactatgattagagtcgtttctcatacctctgttcctttgttgttaaagaatccagactacttctttaaggaagctaacacgactatctacgtgatttggggccctttccgcaacatgaggaaggacggaaacggaattgtttacaatatgctcaagaagactgtcggaatctaccccaacgctcaaatatacgtcaccacagagaagcggatgagctactgcgatggagtgttcaaaaaggagaccggcaaggacagcacagagtag

SEQ ID NO: 46544 - DNA, 612 bp, Artificial Sequence
  Description of Artificial Sequence: Synthetic coding sequence
ttcagcatcttccagcccctgcagctggactgcgacctgtgcgccatcgtcagtaattccgggcagatggtggggcagaaggtagggaatgagatcgatagaagctcatgcatatggcgcatgaacaacgcccccacgaaaggatacgaggaggacgtcggtcggatgactatgatcagggttgtgagccacacaagcgtacccctgctgctgaagaacccggattatttcttcaaagaggccaatactactatatatgtcatatggggcccgttccgcaacatgcggaaagacggcaatggtattgtatataatatgctgaagaaaacagtgggcatctacccaaatgcccaaatatacgtgacaacagagaaacgaatgtcttactgtgacggcgtgttcaagaaggagaccggtaaagacagaactgaagggtacaggaaggtgccctatcactactatgagcaagggagagacgagtgtgacgagtactttcttcatgagcatgccccctatggggggcaccgttttataacggaaaaaaaggtgttcgccaagtgggccaaaaagcaccggattattttcactcaccccaattggaccttaagctag

SEQ ID NO: 46545 - DNA, 909 bp, Artificial Sequence
  Description of Artificial Sequence: Synthetic coding sequence
atgaaggcccccggccggctggtgctgatcatcctgtgcagcgtggtcttcagtgctgtgtacattctgctgtgttgctgggccggcctgccactttgtctggctacgtgtctggaccaccactttccgactggtagtagacctactgtccctggacctctgcattttagtggctatagctcagtccccgacggcaagcctctcgtccgagaaccttgtaggtcttgcgctgtggtgagttcaagcgggcaaatgttgggtagcggattaggggctgagattgattccgcagaatgtgttttccgcatgaatcaggctcctacagtgggctttgaggccgatgtggggcagcgttccacactgagggtggtcagtcacacaagcgtgcccttgctgctacgtaactactcccactatttccagaaggctcgggataccttgtatatggtgtggggacagggcagacatatggacagggttcttggaggccgaacttatagaaccttactgcagttaacccggatgtatcccgggctgcaggtttatacatttactgagcgaatgatggcgtactgtgatcagattttccaggacgaaactggaaaaaataggaggcagtccgggtctttcctcagcaccggctggtttacaatgattctcgccctcgagctatgtgaggaaatcgtggtgtatggtatggtatctgatagctattgtcgcgagaaatcgcatccctcggtcccctaccattacttcgagaaaggtaggctcgatgaatgtcagatgtacctggctcacgaacaggctccaagatctgcgcaccgcttcatcaccgaaaaggccgtcttctccagatgggccaaaaagaggcccatcgtctttgcccatcctagctggcgtactgaatag

SEQ ID NO: 46546 - DNA, 657 bp, Artificial Sequence
  Description of Artificial Sequence: Synthetic coding sequence
atgctgggcagcggcctgggcgccgagatcgacagcgccgagtgcgtattcaggatgaaccaggcccctacagttggattcgaggccgatgtgggccagcgaagcaccctacgcgttgtgagccatacttcagtacccctgctcctgcgtaattatagtcattactttcagaaggccagagacaccctgtatatggtctggggccagggccgtcatatggatcgggtactcgggggacggacctaccgcaccctcctgcagctgacgcggatgtatcctggcctgcaggtgtatacattcacagaaagaatgatggcatactgcgatcagatatttcaggatgaaaccggaaagaacaggcgccaatcaggttccttcctcagtactggatggttcacaatgattctcgccctggagctctgtgaggaaatcgtcgtttatgggatggtaagtgacagctactgtcgcgagaaatcccacccctctgtcccttaccattactttgagaagggcagactggatgagtgccagatgtatttggctcatgagcaggctccgcgctctgcccataggttcatcaccgaaaaggcagttttcagccggtgggcgaagaaaagaccgattgttttcgcccacccttcctggcggaccgagtag

SEQ ID NO: 46547 - DNA, 606 bp, Artificial Sequence
  Description of Artificial Sequence: Synthetic coding sequence
atgctgggcagcggcctgggcgccgagatcgacagcgccgagtgcgtgttccgaatgaaccaggcccctacagtcgggttcgaagcggacgtgggccaaaggtccacattgcgcgtggtatcccacacaagcgttccgttgcttttgagaaattactcccattatttccagaaggccagagatactctctacatggtgtggggacaggggcggcacatggaccgggtactcggagggcggacgtatcgcacactgctgcagctcacaagaatgtacccaggtctgcaggtgtacacattcactgagcgaatgatggcttattgcgaccagattttccaggatgaaactggaaagaatagacgacagtctgggtcctttctaagcacggggtggttcacaatgatattggcgctcgagttgtgtgaagaaatcgttgtatatggaatggtctctgactcctactgcagagagaagtctcatccttccgttccttaccattatttcgaaaaaggcaggctggatgagtgtcaaatgtacttggctcatgagcaagctcctcggagtgcacatcgctttatcacggagaaagctgtgttctcacggtag

SEQ ID NO: 46548 - DNA, 657 bp, Artificial Sequence
  Description of Artificial Sequence: Synthetic coding sequence
atgctgggcagcggcctgggcgccgagatcgacagcgccgagtgcgtgttcaggatgaaccaggctcccaccgttggcttcgaggctgacgtcggccagcgaagtactttgagagtcgtttcccatacgagcgtacctctcctcttgcgcaactacagtcattatttccagaaagctcgagacacattatacatggtctggggtcaggggcgccatatggaccgcgtcttggggggccggacctataggaccctgcttcagcttactcgcatgtatcccggattacaagtgtacactttcacagagcgaatgatggcatattgcgaccagatcttccaggatgaaacaggcaagaatcggcgccaaagcggttcctttctcagcaccggctggttcaccatgattctagcactggagctttgcgaggagattgtagtgtacgggatggtcagtgattcctactgtagagaaaagtcccaccctagcgtgccctaccactacttcgagaaaggccgcctcgatgagtgtcaaatgtacctggctcacgaacaggctcccaggtcagcccatagatttattacagagaaggctgtgttttcgaggtgggcgaagaagcgcccaatcgtctttgctcaccctagctggcgtactgaatag

SEQ ID NO: 46549 - DNA, 1002 bp, Artificial Sequence
  Description of Artificial Sequence: Synthetic coding sequence
atggcctgcagccggccccccagccagtgcgagcccaccagcctgccacccgggcctcccgctggccgaagacatctaccactgagccgccggagaagggagatgagctccaataaagagcagagatctgctgtgtttgtgatccttttcgccttgatcaccatcttgatcctctactccagtaatagtgctaacgaggtgtttcactatggctccctgcgtggacggtctcggagaccagtcaacttgaagaagtggagcataaccgacgggtacgttcccatcctgggtaacaaaaccctgccgagtagatgccatcagtgtgtgattgtgagcagttctagtcacctgttggggacaaaattaggccctgaaattgagagagccgagtgtacaattcggatgaacgatgcccctaccactggctatagtgccgatgttggcaataagaccacataccgcgtggtggctcacagcagtgtcttccgggtgttgaggcggcctcaggagttcgtcaacagaaccccggagacggtattcattttttggggcccaccttcgaagatgcagaaacctcagggttccctcgtaagggtgatccagagagccggtctagtgttccctaatatggaagcctatgcagtgagcccaggaagaatgcggcagttcgacgacctgttccgtggggagactggaaaagatagagagaaatcacactcctggctgtcaaccggctggtttacaatggtgatcgctgtggagctctgcgatcacgttcacgtgtacggcatggtgccccctaactactgttcccaaaggcctcgcttacagcgaatgccttaccactactacgagcctaaaggaccagacgagtgtgttacctatatccagaacgaacatagccgaaaggggaatcaccatcgcttcatcactgagaagagagtcttctccagctgggcacagctgtacggcatcacattctctcaccccagctggacatag

SEQ ID NO: 46550 - DNA, 900 bp, Artificial Sequence
  Description of Artificial Sequence: Synthetic coding sequence
atgagcagcaacaaggagcagcggagcgccgtgttcgtgatcctgttcgctttgataacaatacttatactctatagtagtaacagcgccaatgaagtattccactacgggtcgctgcgtggaaggagccgacggcccgtcaatctcaagaagtggtctatcacagacggatatgtaccaattcttgggaataaaaccctccccagcagatgccaccagtgtgtgattgtgtccagctcgagtcacctgttaggcactaaactgggccccgagatcgaacgtgctgaatgtactattcggatgaatgatgcacctacaacaggatactccgccgatgtgggcaacaagaccacctacagggtcgtagcacacagcagcgtgtttcgggtcctgcgacggccccaggagttcgttaaccgtacgcccgaaacggtgtttatattctggggtccccctagcaaaatgcagaaacctcagggaagtctcgtcagagtgatccaacgggcaggcttggtgttccccaacatggaggcttatgccgttagccctggtcggatgaggcagttcgacgacctgttccggggggagaccggaaaagaccgcgaaaagagccactcatggttaagcacaggttggttcactatggtgattgctgttgagttgtgtgatcatgtccacgtgtacggcatggtgcctccaaactattgttcccagcgccctagactgcaaaggatgccatatcactattatgaaccaaagggccctgatgaatgcgtcacctatattcagaacgagcactcccgcaaagggaaccaccataggtttattaccgaaaaaagggtgttcagctcatgggcacagctatacggaatcacgttttctcacccatcatggacctag

SEQ ID NO: 46551 - DNA, 1125 bp, Artificial Sequence
  Description of Artificial Sequence: Synthetic coding sequence
atggcctgcagccggccccccagccagtgcgagcccaccagcctgccacctggaccgccagccgggcgccggcaccttcccctctcccggaggagaagggagatgagtagcaacaaggaacagcgcagcgccgtgttcgtcatcctgttcgcacttatcacaatcctcatactctatagcagcaactctgcaaacgaagtttttcactatggtagcctccgcggacgttccagacgtcccgtgaatctgaagaaatggtcgatcactgacggttacgtgcccatcctcggaaacaaaactctgcccagccggtgtcatcagtgcgtgatcgtatctagttcgtcgcacctcctcggcaccaagctgggaccggagatcgagagggccgagtgtaccattagaatgaatgacgcccctactaccgggtattctgcagatgtgggaaacaagacaacctacagggtcgtcgcacactcttccgtcttcagggtgctgcggagacctcaggaatttgtgaatagaaccccggaaactgtgtttatcttctggggccccccgtctaaaatgcagaaaccccagggtagcttggtccgtgtcattcaacgggctggcctggtttttccgaatatggaggcgtatgctgtgtctccgggaaggatgcggcagtttgacgatttgtttagaggtgagacgggaaaggacagagagaagtctcacagctggctcagtactggctggtttacgatggttattgctgtggagttgtgcgaccacgtgcacgtgtatggcatggttccaccaaactactgcagtgggccagcaagttccgcttgccccacgactacaacttctcctcgcggaagaacgaacgtgtcccccacaagccggatgtccaccgtggctagagcgacaaccacggcttcaagtccccggaagggctctagccaccggggtccatcgtgtatggcatcccccagcccaactccaccaggaccacgcccaccaagtctctgggatctgaggcgggtgagaggagaggccgctagcgcgcagcctctcgggcagggaccatcttctggacaatcacggttagctggcgtgtctccaagccagagtggaccttag

SEQ ID NO: 46552 - DNA, 900 bp, Artificial Sequence
  Description of Artificial Sequence: Synthetic coding sequence
atgagcagcaacaaggagcagcggagcgccgtgttcgtgatcctgttcgccctgattaccatactgattctatactcttcaaactcagccaatgaagtcttccactatggctccctccgaggtcgatcaagaaggcctgtgaatttgaagaaatggtccattacggacggctacgttcccattctggggaacaaaacactcccttcgcgctgccaccagtgtgtcattgtgtcatcctcatcccacttgctgggaacaaagctaggaccagagattgagagagcagagtgtaccatccgaatgaatgacgcccctacgaccggatattcagcagatgtcggcaacaaaacaacatatcgggtcgtggctcactcctcagtgtttcgcgtccttaggcggcctcaggagtttgtgaataggaccccggaaaccgtgtttatcttctggggtcccccatcaaagatgcagaagcctcagggctccctggtcagagtgattcaaagggctggattagttttccctaacatggaggcttacgcagtctccccaggacggatgagacagtttgatgatctgtttaggggggagaccggcaaggaccgagaaaaaagccattcttggctgagtacagggtggttcaccatggtgattgcggttgagttgtgtgaccatgtccacgtgtacggaatggtgccaccgaattattgttctcagcgtccacggttgcagaggatgccgtatcattactacgagcccaaggggcccgacgagtgtgtcacttacatccagaatgagcatagtcggaaaggcaatcatcatagattcatcaccgaaaagcgtgtgttctcttcatgggctcagctatacggtataactttctcccaccctagttggacctag

SEQ ID NO: 46553 - DNA, 1002 bp, Artificial Sequence
  Description of Artificial Sequence: Synthetic coding sequence
atggcctgcagccggccccccagccagtgcgagcccaccagcctgcctccagggcctcccgctggaagaagacaccttcctttatcacggcgaaggcgtgagatgtcgtccaataaagagcagcgatctgccgtatttgttatactatttgcgctcatcacaattctaattttgtactccagcaattctgcaaacgaggttttccactatggatctctcagagggcggtccagaagacctgtgaatctgaagaagtggtcaatcacagacggttacgtgcctatccttgggaacaagacactgccaagccggtgtcatcagtgcgtgatcgtgtcatcttccagccacctcctcggcactaagttgggccccgagattgaaagagccgaatgtactattcgcatgaatgatgctccaacaacagggtacagcgctgacgtggggaacaagacgacatacagggtcgtcgctcactcctccgtgtttcgcgttttgcggcgcccccaggaatttgttaatcgaactcctgagactgtcttcatattttggggtccaccctctaaaatgcagaaaccacagggctcacttgtgcgtgttatccagcgggcagggttggtcttccctaacatggaggcctacgcagtgagccccgggcgcatgcgccaattcgatgacctgttccgcggggaaacaggaaaagaccgggagaagtctcacagttggctgtctactggctggtttacaatggtgattgctgttgaactgtgtgaccatgtccacgtgtacggaatggtgccccccaactattgttcacagaggccgcgtctgcagagaatgccttatcactactatgagcctaaggggcctgacgaatgcgtcacatatatccagaacgagcactcgagaaagggtaatcaccatagattcataactgaaaagagagtattttcttcctgggcacaactctacggcatcacattttcccatcccagctggacatag

SEQ ID NO: 46554 - DNA, 603 bp, Artificial Sequence
  Description of Artificial Sequence: Synthetic coding sequence
atgagcagcaacaaggagcagcggagcgccgtgttcgtgatcctgtttgcattgatcactatccttatactttacagcagcaactctgctaacgaggtcttccactacggctccctgcggggcagatctcgacgccctgtaaatctgaaaaagtggtcaatcacagatggatacgttcctattttgggcaataaaactttaccatcacggtgtcaccagtgtgtcattgtctcgagtagttcccacttgttggggactaagctgggcccagagattgagagggcagaatgcaccattcggatgaatgacgccccgacaaccggatactctgctgatgtggggaataagactacatatagagtggtcgcccatagctctgtatttagagtactgcggcggccacaggaatttgtcaatagaacccccgagactgtgtttattttttgggggccaccaagcaaaatgcaaaagccccagggcagcctggttagagttattcagcgggcggggctcgtgtttcccaatatggaggcatacgccgtctccccgggtcggatgagacagttcgacgacttgtttcgcggtgagaccggaaaggactag

SEQ ID NO: 46555 - DNA, 402 bp, Artificial Sequence
  Description of Artificial Sequence: Synthetic coding sequence
atgcggagcagcatcaccgccccctgcggcgccgtggccgccgacctatccactagtcgcagcggggcgtcattgacggccatgagcccgtttagtgcaaccagggagaagtcccactcctggcttagcactggctggttcaccatggtaatcgccgtcgagctgtgcgatcacgtacatgtgtacggaatggtcccacctaactactgttcgcagcggcctagacttcagcgaatgccatatcattactacgaacctaaaggcccagacgagtgcgtgacttatatacaaaacgagcacagtcggaagggcaaccaccaccgcttcataaccgagaagcgcgtgttcagctcctgggcccagctttatggcataacattttcgcaccctagttggacttag

SEQ ID NO: 46556 - DNA, 1590 bp, Artificial Sequence
  Description of Artificial Sequence: Synthetic coding sequence
atgaagccccacctgaagcagtggcggcagcggatgctgttcggcatctttgcatggggtctccttttcctgttgatatttatctattttacagactccaaccccgccgagcccgtcccatcatctctcagttttctggagacccggagattgctgccagttcagggaaagcagagagcgatcatgggggccgcccacgagccatcccctccaggcgggctcgatgcccgccaggccctgcctcgcgctcatccagcaggtagtttccacgctgggccaggtgatctccaaaaatgggcacagtctcaggacggttttgagcataaggagttcttctcatcgcaggtggggcggaaaagtcaaagcgccttttatccagaagacgacgactatttcttcgcggctgggcaacctggttggcacagccacacacagggcacacttggcttccctagcccgggggagccagggccccgagagggtgcattccccgccgcgcaggtgcagagaagaagggtaaaaaagaggcacagacgacagcgtcggtctcacgtcctggaagagggggatgacggcgatagactgtatagcagtatgagccgggcattcttgtatcgtctttggaaaggtaacgtgagtagcaaaatgcttaacccgcggctacagaaggccatgaaagactacctgaccgcaaacaagcacggcgtaaggttcagagggaaaagggaggcaggcctctctcgcgcccaactgctttgtcaattgcgtagccgggcccgggttcgtacactagatgggacggaggcccccttcagcgcacttggttggaggcggcttgtgcctgctgtgccactgtctcagctgcaccccagaggcctgcggtcctgcgccgtggttatgtcagcaggagctattttgaactctagtctaggggaagagatagatagtcatgacgcagtgctaagatttaactctgcgccaactagaggctatgagaaagacgtgggaaataagaccaccatacgcattataaacagccagattcttactaatccatctcaccactttatcgatagttcactgtacaaggatgtgatcctggtggcctgggatcctgctccatactcagcaaacctcaatctatggtacaagaagcctgactacaatctgtttacaccatacattcagcacaggcagaggaatccaaatcaacccttctatattcttcaccccaaatttatctggcaactttgggacatcatccaggagaacacaaaagagaaaattcagccaaatcccccgtcctcagggtttatcggaattttaattatgatgtcaatgtgccgggaggtacatgtctacgaatatataccttctgtgcggcaaacggagctctgccattaccacgaactttactacgatgcagcctgcaccttgggagcctatcatcccctcctgtacgagaaacttcttgtccagcgccttaatatggggacacagggagacctacaccgcaagggtaaagtggtcctccctggctttcaggcggtgcactgtcctgccccatcaccggtgattccccattcctag

SEQ ID NO: 46557 - DNA, 288 bp, Artificial Sequence
  Description of Artificial Sequence: Synthetic coding sequence
tgaagcggcttcatcggcatcctgatcatgatgagcatgtgccgggaagtccatgtgtacgagtacatcccctcagttaggcagaccgaactgtgccactatcatgagctctattacgacgctgcatgtacacttggggcctatcaccctctcctgtacgagaagttgctggtgcagaggctgaacatgggtacgcagggagaccttcaccggaaaggaaaggtggtcttgcccggctttcaggctgtgcactgccccgctccaagtcccgtcattcctcactcctag

SEQ ID NO: 46558 - DNA, 1401 bp, Artificial Sequence
  Description of Artificial Sequence: Synthetic coding sequence
atgaagccccacctgaagcagtggcggcagcggatgctgttcggcatcttcgcctggggcctgctgttcttactcattttcatttatttcactgattccaatccggccgagcccgtaccttcatctttatccttcctcgagacgcgtcgcctccttcctgtgcaggggaaacagcgggcaatcatgggggcggcacacgagccctctcctcccgggggactggatgctcgtcaggctctgccccgggcccacccggctggcagcttccacgctggccctggtgatctacagaaatgggcacagagccaggatggttttgagcacaaagagttctttagttcccaggttgggagaaaatcgcagtcagcattctatcctgaggacgacgactatttcttcgctgccgggcaacctggctggcattcacacacacagggcactctggggttcccttcccctggagagcccggacctcgcgaaggagctttcccggccgcacaagtccaaagacgaagagtgaagaaaagacacaggagacagaggagaagccacgtgttggaagagggggacgatggtgaccgtttatactctagtatgagccgagcctttttgtacaggctatggaagggaaatgtttcttctaaaatgttgaacccacgtctgcagaaggctatgaaagactacctgactgctaataagcacggagtccgattcagggggaagcgggaggccggactgtcccgcgcccagctgttgtgccagcttcgttcacgcgcccgcgtgcgcacactggacggaacagaggctcccttttccgccctggggtggcgtcgactggttcctgcggtgccgctgagccagctgcatcctcgcggtctgcggtcatgtgctgttgtgatgagcgccggcgctatcttaaactcttcattgggtgaagagattgactcccacgacgcagtgctcagatttaacagcgcccctacccgcggttatgagaaagacgtcgggaataagactaccatccgtattattaatagccaaattctaacaaatccatcacatcactttatagattctagcctgtataaggatgtgattctggtggcctgggatccggcaccatatagtgccaacctgaacctttggtataagaaacctgattacaacctttttaccccatatatacaacaccgtcagagaaatcctaaccagccattctacattctccaccctaagtttatctggcagctgtgggacattatccaggaaaacaccaaggaaaagatccagcccaaccctccatcatctggtttcataggctctttcgttaaaattgggcatatcagagcttgttctgagcccaggtcccgtgactgtacccctgcttggaccacggagtag

SEQ ID NO: 46559 - DNA, 1590 bp, Artificial Sequence
  Description of Artificial Sequence: Synthetic coding sequence
atgaagccccacctgaagcagtggcggcagcggatgctgttcggcatcttcgcatggggccttctgtttctgctgatcttcatctacttcactgactccaatcctgctgagcccgtcccctcctcactcagcttcctggaaactcggcggcttctgccagtgcagggcaagcaacgggcaattatgggggccgctcatgaaccttctcccccaggtggcttggacgcacggcaagccctgcccagagctcaccctgcaggcagtttccacgcgggtcccggagatctgcagaaatgggctcagtctcaggatggcttcgagcacaaggagtttttctcatcccaggtgggtaggaagtcacagtctgctttctatccagaggacgatgactatttttttgccgctggccagcctggatggcattcccatacgcagggaactcttggttttccctctcccggtgagccaggtccacgtgagggcgcctttcccgctgcccaggttcagcggagacgcgtgaaaaagagacatagacgacaacgccggtcacacgtgctggaggagggtgacgatggcgatcgactgtactcttcaatgtcgcgagcctttctgtatagactatggaagggcaatgtgagtagcaagatgctgaacccccgccttcagaaggctatgaaggactacctgacggccaataagcatggtgtgagatttcgggggaagagagaggcggggctgagcagggcccagctgctctgtcagcttcggtctcgagccagagtgaggacattagacggcacagaagcgcctttcagcgcactagggtggaggcgtctggttcctgctgtcccattgagccagctgcatcccaggggcctgagatcgtgcgctgtggtgatgtccgcgggggcaattttgaactcctccttgggagaggagatcgattctcatgatgctgttctgagatttaatagcgcacccaccagaggctatgaaaaagatgtgggcaataaaaccaccatcagaattatcaactctcagattctaaccaatccctcccaccacttcattgattcaagcttatataaagatgtgatactggtcgcctgggatcccgccccctactcagcaaacctgaacctgtggtataagaaacccgactataacctatttactccctatatccagcatagacagcgaaaccctaatcagcccttctacattctgcaccccaaatttatatggcaactatgggacatcatacaggaaaatactaaggagaagattcagccgaatccgccatcttccggctttatcggcattctgatcatgatgtcaatgtgtcgagaagttcacgtttacgagtatatccccagcgtgcggcagactgaactctgccactaccacgagctgtactatgatgcagcctgcacactcggcgcgtatcacccgttgctgtacgaaaaactactggtgcagaggctgaacatggggacccaaggggatttgcatcgcaaaggaaaagtggtgttgcctggttttcaggctgttcactgccccgctccctctcctgtgatcccacactcctag

SEQ ID NO: 46560 - DNA, 108 bp, Artificial Sequence
  Description of Artificial Sequence: Synthetic coding sequence
atgaagccccacctgaagcagtggcggcagcggatgctgttcggcattttcgcatggggcctccttttcctactcatctttatttatttcactgacagtaacccatag

SEQ ID NO: 46561 - DNA, 1071 bp, Artificial Sequence
  Description of Artificial Sequence: Synthetic coding sequence
atgagcccctgcggccgggcccggcggcagaccagccggggcgccatggcagtgttggcttggaagtttccaaggacaagactgccaatgggggcttcagctctgtgcgtggtagtgctttgttggctgtatatcttcccggtgtacaggctgcccaacgagaaagagatagtacagggcgtcttacagcaaggcaccgcctggcgcagaaaccagactgcagcgagggcttttcggaaacagatggaagattgctgtgaccctgcacacctgttcgccatgaccaaaatgaacagtcccatggggaaatctatgtggtatgatggggaatttctttacagctttactatagacaattctacctactctctctttccacaagcaaccccgtttcagctgcccctgaagaaatgcgctgtagtgggcaatggaggcattctgaagaagtctggttgtgggaggcagatagatgaggccaatttcgttatgcgttgcaatctccccccgctgagctctgagtataccaaagacgtggggtctaagagtcagctcgttaccgcaaaccctagcataatcagacagaggttccaaaatctgctctggtcaaggaaaaccttcgtggataatatgaagatttacaatcattcttacatttatatgccagccttctccatgaaaaccgggactgaaccgtccctgagggtatactacacattatcagatgtgggcgctaaccagacagtcctgtttgcgaatccaaattttctgcggagtattggaaagttttggaagagcagaggcatacacgcaaagaggttgtcgaccggtctgttcctggtcagcgcagccctgggcctctgcgaagaagtagcaatctacggcttttggcctttctcggtgaacatgcatgagcaaccgatatctcaccactattacgacaacgtgctgccctttagcggctttcacgctatgccagaggagtttctgcagttatggtacctgcacaagattggcgcactgcggatgcaactcgacccatgtgaggatacctctttacaaccaactagctag

SEQ ID NO: 46562 - DNA, 642 bp, Artificial Sequence
  Description of Artificial Sequence: Synthetic coding sequence
atgaccggcagcttctacacccacagccccctgaccatccagctgacactatccagccatcgctgtaacctgccgcccctgtcatctgagtacaccaaggatgtgggatctaaaagtcaactggtgactgcaaatccatccataatacggcagcgattccagaacctattatggagtcgtaagacatttgtcgataatatgaagatttataatcactcctatatctacatgcctgcgttcagcatgaaaactggcactgagcccagcctacgggtgtactacacactgtccgacgtaggggcaaatcagacggttctttttgccaaccctaacttccttaggagcattggtaaattttggaaatccaggggcattcatgccaagcggctttcaaccggcttgtttcttgtgtcggccgccctgggactgtgcgaggaagtcgctatatacggattctggccgttctctgtaaacatgcacgagcagcccatcagccatcactactatgataacgtcctgcctttttccggatttcacgcaatgcccgaggaatttctccagctgtggtatctgcacaaaattggcgcactgcggatgcagttagacccatgcgaagacacttcgttacagccaaccagctag

SEQ ID NO: 46563 - DNA, 1128 bp, Artificial Sequence
  Description of Artificial Sequence: Synthetic coding sequence
atgcagctgcagttccggagctggatgctggccgccctgaccctgcttgttgtgtttctcattttcgccgacatttctgagatcgaggaagagattgggaatagcggcggccgtggaaccatacgctctgccgtgaattcccttcattcaaaaagtaacagggccgaggtggtcattaacggcagttcatctccggcggtggtggatcggtccaatgagtctattaaacacaacatccagccagcctcatctaagtggaggcacaaccagaccctctccttgagaatccggaagcagattctgaaattcctcgacgcggaaaaggatatctccgtgctaaaggggaccttgaaaccgggtgacattatccattacatcttcgatagagatagtaccatgaacgtcagccaaaacctctatgaactcttaccccggacctcacccctgaagaacaagcattttggaacgtgcgccatcgtgggcaacagcggagttctgctgaactcaggatgtggccaggagatagacgcacattccttcgtgatccgatgcaacctggcccctgtacaggagtacgcccgcgacgttgggctgaagactgacctcgtgaccatgaacccttcagtgatccagcgagcttttgaagatctggtcaatgccacctggcgcgagaagttattgcagaggcttcactctctcaatggttctatactttggattcctgctttcatggcccggggcgggaaggaacgggtcgaatgggtgaatgagcttatcctgaaacatcatgttaatgtgcgaacagcgtacccaagtctgagactgctccatgctgtgcgaggctattggttaaccaataaggtccacatcaagcgacccacaactgggctccttatgtacactctggccactaggttctgcaagcagatttatctgtacggcttctggccattccccctcgatcagaaccagaacccggtgaaatatcactactatgactctctcaagtacggctatacctcacaagcctcgccgcacaccatgcctctggagtttaaagccctgaaaagtctgcacgagcagggtgctcttaagctcacagtagggcagtgcgatggcgctacatag

SEQ ID NO: 46564 - DNA, 1065 bp, Artificial Sequence
  Description of Artificial Sequence: Synthetic coding sequence
atgcagctgcagttccggagctggatgctggccgccctgaccctgttggtcgtctttctgatttttgccgacatctccgaaatcgaagaagaaatcggcgctgaagtagtgatcaacgggtcctctagtccggccgtggttgatcgctccaacgagagcattaaacacaacatccagccagcatccagcaagtggaggcacaatcagacgctcagcctgcggattagaaagcaaatattgaagtttctggatgcagagaaggatatatctgtcctgaagggcaccttaaagcccggcgacatcatacattatatctttgaccgcgactctaccatgaacgtgtctcagaacttgtacgaattgttgccacgaacgtctcccctgaaaaataaacatttcggaacctgcgctatagttggaaattccggggttttgctcaactctggatgcggccaggagattgacgcccactcattcgtgatcaggtgcaatcttgccccagttcaagagtacgcccgggacgtggggctcaagaccgatcttgttaccatgaacccttcggtaatccagagggcgtttgaagatcttgtgaacgccacctggagggagaaactgttacagcggctgcattcccttaacggatctattttgtggatcccggcttttatggcgcggggcggaaaggaacgcgtggaatgggtgaacgagctcatccttaagcatcatgttaatgtccggactgcctacccctccctccggcttcttcacgctgtcaggggatactggttaaccaacaaagtgcatatcaaaagacctacaacgggcctgctgatgtacacactggccacgcgcttctgcaaacaaatctatctgtacggtttctggccattccctctggatcagaatcagaatcccgtgaagtaccattattacgactccctgaagtacggctatacttcccaggccagccctcacacaatgcctttggagttcaaggccctgaagtctctccatgaacagggagcccttaaattgactgtcggtcagtgcgatggggccacctag

SEQ ID NO: 46565 - DNA, 1143 bp, Artificial Sequence
  Description of Artificial Sequence: Synthetic coding sequence
atgcggaactgcaagatggcccgggtggccagcgtgctgggcctggtgatgctctccgtcgctctgttgattctgtcactcattagttatgtgtcactcaagaaggagaacatttttacaactccgaagtacgcatctccgggcgctccccggatgtacatgtttcacgctggcttccgctcacagttcgccctgaagttcctggatccaagtttcgtgcctataaccaattcattaacccaagagttgcaggagaagccctccaaatggaaatttaatagaacggctttcctgcaccaacggcaagagattctccagcatgtcgacgtgatcaagaatttctcactcaccaagaactctgtgcgtattgggcagctcatgcactatgattatagcagtcacaaatatgtgttctctatatcgaacaactttcgttcactgctgccagacgtgtccccaatcatgaacaagcattacaacatctgcgcagtggtgggcaactccgggatccttactggttcccaatgcggccaggaaatagacaagtccgactttgtcttccgctgcaatttcgcccctacagaagcatttcaacgagacgtagggcgcaagacaaacctcaccactttcaacccctcgatactcgaaaagtattacaacaaccttctgacgatccaggaccggaataacttttttctgagcctgaaaaaactagatggcgccattttgtggattcccgccttcttctttcatacctccgccactgtgactaggacactcgtcgactttttcgtggaacacagggggcaactgaaggtccaactcgcctggcctggaaacattatgcagcatgtgaaccggtactggaagaataagcatctatccccgaaaaggttgagcactggcattttaatgtatacccttgctagcgccatttgcgaagagatacacttgtatggcttttggcctttcggatttgaccccaacacgcgggaagatttgccttatcattattacgataagaaggggactaagttcaccaccaaatggcaggaatcccaccagctgcccgctgagtttcagctcctgtatcggatgcacggcgaaggcctaacaaagctgaccctgtcccactgtgcttag

SEQ ID NO: 46566 - DNA, 1464 bp, Artificial Sequence
  Description of Artificial Sequence: Synthetic coding sequence
gccggcggccggggccggaccgccctgcgggcccccagcccccggcgtcgtgctgctccaccctcaagctgttctgcacctggccctgcgcgcccctgtttgcggggcccagcggctctgagggggtcctgtcaaccccagcctccagctcccgtggccagcccacacccccgacctggccccccacctcccccccacgcgcgggctcatacccacacacacactcatacccacacacacacgcatatttatactcccgcgagctgttggcctttaaacggacccatctcacccgtgagcttaaaccccgcccagccaggcatgagaaactgtaagatggccagggttgcctcagttctcgggctcgttatgctatccgttgcgctgctcatacttagtttgatttcatacgtctccctcaagaaggagaatatttttacaacccctaaatacgcctctcccggggcgcctcgcatgtacatgtttcatgccggatttcgatcccagttcgcactgaagtttttggatccctctttcgtaccaatcacaaactctctcactcaggagctgcaagagaaaccatccaaatggaagtttaatcgcacagccttcttacatcagaggcaagagatcctgcagcacgtggatgtgataaaaaacttttcacttacgaagaatagcgtgcgaatcgggcaacttatgcactatgattactcctcacataaatatgtgttctctatcagtaacaatttccggagcttactccccgacgtgtctccaatcatgaataagcactataatatctgcgcggtggtcggcaacagcggtattcttacaggttctcagtgcggacaggagatcgacaaatccgacttcgtgtttagatgcaattttgctcctacggaagccttccagcgtgacgtcggacgaaagaccaatctgactacatttaacccgtcaattttggaaaaatattacaataacctgctgacgattcaggaccggaataatttttttctgtcactcaagaaactggacggtgccattttgtggatccccgcgttttttttccataccagcgcaaccgtgacacggaccctggtggatttcttcgtggagcaccgtggccaacttaaggtgcagcttgcttggccaggaaacataatgcagcacgtaaaccgttactggaaaaacaaacatctgagcccaaaaagactcagcactgggattctcatgtacacactggcatcagccatttgtgaggagattcatctctatggcttttggccctttggcttcgatcccaacacccgggaggatttaccataccactactacgacaaaaaggggaccaaattcaccacgaagtggcaggaaagccaccagctgccggcagaattccaactgctctacagaatgcacggagaaggcctaaccaagcttactctctcccactgcgcatag

SEQ ID NO: 46567 - DNA, 405 bp, Artificial Sequence
  Description of Artificial Sequence: Synthetic coding sequence
atgcggatgctgctgcacctgagcctgctggccctgggcgccgcctatgtgtacgcgatacccactgaaattccaaccagcgcgcttgtgaaagagaccctagccctgcttagtacccatagaacattgctgattgcgaacgaaaccctccgcattcctgtgccagttcacaaaaaccaccagctctgcaccgaagagatcttccaggggataggaactttagaatcgcagactgtccagggcggcaccgttgaaaggctgttcaagaacctgtctctgattaaaaaatatatagacggccagaaaaaaaagtgcggtgaagaacgtcgaagggtgaatcaatttctcgattacctgcaagagtttctcggagtgatgaacacagaatggattatcgagtcatag

SEQ ID NO: 46568 - DNA, 507 bp, Artificial Sequence
  Description of Artificial Sequence: Synthetic coding sequence
atgcggagcatccggaagcggtggaccatctgcaccatcagcctgcttttaatcttttacaaaacaaaggaaatcgcccggacagaagagcatcaagagacccagttgattggggatggagaactcagtctcagtcggtcactggtgaattcctccgataagatcatcagaaaggctggatcatctatcttccagcacaacgttgaaggatggaaaattaattctagcctggtcttagaaatcagaaaaaacattctgaggttcctggacgctgagcgcgacgtgtcagtggtgaagagcagcttcaagcctggcgacgtgatccactacgtcctggatcggcggcgcactctgaacatatcgcatgacttacacagtctgctgcctgaggtgagtccgatgaagaatcggcgctttaagacatgcgcagtcgtcggcaactccggcatactgctagactccgagtgtggaaaggagattgactcccacaacttcgttattaggtag

SEQ ID NO: 46569 - DNA, 1131 bp, Artificial Sequence
  Description of Artificial Sequence: Synthetic coding sequence
atgcggtacgccgaccccagcgccaaccgggacctgctgggcagcagaacactcctatttatttttatttgtgcctttgccctcgtgactctcttacaacagatactatacggcaggaactacatcaaaagatatttcgagttttatgagggacccttcgaatataactccactcggtgtctcgagctgcggcatgaaattctcgaagtcaaggttttgtctatggttaagcagtctgagctgttcgacaggtggaagtccctccagatgtgtaagtgggcaatgaacatttctgaggccaaccaattcaagtctaccctgtctcgctgttgtaacgcacctgcgttcctcttcacaacacagaagaacacccccctcgggactaaacttaagtacgaagtggacacatcagggatttatcacatcaatcaagaaatttttcgcatgtttcccaaagatatgccctactatcgaagtcaattcaaaaaatgcgcggtagtggggaatggcggaattctgaaaaattctcgctgcggaagagagataaatagcgccgattttgtcttccgttgtaatctccctcctatcagcgaaaagtacacaatggacgtaggggttaagacggacgtggtgactgtgaacccatctataattaccgagcgcttccataagcttgagaaatggcgcaggccattctacagagtcctccaagtgtacgagaatgcctctgttttgctcccagcgttctacaatacaaggaatacagacgtaagcattcgggtcaagtacgtgttggacgattttgagagtccacaggcagtgtactacttccatccccagtatttagtcaacgtatctaggtattggctctcgctgggagtccgcgccaaacgaatttcaaccgggctcattctggtgacagctgctttggagctttgtgaggaagtgcatctcttcggcttttgggccttcccaatgaatccctccggattgtatatcactcatcactattacgacaacgtaaaaccccgacctgggtttcacgcaatgccttccgagatttttaatttcctgcatctccacagccgcggcattttacgcgtacatacggggacatgctcatgttgctag

SEQ ID NO: 46570 - DNA, 1038 bp, Artificial Sequence
  Description of Artificial Sequence: Synthetic coding sequence
atgcggtacgccgaccccagcgccaaccgggacctgctgggcagccggacactcctgttcatatttatctgcgcctttgcattggtcacgctgttgcagcagatcctttacgggaggaattatatcaaaagggtgaaacagtctgagctcttcgacaggtggaaatcattgcagatgtgtaaatgggccatgaacattagcgaggctaatcagttcaaaagtacgctctctagatgttgcaatgctcccgcgttcctctttactacccagaaaaacaccccgctgggcactaagcttaaatacgaggttgatacatcaggtatttatcacatcaaccaagagatctttcgaatgttccccaaagatatgccatattatagatcacagttcaagaagtgtgccgtggtcgggaacggaggtatactgaagaattctcgctgcggcagggagattaatagcgctgattttgtctttcgatgcaatcttccccctatatccgaaaagtacacaatggatgtaggagtgaaaacagatgtcgtgaccgtgaatccaagcataataactgagcggttccacaagctggagaagtggcgtcgcccattttatcgggtgttgcaggtgtacgagaacgcctctgtcctgttgcccgccttctataacacccgtaacacagacgtgtccatccgcgtgaagtatgttctggatgactttgaatccccgcaagccgtctactacttccatccccaatatctggtcaacgtgtctaggtattggctctctcttggcgtacgtgcgaagcgaatcagtaccggacttatactggtgactgccgccttggagctgtgtgaggaagtacatctgtttgggttttgggcattcccaatgaacccttctggattatatattacacaccattattacgacaacgtgaaacctcgtccaggattccatgctatgccaagcgaaatcttcaatttcctgcacttgcattcgcgcggcatcctaagggtccacactggcacgtgctcctgttgctag

SEQ ID NO: 46571 - DNA, 1239 bp, Artificial Sequence
  Description of Artificial Sequence: Synthetic coding sequence
atgcggtacgccgaccccagcgccaaccgggacctgctgggcagcaggactttgcttttcattttcatctgcgctttcgccctggttactctgttacaacagattctgtatggaaggaattacattaaaaggggccttcagtttggctggcagtctggcgaccagcttacaaattggacaggcctcttcaacgtcacggacgatcccgctgttcagtcgggtagcgactcttcatcgaggtacttcgaattctatgagggcccattcgaatacaacagcaccagatgtctagaattgcggcatgagatcttagaagtaaaggtgctttcaatggtaaaacagtctgaactgtttgaccgatggaaaagcctgcagatgtgcaaatgggcaatgaacatttcggaggcaaaccagtttaaatccaccctgtcaagatgttgcaacgctccggccttcctcttcactacacagaaaaacactccactggggaccaaacttaaatacgaggttgacacgtcaggcatttaccatattaatcaggaaattttccggatgttcccaaaagacatgccgtactatcgttcccaattcaagaaatgtgcagtggtgggaaatggcggaatcctgaagaactccagatgcggacgagaaatcaattccgccgattttgtgttccggtgcaatctaccaccgattagcgaaaaatacacaatggacgtcggtgtgaaaaccgatgtcgtcaccgttaacccatcaatcattacggaacgcttccacaaactggagaagtggcgcaggcctttttaccgggtgttacaggtgtacgaaaacgccagtgtacttttgcccgcgttctacaacacgagaaatacagatgtgtccatccgggtaaagtacgttctagacgactttgagtcaccacaggccgtatactactttcatccgcaatatctcgtgaatgtttctaggtattggctgtctctgggagtcagagccaaacgaatctcaaccggcttgatcctggtcaccgctgcgcttgagctttgtgaggaggtacacctgttcggattctgggccttcccgatgaatcccagcggcctgtacatcactcatcattactacgataatgtcaagcctcgacccggctttcacgctatgccaagcgagatcttcaacttcctgcatttgcatagcaggggaatcctgcgcgtacacactggaacctgcagttgctgctag

SEQ ID NO: 46572 - DNA, 1197 bp, Artificial Sequence
  Description of Artificial Sequence: Synthetic coding sequence
atgcggcccggcggcgccctgctggccctgctggccagcctgctgctgttgctactcctgcgactgctctggtgtcctgctgatgcccccggtcgagcgcggattctcgttgaggaatcccgtgaggccacgcacggcacccccgccgccctgcgcactttacgctcccctgcaaccgctgttccaagagcaaccaatagcacttacctgaacgagaagtctcttcaacttactgagaagtgtaaaaacttgcagtatggcattgaatcctttagcaataagacaaagggctactcagagaatgattatctccaaataatcactgatatccaaagttgtccgtggaagcggcaggccgaagaatatgccaatttcagggctaaacttgcctcgtgctgcgatgcagtgcagaacttcgtcgtctcccagaacaatacccctgtgggtacgaatatgtcatatgaagtggagtccaagaaagagattcctatcaagaagaatatttttcatatgttccccgtgtcccagccattcgtggattatccctataatcagtgtgcagtcgtggggaacggggggattctcaacaagtctctttgcggcacagagatcgataaatctgattttgtgttccggtgcaatctgcccccaacaaccggagacgtgtccaaagacgttggaagcaaaaccaacctcgtgacaatcaatccctccatcatcactttaaagtacggcaacttgaaggaaaaaaaagctctctttctggaggacatcgcaacatacggcgacgcatttttcctgttgcccgctttctcgttcagagccaataccggaacctcatttaaggtgtattacaccttggaggaatctaaagccaggcagaaggtgctgtttttccatcccaaatacctcaaggatttggccctgttctggcgaactaaaggagttaccgcatataggctgtcgacaggtctgatgatcacgtccgtcgctgtcgagttatgtaaaaatgtgaaactgtatggattctggcctttctctaaaaccgtggaagatatcccggtgtcacaccactactatgataataagctccccaaacatggcttccaccagatgcccaaggagtatagccagattctgcagctgcatatgaagggaattctgaagcttcagttcagcaagtgcgaggtggcttag

SEQ ID NO: 46573 - DNA, 414 bp, Artificial Sequence
  Description of Artificial Sequence: Synthetic coding sequence
atgttccccgtgagccagcccttcgtggactacccctacaaccagtgtgccgtggttgggaatggcggaatcctgaacaagtctctgtgtggtaccgaaatagacaagtccgatttcgtgttcaggtgtaatctgcccccaaccactggcgatgtctcaaaagatgtggggagcaagacgaaccttgtcacaatcaaccccagcatcataacactgaagtatggcaacctgaaggaaaaaaaggctctgtttttagaagacatagccacttacggagacgccttctttctgttgcccgccttctcattccgggctaacactggaacatcatttaaagtttactacactttagaagaatcaaaggcccgacagaaatgtaagactaagaggaagactattaactccatcctgtag

SEQ ID NO: 46574 - DNA, 387 bp, Artificial Sequence
  Description of Artificial Sequence: Synthetic coding sequence
tgatacccctacaaccagtgcgccgtggtgggcaacggcggcatccttaataaatccctttgtggcaccgaaatagataagagcgatttcgtgtttagatgcaacctgcccccgaccaccggggacgtctccaaagacgtgggcagtaaaaccaacttagtgaccattaacccgagtatcattactctcaagtatgggaatctgaaggagaaaaaggctctgttcctggaggacatcgcaacctacggtgacgccttcttcctgctacccgcgttctcttttcgtgcaaacacaggaacctcctttaaggtctactacaccctagaggaaagtaaggcacggcagaagtgcaagaccaaaaggaagaccattaacagcattctctag

SEQ ID NO: 46575 - DNA, 7713 bp, Artificial Sequence
  Description of Artificial Sequence: Synthetic coding sequence
atggccggcccccggggcctgctgcccctgtgcctgctggccttctgtttagctggcttcagtttcgtgagaggacaagtgctgtttaaggggtgtgacgtgaaaaccacattcgtcacccacgtaccatgtaccagctgcgccgccatcaagaaacagacatgtccatccgggtggctgcgagaacttccagaccagattacccaagactgccgatacgaagtacagctgggaggttcaatggtatccatgtccggctgtcgccggaagtgcaggaagcaagtagtccaaaaggcgtgttgtccaggatactggggatcacgctgccacgagtgcccaggaggagctgagaccccatgtaacggacatggcacctgccttgatggcatggatcgaaatggaacctgcgtctgccaggaaaacttccggggcagtgcatgccaagaatgccaggacccaaaccggtttgggcctgactgtcaatctgtgtgctcctgcgtccacggcgtgtgcaaccacggtccaaggggggatggatcctgtttgtgtttcgccggatacacgggaccacattgcgatcaggagctgcctgtgtgtcaggagctccgctgtccgcagaatacccagtgctcggccgaggccccatcctgcaggtgtctgcctgggtacactcagcagggaagcgaatgtcgggcccccaacccgtgttggccgtcaccatgtagtttgcttgcccagtgctccgtttcccccaagggacaggcgcagtgccactgccctgagaattaccatggcgatgggatggtgtgccttcctaaggatccatgtacggacaacctcggcggatgcccttctaattcaactctctgcgtatatcagaagccggggcaggcgttttgcacctgcagacccggtctggtgtccataaactcaaatgcatccgcagggtgttttgctttctgtagccctttttcatgcgaccgctccgccacatgccaggttaccgccgatggtaaaacctcgtgcgtctgccgggagagcgaagttggcgacggaagggcctgctatggccatctcttacacgaggtgcaaaaagctacgcagacgggcagggtgttcctgcagctgcgggttgccgtcgccatgatggatcaaggttgccgggaaatacttacaacggctgggccctttactgtgctggtgccatcagtgtcttcgtttagtagtcgaacaatgaacgcctcattagctcagcaattgtgtagacagcacatcatcgccggacagcacatattagaggatacacggacccagcagacacgacgctggtggacacttgctggacaggaaataaccgtgacattcaatcagttcactaagtattcatataagtataaagatcagccgcagcagactttcaacatctacaaggctaacaacatcgcagcgaacggggtcttccatgtggtcacgggactccggtggcaggcaccctcaggaaccccgggagaccctaaaaggaccatcggtcagattctcgctagcacagaagctttctcccgttttgagaccattctggaaaattgtggtctgccttctatccttgacgggccagggcccttcaccgtgtttgccccatcaaatgaggccgtggatagcctgagggacggacggctgatatacctctttacggctggcctcagcaagttacaagaactggtgaggtaccacatatataaccatggccaattgacagtcgagaagctaatcagcaagggcaggatcctcaccatggcaaaccaagtgctcgctgtgaatatcagtgaggagggcaggattctcttgggccctgaaggcgtacctctgcaacgagtggatgtgatggccgctaacggcgtcatacatatgctggatggaatcctgctgccacctaccatcttacccattttacctaaacactgctcagaggagcagcacaagatagtcgcagggtcctgcgtggattgtcaggcattgaatacaagcacatgtccacctaatagcgtcaagttagatatattcccaaaggaatgcgtctatatccacgatcccaccggcctcaatgtgctgaagaagggctgcgccagctattgtaaccagacaatcatggagcaaggttgttgtaagggctttttcggaccagattgcacacagtgccctggggggttcagcaatccctgctatggaaagggaaactgttccgacggcatccagggcaacggagcctgtctgtgcttcccggactataaggggatcgcctgccatatctgttccaacccaaacaaacatggagaacagtgccaggaagactgtggttgtgtgcacggcctctgcgataaccgcccagggtccggaggggtctgccagcaaggcacctgcgctcccgggtttagcggccgattttgcaacgagagcatgggcgattgcgggcctaccggcctggctcagcattgtcatctgcacgctaggtgtgtgtcccaggaaggcgtggctcgatgccgctgtttggatgggtttgaaggggacgggttctcatgcacgccctcaaatccatgctcccatccagatcgcggaggttgttccgaaaacgccgagtgtgtgcctggcagtctcggcacacaccactgtacatgccataaggggtggtccggggatgggagagtgtgtgtggccatagacgaatgtgagctggacatgaggggaggctgtcacaccgatgctctctgctcttatgtcggccccgggcagtcccggtgcacttgcaagctcggatttgccggtgatggttatcaatgtagccccattgatccatgcagggctggcaacggtggctgtcacggtctcgccacttgccgagccgtcgggggaggacagcgggtgtgtacatgtcctcctggctttggcggtgacggatttagctgctatggtgatatttttcgcgaactggaggctaatgctcatttttccatcttctatcagtggctcaagagcgctgggattactctgcccgccgataggcgggtgacagcactcgtcccaagcgaagcagctgtacgccagctgagtcctgaagatcgagctttttggctgcagccccgaacacttcccaatttagttagggctcatttcctacagggcgcgctgttcgaagaagaactggcccggctgggtggccaggaggtggcaacactcaacccaaccacccgatgggaaatcaggaacatttctggtcgcgtgtgggtacagaatgctagtgtagatgtggctgacctgctcgctaccaacggagtactgcacatactttcccaggtcctgctccctccccgaggtgacgtgccaggcggccaagggctcctgcagcagttggaccttgttccagccttttctttgtttagggaattactgcaacaccacggactggtaccccagattgaggccgccaccgcgtataccattttcgtcccgaccaacagatccctggaggcccagggcaattcatcccatctcgatgcagacactgtgagacaccacgttgtcctgggggaagcactgtcaatggaaacgctgcggaagggcggccaccgcaatagcttacttgggcccgcacactggatcgtgttttacaaccatagcggccagccagaagtgaaccatgtcccccttgaggggcccatgttagaagccccaggtcggagtttaattggcctgtccggagtcctaaccgttgggagctcaagatgtttgcattcccatgccgaggctctgcgggagaagtgcgttaactgcactaggaggtttcgctgcacccagggtttccagttgcaggacactcctagaaaaagctgcgtgtaccgcagcgggttctcattctcccgcggatgcagttacacttgtgcgaagaagatccaagtgccggattgctgccccggcttcttcgggactctgtgtgagccatgccccggcgggctgggtggcgtctgtagcggccacggacagtgccaggaccgttttctcgggagtggagagtgtcactgtcacgagggatttcacggaaccgcctgcgaagtctgtgagcttggcaggtacgggccgaactgcactggagtatgcgactgcgcccatgggctgtgccaggagggcttgcagggggatgggtcttgtgtgtgcaacgtcgggtggcagggcttgaggtgtgaccagaaaattacgagcccacagtgtcctagaaagtgcgaccctaacgcaaactgcgtccaggactcggctggggcatcaacttgtgcatgcgctgctggctacagcggcaacggaatcttctgcagcgaagtggacccatgtgcacacggacatgggggatgctccccccacgcaaactgcacaaaagtggcacccgggcagagaacttgcacctgtcaggacggctacatgggggacggcgaactctgccaggaaattaactcctgtttgatccatcatggcggctgccacattcacgcagaatgtatcccgactggaccgcagcaggtcagctgttcctgtagagaaggttatagcggcgatggcatcagaacttgcgaactgctcgacccgtgctcaaaaaataatggcggctgttctccctacgcaacatgcaagagcaccggagacggccagcgcacctgcacatgcgatactgctcacactgttggcgatggtttgacctgccgggccagggtcggtctagaacttctgcgggacaaacacgcatcgtttttttcgctgaggctgctggagtataaggaactgaagggagacggtccattcaccatattcgtgcctcacgcagatctgatgtccaacttatctcaagatgaactagctcggattagggctcaccgccaacttgttttccggtatcacgtggttgggtgccggaggctccgcagcgaggacctcttggaacaagggtatgctacagcgttatctggacatccacttcgatttagcgaaagagagggcagcatttacctgaatgactttgcaagagtggtttcctctgaccacgaggccgtgaatggaatcctgcatttcatcgatcgtgttttgctacccccagaagcccttcactgggaacctgatgatgctcctatccccagaaggaatgtgaccgcagctgcccagggcttcgggtacaaaatcttctcaggcctgttaaaagtcgctggactacttcccttgctgagagaggcctctcacaggccctttaccatgctgtggcctactgacgctgccttccgcgctttgccccccgatagacaagcctggctgtatcacgaggaccacagggataaactggctgcgattctcagaggacacatgatccggaacgtggaggctctggcttcagacctgccaaacttggggccccttcgcacgatgcacggaacacctatctcatttagctgttcccgtactagagcaggcgagctgatggtgggcgaagacgatgccagaatcgttcagagacatctcccatttgagggaggtctggcttacggcattgatcagctgctcgagccgcctggccttggggcgcgatgcgaccattttgaaactaggcccctgcggctgaacacatgcagtatctgcggcttggaacccccctgccccgagggatcgcaggagcaggggtctcccgaggcttgctggcgcttctacccgaaattctggacttccccacctctgcattcgctcggattgcgttctgtgtgggttcacccttcactatgggggcgtccccaggggctgggcagaggttgtcaccgcaactgcgtgaccacgacttggaaaccgagctgctgtccaggccactatgggtcagaatgccaagcctgccccggcgggcccagcagtccttgctcagaccggggggtgtgcatggacggtatgtccggaagcggccagtgcctgtgccgctctggctttgccggaacggcctgcgaactttgcgcccctggtgccttcggccctcattgtcaagcctgcaggtgtaccgtgcacggccgctgtgatgaaggactgggaggttccggctcctgtttttgtgatgagggttggacaggacctagatgcgaggtgcaactggagctccagccagtgtgtaccccaccatgcgccccagaggctgtgtgccgggcagggaactcatgcgagtgctcactggggtatgagggcgatggacgggtgtgcaccgtggcggatctctgccaggatggtcacgggggatgctccgaacatgctaactgcagtcaggtcggcacgatggtgacttgtacttgtctgcctgactacgagggagacggttggtcttgtcgggcaagaaatccgtgcacagatggccaccgcgggggttgtagcgagcacgccaactgtttatcaacaggcctcaacacgcgacgttgcgaatgccacgcgggctacgtcggcgacgggttgcagtgtctcgaagagtccgagccacccgtggatcgatgtttaggccagccacccccatgccactctgatgctatgtgcacagacctccattttcaagagaagcgtgcaggagtgttccacctccaggctacttccggaccctacggcctgaacttcagcgaggcagaagccgcctgtgaggcacagggcgccgtgctggcgtcatttccacagctgtccgctgctcaacaactgggatttcacttgtgcctcatgggctggctggccaacggttctacggcacaccccgtggtgttcccagtagcagattgcggaaacggccgggtgggcatcgtgtcattgggagcccggaaaaacttgagcgagcggtgggatgcgtattgcttccgggttcaagacgtggcctgtagatgccgaaacggctttgttggcgacggaatctctacatgtaacgggaagctgctggacgtcctcgccgccacagctaactttagtaccttctacggaatgctattaggctatgcaaatgccactcagcggggactggattttcttgattttctggatgacgagctgacctataagacactctttgtgccagttaacgagggattcgttgataatatgaccctgtccgggccggacctcgagctccacgcgtcaaatgccacccttctgtccgccaatgcctctcagggcaagctgctgcctgcacactccggtctgagcttaatcatctcagacgcagggcctgataattcctcttgggctcctgtggccccagggactgtggtcgtgtcccgtattatcgtctgggacatcatggcttttaatgggattatccacgcacttgcctccccactgttggcacctccacagccacaagccgtccttgcaccagaagccccgcctgtcgctgccggcgttggcgcagtgctggcagctggagctcttctcggcttggttgctggtgcactgtacctaagagcgcgcgggaagcctatgggctttgggttttcagcatttcaggccgaagatgatgcggatgatgacttctcgccatggcaggaaggaaccaaccccaccttggtctctgttccgaaccccgttttcgggagtgacacattctgcgagccctttgacgacagtcttttggaagaggactttcccgacacacagcggattcttaccgtgaagtag

SEQ ID NO: 46576 - DNA, 3003 bp, Artificial Sequence
  Description of Artificial Sequence: Synthetic coding sequence
atgggccggcggaccctgttcatcggctgccagcccaagtgcgtgcggactgtcattacccgcgaatgttgcgcaggattctttggccctcagtgtcaaccctgcccaggtaacgcgcagaacgtgtgttttggaaatgggatctgtctggatggcgtcaacggaactggagtatgtgaatgtggtgaaggattctctggcactgcctgcgagacctgtaccgaggggaagtacggcatccactgcgatcaagcttgttcatgtgttcatgggcgctgcaaccaaggcccactgggggatggctcgtgcgactgcgacgtcggctggcgaggcgtgcactgcgacaacgccaccaccgaagataattgcaatggcacctgtcatacatccgccaattgtctgacaaacagcgacggcacagcttcttgtaagtgcgcagctggattccaaggaaacggcacaatatgtactgcaattaacgcttgcgagatctccaacggcgggtgttccgctaaggccgactgcaaacggactactcccggtcgccgcgtctgcacctgcaaggcaggctacaccggcgatgggattgtgtgtcttgaaattaacccttgtctcgaaaatcacggtgggtgtgacaagaacgcagaatgcacgcagaccgggcccaatcaagccgcgtgcaattgtctccctgcgtacacaggagacggaaaggtatgcacccttatcaatgtttgcttaaccaagaacggaggatgtagcgaattcgcaatttgcaatcacaccgggcaggtcgaacgaacatgtacctgcaaacctaactatattggcgacggatttacctgtcgcggtagcatctatcaagaactgcctaagaatcctaagaccagccagtatttttttcagctccaagaacactttgtgaaagaccttgtcggacccggtcccttcacggtattcgctcccctcagcgccgcatttgacgaagaagctcgcgtcaaagattgggataagtacggcctgatgccgcaggtcctaagataccacgtcgttgcctgccatcagttactcttggagaacctgaaactaatctccaatgcgacatcccttcaaggagagcctatcgtcattagcgtgagccaaagcaccgtctatataaataacaaggcgaagatcatttccagtgacatcatctccaccaacggtatagtccatataatcgataagctgctgtcccccaaaaatctattaataactcccaaagacaacagtggtaggattttacagaatctgacaaccctggccactaataatgggtatattaagttctccaatctcatacaggactcaggcctgctgtctgtgatcacagaccccatccatacacctgttacactgttttggcctaccgaccaggctctgcatgccctccccgccgaacagcaagattttttgttcaaccaggataataaagacaagctgaaggagtatctcaagtttcacgttattagagatgccaaggtgcttgcagtggatttacccactagcacagcttggaaaactcttcagggatccgaactgtctgtcaagtgtggcgctggcagggatattggcgacctgtttctcaatgggcagacatgtagaatcgtccagcgcgaactcctgttcgatctgggggtagcctatggaattgactgtctcctgatcgatcctacgctcggaggtaggtgcgatacctttacaacctttgatgcctctggcgagtgtggcagctgcgttaacacacctagttgtccgaggtggtctaagccaaagggcgtgaaacaaaaatgcctgtataatctacctttcaagcgcaacctggaggggtgccgagaaagatgttctcttgtgatccagatccctcggtgctgcaagggctattttgggagggactgtcaggcttgccctggtggccctgatgccccatgtaataaccgcggggtgtgtctggaccagtacagtgcaaccggcgaatgcaagtgcaatacggggtttaacggcaccgcatgtgagatgtgttggcccggcagattcggtccagattgcctgccttgcgggtgttcagatcacggccagtgtgacgatggaatcaccgggtctggccagtgcctctgcgagaccggctggacgggccctagttgcgacacccaagccgtgctgcccgccgtgtgcactccgccttgctctgctcatgcaacctgcaaagagaacaatacatgtgaatgcaacctggactatgagggcgatggcattacctgcaccgtggtcgatttctgtaaacaggacaacggtggatgcgcgaaggtggcgagatgctctcagaagggaaccaaggtgtcttgttcttgtcagaaggggtacaaaggagacgggcattcctgcacagagatagatccatgtgcagacggtctcaatggaggttgtcatgagcacgccacatgcaagatgactggccccggaaaacacaaatgcgagtgcaagagccactacgtgggcgacgggctaaactgtgaacccgagcagttaccaattgacagatgccttcaggataacggccaatgccatgcggacgccaagtgtgttgatctccacttccaggataccacagtaggtgtgtttcacttgcggtctcccttgggccagtacaagctgacctttgataaagctcgggaagcgtgtgccaatgaggctgcgacaatggccacgtataatcaactgagctacgcccagaaagcaaaataccacttgtgtagcgctgggtggctcgaaacaggtcgggtggcgtaccccacagcattcgctagccagaattgcggctctggcgtcgtgggcattgtggactacggcccacggcccaacaaatctgaaatgtgggacgtgttttgttatcgcatgaagggctccgccggcctatttcagcagttgtctagtcgaccgtgcatatccaggacgccagactag

SEQ ID NO: 46577 - DNA, 7656 bp, Artificial Sequence
  Description of Artificial Sequence: Synthetic coding sequence
atgatgctgcagcacctggtgatcttctgcctgggcctggtggtgcaaaatttttgcagtcccgcagagaccaccggccaggcgcgtagatgtgacagaaagtccctgctgaccatccggaccgaatgtcggagctgtgcactaaatttgggtgtgaagtgcccagacggctacacgatgatcactagcggctccgttggggtgagagattgtcggtatacattcgaggtccggacatactctctcagcctgcccggctgtcggcacatctgccgtaaagactacttgcagcccaggtgctgcccggggaggtggggaccagattgtattgagtgtcctggtggtgcaggttccccctgtaatggcaggggcagttgtgccgagggaatggagggtaatgggacctgcagctgtcaggaggggtttggaggtaccgcgtgcgagacttgtgcagatgataaccttttcggcccttcgtgcagttctgtttgtaattgcgtgcatggggtgtgtaactctggactggacggcgatggcacatgcgaatgctactcagcatacacagggcctaaatgcgacaagccaatccccgaatgcgcggcgctactgtgtcccgagaacagtcgttgttcgccatcaacagaggacgaaaacaaattggagtgcaaatgcctacccaattatagaggcgacggcaagtattgtgaccctatcaatccctgcttgcggaagatttgccacccccacgcccactgcacctacctgggacctaatcgccattcgtgcacgtgccaggagggatatcgtggggacgggcaggtctgtctgccagtggatccgtgtcagataaactttggaaactgtccgaccaaatcaacggtctgcaagtatgatggccccggccagagccactgtgaatgtaaggagcattaccaaaacttcgtgcccggcgtcggctgttccatgactgatatctgcaagtctgataatccctgccacagaaatgctaattgcacaactgtggctccagggcggactgagtgcatctgccagaaggggtacgtcggcgacgggctcacgtgttacggaaacatcatggagcgcctgagggagctgaatactgagcccaggggtaaatggcagggcaggctgaccagctttattagtctgctggacaaggcatacgcctggcccctaagtaagcttggacccttcaccgtgctacttccgaccgacaaaggactaaaagggtttaacgtcaacgagctcttagtcgacaataaagccgcccagtacttcgtcaaacttcatattatcgcaggtcagatgaatatcgagtacatgaacaacactgacatgttctatacactaacgggcaagtccggagagatattcaactccgacaaggacaatcaaattaaattgaagcttcacggcggaaagaagaaagtaaagattatccaaggcgacattatcgcatctaacggcctcttacacatattagatagagcgatggacaaactcgaacccactttcgaaagcaacaatgaacagacgataatgaccatgctacagcctcggtatagtaaatttcggtccctccttgaggaaaccaatctgggccacgccctggacgaggacggcgtcggaggcccctacactatctttgtgcctaataatgaagcgcttaacaacatgaaggatggcactctggactacctcctgagtcccgaaggatccaggaagttgctcgaactagtccgctaccacatcgttccattcacccaactggaagtggccacacttatttctacaccccacattcgttccatggccaaccaactgattcagtttaataccacagacaacggccagattttagctaacgacgtggcgatggaggagatagagattaccgccaagaatggtcgtatctacactctaaccggagttcttattccaccaagcattgtgcccattctgcctcatcgctgtgacgaaacgaaacgagagatgaaactaggaacctgtgtctcatgctctctggtctactggtcccgttgccctgccaactccgagccaactgcgttattcacacataggtgcgtgtatagcggacgttttggaagtttgaaatcagggtgcgccagatattgtaacgctactgtgaaaataccaaagtgctgtaagggattttacggccctgactgtaaccagtgcccaggaggcttctctaacccctgtagcggaaatgggcagtgtgccgattctttaggcggtaatggaacctgtatttgcgaagagggatttcagggtagtcagtgccagttctgcagcgacccaaataagtacgggcctcgttgtaacaaaaagtgtttatgcgtccatggtacatgcaacaaccgcatagacagcgacggtgcttgcttaactgggacgtgtcgcgacggtagcgccggcaggctgtgcgataaacagacatctgcttgtggaccctacgtccagttttgtcatatccacgctacttgtgagtatagtaacgggacggccagttgcatttgcaaggctgggtacgaaggggacgggacactctgctcagaaatggatccgtgtacaggcttgactcccggcggttgttcgaggaatgccgagtgtatcaagactgggacaggaacccacacatgcgtctgccagcaagggtggaccggcaatgggagagactgcagcgaaattaataactgcctgctcccgtcagccggcggctgccacgacaacgcttcctgcttgtacgttggccccgggcaaaatgagtgcgaatgtaagaagggctttcggggcaacgggatcgactgcgagcctattactagctgccttgagcagacggggaaatgtcacccactcgcatcatgccagagtacctcctctggggtttggtcctgtgtctgtcaagaggggtatgaaggcgacggattcctgtgctacggaaatgccgctgtcgaattatctttcttatcagaggccgcaattttcaacaggtggattaacaacgcctccttgcagcctactctgtctgcaacaagtaatttaactgtgctggtcccatcacagcaggcgacagaggatatggaccaggacgagaaaagcttctggctttctcagagcaacattccggccctcatcaagtaccatatgctcctgggaacctaccgcgtcgccgacctgcagaccctctcttcttctgatatgcttgcaacgtccctgcaagggaattttcttcatctggccaaggtggatgggaatattacgatcgagggcgcatcaatcgtcgacggcgacaatgccgccacaaacggtgtcattcatattataaacaaagtcctagtgccccagagaaggctgaccggcagcctcccaaatctgctgatgcgtctggaacagatgccagactacagcattttcagggggtacattatccaatacaatctagctaatgccattgaagctgcggacgcttatacggtgtttgctcccaacaacaatgctatcgagaattacatccgggagaaaaaagtgctgtccctggaggaagatgtgcttcgctaccatgtcgtgttagaggagaagctgcttaaaaacgatttacataacgggatgcaccgggagactatgctcgggtttagctactttctgtctttttttctgcacaacgaccagttgtacgtcaacgaggcgcctatcaattataccaatgtggctacagataaaggggttattcatggcctcggaaaggttctggagatacagaagaacaggtgtgataacaatgatactaccatcatccgcgggcgatgtagaacatgttcaagcgaactgacctgtccgtttggtaccaaatctctaggcaacgaaaaacggcgttgcatatatacctcttatttcatgggccgcaggaccctgttcattggttgccagcccaaatgtgtgcggaccgtgattactcgggagtgttgtgctggttttttcgggccccagtgccagccttgcccgggaaacgcgcagaatgtttgttttggcaatggaatctgcctcgacggcgtgaatggaacaggggtctgcgagtgtggggagggattcagcggtactgcatgtgaaacatgcaccgaagggaaatacggaatacactgtgatcaggcttgtagctgtgttcacggcaggtgtaaccaagggccactgggcgacgggtcctgcgattgtgatgttgggtggcggggggtgcactgcgataatgccacaacagaggacaactgtaatgggacttgccatacgtcagccaactgcctcactaattctgacggaacagcctcgtgcaagtgtgctgcaggctttcagggtaatggcacaatctgcactgccattaacgcctgcgagatcagcaacggcggctgctcagccaaggcagactgcaaacgaacaactcctgggagaagggtgtgtacttgcaaggctggatatacgggggacggtattgtctgcctcgagataaacccctgcttggaaaaccacggtggctgtgacaaaaatgcagagtgtactcagaccgggccgaatcaggcggcatgcaattgcttgccggcttacactggggatgggaaagtgtgcacacttatcaatgtttgcttgacaaaaaacggaggttgctctgagttcgccatttgcaatcacacaggccaagttgagcgcacttgcacctgtaagccgaattacattggggatggcttcacctgtaggggatcaatttatcaggagctgccaaaaaatcctaaaacaagccagtattttttccagctgcaggaacacttcgttaaggacctcgttggccccggaccttttacggtgtttgccccgctttctgccgcctttgacgaagaagctcgggtaaaggattgggacaagtacggtctgatgccgcaagtactgcggtatcacgtggtggcgtgtcaccagctgttactggagaacctgaagctgattagcaatgcaacttctctgcagggcgaacccatcgtgattagtgtgagtcagtctacagtttatattaacaataaagccaaaatcatctcatctgacattatcagtaccaatggaattgttcacatcatcgacaaactcctgagcccaaagaacctgttgatcacccccaaagacaattccggtcgcatcctgcagaacctcactacactagccactaacaatggctacatcaagttctccaatctcatacaagattccggtcttctcagtgttatcacagaccctattcacacccccgttaccctgttttggcccacagaccaggcccttcatgcgctgcctgctgagcaacaggactttctcttcaatcaagacaataaggacaagctcaaggagtatctgaagtttcatgtaattagggacgcaaaggttctcgcggtggaccttcccacgtctaccgcatggaaaacgctccagggatctgagcttagtgtgaaatgcggagcaggtcgggacattggggacctctttcttaacgggcagacatgccggatcgtccagagggagttactgtttgatctgggagtggcatacggcatcgattgcctgctcatcgaccccacgctcggtggccggtgcgatacttttacaacgtttgacgcctccggagagtgtgggtcttgcgtcaacacaccaagctgccctagatggagcaagccgaaaggcgtgaaacagaagtgtctgtacaatttgccttttaaaaggaacctcgaaggatgtcgcgaacgttgtagtctggtcattcagattccacgctgttgcaaaggctacttcgggcgtgactgtcaggcctgccctggaggacctgacgcgccttgcaataacaggggcgtctgcctcgatcaatatagcgccacaggggagtgcaaatgcaatacaggcttcaatggtaccgcctgcgagatgtgctggccaggcagatttgggccggactgcctgccttgcggctgttcagaccacggccagtgcgacgacggtattactggaagcggtcagtgcctgtgcgagacagggtggaccggccccagctgcgacacacaggcagtccttccagccgtttgcactcccccttgctctgctcacgccacctgcaaggagaataatacgtgtgagtgcaatctggactatgagggtgacggcattacctgcactgtagttgacttctgtaagcaggacaacggcgggtgtgctaaagtggcccgctgtagccaaaaaggcaccaaggtcagctgctcttgccaaaagggctataaaggcgacgggcactcatgtacagaaattgacccatgcgccgacggcctcaacggtggatgtcatgagcacgctacttgcaagatgacagggccagggaagcacaaatgcgagtgtaaatctcattacgtgggggacgggctcaattgcgagcctgagcagcttcctatcgaccggtgtctgcaggataacggccagtgccacgctgatgccaaatgcgttgatctgcatttccaggataccaccgtgggcgtgttccatcttaggtccccactcgggcagtacaagctgaccttcgacaaggccagagaggcctgcgccaacgaagctgccacaatggccacctacaatcaactgagttacgctcagaaggctaagtatcacctctgcagtgcgggatggctcgaaaccggccgtgtggcatatccgactgcctttgctagccagaactgcgggtccggagtggtcggtatcgtagactatggccctagacccaataagtccgaaatgtgggacgtgttctgttaccgcatgaaggacgtgaattgcacctgcaaggtcggctatgttggggacggattctcatgttccggcaatctgctacaggtgctgatgtcatttccctccctgacaaacttcctaacagaggtcctcgcctatagcaacagcagcgcccgaggtcgagcatttctagagcacctgaccgacctgtcaattcgcgggaccctatttgtgcctcagaattctggcctcggggagaatgagacactcagcggcagagatattgaacatcatttggctaacgtttctatgtttttctacaatgatctcgtgaatggcacgactttacagacaaggctaggctctaagttgctgatcacagcctcacaggatccgctccaacctacggagactaggttcgtggacggccgagccattttgcagtgggacatcttcgcttcaaacggcattattcatgtgatcagccgccccctgaaggctccaccagccccggtcaccttaacccacaccgggttaggtgccggaatcttcttcgccatcattctcgttacaggcgcagtggctctggcagcctatagctatttccgcataaatcgcagaacaatcgggttccagcatttcgaatccgaagaggatatcaacgtggccgctcttggaaaacagcagcccgagaatatctcaaatcctctatatgagtccaccacaagtgcacctccggaaccaagctatgacccatttacagatagcgaggagcgacaactagagggtaatgaccccctccggacactgtag

SEQ ID NO: 46578 - DNA, 1077 bp, Artificial Sequence
  Description of Artificial Sequence: Synthetic coding sequence
atgggcgccgtgtggagcgccctgctggtgggcggcggcctggccggcgcgctgtttgtatggcttttaaggggcggcccaggagatacaggcaaagacggtgatgcagaacaggagaaggacgccccacttgggggagcagccatacccggcggacaccagagcggaagttccggattatccccgggaccaagcggacaggaactggtgacaaagccagaacatctccaagaaagcaatgggcacctgatctctaagacgaaagacctggggaaactgcaggccgcgagttggcgactgcagaacccgagccgagaggtctgcgacaactctcgggaacacgttccctctggccagtttccagacaccgaggcacccgctacttcagagacctcaaactctaggtcctactccgaggtgagccgcaacgagtctctggagagcccgatgggggaatggggattccagaaaggccaggaaatctcagccaaagccgcgacatgtttcgcagagaagctgccaagttcaaatcttctgaaaaatcgcgccaaggaggagatgagtctctccgacctgaacagtcaggacagagtggatcatgaagagtgggagatggtaccgcgacacagtagttggggagatgtgggggtgggaggaagcctcaaagctccagtcctgaacctcaatcaaggaatggataacggacggtcgactctggtggaggcccgcggacagcaggttcacggaaagatggagcgcgtcgccgttatgccagccgggtctcaacaggtcagcgtccgcttccaggttcactatgttactagcacggacgtgcaattcatcgctgtcacgggagatcacgagtgtttggggaggtggaacacatatattccactgcattataataaagacggcttttggtctcactctatattcctaccggccgacacagtcgtcgagtggaagtttgtcttagtagagaatggtggcgtgacacgttgggaagaatgctctaaccggttcctagaaaccggtcacgaggataaggtggtgcatgcttggtggggtatccattag

SEQ ID NO: 46579 - DNA, 630 bp, Artificial Sequence
  Description of Artificial Sequence: Synthetic coding sequence
atgggcgagtggggcttccagaagggccaggagatcagcgccaaggccgccacgtgttttgctgaaaagctgccaagcagcaacctgctgaagaatagagctaaggaagagatgtcactaagcgacctaaacagtcaggaccgagtcgatcacgaagaatgggaaatggtacccagacactcctcctggggcgatgtaggcgttggggggtctctaaaggcaccggtcctgaatctgaatcagggcatggataatggtcgcagcaccctcgtggaggctcggggacagcaagtgcacggtaaaatggagagggtggccgtaatgcctgccggctctcagcaggtcagcgtccgattccaggtgcactatgttacctctacagatgtacagtttatagctgtcacaggggatcatgagtgcctgggcagatggaatacgtatatcccactgcactacaataaggatggcttttggtctcatagcatctttctgccagcagatactgtagtcgaatggaaatttgtattggtggaaaatggcggggtaacgcgctgggaggagtgcagtaatagattcctagaaacaggacacgaagacaaggtcgtgcatgcttggtggggcattcattag

SEQ ID NO: 46580 - DNA, 1113 bp, Artificial Sequence
  Description of Artificial Sequence: Synthetic coding sequence
atgctgccccggcggctgctggccgcctggctggccggcacccgggggggtggactcctagctctgttggcaaaccagtgtagattcgtgacagggctgagggtaaggcgggcccagcaaatagcccagctatatggacgactgtattctgagagctcccgaagagttcttctagggcgattgtggaggcgcttacacggaaggccgggccacgcgtctgccctcatggcagcccttgctggagtcttcgtatgggatgaggaacgtatccaggaggaagagctacagcgctctatcaatgaaatgaaaagactggaagaaatgagcaacatgttccagagctccggagtccagcatcacccaccagagcctaaggcacagaccgagggcaatgaggactctgaaggaaaggagcagcgttgggagatggtaatggacaaaaagcattttaaactgtggcgacgccctattaccggcacacatctctaccaatatcgggtctttgggacttacactgacgtgaccccgcggcagttttttaatgtccagctggacacagagtaccggaaaaaatgggacgctctggttatcaaacttgaagttatagagagagatgttgtaagcggatccgaggtcctacactgggtgacacacttcccatatcccatgtacagcagagactacgtgtatgtgaggagatatagcgtggaccaagagaacaatatgatggtgctggtgagcagagccgtagagcatccgtctgtccccgaaagtcccgaatttgtgcgggtgcgttcttacgagagccagatggtcatacgcccacataaatctttcgacgaaaacggtttcgactatttgctcacgtattcagataatccacagactgtgtttccaagatactgtgtgtcttggatggtgtcaagcggtatgccagatttccttgaaaagctgcacatggcaacactcaaggcaaagaatatggagataaaagtgaaggactacatcagtgccaaacccctcgaaatgagcagcgaggcgaaagctacaagccaatcctctgagagaaagaacgaaggaagctgcggcccagcacgaattgagtacgcttag

SEQ ID NO: 46581 - DNA, 738 bp, Artificial Sequence
  Description of Artificial Sequence: Synthetic coding sequence
atggagagccggaaggacatcaccaaccaggaggagatctggaagatgaagccgaggcggaatctggaggataatgactatctccagactgcccacgccgacgaatttgattgcccatctgagctgcagcatgctcaagaactcttcccacagtggcacttacctatcaagatcgccgcagtcatggccagcctcaccttcttgtatactctcttgcgcgaagttattcacccactggctacttctcaccagcagtatttttataagatacctatattggtaatcaacaaggttctccctatggtcagcataactctcttagccctggtctacctgcccggtgttatagcagcgatagttcaggttcacaatggaaccaagtacaaaaaatttccccattggcttgacaaatggatgctgacgcgcaaacaattcggccttctgagcctcttctttgctgtgcttcatgctatctacacactttcttacgcgatgcgtaggagctacagatataagctcctaaattgggcctaccagcaggtccagcagaacaaggaagatgcctggattgagcacgatgtatggaggatggaaatttatgtgagtctgggaattgtgggcctcgcaatccttgcactgctcgctgtgaccagcataccctccgtgtctgatagcctgacctggcgggaattccattacatccaggtccacggccgcattaatttcctcactctctag

SEQ ID NO: 46582 - DNA, 765 bp, Artificial Sequence
  Description of Artificial Sequence: Synthetic coding sequence
atggagagccggaaggacatcaccaaccaggaggagatctggaagatgaagccaaggagaaaccttgaggacaacgattacttgcatgaggacaccggagaaacatcaatgctaaagcgccctgtcctgcttcacttgcagcagaccgcgcacgctgacgaattcgactgtcctagcgaactgcagcacgcacaggagctatttccacaatggcatctgccgatcaaaatcgccgccgttatggccagtctgacattcctttacactctgcttcgcgaagtgattcatccgctagctacctcccaccagcagtatttttacaaaatcccaattctggtgatcaacaaagttctgcctatggtctctatcactctgctcgctctcgtgtacctgcccggggttatcgccgcaattgtgcaggtgcacaacggaactaaatacaagaagtttcctcactggttggataaatggatgctcacacgtaaacagttcggcctgctgagccttttcttcgcagtgctgcatgctatttacactctgagctatgctatgcgcaggtcttacaggtataaactgcttaattgggcgtaccagcaggtgcaacagaataaggaggacgcctggatagagcatgacgtatggagaatggagatttacgtgtctctgggaatcgtgggcctggccattctcgcgctgttagctgtgacctccatcccctcagtttctgattccttgacatggcgggaatttcactatattcagtag

SEQ ID NO: 46583 - DNA, 1029 bp, Artificial Sequence
  Description of Artificial Sequence: Synthetic coding sequence
atggagagccggaaggacatcaccaaccaggaggagatctggaagatgaagccacgtaggaacctggaggacaatgactacctgcatgaggatacgggtgaaactagtatgttgaagaggccggtcttgctgcaccttcagcagaccgcccacgctgatgagttcgattgtccatctgagctgcagcatgcccaagagttgtttccacagtggcacctcccgatcaaaatcgccgcagtgatggcaagtcttacgttcctgtacaccctgctgcgagaggtgatacaccccttagctacttctcatcaacagtacttctataaaataccaatactcgtcatcaacaaggtgctcccaatggttagcatcacccttttggccttggtctatctgccgggagtgatcgcagccatcgtgcaagtgcacaacgggaccaaatacaaaaagttcccccattggcttgacaagtggatgctgaccaggaaacagtttgggctgctgagtttattttttgctgtgctccacgctatatatactctcagctacgcaatgagacgtagttatcgctataagttactcaattgggcataccagcaggtccaacagaataaggaggatgcctggatagaacacgacgtgtggcgcatggagatctacgtgagtctgggcatcgtgggcttggccattctcgccctgctggcagttaccagtataccatccgttagcgactcgctgacctggcgcgagtttcactacattcaggccattctaaccggaagccttgttgccctctgtaactttcaggctacaaagctggccaagacgcagctcgtgggaacccccaacttttggcaagaacaacaatgtgggatccattttccccctccttcaaagacacgctcctacatctatttcatacttagcgccgcctcccctagtaaggggaatgtaagctctcacatgttccagctgcacctggagaatcttaataagaaagataaactccttctcatcatttttcagatttag

SEQ ID NO: 46584 - DNA, 771 bp, Artificial Sequence
  Description of Artificial Sequence: Synthetic coding sequence
atgcccggccccgccaccgacgccggcaagatccccttctgcgacgcaaaggaggaaattcgagccggcttggagagctctgagggaggtggcgggcctgaacgccccggagctcgcgggcagagacagaatatcgtgtggcgtaacgtggtgttgatgtccctactgcacttaggagcagtttactctctggtcttaatccccaaggcaaaacccctgactctactctgggcgtacttttgtttcctgttagctgcattaggagttaccgcgggcgcacacaggctctggagccacaggagctatcgtgcaaagttgcccctgcggatatttcttgcagttgcgaacagcatggcctttcaaaacgatatcttcgaatggtccagggaccatcgggctcatcacaagtatagcgagacagatgctgacccccacaatgcccgacgcggcttctttttcagtcacattgggtggctatttgtgcgcaaacacagagacgtgatcgaaaagggccgcaagctagatgtgaccgacctgctcgccgaccctgtggtgcgaattcaacggaatactcagcatatccaaaaagaagggcgggctctgaaccaagaagccgcatgtgaaatgttgcgcgaatggcaccagggacacatcctaaaagttacgctgcctggcctgcacatcctcgctctcctccacacacactgcaatcattccgagaagtgctgtctgatgctaagggctctgagtgtttccctggaggtgttttag

SEQ ID NO: 46585 - DNA, 399 bp, Artificial Sequence
  Description of Artificial Sequence: Synthetic coding sequence
atgcccggccccgccaccgacgccggcaagatccccttctgcgacgccaaagaggaaattagggcgggcctggaaagcagtgagggggggggggggcccgagcgcccaggagccagagggcaacgacagaatatcgtctggcgaaacgtagtcctgatgtccctgctgcatctcggggctgtatacagccttgtgctgatacctaaggcaaaacccttgacattgctgtgggcctacttctgtttcctgctagctgcgctgggggtcaccgctggcgcccatagactgtggagccatagaagctaccgcgcgaaacttcctctccgcatattcctcgccgtggccaactcaatggcctttcaggccgcagccgaggtggttctgacccagatgccttag

SEQ ID NO: 46586 - DNA, 993 bp, Artificial Sequence
  Description of Artificial Sequence: Synthetic coding sequence
atgcccggccccgccaccgacgccggcaagatccccttctgcgacgcaaaggaagagatcagggcaggcctggaaagcagcgaaggtgggggtggcccggaaaggccgggcgccagaggccagcgccagaatattgtgtggagaaacgttgtcctcatgtctctgctacatctgggggctgtttactccttagtgctgatcccgaaggcaaagcctctcacattactgtgggcctacttttgcttcctgctggctgcattaggcgtaactgcgggggcccaccgtctgtggtcccacagatcttatcgagcgaaacttccgctccgcatttttttggccgtcgcaaactcgatggcctttcaaaacgacattttcgaatggtccagggaccaccgtgcccaccacaagtattcagaaacggacgccgaccctcataatgcaagacgggggtttttctttagtcacatcggttggctctttgtcagaaaacacagagacgtcatcgagaaaggccgtaagctcgatgtcaccgacctgctcgccgatcccgttgttcgcattcagcggaaatactacaaaatcagcgttgtccttatgtgtttcgttgtccccactctggtaccctggtacatctggggggagagcctgtggaacagttacttcctcgcctcaatcctgcgctacacaatctccctcaacataagttggctggtgaattccgccgctcacatgtatggaaacaggccctatgacaaacacattagcccacgacagaatcccctagtcgcactgggcgcaattggtgaagggttccacaattatcatcacaccttcccttttgattatagcgcctccgaatttggcttgaactttaatccaactacctggttcatcgactttatgtgttggttgggactagccacagaccgaaagcgggccacaaagccaatgattgaggcacgcaaggctcggactggggattcaagcgcctag

SEQ ID NO: 46587 - DNA, 867 bp, Artificial Sequence
  Description of Artificial Sequence: Synthetic coding sequence
atggccgagaagcggcacacccgggacagcgaggcccagcggctgcccgattcctttaaagactctccaagcaaaggtctgggcccttgtgggtggatcttggttgcattctcatttctgttcactgtgatcacctttcctatctctatttggatgtgtattaagattatcaaagaatatgagagagcgataattttccgattggggcgaatactgcaggggggggctaaaggccctggcctattcttcatactgccctgcacagattccttcattaaagttgacatgcgaaccatatcatttgacatacctccacaggagatcctgacaaaggatagcgtgactatcagtgtcgatggcgtcgtgtattatcgcgttcaaaacgccactcttgctgtagccaatattactaatgctgactcagcaacaagattgttggcccagaccacactgaggaacgtgctgggcactaagaacctgagccaaatcctttctgatagggaggagattgcccacaatatgcagtcgaccctggatgatgctacagacgcctggggtataaaagtggagcgcgtggagatcaaggacgtgaaactgccagttcaactgcagagagccatggcagctgaagcagaagccagtagagaggctagagccaaggtcatcgcagccgagggcgaaatgaatgcctccagagctctcaaggaagccagcatggtgattacagagagccctgctgcactgcagctccgttatctgcagaccctgaccactatcgccgccgagaagaactccaccatcgtgtttcctctgcctattgatatgcttcagggtattataggagcaaagcatagccatctgggctag

SEQ ID NO: 46588 - DNA, 372 bp, Artificial Sequence
  Description of Artificial Sequence: Synthetic coding sequence
atggccgagaagcggcacacccgggacagcgaggcccagcggctgcccgattcattcaaagatagccctagtaaaggcttagggccatgcggttggattcttgtcgctttttcctttctgttcacagtcataaccttcccaattagcatttggatgtgcattaaggtgattgccgccgagggggaaatgaacgccagccgggctttgaaagaagcaagtatggtgattactgaatcaccagctgctctacaactgcgctacttacagactctgactacgattgcagcggaaaaaaattcaaccattgtttttccccttcccatcgacatgctgcagggcattataggtgcgaaacactctcatctcggatag

SEQ ID NO: 46589 - DNA, 714 bp, Artificial Sequence
  Description of Artificial Sequence: Synthetic coding sequence
atgtgcatcaagatcatcaaggagtacgagcgggccatcatcttcaggctcgggcgcatcctgcaggggggcgccaaaggtccggggctgtttttcatattgccttgcaccgactcgtttattaaagtggacatgcgaaccatttcatttgatatcccgcctcaggaaatactgacgaaggacagtgtcaccattagcgtcgacggcgtggtatactatagagtacagaatgctacccttgccgtggccaatatcaccaacgccgacagcgcgacccgcctcctggcccagaccaccctgcgcaacgtgctcggtacgaaaaacctgtcccagatcctgtctgacagggaggagatcgcacataacatgcagtctactctggatgatgcaacggatgcctggggcatcaaggtcgagcgcgtggagatcaaggacgtgaaacttccagtgcaacttcagcgggcgatggcagctgaagcagaggcgtcgagagaggcgagggcgaaggtcattgcagctgaaggagagatgaacgcctccagggccctcaaagaagcttcaatggttattaccgaatcaccagcggccctgcagttacggtacttgcagacccttaccacgatcgccgcggaaaagaatagtacaatagttttcccgttgcctattgatatgcttcagggcatcataggcgctaagcactcccacctgggctag

SEQ ID NO: 46590 - DNA, 3549 bp, Artificial Sequence
  Description of Artificial Sequence: Synthetic coding sequence
atgtgcagcaccaaccccggcaagtgggtgaccttcgacgacgacccagccgttcagagctcacaaaaatccaaaaatttccccttagagaatcagggcgtttgtcggcccaacggtttgaaactgaatcttccaggcctgcgagaatttccaagtggctctagtagcacttcttcaacccctctaagttccccaatcgtggatttttacttttctcccggacctccatcaaacagtcccctttcaacgcctaccaaagacttccctggattcccaggcatacctaaagcgggaactcacgttctgtatcctatcccagaatcctccagcgactcccccctggccatcagcggcggagagtccagtctgctgccaaccaggcccacgtgcctcagccacgccctcctgcctagcgaccactcttgtactcaccccactccaaaggtgggactgccagacgaggtcaacccacagcaggcggaatccttgggattccagagtgatgacctgccacagttccagtacttcagagaggactgcgccttttcgtctcctttctggaaggatgagggttccgactcacactttacactcgatccaccaggcagcaagaaaatgtttagtagcagaaacaaggagatgccaatagatcagaagtctctcaataagtgttcactgaactatatctgcgagaaattggagcacttgcagtcggccgaaaatcaggacagcctgaggagtctgagcatgcactgtctctgcgccgaggagaatgcctcgtccttcgttcctcataccttgttcaggtcccagccaaaatcgggctggtcctttatgttaagaatccccgaaaagaaaaacatgatgtcctctagacaatggggacccatctttttaaaagtactgccaggtggaattctgcaaatgtattacgagcaagggttggagaaacctttcaaggaaattcagctggacccttattgtcgcctgtctgagccgaaggtggaaaatttcagcgtggccggaaaaatccacaccgtaaaaatcgagcatgtgtcatacacggaaaagcggaagtatcattctaagaccgaggtggtgcacgagccagatatcgaacagatgttaaaactgggatccacttcctaccacgacttcctggacttcttgacaactgttgaagaggagttgatgaagctcccagccgttagtaagcctaagaaaaattatgaagagcaagaaatatcactcgaaatagttgacaatttttggggaaaagtgaccaaggagggcaagttcgtggagtccgctgtgatcacgcagatttactgtctttgtttcgtgaatggtaatttggagtgttttctcactctgaacgacttggagttaccaaaaagggatgagtcgtattatgaaaaagattctgaaaagaagggaatcgacattctggactatcacttccataaatgcgttaacgtccaggaatttgagcagtctcgcataataaaattcgtgcccttggatgcatgtcgctttgaactcatgcgctttaaaaccctctacaatggcgacaacctccccttttccttaaagtcagttgttgtggtacagggcgcatacgttgagctgcaagcgttcgtgaacatggcctccctggcacagcggtctagttatgccgggagtctgcgttcatgtgacaacatcaggattcattttcccgtgcctagtcaatggattaaggctctatggacaatgaatctgcagagacaaaaaagtctcaaagccaagatgaatcgcagagcgtgcctggggagtctccaggagcttgaatcggagcccgtaattcaggtcaccgtagggtctgccaaatacgagtctgcctatcaggctgtggtctggaagatagataggttgcctgacaagaactcgtctctagatcacccacactgtctgtcctacaagcttgaactgggcagcgaccaggaaatccctagcgactggtacccttttgccaccgtccaattctccgttcccgacacatgcgcgtcccggaccgaagtgcgttctctgggcgtggaaagcgacgtacagccccagaagcatgtgcagcagagggcatgttacaatatccaacctaagctttacaggtcagtcattgaggatgtaatagaaggcgtgcggaatctcttcgccgaggaggggatagaggagcaggtgctaaaagacctcaaacagctgtgggaaaccaaagtgttgcaaagtaaagccaccgaggattttttcagaaactctattcagagcccccttttcactcttcagctccctcacagcctccatcagaccttacagtcctctaccgcctccctggtaatcccagccggccgcactctgcccagtttcactactgccgaattgggcactagcaacagctcagctaactttacttttccaggatacccgatccacgtacccgcaggggttactcttcagaccgtatcgggtcacctgtataaggtcaatgtaccaattatggtcacagagacaagcgggcgggcgggcattttgcagcaccctattcaacaagtgttccaacaacttggacagccaagcgtgatccagacttccgtgccccagttgaacccttggagtctgcaagcaacgactgaaaagtctcagcgtatagagacagtgctacagcagcctgcaatattgcctagtggtcccgtggacaggaagcacttggagaacgccactagcgatatcttagtgtcacctggaaatgaacataagatcgtgccggaggcgctgttatgtcaccaagagagctcccactatatttctctcccaggggtggtgttctccccccaggtgtctcagaccaattccaacgtagagtccgttttgtcgggctccgcgtctatggcacagaaccttcatgacgaatcactttctacttcaccacacggcgcgctccaccagcacgtcaccgatatccaactgcatatactgaaaaatcggatgtatggttgcgacagcgtgaaacagccgcgaaacattgaggagccctccaatattccagtgtccgaaaaggactcaaactcacaggtagacctgtcaatacgtgtcacagacgacgacatcggggagatcatccaggtcgacggttctggggacacgtctagcaacgaagaaatcgggagtacccgcgatgccgatgagaacgaattcctgggcaatatcgacggaggggaccttaaagttcctgaagaagaagctgattccatttccaacgaggactcagctacaaatagtagcgacaatgaagatccccaggtgaacattgtagaggaagatcccctcaatagtggcgatgatgtctccgaacaggacgttcccgacttgtttgacaccgataacgtaatcgtctgccagtatgacaagatccatagatctaaaaacaagtggaaattttatctaaaggacggcgttatgtgctttgggggcagggactacgtgtttgcaaaagccatcggtgacgccgaatggtag

SEQ ID NO: 46591 - DNA, 1434 bp, Artificial Sequence
  Description of Artificial Sequence: Synthetic coding sequence
gcctgcctgttcctgatccccaagctgtaccggagcgtgatcgaggatgtgatcgagggtgtgaggaacctgtttgcagaggaggggattgaagagcaggtgctcaaggatctcaagcagttgtgggagaccaaggtgctgcagagtaaggcgactgaggatttctttagaaacagcatccagtcccctctgttcaccctgcaacttcctcatagcctccaccagaccctgcagtcttccactgccagcctcgttattccagccgggcggactctgcccagcttcacgaccgctgagcttggcactagcaatagctccgctaactttaccttccccggttaccccatccacgtacccgcgggcgtgactctccaaactgtctctgggcacctttacaaagttaacgtccctattatggtgaccgaaacaagcggccgggccggaatactacaacatccaatacagcaggtgttccaacagttaggacagccctctgttattcagacatctgttcctcagttaaacccctggtctctgcaagccactactgagaagtcccagagaatcgagaccgtcctgcagcagccggcgatcctcccctcaggcccagtggacagaaagcacctggaaaacgcgacgagtgacatattggtttcgccagggaatgaacataaaatcgttccggaagccctcctgtgccaccaggagtctagccactacatttctcttccaggggtggttttttcaccacaggtcagtcagaccaacagtaatgtggaaagtgtcctttccggaagtgccagcatggcccaaaacttacacgacgagtccttgtctacctccccccatggggcactgcaccagcacgtcacagacattcagctccatatcttgaagaatcggatgtatgggtgcgattctgtcaaacagcctaggaatattgaagagccctcgaacatcccagttagcgagaaggactctaatagccaagtggatctgtccatccgagttacagacgatgatattggggaaattatccaggtggacgggagtggcgataccagcagcaatgaagagatcggctctacgagggacgccgatgagaatgaattcctaggcaatatagacgggggcgatctaaaggtgcctgaagaggaagcagactccattagcaacgaagattctgccacaaattcctctgacaatgaggacccgcaagtgaacatcgtagaggaggatccactcaactccggcgatgatgtcagcgaacaggatgtgcctgatctgttcgacactgacaacgtcattgtatgtcaatatgataagatccaccggagtaagaataaatggaagttttatctgaaggatggcgtgatgtgttttggcggacgggattatgttttcgccaaagcaattggcgacgccgaatggtag

SEQ ID NO: 46592 - DNA, 3408 bp, Artificial Sequence
  Description of Artificial Sequence: Synthetic coding sequence
atgtgcagcaccaaccccggcaagtgggtgaccttcgacgacgaccccgccgtgcagagctcccagaagtcgaaaaacttccccctagagaatcagggcgtatgtagaccaaatggacttaagctgaacttgccggggctgagagaatttccttccgggagcagttcaaccagctcaaccccccttagttctcccatcgtggatttttatttttctcctggaccaccatctaactcacctctgagtacaccaaccaaagactttcctggattcccaggcatccctaaagccgggacccacgtgctgtatcctattcctgagtcaagtagcgactccccactggccatttccggtggcgaatcctccctgctcccaacacgccccacttgcctgtcacacgctttgttgccctcggatcatagctgcacccaccccactccaaaggtgggactccctgatgaagtgaacccccagcaggcggagagcctgggctttcagagcgacgacttgcctcagttccagtatttcagggaagactgcgcctttagctctcctttttggaaggacgagggctcagattcacatttcaccctggatccccccggatctaaaaagatgttctcatcccgcaacaaagaaatgccaatcgaccagaaaagcctaaacaagtgcagtctgaactacatatgtgaaaagctggagcacctccaatctgccgagaaccaggatagccttcggtcactatctatgcactgcttatgtgccgaagagaatgccagctcattcgttccccatacccttttcagaagtcagccaaaatccgggtggtcttttatgttgcggatccccgaaaagaagaatatgatgagtagtcggcagtggggcccaatcttccttaaggtccttcccgggggcatcttgcaaatgtactacgaacagggactggaaaagcctttcaaagaaatccagctcgacccctactgcaggttgagcgaaccaaaggtggaaaacttttctgtcgccggcaagatccacacggtcaagatcgagcacgtgagttacaccgaaaaacgcaaataccacagtaagacagaggttgttcacgagcccgatatcgaacaaatgctaaaacttggttcgacttcatatcacgactttttggattttttgacaactgttgaggaggagcttatgaagctgcctgcagtctcaaaaccaaaaaagaattatgaggagcaggagatctccctagagatcgtcgacaatttttggggcaaagtgaccaaagagggcaaattcgtagaatccgccgtgataacccagatatactgcctttgtttcgtgaacggcaacctggaatgctttctcacactcaacgacctggagctacctaagagagacgagagctactacgaaaaggatagtgaaaaaaagggcatcgacatcttggactaccactttcacaaatgcgtaaatgtgcaggagtttgaacaaagtaggatcatcaagtttgtgcccttggatgcctgtcgattcgaactcatgaggttcaaaaccctgtacaacggcgataacctgcccttttcgttgaaaagcgtagtggtcgtgcagggcgcctacgtggaactccaggcctttgtgaatatggccagcctggcacagcgaagttcctatgcgggatctctcaggtcctgtgataacattcgcatccacttcccagtgccttcccagtggataaaggcgctctggaccatgaacctgcagcgccagaaatcactaaaagctaaaatgaatcgcagagcctgtctcggaagtttgcaagaactcgagtccgagcccgtaattcaggtcacagtgggctctgcgaagtatgagagcgcctaccaggctgtggtgtggaagatcgatagactccccgacaagaattcgagcctcgaccacccccactgcctttcgtacaaactggaacttggtagtgatcaggagatcccatccgactggtaccctttcgccacagttcagttctcagtgcccgatacttgtgcttcgaggactgaggtgcgatcccttggggtggagtctgatgtccaaccacagaagcacgtccagcaacgagcttgctataacatccagccaaaactgtacaggtctgtcatcgaagatgttattgaaggcgtccggaatctgtttgcggaagagggcattgaggagcaggtgctgaaggatctgaagcagctctgggaaactaaagtactgcagagcaaagcaactgaggacttcttcagaaacagcatccagtctccgctctttacactgcagctgccacattctctgcaccagacgctgcagtcttctaccggccatctgtacaaagtgaatgtgcctatcatggtaacggagacatctgggcgcgctggaatcctgcagcatcctattcagcaggtattccagcaactgggacagccttccgtgatacaaaccagcgtgcctcagcttaacccctggagcctgcaggctaccacagaaaagagtcaacggatcgagactgtacttcagcagcccgcgattctcccatcaggtcccgtggataggaaacacttagaaaatgccaccagtgacatactcgtgagcccaggtaacgagcacaagattgtccccgaagccttgctgtgccaccaggagtcaagccattatatttctctgccaggcgtagtgttttccccccaggtctctcaaactaacagcaatgtcgaatcagtcttaagtggatctgcgtccatggcccagaacctgcacgatgaatcactgtccacaagccctcatggggcactccatcagcatgtaaccgacattcaactgcacatactgaagaaccggatgtatggttgcgattcggtcaaacagcctcgaaacatcgaagagccttccaatatacccgtaagcgaaaaagattctaattctcaggtcgatctgtccattagagtcactgatgacgacatcggagagatcatccaggttgacggcagtggagatacctcaagcaatgaagagatagggtccactcgggatgcagatgagaatgagttcctgggcaatattgacggtggtgacctgaaggtccctgaggaggaagctgattctatttcaaacgaagactctgctacaaattcttccgataacgaagatccacaagtgaacatcgtggaagaggacccactgaacagtggggacgatgtaagcgagcaggacgtccccgacttatttgacaccgacaacgtaattgtgtgccagtacgataagatccatcgctccaaaaataaatggaagttctatctgaaagacggagtcatgtgctttggcgggcgcgactatgtgttcgctaaagccatcggcgatgcggagtggtag

SEQ ID NO: 46593 - DNA, 3549 bp, Artificial Sequence
  Description of Artificial Sequence: Synthetic coding sequence
atgtgcagcaccaaccccggcaagtgggtgaccttcgacgacgaccccgccgtgcagagctcacaaaaatcaaagaacttcccacttgaaaaccagggggtttgtaggccaaacggactaaaactgaacctcccggggctgagggaatttccctctgggagttcatctacttcctccacacctctgtcttcgcctatcgttgatttctatttctcccctggcccaccaagcaactcacctctgagtacaccaacaaaagattttccaggatttccaggaatccctaaggcaggaacccatgtcctgtaccccatcccagagtctagttccgactctcccctagctattagcgggggggagtccagcttgctgccaacccgacctacctgcctgtcccatgctctgctgccctcagatcatagctgtacgcatcccactcccaaggtcggcttgccagatgaagtgaatccacaacaggccgagtccctaggcttccaatccgatgacctgccccagttccaatattttcgcgaggactgcgctttctcaagcccattctggaaggacgagggcagcgactctcactttacgctggacccacccggaagcaagaagatgttcagtagtcgaaataaggaaatgcccatcgatcagaagagcttaaataagtgtagccttaattacatatgtgaaaagcttgagcacctgcagagcgccgaaaatcaggatagcctgagatctttatcgatgcactgcctgtgcgcagaggagaatgcctctagctttgtgcctcacactctatttaggtctcagcccaagagcggttggagctttatgctcagaattcccgaaaaaaaaaacatgatgagctcccgtcagtggggacccatcttcctcaaagtgctgcccggggggatcctgcagatgtactacgaacaaggactggagaaacccttcaaggagatccagttggatccctactgtagactaagtgaacccaaggtggagaacttctccgtcgccggtaaaatccacacggtgaagatcgaacacgtgtcctatacagaaaagaggaagtaccactctaagaccgaagtagttcacgaacccgacatagaacaaatgctcaaactgggctctacttcctaccacgattttttggacttcctgaccacggttgaggaagagctcatgaagctacccgctgtgagcaaaccaaaaaaaaattacgaggagcaggagatttccctggaaatagtcgataacttttggggcaaagtcacaaaggaggggaagttcgtggaatcagctgtcatcactcagatttactgcttgtgcttcgtgaatggaaatctagagtgcttcctcacccttaacgatctggaactcccaaaacgtgatgaatcatattatgagaaagattctgagaagaagggaattgacatactggattaccacttccacaaatgcgtcaacgtgcaggaatttgagcagagccgcattatcaagttcgtgcctctggatgcctgtaggtttgagctcatgaggtttaagacactctataacggcgacaacctccccttctccctgaaaagcgttgtggtcgtgcagggagcatacgttgagcttcaggcctttgttaacatggcctcattggcccagcgtagtagctatgcaggcagcttacggtcctgtgacaacatcaggatccactttccagtgcccagtcagtggattaaagctctgtggactatgaacctgcagcggcaaaaatccttgaaggcaaaaatgaatagaagagcttgcctaggatccctccaggaacttgagtccgaacccgtcatccaagtcactgtcgggagtgccaagtacgaaagcgcttaccaggctgtcgtgtggaaaatcgatagactccccgacaaaaacagctcacttgatcatcctcactgcctgagctataagctggagctgggaagtgaccaagagataccatcagactggtacccattcgccaccgtgcagttcagcgtgccagatacatgtgcctctcggaccgaggtccgttctctcggagtggagtcagacgtccagccccagaaacacgtgcagcagcgggcctgttacaacatccaaccaaaactgtacaggtccgtgattgaagatgtgattgagggcgtaaggaatctgttcgccgaagagggaatcgaagagcaggtcctgaaagacctcaaacaactgtgggaaacgaaggtcctccagtcaaaagctactgaggactttttcagaaatagcatccaatccccccttttcactctccagctgccacattccctgcatcagaccctgcaaagctctaccgcgtctcttgtcatacctgccgggcgaacactgccgtcgtttacaaccgctgagctcggcacatcaaatagctccgcaaattttacgttcccgggatatcccatccacgtaccagcaggtgtcaccctgcaaaccgtctctgggcatctatataaggttaacgttccaattatggtcacagagacctccggccgagccggcattctccaacacccaatccagcaagtgtttcagcagctggggcagcctagcgtgatacagacctctgttccccagctgaacccctggtcccttcaggcaactacagagaaaagtcagcgaatagaaacagtgctgcaacagcccgccatcctccctagcggacccgtcgaccgaaagcatctggagaacgcaacttccgacattctggtgtctcctggcaatgaacacaaaattgtgccggaggcacttctgtgtcatcaggagtcttctcactacattagcctgcctggcgttgtctttagccctcaggtgtctcagaccaattccaatgtggaatcagtgctcagcgggagcgcctccatggcgcagaacctccacgatgagtcactaagtacaagtccccacggcgccctgcaccagcacgtgaccgatatccagcttcacatcttaaagaatcggatgtacgggtgcgattccgttaagcaaccacgtaacatcgaggaaccctccaatattcctgtgtcggagaaggatagcaattcacaagtagatttgtccattcgggttacagatgatgacattggcgagatcattcaagtggatggatctggcgacacgtcatctaacgaagagataggatccacgcgggatgcagacgagaatgagttcttagggaacattgacggcggtgatttgaaggtgcccgaagaggaggccgactctatcagcaatgaagatagtgccaccaactcgagtgataacgaagatccccaggtcaacatcgtagaggaagacccattgaatagtggcgatgacgtatcagaacaagatgttcccgacctgttcgacactgacaacgtcatcgtgtgtcagtacgacaagatccatcggagtaagaacaaatggaagttctacctcaaagacggagtcatgtgctttggaggccgggactatgtgtttgccaaggccattggcgacgcagaatggtag

SEQ ID NO: 46594 - DNA, 3549 bp, Artificial Sequence
  Description of Artificial Sequence: Synthetic coding sequence
atgtgcagcaccaaccccggcaagtgggtgaccttcgacgacgaccccgccgtccaatcctcccagaaatccaagaacttccccctcgagaaccagggagtttgtagaccaaacggactgaagttgaacctgccgggactccgagagtttccctccggatccagctccacgagcagtactcccctgtcatccccaattgtggatttctacttttcccccggacccccatccaattcacccctctctaccccaactaaagattttcccggattcccaggtatccccaaggccggcacacatgttctgtatcccatacccgagtcctctagtgactcccccttagccatttccggcggagaaagctcgctgcttccaaccaggcccacctgccttagtcatgcactcctgccctctgaccactcttgtacccaccctactccaaaagtcggccttcctgatgaggttaatcctcagcaagcggaaagtctgggttttcagtctgacgatctcccgcagttccagtactttagggaagactgtgcattctctagccccttttggaaagatgagggctctgactcccatttcactctcgacccaccaggatccaagaaaatgtttagtagtcgcaataaggaaatgcctatagatcaaaaaagcctgaacaagtgctcccttaactatatttgtgagaagctagagcacctgcagagtgctgaaaatcaggatagtttacggtccctgtccatgcactgcctgtgtgcggaggagaatgcttcttctttcgtacctcacaccctgttccgctctcagcctaagtcaggttggtcttttatgcttaggattccagagaaaaagaatatgatgtcgtccagacaatggggaccaatattcctgaaggtcctccccggaggtatcctccagatgtactacgagcagggccttgagaagcccttcaaggagattcagttagatccttactgcagattgagcgaacctaaggtggagaatttctctgtggctggaaagatccacacggtgaaaattgaacacgtttcttacacagaaaagaggaagtatcattcaaaaacagaagttgtgcatgagcctgacattgagcagatgctgaagctgggtagcaccagttaccacgacttcctcgactttctcacaaccgtggaggaagagctgatgaagctccccgccgtctctaagcctaagaagaactatgaggaacaagagatcagcttggaaattgttgataatttctggggcaaggtgacaaaggagggcaaattcgtcgaaagcgccgttataacccagatatactgtctatgttttgtgaatggtaatctggagtgcttcttgacactaaacgacctggagttgcctaaaagagatgaatcttactacgagaaggactccgagaagaaggggatcgacatcctcgattaccactttcacaagtgtgtgaatgttcaggaattcgagcagtccaggatcatcaaatttgttcccttggatgcctgtcgcttcgaacttatgcgcttcaagacactctacaacggcgataatctccctttttcccttaagtcggtcgttgttgtgcagggtgcatacgttgagctgcaggccttcgtgaatatggcctcacttgcacagcgctcctcgtatgccggcagcttacgctcatgtgacaatatccggatccatttccctgtaccatcccagtggattaaggcattgtggacaatgaatcttcagcggcagaagagcctgaaagcaaagatgaacagacgggcatgtctcgggtcactgcaggaactcgaatccgaacccgtgattcaggtgactgtgggctccgcaaagtatgaatccgcgtaccaagccgtggtgtggaagatagatcgactgcccgacaaaaatagctctctagaccacccccactgtctgtcttacaagcttgaactggggtccgatcaggaaatcccatcagattggtaccctttcgccaccgtgcaatttagcgtgcccgacacctgcgcctcacgtaccgaggtgaggagcttgggggtggagagtgatgtgcaaccgcagaagcacgtccaacagagggcatgctataacattcagcccaaactgtaccggagcgttatcgaggacgtgatcgaaggcgtgcggaatcttttcgccgaagaaggcattgaagaacaggtcctgaaggacctgaagcagttgtgggagaccaaagtgctccagagtaaagccaccgaagacttttttagaaatagtattcagtctcccctctttacgttgcaactgccacatagcctgcaccagaccctgcaatcatctactgctagcctagtcattccagccggccgcaccctgccatcttttacgacagcagaactgggaacttcaaactcctcagctaacttcactttcccggggtaccccattcacgtcccagcgggtgtcacgctgcaaaccgtgagtggtcacctgtacaaggtaaatgttccaatcatggtgacagaaacttccggccgcgccggcattttacagcacccaatccagcaagtcttccagcaacttggacaaccatctgtaatccagactagcgtaccccagcttaacccgtggagcctacaggcaacaactgagaagagtcagagaatcgaaaccgtcctgcagcaacctgccatactgccttctggccctgtggaccggaaacatctggaaaacgcgacaagcgacattttggtgagtcccggcaacgaacacaagatcgtgcccgaagccttgctctgccaccaggagagctcccattatatttcattgcccggagttgtgtttagcccccaggtctctcaaactaacagcaacgtcgagtcagtgttgtccggcagtgcaagcatggcgcagaacttgcacgatgagtctctgtccacaagtccacacggggccctgcatcaacatgtcactgacattcaactgcacatcctcaagaaccgcatgtacggctgcgattcagtgaaacagcctagaaatattgaagaaccttcaaacataccagtcagtgagaaggattctaacagccaggtagacctgagcatccgggtcacggatgacgacatcggggagattatccaggtcgatggttcaggtgacacctcatccaacgaggagatcggctcaacccgggatgcagatgagaacgaatttctcggaaatattgacggtggggaccttaaagtgccagaggaagaagccgattctatctctaacgaagactctgccacaaacagttccgacaacgaggaccctcaggtgaacatcgtggaggaagaccccttgaactccggcgacgacgtgagcgagcaagatgttcctgacctgtttgataccgataacgtgatagtatgtcaatacgataaaatccatcggtctaaaaataagtggaagttttacttaaaggatggagtaatgtgctttggaggccgtgattacgttttcgctaaagccataggagacgccgagtggtag

SEQ ID NO: 46595 - DNA, 3477 bp, Artificial Sequence
  Description of Artificial Sequence: Synthetic coding sequence
atgtgcagcaccaaccccggcaagtgggtgaccttcgacgacgacccagccgtgcagtcctcccaaaaatccaagaacttccccctcgaaaaccagggcgtgtgtagaccaaacggactgaaacttaatcttccagggctgagggaattcccaagcggaagctcatcaacgagctcgacccccctaagtagcccaatcgtagatttttatttctcccctggacccccctccaattcaccactttccacgccaaccaaagactttcccggatttccaggaatccctaaggccggaacacacgtattgtatcctattcctgagtcatcctccgactcccctttggctatctccggcggcgaatcatctcttctccctacgagaccgacctgcctctcccacgctctgcttccctctgatcacagctgcacgcatccgactcccaaggttggactgcccgacgaagtaaacccacagcaggccgagtcgctcggcttccagtcagacgaccttccccagttccagtactttcgcgaagactgcgcgttcagctctccattttggaaggacgagggctccgactcccattttaccttagaccctcctggctcgaaaaaaatgttttcttctcgtaataaagaaatgcctatcgaccagaaatctctgaataaatgttccctcaattacatttgcgagaaactggaacacctccagtccgctgaaaatcaagactccctgcgatctcttagtatgcactgtctgtgcgccgaagagaacgcgtcgagctttgttcctcatactctgttccgatcgcagcccaaatcaggctggtctttcatgctccgcatcccagagaagaagaatatgatgtcctctcgccagtgggggcccatcttcctcaaagtgttgcctggtgggatcctccagatgtattatgagcagggacttgaaaagcccttcaaggaaatccagttggatccttactgccgcctctcggagccaaaggtggaaaatttttcagttgcaggcaagatacataccgtaaagatcgaacacgtgtcttacactgagaagaggaaataccatagcaagacagaggtggtgcacgagccggatattgaacagatgcttaaactgggaagtacctcataccacgactttctagattttcttaccaccgttgaggaggagctgatgaagctaccagccgtgagcaagcccaaaaaaaactacgaggagcaggagatcagtctggaaattgttgacaacttctggggaaaggtgacaaaggagggtaagtttgtggaatctgctgttattacgcagatttattgtctgtgctttgttaatggcaaccttgaatgttttctcacattgaacgacttggagctccccaaaagggacgaatcatactacgagaaggactctgagaagaaaggtatcgacattctggactaccactttcacaagtgcgtaaatgttcaggagttcgagcagtccagaatcatcaaatttgtgcctttagacgcctgtagatttgaattaatgagattcaagactctgtacaacggtgataatctccccttcagcctaaagtccgtagttgtggtccaaggagcctacgtcgagttgcaggccttcgtgaacatggcctccctagcccagaggtcctcttacgcgggctccttaagaagttgcgacaatattcgtatccatttcccagtgccttcccagtggattaaggctctatggactatgaatctacagcgacagaaatccctgaaagctaaaatgaaccggagggcatgtttggggtctctacaggagctcgagagcgagccggtgatccaagtgacagtcggcagcgcaaagtacgagtcagcctaccaggcagtggtctggaagatagatcgcctgcccgataagaatagctccctagaccacccccactgcctttcctataagctcgagctcggttccgaccaggagatcccgagcgattggtatccttttgcaactgtacagttcagtgtccctgacacatgtgcttcccgcaccgaagtacgcagtttgggggtagaaagcgacgtccagcctcaaaaacacgtgcagcagcgtgcttgctataacatccagcccaagctgtacagaagtgtcattgaggacgtgatcgagggcgtacgcaacctcttcgctgaagaaggcatagaggaacaagtcctaaaagatctgaagcagttatgggagaccaaggtgctgcaatccaaagctacagaggacttcttccgcaacagcatacagtcaccattgttcactctccagctacctcacagtctacaccagaccttgcagtcctccacggcaagcctagtgattccagccggccgtacgctgcctagttttaccactgctgagctgggcacgagtaacagttccgctaacttcacctttcctggctacccaatccacgttcccgctggcgtaaccctgcagactgtgagcggacatctgtataaggttaacgtgcccatcatggtgactgagacatctggccgggcagggatccttcagcatcccatccaacaggtctttcaacagcttggtcaaccttctgttattcagaccagtgtgccccagctgaatccgtggagcttacaggccacgaccgagaagtcccagcgaatcgagactgtccttcaacagcctgcaattttgccctcaggacccgtggaccgcaagcacttggagaacgccactagcgacatcctggtgagccccgggaacgaacacaagatcgtgccagaagctcttctttgccaccaggaatcaagtcactatatttcactgccaggagtcgttttcagcccccaggtttctcagaccaactctaacgtcgagagcgtgctgagtggatctgcttctatggcacaaaacctgcacgatgagtcactcagcacctctccgcacggagctctgcatcagcatgtcacggacatacagcttcacattctgaagaatcggatgtacggttgcgatagtgtgaagcaacccaggaatatcgaggagccatccaatattccagtcagcgagaaagatagcaattcccaggtggatctgtctattagggtcacagacgacgatattggggaaattattcaggttgacgggtctggcgacaccagctccaacgaggagatcggcagcactcgagacgctgatgagaacgaatttcttggaaacatcgatggaggcgatctgaaggttccagaggaagaggctgactctatttcaaatgaggactctgcgacaaactccagtgacaacgaagacccccaggtcaacatcgttgaggaggaccctctcaactctggcgatgacgtgtcagagcaggatgtacccgacctctttgacaccgataatgttattgtctgccaatatgacaaacagggcgatacaagggtgaggcatggccagcaatag

SEQ ID NO: 46596 - DNA, 2208 bp, Artificial Sequence
  Description of Artificial Sequence: Synthetic coding sequence
atgtgcagcaccaaccccggcaagtgggtgaccttcgacgacgaccctgctgtgcagtccagccagaagagtaaaaacttccccctggaaaatcagggcgtgtgtcgccctaacggactcaagctcaacctgcccggcctgagggaattcccatccggaagttcatccaccagcagcacaccactgtcatcccctatcgtggacttttatttcagccccggccctcccagcaactcccccctaagcaccccgacgaaagatttccctggtttcccaggaatcccaaaggccggcacccatgtactctatcctatccctgagagcagcagcgactcaccattggctattagcgggggtgaatcgagcttactgccaacgagacccacgtgcttaagccacgctctactgccctctgatcacagctgcacccacccaactcctaaagttgggctgcctgatgaagttaatccacaacaggcagaatctcttggatttcaatctgacgacctgccccagtttcagtattttcgggaggattgcgctttcagcagcccattctggaaagacgaaggatcggacagccactttacccttgatcctcccggatccaaaaagatgttcagttcgagaaataaagagatgcccatcgaccagaagtctcttaataagtgctcacttaactacatctgcgagaagctcgagcacctgcagtccgcagagaatcaggacagcctacgatctctgagtatgcactgcttatgtgccgaagaaaatgcatcaagctttgttccccacaccctctttagaagccagcctaaatctgggtggagtttcatgttgcgcattcctgagaagaagaatatgatgtctagtagacagtgggggccgatctttttaaaagtcctccccggggggatcttacaaatgtactacgagcagggattggagaagccattcaaggagatacagcttgacccttactgtaggctgtcggaacccaaagtcgagaactttagtgtggccggtaagattcacacagtgaagattgagcatgtttcgtataccgagaagcgcaaataccactccaaaacagaggtcgtgcatgagcctgacatcgagcagatgctgaagctcggctcaacctcctaccacgacttcctggactttcttaccaccgtagaggaagaactgatgaagttaccagccgttagtaagccaaaaaagaactacgaggagcaggagattagtctcgagatcgtcgacaacttttggggtaaagtgaccaaggaagggaagtttgtcgaatccgcagtcatcacacaaatatattgtctgtgcttcgtgaacggcaacctggagtgttttcttacgctgaacgacctcgagttgcccaaacgagacgagagttattatgaaaaggacagtgagaaaaaaggaatcgatatccttgattaccatttccacaaatgtgtcaacgtgcaggagtttgaacaatctaggattatcaaatttgtccccctagatgcctgtcggtttgaattgatgagatttaaaacactctataatggcgataacctgccattcagccttaaaagcgtggtggtagttcaaggtgcctatgtggagctgcaggcttttgtcaacatggcttcactggcccaacgctcaagctacgcaggtagcctgcgatcttgcgataatatccggattcactttccagtcccatcccagtggataaaggctctctggacaatgaacctccagaggcagaagtcattgaaggccaagatgaataggagggcttgcctggggagccttcaggagcttgaaagtgagccagtgatacaggtcactgtgggatccgccaaatacgaaagtgcttaccaggccgtagtgtggaagatagacagactgcccgacaaaaatagttcattggatcacccgcactgcttgtcctataagctggaactcggctccgatcaggaaatcccgtccgattggtaccctttcgcgaccgtgcaattctctgtgcctgatacatgcgcatcccgtactgaagtgcgctcattgggagtcgagagcgacgttcagccacagaaacacgtgcagcagcgggcctgctacaatattcaggtggaaattgagaaaaagtggataaaaatagacggagaagatcctgataaaataggagattgcattacccaatag

SEQ ID NO: 46597 - DNA, 2208 bp, Artificial Sequence
  Description of Artificial Sequence: Synthetic coding sequence
atgtgcagcaccaaccccggcaagtgggtgaccttcgacgacgacccagccgttcagagtagtcagaaaagcaaaaattttccgttggaaaatcagggggtctgccgtcccaacgggttaaagttgaatctgcctggactgagggaattcccctctggctcaagtagtacatcttccacgcccctgtcatctccaatagttgatttctacttttctccagggcctccgtctaactcacccctgtccacacccactaaggactttcccgggtttcccgggatccctaaagccgggactcacgttttatatcctatccccgagtcttcctctgactcccccttagccataagcggaggcgagtcaagtctgctgccaacccggccaacctgtctgtcccacgcgctcctgccttcggaccacagctgtacacaccccacaccaaaagtaggactccctgacgaggttaatccacagcaggccgagtcactgggcttccagtctgacgacttgcctcagttccagtattttcgggaggactgcgcttttagttcccccttttggaaagacgaaggatcagatagccattttacgctcgacccaccagggagtaaaaagatgttctcctcacgcaataaggagatgccaattgatcagaaaagtctcaacaagtgttctctgaattatatttgcgaaaagttggagcaccttcaatccgctgaaaaccaggactctctgcgatccctcagcatgcactgtttgtgtgcagaggagaatgccagtagctttgtaccccatactctctttcgctctcagcctaagtcagggtggtccttcatgctgagaattcctgaaaaaaagaatatgatgtctagcagacaatgggggccgatctttctgaaggtgctcccaggcggcattctgcaaatgtattatgagcagggcttggagaaacccttcaaagagattcagctcgacccctactgccggctgagtgagccaaaggttgaaaatttctccgtagctggcaaaattcataccgtcaagattgagcatgtgtcatatacagaaaaacgaaaataccattcgaaaactgaggtggttcacgagcccgatattgaacagatgcttaaacttggatctacgtcatatcacgatttcctggacttcctgactactgtggaagaggaactgatgaagctgcctgccgtttcaaaacctaagaagaattacgaagagcaggagatctccctggagattgtcgacaatttttggggtaaggttaccaaagaaggcaaattcgtggagtcagctgttataactcaaatatattgtctttgcttcgtcaatggcaacctggaatgtttcttgaccctcaacgacctggaattgccaaagcgtgacgaatcctattacgagaaggattccgaaaaaaagggtatcgatatcctggactaccattttcacaagtgcgtgaacgtccaagagttcgagcagagtagaattattaaattcgtacccctggacgcttgcagattcgagttgatgcggttcaagaccctgtacaatggcgacaacctgcccttttccctaaagagcgtggtagtggttcagggagcctatgtggaattacaggcctttgtcaacatggcttcactggcacagcggagttcttacgccggtagcttacgctcatgtgacaacattagaattcactttccggtaccaagccagtggattaaagctttgtggaccatgaacctgcagagacagaaaagcctgaaagccaagatgaacaggcgcgcatgcctcgggtctctgcaggaactcgaaagcgaacctgttatacaagtgaccgtgggcagcgcaaagtatgaatctgcataccaggctgtggtgtggaagatcgacagattaccggacaaaaacagctcactggatcatccccactgcttgagctacaagttagaactgggttcggaccaagagatcccctccgactggtacccatttgcgactgtgcagtttagcgtgccagatacctgtgcatctaggaccgaggtccgctccttaggggtggaatcagacgtccagccacagaagcacgtgcagcaaagagcatgttacaacatccaagtcgaaattgagaagaagtggattaagattgacggagaggaccccgataagatcggggactgcatcacccaatag

SEQ ID NO: 46598 - DNA, 2208 bp, Artificial Sequence
  Description of Artificial Sequence: Synthetic coding sequence
atgtgcagcaccaaccccggcaagtgggtgaccttcgacgacgacccagctgtacagtcctcccagaagtcaaagaacttcccactggagaaccaaggcgtgtgtcgccccaacggtctgaaactcaatctacctgggctgcgcgagttcccaagcggtagttcatcgacaagcagcacaccgttgtcttctccaatcgtcgatttctactttagcccaggccccccctccaattcccccttgagtacccccaccaaagactttccaggcttcccaggaatccctaaagccggaacacatgtgctgtatccaatcccagagtcttcttcagattccccgctggcaatctcaggaggagagagctcacttcttccaacccgacctacctgcctcagccatgccttacttcccagtgaccattcttgtactcacccaacccctaaagtgggactgcccgacgaagtgaacccccaacaagcggagtctctaggcttccagagcgatgatctcccccaattccaatacttccgggaggactgcgctttcagcagtccattctggaaagacgagggtagcgactcccattttacactagaccccccgggatccaaaaaaatgttttcatctagaaacaaggagatgcctatagaccagaagtccctgaacaaatgttctctgaactacatctgtgagaagctggagcacctccaatcggccgaaaatcaagacagccttcgatcgctcagtatgcactgcttgtgtgccgaggaaaatgcaagtagcttcgtgccccacactttgtttaggagccagcccaaatctggctggtcattcatgctgcgtatacccgaaaagaaaaatatgatgtcatcaagacagtggggaccaatcttcctgaaagtccttcccgggggaattctgcagatgtactatgagcaagggctcgagaaaccattcaaagagattcagctcgatccctactgcagactgtcagaaccgaaggttgagaatttctcagtggctgggaagatccacacagtgaagatcgagcatgtgtcctacacagagaagcgaaaatatcacagcaagaccgaagttgtccatgaacctgatattgagcagatgctgaagctgggaagcacgtcttatcacgatttcctggatttccttacaaccgtagaggaggagctgatgaaacttccggcggtatctaagcctaagaaaaactatgaagaacaagagatctcattggaaatagtggataacttttggggaaaagtcacaaaggagggcaagttcgtggaaagtgccgtcattactcaaatctattgcctctgctttgtgaatgggaacctggagtgtttcctgactttgaacgacctcgaactgccaaagcgagacgaatcgtattacgagaaggactccgaaaagaaaggtattgatatcctggattatcattttcacaagtgcgtgaatgtgcaggaattcgagcagtcccggataattaaattcgtgcctttggacgcctgccgattcgagctgatgcgcttcaagaccctatataacggcgacaacctgccattctctcttaagtctgtagtggttgtgcagggggcgtatgtggaactgcaggcatttgttaatatggccagcctggctcagaggtcaagttatgctggatccttgaggtcgtgtgataacatcaggatacacttccctgtgcccagccagtggatcaaagccctgtggaccatgaatttgcagagacaaaagtccttgaaggccaagatgaaccgacgggcctgtctgggcagtctccaggagttagagtccgaacctgtgattcaggtcaccgttggttccgctaaatacgaaagcgcataccaggccgtcgtgtggaaaattgacaggctgcccgacaaaaactcctcattggatcatccccattgtcttagctataagctggagctggggtcagatcaagagatcccgtctgattggtacccttttgcaaccgtgcaattctctgtgccagatacctgcgcatctcggaccgaagtcagatctcttggagttgagtccgatgtgcagccccaaaaacatgttcagcaaagagcatgctacaacatccaggtcgaaattgagaagaagtggatcaagattgatggggaagatccagacaaaataggtgactgtatcacacaatag

SEQ ID NO: 46599 - DNA, 2718 bp, Artificial Sequence
  Description of Artificial Sequence: Synthetic coding sequence
atgaccaccctggaccacgtgatcgccacccaccagagcgagtgggtcagcttcaacgaagaaccaccgttccccgcgcattcccaggggggcacagaggaacacctacccggactgtcgtcgtcgcctgaccaatccgagtctagtagtggtgagaatcatgtcgtggatggagggagccaagaccacagtcattctgaacaggacgactcttctgagaagatgggccttataagtgaggctgcaagccctccaggctctcccgagcagcccccacccgatttggctagtgctattagtaattgggtgcagttcgaggacgatacaccctgggccagcaccagtccccctcaccaggagactgccgaaaccgcattgccactgactatgccctgctggacctgcccgagcttcgattcgttgggccgatgcccccttacctccgagagttcctggaccactcactccgaggatacttcatcaccctccttcggttgctcctataccgatctgcagctaataaacgcagaggagcagacttcaggccaggcttcaggcgctgattctaccgacaactcctcttccctacaagaagacgaggaggtggaaatggaagcaatcagctggcaagccagctccccagcaatgaatgggcatccagccccaccagtgacaagcgcccgttttccgtcgtgggtgacattcgacgataacgaagtttcttgcccgctacctcctgtcacgtccccacttaagcccaatacccctccaagtgcatcagtgattccagacgtcccctacaacagtatgggatctttcaagaagcgcgacagacccaaatctaccctaatgaatttttctaaagtccagaaactggacatctcttctttgaaccgaacccctagcgtgacagaggcgagcccttggagggccacgaacccgttcctgaacgagacacttcaagacgtgcagcctagtcccatcaatcctttttccgcctttttcgaagaacaagagaggagatcgcagaattccagcatctcctccacaaccggaaaatcccagcgggactctctgattgtcatctatcaggatgccattagtttcgacgattcttctaagacccagagtcactccgacgcagtcgagaaactgaagcagctgcagattgatgaccccgatcactttggatcagccacactgcctgacgatgatcctgtcgcctggattgagttagacgcacacccaccgggctcggcgcgctcccagcctagggacggatggcctatgatgttgaggatccccgagaagaagaacataatgtccagcagacactggggacctatcttcgtcaagctgaccgatacagggtatttgcagctgtactacgagcagggcctcgaaaagccctttagagagttcaagctagaaatctgccacgagataagtgaacctaggttacagaactacgacgagaacggccgtatccactctttaagaatcgatcgggtgacctacaaggagaaaaagaagtaccagcctaagccagccgttgcacacacagccgagagggagcaggtcattaaattgggaacgactaactatgacgatttcctaagtttcattcacgccgttcaggatcggcttatggaccttcctgtgcttagcatggacctttccacagtgggtttgaattacttggaagaagaaattactgttgacgtcagagatgaattctcagggattgtgagtaagggtgacaatcagattctgcaacatcatgtcctgacgagaattcacattttatcctttttgagcggactggcagaatgtcgccttggactaaacgatatactggtgaaaggaaatgagatcgtgctgcggcaagatataatgcccaccacgaccaccaaatggataaagttacatgagtgtcggttccatggctgtgttgacgaggatgtgttccataattcacgggtgatcctgtttaatcctctcgatgcttgtagatttgagttgatgaggtttagaacggtctttgcagaaaagacactacctttcacccttagaaccgctacgtccgtaaatggcgctgaggtcgaagttcagtcctggctgagaatgtctactggattctctgcgaatagagatcctctgactcaggtaccttgcgaaaacgtgatgattcgctacccggtcccttctgaatgggtcaagaactttagaagggagagcgtgctcggcgagaaaagtctgaaggccaaagtaaatagaggagcctcatttggttcaactagtgtgagcggctcagaacccgttatgagagtgacattagggacagcaaagtatgaacacgcgttcaactccatcgtttggaggattaacagacttcccgataaaaactctgctagtggtcacccgcactgctttttctgccatttagagctgggttccgacagggaggtcccaagccggttcgcgaaccacgtaaacgtggaattttccatgcctacgacttctgcttccaaggcatccgtgcggtctatatccgtggaagataaaactgacgtccggaaatgggtcaattactcagcccattatagttatcaggttgcactcgggtcgatctggctcatgctcccgactcccttcgtccacccaacaaccctgccgctgctctttctcctcgccatgctgaccatgttcgcctggtag

SEQ ID NO: 46600 - DNA, 2799 bp, Artificial Sequence
  Description of Artificial Sequence: Synthetic coding sequence
ggccagcagtgcgaggacgaccagtgcctgttcagcatgaccacccttgatcacgttattgcgactcatcagtctgaatgggtatctttcaacgaggaacctccatttcccgctcacagccagggaggaactgaagagcacctccctggattgagtagctcgcctgaccagtccgaatcctcctccggcgagaatcacgtcgtcgatggaggatcgcaggaccacagtcactcggagcaggatgatagtagcgaaaagatgggattgattagtgaagccgcgtctccacctggaagcccggagcagccaccgcctgatttggccagtgctatttctaactgggtccagtttgaagacgataccccttgggcttccacctccccgccacatcaggaaaccgcggaaacggccctgccgctcaccatgccttgctggacatgtcctagctttgactccctgggacgttgtcctttgacatccgagtcctcctggaccacccacagtgaggacaccagcagtcctagcttcggatgttcctacactgacctgcagctcattaacgccgaagagcaaactagtggacaggcatcgggcgcggacagcacagacaattccagcagcctgcaggaagatgaagaggtcgaaatggaagctatttcctggcaggcatcaagccctgctatgaatggtcatcctgcccccccagtgacatccgctcggtttccctcctgggtcaccttcgacgataatgaagtttcctgcccgcttccaccagtgacctcgcccttaaagccaaatacaccgccctctgcctcggtgatacctgacgtgccctataactctatggggagcttcaagaaaagagatcgcccaaagagcaccctgatgaatttctccaaggtgcagaagctcgacatcagtagcctgaatcgcacacctagtgtgacggaggcatcgccatggcgcgccacaaatcccttccttaatgaaacccttcaagacgtgcagcctagccctatcaaccccttctcagcattcttcgaggaacaagaacgaaggtcccagaattctagcatctccagcacgaccgggaaaagtcaacgggactcgctcatcgtgatctaccaagatgctatttctttcgacgacagtagcaagacgcaaagccactccgacgctgtcgaaaagctgaagcagctccaaatcgatgatcctgatcactttggcagcgcgacactgcccgacgatgatcccgtggcctggatcgaactggatgctcatcctccagggagcgcgcgcagtcagcctcgcgacggctggccaatgatgttgcgcattcccgagaaaaagaacatcatgtcctccagacattggggtcctattttcgtgaagcttaccgatacaggatatctgcagctgtactacgagcagggactcgagaagccattccgggagtttaagctggaaatttgtcatgagatttcggagcctagactgcagaactatgatgagaatgggaggattcactcattgagaatagatagagtcacctacaaagaaaagaaaaagtatcagcctaagcccgccgtcgctcacaccgcagagcgcgaacaggtgattaaactgggcactaccaattacgatgacttcctgagctttattcatgctgtgcaggacagactaatggacctgccagtgttgagcatggatctgtctaccgttggactgaactacctggaagaagaaattacggtggacgttcgtgacgaattttccgggatagtctcaaagggagataatcagatactgcagcaccatgttttgacacgtatacacattctgtccttcttatccggtcttgctgaatgccgactggggctcaacgatatcctcgtgaaagggaacgagatcgtcctgagacaggacatcatgcccacaactaccaccaagtggattaagctgcacgagtgccgctttcacggctgcgttgatgaagatgtgtttcacaacagccgggtgattttgtttaatccgctcgacgcttgtcgattcgaactgatgcggttcaggacagtctttgctgagaagacgctgcccttcactttacggacggcgacctctgtgaatggcgccgaggtggaagtgcagtcttggctgaggatgagcaccggttttagcgccaaccgagacccacttacacaggtgccatgcgaaaacgtcatgattcggtaccccgtcccaagcgaatgggtgaaaaacttcagaagggagtccgttttgggagagaagtctctaaaggccaaggtaaatcggggcgcttcgtttggctccaccagcgtcagcggctccgagcccgtgatgcgagttacgctcggaacagctaaatacgagcatgcgtttaactcaatcgtctggaggattaataggctgccagataaaaattctgcatcgggccatccccattgttttttctgccacctggaattgggcagcgaccgcgaagtgccctcccggttcgccaatcatgtgaacgtcgaattcagcatgcccaccacctccgccagtaaggcaagcgtccggagcatctctgtggaagataaaactgatgttcggaaatgggtgaactacagtgcccactactcatatcaaacaacagagacagataatttacccaatcctctgtattgctcatgtttgccccatacagacctgaaacggggcagtaagcgggtagtaaagattcggtggaatgcctccctcgaggtacccctggcatcatcaatccgtactatggtatag

SEQ ID NO: 46601 - DNA, 12 bp, Artificial Sequence
  Description of Artificial Sequence: Synthetic coding sequence
atgaccacctag

SEQ ID NO: 46602 - DNA, 153 bp, Artificial Sequence
  Description of Artificial Sequence: Synthetic coding sequence
atgaccaccctggaccacgtgatcgccacccaccagagcgagtgggtatcctttaatgaggaaccaccattcccagcccacagtcagggcggaacagaagaacacctgccaggtctgtcttccagccctgaccagtccgagtcaagctcgtag

SEQ ID NO: 46603 - DNA, 2763 bp, Artificial Sequence
  Description of Artificial Sequence: Synthetic coding sequence
atgaccaccctggaccacgtgatcgccacccaccagagcgagtgggtctcttttaacgaggagcctccctttcccgcacactcccagggtggcaccgaagaacatctgccggggctaagctcgtcacctgatcagagcgagagttccagtggagagaaccatgtcgtcgacggtggctcccaggaccattcacactctgaacaagacgactcttcagaaaagatgggcctgatctccgaagccgcctctccccctggctcccctgagcaacctccacccgacctggccagcgcaatcagcaactgggtccagttcgaggacgatacaccatgggctagtacttcacctccacatcaggagacggcagaaactgcactccctctcactatgccatgttggacatgtccctcattcgatagccttggtcgatgcccattaacctcagagagcagctggaccacccattccgaggatacaagctcaccctctttcggctgctcatacaccgatttgcagttaattaacgctgaggaacagacttcagggcaggcgagcggagctgactctaccgataattcctctagtctccaggaagacgaggaggttgaaatggaggccatctcctggcaggcgtccagtcccgcgatgaacggtcaccccgccccacctgtcacttccgcccgctttcctagctgggtgaccttcgacgacaatgaggtcagctgccccctgccaccagtgaccagtcccttgaaaccaaacacacctccatcagcatctgtgatccccgacgtgccttacaacagtatgggcagttttaaaaagcgtgataggcctaaatccaccctgatgaacttttcaaaagtccagaaactcgacatttcgagtctcaataggaccccaagcgtaactgaagcgtccccttggcgcgccactaatccgttcctgaacgagaccctgcaagacgtccagccaagtcctattaatcccttttcggctttcttcgaggaacaggaacggagaagtcagaatagctcaatttcgtccaccaccggcaaatcacagcgcgacagcttgattgtaatatatcaggacgccattagttttgatgacagcagcaaaacacagagccattcggacgccgtggagaaactaaagcagctgcagattgatgatccggaccacttcggttcagctactctacccgacgatgatcccgtggcctggattgagttagacgcccaccctcccggttcagcccggtctcagcctcgagacggctggccaatgatgctgagaattccggaaaagaagaacatcatgtcttcgagacattggggccctatatttgtcaagctgacagacacagggtacttgcagctctactacgaacaaggcttagaaaagcccttccgtgagttcaaattggagatttgtcacgagatctctgagccaaggctgcagaattatgatgagaatggcaggatccacagcctgcgtattgatagagtcacctataaggagaagaaaaaatatcagcccaagcccgcagtggctcatacagctgagcgagaacaggtcattaagttgggcactaccaattacgacgattttctcagctttattcacgccgtgcaggacagattaatggacctgccagtccttagcatggatctaagcaccgtgggcctaaattacctggaagaagagatcaccgtggatgtgagagacgaatttagtggtattgtgtctaagggcgataaccagattctacaacaccatgtgctgaccagaattcacatcctctcgtttctgtctgggctcgccgaatgtcgcttaggattaaacgacatcttagtgaagggcaatgaaattgtgttaagacaggacatcatgcccactactactaccaaatggattaagctccatgagtgtcgttttcatggttgtgtggacgaggacgtttttcacaattcacgggtaatcctctttaaccccctagacgcatgcagattcgagttgatgcggtttagaacagtgttcgctgaaaaaacgttacctttcaccttgaggaccgcaacctccgtgaacggcgccgaagtcgaggtgcaatcctggctgcgcatgtcgacgggattctcggcaaatcgcgacccactgacccaggtcccctgcgagaatgtgatgatacgttacccagtcccttcagagtgggttaaaaatttccgacgagagagtgtcctcggtgagaaaagtctgaaggccaaggtgaaccgaggtgcttcattcggatccacgtcagtgagtggtagcgagcccgtgatgagggtcacgcttggtaccgccaagtacgagcacgcgtttaactcaatagtctggcggattaacagattgcctgataaaaacagcgcctctggccaccctcactgctttttttgccacctggagctggggtcggatcgtgaggtcccttctcgatttgctaaccacgtgaacgtcgaattttcaatgcccactactagcgcatcgaaagcatccgtgaggtcaatttctgtggaggacaaaacggacgtgcgcaaatgggtcaattacagtgcacactattcttaccagacaactgaaacagataacctgcccaaccccctctattgttcatgcctgcctcatacagacttgaagaggggcagcaagagggtggttaaaatacgctggaacgcaagtctcgaagtaccgctggcctcttcgatcagaaccatggtttag

SEQ ID NO: 46604 - DNA, 441 bp, Artificial Sequence
  Description of Artificial Sequence: Synthetic coding sequence
atgtggcccgccccctgcagcgtgggccggctgctgatcttcttcatgtgctccagttccggctacgttgtgcaggggtgtggaccttcccctggcgcgcggaccacccttggtagcccactgagtctgtggtccatcaagactccgtcacacatattttgtactcgcagggccattaacctggggttccccagccctccacttgttcagttgatattctggtcactcaatgccggacttgacctgtatctgtgccttatctcaagctgcggcttttcacaagtgttctggccagtggaagccttttgttctttttccctgtcctttttcgcgctggcactgagtcacaagttcgtgatttgtaggctggaccagcacattttcagcgggtttacaaaatctctaaagaacctgcctccctgtcaccgaactgacatttag

SEQ ID NO: 46605 - DNA, 201 bp, Artificial Sequence
  Description of Artificial Sequence: Synthetic coding sequence
atggtggccaagcagcggatccggatggccaacgagaagcacagcaagaacattacacagcgagggaacgttgccaaaacatcacgtaatgcccccgaggagaaggcctccgtcggtccatggttgctggcactgttcattttcgttgtgtgcggttccgccatttttcaaataattcagtcgatccgcatgggcatgtag

SEQ ID NO: 46606 - DNA, 201 bp, Artificial Sequence
  Description of Artificial Sequence: Synthetic coding sequence
atggtggccaagcagcggatccggatggccaacgagaagcacagcaaaaatattacccagcggggaaacgtggctaaaacaagcaggaatgctcctgaggagaaggcctcagtaggcccttggctgctggcccttttcattttcgtggtatgtggtagcgctatcttccagataattcagtccatccgcatggggatgtag

SEQ ID NO: 46607 - DNA, 198 bp, Artificial Sequence
  Description of Artificial Sequence: Synthetic coding sequence
atggtggccaagcagcggatccggatggccaacgagaagcacagcaaaaatataactcagcgcggcaacgtcgcgaagacgctcaggccacaagaggagaagtaccccgtggggccctggctactcgcccttttcgtattcgtggtctgcgggtctgccatctttcagattatccagtccattcgtatggggatgtag

SEQ ID NO: 46608 - DNA, 2343 bp, Artificial Sequence
  Description of Artificial Sequence: Synthetic coding sequence
atggacgagcaggccggccccggcgtgttcttcagcaacaaccacccgggtgccggcggtgcgaagggactcgggcctctagccgaggctgcagcggcaggcgatggtgcagctgcagctggagcggcccgtgcccagtattcactcccgggaatcttgcattttctccagcacgagtgggcacggttcgaggtcgaaagggcacagtgggaggtggagcgtgctgaacttcaagcgcaaatcgcctttcttcagggcgagagaaaaggccaggagaatctgaagaaggacctagtgaggcggattaagatgctggagtacgccttgaagcaggagcgggcaaagtatcataagctcaagtatggtaccgaactgaatcagggggatatgaaacccccctcttatgactccgacgaagggaatgagaccgaagtccagcctcagcagaatagccagctgatgtggaaacaaggccgccagctgttgcgccagtacctgcaagaagtgggctacacagacacaattctggacgtaaagtccaaacgggtgcgagccctgctgggtttttcttccgacgtcaccgatagggaggatgacaagaaccaggacagcgtagtcaacgggaccgaggctgaagtaaaggagacggctatgattgctaagagcgaactcaccgactcagcctccgttcttgataattttaagttcttagagtccgctgccgccgacttttccgacgaggatgaggacgacgatgtagacggacgggaaaagagtgtaattgacacctctacaattgtgcggaagaaggctttacccgactcaggcgaggacagagacacaaaagaggccctgaaagaatttgatttcctggtaacctctgaagaaggcgataatgagagccggtccgctggcgacgggacggactgggagaaggaggatcagtgcctgatgcccgaggcctggaatgtggatcagggtgtaatcacgaagctgaaggaacagtataagaaggaacgcaagggcaagaaaggagtgaagagaccaaaccgttccaaattgcaggacatgcttgcaaacctgagggacgtagacgagctcccgagtctgcagcccagcgtgggaagtccatccagaccctcttcttcaaggttaccagagcacgagattaacagggccgacgaggtggaggctctgacgtttccccctagttcaggtaaaagttttataatgggggctgacgaggcactggaatccgagctcggcctgggagaactggccggccttacagtggccaacgaagccgactcacttacctacgacattgccaataataaagacgcgttgagaaagacctggaatcccaagttcactctgcgatctcattttgatggtatccgggctctggcatttcaccctattgagccagtcctcattaccgcatcagaagatcacacacttaaaatgtggaatttgcagaagaccgcacccgcaaagaagtccacctcactcgatgtggaacccatctacacgtttcgcgctcacaaaggccctgtgctgtgcgtcgtgatgagttctaatggcgaacagtgctacagcggtggaacagatggactgatccagggatggaacacaacaaacccgaatatcgacccctacgactcctacgatcccagtgtccttcgggggcccttgcttggccacaccgacgcagtgtggggattggcttactcggcagcacaccagcgccttctgagttgctctgctgacggcacactgaggttatggaacaccactgaagtggcaccggccttgtcggtgtttaacgatactaaggaattggggatcccagctagcgtggatctggtgtcatccgaccccagccacatggtcgcatcattttctaaagggtacacttctatatttaatatggagacgcagcagaggattctcactttggaaagcaacgtggatacaaccgctaatagctcttgtcagatcaatcgggtgattagtcacccaactctgcctatctccatcactgcccacgaggataggcacatcaagttttacgacaataacacaggcaaacttatccacagcatggtcgctcacctggaagctgtgaccagcctggccgttgatccaaatggactgtacctcatgagcggctcacacgactgcagtattagattatggaatctggaaagtaaaacatgcatccaagagttcactgctcaccgcaaaaagttcgaggagagtattcatgacgttgcgtttcatccttcgaagtgttatatagctagcgccggcgctgatgcactcgcaaaagtgttcgtgtag

SEQ ID NO: 46609 - DNA, 2196 bp, Artificial Sequence
  Description of Artificial Sequence: Synthetic coding sequence
atggacgagcaggccggccccggcgtgttcttcagcaacaaccaccccggagcagggggcgccaagggactgggacctcttgcaggggcagcccgtgcacagtattccttgccgggtattctgcactttctgcagcatgaatgggcccgcttcgaagttgagagggcccaatgggaggtggagcgcgccgagctccaggcccaaattgcttttctgcagggtgaacgcaaaggacaagagaacctgaagaaagacctggtcagacgtattaagatgctggagtacgcactgaagcaagaaagggccaagtaccacaaactcaagtacggaactgaactgaaccagggcgacatgaaaccccccagctacgactctgacgagggaaatgagaccgaggtgcagccccagcagaatagtcagctcatgtggaagcaggggaggcagctgttgcgccagtacctacaggaggtcgggtatacagacactatcctggacgtgaaaagcaagagggtgcgggcacttctgggcttctcgtcagacgtcaccgaccgcgaggacgataagaaccaagattctgtcgtcaatggcaccgaggccgaggtgaaagaaaccgccatgatagctaaaagcgagctcaccgacagcgcctccgtgctagacaacttcaaatttttggagtccgctgccgccgatttctcggatgaggatgaggatgacgatgtggacggtagagagaaatctgtcatcgatacctcgaccatcgtgaggaaaaaggcgctccccgatagcggggaggacagagatacaaaagaagctttgaaagagtttgactttctcgtgactagtgaggaaggtgataatgaaagtcgcagcgctggtgatggtaccgattggggacccaacaggagtaagcttcaggatatgctcgccaatctgcgcgatgtggatgagctgccatctctgcagccttcagttgggagtccaagccgccccagcagcagtcggcttccagagcacgaaatcaatcgggccgatgaagtagaagccttgacttttccccccagcagcggcaagagctttataatgggagcagatgaggctctagagtcagagctgggccttggcgagttagcaggactgactgtagctaacgaagcggatagtttaacttacgacattgcaaacaataaggacgcgctacggaagacctggaatcctaaatttacactcagaagccactttgacgggattcgtgccctggccttccatccaatcgagccggtgcttataacagcgagcgaagatcacacactgaagatgtggaatcttcagaagaccgctcctgccaagaagagtacatcgctggacgtggagcctatctacacattcagagcccacaaaggcccagtactgtgtgtggtcatgtctagtaacggggaacagtgttacagtggcggcacggacggcctgatccagggctggaacactacgaaccccaatatcgatccctacgactcctatgacccatctgttctgcgaggcccactgctaggacacacagatgctgtgtggggtctagcgtattctgccgcccatcaaagactcctctcatgctccgcagacggaaccttgagactatggaacaccactgaggtggctccagctctctctgtgttcaacgacaccaaagagctaggcatccccgcgtcagtcgacctcgtttcaagcgacccctcgcatatggtagcttcattctcaaagggatacacttctatttttaatatggaaacacagcagcgcatcctcacgctcgaaagcaatgtggatacgacggcaaacagttcctgtcagattaaccgggtgatttcccatcctaccctgccgatctctattaccgctcatgaggatcgtcacatcaaattctatgataacaacaccggtaagctgatacattcaatggtcgcccatctcgaagcggtgaccagcctggccgtcgatcccaatggcctctacctcatgagtggatcgcacgactgctctattcgactctggaatctcgagtcgaaaacctgtatccaggaattcacggcccacagaaagaagtttgaggagagcatacacgacgtcgcatttcacccttctaaatgctacatagcctcagccggcgcagatgcattggccaaggtctttgtatag

SEQ ID NO: 46610 - DNA, 2268 bp, Artificial Sequence
  Description of Artificial Sequence: Synthetic coding sequence
cggcccccctggaccagccggcgggtgcccgccagcagcagcgccaccactacgagggcccaatactctttaccaggaattctccatttcctacaacacgaatgggccaggtttgaggtcgaaagagcccaatgggaagtggagcgggccgagctgcaggcacagatcgcttttctgcagggcgaacgcaaaggacaggagaacctgaaaaaggatctggttagaaggatcaagatgctggaatatgccctgaagcaggaaagagctaaataccataaactgaagtacggtaccgaacttaaccaaggcgatatgaagcctccctcttacgactccgatgagggaaacgaaactgaggtgcagcctcagcagaattcccagctgatgtggaagcaagggagacagctgctgcggcagtacctgcaggaagttggctacacagacacaatactggatgtgaagtctaagcgggttcgagcattgctcggattttcttccgacgtgaccgatagggaggatgacaagaatcaggactcagtcgtgaatggcaccgaggcagaggtgaaagagacggctatgattgcgaagtctgagctgacagactccgcgagtgtgctggacaacttcaagttcctggaatctgctgccgccgacttttccgatgaggacgaagacgatgatgtagatggccgtgagaagagtgttattgatacctctacaatcgtcagaaagaaagcgctcccagattctggggaagatcgcgacaccaaggaggccctcaaggagtttgattttctggttaccagtgaagagggcgataacgagagccgatctgccggcgacggaacggattgggaaaaagaggaccagtgtctgatgccagaagcgtggaacgtcgaccaaggggtaataactaagctcaaagagcagtacaagaaagaaaggaagggcaagaaaggggttaagagacctaatcgttcaaagctacaggacatgctcgctaacttgcgtgatgtggacgagcttcctagcctccagccatctgtgggcagcccttcaagaccctcatcaagcaggctccccgagcatgagattaatagggcggacgaggtcgaggccctgacctttccccctagttctggaaagtctttcatcatgggagcggatgaggcattagagtccgagctaggattgggcgagctcgcaggactgacagtggcgaacgaagctgactcattgacctatgacatcgccaataacaaggacgcgttgaggaagacctggaatccaaagtttacactgaggtcccatttcgatggcatccgagctctcgcatttcaccctatcgaaccagtcctgattaccgcctcagaggatcacactctcaagatgtggaatctgcagaagactgcccctgcaaaaaagtccacctcgctcgatgtggaacccatttacacgttccgggctcacaaaggcccagttttgtgcgttgtgatgagcagcaatggggagcaatgttacagcggcgggacggacggcctcattcagggctggaacacaacgaatcccaatatcgatccatacgatagttatgacccttctgttctacgtggacctctccttggacacactgacgctgtatgggggctggcctattctgcagcacatcagcggctgctctcatgcagcgccgatggcaccttgcgactgtggaatactactgaggtggccccggcactctctgtgttcaatgatacaaaagaattgggcatcccggcctccgtagatctcgtgagcagcgacccatctcatatggtcgccagcttctcaaagggatacacaagtattttcaatatggagacacaacagagaatactaacccttgaatcaaatgtggatactaccgctaattccagctgccaaattaatagggttatcagccaccccacactgccaattagcatcacagcccacgaagacagacacatcaagttctatgataacaacacaggtaaacttattcactccatggttgctcacctcgaagcagtcacttccttggcggttgatcccaatggtctctacctcatgtcaggctcacacgattgcagcattagattatggaatctggaaagtaaaacctgtatccaagaattcaccgcccatagaaaaaaattcgaagagtcaatccatgatgtggctttccacccgagcaaatgttatatcgcctctgcaggggctgacgccttggctaaggtttttgtgtag

SEQ ID NO: 46611 - DNA, 2142 bp, Artificial Sequence
  Description of Artificial Sequence: Synthetic coding sequence
atggacgagctggccggcggcggcggcggcggccccggcatggccgctcctcctaggcaacagcagggccccggtggaaatcttgggctcagccccgggggcaatggagcagccggcggaggtggaccccccgccagcgagggcgcgggcccagccgccggcccagagctgtccaggccacagcaatacaccatccccggcatccttcattacatacaacacgaatgggcccggtttgagatggaacgggcacattgggaggtcgagagagccgagctgcaggctcggattgcttttctccaaggggagaggaagggccaggagaacttgaaaaaagacttagtgagacgcatcaagatgctcgagtacgctctgaagcaagaaagagctaaataccataagctaaaatatggaactgaactgaaccaaggggaccttaagatgcccacattcgagagcgaagaaaccaaggacacagaggcgcctactgccccccagaactcccagctgacttggaaacagggccgccagctgcttagacagtatcttcaggaagtaggttacactgacacaattctggatgtgcggtcccagagagtgaggagtctgttgggtttgtccaacagtgagcccaatggcagcgtcgagaccaaaaacctggaacagatactgaacgggggcgagtcaccaaagcagaaggggcaggagatcaaacgatcctcaggtgacgtgttggaaactttcaacttcttagaaaacgccgatgactctgacgaggacgaagaaaacgacatgatcgaagggatcccagagggcaaggacaagcacaggatgaacaagcacaagatcggcaatgagggcttggctgctgatctcaccgatgatcctgatactgaagaagccttgaaggaattcgactttctcgtgacagccgaggatggtgagggagccggagaggcccggagtagcggggatggaactgaatgggcagagcccattacattcccttccggcggtggtaaatcattcataatgggttcagatgacgtgctgttaagcgttttaggactaggagatctggccgatcttaccgtgaccaatgacgctgattatagctatgacctgcccgccaacaaggacgcatttcgcaagacatggaatcccaagtataccttgcggtcacattttgacggagtaagggccttagcgtttcacccagtggaacctgtcctggtgaccgcgagtgaggatcacactctgaaactgtggaatctccaaaaaactgtgcctgctaagaagtcagcatcactggacgttgagcctatctatactttccgtgcccacattggacccgtgctttccctggccatctcgtctaatggagagcagtgcttctctggcgggatcgatgctaccattcagtggtggaatatgccgtctcctagtgtggacccatatgacacttatgagccaaatgtgctggcaggcacactggtcgggcacaccgacgccgtttggggcctcgcgtattcaggtatcaagaaccagttgctgtcgtgcagcgccgacgggactgtcaggctgtggaaccctcaggagaaattaccgtgcatatgcacctataatggcgacaagaagcacggaatcccgacaagcgtcgattttatcggttgtgacccagcccacatggtgacaagcttcaatacaggctctgctgtaatctacgacttggaaacgtcccagtcgctggttatactctcctcacaggttgatagtggactgcagtctaataaccacataaatcgcgtggtgagccatcctaccctgcccgtgaccataactgcacacgaagatcgccatatcaaattctttgacaataagactgggaagatgattcactccatggtggctcatttggatgcggtgacctctctggctgtggacccgaatggcatttacctcatgagtggctcacacgactgctccatccgcctctggaatctagacagcaaaacgtgcgtacaggagataaccgcacaccgtaaaaagttagacgagtctatttacgacgttgctttccactcaagtaaggcttacatcgcttctgccggcgcagatgccctggcaaaagtattcgtctag

SEQ ID NO: 46612 - DNA, 2394 bp, Artificial Sequence
  Description of Artificial Sequence: Synthetic coding sequence
atggacgagctggccggcggcggcggcggcggccccggcatggccgccccgcctcgccagcagcagggcccaggcggaaatctagggctttcacctggcggcaacggagccgcggggggaggagggcctcctgcctccgaaggcgcaggtccggcagccggaccggagcttagccgtccacagcagtatactatccccgggatcctgcactatattcagcacgagtgggccaggtttgagatggagcgggctcattgggaggtggaaagggcggagttgcaagcaagaattgcttttctgcagggggaacgaaaaggacaggagaacttgaagaaagacctggtgcgtcgtattaagatgttggaatatgctttgaaacaagagagagctaagtaccacaagctgaagtacgggaccgaactgaatcagggcgacctgaaaatgcctaccttcgaatctgaggagactaaggacaccgaagctcctacagctccccagaatagtcaactcacatggaaacaaggccggcaacttttacgacagtacttacaggaagtggggtacacggacaccattctggatgtgaggtcccaaagggtcaggagtctcttgggcttgtctaacagtgagcccaatgggtcagtggaaactaagaacttggagcagatcctgaatggcggagaatcacctaaacagaagggccaagaaatcaagcgttctagcggagatgtgctcgaaacgtttaattttctggagaatgcggacgattctgacgaggatgaagagaacgatatgatcgaggggatcccggaaggtaaagataagcatcgtatgaacaaacacaagatcggtaatgaaggactggcggctgatctcactgatgatccggatacggaagaggctctgaaggagttcgactttctcgttaccgcggaggatggtgagggcgctggagaggctaggagcagcggtgatggcactgagtgggacaaggacgacctgtccccaaccgctgaagtttgggatgtggatcaaggtcttatctctaaactgaaggagcagtacaagaaagaaaggaaaggcaaaaagggagtcaaaagagctaaccgcacaaagctgtacgacatgattgcggacctcggcgatgacgaacttcctcacatccccagcgggattattaaccagagcaggagtgcatccaccagaatgaccgaccacgagggagcaagagccgaggaagccgagccaataacattcccgtcaggaggtggcaaatcttttatcatgggatccgatgacgtccttctgagcgtactgggcctcggagatttggcagacttgactgttacaaatgacgcagactactcttacgacttgccagcaaacaaggatgcttttaggaaaacttggaatccaaaatatactctcagatctcacttcgacggcgtgagggcgctggccttccaccctgttgaacctgtgctcgtgactgcctccgaggaccacactcttaagctgtggaatttacaaaagaccgtgcctgcgaaaaaatcggcgtcactagatgtggaacctatttacactttccgagcacatatcggcccagttctgtctctggctatctcttctaacggggagcagtgtttttcaggaggcatagatgcgacaatccagtggtggaacatgcctagcccgagtgtcgacccatacgatacctacgagcctaacgtgctggccggcacactggtcgggcatactgacgctgtatggggcctggcctattccgggattaagaaccagttgctgagctgctctgccgatggaaccgtgaggctatggaacccccaggaaaagctgccatgcatatgcacttacaatggtgataaaaagcatggcatacctacctccgtggacttcatcgggtgcgacccagcacacatggtgactagcttcaatacaggctcggccgtcatctatgatttggaaacttcacagtcgctcgtgattctttcgtcccaggtagactcggggctgcagtccaataaccatattaacagagtagtttcacatcccactctcccagttaccatcacagcgcacgaggataggcacatcaagttttttgataacaagaccgggaaaatgatccacagtatggtggcacacctcgacgctgttacttcactggcagtagacccaaatgggatttacctgatgtctggatcccacgactgcagcatacggctgtggaacttggactctaagacctgcgtgcaagagatcactgcgcatcgcaaaaaactggatgagtccatctatgacgtcgcgtttcattcgtcgaaggcttacatcgcatccgcaggcgccgacgcattagcaaaagtgttcgtttag

SEQ ID NO: 46613 - DNA, 2118 bp, Artificial Sequence
  Description of Artificial Sequence: Synthetic coding sequence
atgaccaagttcggcttcctgcggctgagctacgagaagcaggacacactgctgaagctcctgattctatctatggccgccgtgctttcctttagcactcgtctatttgccgtcctgcgctttgagtctgtgattcacgagtttgatccttactttaattacaggaccacaaggtttctggcagaagaaggcttctacaagttccacaactggttcgacgatcgcgcttggtatcccctgggacggattattggcggaactatctatcctggactgatgattaccagcgccgcgatctaccatgttctgcattttttccatattacaattgacataagaaacgtgtgtgtgttcctggcccctctcttcagctccttcaccacaatcgtgacgtaccatctgacgaaggagctgaaagatgctggggccgggctcctcgcggctgctatgatcgctgtggtgcctgggtacatctctagatccgttgccggcagctatgacaatgaagggattgccatcttttgtatgctccttacctattacatgtggatcaaggcggtgaagactggatcaatctgttgggcggctaagtgtgccttagcttatttctacatggtcagttcatggggaggttacgtctttcttatcaacctgatcccgttgcatgtactggttctaatgctcacaggaagattttctcatcgcatttatgtggcgtactgcacagtctactgcctgggcacaatactcagtatgcagatctcattcgtcggttttcaacccgtcctgtcatctgagcacatggcagcttttggggtgtttggactctgtcagatccatgcattcgttgactacctgaggagtaagctgaacccacagcagtttgaggtgctgtttagatccgtgattagcctggtgggattcgtgttgcttaccgtcggagccctgcttatgttaaccgggaaaatttctccctggacgggtagattttactcattgcttgacccgtcctacgccaagaataatattcccattatcgcatctgtgtccgaacaccagcccacgacttggtcatcatactattttgatcttcagttgctcgtgttcatgttcccagtgggtctctattactgcttttctaatctgtccgacgcgcggatttttataattatgtatggcgtcacaagtatgtacttctcagccgttatggttaggcttatgctcgtcttggcgcccgtcatgtgcattttgagcggaattggagtgtcccaggtgctcagtacttacatgaagaacttggacatctccagacctgacaaaaagagtaaaaaacagcaggactctacataccccattaaaaatgaagtcgccagcggcatgattctcgtgatggccttcttcctcattacgtatacgtttcactcaacttgggtaacctccgaagcttacagcagcccttccatcgtactttccgcacgtgggggggacggctcccgcattattttcgatgatttccgcgaggcgtactactggcttcggcacaacactcccgaagacgcaaaagtgatgagctggtgggattacggataccagatcacggcgatggcaaaccggaccatcctggtcgacaataacacttggaataatactcacatctctcgagtgggacaagctatggcctctaccgaggaaaaggcgtatgagataatgagagagcttgatgtctcatacgttctagtaatcttcggtgggctcaccggctactccagcgatgacatcaacaaattcctctggatggtgaggattggaggatccacggataccggcaagcacatcaaagagaatgattactacactcccaccggcgagtttcgcgtggatagagaggggtctcctgtgcttctgaattgcctcatgtacaagatgtgttactacaggttcggccaggtgtatactgaggcaaagcggccaccaggctttgatagagtcagaaacgcagagattggcaataaagacttcgagttagacgtgctagaggaggcatataccacagaacattggcttgtgcgcatctataaggttaaagatcttgacaaccgcggactgtctaggacctag

SEQ ID NO: 46614 - DNA, 2118 bp, Artificial Sequence
  Description of Artificial Sequence: Synthetic coding sequence
atgaccaagttcggcttcctgcggctgagctacgagaagcaggacaccttgctcaagctgcttattctgtccatggctgccgtcctgtcgttctctacacgccttttcgcggttctgagattcgaatcagtgatccatgaattcgacccctacttcaactatcgaactacaaggttcttagctgaggaagggttttataaattccataattggttcgacgatagagcttggtatcctcttggtcgtataatcggaggcaccatttatccaggtctgatgattaccagcgccgccatataccacgtcctgcattttttccacattaccatcgacattcggaatgtctgtgtttttctcgcccccctgtttagcagttttactacgatagttacctatcatttgactaaagaattgaaagacgccggggcgggcctcctggccgctgctatgattgccgtggtgccggggtacatcagccgttcagtcgccgggagctacgacaatgaggggattgccatcttctgtatgctactgacatattacatgtggatcaaagcagtgaagactggatccatctgttgggccgccaaatgcgccttggcctatttctatatggtgtcctcttggggcgggtatgtgtttcttatcaatctgatccccttacacgtgctggtactcatgctcaccgggaggttttctcatcggatatacgtcgcttactgcaccgtgtattgtctgggcacaatcctgtccatgcaaatctcttttgtcggctttcagcccgtgctgagcagtgaacacatggccgcgttcggggtgtttgggctatgtcagatccacgctttcgtagattacttgagatcaaagctgaacccacagcaatttgaagtgttgttccgttctgtgatctccctggtgggctttgtcttgttgacagtgggggcgcttctcatgctgacagggaagattagtccatggactgggagattctactcactgctagacccttcctatgccaaaaacaacataccaattatcgctagtgttagcgaacaccaacccactacatggtcttcctattattttgatcttcagcttttagtttttatgtttccagtaggcttgtactattgcttttccaacttgagtgacgcacgcatttttatcataatgtatggcgttacgagcatgtatttcagcgcagttatggtccggttaatgttggtcctggctccagtgatgtgtattctgtctgggattggcgtctcccaagtgctgagtacctacatgaagaatctggatatctcacggcccgataagaagagcaagaagcagcaagatagcacctaccctattaaaaacgaggtggcttcagggatgatcttggtgatggctttttttctcattacctacacctttcattccacctgggtgacgtccgaggcctactcatccccttctatcgtgctgtctgctcgcggcggagatggatcacgtatcatcttcgacgattttagagaggcctactactggctgcggcataatacgccagaagacgctaaggtgatgagttggtgggattatggttatcagatcaccgcaatggcgaacagaacaattctggtggacaacaatacctggaacaacacgcatatttcacgggtggggcaggcgatggctagcacagaagaaaaagcttacgagataatgcgggagctcgatgtctcctacgtcctggtaatcttcggcgggctaacaggctattcctcagatgatatcaacaagttcctctggatggttcgcatcggaggttccacagacacagggaagcacataaaggagaacgattattatactccaaccggagaatttagagtcgatagggagggatctccagtgctcctaaattgcctgatgtataagatgtgctattacagatttggtcaggtgtacacagaggctaagcgcccaccagggtttgatcgcgtgcgcaacgccgagattggcaataaagattttgaactggatgtactggaagaggcatataccaccgaacactggcttgtccgcatctataaggttaaggacttggacaaccgcggcctgtccagaacctag

SEQ ID NO: 46615 - DNA, 2481 bp, Artificial Sequence
  Description of Artificial Sequence: Synthetic coding sequence
atggccgagcccagcgcccccgagagcaagcacaagagcagcctgaacagctctccatggtccggccttatggcactcggcaacagccggcacgggcatcacggccccggtgctcagtgtgctcacaaggcagctgggggcgccgcccctcctaagcccgcaccggctggtctgtctggcgggctgtcacagccagcagggtggcaaagccttctaagcttcactattctcttcctggcctggctggccggctttagttcaagactttttgccgtgattcggttcgagtccattatccacgagttcgacccgtggtttaactaccgttcgactcatcacctggctagccatggcttctacgaatttctgaattggtttgacgagcgagcttggtacccactgggtcgaatagtaggtggcacagtgtaccctggacttatgatcacagcaggattaattcactggatacttaacaccctgaacattacagtgcacattcgggatgtttgcgtctttctagcacccacattttccggcctgacaagtatctctacttttctgctgactcgcgagctgtggaatcagggcgctggcctgttggcagcatgcttcatcgccatcgttccagggtatatcagccgctccgtcgctgggtctttcgacaacgaggggatcgctatcttcgcactacagttcacctattatctgtgggttaagtcagtcaagaccggcagcgtgttctggactatgtgctgctgtctgtcgtatttctacatggtgagcgcttggggaggttacgtcttcattataaacctgattccccttcacgtgtttgtgctattgctcatgcagcgctatagcaagcgggtgtatatcgcctatagcacgttctatatcgttgggctgattctctccatgcagattccgtttgtaggctttcaaccgattagaacatccgaacacatggctgcagcaggcgtcttcgcattattgcaggcatacgctttcctccagtatttgagggaccgtttgactaagcaggagttccagaccctgttttttctgggggtcagcctggccgcaggtgccgtgtttctgtcggttatctacttgacatacaccggatatattgcaccgtggtctgggcgcttctattccttgtgggatacggggtacgcaaagatccacattcccatcatcgccagcgtctcagaacatcaacctacaacctgggtgtcatttttcttcgatctgcacatcttagtctgtaccttcccagcgggcttgtggttctgcatcaaaaatatcaatgacgagagggtatttgtcgctctgtacgccattagcgccgtgtattttgccggcgtgatggttcggctcatgctgacactgacgcccgtggtgtgcatgctgagtgcaattgcatttagcaacgtatttgagcactatctaggcgatgacatgaaaagggagaaccctccagtggaagatagctccgacgaagatgataaacgcaaccaggggaatttatacgataaagccgggaaagtccgcaagcacgctacagaacaggagaaaaccgaagaaggcctgggcccgaacatcaagagtatcgtaactatgctgatgctgatgctgctgatgatgttcgcggtgcattgcacctgggttacttccaatgcatattcgtcgcccagtgttgtgttagcttcttataaccacgacggcacacggaatattcttgatgactttagagaggcctacttttggctacggcagaatacggacgagcatgccagggtgatgtcgtggtgggattacggataccagatcgctggaatggctaataggaccactctggtggacaacaatacatggaataactctcacattgcccttgtgggaaaagcaatgtcatccaacgaaacagctgcctacaaaataatgaggacattggatgtggactatgtcttagtgatcttcggaggcgttatcggctacagtggagatgacatcaacaaatttctctggatggttcgtatagccgagggtgaacaccctaaggatattagggaatctgattatttcacccctcaaggagaattcagagtggataaagccgggtcccccactctcctgaattgcctcatgtacaagatgtcctactaccggtttggcgaaatgcagctcgatttcaggacccccccgggcttcgaccggacaagaaacgctgagattggtaacaaagacatcaaatttaagcatctggaagaggccttcacctcagaacattggcttgtaaggatctacaaggtgaaggctcccgataatcgcgagacactggaccacaagcctcgcgtgaccaatatttttccaaagcaaaaatacctcagcaagaagaccacaaagcggaaacgcgggtatattaaaaacaaactcgttttcaagaaaggaaaaaaaatttcaaagaagaccgtgtag

SEQ ID NO: 46616 - DNA, 1005 bp, Artificial Sequence
  Description of Artificial Sequence: Synthetic coding sequence
atgctgggcatcatggcctggaacgccacctgcaagaactggctggccgccgaagctgctctggaaaaatactatctatctattttttatgggattgagtttgttgtaggcgtgctgggcaacacaatagttgtgtacgggtatatattctcactcaaaaactggaatagtagcaatatttatcttttcaatctgtccgtgtccgatctcgctttcctttgtaccctgccgatgttgatacgctcatacgccaatgggaattggatatatggagatgtcctgtgtatctccaatcgctacgtactacacgctaacctttacaccagtattctatttttaacattcatctccattgaccggtacctgataatcaagtaccccttccgtgagcacttgcttcaaaagaaggagttcgccattttaatctcactggccatttgggtgcttgtgactctcgaactgctacccatccttcctctcattaatcctgttatcacagacaacggcacaacatgtaatgactttgcatcctcaggtgatcctaattataacttgatctactctatgtgcctgacacttctcggctttctcatacccctgtttgtaatgtgttttttctactacaaaattgccctgttcctgaagcagagaaatcgccaagtagcaaccgcgctcccactcgagaagccactcaacctggtgatcatggccgtggtgatatttagtgtactatttaccccatatcatgttatgagaaacgtgaggattgccagtagactggggagttggaagcagtaccaatgcacccaggtcgttattaactctttctacattgttactaggcccctcgctttcctcaacagcgtgataaatccagttttctattttcttctgggcgatcacttcagggacatgttaatgaatcagctgcgacacaattttaagagtcttaccagtttctctagatgggcccacgagttactgcttagttttagggagaagtag

SEQ ID NO: 46617 - DNA, 1323 bp, Artificial Sequence
  Description of Artificial Sequence: Synthetic coding sequence
atggccagccccgtggccgcccaggccggcaagctgctgcgggccctggctctccgtcctagattcctcgcggccggttcacaggccgtgcaattgacgtcccgcagatggcttaatctccaggagtaccagagcaaaaagctaatgtcagataacggtgtgagggttcagcgcttttttgtcgcggatactgcgaacgaagccctggaagcggccaaaaggttaaatgcaaaggagatcgtgctcaaggcccagattctcgccgggggtcgtggaaagggggtctttaattccggcctaaaaggaggggttcacttaacgaaggatccaaacgtggtcggacagctggctaagcagatgataggatacaacctggccaccaagcagacccctaaggaaggagtcaaagttaacaaggtgatggtggcagaggctctggacattagccgtgaaacctaccttgcaatattgatggatcggtcttgcaatggacccgtgctcgtcggcagcccacagggcggcgtcgacattgaagaggtggccgcctccaaccctgaacttatctttaaagagcaaatcgacattttcgaaggcatcaaggatagtcaagctcaaagaatggccgaaaacctgggattcgtgggcccactgaagagtcaagccgcagatcagatcacgaaactttataacctgttcctaaagatcgatgccacgcaggtggaagttaatcctttcggcgaaacaccagaaggacaggttgtgtgcttcgacgccaagattaactttgatgacaacgcagagtttaggcagaaggacatctttgccatggatgacaagtccgagaacgaacctattgaaaacgaagcagcaaagtacgacctgaagtatatcgggctcgacggtaatatagcttgttttgtcaatggagccggactcgcaatggctacatgtgacataatttttcttaacggtggtaagcctgctaactttcttgacctcggaggcggggtgaaggaggcccaagtctaccaagctttcaagctcctcacggcagatcccaaagttgaagccattctcgtgaacatatttggtggaatcgtgaattgtgcaattatagctaatggcatcacgaaggcgtgtcgtgagctagagttaaaggttccgctcgtggtgcgtctagaagggacatttatggagaaaaagggttcatatatgcatataaaacaggagacagggaattcgaacgagaacattaccggcattcaggaaaacgtggcacatcagaatctcagcaaatgcgcaatcagcatctttttgtgctag

SEQ ID NO: 46618 - DNA, 1299 bp, Artificial Sequence
  Description of Artificial Sequence: Synthetic coding sequence
atggccagccccgtggccgcccaggccggcaagctgctgcgggccctagctctaagaccgcgctttcttgccgctgggagccaggctgtgcagttaacctcacggcggtggctcaacctgcaggagtatcagtctaagaaactaatgtcggacaacggggtgcgcgtgcaacggttcttcgtcgccgacacggccaacgaagccttagaggccgctaagcgccttaacgctaaagaaatcgttctgaaggcccaaatactcgccggaggtcggggaaagggcgttttcaactcaggcctcaaaggaggcgtacacctgacaaaagaccctaatgtagtcggccagctagctaaacaaatgatcggctataatctcgctactaaacagacccccaaagaaggggtgaaggtaaacaaggtcatggtggcggaggcgctggatatctccagggaaacttacctggcaattttaatggacaggagttgcaacgggccagttcttgtgggctcaccgcaaggcggcgtggacattgaagaagttgccgcctcaaacccagagctgatcttcaaagaacaaatcgacatttttgaaggcatcaaggacagccaggctcaacggatggccgagaacctaggctttgtgggccctttgaagtcacaggctgcagatcagatcaccaagctgtataacctatttcttaagatcgatgctactcaggtggaggtcaacccttttggagagacccccgaaggacaggttgtttgcttcgacgctaaaattaacttcgacgacaatgcagagttccgacaaaaggatattttcgcaatggatgataaaagtgagaacgagccgatcgagaatgaagccgccaagtacgacctaaagtatatcggcctagatggaaatattgcgtgctttgtgaatggggctggccttgcaatggctacgtgtgacatcatctttcttaatgggggaaaacctgccaacttcctcgacctgggaggcggcgtcaaagaggcgcaggtatatcaagcttttaaactccttacagccgaccctaaagttgaagcaatcctggtgaatatctttgggggcattgtcaactgtgccatcatcgcgaacgggatcacgaaagcgtgccgtgaattggagttgaaagtccccctggtggttcgtttagaggggacaaacgtgcaagaggcacaaaagatcttgaataatagtggcttgcctattaccagcgcaattgatctggaggacgccgcaaagaaggctgttgcaagcgttgctaaaaagtag

SEQ ID NO: 46619 - DNA, 753 bp, Artificial Sequence
  Description of Artificial Sequence: Synthetic coding sequence
atgagcgacaacggcgtgcgggtgcagcggttcttcgtggccgacactgctaatgaagctctagaggccgccaaaagactaaatgcgaaggagattgttcttaaagctcagattctggccggagggcgcgggaaaggagtgtttaactctggacttaagggaggggtccatctgaccaaggatcctaatgtggtggggcagctggcgaagcagatgatcggctacaatttagccacgaagcagacgcctaaggagggtgtgaaagtgaacaaggtgatggttgctgaggcgttggatatctccagagagacctaccttgcaatcctcatggatcgcagctgcaatgggccagtcctggtaggatcccctcaaggcggagtggatatcgaggaggtggccgcatctaatccggagctcatcttcaaggagcagattgacatcttcgaaggcattaaagattcccaggctcagaggatggctgaaaatctgggatttgtgggcccactgaaaagtcaagtcgaagccatcctggtgaatatatttggaggcattgtgaactgcgccatcatagccaatggcattaccaaggcctgtcgcgaactggagcttaaggtacccctggttgtgcgactcgaggggaccaacgtgcaagaggcacagaagatactcaacaatagcggactgcctataactagtgcaatcgatctggaggatgcagctaaaaaggctgtggccagtgtcgctaagaaatag

SEQ ID NO: 46620 - DNA, 642 bp, Artificial Sequence
  Description of Artificial Sequence: Synthetic coding sequence
atgttcggctggagcttcgtgttcgaggacttcgtgagcgacgagttgagaaacaaagcgacccagcctatgaagagcgtcctttggtggctgcctgtagagaaagccttttggcgtcagccggctgggcctgggtctgggattcgggaaaggctcgagcacccagtactccacgtcagttggaatgacgctagagcctattgtgcctggcggggcaaacgcctgccaaccgaggaagaatgggaattcgctgcccgcggcggacttaagggccaggtgtacccatggggaaactggtttcaaccaaatcggaccaacctttggcaggggaaatttccaaagggcgataaagcagaagacggctttcatggggtctccccagtgaacgccttcccagcacaaaacaattatggactatacgacctgctcggtaacgtgtgggaatggacagctagcccctatcaggcagcagagcaggatatgagagtcctcagaggcgccagttggatagacacagctgatggctccgcgaaccacagagccagggtgacaaccagaatggggaacacccccgatagtgcctccgacaacctggggttccggtgtgccgctgatgctggccgtccaccgggtgagttgtag

SEQ ID NO: 46621 - DNA, 1077 bp, Artificial Sequence
  Description of Artificial Sequence: Synthetic coding sequence
atgcgggcccacgcccagcggggccggggctgcacccggcggagcgcagccgtgctgatggccaggcacgggctgcctctgctaccgcttcttagcctccttgtgggggcctggttgaagctgggcaatggccaggccacctccatggtgcagctgcaggggggccgcttcctgatgggtactaattcaccggactcacgagatggcgacggccccgtgcgagaagccacagtcaagcccttcgcaattgacatttttcccgtgactaataaagactttagggattttgtgcgggagaagaagtaccggacagaggcggagatgtttgggtggagtttcgtgtttgaggacttcgtatccgatgaactccgaaacaaagctacacagccaatgaaatccgtcttgtggtggctacctgtcgagaaagctttttggcgtcagcccgcgggaccaggctctggcatccgcgagcggctggagcatcccgtgctgcacgtctcttggaacgatgcccgggcatactgcgcttggaggggtaagaggcttcctaccgaggaggagtgggagttcgcagccaggggcggcctgaaaggacaagtttacccttggggcaactggttccagcctaacagaacaaacctgtggcaggggaagttccccaagggggataaagcagaggacggcttccacggcgtgagcccagtgaatgcattcccagctcagaacaattacgggtgggccactttacaaatccagcctcagacaaccagcgtgagtgcagtactgcaaacacaagccggtcggcaagggagctgtaagcaacccggaggcgataaagagaagtctctgctaggcagcttgtctttccctggccacgtcgctaattccgctataccctctagcagggctagtgcctctggcaagaacttcccttttccggtgtcccaccccagtgtagccggggcctcccaccagggtagacgtggattaagcttgctctgtttcggcgagggtgcccagtgcgtgctcactatggctggcgggcaagtgtttctgctggaggccaagtattactag

SEQ ID NO: 46622 - DNA, 711 bp, Artificial Sequence
  Description of Artificial Sequence: Synthetic coding sequence
atgcgggcccacgcccagcggggccggggctgcacccggcggagcgctgcagtgcttatggcacggcatggactcccactcctgcccttgctgtcccttttggtgggcgcctggttgaagcttggaaacggacaggctaccagcatggtccaactccaggggggacgttttctgatggggaccaacagtcctgactctcgggacggtgacggcccagtccgggaggcaacggttaagccttttgcgatcgatatattcccagtgactaataaggacttcagggacttcgtacgggaaaagaagtaccggaccgaggcagaaatgtttgggtggtcttttgtgttcgaagatttcgtgtccgatgaacttaggaacaaggctactcagcccatgaaagggaaattcccgaagggggataaggccgaggatggctttcacggcgtgtctccggttaatgcttttccagcccaaaataattacggtctctacgacctgctgggtaatgtgtgggagtggacagcctccccctatcaggcggccgagcaggatatgcgggtcttgcgtggagcatcttggattgacaccgccgacggctcagcgaaccatagagcccgcgtcactactcgcatggggaatactcctgattccgcgtccgataacctgggattcagatgtgccgctgatgctggtcgtccccctggcgagctgtag

SEQ ID NO: 46623 - DNA, 918 bp, Artificial Sequence
  Description of Artificial Sequence: Synthetic coding sequence
atgcgggcccacgcccagcggggccggggctgcacccggcggagcgctgccgtgctcatggcgcgtcatggactgcctctgctccctcttttgtcactcctcgttggagcctggttgaaactgggcaacgggcaagctacatccatggtgcagttacagggaggcaggttcctgatgggcacaaacagccccgatagtcgagatggtgatgggcctgttcgcgaagctactgtcaagccttttgctattgacattttcccagttaccaataaggatttcagagacttcgtgagggagaagaagtacaggaccgaagctgagatgtttgggtggtcctttgtgttcgaagactttgtgtcggatgaattgcgcaataaagccacccaacctatgaagccagctggcccgggtagcggaatccgcgagaggttagaacatcctgtgttacacgtctcctggaatgacgctcgtgcatactgtgcctggagaggcaagagactccccaccgaggaggagtgggagttcgcagctcggggtggtctaaagggccaggtgtatccatgggggaattggtttcagcccaataggaccaatttgtggcagggcaaattccctaagggcgacaaggcggaagatggcttccacggcgtgtccccagttaatgcatttccagcccaaaacaattacggtctgtacgacctcctgggaaacgtttgggaatggaccgcgagcccttaccaggccgccgagcaggacatgagggtgctccgtggggcctcctggatagacactgcagacggcagtgcaaatcacagagcgagggtcaccacgcgaatggggaatacccctgattcagcatcagacaacttggggtttcgctgcgcggccgatgctggaaggccaccaggcgagttatag

SEQ ID NO: 46624 - DNA, 885 bp, Artificial Sequence
  Description of Artificial Sequence: Synthetic coding sequence
atgcgggcccacgcccagcggggccggggctgcacccggcggagcgccgccgtgctcatggcgcgacacgggctgccactgctccccctccttagcctcctggtgggcgcctggctaaagttgggaaacgggcaagccacgtctatggtccagttacaaggcggcaggttcctcatggggacaaacagccccgatagtagagacggtgacggccccgtgcgcgaggcaaccgtgaagcctttcgccattgatatcttcccggtgaccaacaaggactttaggtatatccgcgatttcgtacgggagaaaaagtatcggactgaggccgagatgtttggctggtcatttgtatttgaagatttcgtgagcgatgagctgaggaataaggccactcaaccaatgaaatccgtgttatggtggttacctgttgagaaggcattctggaggcagccggccggacctggttcaggtattcgggaaaggctggaacaccccgtgttacatgttagctggaatgatgcgcgggcatattgcgcttggaggggaaaacggctgccaacagaagaagagtgggagttcgccgctcggggggggttaaagggccaagtgtatccatggggtaactggtttcagcctaatcgcactaacctttggcaaggtaaattcccgaagggtgataaggctgaggacgggttccacggtgtcagcccagtgaacgcctttccggcacaaaacaactatgggttatacgatctgctggggaacgtgtgggaatggactgctagcccttatcaggctgcagagcaggacatgcgggtgctgcgcggagcgtcgtggattgatacagccgacggttctgccaaccaccgggctcgagtgacctag

SEQ ID NO: 46625 - DNA, 963 bp, Artificial Sequence
  Description of Artificial Sequence: Synthetic coding sequence
atgcgggcccacgcccagcggggccggggctgcacccggcggagcgctgcggtgttaatggcacgtcacggccttccacttctccctcttttatccttgctggtcggggcctggttgaagcttggtaacgggcaggctacctcaatggtgcaactgcagggtggcaggtttcttatgggtactaactctcctgacagccgagatggggacggtcccgtgagagaagccaccgttaagccatttgcgattgatattttcccagtcacaaataaggacttcagggacttcgtgcgggaaaagaagtaccgcacagaggctgagatgttcggctggagctttgtgttcgaagacttcgtgtctgatgaactccgtaacaaggcaactcaaccaatgaaatctgtgctttggtggctgcctgtggagaaagctttctggcgccaacccgccggcccagggagcgggattcgcgagaggctcgagcaccccgtcttgcacgtctcttggaacgatgcccgtgcgtactgtgcctggcgtggcaagcgtctgccaaccgaagaggagtgggaattcgcggcccgcggcgggcttaaagggcaggtctatccctggggtaactggttccagccaaatagaaccaatctgtggcaggggaagtttcctaagggcgataaggccgaggacggatttcatggtgtgtcccctgtcaacgcgtttccggcacaaaataactatggtctttatgatcttttgggaaatgtgtgggagtggacagccagcccctaccaggctgccgaacaggacatgagggtactgagaggcgcatcttggattgataccgctgacgggtcagccaatcacagagccagagtgaccacccgcatgggaaacacccctgattccgcctcggacaatctaggcttccgctgcgcagccgacgctgggaggccacctggagagctgtag

SEQ ID NO: 46626 - DNA, 1821 bp, Artificial Sequence
  Description of Artificial Sequence: Synthetic coding sequence
atggtgcggggcgcccggcagccccagcagccccggagccggctggcgccccggttaacagggaccgtagaaaaacccccacgcaagcgtcgctctaggacagaattcgccttaaaggagatcatgtcaagtggcggagctgaagatgatattccacagggggaacgtaagaccgtaactgatttctgctatctgcttgataagtctaaacagttgttcaatggactgcgggatctcccacagtacggacagaagcagtggcagtcatactttggccggacttttgacgtgtacaccaagctctggaaatttcagcagcaacacagacaggtgctggacaatagatatggcctgaaaagatggcagattggcgagatcgcctcaaaaatcggtcagctctactatcactattacctgagaacatctgagacgtcttacttgaacgaggccttttccttctactccgcaattcgccagcggtcatactatagccaagtcaataaagaggaccggccagagctggtggtgaagaaactccgctactatgctcgattcatagtggtgtgcctcttactcaataaaatggacgtggttaaagatctggttaaggaactcagcgatgagatcgaagactacacccacagatttaatacggaggatcaggtggagtggaatttggtcttgcaagaagtagccgcctttatagaagccgaccccgtgatggtgttaaacgatgataacacaatagtcataacttccaatagacttgccgagacgggagcgcccctgctggaacaagggatgatcgttggccagttatcattggccgacgccctgataattggcaattgcaacaaccaggtgaagttctccgagttaaccgttgacatgttccgaatgctccaggcactcgaacgagaacctatgaacttagcctctcagatgaacaagccgggtatgcaggaatccgcagataagcctacccgacgcgaaaatcctcataagtatttactgtataagcctacattctcccaattgtatacattccttgccgcgtccttcaaagagctccccgcaaattctgtgcttctgatttatctgtcggctactggcgtattccccaccggaaggagcgacagtgagggcccctatgactttggcggcgtgctcacaaacagtaacagagatatcataaatggagatgcgatccataagcgtaatcagagccataaggaaatgcactgcctccatcccggggacttgtatccatttacaaggaagcccctcttcatcatcgtggactccagtaactctgttgcgtacaagaacttcaccaatttgtttgggcagccattagtttgtttgctgagccccacagcctatccaaaagccctccaagaccagtcacagcgtgggagcttattcacactcttcctgaacaacccactcatggcgttcctgtttgtctcggggctgagctctatgagaagaggactctgggaaaaatgccaggaatacctgcggaagatcaatcgagacatcgcacagcttctgactcattcaagatccatcgatcaggccttcctacagttttttggggatgaatttctgagactcctccttaccagatttattttctgctccgcaacaatgcgaatgcacaagatctttcgcgagactcgcaattacccagagagctaccctcagcttccaagggatgagactgtcgaaaatcctcaccttcagaagcacattctagagttggcttcaatcttagacgtacgcaacgtgttctttgagaacactatcgatgactactag

SEQ ID NO: 46627 - DNA, 1890 bp, Artificial Sequence
  Description of Artificial Sequence: Synthetic coding sequence
atggtgcggggcgcccggcagccccagcagccccggagccggctggcaccgaggcttacgggaaccgttgagaaacctccccggaaaaggcgcagttctatcagggggagcggggacagctcccactctcaatctcaaggagaaagatatcaacactttacggaaaagacggagtttgcattgaaggagatcatgtcttctggaggggctgaagacgatataccacagggggagaggaagacggtgacagatttttgttatctgctggacaaatcaaagcagttatttaacggcctgcgagatttacctcaatatgggcagaaacagtggcaaagttatttcggtagaaccttcgatgtgtacaccaagttgtggaaattccagcagcagcatagacaggttcttgataaccggtatgggctgaaaagatggcagatcggagaaatagcctctaagattggacagctatattatcactattatctgaggacaagcgagactagttacctgaacgaagcatttagcttttatagcgctattagacaaagatcctactactctcaagtgaataaggaggaccgaccagagctggttgtaaagaagctgcgctactacgcgcgctttattgtggtgtgcctgttgctgaacaagatggatgttgtgaaagacctcgtgaaagaacttagtgatgagatcgaagactacacgcacagattcaataccgaagatcaggtggagtggaatcttgttttacaggaggtcgcagctttcattgaagctgatcctgtgatggttctgaatgatgataacacaattgtgataaccagcaaccgtctggccgagacaggcgcacccctactggagcagggtatgatcgtaggccagctgtcgctggccgatgccctaataatcggcaattgtaacaaccaggtgaaattcagtgagttaacagtggacatgttcaggatgctccaggctctggagcgcgaacctatgaacttagccagccagatgaataagcctggcatgcaagagagcgccgacaaacctacccgaagggaaaaccctcacaaatacttgctgtataagccaaccttttctcagctgtataccttcctcgccgcctcttttaaggaactacccgccaatagtgtgctgctcatttacctgagtgcaaccggggtgttccccaccggtcgatccgactctgagggaccttatgactttgggggggtcctcaccaactccaacagagacatcattaacggagacgctattcataaaaggaaccagagccataaagagatgcattgcctgcaccccggcgacctgtatccctttacccggaaaccccttttcattattgtggacagcagcaattcagtggcatacaaaaactttaccaatctatttggccagcctttagtgtgtcttctttctcctactgcttatccaaaggctctgcaggatcagtcacagcggggcagtctgttcacacttttcctcaataatcctctgatggctttcctcttcgtctcagggttgtcatctatgcggcgcggattatgggaaaaatgtcaagaatatttacgcaagattaatagagatattgctcagcttttaacacattcgcgcagcattgatcaggcattcctacagttctttggcgatgagttcctgaggctactcttgaccaggtttattttttgctcggcaacaatgaggatgcacaagatctttagggagactaggaattaccctgagtcttacccccagcttcccagggacgagaccgtggaaaaccctcatctacagaagcatattctcgaactggcaagcatattggacgtgcgcaatgtgttcttcgagaatactatcgatgattattag

SEQ ID NO: 46628 - DNA, 1746 bp, Artificial Sequence
  Description of Artificial Sequence: Synthetic coding sequence
atggtgttccggaacgtgggccggccccccgaggaggaggacgtggaagccgcacctgaaccggggccctccgaactcctgtgccctcggcatcggtgtgcattggatcctaaggccctgccacctggtctggccctggagaggacctggggcccagccgccggtcttgaggcacagctcgccgccctcggtctgggccagccagctggccctggagtgaagacagtcggcggaggatgctgcccgtgtccttgcccgcctcaaccgccacccccacagcctcagccacccgccgccgctccccaggctggggaagatccaacagagacatccgatgcccttctcgtactggagggactagagtcggaggctgagtctttagaaacaaacagttgctctgaagaggaactcagctcccctggaaggggcggcggcggcggagggaggcttctgctgcagcccccaggaccggagctgcctcccgtaccattccctctgcaggacctggtgccccttgggcgcctctcaaggggcgagcagcaacagcagcaacaacaacagcctcctccccccccgccccctcctgggccacttaggcctctggctggtcccagcagaaagggatccttcaaaataagactgagtcgtctcttcaggaccaagtcttgtaacggtggatctggggggggcgatgggaccggcaagaggccttcaggggaactggcagctagcgccgcttctctgaccgatatgggagggtcagccggacgagaactagatgctggtcgaaaacctaaactgacacgaacgcaaagtgccttctcccccgtgtctttctcaccacttttcacgggtgaaacagtctcactggtcgacgtggacatcagccaaaggggattgacatcaccgcatccaccaacccctccaccaccaccaaggcgtagcttgtcgttactggatgacatctccggaaccctgccaacaagcgtgctggtggctcctatgggatctagcttgcagagctttcccctacctccccccccgcctccacatgcaccagacgcgtttccacgcatcgcaccaatcagagccgctgagtccctccatagtcagccaccacagcatctgcagtgccccctttaccggccagattccagctctttcgcagctagccttcgcgagctagagaagtgcgggtggtattggggaccaatgaactgggaagatgccgaaatgaagttgaaaggtaagcccgatggaagctttctcgtgcgagactcctccgacccccgctatatactatccctgtccttccgctctcaaggcattactcatcacacccgaatggaacattacaggggtacgttcagcttatggtgccaccctaaatttgaggatcgttgccagtccgtggtggagtttattaagcgggcgatcatgcacagtaaaaatggaaagttcctttacttcctccggtccagagtccccggactccctcccacccccgtccaattgctttaccctgtgtccaggttctcaaacgtgaaaagcctccaacacctgtgccgtttcaggatccggcagctggtgaggattgaccatatccccgatctgccactgcccaaacctctgatcagctacatacggaagttttactattacgacccccaagaagaggtatatctatctctcaaggaggcacagcttatcagcaaacagaaacaggaagtggaacctagcacatag

SEQ ID NO: 46629 - DNA, 1746 bp, Artificial Sequence
  Description of Artificial Sequence: Synthetic coding sequence
atggtgttccggaacgtgggccggccccccgaggaggaggacgtggaggccgcgcctgagcccggtccatccgaactgctgtgtccgcgccatcggtgcgcattggaccccaaggcactgccaccaggcctggccctggaacgcacatggggaccagctgccggactggaagcccagcttgcagccctgggcctgggccagccagctgggcccggggttaagactgtaggcgggggatgttgtccctgtccgtgcccaccacagccgcccccaccccagccacagccgcctgccgcagcaccccaggcaggcgaggacccaaccgaaacctccgatgcgctgcttgtcttggagggtctggagagtgaagcagagtctttggagactaactcatgcagcgaagaagagctctcatcacctggtcgcggcgggggaggtggcggacgtttactcctacaacctcccggtcccgagctgccacctgtcccatttcctctccaagacctcgtgcccctcgggagactgagtcggggtgagcagcagcagcagcagcagcaacagccgcccccgcccccaccaccccctggccctctgagacccctggccggtccttcaagaaaaggctctttcaaaatcagactcagccgattgttccgtactaagagctgcaacggcggctctggaggtggggacggaactgggaagcgcccatctggggaactggccgcctcagctgcgtcgctgactgatatgggagggtctgctggaagggagctcgacgcaggacgaaaaccaaaacttacccggactcagtctgcattttcccccgtgagcttctccccactgtttaccggcgagaccgtatcactagtcgacgttgatatttcccagcgcggccttaccagtcctcatccccctacacccccaccgcccccaagacgttctctctccctgttggatgatattagtggcacgcttcccacatccgtgctcgtggccccaatgggctcctcactgcagtctttccctctgccacctcctccccccccccatgctccggatgcctttcccagaattgcgcctatccgggcggcagaaagcctgcactctcagccgcctcagcacctacagtgtcccctatacagacccgacagttcctcgttcgcagcctctcttcgcgaacttgagaaatgtggctggtactggggccctatgaactgggaagatgccgaaatgaagctgaaaggtaaacctgatgggagtttcctggtgagagactcttccgacccccgctacatacttagtcttagctttcggtcccagggtattacccaccacacacgcatggaacactaccgcggtactttctccctgtggtgccaccctaaatttgaggataggtgccagtccgttgtggagtttataaagagggccattatgcattctaaaaacggaaagtttctctactttctaaggagtcgcgtgcctgggttaccaccgacaccagtgcagctcctctaccctgttagtagattctctaatgtaaagtcgcttcagcacctgtgtcgatttaggattcgacaattggtgagaattgatcatatccccgacctgccgctgcctaaacccttgattagttacataagaaagttctactattacgatccacaggaggaagtctatttgtcgctgaaggaagcccagctgataagtaaacaaaagcaggaagttgaaccgtctacctag

SEQ ID NO: 46630 - DNA, 2169 bp, Artificial Sequence
  Description of Artificial Sequence: Synthetic coding sequence
atgggccggggcccctgggacgccggccccagccggcggctgctgccattgctgcttctgttaggattggcaagaggcgccgcgggggcaccggggcccgacgggctggatgtgtgcgcaacgtgtcatgaacacgccacttgccaacaaagagaagggaaaaagatttgtatttgtaactatggctttgtgggcaatggacgaacacaatgcgtggataagaacgagtgtcagttcggtgcaaccttagtgtgcggcaaccatacctcgtgccacaatactccgggaggtttttactgtatctgtctggagggatatagagccactaacaataataagacattcattcctaacgacggcacgttctgtactgatatagacgagtgtgaggtaagcggcttgtgccgtcacggcggtagatgtgtgaatacacatggcagcttcgagtgctactgcatggatgggtatctgcccaggaatgggccggaaccattccaccctactacagacgcaacttcctgtacagagatcgattgtgggacacccccagaagtgcccgacgggtacatcatcggtaattacactagctctttggggtcacaggtgaggtacgcctgccgtgagggatttttcagcgtccccgaagacactgtgtcgtcctgtaccggccttgggacgtgggaatctccaaaactccactgccaggagatcaattgcggaaacccccccgagatgcggcatgctattctggtgggaaaccactcctctcggctggggggagtggcgcgctacgtgtgccaggaaggttttgagtctcctggaggcaaaattacctccgtgtgcaccgaaaagggtacatggcgcgagagtacactgacctgcacagagatactgactaagattaacgatgtgtcgttgtttaatgatacctgtgttaggtggcagatcaattccagaagaattaacccaaagatttcttatgtgatctctatcaaagggcaacggctggatccaatggaatcagtgcgcgaggagacagtaaacctaaccacagattcacgaacccccgaggtctgccttgcactttatccaggtactaactatacagtgaatattagtactgcgcctccacgcagaagcatgcccgccgtgattgggttccagacggctgaagtggacttactggaggatgacggcagttttaatatctccatctttaatgaaacttgcctgaaactcaaccgtcggagtcgaaaggtgggatctgagcacatgtaccagttcaccgtgctgggccaacgctggtatctggctaacttcagtcacgccacgagttttaattttacgactcgagagcaggtgccagtggtatgcctggacttatatcctactaccgactacacggtgaatgtaactctccttcggagcccaaagcgccacagcgtgcaaataactattgccactcctcctgccgtgaaacaaacaatcagcaatatcagcggcttcaatgaaacctgcctaagatggcgctccattaaaacggctgacatggaagaaatgtacttgtttcacatttggggccagagatggtaccaaaaggaattcgcacaggagatgacctttaatatctccagtagctccagagatcctgaagtttgtttggatctgcgccctgggacaaattacaatgtgagcctgcgggccctgtctagtgagctccctgtggtgatttctcttacaacccaaattacggagccgcccctcccagaggttgaattctttactgtacatcgcggtccactgcctaggctgcgtctcaggaaggcaaaggagaaaaatggcccaattagttcttaccaagtcctggtgctgcccctcgccttgcaatctacattcagttgcgactccgagggggcctccagctttttctccaatgcatcagatgccgatgggtacgtagcagccgaactgctcgcgaaagatgttccagatgacgcgatggagatcccaattggggatcgtctatactacggagagtactacaacgctcctttgaaacggggctcagattactgcattatccttagaattacttcagagtggaataagatcaggcattcatgttgctgcaggtggagggtcctcgactgggtcccgtggctcctctag

SEQ ID NO: 46631 - DNA, 2274 bp, Artificial Sequence
  Description of Artificial Sequence: Synthetic coding sequence
atgggccggggcccctgggacgccggccccagccggcggctgctgcctctgctattgctgctcggacttgcacgtggcgctgccggcgccccagggcccgatggactcgatgtttgtgctacatgccacgaacacgccacatgccagcaaagggaaggcaaaaaaatatgcatctgtaactacggcttcgtggggaatggaagaacccagtgcgtggataaaaatgaatgccaatttggcgcaacgctcgtttgtggaaatcacacatcgtgccacaatacccccggagggttctattgcatctgcctcgaggggtatagagccacgaataacaacaagacatttattccaaatgatggtacgttctgtaccgacattgacgaatgcgaggtcagcggcctctgtcgacacggaggtcgttgcgtcaatacccacggttcttttgagtgctactgtatggatggctatctgcctcggaatggccctgaaccctttcatccaactaccgacgcaacaagctgcacggagattgattgcgggaccccgccggaggtccccgatggatatattatcggcaactacacctcctccctgggcagccaggtgcgctacgcatgccgagaagggtttttttcagttccagaggacaccgtcagctcttgcaccggtctggggacatgggagtccccaaaactccattgtcaggagattaattgcgggaacccccctgagatgaggcacgccatccttgtgggaaatcactctagtaggttggggggagtggcccgatacgtctgtcaggaggggtttgagagtcccggtggaaaaattacaagtgtgtgcaccgaaaaaggcacctggagagagtccactcttacttgcaccgagatcctgactaaaattaatgacgtgtctttatttaacgacacctgcgtgcggtggcagatcaactctagaaggataaaccctaagatctcctacgtaatatctataaagggccagcgcctagaccccatggaatctgtccgagaggagactgtaaacctgactacagattcacgaacccctgaggtctgcctcgctctttatcctggtactaactataccgtgaacatttcaaccgcccctccacgccgatcaatgcccgcggtcattggatttcagacggcggaggtggacttgctagaggacgatggttctttcaacatctctatcttcaacgagacatgcctgaaacttaaccgccggtctcgaaaggtgggttctgaacacatgtaccagttcaccgtccttggccagcggtggtacttggcaaacttttcacatgcaacgagctttaactttactacccgggaacaggtgcccgttgtttgcttggatctgtaccccacaacagactacacagtcaatgtaactctattaagatctccaaagagacattccgtgcagattactatcgccacgccacccgctgttaagcagacgatatccaacatcagcggctttaacgaaacgtgccttaggtggcggtccataaagaccgcggacatggaggaaatgtacctgttccacatctggggccagcgctggtaccagaaggagtttgctcaggagatgacatttaacatcagtagtagtagtagggatccagaagtctgtttggatctgcggcctgggacgaattacaatgtcagcctcagagccctgagtagcgagttacctgtggtgatttcgctgacaacccagattaccgaaccgcctttgccggaggtggagtttttcaccgtacaccgcggccccctgccccggcttcggctacgcaaagctaaggagaagaacgggcccataagtagctaccaggttctggtcttacccctcgcacttcagagtacattctcttgcgactctgagggggcctccagttttttctccaatgctagtgacgcggacggttacgtggcggccgagctgctggcaaaggatgtgccagacgacgccatggagattcctattggagaccgcctgtactacggggagtattacaacgctccgctgaagcgaggatccgattattgtattattctgaggattacttccgaatggaacaaggtgcgcagacacagctgtgccgtgtgggcccaggtgaaagaaattccttgcaactgcaatttcctgcgactgcacatacatcgagccaacagcggcgatacccagatccggcactcatgttgttgtagatggcgtgttctagattgggtgccatggctcctgtag

SEQ ID NO: 46632 - DNA, 2244 bp, Artificial Sequence
  Description of Artificial Sequence: Synthetic coding sequence
atgggccggggcccctgggacgccggccccagccggcggctgctgccccttctcctgctgcttgggctggcacgaggtgcagctggagcccccggcccagacgggttagacgtttgcgccacctgtcacgagcacgctacatgtcagcagcgggaaggcaagaaaatctgtatctgtaactatggctttgtgggaaacggacgaactcaatgcgtcgacaagaacgaatgtcagtttggtgcaacactggtctgtggaaatcatacatcttgccacaacacccccggggggttctactgcatatgcctcgagggttatcgcgcaaccaacaataacaaaaccttcattccaaacgatggcaccttttgtacagatatagacgagtgcgaagtgtccggtttgtgtcgtcatggtggacgctgcgtcaacacgcacggaagctttgaatgttattgtatggatggttacttgccccggaatgggccggagccatttcaccctacaacagacgctacttcttgcacagagattgactgcggaacccctcctgaggtcccagatgggtacataatcgggaactatacatcctcgctggggtcacaagttcggtatgcctgtcgagaaggtttcttcagcgtgcccgaggatacagtgtcaagctgcacaggactgggtacgtgggagtcacccaaactccattgtcaggagattaactgtggaaatccaccagagatgcgtcatgcaatactcgtgggaaatcattcttctcggctcggcggcgtggcccggtatgtgtgtcaggaaggatttgagagccctggcggaaaaattacaagtgtgtgcaccgagaaagggacatggcgggaatccactcttacctgtactgaaattttaacaaaaatcaacgatgtatccctgtttaatgacacatgcgtgcgatggcagatcaactcgagacggatcaaccccaagatcagctatgtgatctcaattaaggggcagaggcttgatcccatggaaagcgttagggaggagacagtgaacctgaccactgatagtcgcacgcctgaagtctgcctcgccctgtatcctgggacaaactatacggtgaacatcagtactgcaccaccccggaggagtatgcctgcagtgattggattccagacagccgaggtggatctgctggaggacgatgggtcttttaatatttcaatcttcaacgaaacctgcctaaagctgaaccgtaggtcaagaaaagtgggaagcgagcacatgtatcagttcactgtgctaggacaaagatggtatctggcaaacttttcgcatgccacttcttttaactttacgacaagagagcaggtacctgtggtctgcctggacctgtaccccactacagactacacagttaacgtgaccctgctgaggagtccaaagcggcacagcgtgcaaatcactattgccacaccaccggccgtaaaacaaactatctccaatataagcggcttcaatgagacatgccttagatggcgctctatcaagactgcggacatggaggagatgtacctgtttcacatttgggggcagcggtggtaccagaaagaatttgctcaggagatgacatttaatatttcatcaagcagtagggaccccgaggtgtgcctggatctcagacctgggacaaactacaacgtgtccttgagagctttgtcgtcagagctgcccgttgtcatatctctgacaacgcaaatcaccgagccccccctgccagaggtggagttctttacggtacaccgcggccccctcccaaggctccgcctgcgcaaggcaaaagaaaaaaatggccccattagttcttaccaggtgcttgtcctgcccttagcacttcaatctacattcagctgtgactctgagggtgcctcgtcttttttcagtaatgccagtgacgcagacgggtacgtcgctgctgagctgcttgccaaagacgttccagatgacgccatggagatacctatcggtgaccgcttgtattacggagaatattacaacgccccccttaagcgaggctctgactattgtatcatcctacgaatcacctcagagtggaataaggtgcgccggcactcctgtgccgtgtgggcccaggtaaaagacagcagtttgatgctcctgcagatggctggagtaggcctggggtcgctagcagtggtgatcatattgactttccttagtttcagcgccgtttag

SEQ ID NO: 46633 - DNA, 2469 bp, Artificial Sequence
  Description of Artificial Sequence: Synthetic coding sequence
atgaagcccgccctgctgccctgggccctgctgctgctggccaccgctctcggacccggtccaggtccgacagccgatgcgcaagagtcttgtagcatgagatgcggggccctggatggtccctgctcttgtcaccctacctgttccggactggggacttgttgcctagatttccgagacttttgcctggaaatcctgccatacagtggctccatgatgggcggcaaggacttcgtggtgagacacttcaagatgtctagcccgacagacgcctcagtcatttgtcggtttaaagactccattcaaacgttaggacatgtggactcttccgggcaggtccactgcgtgagtccgctgctctacgaatctggccgaatcccattcacagtctccctggataacggccactcctttcctcgggctggaacctggctagctgtgcaccccaacaaggtgtcaatgatggagaagtccgagttagtcaacgagactcgctggcaatactatgggactgccaatactagtggcaatctctctctgacatggcatgtcaagagccttcccacccagaccatcaccatcgagctgtggggctacgaagagaccggtatgccgtattcccaggaatggacggcgaaatggagctatttatacccactggccactcatataccgaatagcggcagtttcactttcacccccaaaccagctccaccgagttatcaaaggtggagggtgggcgcccttcgcatcatcgattcaaagaactatgcaggtcagaaagatgtccaggccctttggaccaatgaccatgccctggcttggcacctcagcgacgacttcagggaggaccccgttgcatgggctcggactcagtgtcaggcatgggaggagctagaggatcagttgcccaactttcttgaggaactacctgattgcccctgcactttaacacaggccagagctgactccgggcgtttcttcactgattacgggtgcgatatggagcagggttccgtgtgcacttaccaccctggggcagtccattgcgtgaggagtgtacaagcctccctgcgttacgggtccggccaacagtgttgttatactgcggatggcacgcagctgctgactgccgactctagcggtgggagtacccccgacaggggtcacgactggggggccccaccctttcgcactccgccccgggtaccatcaatgtcccactggctgtatgacgtcctcagcttttattactgctgtctctgggcccctgattgcccacgatacatgcagcgcagaccctctaacgactgtagaaactataggccaccccggctcgccagcgcgttcggagaccctcactttgtgacctttgatgggactaatttcacttttaacggcagaggagagtatgtgctgctggaagccgctctcaccgatctgcgcgtgcaagcacgtgctcagccagggaccatgagcaatggaaccgagaccaggggaaccgggttaacggcagtggctgtgcaggagggcaacagcgacgtcgtggaagtccgactcgcgaatcggaccggcggactggaggtcctactgaatcaggaggtgctttcctttaccgagcagtcctggatggacctcaagggcatgtttctgagcgtagcagccggagacagagttagtattatgctggcctctggcgcaggcctggaggtctccgtgcaggggccttttctaagtgtttcagttctgttgcccgagaagtttctcactcacacacatggcctcttgggcacgctcaacaatgatcccacagacgacttcaccctgcatagtggacgcgtccttccgcccgggactagcccgcaggaacttttcttgttcggcgctaattggacagttcataacgctagcagcctgctcacctatgactcatggttccttgttcacaactttctgtaccagcccaagcatgatcccacttttgagcctctcttcccctccgaaacaactttgaatccttcacttgcacaggaagccgcgaaactctgtggggacgatcacttctgcaatttcgatgtagccgccactggctcactgtctacaggtaccgctactcgggttgcacaccaattgcaccaaaggcggatgcagtctcttcagcctgtcgtttcctgcggatggctggccccgcctccaaatggccagaaggaagggaacagatatctggccggcagcaccatctacttccactgcgacaacgggtattcacttgccggcgccgagacctcaacctgccaggccgatggtacatggagctctccgacacccaaatgtcagcctggtcggtcttacgcagtcctgctcggtattatctttggcggcctcgctgtggtggccgcggtggccttggtttacgtgctgctgagacgccgaaaaggcaatacccacgtatggggcgctcagccttag

SEQ ID NO: 46634 - DNA, 729 bp, Artificial Sequence
  Description of Artificial Sequence: Synthetic coding sequence
atgaagaacatcggcctggtgatggagtgggagatccccgagatcatttgtacttgcgcaaaactgcgtttgccaccgcaggctacatttcaggttctgcgcggtaatggggcatctgtcggtactgtgctgatgtttagatgtccctctaaccatcagatggtcggtagcggactgctgacgtgtacttggaaaggatctatcgccgagtggtcatcagggagccctgtttgcaaacttgtccccccacacgaaaccttcgggttcaaagtggccgttatagctagcatagtgtcctgcgctatcatcctcttgatgagcatggctttccttacttgttgtctcctgaagtgtgtgaagaagtcaaagcgaaggagatctaaccggtctgcccagctttggagtcagctgaaagatgaagacttagagactgtgcaggccgcctacctgggactaaaacactttaacaagcctgtgtctggcccgtcgcaggcccacgataatcattcatttacgaccgatcacggggaatccacgtcgaaactggcctcagtcactcgctcggtcgacaaggatcctggcatacctagggctttgagtctgagcggcagctctagcagccctcaggcccaggttatggtacacatggctaatcctcggcaaccacttcctgcctctgggctggccactggcatgcctcagcagccagcggcctatgccctcggctag

SEQ ID NO: 46635 - DNA, 768 bp, Artificial Sequence
  Description of Artificial Sequence: Synthetic coding sequence
atgcggtgggccgccgccaccctgcggggcaaggcccggccccggggaagggccggagtaacaactccggcccccgggaatcgtaccggtacatgcgccaaacttaggctgccacctcaggccacctttcaggtactacgggggaatggtgccagcgttggcacggttcttatgtttaggtgcccttctaatcaccagatggtgggttcagggctgttaacgtgcacatggaagggcagcatcgccgagtggagcagtggatctcccgtgtgcaaacttgtgccgcctcacgagactttcgggttcaaagtcgccgtgattgcttccatcgtaagctgcgcaataatcctgctgatgtctatggcatttcttacatgctgcttgcttaaatgcgttaaaaagtctaagcggaggaggtccaatcggagcgcccaactctggtcgcagctcaaagacgaggaccttgagacagtacaggcagcctacctaggacttaagcacttcaataagccagtgtcgggaccctcccaagcccatgataatcatagttttacaactgatcacggcgagtccacctcaaagcttgcgtccgttactcgtagtgtcgacaaagaccctgggatcccacgggctctgagcctgtccggctcctccagcagtccccaggcccaggtgatggttcatatggcaaaccctaggcagcctctgccagcatccggactcgctaccggaatgccacaacagcccgccgcctatgctctcggatag

SEQ ID NO: 46636 - DNA, 711 bp, Artificial Sequence
  Description of Artificial Sequence: Synthetic coding sequence
atgtaccacggcatgaaccccagcaacggcgacggcttcctggagcaacagcagcagcagcagcagccccagtctccccagcgcctgctggcggtgatcctgtggttccagttagccctttgctttggccctgctcagctgactggcggctttgacgacctgcaggtatgtgcagacccaggaatccccgaaaacgggttcaggaccccatccggaggggtgttctttgagggtagcgtggcccgctttcactgccaggatggatttaaacttaaaggcgctactaaacggctatgcctcaagcatttcaatggtacacttggctggatcccctctgacaacagcatttgtgtacaagaggattgtcgcataccccagatcgaggatgccgaaatccacaacaaaacttacagacacggcgaaaagctgatcattacctgccatgaaggctttaagatacggtaccccgatctgcacaatatggtttcactttgtagagacgatggaacctggaataacctgcccatatgccagggctgcttacgccctttggctcctcagcacacacctgctcagggcacgcgaactcaagcccaaggctctcagaagcccgtcaccgccagtcaggcactgctttcttgttctaaggtctgtattcaccttccaggggcaaagagagctcctacactgctacggacaactttgacatag

SEQ ID NO: 46637 - DNA, 321 bp, Artificial Sequence
  Description of Artificial Sequence: Synthetic coding sequence
atgtaccacggcatgaaccccagcaacggcgacggcttcctggagcaacagcaacagcaacagcagcctcagagtccgcaaagactgctggccgtgatcctttggtttcagttggccctctgctttggccctgctcagcttaccggtgtccacctgacacgcgatctgttagggttcgagggctgccccgagtgcccccctccaccaggctttaaggaggaatcccaagagtttgcccagcaggttaccccactgcgttctctgacccacgcaaacccatggagctcgggacccctttgcattcccaaatcctggtcatag

SEQ ID NO: 46638 - DNA, 1473 bp, Artificial Sequence
  Description of Artificial Sequence: Synthetic coding sequence
atgtaccacggcatgaaccccagcaacggcgacggcttcctggagcaacagcagcagcaacagcagccccagtctccccagcggttactggccgtgatcctgtggttccagttggccctgtgtttcggtcccgcgcagctgacagggggatttgatgacctgcaggtgtgtgcagatcccggaatcccggaaaacggctttcgcacaccaagcggtggggtgttttttgaaggttccgttgccagatttcactgccaggacggcttcaaattgaagggagccactaagaggctttgcctgaaacatttcaatggcacacttggctggattccgtccgacaactcgatctgtgtacaggaagactgtcgcatccctcaaattgaggacgctgagatacacaataaaacgtatagacatggtgagaagctgatcatcacttgccacgaagggttcaaaatccgctaccctgatctgcacaatatggtttccttgtgtcgggacgacggcacgtggaacaatctgccgatctgccaaggatgtctccgccccctggcaagttctaacgggtatgttaacatttctgaactgcagacttcattccccgtgggcactgtgattagctacagatgttttcctggctttaagctggatggatcagcgtacctggagtgtctccaaaacttaatatggagctcctctccaccgcggtgcctcgctctagaggtctgtccactgccaccgatggtatcacatggagacttcgtatgtcatccacgcccatgtgagcggtataaccatggcaccgtggtagagttttattgtgatcccggttattctctcacaagtgactacaagtatatcacttgtcaatacggagagtggttcccatcctatcaggtctactgtattaagagcgagcagacctggcccagtacccacgaaactctgttaacaacctggaaaatagttgcttttaccgcgacaagtgtgctactcgtgttactgttagtgatcctggcgaggatgttccagactaagtttaaggcacatttcccaccaagaggcccgccacgtagcagctcatccgaccctgattttgtggtggtggacggagtccctgtgatgctgcccagttatgatgaagcggtgtctgggggcctgtcagccctggggcctggctatatggcctcagtgggccagggttgcccgctccccgtcgatgatcagtctccccccgcataccccggcagtggggacaccgacacaggacctggcgagtcagaaacatgcgatagtgtgtctggctcgagcgagctcctacagagcttatattcgcccccgcgctgtcaggaaagtacacatccagcatccgataatccagacatcatcgcttccaccgctgaggaggtagcaagcacttcacccggcatcgatatcgctgacgaaatccctctgatggaagaggacccctag

SEQ ID NO: 46639 - DNA, 873 bp, Artificial Sequence
  Description of Artificial Sequence: Synthetic coding sequence
atgtaccacggcatgaaccccagcaacggcgacggcttcctggagcaacagcagcaacagcaacaaccccaaagccctcagcgcctgcttgctgtgatcctctggtttcagctcgccctctgtttcggcccagcgcaactgaccggcggttttgatgacctgcaagtgtgtgcggatcccggaatcccagagaatggcttccgtaccccaagcggaggggttttctttgagggatccgtggccagattccactgtcaggatggctttaagctcaaaggcgccactaagagactgtgccttaaacactttaatggcaccttgggctggatcccttccgataacagcatctgcgtgcaagaggattgtcggattccgcaaatagaagacgccgagatacacaataaaacctacagacatggggaaaagctcatcataacgtgccacgagggcttcaaaatccggtatcccgacctccataacatggtgtctctctgccgggacgatggcacctggaacaatcttcccatttgccagggttgtctgcggccactggcgagcagtaatggctacgtgaacattagcgaactccaaacgtcctttccggttgggacggtgatcagttatcgatgcttcccgggattcaagctggacggaagcgcttacctcgagtgtttgcagaacctcatatggtcctcctccccaccacgatgtctggcattagagggcggaaggccagagcatctgttccccgtcttgtattttcctcatatccggctggccgcagccgtactttacttttgtccagtactgaaaagttccccaacccccgcacctacctgttcttcgacctctacaactacctctctgttttag

SEQ ID NO: 46640 - DNA, 321 bp, Artificial Sequence
  Description of Artificial Sequence: Synthetic coding sequence
atgtaccacggcatgaaccccagcaacggcgacggcttcctggagcagcaacaacagcagcaacagcctcagtctccccagcgactgctggcagtgatcttatggtttcagctcgctttgtgttttggccccgcccagttgaccggtgttcatttgacccgggaccttcttggatttgagggctgcccagaatgcccccccccccctggattcaaagaagagtctcaggagttcgcacaacaagttaccccgctgcgcagcctgacacatgccaacccatggtcgagcgggcctttgtgtattccgaagtcatggtcgtag

SEQ ID NO: 46641 - DNA, 1473 bp, Artificial Sequence
  Description of Artificial Sequence: Synthetic coding sequence
atgtaccacggcatgaaccccagcaacggcgacggcttcctggagcagcagcagcagcagcagcagccccagtccccacagaggctgcttgccgtcatcctttggttccagctcgcgttgtgcttcgggcctgcgcagttgaccggcggttttgatgacctacaggtctgcgccgatcctgggatacccgaaaacggtttccgaacaccttcaggaggggtgttttttgaggggtctgttgcacggtttcattgtcaggacgggttcaaactcaaaggcgctaccaaacggttgtgcctgaaacattttaatggaactctgggctggattcctagcgacaatagcatctgcgtgcaagaggactgtcgcatccctcagatcgaagatgccgaaatccacaataaaacgtatagacacggggaaaagctcataattacatgtcacgagggcttcaaaattagatatccagacctccacaatatggtgtccctctgtcgcgatgacggaacttggaataacctgcctatttgccaagggtgcctgcgcccactggcctcctctaatgggtacgtcaacatatccgagctgcaaacttcatttccggtgggtacagtgatctcataccgctgcttcccaggttttaagctagatggctcggcatacttggaatgtcttcagaaccttatctggtcctctagccctccccggtgtttggccctggaggtgtgtccattgccccccatggtttcccacggcgacttcgtgtgtcaccccaggccctgtgagcggtataatcacggtactgtggtagaattttactgcgatccgggatattccttaacctctgattacaaatatatcacttgccagtatggagagtggtttccctcctatcaggtctactgtattaagagcgagcagacttggccatcaacacacgagaccttgctcaccacatggaaaatcgtcgcatttacagctacatccgtgttacttgtgcttctgcttgtcattctcgcccgaatgttccagactaagtttaaagcccacttcccaccccggggccctcctcgttcctcttctagcgatccagattttgttgtggttgatggggtgcccgtcatgcttccatcctacgacgaggccgtgtctgggggactgtctgcccttggcccgggatacatggcctctgtgggccaggggtgtcctcttccagtcgacgaccagtcgccccccgcttatcctggttcaggagatacggacaccggacccggggaaagtgagacatgtgattccgttagcggctcctcagaactgcttcagtctctctacagtccacctagatgtcaggagtcaacccaccccgccagtgacaaccccgacatcatcgccagcacagccgaagaggtggcctccacgtctcctggcatcgacatagccgatgagattccgctgatggaagaagacccctag

SEQ ID NO: 46642 - DNA, 993 bp, Artificial Sequence
  Description of Artificial Sequence: Synthetic coding sequence
atggtgagcctgtgccgggacgacggcacctggaacaacctgcccatatgccaggggtgcctgcgacccctagccagctctaacgggtatgtcaatatcagcgaacttcaaacctctttccccgtgggtactgtgatctcataccggtgctttcccgggtttaaactggatgggtcagcataccttgagtgcttgcaaaacctaatttggtctagttctcccccacggtgcttggcccttgaagtatgtcccctgccacctatggtatcgcacggcgattttgtctgccaccctcgaccttgcgaacgctataatcacgggacagtagtggaattttactgtgatccaggatattctctgacgtccgattataagtacattacctgtcagtacggagagtggttcccaagttaccaggtttattgcattaaatccgaacagacctggccctcaactcacgagacactgctaacaacttggaaaattgttgcgttcacagccacatccgtcctgcttgtgcttctgctggtgatcttggcaagaatgttccaaaccaagtttaaagctcatttcccgcctagaggcccgccacgtagctcatcatccgaccccgattttgtggtggtcgatggagtccccgtgatgctgcctagttatgatgaggcagtgtcaggcggcctcagtgccttaggtccgggatacatggcctcagtggggcagggttgccccctgcccgtcgacgatcagtccccacccgcctaccccggcagcggtgatacagacaccgggcccggcgaatctgagacgtgtgactccgtgtccggctcctctgaactcctgcaatccttgtactcaccccctcggtgtcaggagagtactcacccggcctctgataatcccgacattatcgcgtccaccgccgaggaggttgctagcacaagtccaggaatcgatatagctgacgaaatacctctgatggaggaggatccttag

SEQ ID NO: 46643 - DNA, 1266 bp, Artificial Sequence
  Description of Artificial Sequence: Synthetic coding sequence
atgtaccacggcatgaaccccagcaacggcgacggcttcctggagcaacagcagcagcagcagcaaccgcagagtcctcagcgccttctggccgtgatcctctggtttcagttagccctctgcttcggtcccgcccaattaaccggcgactgcaggatccctcagattgaagacgccgaaatacacaataaaacgtaccgccacggagagaaactgattatcacatgccacgagggctttaaaattagatatccggatctccataacatggtgtctctgtgcagggatgatggaacatggaacaaccttcctatttgtcagggctgtctccggcctcttgctagcagtaatgggtatgtgaacatctcagaacttcaaacatccttcccagtgggcaccgtgatttcttaccgttgcttccctggattcaaactggacgggtccgcttacctggaatgcctacagaacttgatatggtcttcatcgccaccaagatgtttggccctggaagcgcaagtgtgtcctctccccccaatggttagccatggggacttcgtgtgccaccctagaccctgtgagcggtataaccacggtacagtagtggagttctattgtgatcctggatattccctgacgtctgattataaatacatcacatgccagtacggggagtggtttccaagctaccaggtatactgcattaagagcgagcagacctggcctagcacccacgaaactctgctgacaacctggaagattgtggcctttacagccacctccgtcctgctggtcttgctgcttgtgatcctcgcccgaatgttccagactaagttcaaagctcacttccctccccgcggaccgccgcgttcgtcatcgtccgacccggatttcgtagtagttgacggagtacccgttatgctaccttcctatgacgaggctgtctctggaggcttgagtgccctcggcccggggtatatggcctccgttggtcagggctgtcccctccccgtagacgaccagtcacctcctgcttatcccggtagtggggatacagatacaggccctggcgaatctgagacttgcgattcagtaagtggatcttctgaacttctgcagtccctgtacagcccccctagatgccaagaatctacccaccctgccagcgataaccccgatattattgcttcgacagctgaagaagtcgcgagtacctctccaggaattgacatagctgacgagatccctctgatggaggaagacccctag

SEQ ID NO: 46644 - DNA, 1890 bp, Artificial Sequence
  Description of Artificial Sequence: Synthetic coding sequence
atgaccgccgagggccccagcccccccgcccggtggcaccggcggctcccaggcttatgggcagctgctttgctacttttagggctgcctcggctgagcgtgagagccgatggtaagtttttcgtgctggagtctcagaacggcagtcagggactgcaactagaagccgcacggctgagctgcaagtctcgcggcgcgcacttggccagtgctgatgagctaagacgcgtggtgcaggattgctcttttgctgtctgtacgactggctggctcgctgatggaacgctaggaaccacggtgtgtagcaaaggctccggggagcaacagatcatgcgggccgtggatgttcgtattgagtccaaccccgttcccggcgggacctacagtgccctttgcatcaaagatgaagagaaaccctgcggcgacccccctagttttccacacacaatcctccaaggtcggacaggactcgagatgggcgatgaactgctgtatgtgtgtgctccaggacatatcatgggccaccgcgaaaccgcctttacactgttgtgtaactcctgcggagaatggtacggcctagtccaggcgtgcggaaaggacgaggcagaggctcacatagattacgaagataattttcctgacgacagatccgtgtcttttagagaactcatggaggatagcagaactgaagccgatgaagatcggggccaaggagacagctcagaggaagcgcccaaacaggaccgcctggtgtccatttccgttggaagagaaaatatagcaagagataaggtgtttgtgccgacaaccggcctgcctggcgcgggcagcagcgtgcctgcggacagccctggaagcaggttgctccaaaaacatctgttttggtttcccgcagaagcgttccacaaaccaggcctcgagaaggaggtagacgacgatacaaaaaagcagttctccgctggggataatcactctggcgtcaagctggttccaggagagcctgagacgaaggtcatttacgggaatacagacgggccttcaggcccctttgttggtaaaaacgatagcaaagctggcgaccccgtggtgagcagttctgacgagtcatggctggatggctaccccgttacagagggggcttggagaaaaaccgaagccgaggaagaggaagatggagatagaggtgacggaagcgtgggacttgacgagaatgtccttgtgacacctgaccaacccatactcgtggaagtgaaaaagccaaaatctagtactctgaccccttctgagggaatgacacactcaagtgtgctcccctcccaaatgctggatgtagaagctctggcgttacgtcccgtgaatgccagtgagactgagggaataggcgacggcgatctgactaagtaccagtctacactgccctggcgcttcatcaccgaggaaagccctatggcaacgctttcttatgaactgaccagctcgactctcgaaatcttgaccgtaaacactgtaaaacagactcctaaccatatcccgtccacaattatggccaccactcagccccccgtggagaccacagtgcctgagattcaggatagtttcccctatctgctctcagaggatttttttggccaagaggggcctggccccggggccagcgaagagctgcacccaacactcgagtcctgtgtgggcgacggatgtcctggactctcccgagggccagtgattgccactatagttacagtcttgtgcttgctgctattgctagccggtgtcgggatggtgtggggctacagaaagtgccagcacaaatccagcgtctacaagctgaacgtgggccagagacaggcgcggcattatcatcagcagatcgaaatggagaaagtgtag

SEQ ID NO: 46645 - DNA, 3825 bp, Artificial Sequence
  Description of Artificial Sequence: Synthetic coding sequence
atggccagcggcagcggcgacagcgtgacccggcggagcgtggcctcgcaattttttacccaggaggaagggcccggtattgatggcatgaccacaagtgagcgtgtagtggacttactcaaccaggccgccttgatcacaaacgatagcaagatcaccgttttgaagcaggtccaagagctgatcattaacaaggatccaacacttctggacaactttcttgatgaaatcattgccttccaagcagacaaatctattgaagttagaaagtttgtcatcggctttatcgaggaggcctgtaaaagggatattgagctccttctcaagctcatcgctaacttgaatatgttgctacgtgatgagaacgtaaacgtcgtcaagaaggccattctgacaatgacgcagctgtataaagtggccctgcagtggatggtcaaaagccgtgtgatctcagagttgcaggaagcatgctgggacatggtgtcagccatggccggggatattattctcctcctagatagtgacaacgatgggattcgtacccacgcaattaaattcgtggagggtctgattgtaaccctgtccccacggatggccgactcggaaatccctaggaggcaggaacacgacatctccctggacaggataccgcgcgaccacccatatatccaatacaatgtgctgtgggaggaaggaaaggctgcgctcgagcagcttctgaagtttatggtgcatcccgccataagttctatcaacctcaccacagctcttggttccttggcgaatattgcaagacagcgccctatgttcatgtccgaagtaatccaagcctacgagacacttcacgcgaatttgccgcccaccctggccaaatcccaggtgtcatccgtgcgcaaaaacctcaagctgcatttattatctgtgttaaagcatcccgctagccttgagttccaggctcaaatcaccaccttacttgtggatctagggactcctcaggcagaaatcgccaggaacatgccatccagtaaagatactagaaagaggccacgggatgattctgactcgacgctgaagaagatgaagctggagccgaatctgggtgaggacgacgaagacaaggacttggagccaggtccgtcagggacatccaaagcatctgcacagatttcaggtcagtcagatacagatatcacagccgagtttctgcagcccctcctgacaccagacaacgtagccaatctcgtcctgatctctatggtttacctgcccgaggccatgcctgccagctttcaggccatctatactcccgtagaatccgcaggcacagaggcgcagattaagcacctcgctcgcctcatggctacccagatgacagctgccggcctcgggcccggcgtcgagcagaccaagcagtgtaaggaggagcccaaagaagagaaggtcgtgaagactgaatcagtgctgattaagcgaaggcttagcgcacagggccaggcaatctcagtagtcggttcccttagttcaatgtcccccttggaagaggaggccccccaggccaagcggagaccagagcctattatccctgtcacacagcctcgcctggctggagcggggggccgcaagaaaatatttagattgagcgacgtgctgaagcctcttacagatgcccaggtggaggcaatgaagctgggcgccgtgaagagaatcctgcgggctgaaaaggcagtggcttgttcaggagccgcccaagtgaggatcaaaatccttgcaagcttggtaactcaattcaattccggactgaaggcagaggttttaagtttcattctcgaggatgtgagagcacgattggacctggcgttcgcttggctgtaccaggagtacaacgcctacctggccgccggcgcaagtgggtcattggacaaatatgaggactgtcttatcagactgttaagcggactgcaggaaaaaccagatcagaaggatggcatatttacaaaagtcgttctagaagcacccttaatcacagagtctgccttagaggtcgtccgaaaatactgcgaggacgaatctagaacgtacctagggatgtccaccctgcgcgacctgatttttaagcgccctagcagacagttccagtacctgcacgtactcctggatctttccagccacgagaaagacaaggtgagatctcaggcgctactcttcattaagaggatgtacgagaaggagcagttacgcgaatatgtcgagaaatttgcattgaactatctgcagctgctggttcatcccaatcctccaagcgtgctgtttggtgctgataaagacacggaagtggcagccccctggacggaggaaacagtaaaacagtgcttgtacctttatctggctctgcttccacagaaccacaagctgatccacgagctggccgcggtatataccgaggcaatcgccgacatcaagaggactgtcctaagagttatcgagcagccaattcgaggaatggggatgaacagtccagagctgctgctgctagtggagaactgtcccaaaggcgccgagacactggtcacacgctgcctgcactctttgacagataaggtgccaccttcacctgagctggtgaagagggtgagggatttgtaccacaaaaggctacccgacgtccggttcctcatcccagtgcttaatgggctcgaaaagaaggaggtcattcaggctctgcctaaactaatcaaactcaaccccattgttgtgaaggaagtctttaatcgtctactgggcactcaacatggtgaaggtaatagtgcacttagccctctaaacccaggagaactcctgatcgcgttacataatattgactctgtgaagtgcgatatgaagtccatcattaaggccacaaatctgtgcttcgccgaacgcaatgtttatacgagcgaagtgctggctgtggttatgcagcagctcatggaacaaagccctttaccgatgctgcttatgcgcaccgtgatacagtcacttacaatgtatcctcggctggggggttttgtgatgaatattctcagtcgactgatcatgaagcaagtatggaaatacccgaaggtatgggaggggtttattaaatgctgtcaaagaaccaaaccacaaagctttcaggtaattttgcaactcccaccccaacagctaggtgccgtatttgacaaatgccccgagctgcgagaaccacttctggcgcacgttagaagtttcaccccacaccagcaggcccacatccccaattctattatgacaatcttagaggcctcaggtaaacaggagccagaggcaaaggaggcacctgctggacccctcgaagaggatgacttagaacctcttactctagctcccgctccggcaccaagaccaccccaagatctcatcggactgagactggcacaggagaaggcattgaagagacagttggaggaggagcagaaactcaaacccgggggggtcggcgccccttcgagtagctcgccatctcctagcccttctgctaggccggggccacctccctccgaagaagcaatggactttagagaggaggggccggaatgcgaaactcccggaatcttcatcagcatggatgacgattctggcctgacagaggccgctctgcttgactcgtcactcgaagggcctctcccgaaggaaactgccgccgggggacttaccctgaaggaggaacgaagcccacagactctcgccccagtgggggaagacgcgatgaagacccccagcccagcagcagaggatgcccgagaaccggaagccaaaggaaactcctag

SEQ ID NO: 46646 - DNA, 465 bp, Artificial Sequence
  Description of Artificial Sequence: Synthetic coding sequence
ctgaccgccgccatggccagcggcagcggcgacagcgtgacccggaggtcggtcgccagccaattttttacccaggaggagggccccggaattgacggcatgactaccagtgaacgggtggttgacttgctaaatcaagctgccttgatcacaaatgattcaaagattacagtgctaaaacaggtacaggaactcattataaataaagatcctaccctgctagacaattttctggacgagattatcgcatttcaggcagataagtctattgaggttcgcaagttcgtaatcggcttcattgaggaagcgtgcaagagggatatcgaactgctcctgaagctgatcgcaaacctaaacatgctgctgcgcgatgaaaatgtgaatgtggtgaagaaggccatcctcacaatgacacaactgccagttcccgtgcccgcatgccccccccggccgcagctgccttag

SEQ ID NO: 46647 - DNA, 3900 bp, Artificial Sequence
  Description of Artificial Sequence: Synthetic coding sequence
atgagccggagccgggccagcatccaccggggcagcatccccgccatgtcttacgccccctttagggatgtgcgcggcccaagtatgcaccggactcaatatgtgcactctccttatgacaggcctggctggaaccctcggttctgtataatatcaggcaatcagctgttaatgctggacgaagatgaaatccacccgctgctgattcgggacaggcgatccgagagctcacgtaataagttgctgcgtcgaacagtgtctgtccctgtcgagggaagaccccacggagagcacgaataccaccttggccggtctaggagaaagagtgttcccggcggtaaacaatatagcatggagggagcgcctgcggccccattccggcctagccagggcttcctttcacgcagacttaaatctagtataaaacgcaccaaaagtcagccaaagttagatcgcaccagctcatttcgccaaatactaccccgttttcgcagcgcagaccacgaccgggcccgtctgatgcaaagcttcaaggaaagccactctcatgaaagcttactctcaccctcctccgcggccgaagcactagagctcaatctcgatgaggactccattattaagcctgtacattccagcattttgggtcaggaattctgtttcgaggtgacaaccagctccggaaccaagtgcttcgcctgtcggagtgcggccgaaagagataagtggattgagaatttgcagcgcgctgttaagccaaataaggacaatagcagaagagtcgacaacgtgctcaagctatggatcatcgaagctcgagagctgcccccaaaaaagcgctattactgcgaactctgtcttgatgacatgctttatgcaaggactactagcaaaccaagatcggcatctggcgacacagtcttctggggggaacacttcgaattcaacaacctcccagcggtcagagccctccgattgcatctataccgggattctgacaagaaacggaagaaggacaaagccggctatgtaggcctcgttaccgtcccagtcgcaacactggccggtcggcacttcaccgaacagtggtaccctgtgacgttaccaaccggctcaggggggtccgggggcatgggatccggcggaggaggcggctctggtgggggatccggtggcaaagggaaggggggctgcccagccgttcggctaaaggcgcgataccaaaccatgagcattttgcccatggaactgtataaggagtttgcggagtacgttacaaatcattatcggatgctatgcgcagtcctggagcctgccttgaatgtgaaaggcaaggaggaggtggcgagtgctctggtccacattctgcagagtacgggcaaggccaaggacttcctttctgacatggcaatgtccgaagttgatcgatttatggaacgggagcatttaatctttcgggaaaatactctggcaaccaaagcaattgaggagtatatgcggttgatcggccagaaatatctcaaggatgcgattggcgagtttattagggctctatatgaatcagaagaaaactgcgaggtggacccaatcaagtgtaccgcctcttcccttgcagaacatcaggctaatctgcgaatgtgctgtgaattagccctttgtaaagtggtgaacagccactgcgtgttcccacgcgagctaaaggaggtgtttgcaagttggcgactgaggtgcgcggagcgaggccgagaggatatagccgaccggcttattagcgcgtccctctttctcaggttcttatgtccagccatcatgtcccccagccttttcgggcttatgcaggagtatcccgacgagcaaacctctcgcacgcttacactgatcgccaaggtgatacagaatttagccaatttttccaaatttacaagcaaagaggacttcctgggcttcatgaatgaatttctggagctggagtggggatccatgcagcagttcctctacgaaataagcaatctggacacactgacaaacagctcaagcttcgagggatacatcgacttgggcagagaactgagcactctccatgcactgctgtgggaggttcttccgcaactgtccaaagaagcgctgctgaagctggggcccttacctcggctcctcaacgacatttctacagccctacggaatccaaatatccagcgacaaccaagccgccagagtgaacggccacgaccgcagcccgtggtccttcgagggccctccgcagagatgcaaggctatatgatgcgggacctgaactcttcaatcgatttgcagtctttcatggcacgaggactgaactcatcgatggatatggccaggttgcctagtcctacaaaagagaaaccccctccccctcccccgggcggtggcaaggacctgttttacgtgtcacgaccgcccctggcacgatccagtcccgcttattgtacgtcatcctcagatattaccgaacccgagcagaagatgttatccgtgaacaagagtgttagtatgctggatttgcagggagatggaccggggggccgcctgaattcgagctcagtgagcaacctggctgcggtgggagacttactgcactctagtcaggcctctttgaccgccgccctgggcctgaggccagctcccgccgggcgactgagccagggttctggatcctccattacagccgccggaatgagactgtcccagatgggagttactaccgatggagtccccgctcagcagttgcggatacccctatccttccagaatccactcttccatatggccgcggatggacccggtccccctgggggccacggcggtggaggcggccatggcccgccaagcagtcatcaccaccaccatcatcaccaccatcatagaggcggggagccacccggtgacacttttgctccatttcacggatactcaaagagtgaggatttatccagtggtgtgcccaagccgcctgcggctagcatcctgcacagccatagctatagcgatgagttcggtccctccggaaccgacttcacgaggcgccagctgtcattacaagataaccttcagcacatgttaagcccaccgcagattacaattggaccccagaggccggcaccatcgggccccggcggggggagcgggggaggctcaggaggggggggtgggggccagcccccccctctgcagcgcggaaaatctcagcagcttaccgtgtctgctgcccagaagccccgaccgagctcaggtaatctgttgcagagcccggaacctagctatggccctgctcgaccacggcagcagtcactgtccaaggaagggtcaatcgggggcagcggcgggagcggtggcggaggaggcgggggtctaaaaccatcgataacaaaacaacattctcagacgccttccacactcaacccaacaatgccagccagcgagcggactgttgcctgggtctccaatatgccacatttatctgccgacatcgaatcagcccacatagaaagagaagagtataaattgaaagagtatagtaagtcaatggacgaaagtagactggacagggtaaaagagtacgaggaagagatccactcactcaaagagaggctccacatgagcaaccgaaagttagaggaatacgagcgacgcttattaagtcaggaggaacagacctccaagatccttatgcagtaccaagcacgtctcgagcagtcggaaaaacggctcaggcagcaacaggcggaaaaggattcacagataaaaagcataatcggtcggttgatgctggtcgaggaggaactgaggagagatcacccagctatggctgaaccattgcccgaacccaagaaacgcctcctggatgcacagctgttgataaggtag

SEQ ID NO: 46648 - DNA, 1464 bp, Artificial Sequence
  Description of Artificial Sequence: Synthetic coding sequence
gaggacttcctgggcttcatgaacgagttcctggagctggagtggggaagcatgcagcagttcctttacgaaatctcgaatttggataccctgaccaactcaagttcattcgagggatacatagacctgggccgggaactgtctactctacatgcgttactgtgggaagtcttaccccagctgtctaaagaagctctgctgaagctaggccccctgccccgcctgttgaacgacatctctaccgcattgagaaacccaaacattcaacgacagccatcccgacaaagtgaacggcccagacctcagcctgtagtgctgcggggaccatctgctgaaatgcagggctatatgatgcgcgacctgaattcatccatggacatggctcggttgccttcacccaccaaggaaaaaccacctcccccccctcctggaggcggtaaagacctcttctacgtatcgcggccgcctctcgccaggtcttcccctgcatactgcacctctagcagtgatattaccgagcccgaacagaaaatgctgtctgtcaacaagagcgtgagcatgctcgacctgcaaggcgacggcccagggggtcggctcaactcaagtagcgtttcgaacctcgctgccgtgggagacctgctacattccagtcaggcatcattgaccgccgccctgggactgcgtcctgccccggccggtcgcttgtcccagggaagtggcagcagtataacagctgcaggaatgaggctatcacaaatgggcgtcacaaccgacggtgttccagctcagcagctccgtatcccactctcattccaaaatcctctctttcatatggccgcagatggccccggccctccaggcggccacggggggggtggcgggcacggaccccccagttcccatcaccatcaccaccatcaccaccaccataggggaggagagccacctggcgataccttcgcaccctttcatggctattctaagtccgaggatctgagcagcggtgtgcccaaaccacctgctgcttctattctccactcgcattcctactctgacgaattcggaccatctggtactgacttcaccagacgacagctttctctccaggacaatctgcagcatatgctgtccccgccccagatcaccatagggccccagcgacctgcaccctctggccccggggggggctcagggggggggagcggtgggggcggcggcggacagccgccccctctgcaacggggcaaaagtcagcagttaactgtctcggccgctcaaaaaccaaggccatcatccgggaacctcttgcagtccccagagcccagctacgggccagcccgtcccagacagcagtctctatcaaaagagggatccattggtgggtccggagggagcgggggcggcggcggtggcggactaaagccttctataacgaagcagcattcacagaccccttccacgtag

SEQ ID NO: 46649 - DNA, 3900 bp, Artificial Sequence
  Description of Artificial Sequence: Synthetic coding sequence
atgagccggagccgggccagcatccaccggggcagcatccccgccatgagctatgcccccttcagggatgtccgcggccctagcatgcatcgcactcagtacgtccatagcccatacgaccgacccggctggaacccccgattttgcatcatctcgggcaaccagctgttgatgctcgatgaagacgaaatccatcctctgcttattagagataggagatccgagtccagcagaaacaaactgctgcgacgaaccgtgtcagtgccggtggaggggcgcccacatggcgaacacgagtatcatctggggagaagcaggcgcaagtcagtacccggcggtaaacaatacagcatggagggagcacctgctgcaccctttcgcccatcccaggggtttctgtctaggcgattgaaatcaagcatcaaaagaaccaaaagtcaacctaaactggacagaacctcaagtttcaggcagatactccctcgctttcgtagcgcagatcacgatcgcgccaggcttatgcagagcttcaaggagtcacacagtcacgaaagcctgctaagcccttcgtcagccgccgaggccctggagctgaatttagacgaagattcgatcattaagcctgtgcatagcagcattcttggccaggaattctgttttgaggtgacaaccagctcgggcacgaaatgttttgcctgtcgttccgctgccgaaagagacaaatggatcgagaacctgcagcgggctgtcaagccaaacaaggacaattcaagaagagtcgacaacgtacttaagttatggatcatagaagcccgggagcttcccccaaagaaacggtattactgcgagttatgcctggatgacatgctgtatgctagaacaacttcaaaacccaggtctgcctccggggataccgtgttctggggtgaacactttgaatttaataacctacccgccgttagagctcttcgactccatctctatcgagattccgacaaaaaacggaagaaagacaaggccgggtacgtggggctggtgactgtgcccgttgccaccctggctggccgacacttcactgaacagtggtatccagtcactctgccaaccggcagcggaggtagtggtgggatgggatccggaggcgggggggggagtggcggtggctcaggtgggaagggcaaggggggctgccctgccgtccgcctgaaagctcggtaccagactatgagtattcttccaatggaattgtacaaggagtttgcggaatatgtaacgaaccactatagaatgctctgtgctgtgctggagcctgcccttaacgttaaaggcaaggaggaggttgcctcggcactggtccatattctgcagtctacaggaaaagccaaagacttcctgagcgatatggctatgtctgaggtcgatcgatttatggaaagggaacacctgattttccgagaaaacaccctggcgactaaggccatcgaagagtacatgcggctgattggccagaagtacttgaaggatgccatcggcgagtttatcagggcactttatgaatccgaagaaaactgcgaggtcgacccgattaagtgcaccgcgtcctccttagccgagcaccaagccaacctgcgcatgtgctgcgaactcgccctgtgtaaagtggttaatagccactgcgtatttccacgggagctgaaggaagttttcgccagctggaggttgagatgcgcggagcgtggcagagaagacatagccgaccgactcatctcagcatctttgttcctccgtttcctgtgccctgctatcatgtccccctccctgttcgggctgatgcaggagtatccggatgagcagacctctagaacactgaccctaattgcaaaggttatccagaatttggcaaatttctccaagtttactagcaaggaggactttctcggattcatgaatgaatttctcgagcttgaatgggggtctatgcagcagttcctgtatgagatctccaatctcgacacactgacaaactcgagctcctttgagggatatattgacctgggtagagaactctccacattacatgccctgctgtgggaggtgcttcctcagctgagcaaggaggcattgctgaagctgggaccattgcctagactgcttaacgacatttccaccgctttgagaaacccgaatatccagagacagccctctcgacagagcgagcgccccagacctcagcctgtggtgctgaggggtccatctgctgagatgcaaggctacatgatgcgcgacctcaactcttcgattgatctccagtcgtttatggctcgcggcctgaattcaagcatggacatggcccgtctgccctccccaaccaaagaaaagccccccccacctccccccggcgggggaaaggaccttttctacgtgtcacggcctcctctggccaggtcctccccagcctattgtacgagtagcagcgatattactgaaccagaacagaagatgttgtccgtcaataagagcgtgtcaatgctggacctgcagggggacgggccaggggggcggcttaactcttccagtgtctctaacctggcagccgtgggtgacctgttgcatagctcccaagcctccctgaccgctgcactcggactccggccagctcctgctgggagactaagccaaggatctggaagcagcatcactgcggccggaatgcgcctgtcacagatgggagtgaccaccgatggcgtgcctgcacagcagctccggatacccctgtctttccagaaccctttattccacatggccgcggacggccccggccctcctggcggacacggcggaggggggggccatgggcccccttcctctcaccaccaccaccaccaccatcatcatcaccgtggaggagagccccctggggacacatttgcacctttccatggttactctaaatcagaggatctatccagtggggtgcctaagccccccgctgcctccatattacactctcactcatatagcgatgaatttggccctagcggtactgatttcacccgacgacagttgtctctccaggataatctgcaacatatgttgagcccgcctcaaatcaccattggaccccaacgacctgctccgagcggaccaggaggtggatccgggggagggagtggggggggtggtggcggacagcccccaccattgcagcgcggcaagagtcagcaactaactgtttccgcagcacagaagcccaggcccagcagcggaaacctgttgcagagtcccgaaccatcttacggcccggcccgaccccgccaacagagcctgtctaaagaaggttccattggcggaagcggggggtctggtggcgggggcggagggggactcaagcctagcattactaagcagcattcccagacgccctcgactctgaatcccaccatgccagcatcagaacggaccgtggcgtgggtgtccaacatgcctcacctttctgccgacattgagtcagcacatattgagagagaggagtataaactgaaagaatactcgaagagcatggacgagtctcgcttagatagggtaaaggagtacgaggaagagattcattcactgaaagagagactgcatatgagcaacagaaaactggaggagtatgagcgtagacttctgagccaggaggagcagacgagtaagatcttaatgcagtaccaggctcggctggagcagtccgagaagagactccgccaacagcaggcagaaaaggacagccagatcaaaagcatcatcggccggttgatgctggtggaagaggaactgagacgggaccatcccgccatggctgaacccttgcctgagccaaaaaaacgcttgctcgatgcccaacttctgattcgatag

SEQ ID NO: 46650 - DNA, 3855 bp, Artificial Sequence
  Description of Artificial Sequence: Synthetic coding sequence
atgggcctgcggccccccacccccagccccagcggcggcagctgctccgggagcttgccacctccctctaggtgccagcctctgaggaggcgatgttcaagttgttgctttcccggcgaataccacctgggcaggagccggcgaaagagtgttcccggaggaaagcagtacagcatggaaggagctccagcggctccctttcggccatcccagggattcctttctaggaggctgaagtcctctattaagaggacaaagtcccaacccaagttggacagaacgtcctctttccgtcagatccttccgcgcttcaggagcgccgatcatgaccgggcgaggctgatgcagagttttaaagaaagtcacagtcacgaaagcctgctttcaccttcttctgccgccgaagccctcgaactgaacttggatgaggactctatcatcaaaccagtgcattcatctatcttaggacaggagttctgctttgaggtcaccacctcaagtggcaccaagtgcttcgcttgccgttctgctgctgaaagagataaatggatcgagaacctgcagcgagctgtgaagcccaataaggacaactcacggagagtggacaatgttcttaagctgtggatcatagaagcccgagagctacctcctaagaagagatactattgcgaactctgcttggacgacatgctctacgcccgcaccaccagcaaaccgcgatctgcctcaggggataccgtattttggggcgaacactttgaatttaacaatctgcccgccgtacgcgcacttcgactgcatctctaccgggatagcgataaaaagagaaaaaaagacaaagcggggtacgtggggctcgtgactgtgcctgtcgccacacttgctggtagacatttcaccgagcagtggtaccctgttacactacccactggaagtggtggctctggcggcatgggcagtgggggaggaggcgggagtggaggcgggagtggtggaaagggaaagggtgggtgcccagcggtacggctaaaagcacggtaccagactatgagcatactacctatggagctgtacaaagaatttgcggaatacgtaacgaatcattatcgcatgttatgtgccgtcctcgaaccagccctcaacgtgaaagggaaggaagaggtggcgtctgcactggtacacatcctgcagtctaccgggaaagccaaggacttcctctccgatatggccatgtcagaagtggaccgctttatggagagggaacacctaatcttcagagaaaatacactggctaccaaggcgatcgaagaatacatgagactgattggccagaagtacctgaaagatgccatcggagagttcattagagcactgtatgaaagcgaagagaactgcgaagttgaccccattaagtgtacggcgagtagccttgcggagcaccaggccaacttaagaatgtgttgcgagttagccctgtgtaaggtggtgaactctcattgcgtgttccctcgggaactgaaggaggtgttcgccagctggagactgcggtgtgctgagcgcggcagagaggacatcgccgaccggttgataagcgcttcgctgtttcttcgattcctctgtcccgccattatgtctccctctctgttcgggttaatgcaagagtacccagatgaacagactagccggaccctcactctgatcgctaaagttattcagaacctggcgaacttctcaaaatttacatccaaagaagactttctgggctttatgaacgagtttctcgagctcgagtggggatcgatgcagcagtttctgtacgagatcagcaatcttgacacactcactaactcctccagcttcgaagggtacatcgaccttgggcgggagcttagcacgctccatgcgcttctttgggaggtcctgcctcaattatccaaggaagccctgctcaagttgggtccactcccccgactccttaatgacataagtaccgcacttcgcaaccctaatatccagcgccagccttcacggcaatcggaaagaccccggcctcaacctgtggtgctcaggggcccctcagcggagatgcagggctacatgatgagagatttgaactccagtatcgatcttcagagcttcatggcccgcggtcttaactctagtatggatatggctaggctcccgagccccacgaaggagaagccccccccgccgccgcccggcggcggcaaagacttattctacgtcagcagacctcctctggccagatcaagtccagcatactgcacgtcctcctccgatattacagaaccagagcaaaagatgctgagcgtgaataagagtgtcagcatgcttgacctgcaaggagatggccctggtggtcgtctaaatagcagttcagtgtccaaccttgctgccgtaggcgatctgctgcatagtagccaggcaagcctgactgccgcacttggcctgcgccctgcccccgctgggagattgtctcagggctccggatcttctatcacagcggccggtatgcggctgagccagatgggtgttaccacagatggtgtgccagcgcagcagcttcgcatacccttaagctttcagaatccccttttccacatggctgccgacggccctggcccaccaggtggacatggcgggggaggaggccacggtcccccgtctagccaccaccatcaccaccatcaccaccatcaccgcggcggggagccacccggcgatacgttcgctccctttcacggctattctaaaagcgaagacctctccagcggtgtccctaaacctcctgcggcctcgattttacatagtcactcttattctgacgagtttgggcctagtggaaccgactttaccaggcgccaattaagcctgcaagacaatttgcagcatatgctgtctcctccacaaataacgatcgggcctcagcgcccggctccgagtggacctgggggaggcagcggaggtggatctggcggcgggggcggcggacaaccaccgccactgcagcgagggaaatcgcagcagcttaccgtgtccgccgcccaaaagccccggccctccagtggaaacctgcttcagtctccagagcctagctacggtccagcccgaccgagacagcagagcctctccaaggaaggttcaattggtggctccggaggctctgggggggggggtgggggtggcttgaaacctagtattaccaaacagcattcacagacgccctctacattgaatccgaccatgcccgccagtgagaggacagtggcatgggtgtctaacatgcctcacctttccgcagatatcgaatcagcgcatatcgagcgcgaggagtataagctcaaagagtactcaaagtcaatggatgaatccagacttgatcgcgtaaaagaatatgaggaagagatccacagtctgaaagaaagactgcacatgtcaaaccggaaactggaggagtatgaacggaggctcctgagtcaggaagagcaaacttctaagatcctcatgcagtatcaagctaggttggagcagagcgagaaacgcctcaggcagcagcaggcagagaaggactctcaaatcaaaagcatcattggccgcctgatgctcgttgaagaagagctccggcgggaccatcctgccatggccgaaccgcttccagaacctaaaaaacggctactcgacgcacaagagcgacagctgccccccctgggaccaactaacccaagggtaacattggcaccaccttggaacggccttgctcctccggctccaccccctcctcctaggttgcagataacagagaacggtgagtttagaaacaccgccgaccactag

SEQ ID NO: 46651 - DNA, 4032 bp, Artificial Sequence
  Description of Artificial Sequence: Synthetic coding sequence
atgagccggagccgggccagcatccaccggggcagcatccccgccatgtcgtacgccccctttagagacgtgaggggtccgtcaatgcacagaacccagtatgtgcactccccgtatgatcggcctgggtggaacccgaggttctgtatcatcagcggcaaccagctgttaatgttggacgaggatgaaattcaccctctcttgatccgcgatcgtcgatctgaaagttcgagaaacaaacttctgcgacgcaccgtgtctgtgcctgtggaagggcgcccacacggggagcatgaatatcatctcggaaggtctcggcgcaaaagtgttccaggcggtaagcagtacagcatggagggagcccctgcagcgcccttccggccgagccagggattcctcagccgacggttgaagtcaagcataaaacggacgaaaagtcagcccaagctggaccgcacttcctcgttcaggcaaatactgcctcgatttcgaagcgctgaccacgaccgcgccagattgatgcaatcattcaaagagagtcacagtcacgagtcattgctgagtccatcctccgcggccgaggccctggagttaaatctggacgaggattcaattatcaaacctgtgcactcatccatactaggccaagagttctgcttcgaagtgaccacaagttccggtacgaagtgttttgcttgcagatccgccgctgaaagagataagtggattgagaatctacagcgtgccgtgaaaccaaacaaggacaactcccggagagtggacaacgtgttgaagctgtggatcatagaggctcgtgagttgccccccaaaaaaagatactattgcgagctctgcctggacgacatgctgtacgcccgcaccaccagcaagccacgtagtgcctccggtgacacagtgttctggggagaacacttcgaattcaacaatttacctgctgtgcgcgcactcagactgcatttataccgtgactcagataaaaagaggaagaaagacaaggccggatacgtgggacttgtcaccgtgcctgtcgctacactggcgggtcgccatttcacggagcagtggtatcctgtcactctccctaccggctcgggcgggtctggtgggatggggtccggagggggtggtggctccgggggcggctctggtggaaagggcaagggtggctgtcccgccgttagactgaaggcgaggtatcaaactatgtccattctcccaatggagttgtataaggaattcgcagagtacgtcacaaaccattaccgtatgttatgtgccgttctggaacccgctcttaatgtcaagggcaaagaggaggttgccagtgctctggttcacattctacagtctacaggcaaagccaaggactttctgagtgatatggccatgagcgaagtcgatcgattcatggaaagggaacatttaatattccgggagaacaccctagcaaccaaagccatcgaagagtacatgcggcttataggccagaagtatttgaaagacgctatcggagaatttatccgagccctgtatgagtcggaggagaattgtgaagtggaccctatcaaatgtaccgcctcttctctggccgagcaccaggcgaacctgcgtatgtgttgtgagctcgcgctctgtaaagtggttaatagtcattgtgtattccctagagagctgaaggaagttttcgctagttggagacttaggtgcgccgaacgtggcagggaggacattgccgatcgtttaatatccgcctcactcttcctgcgcttcttatgccctgcaataatgagtcccagcctcttcggcctcatgcaggagtacccggatgagcaaacaagcaggacactcactctcattgccaaagtgattcagaatttagcgaacttttccaagtttaccagtaaggaggatttcctaggcttcatgaatgagtttctcgagcttgagtggggcagcatgcagcagttcctctatgaaataagtaatttggatactttaactaacagtagctcgttcgaaggatatattgatctggggcgtgagctaagtaccctccatgccctgttgtgggaagtcctgccccagctcagcaaggaggcactcttgaaattgggcccccttccccgcctgctgaacgatatctcaaccgcactgcggaatccaaacatccagagacaaccgtctcggcagtcagagaggccacgaccgcagccagtcgtccttcggggcccttcagcggaaatgcaggggtacatgatgcgcgacctgaactcaagtattgatctgcaatcatttatggctcgaggccttaactccagcatggatatggccaggctgccatcccccacaaaagagaaaccaccaccgccgcctcccggtggggggaaggatctgttttatgttagccggccccccctggcccgctcctcaccagcttactgcacctcctccagtgacataactgagcccgaacagaagatgctttctgtgaacaagtcagtgtcaatgctagacctgcaaggagacgggcctggtggtcggctcaattctagcagtgtttctaatcttgcggcggtcggcgatttgcttcattcatcccaggcctcactgaccgcggccctcggtttgcggcctgcaccggcagggagattatcgcagggaagcggttcttctatcacagcagccgggatgaggctgtcccaaatgggtgttacgaccgacggggtccctgcccaacagctgcggatcccactttctttccaaaaccccctctttcacatggccgcggacggaccgggtccccctggcgggcatgggggaggcggaggccacgggccaccgagttcccatcaccaccatcaccatcaccaccaccatcgcggcggtgaacctcctggcgatacgttcgccccctttcacggatattccaagtccgaagacctgagcagtggagtgccgaaaccacctgctgcctcgattctacatagccacagctatagtgacgagtttggcccatcaggcacagacttcacccgcagacaactctctctccaggataacctgcagcacatgttaagtccgccccagatcactatcggcccacagagaccagccccatctggcccaggaggcggctctggtgggggtagcggcgggggcgggggggggcagcctccacctttgcaacggggaaagagtcagcaactgactgtgagtgccgcccaaaaaccgcgacctagctctggcaatctgctgcagtctcccgagccatcctacggccctgcccgcccgaggcagcagtcactctcaaaggagggaagtatcgggggaagcggcgggagcggcggaggaggtggtggaggactcaagccttctatcacaaagcaacacagccaaactccaagcacacttaacccgacaatgccagccagtgagagaaccgtggcctgggtgtcaaatatgccccacttatctgcagacatcgagagtgcccacattgagagagaggaatataaactgaaggagtattctaaatccatggacgagtccagactggatcgtgtgaaggaatatgaggaggaaatacactcccttaaagaaaggctccacatgagtaataggaaactggaggagtacgaacggagactgttatcccaggaggagcaaacatctaaaatcttaatgcagtatcaagctcggctggaacagtccgagaaaaggctcaggcaacagcaggcagagaaagattcccaaataaagagcataatcggtcggctgatgttggtggaagaggaacttcgcagagatcaccctgcaatggctgagcccttgcctgagcccaagaagaggctgctggatgcccaagagcggcagctccctcctctcgggccaactaacccacgagttaccctggctccgccctggaacggattggcccctccagctcccccccctccaccacggctgcagataaccgagaacggcgaattcaggaacacggcagaccattag

SEQ ID NO: 46652 - DNA, 3879 bp, Artificial Sequence
  Description of Artificial Sequence: Synthetic coding sequence
atgagccggagccgggccagcatccaccggggcagcatccccgccatgtcgtatgcacctttccgtgatgtacgaggcccatcgatgcaccgtacgcaatatgtgcacagcccctatgatagacctgggtggaaccctaggttttgtattatttccggaaaccagctgctaatgctagatgaggatgagatccaccccctccttatccgcgacaggcgaagcgagtctagcaggaacaagctcttacgcagaactgtgtctgtcccagttgaggggagaccccacggtgaacacgaatatcatcttgggcgctctagacgcaaatccgtccctggtggcaaacagtactcaatggagggggccccggccgctcccttcaggccctcccagggattcctatctcgccggctcaaatcctccataaaacgcaccaagagtcagcctaagttggaccgaacatctagtttcagacagatcctgccacggttcaggagcgcggaccacgatcgcgcccggttgatgcagagcttcaaggagagtcacagccatgaaagtttactcagccccagcagtgcggcggaggcactagagttaaatctggacgaagacagcatcattaagcccgtgcactccagcatattaggccaggagttctgtttcgaggttactactagctccggcactaaatgttttgcctgtaggagcgcggctgagcgtgacaagtggatcgagaatctgcagagagccgtaaaacccaataaggataactccagacgagtggacaacgtcctgaaactgtggattatagaggcacgggaactcccaccaaagaagcgctactactgcgagctctgtcttgatgatatgctgtacgcacgaacgacctctaagccaagaagcgcatcaggcgacactgtattttggggcgagcacttcgaattcaataatctgccagctgtgcgcgccctgcgcctgcacctctatagggattctgacaaaaagcggaagaaagacaaagccggttatgtaggacttgtgacggtccctgtggcaacattggccggcagacacttcacggagcagtggtacccggtaacactgcccactggctccgggggttcaggcgggatgggatcaggaggtggaggaggttcagggggggggagtgggggcaaagggaaaggaggctgccccgcagtgcgcctgaaagctcgctaccaaaccatgtcgatcctgcccatggagctgtacaaggagttcgccgaatacgtgaccaaccactataggatgctctgtgctgtgctggagcccgctctcaacgtcaagggcaaagaagaagtggccagcgccctggtgcatattcttcagagcactggtaaggccaaagacttccttagcgatatggcaatgtccgaggtggacagatttatggagcgcgagcatttaattttccgggagaatacgcttgcaacgaaggccattgaagaatacatgcgcctgattggccagaagtacctgaaggatgcaataggggaattcattcgcgctctatacgaaagcgaggagaactgcgaagtggaccccatcaagtgcacagcatccagcctggccgaacatcaggccaacttgaggatgtgctgtgaacttgcactgtgcaaagtggtaaactcacactgcgtctttcccagggagctgaaggaagtctttgccagctggcggctgaggtgtgctgagcgggggagggaagatatcgccgatcgcctaatctcagcttccctgttcttgagattcttgtgcccagcgataatgtcgcctagtctcttcgggctgatgcaggagtaccccgatgagcagacatctagaactctgactctgatcgccaaggttatacaaaacttggctaacttctctaagttcacttcaaaggaagatttcctgggctttatgaacgagttcctcgagcttgaatgggggtccatgcagcagttcctctacgagatatccaacctcgacaccttgactaattcctctagttttgaaggctatattgacctgggtagggagctttccactcttcatgcgctgctctgggaggtgctccctcaactcagcaaggaagcgctgctgaaactcggtcccttaccacggctgttaaatgatataagcaccgcgcttaggaatcccaacatacagcggcagcccagccgccagtctgagcgacctaggccacagcccgtcgtactacggggtccaagcgcagagatgcagggctatatgatgcgcgacctgaactcttctatggatatggcaagactgccctctccaacaaaagagaagcctccaccacccccacctgggggtggtaaggatctgttttatgtctcccgccccccattggccaggtctagtccggcttactgcacctcctccagtgacattactgagcctgaacagaagatgctttctgtaaataagtctgtcagcatgctcgatctgcagggagacgggccaggtggcaggttgaactcgtcctctgtgtcgaatcttgccgcagtaggcgacctgttgcacagctcccaggcgtcactgacggctgccctcggactgcgccctgctccagcgggcagactgtcgcaagggtcaggttccagtattactgccgcaggcatgagactgtctcaaatgggagtcacaaccgacggagtgcccgcccaacagttgcgcataccactgagttttcagaaccctttgtttcacatggcagcagatgggcctggccctccagggggacacggcggagggggcgggcatgggcctcccagcagccaccaccatcatcaccatcatcaccaccatcggggcggagagcctcctggtgacacatttgccccattccacgggtatagtaaatcggaggacctgtcttcgggcgtgccaaaaccacctgccgcatcgatcttgcatagccattcatatagcgacgagtttggaccttctggcactgacttcacccgccggcagctatcgctgcaggacaatcttcagcacatgctgtctccaccacaaatcaccatcggacctcagcggcctgccccctctggcccaggagggggctcggggggggggagcggcggtggtgggggcggccagccaccgcctctccaacgaggaaaaagccagcaattgaccgtgagtgctgcacagaaaccccgtcccagttccggtaacctgctgcagagccccgaaccatcttatgggcccgctaggccaaggcagcagagtctttcaaaggaaggctctataggtggctcgggaggctccggaggaggagggggaggaggcctcaaaccatccatcacaaagcaacatagtcagacacctagcacgctaaaccccacaatgccagcctccgagcgcaccgtggcatgggtttctaatatgccacacttgagcgctgatatcgagagcgcacacatagaacgggaagagtataaactgaaagaatacagcaagtctatggatgaaagccggctggacagagagtatgaggaagagatccacagcctgaaagagcgattacatatgtccaatcggaagttggaagaatatgaaagaaggctgctctctcaggaggagcagacaagcaagatccttatgcagtaccaggctaggttggagcagtctgaaaagcggttgcgccagcagcaggctgagaaagacagtcagatcaaaagtatcattggcagactgatgttagtggaggaggaacttaggcgggatcaccccgcgatggctgagcctttgcccgagcccaagaaacggctcctcgatgcccagcggggtagctttccaccttgggtgcagcagacccgggtgtag

SEQ ID NO: 46653 - DNA, 4032 bp, Artificial Sequence
  Description of Artificial Sequence: Synthetic coding sequence
atgagccggagccgggccagcatccaccggggcagcatccccgccatgtcctatgctccctttagagatgtgagaggacccagcatgcacaggacacagtatgtgcattccccttatgaccgccctggctggaacccacggttctgcataatcagcggaaatcagctgctcatgctcgacgaagacgaaatccacccactccttataagggatcggagatctgagtccagccgaaataagctgctgcgacggactgtatctgtgcccgtggaaggaaggccacacggagagcacgaatatcatctggggcgcagtcggaggaagagcgtccccggagggaaacagtactctatggagggtgcccctgcagctcctttcagaccttcccagggattcctaagtcggcgcttgaagtcctcaataaaaaggactaagagccagccaaaactcgatcgtacgtcttcatttcggcagattttgccgcggtttcggagcgctgaccatgatagggcccgcttaatgcagagcttcaaagaatcacacagtcatgagagcctgctgagcccaagctctgcagcggaagccctcgagctcaacctagacgaagacagcattatcaagccggtgcacagttcaattctgggccaggaattttgtttcgaggtgacaacctcttccggcaccaagtgttttgcatgcagatctgccgcagagagggacaagtggatcgagaacctccagcgggctgtgaagcccaacaaggacaacagtaggcgagtcgataacgtcttgaagttatggattatcgaagctagggagcttccgccgaaaaaacgatactactgtgaattgtgcctggatgacatgctatacgctcggaccacttcaaagcctcgcagtgcctccggcgacactgtcttttggggagagcacttcgagtttaataacttaccagcggtgcgggcactgcggctgcacctctatagggactccgacaagaagcgaaaaaaagataaggctggttacgttggactagtcacggtgcccgtggctactttggccggacgccatttcacagagcagtggtaccctgtgaccctgcctaccggatcaggggggtccggaggcatggggagcggggggggcggcggttccggagggggaagtggtggaaaggggaaaggcggctgccccgctgtgcgcttgaaggctcgttatcagaccatgtcgatcttgccaatggagctgtacaaggaatttgccgaatacgtgactaaccactataggatgctatgcgccgtgctcgaaccagcactcaacgttaagggaaaggaggaggttgccagcgctctggttcacatactccaatccactgggaaagccaaagacttcttatccgatatggccatgtctgaggtggatcgctttatggaacgcgagcatttgatcttcagagaaaacaccctggcgaccaaagccatcgaagagtacatgagattaataggacagaaatatctgaaggacgctataggtgagttcatcagggctttgtatgagagtgaggagaattgtgaggtggatcccatcaaatgtactgcttcttccctcgccgaacatcaggcaaacctgcggatgtgctgcgaactcgccctttgcaaggtggttaattctcattgcgtgttcccacgggagctgaaggaggtgtttgcaagctggcgcctgaggtgtgcagagaggggacgcgaagacatcgccgacagacttatctccgcgtccctgttcctgagatttctctgccctgctataatgagcccttccctctttggtcttatgcaggaatacccagatgagcagacctcccggacactcaccttaatcgctaaagtgattcaaaacttggctaacttctcaaagtttacatcaaaggaggattttctaggttttatgaacgagttcctggaactcgaatgggggtcgatgcaacagtttctgtatgagatcagcaacttagatacactgactaactcgagcagcttcgaaggatacattgacctgggccgggagttgtctacgcttcatgctctgctctgggaggtcctgccccagctgagcaaagaggcgttgctgaagttggggcccctgccgaggttgctcaatgatatttccactgctttgaggaatcctaacatacagaggcagccttccaggcaaagtgaaaggccaagaccacaacccgtggttctacggggtccctcggccgagatgcaaggatacatgatgagagacttgaactcctccatcgacctccaatcatttatggcgagggggcttaactcctcaatggatatggcccggctgcccagtcctaccaaggaaaagccaccgcctccgcctcccggaggcgggaaagatctcttctacgtgtcacgccctcccctcgctaggtcaagcccagcatattgcactagcagctccgacatcacggaacccgaacaaaagatgctaagcgtgaataaatcagttagcatgcttgatcttcagggcgatggaccaggtggacgcctcaattcttcatctgtttccaatctcgctgccgtgggagaccttcttcactcttctcaagctagtctgacggcagcactaggccttcgacctgccccagccgggcgtttatcccaggggagcggctcctccattactgcggctggcatgagattatcccagatgggcgtaacgacggatggcgttcccgcgcagcagttgagaatacccttgagcttccaaaatccgctgttccatatggcggcagatggacctgggcctccagggggccatggagggggcgggggccacggacctcccagcagccaccatcaccaccatcatcatcaccaccacagaggaggtgagccccctggagacactttcgccccatttcacggatacagcaaatccgaagatctctccagcggcgttcctaagcctcctgctgcttccattctgcactctcattcgtatagcgacgaattcggtcccagcgggacagatttcaccagacggcagctgtctctgcaggataacctccaacacatgctttctcccccacagataactatcgggccccagcgccctgccccctcagggcccggcgggggatctggcgggggaagcggcgggggcggggggggtcagccgccacccctgcagcgcgggaagagtcaacaactaacagtttcagctgcccagaagcctagaccctccagcggcaatctcctgcaatcaccagagcccagctatggtcccgccagaccccgccagcagagcctgagtaaggaggggagcatcggcggaagcggcggttccggtggggggggtgggggtgggcttaaaccaagcatcacaaagcagcattcacagactccttctacgctgaaccctaccatgcccgcctcagagcggacggtggcatgggtatcgaatatgccccacctgagtgccgatatcgaaagtgcgcatatcgagagagaagagtataaactgaaggagtacagcaaaagcatggacgaatccagactggaccgagtgaaggaatatgaagaggaaatccactcactgaaagaaagactccacatgtccaatagaaagctcgaggagtacgagaggcggttgcttagccaagaggagcaaacctctaaaatcctcatgcagtaccaggcaaggctggaacagtccgaaaagagactacgccagcaacaggctgagaaggacagccagatcaaaagcattatcggccgattgatgctcgtagaagaggagttgcgcagagatcatccggccatggccgagcccttacctgagccaaagaaacgcctcctcgacgctcaggagagacagctgccaccacttggtcccacaaacccccgggtgactctcgcgcctccgtggaatggcttagctccccctgctcctccaccaccgcccaggctgcagatcacggagaacggcgaatttaggaacaccgcagaccactag

SEQ ID NO: 46654 - DNA, 3900 bp, Artificial Sequence
  Description of Artificial Sequence: Synthetic coding sequence
atgagccggagccgggccagcatccaccggggcagcatccccgccatgtcttacgccccattccgagatgtcaggggtccctctatgcatcgaacacagtatgtgcatagtccttatgacagaccgggctggaatccaagattctgcatcataagcggcaatcagctcctgatgctcgatgaagatgaaatccatccactacttatcagggatcgccgatccgagtcgagccgaaacaaattgctgagaagaacagtttccgtgccagtcgagggtcgccctcatggagagcatgagtatcacctgggtcgctctcggaggaaatccgtgccgggcggaaagcaatacagtatggaaggagctcccgccgcacccttcagacctagtcaagggttcctgtcgcggagattgaaaagtagcatcaagagaacaaagagccagccgaagctggatagaacctcttccttccggcagattttaccgcgcttccgatcagctgatcacgaccgggcgcgactcatgcaaagtttcaaagaaagtcacagtcacgaatccctcctctctccttcttccgccgctgaggccctggagctgaacctggacgaggatagtataatcaaaccagtgcactcttccatactgggtcaagaattctgttttgaggtcacgacctccagcggtactaagtgctttgcttgtcgttctgctgctgagagagacaaatggatcgagaatctgcaaagagcagtgaagccaaataaagataacagccggagggttgacaacgtcctgaagctatggattattgaggcaagggaactgcctccaaaaaagcggtactactgcgagttgtgcttagatgacatgttgtatgcccggactaccagcaagcctcgatctgcatctggcgataccgtgttttggggcgagcacttcgagtttaacaatcttcctgcagttcgggccctgcgcttgcatctctatagggactcggataagaagcggaagaaggacaaggctggctacgtggggcttgtaactgtcccagtggctacgctcgccgggcgtcacttcactgagcagtggtaccccgtcactcttcccactggatccggcggctccgggggcatgggctccgggggcggcggcggctccggaggagggagcggggggaaggggaagggcggatgcccagccgtgcgcctgaaagctagataccagacaatgtccatcctaccaatggagctgtataaggaattcgcagaatacgtcactaatcactatcgtatgttgtgcgctgtcttggaaccggccttgaatgtgaaggggaaggaggaagtcgcctcagctcttgtgcatattttgcaaagcactggaaaggctaaagacttcctgtctgatatggccatgtccgaggtggacagatttatggagcgcgaacatttaatttttcgcgagaataccctggcaacaaaggctatcgaggaatatatgaggctcatcggacagaagtatctcaaggacgctataggagaatttattcgtgccctgtatgagagtgaagagaactgtgaggtggaccccattaagtgcaccgcctcctcactggcggagcaccaagcgaatctgcgcatgtgttgtgaactggctttatgtaaagtggttaacagccactgtgtctttcccagggaactgaaggaggtgttcgccagctggcgcctcagatgcgccgaacgcggccgagaggacatcgccgaccggctcatcagtgcttcgttgttcctgagatttttgtgtccagccatcatgtccccctctctgtttggattaatgcaagagtatcctgacgaacagactagccggacactcaccctgattgcaaaggtgatccagaacttagctaacttctctaagtttacgtcaaaggaggactttctggggtttatgaacgaattcctggagctcgaatggggtagcatgcaacaatttctgtacgagattagcaatctggatacactgacaaatagctcaagcttcgagggatacatcgatctgggtcgcgaactttcaacactccacgctctcctttgggaggtgttgccgcagctcagcaaagaggctctcctcaaactcggccccctgcccagacttttgaacgacatttctaccgcactgagaaatccaaatatccagcgccagccatcccgacagagtgagagaccacgcccacaacctgtggtcctcaggggaccttcagctgaaatgcaggggtacatgatgagggatttgaactcctccatcgatctgcagtccttcatggcaagagggttaaatagctctatggatatggcacgcctcccatctcctaccaaggaaaaacccccaccaccccctcccgggggcggaaaggacctgttctatgtgagcagacccccgcttgccaggtcatcaccagcgtattgtacaagctcaagcgacatcaccgagcctgagcaaaagatgctctcggtaaataaatcagttagcatgcttgaccttcaaggcgatggacccgggggtcgactcaattcctcgagcgtatccaatctcgcagcggtcggtgacctgcttcacagctcccaggcaagcctgactgcagcgcttggacttcgtccagccccggccggccggcttagccagggttctggctcctctattaccgccgcaggtatgcggctaagccaaatgggcgtgactacagacggcgtgcccgcccaacagctgcggattccattgtcctttcaaaatccgcttttccacatggccgcagacggaccgggaccacccggtgggcatggtggcggcggggggcacggacctcctagcagccaccaccaccaccaccaccaccatcatcaccgcggaggggagccacccggggatacgttcgctcccttccacggctacagtaaatccgaggatttaagttcaggcgtgcccaaaccccccgccgcttccattctacactcccactcatacagtgatgagttcggaccttccggaacggattttactcgcagacaactctcccttcaggataatcttcagcacatgcttagccccccccaaatcactataggccctcagaggccggcaccgagcggaccaggcgggggttcaggcgggggctccgggggcggaggtggaggccagccaccccctttacagagaggcaagtcccagcaactgaccgtctctgccgcgcagaagccgcgccccagcagcgggaacttactgcaaagtcccgaaccttcttacggccctgcccgccctcgccagcagtctctatccaaggagggtagcatcggcgggtccggcggctctggggggggaggcggcggggggttgaaaccctcgatcaccaagcagcacagccaaacaccttccacactgaacccaacaatgccggcttctgaacgtaccgttgcctgggtttcaaatatgccccacctgagtgcagacatagaatctgcccacattgagagagaggagtataagctgaaggaatatagcaaaagtatggatgaatcccgccttgatagagtgaaagagtacgaggaggaaattcacagcctcaaggaacgactacacatgtctaaccgcaagcttgaggaatatgaacgacgccttctcagtcaggaggaacaaacctccaagatcctgatgcagtaccaggcacgactggaacagagcgaaaagagattgcgacagcagcaggcagagaaagactcacagatcaaatccataatcggtagactcatgcttgtggaagaagagctgcggagagaccatcccgccatggctgaacccctgcccgagcccaaaaaacgactactcgacgcccaattattgattcgctag

SEQ ID NO: 46655 - DNA, 2049 bp, Artificial Sequence
  Description of Artificial Sequence: Synthetic coding sequence
atggaggagggcttccgggaccgggccgccttcatccggggcgccaaggatatcgccaaggaggttaaaaagcacgccgcaaaaaaggtggtgaaaggtttagatcgcgttcaagatgagtacagccggaggtcgtattccagatttgaagaggaggatgatgacgacgatttcccagcgccttctgacggctactaccggggcgaggggacccaggacgaggaggagggaggcgcctcaagcgacgctacagaggggcacgatgaagatgatgagatatacgaaggagagtaccaggggattcctagggccgagagtggcgggaagggcgaacgaatggcagatggtgcccctctcgcaggggtccggggtgggcttagtgacggtgaagggccacctgggggccggggggaggcacagagacgaaaggagagagaggaactcgctcagcaatatgaggctattctcagagaatgcggacatggccgtttccagtggacactctacttcgtgttgggtctcgcccttatggctgacggcgttgaggtcttcgtggtcggctttgtcttgccctctgcagagaaggatatgtgcctgagcgacagtaataaggggatgctgggcttaatcgtgtatttgggaatgatggtcggtgctttcctgtggggaggcctggctgatcgcctgggcagaaggcagtgcctgttgatctctcttagtgtgaactctgtatttgccttttttagtagctttgtgcaggggtacgggacctttctgttttgccggttgctgagtggcgtggggataggcggctcgatccccatcgtgttctcatacttctccgaatttctggctcaggaaaaaagaggcgagcatctgtcttggctatgtatgttttggatgatcggaggcgtctacgccgccgctatggcctgggcaataatcccacactacgggtggagttttcagatggggagcgcttaccaatttcattcttggcgcgtgttcgtgctggtatgcgcttttccgtcggtgtttgccattggggccttaactacccaacccgaatctcctcgattctttttggaaaatgggaagcacgatgaagcttggatggtgttgaaacaggtgcatgatacaaacatgagggccaaaggccaccctgaaagggtattttcagtcactcacatcaagactatccaccaggaagacgagcttattgagatccaaagcgataccgggacttggtaccaaagatggggtgtgagagctctatctctgggtggccaagtctggggtaatttcctgtcctgttttggcccagagtacagacgcataacgctcatgatgatgggagtttggttcactatgtccttttcgtactacggactcacagtttggtttccggatatgattcgccacttgcaggccgtagactatgcttcccgcacaaaggtgttcccgggagaacgggtagagcatgtgacgtttaatttcactttagagaaccagatccatcgtgggggccagtactttaatgacaagttcattggccttcgcttgaaatctgtgtccttcgaggacagcctgttcgaagaatgttattttgaagacgtcactagctctaatactttctttaggaactgcacctttatcaatacagttttctacaacactgatttatttgagtacaagttcgtgaattctagactaatcaattccactttcctgcacaacaaagagggatgtccactcgatgtaactgggaccggagaaggcgcttatatggtctacttcgtgtcatttctggggactcttgccgtgctgccgggaaatattgtgagtgcgctgctcatggacaaaatcgggcgcctgcgaatgctcgccggaagttcagtgatgtcctgtgttagctgttttttcctttcatttggcaactcagaatcagccatgatagccttactgtgccttttcgggggcgtctccatcgcaagttggaatgccctggatgtcctgaccgtagagctctaccccagtgataagcgctag

SEQ ID NO: 46656 - DNA, 2229 bp, Artificial Sequence
  Description of Artificial Sequence: Synthetic coding sequence
atggaggagggcttccgggaccgggccgccttcatccggggcgccaaggacatcgccaaagaggttaagaaacatgctgcaaagaaggtggtgaaaggactggaccgtgtccaggatgagtattcacgaagatcttactcccgcttcgaagaagaagacgatgatgatgatttccccgctccaagcgacgggtactaccggggagaagggacccaggatgaggaggaggggggcgcctcctctgatgcaacagagggtcatgacgaggacgatgaaatctacgagggcgagtatcaaggaatcccccgagcagaaagcggcggcaaaggcgagcgcatggccgatggggcgccactcgcaggagtccgaggaggcttgagtgacggagaagggccaccggggggccgaggcgaagcgcagaggcggaaggagcgagaagaactggctcagcagtacgaagcaattctgagagagtgcggacatggccgcttccagtggaccctttacttcgtgctcggtctcgctttaatggctgacggagtcgaggtgtttgtggtcggattcgtgctgccctccgcggaaaaagatatgtgcctgagtgattccaacaaaggtatgctgggcctgatcgtgtacctcggaatgatggtgggcgcctttctgtggggggggctggctgataggcttggcagacgccagtgccttctgatctccctcagcgtgaattcggtttttgccttttttagcagcttcgtgcaggggtatggtaccttcctgttctgtaggttgctgagcggcgtaggaattgggggcagcatccctattgtgttctcctacttttcggaatttctggcgcaggagaagcgcggcgaacacctgtcttggctctgcatgttctggatgattggtggcgtgtacgcggccgccatggcgtgggccatcattccccattatggatggtccttccagatggggagcgcatatcagtttcactcttggagagtgtttgtgctagtgtgcgcctttccctctgtgttcgccatcggagccctgaccacacagccagaaagcccacgatttttcttggagaacggcaaacacgatgaggcctggatggttctgaagcaggtccatgatacaaatatgcgggctaagggacaccccgagcgagtattcagcgttacccatattaagactatccatcaggaggacgaactaatcgaaatacagtctgatacaggtacttggtatcagaggtggggcgtgcgggccctatcattgggggggcaagtgtggggcaatttcctctcttgttttggccctgaataccggcgtatcaccctcatgatgatgggggtctggttcactatgagcttctcttactacgggctgactgtgtggttccccgatatgattagacacttacaggcagtcgactatgcctcacggacaaaggtgtttcctggtgaacgtgttgagcacgtgacgtttaactttacgctggagaaccagattcataggggaggacaatactttaatgacaagtttatcggtctgagactcaaaagcgtctcctttgaagactccctctttgaagagtgctatttcgaggatgtgacctcttccaatactttcttcagaaactgtacctttattaacacggtgttctataacactgatcttttcgaatacaagtttgtgaattctcgcctgatcaacagcacattccttcacaacaaagagggatgcccactcgacgtgaccgggacaggggagggcgcctacatggtttacttcgtgtctttcctaggaacccttgccgtgcttcctgggaatattgtgagcgccctgctcatggataagatcggcagattgaggatgctcgctgggtccagcgtgatgagctgtgtgtcatgcttcttccttagctttggaaattcagaaagcgcaatgatcgccctgttgtgcctgtttggaggagtgtccatcgcctcatggaacgctttggatgtgctcacggtcgaactgtaccccagtgataagcggacaactgctttcggatttcttaatgctctgtgtaaattggccgctgttctcggcatcagcatctttaccagctttgttggaattaccaaggctgctcccatcctgtttgcatccgctgcactcgcacttggaagtagcctggccttgaaactacctgagacacggggacaggtgctccagtag

SEQ ID NO: 46657 - DNA, 2052 bp, Artificial Sequence
  Description of Artificial Sequence: Synthetic coding sequence
atggacgactacaagtaccaggacaactacggcggctacgccccctctgacggatactatcgcggcaatgaaagcaaccccgaagaagatgcacaatccgacgtcacagaaggacatgacgaagaagatgagatctacgagggggaatatcagggaataccgcaccctgacgatgtaaaggcaaaacaggccaaaatggcgcctagccgcatggattcactcaggggccagaccgatttaatggcggaaaggctcgaggacgaagaacagctggcccatcagtatgagacaattatggatgagtgtggccatggccgctttcagtggatcctgtttttcgttcttgggttggccctgatggcggacggagttgaggtcttcgtcgtgtcgttcgcactgccttccgctgagaaagatatgtgcctctcaagtagtaaaaagggcatgttagggatgatagtgtatcttggtatgatggcgggcgccttcattctgggaggactcgccgacaaacttggccggaagagggtactctcgatgtccctagctgtgaatgcttctttcgcttcactgtcaagttttgtacagggctacggggctttcctattttgtcgccttatctccggaatagggatagggggagcgcttcctattgtgtttgcatatttttcagagtttttgtctcgagaaaagcggggcgagcatctgagctggcttggcatattttggatgaccggcgggttatacgccagtgcgatggcatggagtattatccctcactacgggtggggtttttccatggggacaaattatcactttcattcgtggagggtgtttgtcatagtgtgtgccctcccttgtaccgtgtcaatggtcgcccttaaattcatgcccgagtcccctaggtttctgttggaaatgggcaagcatgacgaggcctggatgatactgaagcaggtgcatgacaccaatatgagggcgaaaggaaccccggagaaagtatttactgtgtctaacatcaagacgcctaagcagatggacgagtttatcgaaattcagagctctaccggtacttggtaccagaggtggctcgtgaggtttaaaaccatatttaaacaggtttgggataatgccctttactgcgttatgggaccctacagaatgaataccctaattctggctgtagtgtggtttgcaatggcctttagttattatggactgacagtttggttccccgatatgattaggtatttccaagatgaggagtacaagagtaagatgaaagtattttttggcgaacacgtctacggcgctaccatcaacttcacaatggagaaccagatccatcagcacggtaaactggtgaacgataagtttacaagaatgtacttcaaacacgtccttttcgaggatacatttttcgatgagtgttacttcgaagacgttacaagtacggatacatatttcaagaattgcacaatcgaatctaccatcttttacaacaccgatctatatgaacataaatttatcaactgcaggttcattaactcaaccttcctggaacagaaagaggggtgccacatggacttagagcaggacaacgattttctgatttatcttgtgtcgttcttagggagtctaagtgtgctgcctgggaatataatcagtgcactcctcatggacagaattggacggctgaaaatgatcggcggatccatgctgatctcagccgtgtgttgttttttcttgtttttcgggaattcagaaagtgccatgattggctggcaatgtctgttttgtggaaccagcatagcagcctggaacgcactggacgtgattaccgtagaactctaccctacgaaccagcgtgcaaccgcttttggcatcctgaatggattgtgcaaatttggtgccattctcggaaatacaatcttcgccagcttcgtcggtattactaaggtcgtgccgatcctattagccgccgctagtctggtaggaggcggcctgatagcattgcgactaccagaaacccgggaacaggtgcttatgtag

SEQ ID NO: 46658 - DNA, 2052 bp, Artificial Sequence
  Description of Artificial Sequence: Synthetic coding sequence
atggacgactacaagtaccaggacaactacggcggctacgcccccagcgatggctactatagggggaatgagtcaaaccctgaagaagacgcccagagtgatgtgaccgaaggacatgacgaggaagacgagatctatgagggggaataccaaggcatcccccaccccgatgatgtgaaggccaagcaggccaagatggcgccttcccgcatggattcactgcggggccagactgaccttatggctgagaggctagaggacgaggagcagctggcgcatcaatacgaaacgatcatggacgaatgcgggcacgggagatttcagtggatcttgtttttcgttctcggcctcgcactgatggcagatggcgtggaagtctttgtagtgagcttcgccctgccttctgcagagaaggacatgtgcctgagctcctcgaagaagggaatgttggggatgattgtctatcttggaatgatggcaggcgcgtttatcctgggtggattggcggataagctcggcagaaagcgcgtgctttctatgtccttggctgtaaatgcttcttttgcttcactgagctctttcgtccagggctacggggccttcctcttttgccggcttatctcaggcatcggtatcggtggggcgctacccattgtgttcgcttacttttcagagttcctgtcaagagaaaagcggggcgaacatttatcttggctcggtatcttctggatgaccggcggattatacgcatctgctatggcatggtccatcataccacactacggctggggattttccatgggcactaattaccattttcatagttggcgggtcttcgtgattgtgtgcgccctgccatgcactgttagcatggtcgccttaaagttcatgcccgaaagcccgaggtttctgctggagatgggtaagcacgacgaggcctggatgattctgaagcaggtgcacgacactaatatgcgcgcaaaagggactccagaaaaagtcttcaccgttagcaacatcaaaacccccaaacagatggacgaattcatcgaaatccagtcttccacaggcacctggtatcagaggtggttagtgagattcaagactatcttcaagcaggtatgggacaacgccttatactgtgtaatgggcccttataggatgaatacactgatcctggccgtagtgtggttcgccatggctttctcatactacgggctcaccgtttggtttccagatatgattcgctactttcaagacgaggagtacaagagcaagatgaaagtgttttttggcgagcatgtctatggagccactatcaactttactatggagaaccagattcaccaacacggaaaactggtcaacgacaagttcacccggatgtacttcaaacatgtgctattcgaagatacatttttcgacgaatgttacttcgaagacgtcacatccactgatacttattttaaaaactgcacaatcgagagcacaatcttttataacacagatctgtacgagcataagttcatcaactgccgcttcatcaacagcaccttcctggaacaaaaggaggggtgtcacatggacctggaacaggacaacgatttcttaatctacctggtttcgttcctgggatcattatctgtgcttccaggcaacatcatctctgctctgttgatggatcgcataggtagactgaagatgatcggtggaagcatgctgatttctgccgtgtgctgcttcttcttgtttttcggcaattccgaatctgcaatgattggctggcaatgtctgttttgcggaacatctatagccgcatggaatgcgctggatgttattactgtagagctgtatccgacgaatcagcgcgctacagctttcggcattttgaacggcctctgcaaatttggcgcaatcctgggcaacacaatttttgcctcctttgtaggcattaccaaggtggtgcctatcctgttggccgccgcaagtctggtggggggcggactgatagcactgaggctaccagagactcgcgaacaggtactgatgtag

SEQ ID NO: 46659 - DNA, 1599 bp, Artificial Sequence
  Description of Artificial Sequence: Synthetic coding sequence
atgatcgtgtacctgggcatgatggccggcgccttcatcctgggcggcctggcagataaactgggaagaaaacgcgtcctgagtatgagcctggccgtgaatgcctcgttcgcctccttaagcagcttcgtgcaggggtatggcgccttcctgttctgccggctgatttccgggatcggtattggcggtgcactgcccattgtgtttgcctacttctcggaatttctctctagagagaaacgcggtgaacatttgtcttggcttggtattttttggatgacgggcgggctgtacgcctccgctatggcgtggtctattataccacactacggatgggggttctccatggggaccaactaccactttcactcctggcgagtgtttgttatcgtgtgcgcactgccttgtaccgtctccatggtggcccttaagttcatgcctgagagccctcgcttcctgctggagatggggaaacacgacgaagcatggatgattctgaagcaggtccatgacactaatatgagggccaaaggcacccctgagaaagtgtttacagtctctaatattaagactccgaaacagatggacgaattcattgaaattcagtccagcacaggaacctggtatcagcggtggctggtgcgcttcaaaacgattttcaagcaggtttgggacaacgccttatattgtgtgatgggcccataccggatgaatacactgattctcgccgtcgtgtggttcgcaatggcctttagctattatggtctgaccgtttggtttccagatatgatccggtatttccaggatgaggaatataagagtaagatgaaagtgtttttcggagaacacgtatacggggctactatcaactttaccatggaaaatcagatccatcagcacggaaaactcgttaacgacaagtttacccgcatgtatttcaagcacgtactgttcgaagacaccttttttgacgagtgctatttcgaggacgtgacctccacggatacatatttcaaaaattgtacgattgagtccacaatcttctataacacagacctgtacgagcacaagttcatcaattgcagatttataaacagcacctttctggagcagaaagagggatgtcatatggatcttgaacaagataatgattttctgatctaccttgtgtccttcctaggcagcctttccgtgctgcccggtaacattatttcagcgctcctgatggatagaattggaaggctcaaaatgattggcggcagcatgctcatatcagccgtgtgttgtttctttctgttcttcgggaatagtgaatctgctatgatcggttggcagtgtctcttctgcgggacgtcaatagccgcctggaacgcactggacgtaatcaccgtcgagctgtacccgacaaatcaacgggctacagctttcggtatcctgaatgggctctgtaagttcggcgctattctaggcaacacgatctttgctagctttgtcggaattactaaggtggtgccaattttgttggcagccgcgtcactcgttggcggggggttgatagctctgaggctccccgagaccagggagcaggtcctcatgtag

SEQ ID NO: 46660 - DNA, 2052 bp, Artificial Sequence
  Description of Artificial Sequence: Synthetic coding sequence
atggacgactacaagtaccaggacaactacggcggctacgccccctccgatggttactatagagggaacgagagcaatccagaggaggacgcccagagtgatgttacagagggacatgacgaagaagacgaaatctacgagggagaatatcaagggataccccatcctgatgatgtcaaggctaagcaggccaagatggctccctctaggatggactcactcagaggccagacagacttaatggccgaacgactggaagatgaagagcagctggcccaccagtacgaaaccattatggatgaatgtggccacggacgtttccagtggattttatttttcgtgctgggcctcgccctgatggccgacggcgttgaagttttcgtggtatcgttcgctcttccttcagccgaaaaggatatgtgcctgagcagctccaaaaaaggcatgcttgggatgatcgtctatctaggaatgatggccggagcgttcattctcggaggactagccgacaagttaggccggaagcgcgttctgtctatgtccctcgcagtgaacgcaagttttgcttccttatcttcattcgtccagggctacggcgcctttttgttctgcaggctcataagtgggattggcattggaggagccctccccatcgtattcgcatacttcagcgagttccttagtcgggagaaaaggggtgaacacctgtcatggctggggattttctggatgactggcgggctgtatgctagcgccatggcttggtccattattcctcattacggatggggcttcagcatgggaaccaattatcactttcacagctggagggtgttcgttatcgtctgcgctcttccctgtaccgtctcaatggtagctctgaaattcatgcccgaatcacctcggtttttgttagagatgggaaaacatgacgaggcctggatgattctaaagcaggtgcatgataccaacatgcgcgccaaaggcacccccgagaaggtattcactgtgtccaatatcaaaaccccgaaacagatggacgagtttatcgaaatacagtcgagcacaggcacatggtatcagcgatggttggtgcggtttaagacgatctttaaacaggtctgggataatgctctgtactgcgtgatggggccctaccggatgaatactctcatactcgccgtggtttggtttgctatggctttttcctactacgggctgacagtctggtttcctgacatgatcagatacttccaagatgaggaatataaatctaaaatgaaggtgttttttggagagcatgtctacggcgctaccataaattttaccatggaaaaccaaattcaccaacatggaaagctggtcaatgacaagtttacccgcatgtatttcaagcacgtcctgttcgaggacaccttctttgatgagtgctactttgaggacgtgacatctacagacacctactttaagaattgcaccattgagagcacaatcttctataacacagatctgtacgaacacaagtttatcaattgtagatttataaattctacattcttggaacagaaagagggctgtcacatggacctggagcaggataatgatttcctaatttacctggtgagtttcctgggaagtctaagcgtgctcccaggaaacatcatatctgcactgttgatggaccgcattggcagacttaagatgattggtggttctatgctgattagtgccgtgtgttgttttttcctgttcttcggtaactcagagtccgcaatgattggttggcagtgtctgttttgcggaacctccattgcagcgtggaatgccctggacgtcattaccgtagagctctaccctactaatcaaagagcaaccgccttcggcattctgaatggactgtgtaagtttggagccattctgggtaacactatcttcgcctcctttgtgggtattacaaaggtggttccaattctcttggccgcagcgagccttgtggggggaggactcatcgctttgcgtctgcctgagacccgcgaacaggttctgatgtag

SEQ ID NO: 46661 - DNA, 2031 bp, Artificial Sequence
  Description of Artificial Sequence: Synthetic coding sequence
atggaggacagctacaaggaccggaccagcctgatgaagggcgccaaagatattgcacgggaagtgaagaagcaaaccgttaagaaagtgaaccaagctgtcgaccgggcacaggatgagtacacacagcgcagctacagcaggtttcaagacgaggaggacgatgacgactattatcccgcgggggaaacatacaacggcgaagctaatgacgatgaggggagtagcgaggctaccgagggccatgatgaggatgacgagatctacgagggggagtaccagggaataccatctatgaatcaggcgaaagactcaatcgtgtccgtaggacagcccaaaggtgatgagtacaaagataggcgcgagttggaatccgaaaggcgggctgatgaggaagaactggctcagcaatacgagctcattattcaagagtgtgggcacggcagatttcagtgggccttattcttcgtgttgggaatggctcttatggcggatggggtggaggtctttgtggtgggatttgtgctgcctagtgcagagacagatctgtgcatcccgaactccggatccgggtggctggggtctattgtgtacctcggaatgatggtgggcgcgtttttttggggtgggctggcagataaggtgggcagaaaacagagcctcctgatctgtatgtcagtaaatggcttctttgccttcctgtcttccttcgtacagggttatggctttttcctcttttgtcgactgctgtctggcttcggaattggcggggctatccctactgtgttttcctacttcgcagaggtgctagcaagagaaaagcggggcgagcatttgagctggctgtgtatgttctggatgatcggaggtatttacgcttcagctatggcctgggcgatcatcccacattacgggtggagtttcagcatgggcagcgcctatcaattccactcttggagagtcttcgtcattgtgtgcgcgttgccatgcgtgagttccgtcgtggccttaacttttatgcctgagtcgccacggttcctgttagaggtgggcaaacatgatgaggcctggatgatcttaaaactgatccatgacacaaacatgcgtgcacggggccaacccgagaaagtattcacagtgaacaagataaaaaccccaaagcaaattgacgagctgattgagattgaatcagataccggcacgtggtatagaagatgctttgtgcgaattcgtaccgaactgtacggtatctggctgacatttatgagatgtttcaattaccctgttcgggacaacactatcaagttgacgattgtgtggttcaccctatcatttggatattacggattgagcgtctggtttcctgacgtaataaaacccctgcagtcggatgaatacgctttgctgactcgcaacgtggagagagataaatacgctaactttacgatcaatttcacaatggagaaccaaattcataccgggatggaatatgataatgggcgttttattggggtgaagttcaagagcgtgacgtttaaagattccgtcttcaaaagctgcaccttcgaagacgtgacaagcgtcaatacgtattttaagaattgtacatttattgacaccgtgtttgataacacggacttcgagccttacaagtttatagactccgagtttaaaaactgttcgttttttcacaacaaaaccgggtgccaaatcacctttgacgacgattatagtgcttattggatctactttgtgaacttcctcggaaccttagctgtgctgcctggcaatatcgtttccgccctgctgatggatcgtatcgggaggctgaccatgttaggtggaagcatggtgctttccggaatttcctgtttcttcctgtggtttggtacatccgagagcatgatgataggaatgctgtgcctttacaacgggctaaccatctccgcctggaactcgctcgacgtcgtcactgtggagttgtaccccacagacaggagacggcgggtcttaccctgttgtcctggatag

SEQ ID NO: 46662 - DNA, 2184 bp, Artificial Sequence
  Description of Artificial Sequence: Synthetic coding sequence
atggaggacagctacaaggaccggaccagcctgatgaagggcgccaaggatattgcacgagaggttaagaagcagaccgtgaaaaaagtcaatcaagccgtcgaccgggcccaggacgaatacacgcagagaagctatagccgcttccaggacgaagaagacgatgatgactactacccagctggtgaaacatacaacggtgaggcaaacgacgatgaagggtcctcagaggcgacagagggccatgatgaggatgacgagatttacgagggggagtaccagggcataccgagcatgaaccaggccaaggacagcatcgtgtctgtaggacagccaaagggcgacgaatataaggataggcgagagttggaatcagagcgcagggctgatgaggaggagcttgctcagcagtacgaattgattatccaggagtgtggtcatggtagattccaatgggccttattctttgtcttaggaatggccctcatggccgacggcgtggaagtctttgttgtgggttttgtgttaccctcggccgagactgacctgtgcataccaaactctgggtctgggtggctcggttccatcgtatacttaggcatgatggtgggcgctttcttttggggagggttagctgataaggttggaagaaagcagtccctgctgatctgcatgagcgtgaacggcttcttcgccttcctgtcctcattcgttcaaggttacggcttcttcttgttttgtaggctgctctcaggttttgggataggcggcgcgattcctacagttttttcctatttcgccgaggttctggccagagaaaagagaggcgaacatctaagttggctctgcatgttttggatgattggggggatctatgcttcagctatggcatgggctataatacctcactacggatggagttttagcatggggtcagcataccagttccactcctggcgcgtattcgtcatagtttgcgcactgccttgcgtgagctcagtggtggcactcacctttatgcctgagtcccccaggttcttgttagaggtgggaaagcatgatgaggcgtggatgatcctcaaactgatccatgacacaaacatgcgggcccgcggacagccagagaaagtgtttactgtgaacaagatcaaaactcctaaacagattgacgagctgattgaaattgaaagcgacacagggacttggtatcgccgctgcttcgtacggatccggacagaactatatggtatttggctgacctttatgcgatgctttaattaccctgtacgcgataacacaattaagctgaccattgtgtggtttacgctatcatttgggtattatgggctgtccgtgtggtttcctgacgtgatcaaacccctgcagagcgacgagtatgccttgctgacccgaaacgtggagagagacaagtatgctaatttcaccataaacttcactatggaaaaccaaattcatacagggatggaatacgacaatggccgcttcatcggagtaaaattcaagtcagtaacattcaaagactccgtgttcaaatcttgcaccttcgaagatgtgactagtgtgaacacatatttcaaaaactgtaccttcatcgacactgttttcgataataccgacttcgaaccttacaagttcattgacagtgagtttaagaattgttccttctttcacaataaaacggggtgccaaattaccttcgacgacgactactctgcatactggatttactttgttaacttcctgggcacgctagctgtcttgccagggaacatagtgagtgctctcctgatggatagaatcggccggctgacgatgctcggtggctctatggtgcttagtggcatttcatgcttcttcctgtggtttggaacttccgaaagtatgatgatcggcatgctttgcctgtataatgggctgaccatctctgcttggaatagtctggatgtcgtgacagtcgaactgtacccaaccgatagaagggctaccggttttggcttccttaacgccctctgcaaggccgccgcagtcctgggtaacttaatattcggctctctagtgtccataacaaagagtattccaattctgctggcatctactgtcctcgtctgtggaggactggttggcctgtgtttgccagatactaggacccaggtgctgatgtag

SEQ ID NO: 46663 - DNA, 780 bp, Artificial Sequence
  Description of Artificial Sequence: Synthetic coding sequence
atggcccccaacatctacctggtgcggcagcggatcagccggctgggacagaggatgtccggttttcaaatcaacctgaatcctttgaaagagccgctggggtttatcaaagtcctcgagtggatagctagtatcttcgccttcgccacatgcggtggctttaaggggcaaactgagatacaggtaaactgtccaccagccgtgacagaaaacaagactgtaactgccacattcgggtatcctttcagactgaatgaagcgtcattccagcctcctccaggagttaacatctgcgacgtgaattggaaagactacgtgctcattggggattatagtagctccgctcaattctatgtaacttttgccgtctttgtgttcctctactgcatcgccgctttgctgctgtacgtgggatacaccagtctgtaccttgacagtaggaagctaccaatgatcgattttgttgtgacactcgtggcgacattcctgtggcttgtgtctacttctgcctgggccaaggcactgaccgatataaaaatcgctacaggacacaatattattgacgaactgccgccctgtaaaaagaaggccgtactctgttattttgggagtgtgacttctatgggtagtttaaatgtgtctgtgattttcgggttcctcaacatgatcctgtggggcggaaatgcatggtttgtgtacaaagagacgtctttacatagcccaagcaataccagtgccccccactctcagggcggtataccgccaccaactggaatctag

SEQ ID NO: 46664 - DNA, 726 bp, Artificial Sequence
  Description of Artificial Sequence: Synthetic coding sequence
atgagcggcttccagatcaacctgaaccccctgaaggagcccctgggatttatcaaagttttagaatggatcgcctcaatcttcgcattcgcaacttgtggaggctttaaaggtcagacagaaattcaggtaaattgccccccggccgttacagagaataagactgttactgccacatttggatatcccttccggctgaacgaagcttcctttcagccacccccaggcgttaatatctgtgatgtaaattggaaggattatgtgctcatcggggattactccagtagcgcccagttctatgtcacattcgccgttttcgtcttcctttactgcatagctgccctgctcttgtatgttgggtacacgtccctgtacctcgatagccgcaaactaccgatgatcgactttgtagtgacattagttgcaacattcctgtggctggttagcacctctgcctgggcgaaggcactgaccgatatcaaaatcgctactgggcacaacattatcgacgaattgcctccttgcaagaagaaagccgtgctgtgctacttcggatcagtcacctcgatgggcagtctgaacgtctccgtaatttttggcttcctgaacatgatcctgtggggtggcaacgcgtggttcgtgtacaaagaaacaagcctgcactcccctagcaacacctcagcaccgcatagtcagggcggtattcccccacctaccgggatttag

SEQ ID NO: 46665 - DNA, 819 bp, Artificial Sequence
  Description of Artificial Sequence: Synthetic coding sequence
atgagcagcaccgagagcgccggccggaccgccgacaagagcccccgacagcaagtggatcgacttttagtgggacttcggtggcgcagactcgaggagcccctcggcttcataaaggtgcttcagtggctgtttgcgatctttgcatttggaagctgtggcagctactccggcgagaccggcgctatggttagatgcaataacgaggccaaggatgtgtcgtctatcatcgttgcattcggatacccattcaggttgcaccgcattcagtacgagatgccattgtgtgatgaggaatccagcagcaagacaatgcatttgatgggagacttttccgctccagccgagtttttcgtcactttagggatctttagcttcttttataccatggccgcgttagtcatatatcttcgctttcataatctgtacactgaaaacaaacgcttccccctagtggacttttgcgtgaccgtcagttttaccttcttttggctggttgctgccgccgcatggggcaaaggccttacagatgtcaaaggggccacgaggccatcctcactgactgccgcaatgagcgtttgccacggggaagaagctgtgtgctcagcaggagcaaccccctccatgggactggctaatataagcgtattgttcggttttattaattttttcttgtgggctggcaattgctggtttgtgttcaaggagacaccatggcacggccaaggccaggggcaggatcaggaccaagaccaggaccagggccagggtccaagtcaggaatcagccgccgaacagggcgccgtcgaaaagcaatag

SEQ ID NO: 46666 - DNA, 627 bp, Artificial Sequence
  Description of Artificial Sequence: Synthetic coding sequence
atgagcagcaccgagagcgccggccggaccgccgacaagagcccccgccaacaggtagatagactgttggtggggctccgctggagaagacttgaagagcccctcggattcatcaaggttctgcagtggctgtttgccatcttcgctttcggtagctgtggctcctatagtggagaaacaggagccatggtgcgttgcaataatgaagctaaggatgtttcatctataatcgtggcctttggttatccttttcgcttgcacaggattcaatacgaaatgcctctatgtgacgaggagtcgtcatcaaaaacaatgcatctcatgggtgatttttccgcacctgccgagtttttcgtcactcttggaattttttcgtttttctataccatggccgcgctggtgatatacctgcggtttcacaacttgtatactgaaaataagagattcccacttgtactgttcgggttcatcaatttcttcctgtgggccggaaattgctggttcgtctttaaggagaccccttggcacggccaggggcaaggccaggaccaggatcaggaccaggatcagggccagggtccatcccaggaaagtgcagccgaacagggggcagtggaaaagcagtag

SEQ ID NO: 46667 - DNA, 798 bp, Artificial Sequence
  Description of Artificial Sequence: Synthetic coding sequence
atgtgcatggtgatcttcgcccccctgttcgccatcttcgccttcgctacctgcggaggatattccggcgggttgaggttgtccgtggattgcgtgaacaaaacagagtcgaaccttagcatagacattgcatttgcatatcctttcaggctacaccaggtcacttttgaggtgcccacttgtgaggggaaagaacgccaaaagttggctcttatcggggactcgtcgtcatccgcagaattctttgtgacagtggcggtattcgccttcttatacagtctcgctgccacagtggtctatatattcttccagaataagtacagagaaaataatcgcggaccgttgatagacttcatcgtgaccgttgtgttctctttcctatggttggtggggtcctcagcttgggccaagggcctgagcgacgtcaaggtagccaccgatccgaaggaagtgctgctcctaatgagcgcgtgtaaacaaccatctaataaatgcatggcaatacactcacccgtgatgagtagcctcaacacctccgtggtgtttggttttctcaatttcatactgtgggcaggcaacatctggtttgtatttaaggagacaggatggcactcgtccggccaaagatacctgtctgatccgatggagaaacatagctcttcttataaccagggtgggtacaatcaggattcatatggatcaagtagcggttacagccaacaagcctcgctgggcccaactagcgacgagttcggccagcagcccaccggccccacttctttcaccaatcagatttag

SEQ ID NO: 46668 - DNA, 831 bp, Artificial Sequence
  Description of Artificial Sequence: Synthetic coding sequence
atgtgcatggtgatcttcgccccccacaacgaggagtgcaagagccacttccatcttctttttgccatcttcgccttcgccacgtgcggcggctacagcggcggcttgcgtttgtcagtagattgcgtgaataaaacggaatcgaacctgtccattgacattgcttttgcatacccatttagactccaccaagtgactttcgaagttcccacctgcgaggggaaagagcggcagaagctagcactgatcggcgattcaagcagcagtgctgagttctttgttaccgtggccgtgtttgcatttctgtactccctcgcagccaccgtcgtgtacatttttttccagaacaaataccgtgagaacaatcggggtccccttatagatttcatcgtgaccgtggtgttctcattcctctggctcgtgggcagctccgcatgggccaaaggcttgagcgacgtaaaggtcgctaccgaccctaaggaggtgttactactaatgtcagcgtgcaagcagccgagcaataaatgcatggctattcacagtccagttatgagtagtcttaacactagtgtggtcttcggatttctgaacttcatcctctgggccggtaacatatggttcgtgttcaaagagactggctggcacagttccggacagcggtacttgtcagaccctatggagaagcatagctctagttataaccagggagggtataaccaggactcttatggttcctcgtcagggtacagccagcaagcaagcctcggaccaacttccgatgagtttggacagcagcccaccggccccactagctttacaaatcagatctag

SEQ ID NO: 46669 - DNA, 858 bp, Artificial Sequence
  Description of Artificial Sequence: Synthetic coding sequence
atggaccccgtgagccagctggccagcgccggcaccttccgggtgctcaaggaaccgttagctttcctccgcgccctggagctgctatttgcaatcttcgcctttgcaacctgtggcggctactccggcggcctgaggcttagcgtcgactgtgtgaataaaacggagtcgaatctcagcattgatattgcattcgcatatccttttaggcttcaccaggttacctttgaagtgcccacctgtgaaggaaaggagagacaaaaacttgccctgataggtgactcatccagttctgccgagtttttcgttactgtggctgtgttcgccttcctttattctctggccgccaccgtcgtctatattttctttcaaaacaagtatcgcgaaaacaatagaggtccgttgatcgatttcattgtaactgtggtgttcagcttcctatggctggttggatcaagcgcttgggccaaaggtctctcagatgtgaaggtggccacagatcccaaggaagtgctactgcttatgtccgcttgcaagcagccatcaaataaatgcatggctatccactcaccggtgatgtcttccctaaacaccagcgtcgtgttcggattcctcaattttatcctctgggcagggaacatatggtttgtttttaaagagaccggctggcacagctcagggcaacggtatctctccgacccaatggagaaacacagctcgtcgtacaaccagggcggctataaccaggatagttatggctcttcatccgggtacagccagcaggcctcactggggccaacctcagatgaatttggacagcagcccacagggccaacttcgttcactaatcagatctag

SEQ ID NO: 46670 - DNA, 177 bp, Artificial Sequence
  Description of Artificial Sequence: Synthetic coding sequence
atgagcggccagaccctgaccgaccggatcgccgccgcccagtactccgtgacagggagcgccgtggcgcgcgcagtgtgcaaagccacaactcacgaggtgatgggacccaagaaaaagcaccttgattacttgcagactttttttcaacaggtgctcccgaatttcgagatttag

SEQ ID NO: 46671 - DNA, 2634 bp, Artificial Sequence
  Description of Artificial Sequence: Synthetic coding sequence
atgagcggccagaccctgaccgaccggatcgccgccgcccagtactctgtgaccggcagcgctgttgccagggcggtctgcaaagcaaccacccacgaggttatgggacctaagaaaaagcaccttgattacttgatacaggccacaaacgaaaccaatgtgaatattccacaaatggcagatacattattcgaaagagcgactaacagcagctgggtcgtagtcttcaaagccctggtcactacacatcacctgatggtgcatggaaacgagcgattcatccaatacctggccagtcggaacacattgttcaatctgagcaactttctggacaagtcaggatcgcacgggtacgacatgtcgacattcataagaagatattcacgatacctgaatgaaaaggcgttttcctataggcagatggctttcgactttgcacgcgtcaaaaaaggtgctgatggtgtcatgcggactatggctcccgaaaaactgctgaaatccatgcctattctccagggccagatcgatgctctgctggagttcgacgtgcacccaaatgagttgacgaatggagttataaatgccgcattcatgctccttttcaaagacctcattaagctcttcgcctgttacaacgacggtgtcatcaatctgctggagaaatttttcgagatgaagaagggacaatgtaaggacgccctcgaaatctacaaaagatttctgaccaggatgactagagtgagcgaattcctcaaggttgctgaacaggtcggaattgataagggcgacattccggatctcacgcaggcaccgagtagtttgatggaaaccctcgagcaacacttaaacaccctcgagggaaaaaaaccgggcaacaaatctggggcccctagtcctctaagcaagtcatcgcccgctacaaccgtgacctcacccaatagcacgcctgctaaaacaatagatacctcccctcctgtggatttattcgctacagccagcgccgccgttccagtctctacctcaaagccatcctctgacctgctggatctccaacctgatttttccagcggtggagcagcagccgcagcagcccctgctcctccaccaccagcaggaggcgcgacggcatggggcgaccttctgggggaagattctctggcggcactgtcttccgtgccatcggaagctcagatatccgatccttttgccccagaaccaactccacctactacgacagccgaaatcgccaccgcatctgcttccgcttccactacaactacagtgaccgccgtgacagcagaagtcgacctattcggcgatgccttcgccgcctcacctggtgaagcacctgcagctagtgaaggtgccgctgctcctgcgacaccaacgcctgtggctgcagcattagacgcttgttccggaaacgacccattcgctcccagcgagggatcggctgaagccgcccccgagttggatctgtttgctatgaaacctccagagacctccgtacccgtcgtgactccgacggcttccactgctccccctgttcctgctaccgccccatccccggcgcctgcggtcgcggccgctgcagcggctacaaccgccgctaccgccgccgctactaccactaccaccacttccgccgccaccgccaccacggctccacctgctctcgacatctttggtgatctatttgagagtacacctgaggtcgcagcggcccccaagccagatgctgccccatcaattgacttattttccacagatgccttctcttcgcccccacagggggcatcccctgtccctgaatcgtcccttactgcggacctgttaagtgacgctttcggaagctccgcttctgaacctcagccagcgtcccaagccgccagctcgtcatcggcctccgcggatctgctcgctgggttcggtggatcgttcatggcgccatccccatccccagtgacccctgctcagaataatttattacagccaaatttcgaagccgcatttggcacaacaccatcgaccagctcttcctcttcctttgatccaagtgtatttgatgggttaggggacctgctcatgcctactatggctcctgccgggcagccggcccctgttagcatggtccccccgagcccagctatggcggcttccaaagcactgggctcggacctggacagctctcttgccagtctagtgggtaatctcggcatttcgggaaccacgacaaagaaaggtgacctgcaatggaatgcgggcgaaaagaagctcacaggcggcgccaactggcaacctaaggttgcgcccgccacatggtcggccggcgtccccccatccgcgcccctgcagggcgcagtccctcccacaagtagcgttcctcctgttgcaggcgcgccctccgtgggtcagcccggggccggcttcgggatgcctccagctggcacaggaatgccgatgatgccgcagcaaccagtgatgtttgctcaaccaatgatgcgcccacctttcggggctgctgccgtgcccgggacccagctgtcccctagccctactcccgcctcacagtcccctaaaaagcctcccgcaaaggatcccctggctgacctaaatatcaaggatttcttgtag

SEQ ID NO: 46672 - DNA, 2709 bp, Artificial Sequence
  Description of Artificial Sequence: Synthetic coding sequence
atgagcggccagaccctgaccgaccggatcgccgccgcccagtactcggtcacagggtctgccgtggcaagagcggtttgtaaggctactacgcatgaggtcatgggcccgaagaagaaacacctggactacctgattcaggccacaaatgagaccaacgtgaatatccctcagatggctgatactctgtttgagcgcgctacaaattcgagctgggtcgtagtgtttaaggctctggttactactcaccacttgatggtacacggcaacgagcggttcatccaatacctagctagcagaaacaccctgtttaatcttagcaattttctggataagagcggttctcatggctatgacatgtccaccttcatccggcgttactctcggtatcttaatgagaaagccttctcttaccgtcagatggcattcgacttcgcacgtgtgaagaaaggcgcggatggagtcatgcgaactatggctcctgagaaactattgaaatccatgcctatcctgcagggccaaattgacgctctccttgagttcgatgtccatcccaacgagctcactaacggggtgattaacgctgcttttatgttgctcttcaaagatcttatcaaactgttcgcctgctacaatgacggcgtaatcaatctgctggagaagttttttgagatgaagaagggccaatgtaaggacgccctggaaatctataagcgcttcctcacaagaatgactcgcgtgtccgagtttcttaaggttgctgagcaggtgggcatagacaaaggagacatcccagacctgactcaggctcctagctcattgatggagactctggagcagcacctcaacactctggaaggcaagaaaccaggcaacaatgaggggtccggagcacccagtcccctatctaagtcttctcccgcgaccactgtgactagcccaaacagcacgccggctaaaacgatcgataccagcccaccagtggatctcttcgctactgccagcgctgctgttcctgttagtaccagcaaaccttcctccgatctcttagatctgcagcctgacttttcatctggtggagccgccgccgctgctgcaccagccccaccgccaccggctgggggtgctacagcctggggtgatcttctcggcgaagacagtctggcagctctgagtagcgtgccgagcgaagcacagatatcagaccctttcgctccagagccaacgcctcctactaccactgcagagatcgctactgccagcgcttccgcatccacaaccaccacagtgaccgcagtcacagccgaagtggacctgttcggcgatgcatttgctgcctcccctggcgaggccccagccgcctctgagggtgcagccgctcccgctactcccacccccgttgccgcggcactggatgcgtgctcaggcaatgaccccttcgcaccttcagaaggaagcgccgaggctgcacctgagctcgacctgtttgctatgaaacctcccgaaacatcggtgccagtggtgacgcctacagctagtaccgctccccctgtgcccgctaccgccccgtcacctgctcccgccgtggcagcagccgccgctgctaccaccgcagccacagccgcggccacaactaccaccacaacgtcagctgcaaccgccaccaccgctcctccagccttagatatcttcggtgacctctttgagtccacccctgaggtggcagccgcgcccaaacccgacgcagcaccatctattgatctcttcagtacagacgcgttctcttccccaccccagggtgccagccctgtgccagagtcttcgctcactgccgacttactatctgtcgacgctttcgcagcaccctcaccagcgacgacggccagtcccgcaaaagtagactcctccggggtcatagacctgtttggagatgcttttggaagttctgctagcgaaccccaaccggcttcacaggccgcttcttctagttcagcttcagcggatcttctggcaggatttggcggcagctttatggcaccttcaccaagcccggttacaccggcccagaacaacctcctacagccaaatttcgaggcagcattcggaactacgcctagcacctctagctccagcagtttcgatccctctggggacctccttatgccgaccatggcccctgcaggccagccggctcccgtgtccatggtgcccccatctcccgccatggcagcctcaaaagcgttgggatcagatttggattcctccctcgccagcctagtgggcaatctcgggatttctggaactacaacaaagaagggtgatttgcagtggaatgcaggggaaaaaaaactgactggcggagcaaattggcagcccaaggtggcccccgcaacatggtctgctggggtccccccttctgccccgctgcagggcgctgtgccgcctacctcctccgtacctccggtggctggggcaccgtccgtcggacagcctggagccggtttcggcatgcctccagcagggaccgggatgccaatgatgcctcagcagcccgtgatgttcgcccagcccatgatgagacccccgtttggtgctgccgccgtaccggggacccaactttccccctcacccacccctgcgtcacaatcccctaagaagcctcccgctaaagacccccttgcggatttaaatattaaggatttcctctag

SEQ ID NO: 46673 - DNA, 450 bp, Artificial Sequence
  Description of Artificial Sequence: Synthetic coding sequence
atgagcggccagaccctgaccgaccggatcgccgccgcccagtactccgtaacaggtagtgccgtggcccgggccgtctgtaaagcgacaacccacgaggttatgggtcccaagaagaagcatctcgactacttgatacaggcaacgaatgaaacaaacgtgaatataccccaaatggccgacaccctgttcgagcgggcgacgaattccagttgggtggtcgtgttcaaagcactcgtgacaacccaccacctaatggtacatggcaatgaaagattcatacagtacctagctagccgcaacactcttttcaacctgtccaatttcctcgacaagtcagggagccatggctacgacatgagtacatttattagaagatatagtcgttaccttaatgagaaagcttttagttatagacagatggcattcgatttcgccagagttaaatag

SEQ ID NO: 46674 - DNA, 2724 bp, Artificial Sequence
  Description of Artificial Sequence: Synthetic coding sequence
atgagcggccagaccctgaccgaccggatcgccgccgcccagtactccgtgactggatccgccgtggctagggccgtttgcaaggcaactactcatgaggtcatgggccctaagaagaagcatctggactatttgattcaagccactaacgaaaccaacgtgaatattcctcaaatggcagatactctttttgagcgggcaacaaactctagttgggtcgtggtatttaaagctctggtcacgacgcaccacctcatggtccacggtaatgaaaggttcatccagtacttagcttcgcgcaacaccctctttaacctgtctaatttcttagacaagagcgggagtcatggatacgacatgagcactttcattagacgatattccagatatctgaatgaaaaagccttcagctatcgccagatggcttttgactttgcaagagtaaagaaaggagccgatggggtgatgcggaccatggccccggagaaactcttgaaatcgatgccgatcctgcagggccaaatcgatgctctgctcgaatttgacgtgcaccccaatgagttgacaaacggcgtgatcaacgccgcttttatgctcctgttcaaggacttgatcaagctatttgcctgctacaacgacggcgttataaatctgctggagaagttttttgagatgaagaagggccagtgtaaagacgccctcgagatctacaaaagattcctgacacggatgacacgggtgagcgaattcttaaaggtcgcagagcaggttggcattgataagggagacatccctgacctcactcaggctccttcttcattgatggaaactcttgaacagcacttaaatacccttgagggcaagaaacctggtaacaacgagggctcaggtgccccatctcccctgtctaagtccagtcctgctacaaccgtcacaagcccaaacagtacccccgctaagacaatcgatactagccctcccgttgatctcttcgccaccgcctctgccgctgtgcccgttagtacatcgaagccatcgtctgatttgttagatttgcagccagatttttccagcggaggagccgccgcagccgccgcccccgccccacctccaccagctggcggagccacagcctggggggatcttctgggggaagacagtctcgcagccctgtcctcagtcccctccgaggcccagatctctgatccattcgcacctgaacccacacccccgacaaccacagccgagattgctactgcatctgcaagtgcttctacgactacaactgtcactgccgtgaccgcagaggtggacctgtttggcgatgcatttgctgcatcgccaggggaagctccggccgcctctgaaggcgccgccgctcccgctactccgactccagttgcagccgcgctcgacgcctgctcggggaatgatccttttgcgccatctgaggggtccgcagaagcagcaccagagctggatctatttgccatgaagccgccagagacatcagttccagtcgtgactccgacagcttccactgcaccaccagtacccgccaccgcaccatctccggcccctgctgtggccgctgctgctgccgccaccactgctgccactgctgcagccacaacgactacgaccacaagcgcggccacagccacgactgccccccccgcgctagatattttcggtgacttatttgaaagtacccccgaagtcgccgcagccccaaagcccgatgccgcaccgagcatcgatcttttttccaccgatgccttctcatcaccgccacagggggctagccccgttccagaatccagcctaacagcggacttgctctcagtggatgccttcgccgctccctctcctgccacaaccgcaagtcccgccaaggtggatagctccggggtaatagacctgttcggggacgctttcggaagcagcgcatccgaaccgcagcctgcaagccaggccgccagtagctcaagcgctagcgctgacctgctggctggtttcggcggctcatttatggcacccagccccagcccagtcacaccagcacaaaataacctccttcagcccaacttcgaggccgcctttggcactaccccatctacaagctcctcaagcagctttgaccctagcgtgtttgatgggctgggggaccttctcatgcctaccatggcacctgcgggacagcccgccccagtttcaatggttcccccttcccctgccatggcagcctccaaagctctcggatccgacctggattcaagcctagcctcgttagtggggaacctgggcatatctgggactacgactaaaaaaggcgacctccagtggaatgccggagagaagaagctaactggaggtgctaactggcagccgaaggttgctcccgcaacctggtcagctggagtcccaccatccgcccccctgcagggagccgtgcctccaacgtccagtgtgccccccgttgcgggggccccttccgtggggcagcctggggcagggtttggtatgccaccagctgggaccggtatgccaatgatgccccaacagcctgtgatgtttgcgcagccaatgatgaggcccccattcggcgccgccgcagtccctgggactcaacttagcccctcccctactccagcctctcaatcccctaagaagccacctgcaaaagacccgctggcggatctcaatattaaggacttcttgtag

SEQ ID NO: 46675 - DNA, 2724 bp, Artificial Sequence
  Description of Artificial Sequence: Synthetic coding sequence
atgagcggccagaccctgaccgaccggatcgccgccgcccagtactcagtcaccgggagtgcagtggcaagagcagtgtgcaaggcaaccacacacgaagtgatgggcccaaagaaaaagcacctggattatctgattcaggctaccaacgagacaaatgttaacatccctcagatggccgataccctgttcgaacgagccaccaattcgagctgggtggtcgtgttcaaggcactggtaactactcatcatttgatggtgcatggcaacgagagattcatccagtacctggcttcaaggaatacactcttcaacctgagtaacttccttgataagagcggaagccacggttacgatatgtctacctttatccgacgctattctcgctacttgaacgaaaaggcattctcctatcggcaaatggcctttgatttcgctagggttaaaaagggggccgatggcgtaatgcgcacgatggctcccgagaaactgttaaaaagtatgccaattctgcagggccagatcgacgctttgcttgagttcgatgtacatccaaatgagctgacgaatggggttatcaatgccgcgttcatgctgctgttcaaagacctgatcaaattgtttgcctgttacaatgacggggttatcaatctattggagaagttttttgaaatgaagaagggccagtgcaaggatgctttggagatttacaagagattcctaacccgcatgacacgggtctccgagttcctgaaggtggctgagcaggtgggaatcgataaaggtgacatccctgatctaacacaggcgccttcctcactgatggagacgttggagcaacacctcaacacactggagggtaagaagcccggaaacaacaagatcagtggtgccccaagcccgttgtccaagagttcgcccgcaacaaccgtaacctcccccaacagcacccccgcgaagactattgatacttcaccccccgtagatttattcgcaaccgcgtctgctgctgtccccgtgtccactagcaagccttcaagtgatctccttgatctgcaaccagacttctcaagtggaggagcagcggcagcagctgcgccggcgccgcccccccccgctgggggcgctactgcttggggcgatttgctgggagaagattccctcgctgcactctcttccgtgccaagcgaggcacaaatttcagatccattcgctcctgagccgactcctcctaccacaacggcggaaattgcgactgcaagcgcgagtgcatccacaacaaccaccgtgacggccgtcacagccgaagttgatctcttcggagatgccttcgccgcatcaccaggcgaggctccagctgctagcgaaggcgctgcagccccagccacacctactccagtcgcagccgcactcgacgcctgctcggggaatgaccccttcgccccaagcgaaggctctgcagaagccgctcctgaactggacctatttgctatgaaacccccagaaaccagcgtgcccgtggtgacccccaccgcttcaaccgccccacctgtgccagctaccgcgcccagccctgcacctgcagtcgctgctgccgccgcagctactacagccgcaactgccgctgctactactacaacaactacctccgctgctaccgccaccactgctccccccgccctcgatatcttcggtgacttattcgagtccacacccgaggtcgcagcagctcccaagccagacgctgctcccagtatcgatctcttctccactgacgcattttcctctcctccacagggagctagccccgtaccagaatcatccctgactgccgacctgttatcagtggatgcattcgctgccccctcgccagccacaaccgcttctccggcaaaagtggattcctccggtgtcatagatctctttggcgacgcattcgggtcatctgcctctgagccccaaccagcaagtcaggcagcctctagttccagtgccagcgcagatctgttagccggcttcgggggttcttttatggctccatccccctctccagtcacacctgcccagaataatctcttgcaacccaacttcgaggccgcattcggaactactcctagcacgtccagttcttcttcattcgatcccagcgtgttcgatggtcttggagatctgctcatgcctaccatggctcccgccggtcagccagcccctgtgtcgatggtgccccccagccctgcaatggcagctagtaaggctctaggctcagaccttgactcaagccttgcctcgctcgtgggcaatctcggaatatctgggacgactacgaagaagggtgacttacaatggaacgcaggcgaaaaaaaactgactggcggggccaattggcaaccaaaagttgcccccgctacttggtcagcaggcgtgcctccaagcgcacctttgcaaggcgccgttccgcccacatcaagtgtgccccccgttgctggcgctccttccgtaggccagcccggggccgggttcggcatgccccccgccggtacagggatgcctatgatgccccagcaaccggtcatgttcgcacagcccatgatgagacctcctttcggagccgctgctgtcccgggaacacaactttctcctagtcccacgcccgctagccagtcaccgaaaaagcctcctgctaaagacccgttggcagacttaaacattaaagatttcctttag

SEQ ID NO: 46676 - DNA, 1803 bp, Artificial Sequence
  Description of Artificial Sequence: Synthetic coding sequence
atgagcggccagaccctgaccgaccggatcgccgccgcccagtactccgttaccgggtcggccgtggctcgagccgtgtgcaaagcgactacccacgaggtcatgggtcccaaaaagaagcaccttgattacctgatacaggctaccaacgaaacaaacgttaatatccctcagatggctgatactctgttcgaacgtgctaccaattcaagttgggtggttgtcttcaaggccctggttactacccaccatttgatggtacatggcaacgaacggttcattcagtacctggccagtcgcaataccttattcaacctatcaaactttctggataagagtgggtctcacggatatgacatgagcacattcatcagacgttattctcggtacctaaatgagaaggctttcagctatcggcagatggcgtttgatttcgcgcgcgtgaagaagggcgctgacggggtcatgaggactatggcacccgaaaagctgttgaaaagcatgcccatcctccagggacagatcgacgcacttctcgagtttgacgtgcaccccaatgagttaactaacggagttattaatgccgccttcatgctgttgtttaaggatctgatcaaactgttcgcttgttataatgacggcgttatcaacctgctggagaaattcttcgaaatgaagaaagggcagtgcaaggatgcgctagagatttataaacggttcctcacccggatgacccgcgtgtccgagttcctgaaggttgctgaagcccccagcagcctgatggaaaccctggagcagcatctgaatacattagaaggtaagaaacccggaaacaagtcaggagctccctccccgttgtctaagtcctcccctgcaacaacggtgacgtcccctaatagtacccctgccaaaacgatcgatacttctcccccagtcgacctgttcgccaccgcctccgcggcagtcccagtatccacttccaaacccagctctgatttattggatcttcagcctgacttttctagcgggggcgctgccgccgccgctgcgcccgctcctcctcccccagctgggggagccaccgcatggggggggtttggcggctcatttatggcacctagtccatctcccgtgacacccgctcaaaacaatttattgcaaccaaactttgaggccgcgtttggtacaacgccaagcacctcaagttctagttcatttgatccttccgtatttgacggccttggcgatttactcatgccgactatggcacctgcaggacagccagcaccggtcagcatggttccccctagtcctgcaatggccgcttccaaggcactcggatcagatctggatagctctctggcatctctggtaggaaatttgggcataagcggaaccaccacaaagaaaggggatctgcagtggaatgcaggcgagaagaaactgacagggggcgccaactggcagcccaaggtggcacctgcgacatggagtgcgggcgtccccccttctgcacccttgcagggcgctgtgccaccgaccagttctgtcccaccggtggcgggagccccatcagtggggcaacccggagccggctttggtatgccccccgccggcactggcatgcctatgatgccccaacagcctgtcatgtttgcccaacctatgatgagacccccattcggtgcggctgctgttcccggaactcagttatctccttctccgactccagctagtcaaagccccaaaaaacctccggctaaagaccctctggccgaccttaacatcaaagattttctatag

SEQ ID NO: 46677 - DNA, 2724 bp, Artificial Sequence
  Description of Artificial Sequence: Synthetic coding sequence
atgagcggccagaccctgaccgaccggatcgccgccgcccagtactccgttacaggttcggccgtggccagagctgtttgcaaggctaccacccatgaagtcatgggtccaaagaaaaaacacttggactatctgattcaagctactaacgagactaacgtaaacatcccacagatggcagacacactcttcgagcgagcaaccaactccagctgggttgtggttttcaaagcactggtcacaacccaccacttaatggtgcacggcaatgaacggtttattcagtacctcgcatcgcgcaataccctcttcaatttgtcgaattttctcgataagagcgggtcccatgggtacgacatgtcgacattcatacgaagatattcccgctacttgaatgaaaaggctttttcctaccggcagatggccttcgattttgccagggtgaagaagggcgctgacggggtgatgagaactatggccccggaaaagctgctcaagagtatgcctatcttacagggccagattgacgccttgctcgagttcgatgtgcaccccaacgagctaacgaatggggtgattaacgctgcatttatgcttctcttcaaggatctaattaagctcttcgcgtgttacaacgatggtgtcatcaacctcttggaaaaattctttgaaatgaaaaaggggcagtgcaaggacgctctggagatttacaaaagattcctcaccaggatgactagagtgtctgaatttctgaaagtggccgagcaggtgggtattgacaagggagacataccagatcttacgcaggcaccatcctctctgatggaaacactggaacagcatctcaacacacttgagggaaaaaagccaggcaacaacgaagggtcgggggcaccatctcctttaagcaagagcagtcccgctactacagtgaccagccccaactccacccctgcaaagactatcgatacaagcccaccagttgacttatttgccaccgcttcagccgccgtaccagtgagcacaagcaaaccttcctctgatctgctagatctgcaaccggatttcagcagcgggggcgccgctgccgccgcggctccagctcccccgccacccgctggaggcgctaccgcttggggcgatctactgggagaggattctctggctgccttgagctccgtgccctctgaggctcagatctccgaccccttcgcgccggaacccacgccgcctacgaccaccgcagagatagcaaccgctagtgcctccgccagcacaaccacaacggtgacggcagtcacggctgaggtcgatcttttcggcgatgcctttgcggcatcccctggggaggctcctgccgcttccgagggagccgccgcccccgctacgcccacacctgtcgccgctgccctggatgcctgcagcggtaacgacccctttgcaccctcagaaggcagcgccgaggctgcccctgaattagatctgttcgccatgaaacctcctgaaactagcgtgcctgtggtgacccccactgcttcaaccgcccctcccgtgcctgccaccgcaccctcgcctgctccagctgtggctgcagcagctgccgctaccacagcagcgactgcagccgcgacaactacaactactactagcgcagcgactgcaaccacggccccgcccgccctggatatttttggggatctatttgagtcaacgcctgaggtggccgccgcccccaaaccagatgccgcgccttcgatcgatttattctccacagacgcgttcagctcgccccctcagggagctagtcccgtgccggaatcatctctgactgctgaccttctgagcgtggatgcctttgcagctccatctcccgcgaccacagcctctccagcgaaagttgattcctctggcgtaatcgacctgtttggcgacgcttttgggagctccgcctctgagccccagcccgccagccaggccgcctcttctagctctgcatccgcggatctactagccggcttcggggggagctttatggccccttcccctagcccagtgactcctgcacagaacaatcttttgcagcccaactttgaggccgcttttggaacgacacccagtacaagctcctcgtcgagtttcgatccttcagtatttgatggtctaggcgatctgctgatgcccactatggccccagccggacagccggcccccgtctctatggtcccacccagtccagctatggccgcatccaaagccctgggctccgatctggactccagtctggcgtctctggtcggtaacctaggcatatccggcaccactaccaaaaagggcgacctacagtggaacgctggagagaagaagcttacaggcggtgctaattggcagcctaaggttgcccccgcaacctggtccgcaggcgttcctccgtctgccccacttcagggcgcggtccctcccacatccagtgtgcctcctgtcgctggcgcaccatcggtgggccagcccggtgccggctttgggatgccccctgccggcactggaatgcctatgatgccccagcaaccagtcatgttcgctcaacccatgatgagacctccattcggagccgcggccgtgccaggtactcagctttcccctagtcccacacctgcttctcaaagcccgaagaagcctcccgcaaaggaccctctcgcagatttaaatattaaagattttctgtag

SEQ ID NO: 46678 - DNA, 633 bp, Artificial Sequence
  Description of Artificial Sequence: Synthetic coding sequence
atggagaccctggagcagcacctgaacaccctggagggcaagaagcctggaaataaatatgcttctggggctccatctcctctctctaagagcagcccggccaccacggtcacttctccaaattcaacccccgccaagacaatcgacacgagtccaccggttgaccttttcgctacagcttccgcagccgttccagtttcaacttccaagccaagttctgacctgctggacctccagcccgatttctcaagcgggggtgcggcggcagcagcggcaccagcaccgccccctcctgctggcggcgccaccgcttggggcgacctcttaggggaggacagcctggctgccctgtccagtgtgccttccgaggcacagatttctgatcctttcgcgcccgagcctacccctccaaccaccacagctgaaattgctaccgcctcagcctcagcatccaccactactacagttaccgccgtgacagcagaagtcgacctgtttggaggcagcgcagaggctgccccggagttggacttgttcgcaatgaaacctcctgaaactagcgttcctgtggtgacccctaccgcctcaacagcgccacccgttccagccaccgctccatcaccagccccttag

SEQ ID NO: 46679 - DNA, 456 bp, Artificial Sequence
  Description of Artificial Sequence: Synthetic coding sequence
atgagcggccagaccctgaccgaccggatcgccgccgcccagtactctgtgactgggagtgccgtggcccgagctgtatgcaaagctacaacacatgaggtgatgggacccaaaaaaaaacatctggattacctgattcaggcaaccaacgaaaccaatgtgaacatccctcagatggcggacacattgttcgaaagagctactaactcaagttgggtcgtagtgttcaaagccctcgtcacaacccaccacctgatggtgcacggcaatgagcgatttattcagtatctggcatcccggaacaccctcttcaatctcagcaatttcttggacaaaagcggctcccatggttacgatatgtcaactttcatcagaaggtactctcgttacctcaacgaaaaagcgttctcatatcggcagatggcctttgatttcgctagagtcaagaaggggtag

SEQ ID NO: 46680 - DNA, 459 bp, Artificial Sequence
  Description of Artificial Sequence: Synthetic coding sequence
atgagcggccagaccctgaccgaccggatcgccgccgcccagtactccgtgaccggcagcgccgtggctcgcgccgtctgcaaagctactacccatgaggtgatgggtccaaagaaaaagcatctggattatcttatacaggctacaaatgagaccaacgttaatatcccccagatggcggatacattatttgagagggcaacgaactcatcttgggtggtcgtgtttaaagccctcgtgacaacacatcacctgatggtccatggaaacgagcgatttattcagtatctggcgtctaggaacacactgtttaatctgtcaaatttcttagataagagcggatctcacggatatgacatgagtacctttatacggcggtattctcgctatctgaacgagaaggcattcagttaccgtcaaatggcatttgactttgcaagggttaagaaaggagcctag

SEQ ID NO: 46681 - DNA, 201 bp, Artificial Sequence
  Description of Artificial Sequence: Synthetic coding sequence
atgagcggccagaccctgaccgaccggatcgccgccgcccagtacagcgtcactgggtcggcggttgcgcgggccgtttgtaaagccacaacacacgaagtcatgggccctaagaagaagcatctggactacttgattcaagcgaccaacgagaccaatgtgaatatcccccaaatggccgacaccctgttcgaaagatag

SEQ ID NO: 46682 - DNA, 1803 bp, Artificial Sequence
  Description of Artificial Sequence: Synthetic coding sequence
atgagcggccagaccctgaccgaccggatcgccgccgcccagtacagtgttactggcagtgctgtcgctagggcagtgtgtaaagccactacacatgaggttatgggcccaaaaaagaaacatttggactatctgattcaagccacaaatgagactaacgtgaacatacctcagatggctgacactctcttcgagagagccaccaatagtagctgggtcgtggtcttcaaggccctggtgacaacccatcacttaatggtgcacggcaatgaacgttttatccagtatctggcctcacggaacacactttttaatctttcaaatttcctggacaagtctgggtcacacgggtacgatatgtctaccttcattaggaggtacagccggtatctgaatgaaaaggccttcagctaccgacagatggcattcgattttgccagggtgaagaaaggagcggatggagtgatgaggactatggctcctgaaaagctgctcaagtctatgccaattctccaaggccagatagatgcgcttctggagtttgacgtacatcctaatgagttgaccaatggagttatcaacgctgcgttcatgttgttgtttaaggatctgattaaactgtttgcatgttataatgacggcgtcatcaatcttctggaaaagttctttgagatgaaaaaggggcagtgtaaggatgctctggagatctacaaacgcttcctcacacgcatgactcgggtttccgaatttctgaaggtcgcagaagcaccatcatcgctgatggagacactggaacagcacctcaacactctggaaggtaagaaaccgggaaataaatccggcgcgccgagcccactgtccaagtcttcacctgcgactaccgtgacaagcccaaacagcactcctgcgaaaaccatcgatacctctccccccgtcgacctgttcgccaccgcctccgccgcggttcccgtatccacctctaagccatccagtgatctcctggacctccaaccagattttagcagcggtggagcagctgccgccgccgcaccagctccacctcctcccgccggcggggctaccgcctggggcggattcggtggctcttttatggctccttctccttctcccgtgacacccgcgcagaataatcttctacagcccaactttgaagccgcctttggaaccacaccctcgactagctcctcttcctcctttgacccctccgtcttcgatgggctgggcgatctgcttatgcccaccatggccccagccggacagccagcccccgtcagtatggtacctcccagccccgccatggcagcttcaaaggctctgggatctgatctggactcttcgctcgccagcctcgtgggaaatctgggtatctcaggtacgactacaaagaagggggatctccagtggaatgcgggcgagaaaaaactcacaggaggggctaactggcaacccaaggtcgcccccgcaacttggtccgccggcgtgccgccgtctgccccattgcaaggggccgtgccaccaacaagctccgtccctcccgtggcgggagcaccaagcgtgggccagcctggggccggcttcggtatgccaccggctgggactggaatgcccatgatgcctcaacagcccgtcatgtttgcacagccaatgatgaggccaccctttggcgccgccgccgtccccgggactcagctctcccccagtccaacccctgcaagccagtcacccaagaaaccgcccgccaaggacccactcgctgacctgaacatcaaagattttctatag

SEQ ID NO: 46683 - DNA, 2709 bp, Artificial Sequence
  Description of Artificial Sequence: Synthetic coding sequence
atgagcggccagaccctgaccgaccggatcgccgccgcccagtacagtgtgacagggagcgcagtcgctagagctgtttgcaaggcaaccactcatgaggtcatgggcccaaagaaaaagcacttagattatttaatccaggcaacaaacgaaactaacgtgaacatccctcagatggcagacacactcttcgagagggcgacaaactctagctgggtggtcgtgtttaaagcgctagttacaacccatcaccttatggtgcacggcaacgagcggttcatccaatatctcgcctctagaaacacactctttaatcttagtaattttctggacaaatcaggctctcatgggtatgatatgagtacgttcatacggcgctactcaaggtacctcaacgagaaggctttctcttatcggcagatggcatttgatttcgctagagttaaaaaaggtgccgacggcgtgatgcggacaatggctcccgagaagttactgaagtctatgcctattctgcaggggcagattgatgctttattagagtttgacgtacaccccaacgaacttaccaacggagtgatcaacgccgcctttatgctactgttcaaagacctcattaagttattcgcttgttacaatgacggggttatcaatctgctagagaaattcttcgaaatgaaaaagggacagtgcaaagacgcactcgaaatctataagcgatttctcacgagaatgacccgggtctccgagtttctgaaggttgctgaacaggtggggatcgataagggcgatattcccgacctgactcaggcgccatctagcttgatggagaccctggagcagcacctgaacactctcgagggcaagaagccggggaacaatgagggaagcggagctcctagcccccttagtaagagtagcccagcgactactgtcacctccccaaactctacccccgccaagaccattgatacctctcctcctgtggacctgttcgctacggcaagtgccgcagtaccagtcagtacaagcaaaccttctagcgatttactcgacttacagcccgatttctcctcagggggggctgctgctgccgctgcaccagccccacccccccccgctggcggtgccaccgcctggggggacttactgggagaagactcccttgcagccctgagctccgtgccgagcgaggctcagatatctgaccccttcgcgcctgagccgacaccccctacgacaaccgctgagattgcaaccgcttctgcgagcgcctcaactacaaccacagtaacagccgtgaccgctgaggtcgacctgttcggagacgcattcgctgcttcccccggtgaggcaccggccgcctcggagggggccgctgcaccggcaactccaacacccgtggcggcagccctagatgcttgctcgggaaacgatccttttgcgccctccgagggtagcgccgaagcggccccggagctggatctgttcgccatgaaacctcctgagacaagtgtcccggttgttactccgactgcttcaaccgcacctccagtgcccgctaccgcacccagccccgcccctgccgtagcagcagccgcagcagccaccaccgccgcaactgccgcagctacaactaccacaaccacctccgcggccacagccaccacggcgccgccagcattagacatcttcggagacctgtttgagagtacgcccgaagtggcggcagctcccaaaccagacgctgcgccaagcattgacctgttctctaccgacgcattttccagcccaccccagggagcatcccccgttcctgaaagtagcctgacggccgatttgttaagcgttgacgccttcgccgctcccagtcctgccaccactgcctcccccgctaaggtggacagtagtggcgtcattgatctgttcggagatgctttcggatcctccgctagtgagcctcagcctgcttcccaggctgcatcatcgagcagcgcaagtgcagacctcctggcaggctttggcggcagttttatggctccgtctccctcccccgttactccagcacagaataatctgttgcagcccaactttgaagcagccttcgggacaacaccttccacgagctccagtagcagttttgaccctagcggggacctgctgatgcccaccatggcgccagcaggccagcctgcccccgtgtccatggtgccgccatctccagccatggccgcttcaaaggctctgggctccgacctcgattcatccttagcaagcctcgtgggcaatctaggaattagtgggaccaccaccaagaagggggatttacagtggaacgctggtgagaaaaagttgacaggaggagccaattggcagcctaaggtggcaccagccacctggtccgccggcgtccccccttccgcccccctgcagggagccgtgccccctacaagcagtgtgccacctgtagccggtgctccttccgtgggccagccaggcgcaggattcggaatgccacccgccggcacgggcatgcctatgatgccccagcagcccgtgatgttcgcccaaccaatgatgagacccccattcggcgcagccgctgtgccaggcacccagctgtctccttctcccactccggcttctcagtctccgaaaaaaccacccgcaaaggatccgttggccgatctgaacatcaaagacttcctttag

SEQ ID NO: 46684 - DNA, 2724 bp, Artificial Sequence
  Description of Artificial Sequence: Synthetic coding sequence
atgagcggccagaccctgaccgaccggatcgccgccgcccagtacagcgtgacaggatccgccgtcgcccgggctgtgtgcaaagcaactacgcacgaagtgatgggcccaaaaaagaaacacttggattatcttatccaggcaacaaacgaaactaacgtgaacatcccccagatggccgacaccttgttcgagcgagcgaccaatagctcctgggtggtcgtatttaaagctctggtcactacccaccacctcatggttcatggaaacgagcgtttcatccagtaccttgcgtctcggaacactctgttcaacctgtccaatttcctcgataaatcaggaagccacgggtacgacatgtctaccttcattagacgctattccaggtacctcaacgaaaaggcattcagctatagacaaatggcatttgatttcgcccgagtgaaaaagggcgcagatggggttatgcggacaatggcacccgagaaacttctgaagagcatgcctatcctgcaaggacaaatcgatgccctgctggagttcgatgtgcaccctaacgaactgaccaatggagttatcaacgcagcattcatgttactgtttaaagatctcattaaattgtttgcgtgctataacgatggagtgataaacctgctggagaaatttttcgaaatgaagaaggggcagtgtaaggatgctctggaaatctacaagcggttcttgacacggatgactcgcgtgtccgaatttctgaaggtagccgagcaggtagggatcgataagggagacatccccgatttgacccaggctccaagctctctgatggagacactcgagcagcacctcaacaccttagaagggaaaaaacccggaaataatgagggctctggagcgccctccccactgtctaaaagctctcctgccacaactgtgacaagcccgaacagcacccccgcgaaaactattgataccagccctcccgtggatttgtttgccacagctagcgcagctgtccctgtctccacctctaagccatcaagcgatttgttggatctgcaacctgatttctcttctgggggcgccgccgccgcagccgccccagctccgcctcccccagcggggggcgcgacggcttggggtgacctcctgggagaagacagtttggctgctctctccagcgtgcccagcgaagctcagatatctgaccctttcgcccccgaaccaactccacccaccacaaccgccgagatcgctaccgccagcgctagcgccagcaccactacaacagtgactgccgtcactgcagaggttgacctatttggagacgcttttgcagcctcgcccggcgaggcaccagccgccagcgaaggtgccgctgcaccagcaacccctacaccagtggcggcggccctggacgcctgctcggggaacgatcctttcgctccttctgagggaagcgcagaggcagcccccgaactggacctattcgctatgaaaccaccagaaaccagtgtgccagtcgttacccctacagcgtcaacagccccacctgtcccagctacagctccctcccctgctcccgccgtcgcagcagctgcagctgccactactgccgccaccgctgccgcaactactaccacgaccacctctgctgcaaccgcaaccaccgcccctcccgctctagatatatttggcgacctgtttgagtccacaccggaagttgccgcagcgccaaagcccgatgcagccccttccattgacctcttctcaacagacgctttttcatccccaccacagggcgccagcccagtgccggaatcatcccttactgcagatctcttgtccgtggacgcttttgcagcccccagcccagcaacaaccgcatctccagcgaaggtggacagcagcggggtgatcgacttgttcggcgacgcttttggatcctccgcatccgaaccccaacctgccagccaagctgctagctcaagctctgcctccgccgacctgcttgcgggatttgggggtagctttatggcgccgtcaccgtctcctgtcacaccggctcaaaataatttgcttcagccaaatttcgaagctgctttcggtactactccctctacgagttctagctcctcctttgacccctccgttttcgatggtctgggagatttgctgatgcctaccatggcccctgctggtcagcctgctcccgtgagcatggttcccccgtctccggctatggccgccagcaaggcactggggtcagatcttgattcaagcctggcctccctggtcggaaacctgggaatttcaggtaccacgacaaagaaaggggatctgcaatggaatgcgggtgaaaagaagctgaccggtggtgctaactggcagcctaaggttgccccagccacatggtctgccggcgtgccaccctctgctccattgcagggtgctgtgccccctacttctagcgtgccccctgtcgccggagctccatctgtaggccagcctggagctggttttggcatgccgccagccggcactggcatgccaatgatgcctcagcaacccgtgatgttcgcacagcccatgatgaggccaccctttggagcagctgcagtgcccgggactcagcttagtccttcaccaaccccagcctcccagagtcctaaaaaaccacccgccaaggatccactcgcagacctgaacattaaagattttttgtag

SEQ ID NO: 46685 - DNA, 354 bp, Artificial Sequence
  Description of Artificial Sequence: Synthetic coding sequence
atgagcggccagaccctgaccgaccggatcgccgccgcccagtactcagtgactggttccgctgtggcccgggccgtatgtaaagcaaccacacacgaggttatgggaccaaaaaaaaagcacctggactatctgatacaggctactaatgagacaaatgtgaacattccccaaatggccgacacactgtttgagcgggctaccaattccagctgggtggtggttttcaaagcactagtgaccacccatcacctgatggtgcatggaaatgagcggttcattcagtatctggcctcgaggaacactctgttcaacctcagcaactttctcgataagtccggcagtcacggctag

SEQ ID NO: 46686 - DNA, 1689 bp, Artificial Sequence
  Description of Artificial Sequence: Synthetic coding sequence
atggccaccgagcacgtgaacggcaacggcaccgaggagcccatggacactacttccgcagttattcatagtgagaatttccagactttactggatgctgggttgccccaaaaggtggctgagaagcttgatgaaatctacgtggccggcttggtcgcacattccgacttggatgagcgagctatcgaagctctgaaagaattcaatgaagatggagccttagccgttctgcagcagtttaaagacagcgacctgtcccacgtccagaataaaagcgcgtttttgtgcggggttatgaagacttataggcagcgagaaaagcaaggcactaaagtggccgacagctccaagggcccagatgaagcaaagataaaagcgctcttggagcgcacgggctacaccctggacgtcacaactggccagagaaagtacggagggccccctcctgatagtgtttacagtggacagcaaccatctgtcggtacggagatctttgtcggcaagatccctagagacctctttgaggacgagctggtgccactgttcgagaaggcgggccccatttgggaccttagactcatgatggacccgctgaccggtcttaatcggggctacgcattcgtgactttctgcaccaaggaagccgcgcaagaggccgttaaattgtacaacaaccacgagatacgatctggcaaacacattggagtatgtatctccgttgcaaacaatcgtctctttgtgggatcaatcccgaaaagcaagaccaaggaacagatcttggaggagtttagcaaagtgactgaaggactgacagacgttatcttgtaccaccagccggacgataagaagaaaaatcgaggcttttgttttctggagtatgaggaccataagactgcggcacaggctcgccggcgcctgatgtccggaaaagtgaaagtgtggggcaacgtggggaccgtagaatgggcggatcccatcgaggatccggaccctgaggtgatggctaaagtgaaagtgttgtttgttcggaacttagcaaacactgtgacagaagaaattctagaaaaggctttttcccagtttggaaagctggaacgagttaaaaagctaaaggactatgcctttatccacttcgacgaacgggacggcgctgttaaggcaatggaggagatgaatggtaaagacctggaaggggagaatatcgagatcgtgtttgccaaacccccggaccagaagcgaaaggagcgtaaggcacagcgacaagctgccaaaaaccagatgtatgacgattattattattacggtccgcctcatatgccccccccaaccagaggacgtggcagaggcggcaggggaggatatgggtatccacccgattattacggatatgaagactattacgattactatgggtacgattaccataactatcgtgggggatatgaagatccctactatggctacgaagacttccaggtgggcgctagaggcagaggggggcggggagctagaggggccgccccatctcgggggagaggggccgccccacctagggggcgagctggatactcacagcgtggcggtccagggtccgctcggggagtgcgtggcgcgcggggaggggctcagcaacagaggggcagagggcagggcaaaggggtggaggctgggccggacctcctccaatag

SEQ ID NO: 46687 - DNA, 1872 bp, Artificial Sequence
  Description of Artificial Sequence: Synthetic coding sequence
atggccaccgagcacgtgaacggcaacggcaccgaggagcccatggacacaacttccgctgtcatacattcagagaatttccagaccctgctagatgccgggttgcctcagaaagttgccgaaaagctggacgaaatttacgtcgcaggtctcgtcgcgcactccgacttagatgagcgggccatcgaggcattgaaggagttcaatgaggatggagctctggcagtcctgcaacagtttaaagacagcgatctgagtcatgtgcagaacaaatccgccttcctgtgtggcgtgatgaaaacctacagacaaagggagaagcagggtaccaaggtcgctgacagctctaaggggcctgacgaagctaagattaaggcgctgctggaaaggacaggctacacactcgatgtgacaactggccagagaaaatacgggggtccaccacccgacagcgtgtatagcgggcagcagccctcagtgggcacggagatcttcgtgggtaagattccaagagatctgtttgaggacgagttagtccccttgttcgagaaggcgggtcccatctgggaccttaggctcatgatggaccctctgactggccttaatcggggttacgcgttcgtaacgttttgcacaaaggaggctgcacaagaggccgtcaaactgtataataatcacgagattcggagcggcaaacacattggggtatgtatatctgtggctaacaacaggctgtttgtcggttccattccgaagtctaagacaaaagagcagatcctcgaagaattcagcaaagtgacagagggcttgaccgacgtgattctttatcatcaacccgacgacaagaagaagaaccgcgggttctgttttctcgagtatgaggatcataagactgccgctcaggccaggaggagactgatgagcggcaaggtgaaagtatggggcaatgtaggtacggttgaatgggccgacccaattgaggatcccgatccagaggtcatggctaaagttaaagtcttgttcgtgcggaacttagcaaataccgtgactgaagagatactggagaaggcattcagtcaatttggaaagttggagcgtgtgaagaagctgaaagactacgctttcattcatttcgacgaaagagatggcgcagtgaaagccatggaagaaatgaacggcaaggatttagagggagaaaatatcgaaattgtgttcgcaaagcctcccgatcagaagcgaaaagaacggaaggcacagcgtcaggctgccaaaaaccagatgtatgacgactactattactatgggcccccccacatgccgcccccaacgcgcggacgggggcggggaggcagaggcgggtacggatatcctcccgattactatggatatgaagattattacgattactatggttacgattaccacaattaccgaggcggatatgaagatccatactatgggtatgaggattttcaggtaggcgcccgaggacgaggaggcaggggagcaagaggagccgctccctcccgaggcaggggggcagccccaccacgcggaagagccggttactcccaaaggggcggaccaggctctgcgaggggcgtgcgcggggcaaggggcggcgcccagcaacagagaggcaggggcgtccgaggcgccagagggggtcgggggggtaatgtcggtggtaaaaggaaagctgacggttataatcagcccgattccaaacgacgccagactaacaaccagaactgggggagtcaacctatcgcacaacagcccctgcagggcggtgaccactctggcaattacggctataagtctgaaaatcaagagttttaccaggatacttttggacagcagtggaagtag

SEQ ID NO: 46688 - DNA, 558 bp, Artificial Sequence
  Description of Artificial Sequence: Synthetic coding sequence
atggccaccgagcacgtgaacggcaacggcaccgaggagcccatggatacaacaagcgccgtcattcattctgagaacttccaaacattgctagacgctgggctgcctcaaaaagtggcggaaaaactcgacgagatctacgtggccggcctcgtcgcacactccgatctggacgagcgcgccatcgaggctttgaaggaatttaacgaagacggcgccctcgccgtcctgcagcaattcaaagattccgacctgagccatgtgcagaataagagcgcctttttatgcggtgtcatgaaaacttacagacagagggagaagcagggaacaaaggtggccgactcttccaaaggcccagacgaagcgaaaatcaaggcactgctggagagaaccggatacactctcgacgttaccactggacaacgcaagtacgggggtcccccgcctgactcagtgtacagcgggcagcagccaagcgtcggtacggagatctttgttggaaagatcccccgcgacttgtttgaggatgagcttgtcccgctcttcgaaaaggcctag

SEQ ID NO: 46689 - DNA, 1260 bp, Artificial Sequence
  Description of Artificial Sequence: Synthetic coding sequence
atgcggaacatcttcaagcggaaccaggagcccatcgtggcccccgccaccacgaccgcgacaatgccaattggtcccgttgacaattcaacggaatccggcggtgctggggagtcgcaggaggatatgttcgccaaattgaaagaaaagttatttaatgaaatcaacaagattcctttgcctccctgggctctcatcgccatcgccgttgtggctggacttctgctcctgacctgttgtttttgtatctgcaaaaaatgttgttgtaaaaagaaaaaaaacaagaaggagaaggggaaggggatgaagaatgctatgaacatgaaagatatgaagggaggtcaggacgatgacgatgcagaaactgggctcaccgagggagagggggagggcgaagaggagaaagaacccgagaacctcgggaagttacagtttagtctcgattatgattttcaggcaaaccagctcacagtcggagtgctgcaggccgcggagctcccagcattggatatgggaggcactagtgatccttacgtgaaggtgttcttgttgccggacaagaagaagaagtacgagaccaaagtgcacagaaagacacttaacccggccttcaacgagactttcacattcaaagtgccctatcaggagctgggcggcaaaaccctggtcatggctatctatgacttcgacagattctctaaacacgacataatcggcgaggtaaaggttccgatgaataccgtcgatcttggacagcccatcgaggagtggagggacttacaggggggtgagaaagaggagcctgagaaactcggagacatctgtacttctctgagatatgttcccacagccggtaagctcaccgtgtgcatcctggaagccaagaacttgaaaaagatggatgtgggtggactatccgacccctacgtcaaaatccacctgatgcagaatggtaagcgactgaaaaaaaagaaaacgaccgtgaaaaaaaagacgctgaatccgtacttcaacgaaagcttcagctttgagataccatttgagcaaatccagaaagtgcaagtggtcgtgacagtgctggactacgacaagctggggaaaaatgaagccattggcaaaattttcgtgggctccaacgccaccggcaccgaactgagacactggtcagacatgctcgctaaccctagaaggccaattgcccagtggcactcactgaaacctgaagaagaagtcgatgcgctcctgggtaaaaacaaatag

SEQ ID NO: 46690 - DNA, 1260 bp, Artificial Sequence
  Description of Artificial Sequence: Synthetic coding sequence
atgcggaacatcttcaagcggaaccaggagcccatcgtggcccccgccacgaccacggctacaatgcccatcggcccagtcgataactccacggaatctggtggtgccggcgagagtcaggaagatatgttcgctaaattgaaggagaaactgttcaacgaaatcaataaaattcccctcccaccctgggccctcatcgccatcgcagtcgtcgccggtcttctgcttttaacttgctgtttctgtatttgcaagaaatgttgttgtaaaaagaaaaaaaacaagaaggagaagggcaaggggatgaagaatgctatgaacatgaaggacatgaagggtggccaagacgatgacgatgctgagaccggtcttaccgaaggcgagggagaaggtgaagaagagaaggagccagagaacctgggcaaattgcagttttcactagactatgactttcaggccaaccagttgactgttggcgtgcttcaggcagcagagcttccagccttggacatgggcggcaccagtgatccttatgtgaaagtgttcctcctgcctgacaagaagaagaaatacgaaactaaggttcatagaaagactctcaacccagccttcaatgagacatttacttttaaagtgccctaccaagagttgggaggtaagacactggtaatggctatctacgatttcgacagattttctaagcatgatataatcggtgaggttaaagttcctatgaataccgttgacctcggccagccgatagaggagtggcgcgatctgcaggggggcgaaaaggaggaacccgagaaactgggcgatatttgtacttctctgcggtacgtacctacagccggcaagttgacagtctgtatccttgaagccaaaaacttgaaaaaaatggatgtgggggggctcagcgatccatacgtgaagatccacctgatgcaaaacggcaaaaggttaaaaaaaaagaagactactgtgaagaagaagacattaaacccttactttaatgaatccttttctttcgagattccctttgaacagattcagaaggtacaagtggtcgtgaccgttctggattatgacaaactgggcaagaatgaagccataggaaagatattcgtcggttcaaacgcaacaggcactgagctcaggcactggtcagatatgctcgctaacccacggcgccctattgctcagtggcactcactaaaacccgaggaggaagtggacgctttactcggcaaaaacaagtag

SEQ ID NO: 46691 - DNA, 1206 bp, Artificial Sequence
  Description of Artificial Sequence: Synthetic coding sequence
atgctgcacctgcacggctggcagaccatgcagggccggaagatggggcacccccctgttagtccttccgctccggcgccagctggaactaccgccatccctggcctgatccctgacctggtggcaggaactccctggccgcgttgggccctgatagccggggcgctagcggctggggtgctgttagtcagctgcctactgtgtgccgcgtgctgctgctgcaggcggcatcgcaaaaagccaagggacaaagaatctgtgggacttggctcagcccgcggcactacaactacccatctggttcagcccgacgtggatggtctcgagtcctccccaggcgatgctcagcaatggggctgtctgcagttatccttggaattcgatttcgggagccaggagattagggtgggacttagacaggcggccgacttacgccctggcggcaccgtagacccctatgccagagtgtctgtgtcaacccaggctggacatcgccacgagacgaaagtacacaggggaactctgtgccctgtgtttgatgagacctgttgtttccacattccacaggcggagctgcccggcgcgaccttacaagtccagctgttcaattttaagaggttttctggccacgagcccctgggcgagctcagattacccctggggactgtcgatctgcagcacgtgttagagcactggtacttactaggtcctcccgccgccacccagcccgaacaggttggcgagctgtgtttcagccttcgctatgtgcctagctctggacggctgacagtagtggtgctcgaggccagagggctccgacccggtctggctgaaccatatgtcaaggttcaattaatgctgaaccagcgcaaatggaagaaacgtaagacagccaccaaaaagggaacggccgccccgtattttaatgaggcctttacctttcttgtccctttttctcaggtgcagaacgtagacctcgtgctggccgtgtgggaccggtctcttccactgcggaccgaacccgtgggcaaggtgcaccttggcgcccgcgcctcaggtcaaccactgcagcattgggccgacatgttagctcatgcaaggagaccaatcgcccagaggcaccccctgcgacccgcccgagaggtggatcgtatgctggctctgcaaccgcggctccgattacgcctgccacttcctcactcttag

SEQ ID NO: 46692 - DNA, 477 bp, Artificial Sequence
  Description of Artificial Sequence: Synthetic coding sequence
atgggccacccccccgtgagccccagcgcccccgcccccgccggcactacggctatccctggcctcattccagacctcgtagctgggaccccatggccacggtgggcactaattgctggggcactggctgccggcgttctgcttgtgtcatgtctcctttgcgcagcgtgttgctgttgcaggaggcatagaaagaaacctagggacaaggagagtgtgggcttaggctccgccaggggtaccaccaccacacatctggtccagccagatgtcgatggtctggagagctcccccggagacgcccagcagtggggttgcctccaactgtctcttgaattcgatttcggttcccaggaggtgaagggccctgctgcgcaggaccagcgcttctgcgagtttccagagcgggttaccggcgagggccagactccctgtcccggctggtggggcgctgatagggctggtgctctgggctag

SEQ ID NO: 46693 - DNA, 933 bp, Artificial Sequence
  Description of Artificial Sequence: Synthetic coding sequence
atgcccagcagcaagcccggcagccccgccccccaggaccccagccccagttgtcggacctgtagcaaccaggtccaaccaggccatctgctgctccccttgacaaaggccagtctgaccggtccctcaccccctccagctaaattaggtcgagcacagggggccccatcccctaagggaccgctggagatcggatggtctcctgacgcccagcctctcaggctgggcgagaccttcctcccgaaaggtgtcgctcaactctccagagccagcagttcaggccataaggtgggcttccttcagccttggccaccccacccactgttgcctcaggagcgcgtgccccgacaccaacgtcagtgttgcccgagggcaggcccagctttcggatgcctgaggggtcgccctggagggtggccagccactgggtctggtggccgtcagcaagggcggaaaatggggcaccctcctgtgtcgccgtcggcgcctgcccccgctggtacaacggcgatccccggactgattcccgatctggtggccggcacgccctggccacgctgggcacttatcgcaggggccctcgcggccggcgtgctcctggtgtcatgccttctttgcgccgcctgctgctgctgccgtaggcaccggaaaaaaccgagggataaggaatctgtcggtctgggttctgccaggggtaccactaccacacacctcgtccagccggacgtggacgggctcgaatcaagccctggagacgcccagcaatgggggtgcctgcagctgagcctggagttcgatttcggttcccaggaggtcaaagggccagctgctcaagaccagaggttttgcgagtttcccgaacgggtgaccggtgaggggcaaaccccctgcccaggatggtggggagcagatcgagctggtgcattaggatag

SEQ ID NO: 46694 - DNA, 570 bp, Artificial Sequence
  Description of Artificial Sequence: Synthetic coding sequence
atgctgggcagccgggccgtgatgctgctgctgctgctgccctggaccgcacaaggacgcgccgtacccggaggcagttcccccgcctggacccagtgccagcagttatcacagaagctttgtaccctcgcctggagcgcccaccctcttgttggtcatatggacttgcgagaagagggcgatgaggaaaccactaacgatgtacctcacatacagtgcggcgacggctgcgatccacaggggctacgggacaactcccagttctgcctacaacgcattcaccaaggcctcatcttctatgaaaaacttttaggaagcgacatatttacaggggagccgtctttgctgccagatagcccagtgggtcagctacacgcgagcctcctggggctgtcacagctgcttcagcctgagggacaccattgggagacccagcagatccccagtctgagtcccagtcaaccatggcaacggctcctgttgaggttcaagattctcaggagtcttcaggcgttcgtcgcagtcgccgctcgggttttcgcccacggcgctgctactctatccccctag

SEQ ID NO: 46695 - DNA, 1029 bp, Artificial Sequence
  Description of Artificial Sequence: Synthetic coding sequence
atgcaggtgagcagcgtggacttcagcatgggcaccgagcccgtgttgcaaaggggggagactaccacttcaatcgggagaattaagcccgaattatacaaacagaaaagtgtcgactcagaagggaaccaaaacgaagatgtcaaaatctgcgggaaactgaacttcacactacaatatgactacgagaacgaattgctcgtggttaagatcattaaagcgcttgatcttcccgcaaaggattttactggcacatccgatccatatgtgaaaatgtatttactgcctgaccggaagaaaaaattccagacccgggtccatcgcaaaacactgaacccactcttcgacgagaccttccagttccctgtggcctatgaccagttaagcaacaggaagttgcatttcagcgtttatgatttcgaccgctttagcagacatgatatgatcggcgaggtgattctggataacctttttgaagtctccgacttatctcgggaagccactgtgtggaaagacattcattgcgcaacaaccgagtccattgacctgggggagataatgttttcattgtgctacctccctactgctggtcgcatgacgctaactgtaatcaagtgtcggaacctgaaagcaatggacataaccggatcttcagacccatacgttaaagtctcattaatgtgcgaggggcggcgcttgaagaagcggaagaccaccactaagaagaatactctcaatccagtgtataacgaggcgattatttttgacataccccctgagaacgtggaccaggtgagccttagcatcgctgtcatggattacgatagggtcgggcacaacgaagtcatcggcgtgtgtagaacaggtctggacgcagagggtctaggaagagaccactggaacgaaatgctggcctaccacagaaagcctatcactcactggcacccccttctggagctccccggtcgggctacttcatttgatagccaggggagttgcccgtctcctaaaccacccagcacgccctag

SEQ ID NO: 46696 - DNA, 1296 bp, Artificial Sequence
  Description of Artificial Sequence: Synthetic coding sequence
atggccgagatcaccaacatccggcccagcttcgacgtgagccccgtcgttgccggactgatcggtgcctcagtccttgtggtgtgcgtatccgtgaccgtgtttgtgtggtcatgttgtcaccaacaggcagaaaagaagcagaagaaccccccctacaagttcatacacatgctgaagggtatctcgatctacccggagaccttgtctaacaagaaaaaaattatcaaagtcaggagagacaaggacggacccgggcgagagggcgggcgcagaaacctcctggttgatgccgcagaagccggactgctatcacgtgacaaagatccgagagggccctcctcagggtcctgcattgatcagttgccaattaagatggactatggcgaggagctgagatctccgattacctctttgactccaggtgagtcaaagacgacctcaccgagctcccctgaagaggacgtcatgctcggctctttaactttttcagtggactataattttcccaaaaaagccctggttgtgacaatccaggaggcccacggcctgcctgtgatggacgaccagacacaggggtctgatccttatataaagatgaccattctgcccgacaaacggcacagagtgaagactagggtgcttcgcaagactctggacccagtatttgacgaaacattcaccttttacggcattccatactctcagttacaggacctcgtgctgcattttctggtgttatcttttgacaggttctctcgcgacgacgttattggggaggtaatggtgcccctggctggtgtggacccttcgactggaaaggtacaactaacgagagacatcattaaacgaaatatacagaagtgcatctcgcgaggggagctccaagtgtctctgagctaccaacctgtggcccaacgtatgaccgtcgttgtgctgaaggctcgacacctgcccaaaatggacatcacagggctaagtggcaatccttatgtaaaggttaacgtttattatgggaggaagcggatcgccaagaagaaaacccatgtcaaaaagtgtactctgaatccaatctttaatgagtcctttatctatgacatccctactgatcttttgcctgacatatcaatcgaattcctggtgattgacttcgaccgaactactaaaaatgaggtggttggtcggctgattttaggggcccatagcgtgactgcttccggcgcagagcactggagagaggtatgtgaatctccccggaagccggtagccaagtggcacagcctgtctgagtactag

SEQ ID NO: 46697 - DNA, 375 bp, Artificial Sequence
  Description of Artificial Sequence: Synthetic coding sequence
atgaccgtggtggtgctgaaggcccggcacctgcccaagatggacattactgggctgagtggcaacccttatgttaaagttaatgtctattatgggcgaaagcggatcgcaaaaaagaagacccatgtgaaaaagtgtactctgaaccccattttcaacgaaagttttatctatgatatcccaacagatctgctccccgatatttctatcgaatttctcgtgatcgattttgaccggaccaccaagaatgaggttgtgggccgcctcattcttggcgctcactctgtaactgcatctggcgcggaacactggcgagaagtgtgcgagtcacctagaaagcccgtggcaaaatggcattctttgtccgagtactag

SEQ ID NO: 46698 - DNA, 1425 bp, Artificial Sequence
  Description of Artificial Sequence: Synthetic coding sequence
atggcctacatccagctggagcccctgaacgagggcttcctgagccgcatttctggactgttactctgccgctggacctgtcgtcattgctgtcagaaatgctacgagtcttcttgctgccagagtagtgaggatgaagtggagatcctgggtccttttccggctcagacgcccccatggctgatggccagcaggtcatctgacaaagatggagacagcgtgcacacagccagcgaggtgcccctcactcctaggacgaatagccctgacggtcggcgttcttcttctgacaccagcaaaagcacttactccctcacacggcggatttcctcccttgagagcagacggcccagcagccctttgatagacattaagccaatcgaattcggagtgctgtccgctaaaaaagagcccattcagccgagcgtgctccgtagaacgtataaccctgacgactatttccgcaagtttgagccgcacctttatagcctagactccaactctgatgatgtggattctttaacggacgaagagattctctcgaagtaccagttgggtatgctgcactttagcacacagtatgacttgctgcacaaccatctcacagtgagagtgatcgaggccagggacctgccccccccaatttcccacgacggcagtcgacaggatatggcccactcaaacccttacgtcaaaatttgcctgttgcctgaccagaagaattctaagcaaacgggggtcaaaagaaaaactcagaaaccagtctttgaggaacggtatacttttgagataccttttctggaggctcagagacgtacactccttctgaccgtggtggattttgacaagttcagccggcactgtgtcatcggcaaggtgagcgttcctctgtgtgaagtcgacctcgtgaaaggaggccattggtggaaggctcttataccgtcttctcagaatgaggtcgagctaggggagctgctgctttctctcaactacttgccttcggcaggcaggctcaacgttgatgtgatccgggccaagcaactcctgcaaaccgacgtttcacaggggtccgatcctttcgttaagattcagttagtgcatgggctgaaactcgttaaaaccaagaaaacttcatttttgcggggtactattgatcccttttataacgaaagtttcagcttcaaagtcccacaggaggagctggagaatgcaagtctggtatttacagtgtttggccataacatgaagtcatccaacgatttcataggaagaatagtgatcggacagtactcctctggcccatccgaaactaaccactggcgccgcatgctcaatacacacaggacagctgtggaacagtggcactctttgagatcaagggccgaatgtgatagagtgtcaccggcctcactggaggttacctag

SEQ ID NO: 46699 - DNA, 1431 bp, Artificial Sequence
  Description of Artificial Sequence: Synthetic coding sequence
atggccagccccgagccccggcggggcggcgacggcgccgcccaggccgcccgtaaaactcgcgtcgaggctaactcccctttgcctaagaacagcggttctctgaacgaagcagaagctctcaaccccgaagtgacgctcagcagtgaaggctctctcaacctcgaggacattttgtatctggaagacactggagatcttgacgaaaccctgtacgtgcaggagaccgagaaagctgaggaagctctgtacatcgaggaggccatgcagccagatgaagcgctgcatgtggaagaacctggaaaccccgaagaaaccgtgtgcgtggaagaaacaaccgagccagatcgtatccagttcgtcgaaggtcctgtcgaaccgggaaagcccaccagtccagagcacgtcgtttatgagggggaaacggtgacaagggccgaaaaatctaatccagaagaaagtctgcgggcagaacagtcaccgtctatggaggagaatctatccatcgaggatcttgaactgctagaaggcagatttcaacagtgtgtccaggcagtggcgcagctagaggaggaacgagaccaactgattcacgagctggttcttctgcgagagcccgctcttcaagaggtgcagcaggttcaccaagatattttggccgcttacaaactccatgcacaggcagagctggaacgagacggattgcgagaggaaatcagattggtaaagcagaaattgttcaaagtgacaaaagaatgtgtggcataccaatatcagctagaatgtcggcagcaggacgtggcccaattcgcggactttcgggaggtcctgaccacacgagctacccagctgtctgaagaactggcccagctgcgagatgcttaccaaaaacagaaggagcaacttagacagcagcttgaggcgccaccctcccagcgggacgggcacttcctccaggagagtagacgtctttcagcccaattcgaaaacctcatggcagaatccaggcaggacctcgaagaagagtacgaaccgcagttcctccgattgctggagaggaaagaggccggaactaaagccctgcagagaacacaggctgagatccaagaaatgaaggaagccctcagaccattacaggcggaggctagacaactgcgcctgcagaacagaaacctcgaagaccagatagctctggtacggcagaagcgagatgaggaggtccagcagtacagggagcagttggaggaaatggaggaacggcagcgccagttgcgaaacggtgtgcaattacaacagcagaaaaataaggaaatggagcagcttcggttgtctctggctgaggagctgtctacgtacaagggctgtctggaaatttacgggcagatctgtaatccagagactgccaaaaactttttggcaaaggaccactag

SEQ ID NO: 46700 - DNA, 1449 bp, Artificial Sequence
  Description of Artificial Sequence: Synthetic coding sequence
atggccagccccgagccccggcggggcggcgacggcgccgcccaggccgcccgtaagacgcgcgttgaagcaaactcgcccctaccaaaaaattcaggtagcttgaatgaagctgaagctttgaatcctgaggtgacattgtcatccgaaggttctctgaacttggaagatattctgtacctggaagacacgggcgacctcgatgagactttatatgtgcaggagactgaaaaagcagaagaggcgttgtacatcgaggaggctatgcagcccgacgaggccttgcacgtggaagagcccggcaaccctgaggagactgtgtgcgtggaggagacaaccgagcctgaccgaatacagtttgtcgaggggccggtcgaaccagggaagccaacttcccctgagcatgtggtttacgaaggcgaaacggtcaccagagcagaaaagtccaaccctgaagaaagcctgcgggccgagcagagcccgagcatggaagaaaacctttcaattgaggacctggaattgctcgaggggcgtttccagcaatgcgtacaagcggttgcccagctagaggaagaaagggaccaactcattcacgagttggtcttgctaagggaacctgccctgcaggaggtgcaacaggtgcaccaggacatcttggcggcctacaaacttcacgcccaggccgaattggagagagacggcctccgcgaagagattaggttggtgaagcagaagctgttcaaagttaccaaggagtgcgtcgcttaccaataccagctggagtgtagacagcaggatgttgcccagttcgctgatttcagagaggtactcaccacacgggctacacagctcagtgaggagctcgcccagcttcgagacgcgtatcagaagcagaaagaacagctgcggcaacaacttgaggcgcctccgtcccaaagagacgggcacttcctgcaggagtctcgtcgacttagcgcacagttcgagaacctgatggccgagagtcggcaagatctggaagaggagtacgagccgcagttcttgagactactggagagaaaggaggccggcactaaggctcttcagagaactcaggcagaaatccaagagatgaaggaagcactcagaccacttcaggctgaagctaggcagctccgcttgcagaatcgaaacctcgaagaccagatagccctggtacgccagaagcgcgatgaggaagtgcaacagtacagagagcaactggaagagatggaggaaagacaacgccagctgcgtaatggggttcagctgcagcagcaaaagaataaagaaatggagcagttgcggctctccctggccgaagaactgagcacttataaagctatgcttcttccaaagtcgctagaacaggccgacgcgcctacaagccaggccggtggaatggaaacccaatcccagggagctgtgtag

SEQ ID NO: 46701 - DNA, 273 bp, Artificial Sequence
  Description of Artificial Sequence: Synthetic coding sequence
atgcagcccgacgaggccctgcacgtggaggagcccggcaaccccgaggagaccgtttgcgtcgaggaaacaaccgagccagatcgcatccagttcgtggaaggcccagttgaaccgggtaagccgacctctccagagcatgtcgtgtatgaaggagaaaccgtgacaagagctgaaaaaagtaatcccgaagagagtttgagggcagaacagagccccagtatggaggaaaacttgagtatcgaggatctagaactgctcgagggaagatag

SEQ ID NO: 46702 - DNA, 213 bp, Artificial Sequence
  Description of Artificial Sequence: Synthetic coding sequence
atgcagcccgacgaggccctgcacgtggaggagcccggcaaccccgaagagaccgtctgtgtggaggaaaccaccgaaccagaccgcattcagtttgtggaaggcccggtcgagccaggcaagcccacatcacccgaacatgtcgtgtatgagggtgagactgtgaccagagctgaaaaatccaacccagaagaaagccttagagcagagtag

SEQ ID NO: 46703 - DNA, 405 bp, Artificial Sequence
  Description of Artificial Sequence: Synthetic coding sequence
atgagccccctgcggcccctgctgctggccctggccctggccagcgttccatgtgcccagggggcctgccccgcctcggccgatcttaaacattccgacggcacaaggacgtgtgccaaactctacgacaagtctgacccttactatgagaattgttgcggaggcgccgagttgtctctggaaagtggcgcagacttgccatatctgccaagcaattgggcaaataccgcctcctctctcgtggtagcccccagatgcgaactgacagtatggagccgccagggaaaagcaggaaagactcacaagtttagcgctggaacatatcctcgcttagaggagtaccgtcggggtatcctgggggattggtcgaacgccatttccgccctttactgccgctgttcgtag

SEQ ID NO: 46704 - DNA, 897 bp, Artificial Sequence
  Description of Artificial Sequence: Synthetic coding sequence
atgagcctgtaccccagcctggaggacctgaaggtggacaaggtgatccaggcccagacagccttttccgccaatcccgctaacccagctatcctaagcgaggcgagcgcccccattcctcacgatgggaatttatatcctcgcctgtatccagagctttctcagtatatgggtctcagtctgaatgaggaggagattagggccaacgtggccgtggtctccggtgcacctctgcagggacagctggtggcaagaccaagctcaatcaattatatggtggccccagtcaccgggaatgatgtaggaatacggagggccgaaatcaaacagggcattagagaggttatcctttgtaaagatcaggatggcaagatcggacttcggctgaagtctatcgataacgggattttcgttcagctggtccaagctaatagtcctgcatcattggtcggcctgcgatttggtgaccaagtgcttcagattaatggcgagaactgtgctggatggagctccgataaggcccataaggttctaaaacaagctttcggggaaaagatcaccatgactattagggatcgtcccttcgaaagaaccatcacaatgcacaaagactcaactggacacgtgggcttcattttcaagaacggaaagattacctctatcgtgaaagactcctccgccgcccgcaatgggcttcttactgagcacaacatttgtgagatcaatggtcagaacgtgattggcttgaaggacagccaaatagccgatatcctgtcaacctccggaacggttgtgacaattacaatcatgccagcatttatttttgagcatatcattaaacgcatggcccctagcattatgaaatcacttatggatcacactattcctgaggtgtag

SEQ ID NO: 46705 - DNA, 897 bp, Artificial Sequence
  Description of Artificial Sequence: Synthetic coding sequence
atgagcctgtaccccagcctggaggacctgaaggtggacaaggtgatacaggcccagacagctttctcagcgaacccagcaaacccagctattctttccgaagccagcgcacctatcccccacgacggaaatttataccccagactgtatcccgagctgtcccagtatatgggcctgtcattgaatgaggaggagatcagggccaacgtcgccgtggtgagcggagcccctttgcagggccaactggttgccaggccctccagcattaattatatggttgcaccagtgacaggtaatgatgtaggtattcggagagccgagatcaaacaaggtatacgcgaggtgatcctgtgcaaggaccaagatggcaagattggcctgcgactgaagtcaattgacaacgggattttcgtacagcttgttcaggcaaatagtcccgcctccttggttggactccggttcggggaccaagtgctccagatcaatggtgagaactgcgcaggctggtcctccgataaggcacataaggtgcttaagcaggccttcggggagaaaattaccatgactattcgcgaccgcccattcgagagaacaatcacgatgcataaagactccacagggcatgtggggtttatctttaaaaacggtaagataacttctatagtaaaggacagtagcgcggcccgcaacgggctcctaactgagcataacatttgtgagattaacggccagaacgtcattggtctcaaagattcccagatcgcggacatactctccacgagcggcaccgtagtgactatcaccattatgcctgccttcatcttcgagcacatcataaagcgcatggcaccttctattatgaagagtctgatggatcatacaataccagaagtgtag

SEQ ID NO: 46706 - DNA, 894 bp, Artificial Sequence
  Description of Artificial Sequence: Synthetic coding sequence
atgagcctgtaccccagcctggaggacctgaaggtggacaaggtgatccaggcccagactgccttctctgccaatccggcgaatcctgcaatcttatcagaagcctcagcgcctatcccccacgatggcaacctatatcctagactctaccccgagctctcccagtacatgggactgagcttgaatgaagaggaaattcgcgccaatgtcgccgtggtcagtggagctcctctccaaggcctcgtggcgcgacctagcagcattaattacatggtggccccagtgactggtaacgatgtgggaatacgccgagccgaaatcaagcagggtatacgtgaagtgattctctgcaaggatcaggatggcaagattggattgagactgaagtccatagataacgggatattcgtgcagctggtgcaagcgaatagccccgccagtctcgtaggtctgcggttcggggaccaggtgctgcagataaacggcgaaaactgcgcaggatggtcttctgacaaagcccacaaggtgctgaaacaggcattcggagagaaaatcacaatgacaattcgggaccgaccctttgagcggactatcacaatgcacaaagactctactggtcacgttggcttcatctttaagaacgggaagataacaagcatcgtcaaggattcaagtgcggcacgaaacggcctgctgactgaacacaatatttgtgaaattaacggtcagaacgtgataggtcttaaagattctcagattgcagatatattatcgacttccgggacagtagttactattactattatgccagccttcatattcgagcatatcatcaagcggatggccccctctattatgaagtctctgatggaccatactattcctgaggtgtag

SEQ ID NO: 46707 - DNA, 879 bp, Artificial Sequence
  Description of Artificial Sequence: Synthetic coding sequence
atgagcctgtaccccagcctggaggacctgaaggcccagaccgccttcagcgctaacccggccaatcccgccattctttctgaagcatctgcaccaattccccatgatggtaatctctatccccgactttatccagagctctctcagtacatggggttgtccctgaatgaagaggagatcagggccaacgtggccgtcgtttctggagcccccctgcagggtcagctggtggcccgccccagtagtattaactacatggtcgccccggtcactggtaacgacgtgggtattcgtagggcagagatcaaacagggaattcgggaagtgatcttgtgcaaggatcaggatggtaagattggactgagacttaaaagcatagataatggtatatttgttcagttagttcaggctaattcccccgcctcactggtaggcctgcgattcggtgatcaggtgctccagatcaatggggaaaactgcgctggctggtccagcgataaagcccacaaagtgctcaaacaggctttcggagagaagataacaatgaccattagagataggccattcgagaggacaattactatgcacaaagatagcaccgggcatgtcgggttcatctttaagaatgggaagattacctcaattgtgaaggatagttccgccgcccgaaatggcctgttaaccgaacataacatttgtgaaatcaatggccagaacgtcatcggtctcaaagacagccagatcgcagatatcctgtcaactagtgggactgttgtcacaatcaccatcatgcccgccttcatttttgaacacatcatcaagagaatggccccgagcattatgaagtctctaatggatcacaccatcccagaagtttag

SEQ ID NO: 46708 - DNA, 894 bp, Artificial Sequence
  Description of Artificial Sequence: Synthetic coding sequence
atgagcctgtaccccagcctggaggacctgaaggtggacaaggtgatccaggctcaaacagcattttccgccaatcccgcaaacccggcaattttgtccgaagccagcgcccccatacctcacgacggtaacctgtatcctcgcctgtaccccgaactctcccagtacatgggcctgagcctgaatgaagaggagatacgggcgaacgtcgcagttgtgtccggagcccctctgcagggcttagtggcccgcccgagttccattaattacatggtggctcccgtgaccgggaacgacgttgggattagacgggcggaaatcaaacagggaatcagggaggttatcctgtgcaaagaccaggacggaaagatcgggcttcggctgaagtccattgataacggtatcttcgtccaactagtacaggcaaatagccccgcctcactggtcgggctccggttcggcgaccaggtgttacagatcaacggggaaaattgtgcaggttggagctccgacaaagcccacaaagtgctcaagcaggcattcggggagaagataactatgacgattcgagatcgccctttcgagcggactataaccatgcacaaagactctaccgggcatgtcggtttcatcttcaagaacgggaaaatcacaagtatcgttaaagactccagtgcggcacgcaacggtttacttacagagcataatatttgcgagatcaacgggcagaacgttatcggccttaaagattcacagattgctgatatcctctccactagcggcaccgtcgtgacaattactatcatgcccgccttcatttttgaacatattattaagcgaatggctcctagcatcatgaaaagtcttatggaccacacgattcccgaagtgtag

SEQ ID NO: 46709 - DNA, 879 bp, Artificial Sequence
  Description of Artificial Sequence: Synthetic coding sequence
atgagcagcctgtaccccagcctggaggacctgaaggtggaccaggcaatccaggcccaggttcgggcctctcctaagatgccagccctccctgttcaagccactgccatctccccaccgcctgtcctttaccccaatcttgcggaattagaaaactatatgggattatcactatcttcccaggaggtccaggagtctttactacagatcccagaaggggacagtacagccgtatcaggtccaggacccgggcagatggttgccccagtcacaggctactccttaggcgtgaggcgggccgaaatcaagcccggcgtaagggagatccatttgtgtaaggacgaaaggggcaaaaccgggctccgcctgagaaaggtggatcagggcctgtttgttcagctggttcaagccaacacgccagcatcacttgtgggtctgaggtttggcgaccaattgcttcagattgacggtcgcgactgcgccggctggtcaagtcataaagcccaccaggtggtgaaaaaagcgtctggtgataagatagttgtggtagtgcgagacaggccctttcagcggactgtcacaatgcacaaagacagcatgggccatgtagggtttgtaatcaagaagggcaagatcgttagcctggtgaaaggcagctccgcagcacgaaacggcctcctcactaaccattacgtgtgtgaggtcgatggccagaacgtgattggtttgaaggacaagaagattatggagatactggccacggcaggaaatgttgtgacactgaccattatcccgtccgtgatctacgagcacatggtgaagaaattgcctccagtgctactccatcacaccatggaccactcaatccctgatgcctag

SEQ ID NO: 46710 - DNA, 879 bp, Artificial Sequence
  Description of Artificial Sequence: Synthetic coding sequence
atgagcagcctgtaccccagcctggaggacctgaaggtggaccaggcgatccaggcacaggtacgggcctcccctaagatgccagcactcccagtgcaagccaccgcgatttcgcccccaccagtgctctaccctaacctcgctgagctcgagaactatatgggactgtcgctctccagccaggaggtgcaggagagcctgctgcaaattcccgaaggcgacagcactgccgtgtctggacccggcccaggtcagatggtggcacctgtgacaggctatagcttaggtgtccgcagggcagagatcaagcctggagtcagggaaatacacttgtgtaaggatgagaggggcaagaccggactccgccttcgaaaggtcgatcagggcctcttcgtgcaactcgtgcaagcgaatactccagcgtccctggtgggcctaaggttcggcgatcaactgctgcaaatcgacggccgcgattgcgcaggttggtccagtcacaaagcccatcaggtcgtaaagaaggccagtggcgacaaaatcgtggttgtcgtcagagatcgaccattccagcggacagttacaatgcataaggattcgatggggcacgtcgggttcgtcataaaaaaaggcaaaatcgtgagtttggtgaagggtagttctgcagcacggaatggcctgcttacaaatcactacgtctgcgaagtggatggtcaaaacgtgataggtctcaaagataaaaagataatggagattctggccactgctggaaatgtagttacactaaccattatcccatccgtcatttacgaacatatggtcaagaaacttccccccgtgctgctccaccacacaatggaccactccatccctgacgcttag

SEQ ID NO: 46711 - DNA, 624 bp, Artificial Sequence
  Description of Artificial Sequence: Synthetic coding sequence
atggtggcccccgtgaccggctacagcctgggcgtgcggcgggccgagatcaagcctggagtaagggaaattcacctgtgtaaggacgaacgcggaaaaacaggcctcagactcagaaaggtggatcaaggcctgttcgtgcagcttgtgcaggccaacacaccagcctctctcgtcgggctgagattcggggaccagctgcttcaaattgacggacgcgactgcgcaggttggtcctcccacaaggctcaccaggttgtcaaaaaagccagcggcgacaagattgtggtggttgttcgtgatcggccctttcagagaactgtcaccatgcacaaggattcaatgggtcatgttggtttcgtgataaagaaaggaaagatcgtatccctggtcaaaggaagttccgccgcgcggaatggccttctcacaaaccactatgtttgcgaagttgatggccagaatgtgataggtttaaaggataaaaaaataatggagatcctggctactgcaggcaacgttgttaccttgaccattattccttctgtgatctatgagcacatggtaaagaagcttcctccagtcctgcttcaccacactatggatcacagcatacccgacgcctag

SEQ ID NO: 46712 - DNA, 879 bp, Artificial Sequence
  Description of Artificial Sequence: Synthetic coding sequence
atgagcagcctgtaccccagcctggaggacctgaaggtggaccaggccatacaagcacaggttagagcaagccccaagatgccagcactccctgtgcaggcaaccgctatctctccaccacccgtcctctaccctaacctagcggagttggaaaattacatgggcctgagtttgtcatctcaagaggttcaggagtcgctgctgcagattcccgagggcgatagcaccgccgtgtcaggccctgggcctggacagatggtggcaccagtgacaggctatagcttgggagttagaagggctgaaataaagcccggcgtccgggaaatccacctctgtaaggatgaaagggggaagacagggttaagactcaggaaagtagaccaaggacttttcgtacagctggtacaggccaatacccctgcctctctcgtgggcctgcgcttcggtgatcagctgctgcagatagatggaagggactgcgccggctggagctctcataaggcccatcaggtggtgaaaaaggcctccggtgacaaaattgtggtcgtggtccgagatcgtcccttccagaggactgtgacgatgcacaaggactcaatgggacacgtagggtttgtgattaagaaaggcaagatagtctccttggtcaagggatcatcggctgctagaaatggtctccttactaaccattacgtgtgtgaagtcgatggtcagaacgtaatcggcttgaaggataagaagattatggagattctggcgactgctgggaacgtggtgaccctgactatcattccctccgtaatttatgagcatatggttaagaaactcccacccgtgctgctgcaccatactatggaccatagcatacctgacgcatag

SEQ ID NO: 46713 - DNA, 750 bp, Artificial Sequence
  Description of Artificial Sequence: Synthetic coding sequence
atgagcctggaggaccccttcttcgtggtgcggggcgaggtgcagaaggctgtcaacactgcccgcggcctgtatcaaagatggtgcgaattgctgcaggaatcagcagcagtgggccgcgaggaactggattggacaacaaacgagctgcggaacggcttgaggagcattgaatgggaccttgaggatctggaagaaaccatagggattgtagaggctaatccgggtaaattcaagttgcctgcaggggatttgcaggaacgaaaagtttttgtcgaacggatgagagaagctgtccaggagatgaaagaccacatggtgtcaccgacggctgtagccttcctagagcggaataaccgcgaaatcctggcgggtaaacctgcagcacagaaatccccatctgatctcctggatgcatctgctgtctccgctaccagcagatatatcgaggaacagcaggccacacaacaactgattatggacgagcaagatcagcagctcgaaatggttagtggcagtatccaggtccttaagcacatgtcagggcgggtgggtgaggagctcgacgaacaagggatcatgctcgatgctttcgcacaggagatggaccacactcaatccagaatggatggtgtgctccgcaagctggccaaggtctctcatatgactagcgaccgccggcagtggtgcgccattgctgtcttagtgggcgttttgctcctggtgctgattcttctcttcagcttatag

SEQ ID NO: 46714 - DNA, 603 bp, Artificial Sequence
  Description of Artificial Sequence: Synthetic coding sequence
atgagcctggaggaccccttcttcgtggtgcggggcgaggtgcagaaggccgtgaataccgctcggggcctgtatcaacgatggtgcgaactactgcaggagtccgccgccgtaggcagggaggaactagactggaccactaatgaactacggaatggtttaagaagcattgaatgggatctagaggatctggaagagaccatcgggattgtggaagcaaacccagggaaaccagctgcccagaagtctccatccgacctacttgacgcatccgcagtgagcgccacgtcacgctatatcgaggaacaacaggctacgcagcaattaattatggatgagcaagaccagcagttagaaatggtgagcgggtctatccaggttctcaagcatatgagcggccgcgtgggagaggaattagatgaacaggggatcatgcttgatgcttttgcacaagaaatggaccatacacagtcacgaatggatggcgttctcagaaagctggccaaagtaagccatatgacctcggacagaagacagtggtgtgccattgcggttctcgtcggggtcctgctcctggtgctcatcctgctgttttccctttag

SEQ ID NO: 46715 - DNA, 741 bp, Artificial Sequence
  Description of Artificial Sequence: Synthetic coding sequence
atgagcctggaggaccccttcttcgtggtgcggggcgaggtgcagaaagccgtcaacacagcgaggggtttgtatcagaggtggtgcgagttgctccaggagtctgccgcggttgggagggaagagctcgactggaccacaaatgagttgagaaatggcctgcggtccatcgaatgggacctggaggacttagaagagacaatcggcatcgtggaggcaaatcctggaaagttcaagctccctgccggagatttacaggagaggaaagtttttgttgaacgtatgagggaagctgtgcaggaaatgaaagaccacatggtctctccaacggccgtcgctttcctagaacgcaacaaccgcgaaattctcgctggaaaaccagccgcccagaagagtcccagtgacctcttagatgcctccgccgtgagtgctacttctcgctacattgaggaacagcaggcgactcagcaattgattatggacgagcaggaccaacagttggagatggtatccggcagtatccaggtgctcaaacacatgagcgggcgggtgggggaggaactggatgagcaggggatcatgctggacgcctttgctcaggagatggaccatacccagtctaggatggacggcgtattgagaaaactggccaaggtctctcatatgacttccggggagtccccccagggccgggggcaatcttggtgggggcaggttgttggcgggaccctgagtccttag

SEQ ID NO: 46716 - DNA, 750 bp, Artificial Sequence
  Description of Artificial Sequence: Synthetic coding sequence
atgagcctggaggaccccttcttcgtggtgcggggcgaggtgcagaaagctgtgaacaccgcgagaggactctaccaacgatggtgtgaactgctccaagagtccgctgccgtgggcagggaggagctcgattggacgaccaacgaactgcgaaatggtctaaggagtatagagtgggacctcgaggatcttgaagagaccatcggaattgtagaggcaaaccccgggaagttcaaactgcctgctggtgatcttcaagagcgaaaagtgttcgtggagcgtatgcgggaggccgtccaagagatgaaggatcatatggtgtccccaacagccgtggcatttctcgaacgcaataatagagagatattggctggaaaaccggcggcacagaagtcaccgagcgatctgctagacgcatcagccgtatcggccacttcgcggtatatcgaggaacagcaggcaacccagcagctgattatggatgagcaggaccagcagctcgagatggtgtctggctccattcaagtcttgaagcacatgtccgggcgggtgggcgaagagctggatgaacaagggatcatgctcgatgccttcgcgcaggagatggaccatacacaaagtagaatggatggagtattaagaaaattagctaaggtgtcacatatgaccagcgatcgacggcagtggtgtgcaattgcggttttggtgggcgtgctgttgttagttctcatcttgctgttctcgctgtag

SEQ ID NO: 46717 - DNA, 741 bp, Artificial Sequence
  Description of Artificial Sequence: Synthetic coding sequence
atgagcctggaggaccccttcttcgtggtgcggggcgaggtgcagaaggccgtgaatactgctagggggttgtaccaacggtggtgcgagttgctgcaggaaagtgccgctgtgggccgggaggagttggactggaccacaaatgagttacggaatggcttgcgatctatcgaatgggacttggaagatctcgaagagactatcggaatcgtggaagccaatcccggcaagttcaagctccccgccggagaccttcaggagagaaaagtgttcgtcgagaggatgcgagaagccgtgcaggagatgaaggaccacatggtgtctcccacagcagtggcgtttcttgagcgcaacaaccgcgagattctggccggcaaacccgctgctcaaaagtctccctcagacctcttggatgccagcgccgtgtcggcaaccagcagatatattgaggaacaacaggccactcaacagttaatcatggatgaacaggatcagcagctggagatggtctcaggaagcatccaagtgctcaagcacatgagcggccgagtcggcgaggaactcgatgagcagggtatcatgttagatgccttcgcacaggagatggatcacacccaaagccgcatggacggagtgctgcgtaaactagccaaagtgtcgcatatgacatccggggaatccccgcaggggcgcggccaatcttggtgggggcaggtggtcggcggcacactctcaccgtag

SEQ ID NO: 46718 - DNA, 831 bp, Artificial Sequence
  Description of Artificial Sequence: Synthetic coding sequence
atgagctacggccccctggacatgtaccggaaccccggccccagcggaccccagctccgtgactttagctccatcattcagacctgcagtggcaatattcagaggatctcccaggctactgctcagattaaaaatctgatgagccaactggggaccaagcaggattctagcaaactgcaggaaaacctccagcagttacagcattccacaaaccaactggcaaaggaaaccaacgagttgcttaaagagctgggatctctccctttgcccctgtctacatctgagcaaaggcagcaaagacttcagaaggagaggttgatgaacgacttcagcgctgccctaaacaatttccaggccgtccaacgtagggtgagcgagaaagagaaggaatcgattgcccgagcccgggctgggagccgattgtctgcggaggaaaggcaaagggaggagcaactggtttcattcgacagccacgaagagtggaatcagatgcaaagccaagaagacgaagtcgcgattacggagcaagatctggagttgatcaaggagagggagaccgctatcagacagcttgaagcagacattctggacgtgaatcagatttttaaggacctggcgatgatgatccatgaccagggagatctcatcgactccattgaggcaaacgtcgaaagcagcgaggtccacgtagagcgcgctaccgagcagctgcagcgagccgcctactaccaaaagaagagccgtaagaaaatgtgcatattggttctggtactgagcgttatcatactgatcttagggctcatcatttggctagtgtacaagacaaaatag

SEQ ID NO: 46719 - DNA, 705 bp, Artificial Sequence
  Description of Artificial Sequence: Synthetic coding sequence
atgagctacggccccctggacatgtaccggaaccccggccccagcggaccccaactccgagattttagctcaattatacaaacatgctccggaaacatccaaaggatcagccaggcgacagcccaaattaaaaacctgatgtcacaactgggaacaaaacaggattccagtaaactgcaggagaatctccagcaactgcagcacagcacaaaccaactcgccaaagagacaaatgagctgttaaaagaactgggaagcctgccactgccactgagcacctctgaacagagacagcaacgcctgcagaaggaaaggttaatgaacgatttctctgccgccctgaataattttcaggccgtgcagcggcgggtgagtgaaaaggagaaagaatcaatcgctcgggctcgcgccggctctcgcctatctgccgaggagcgacagcgggaggaacaattggtatcttttgatagtagcctactccttgacatgaagaacgtggccctgcaagatttcatcgatagtcgcggattagaaccatgtcatgaggaatggaatcagatgcaaagccaggaggatgaagttgccattacagaacaggacctggagctgataaaagagcgtgaaacagcaattagacagctggaagccgatattcttgatgtgaaccagattttcaaggatcttgcaatgatgattcacgactag

SEQ ID NO: 46720 - DNA, 1008 bp, Artificial Sequence
  Description of Artificial Sequence: Synthetic coding sequence
atggccgtggacatcaccctgctgttccgggccagcgtgaagaccgtgaagacaaggaataaagcattgggtgtggccgtggggggaggggttgacggatctcgtgatgaactgttcagaaggtcacccagacctaaaggcgacttctcatcaagagccagggaggtgatcagccacatcggaaagctgcgagatttcctgctcgaacaccgcaaagattatattaacgcttactcacacacaatgtcggagtacggacgcatgaccgacacagagagagaccagatcgatcaggatgcccagatttttatgcgaacctgttccgaggccatccagcaactgaggacagaagcgcataaagaaatccactcccagcaagtgaaggaacataggaccgcagtgctcgacttcattgaagattatttaaagcgcgtgtgcaagttgtattctgaacagcgggctataagagttaaacgagttgtcgataaaaaaaggctatcaaagcttgagccagagcccaacactaagacgagagaatcaaccagttcagaaaaggtgagtcaaagccctagtaaggattctgaggaaaatcccgccacagaggagcggcccgaaaaaatcctcgccgaaacccagcctgaattaggcacctggggggacggcaaaggagaggacgagctgtcccccgaagagattcagatgtttgagcaagagaaccagcggctgatcggagaaatgaacagtctgttcgacgaagtaagacagatcgaaggtcgcgtggtagagatttcccgactccaggaaatttttaccgaaaaagtgcttcagcaggaggcagagatagacagcattcaccagctggtcgtcggggccaccgaaaatattaaagaggggaatgaggatataagagaggctatcaaaaacaacgccggatttcgcgtgtggattctgttctttcttgtcatgtgttctttttccctgttgtttctcgactggtacgactcttag

SEQ ID NO: 46721 - DNA, 768 bp, Artificial Sequence
  Description of Artificial Sequence: Synthetic coding sequence
atgagcatggaggaccccttcttcgtggtgaagggcgaggtgcagaaggccgttaacacggcacaggggctgttccagagatggaccgagttgttacaagatccttcaactgcgacacgagaggagattgactggactactaacgagttgcgcaacaacctgagatccattgagtgggatctggaggacctcgatgaaaccatttcaatcgttgaggccaatccaaggaagttcaacctggatgcaaccgagctctctattaggaaggcatttataacaagtacccgtcaggtcgtgcgtgacatgaaggaccagatgtccacctcttctgtgcaggcactggctgaacgaaaaaatagacaggcactgttgggtgacagtgggagtcaaaattggtcgaccggcacaaccgataagtacggacggttggatagagagttgcagcgagccaacagtcatttcatcgaagaacagcaagctcagcagcagctcattgtggagcaacaggatgaacaactcgaactggtgtctggcagcatcggagttctgaaaaatatgtcccaacggatcgggggggaactcgaagagcaggcagtgatgcttgaggacttcagtcacgagctcgaatcaacacagtcgagactggacaacgtcatgaagaagctcgccaaagtctcacatatgacaagtgaccggcggcagtggtgtgcgatcgccatcctgttcgccgtgctgttggtcgttcttatcctgttcctcgttctctag

SEQ ID NO: 46722 - DNA, 465 bp, Artificial Sequence
  Description of Artificial Sequence: Synthetic coding sequence
atgaaggaccagatgagcaccagcagcgtgcaggccctggccgagagaaagaaccggcaggcgctgttaggggattccggtagccagaactggtctacgggcacgaccgataagtatgggagacttgacagggaacttcagcgggctaacagccacttcatcgaagagcaacaagcacaacagcagctgatcgtggaacagcaggatgagcagctggaacttgtgtctgggtctattggggtgttgaaaaatatgtcccagagaattgggggtgaactcgaagaacaggccgtaatgttggaggatttttcacatgagctggaatctactcaatcaagacttgataacgtcatgaagaaacttgctaaagtaagtcacatgacttcagacagaagacagtggtgtgcaatcgctatactctttgcggtcctgctggttgtcctgattctgttccttgtcctctag

SEQ ID NO: 46723 - DNA, 1779 bp, Artificial Sequence
  Description of Artificial Sequence: Synthetic coding sequence
atggccccccccgtggccgagcggggcctgaagagcgtggtgtggcaaaagattaaggccactgtttttgacgattgtaaaaaagaaggcgaatggaaaatcatgttactcgatgaattcacaacaaaattgcttgccagctgttgcaagatgaccgatcttctagaagagggtatcacggtggttgaaaacatctacaagaaccgggagccagtccgtcagatgaaagcgctctacttcatcacacctacaagtaagtctgtggattgttttctgcatgacttcgcttcaaaaagtgaaaacaaatacaaggcagcctacatatattttaccgatttttgtcctgataacctttttaacaaaattaaagcctcttgctccaaaagcatcaggaggtgcaaagagatcaatatctccttcattccacacgaatcgcaggtgtatacactggatgtgcccgacgccttctattactgctactcaccagatccagggaatgccaagggcaaagacgccatcatggagacaatggcggatcagatcgtcactgtttgcgcaaccctcgacgagaaccccggagttcgctataaatctaagccactggacaatgcgagcaaattagctcaattagtggaaaagaaactggaagattattacaaaatcgatgaaaaatcacttatcaaggggaagacgcactcccagcttctgataatcgatcgaggcttcgatcctgtgtctacagtgcttcacgagttgacgtttcaggctatggcctatgacctcttaccaatagaaaacgacacatacaaatacaaaaccgacggcaaggagaaagaagcaattcttgaggaagaggacgatctctgggtaaggattcggcatagacacatagcagtcgtgctggaggaaattcctaagctgatgaaggaaatctcctccaccaagaaggccaccgagggtaaaacgtcactaagcgccctgacacagctaatgaaaaaaatgccccactttcgcaaacagataaccaaacaggtggttcatcttaacctggctgaggattgtatgaataagtttaaattaaacatcgaaaagctctgtaagacggaacaggacttagctttgggaaccgatgctgaaggacagaaagtgaaagatagtatgcgggtgctcctaccggtgctcctgaacaagaaccatgacaactgtgacaagatcagggcgatcctgctgtatattttttcaattaatgggactacagaagaaaatctggacagactgatccagaatgtgaaaatcgagaacgagtcagatatgatcagaaactggagttacctgggcgtgcccatagttcctcaatctcaacaaggcaaacctctacgcaaagacagaagcgcagaggaaactttccagctctcaaggtggacgccttttattaaagacatcatggaggatgcaattgacaaccgcttggacagtaaggagtggccctactgtagccaatgcccggccgtttggaacggatctggcgctgttagtgccaggcagaagcctcgggccaactatctcgaagaccggaagaatgggtcaaaattgatcgtcttcgttattggcgggattacatactccgaggtcaggtgtgcctacgaggtgtctcaggcccataagagttgcgaagtcatcatcggttctacacatgtgctgaccccgaagaaactgttggacgatatcaagatgctgaacaagcctaaggacaaagtcagcctcatcaaggatgagtag

SEQ ID NO: 46724 - DNA, 2616 bp, Artificial Sequence
  Description of Artificial Sequence: Synthetic coding sequence
cggatctgcagccaggaggaggtggtgatcccctgcgcctacgacagtgactctgaatctgtggacctggagctgtcaaacctggaaatcatcaagaagggctccagctctatagagctaaccgatttggacatacccgacatacccggcttgcactgtgagcccctgtctcatagtcctagacacctgacacaacaggaccctttatccgaagccatagtagaaaagttgatccagagcattcagaaagtgttcaacggcgaactgaaaggcgagcttgagaaattaaagttcctcggagacttgagcagcttgtcccaggctctgccttatgacgagaccgccaaatcatttatccattctcacattgctgatattgtgcataccctgaatgttctagtgcaggaggagcgacctcattctctgagtagtagcatgcggcaagaagtattcgtcaccattgccgacctgtcctatcaggacgtgcacctgctactcggtagtgaagatcgcgccgaactgttctcactcactataaagtccattatcaccctaccatccgtgaggaccttgacacagatccaagagatcatgccaaatggtacatgtaacaccgaatgcctgtaccgtcaaaccttccaggccttctcggagatgcttcagtcactggttgttaaggacccacacctggagaaccttgacactatcataaagctgcctctgcggttccagcgcctggggcatctagtagcccttatggctctgctttgtggagaccctcaggagaaggtggccgaagaggcggcggaagggattcactccctgctccacatcactctgagactgaagtatatcacacacgacaagaaagatcagcagaacctgaaacgcgccctgacaaagtgccgagagttcttagagttgcatagctcagcggccaaatgcttctataattgtccgttccggatagctcaggtcccagagatcatgggggtcatctgcgctcagcttagtatcatttcacaaccccgagtgaggcaacagatcatcaacactgtgtctttgttcattagtagacctaagtacactgatattgtcctatccttcctgctgtgtcatccagtgccctataacaggcaccttgctgaggtctggcgtatgctgtcagtcgagctaccctccactacatggatcctgtggaggctcctgcgcaagctccaaaaatgccataatgagcccgcccaggaaaagatggcgtacgttgccgtggctgcaacagatgccctttacgaggtgtttcttggtaatcgactccgcgccgccacatttaggctatttccacagctgctgatgactctcctgatccagattcaccactccatcggcttaaccatgagcgacgtggacattccctccggcttgtacacggaacaagaagtgcccagcgaggttacaccactgtgtttcgctatgcaggcaacaaagacactcctgttaaggacctgttgtctgcaggaatttaacatcatggagaaaaacaaaggctgggctctactggggggaaaggatgggcaccttcaggggctgttccttctggccaatgccttgctggagcgcaatcagctgctggctcagaaggtgatgtatctcctggtgccattgctgaaccgaggaaacgacaagcacaagcttacttcagctggcttctttgttgaattgttgcggagtccagttgcaaaacgcttgccaagcatatattccgtggcacgatttaaagactggctgcaggacggtaatcacctcttcagaatcctggggctccgggggctctacaatcttgtgggacaccaggagatgagggaagatatcaaaagtctactgccctatatcgttgactccctgagagaaactgacgaaaagatagtgttgtctgccatacaaattcttctgcagctcgtccgtacaatggattttaccaccctggccgccatgatgcgcacactgttttccctgtttggcgatgtgcgttcggacgtgcaccggttttcagtaacactctttggagctgccataaaatccgtcaagaaccccgataagaagagcatcgaaaaccaggtgctggatagcctggttcctttgttactctactcccaagacgaaaacgacgctgtcgccgaggagtctaggcaggtgcttaccatctgcgctcagtttttgaaatggaagttaccccaagaggtctactccaaggatccatggcacatcaaaccgaccgaagccggcactatttgcaggtttttcgagaaaaagtgcaaaggaaagatcaatatcctggagcaaacgctgatgtattctaagaaccccaaactacccattcggaggtccgcagtcctgtttgtaggactactttctaaatacatggatcataatgaactgcggcggatggggaccgattggattgaagatgacctgagagatctgctgtgtgatcctgagccgagtctgtgtatcatagccagccagaccttgctcctggttcagatggcacgcgctgagcccaagcctaagcagcgggtgaattggcttcagaaattgatgggcagaagttccgcatag

SEQ ID NO: 46725 - DNA, 1620 bp, Artificial Sequence
  Description of Artificial Sequence: Synthetic coding sequence
atgggcaccgagggcccccccccccccgccgccagccggggccggcagggctgcttgctggtccccgcacggacaaaaacgactatcgccctcctatatgacgaggagagtgagaacgcatatgatatacggctgaaactaaccaaagaagtgctgaccattcagaagcaggacgtggtttgcgtcggagggtcacaccagggaaggaatcgaaggacagtcacactccgacgtcagccagttggcggtctgggcttgtccatcaagggcggttccgaacataacgtgcctgttgtaatatcaaagatattcgaagaccaggctgccgatcagactggcatgttgtttgtgggcgacgccgttctacaggttaacgggatccatgtggagaatgcgacccacgaggaggtggttcatcttctgaggaatgctggtgatgaagttacaatcacagtcgaatatctacgagaggctccagccttcctcaagttaccactgggttcccctggaccatcgagcgatcacagtagcggggcctctagtcccctatttgacagtgggctccacctgaatgggaattcctcgaccacagcgccatcgtccccaagcagccccatagcaaaagatcccaggtacgaaaagcggtggctcgacacgctaagcgtgcctctgtccatggcccggataagtaggtacaaggcggggactgagaagctcagatggaatgcttttgaggtcctggccttggatggcgtgtctagtggcatcctgaggttttatacagcccaagatggtaccgactggctacgggcagtgtctgctaacattagagagctgaccctgcaaaatatgaagatggcgaacaaatgctgcagccctagcgaccaggttgtgcacatggggtgggtgaacgaaaaactccaaggggcagactcttctcagacgttccgccctaagtttctggctctgaagggcccaagtttctacgttttttcaacacctccagtgagcaccttcgactgggtccgcgcggaacgaacttatcatctctgcgaggtcctgttcaaggtccacaagttctggttgacggaagactgctggctgcaagccaatctctaccttggcctccaggattttgattttgaggatcagaggccatactgcttcagcatagttgcaggccacgggaagtctcacgtgtttaatgtggagctgggcagcgagcttgcgatgtgggagaagagcttccagcgggccacgttcatggaggtgcagcgaaccggctctcgcacttacatgtgctcctggcaaggggagatgctgtgcttcactgtcgattttgctctggggttcacttgcttcgaaagtaaaacgaagaatgtcctgtggaggtttaaattcagtcagctaaaaggtagcagcgatgacggcaagacgagggtgaaactgttgttccagaatttagacactaagcagatcgaaacaaaagagctggagtttcaagacttaagggcagtcctgcactgcatacattcgttcatcgcagcaaaagtggcatccgtagaccccgggttcatggactctcaaagcctggccagaaagtatatgtactcctcatag

SEQ ID NO: 46726 - DNA, 540 bp, Artificial Sequence
  Description of Artificial Sequence: Synthetic coding sequence
tgagacctgaagaacgtgttcccccccgaggtggccgtgttcgagcctagtgaagctgaaatcagccacacacagaaggccacactggtgtgccttgccacaggcttttacccagatcatgttgaactgagttggtgggtgaacggtaaggaagtacattccggtgtctctactgacccgcaacctctcaaagaacagccagccctgaacgactccagatactgccttagctctcgcctgcgcgtgagcgcaacattttggcagaacccacgcaatcatttcagatgtcaagtccagttctacggcctcagtgaaaatgatgaatggactcaggatagagccaagcccgttacacagattgtgagcgctgaggcctgggggcgagcagactgcgggttcacttctgaatcatatcagcaaggagtgctcagcgccactatcctgtatgagattctcctgggcaaagctacactgtacgccgtcttagtgtccgctctcgtactgatggccatggtaaagcgaaaagatagccggggatag

SEQ ID NO: 46727 - DNA, 465 bp, Artificial Sequence
  Description of Artificial Sequence: Synthetic coding sequence
tgaagccagccccacaccaagcccagcgtgttcgtgatgaagaacggaaccaatgttgcctgcctagtcaaggaattctatcccaaagacattaggatcaacctggtgtcctcaaagaaaatcactgagttcgaccccgctatcgtgatcagccccagcggaaagtacaatgcggtgaagctcggtaagtatgaggattccaattccgtcacatgttcagtccagcacgataacaaaacagtacacagcaccgactttgaggtgaagacagactcaactgaccacgttaaacctaaagagactgagaacaccaagcagccatccaaatcatgccataaacccaaggccatcgttcacacggagaaggtgaacatgatgagcctcaccgtgcttggccttcgaatgctgttcgccaagacagtcgctgtgaacttcctgctgactgccaaattattttttctatag

SEQ ID NO: 46728 - DNA, 357 bp, Artificial Sequence
  Description of Artificial Sequence: Synthetic coding sequence
atgcggtgggccctgctggtgctgctggccttcctgagccccgcctcacagaaatcttcgaatctggagggccgtacgaagagcgtaactcgtcagactgggagcagcgctgagataacatgtgatctgactgtgactaacactttttacatacattggtatttgcatcaggaaggcaaggccccccagcgcctgctgtactatgacgtctccaccgcccgcgacgttctcgagagtgggctgtcccctggtaagtattacactcacactcctagaaggtggtcctggatccttcgcctgcagaacctcatcgagaatgacagcggggtgtattactgtgcaacatgggaccgctag

SEQ ID NO: 46729 - DNA, 816 bp, Artificial Sequence
  Description of Artificial Sequence: Synthetic coding sequence
atgatccccaagctgctgagcctgctgtgcttccggctgtgcgtgggacagggagacacacgcggagacggaagcctacccaagcctagtctttccgcctggccctcgtccgtggtgccagccaactccaacgtgacccttcgatgttggacccccgctcgcggagtatctttcgtgcttcgcaagggaggaatcattctggagtccccgaaaccactcgactctaccgagggcgcagctgaattccatctgaacaatctcaaggtgaggaacgccggtgagtatacctgcgaatactaccgtaaggcatctccgcacatcctgagtcagcgaagcgacgtgttgttgcttcttgtaacaggacacctttccaagcctttcctgcgcacgtaccagaggggtacagttacagcaggaggaagggtcaccctgcagtgtcaaaaaagagaccagctctttgtgcctatcatgtttgcactgttgaaggccggaactccttccccaatccagctccaaagccctgccggaaaggaaatcgacttttccctggtcgatgttacggcaggcgatgccggaaactattcttgtatgtactaccaaactaagagtccattctgggcctctgagcccagcgaccagctggaaatcctggtgacggttcctcctggaaccacctcctccaactatagtttggggaacttcgtgcggctaggactggccgccgtcattgtcgttatcatgggtgccttcctagttgaagcctggtactccagaaatgtcagtcccggcgagagtgaggcgtttaaacccgagtag

SEQ ID NO: 46730 - DNA, 840 bp, Artificial Sequence
  Description of Artificial Sequence: Synthetic coding sequence
atgaaggagcggaagaagaaggagcggaaggagcggaagcggaagaaagagcgcaacggcttatgtgttggtcagggtgacacccgcggagacggctctttaccaaagccttcattatccgcatggccgtcctccgtagtcccagctaattcgaacgttactttacgttgttggacaccggctcggggagtaagtttcgtgctacggaaggggggaatcatacttgagagtccgaagcctctggacagtaccgagggtgcggccgagttccatctgaataaccttaaagtgcgcaacgcaggggaatacacatgcgagtactaccgaaaggcttcccctcatattctttcgcagaggtccgatgtgctgctcctgctggttaccgggcatttgagcaagccttttctgagaacatatcagcgtgggacagtgacagccgggggtagagttacccttcagtgccagaagcgggaccagctgtttgtcccgattatgtttgccttactgaaggccggcacccctagcccaatccagctccagtcccctgccggaaaggagatcgacttcagcctggtcgatgtgacagcgggagacgcggggaattattcgtgcatgtactatcagactaagagccctttctgggcgtccgagccaagtgatcagttggaaatccttgtgactgtccctcctgggaccactagttcaaactactccttgggaaatttcgtccgtttgggtctcgccgcggtcatcgttgtaatcatgggagcattcctcgtcgaggcgtggtattcccgcaacgtgagccccggggaaagcgaagcctttaagcctgagtag

SEQ ID NO: 46731 - DNA, 951 bp, Artificial Sequence
  Description of Artificial Sequence: Synthetic coding sequence
atggccctgcagaccctgcagagcagctgggtgaccttccggaagattttgtcccacttccccgaagaattgagcctcgcattcgtttacggctccggcgtctataggcaagctggccccagctcagatcaaaagaatgcaatgttggatttcgtgtttacggtggacgaccctgtagcttggcactcaaaaaacctcaaaaagaactggagtcattactctttccttaaggtgctaggtccaaagattattactagcatccaaaacaattacggtgcaggcgtctattataactccctaattatgtgcaacgggcgcctcatcaagtatggcgtgatcagtaccaatgttcttattgaggacctcctcaactggaataatctgtacattgctggcagactccagaaacccgtgaaaataattagcgtgaacgaagatgtaaccttacgcagtgccctcgataggaacctgaagagtgcggtcacagctgcttttctaatgctccccgaatccttttcagaggaggacctgtttatagaaatagccgggctatcttactctggcgacttccgtatggtagtgggggaagacaagaccaaagtcctgaatatcgtcaagccaaacattgcccatttccgagagctgtacggaagcatcctgcaagaaaatccccaagtggtatacaagagccagcagggatggcttgaaattgataagtcccccgaggggcagttcactcagctgatgacactgccaaaaaccctccagcaacagattaatcatatcatggaccctcctggcaaaaatcgcgatgtggaagaaactcttttccaagtggcccatgatcccgattgcggggacgtggtgcggttagggctgaaaaagagtgtcatttacagtagcctcaaacttcataaaatgtggaaaggttggcttagaaagacttcttag

SEQ ID NO: 46732 - DNA, 2190 bp, Artificial Sequence
  Description of Artificial Sequence: Synthetic coding sequence
atgcagagcaccagcaaccacctgtggctgctgagcgacatcctgggacagggggctacagccaacgtgtttcgcgggcgacacaagaaaaccggcgatttgttcgccattaaggtgttcaataacatctccttcctgagacctgttgacgtgcagatgcgtgagttcgaagtgcttaagaagctgaaccataagaatatcgtgaagttgtttgccattgaggaggagacgacgacgaggcacaaggtcctcattatggaattttgtccttgtgggtcattatatactgtgctcgaggaaccttctaatgcctacggccttccagagtctgaattcctaatcgtcctgagagatgtcgtcggggggatgaaccacctccgtgaaaatgggatcgttcaccgggatattaaaccgggaaatataatgcgcgtgatcggggaggacggacagagcgtctacaaacttactgatttcggggcagcccgagaacttgaagacgacgaacagtttgtgagcctttacggcacagaagagtacctgcatcctgacatgtatgagcgcgctgttttgcggaaagaccatcaaaagaagtatggtgctacagtggatctctggagtattggcgtgaccttttaccacgctgccacaggttctctgcctttccgaccctttgaaggcccaaggcggaataaggaggtgatgtataaaatcatcaccgggaagcccagtggggccatctcaggcgtacagaaagctgaaaacgggccgatcgattggagtggagacatgcccgtctcgtgctctctcagcagggggctgcaggttctgctgacccccgtgctcgccaacattctggaggcagatcaagaaaagtgttggggattcgaccagttctttgctgagacgtccgatatactccacaggatggtaatccacgtgttctctctgcaacaaatgactgcgcataaaatctacatacacagctacaataccgcaacgatctttcacgagcttgtgtacaagcagacaaagatcatctcgtctaaccaggagcttatttacgagggccgcagactggttctggaacctggacgcctggctcagcactttcccaaaaccacagaggagaatccgatatttgttgtatcacgcgagcccctgaacactatcgggttaatttatgagaaaatctctcttcctaaagtacaccctcggtacgatctggatggggacgcttcaatggccaaggcgattacaggggttgtttgctacgcctgtagaattgcctccacgcttctgctatatcaggaactaatgcgcaagggtataaggtggcttatagagttaatcaaggacgattacaacgagaccgtgcacaagaaaaccgaggtggtcatcaccctggacttttgtatccgcaatatcgaaaagactgtgaaggtgtatgagaaactgatgaagattaatttggaagcagctgaactgggtgaaatttccgacatacataccaagttgttaagactgagttcttcccaggggaccatcgagacaagtctgcaggacattgactcccgcctcagccccgggggatccttagctgatgcttgggcccaccaagaggggacccacccaaaggaccggaatgtcgagaagctgcaggtcctgcttaattgtatgaccgaaatctactatcagtttaaaaaggacaaggcagagcggcggctggcctacaatgaagagcagattcataaatttgacaagcagaagctctactaccacgctacgaaagccatgacgcactttaccgacgagtgcgtgaagaagtatgaggcattcttaaacaagagcgaagagtggatacgaaagatgttgcatttaaggaaacagttgctgtccctgaccaaccaatgtttcgacattgaagaggaggtatcgaaataccaagaatataccaatgaactccaggagacactcccccaaaaaatgtttaccgctagttcaggcatcaagcacacaatgactccaatatacccatcatctaatacgctggtggagatgactttggggatgaagaagctcaaagaagaaatggaaggggtggtgaaagagctggccgagaacaatcatattctggagcggtttggatccctcaccatggatggcgggcttcgtaacgtggattgcttgtag

SEQ ID NO: 46733 - DNA, 312 bp, Artificial Sequence
  Description of Artificial Sequence: Synthetic coding sequence
atgcagagcaccagcaaccacctgtggctgctgagcgacatcctgggccagggggctacagccaatgtttttcggggcagacataagaagacaggcgacttgtttgctattaaggtgtttaataatatttccttcctgagacctgtagacgtacagatgagggaattcgaagtgttaaaaaagttgaaccacaaaaacattgttaagctgtttgctatcgaggaagaaacaactacgcggcacaaggttcttattatggagttttgtccttgcggatcgctgtacactgtcctggaggagccatcgaactag

SEQ ID NO: 46734 - DNA, 297 bp, Artificial Sequence
  Description of Artificial Sequence: Synthetic coding sequence
atgcagagcaccagcaaccacctgtggctgctgagcgacatcctgggacagggtgctaccgccaacgtgttccgtggtcggcacaaaaaaacaggggacctcttcgccattaaagtttttaataatatatcctttctccgccccgtggatgtgcaaatgcgcgagttcgaagtgttgaagaagctcaatcataaaaacatagtgaaactgttcgctatcgaggaagagacaaccacaagacataaggtcctgatcatggagttttgtccgtgtggcagcctatataccgtgctgtag

SEQ ID NO: 46735 - DNA, 924 bp, Artificial Sequence
  Description of Artificial Sequence: Synthetic coding sequence
atgcacgacgacgagagcaccatcaacagcagcagcagcgtggtgcataaaaaggatcatgttttcatcagagacgaggcagggcatggagatcccaggcccgagcctcgcccaacccagtcagttcagagccaggcccttcattaccggaaccgagagcgattcgccaccataaagagcgctagtcttgttactaggcagatccacgagcacgagcaggagaatgagctgcgggagcagatgagcgggtataagaggatgagacgacagcaccaaaaacaacttattgcactcgagaacaaactgaaagctgagatggacgaacacaggctaaaactgcagaaagaggtagaaactcatgccaacaactcctcaatcgaacttgagaaacttgcaaaaaagcaggttgccatcatagagaaagaagccaaggtggccgccgccgatgagaaaaaatttcagcaacagatcctggctcaacagaaaaaagacctgacaacctttctcgagtcgcagaagaagcagtataaaatttgtaaggaaaagattaaagaagagatgaatgaggaccatagcacacccaagaaggagaagcaggagcgcatctccaaacataaggagaacctgcaacacacccaagcagaggaggaggcacacctactgacccagcagcgactatactatgataagaattgtcgattttttaagcgtaaaattatgatcaaaagacacgaggtggaacagcaaaacattcgcgaagagcttaataaaaagcgcaccgagggcgacggggcttgccacgctaatccggacgagtccactagagagcttgaataccgccaactgcatactctccagaagctacacggaagtgatcccttcactgcaccagacggtacaggcaaacctgctggtgtacagtag

SEQ ID NO: 46736 - DNA, 2697 bp, Artificial Sequence
  Description of Artificial Sequence: Synthetic coding sequence
atgcggaagggcgtgctgaaggaccccgagatcgccgacctgttctataaagacgaccctgaagaattgttcattggactccacgagattggacacggttcattcggcgctgtctacttcgccacgaacgcccacacctccgaggttgtggccataaaaaagatgtcatattctgggaagcaaacacacgagaaatggcaggatatactgaaggaggtaaagttccttagacagcttaaacatccaaacaccattgagtataagggctgctatcttaaggagcataccgcttggctcgtgatggagtactgcctcggaagtgccagtgatttactggaggtccacaaaaaaccgctgcaggaggtcgagatcgccgccatcactcatggcgctttacacggcctagcgtatttacattctcatgccctcatccatagagatatcaaggccgggaacatcctcctgacagagcctggccaagtgaagctggccgatttcggctccgccagcatggcatccccagccaactctttcgtgggtacgccttattggatggctccagaggtcatccttgccatggatgaaggtcaatacgacggaaaagttgatatttggtctctgggaataacgtgcattgagctggctgagcgaaagcctccactcttcaatatgaacgccatgagtgcgctgtaccacattgcacagaatgactcacctactctccagagtaatgagtggacagactcctttcgaagattcgtagactattgcctgcagaaaattcctcaggagcgtcctacctcagccgagctgctgcggcacgatttcgtgcggcgggatcggccgcttcgagtgctgatcgaccttatccagcgcactaaggacgccgtccgggaacttgacaacctccagtaccggaaaatgaaaaaaatcctgtttcaggaaacgcgaaacggtcccttgaacgaatcccaggaggacgaggaagattccgaacatggcacctcactgaatagagagatggatagcctaggcagcaaccactccattcccagcatgtctgtttccacagggagccagagcagcagcgttaattcaatgcaggaagttatggacgaaagcagctctgaactggtcatgatgcatgacgacgaatcaaccatcaactcaagcagctccgtcgtgcacaagaaagaccacgtgttcatcagggacgaagcgggacacggggaccctcgtcccgaacccaggccgactcaaagtgttcagagccaggccttacactaccgcaacagggaaagatttgccaccatcaaaagcgccagcctggtcactcggcagattcatgagcacgagcaggaaaatgagctcagagaacagatgtcaggatataaacggatgaggcggcagcaccagaaacagttgatcgccctggagaataagcttaaagctgagatggacgaacatcggctgaaattacagaaagaagtggagactcacgcaaacaacagttcaatcgagctggaaaagttggcgaaaaagcaggtagcaattattgaaaaggaggcaaaagtggccgctgctgacgaaaagaagttccagcagcaaatcctggcccagcagaaaaaagatcttacaaccttccttgaaagccagaaaaagcagtataaaatctgcaaggagaagatcaaggaagagatgaatgaggatcacagtaccccgaaaaaggaaaagcaagaaagaatttcgaagcataaggaaaacctgcaacacactcaggctgaagaagaagcccacctccttacgcagcagcgtttgtactacgataagaactgccgcttctttaagcgtaaaatcatgataaagaggcacgaggtcgagcaacagaatatccgtgaggaattaaataaaaaacggacccagaaagaaatggaacacgcaatgctgatccgccacgacgagagcacccgtgagctggagtatagacagctccacacactccagaaactccggatggacctgattcgattgcagcatcaaaccgaactggagaaccagctggaatacaacaaacgcagggaaagggaactgcatcgcaagcacgttatggaactcagacagcaaccaaagaatctgaaagcgatggagatgcaaattaagaagcaatttcaggatacctgtaaggtgcagactaagcagtataaggcgctcaagaaccaccagcttgaggtgacccctaagaacgagcataaaacaattttaaagaccctgaaggatgaacagactcgcaaattggccattcttgcagaacagtacgagcaatcgattaatgagatgatggcatctcaggccttacgtttggacgaggcacaggaggctgagtgccaagctttacggctgcagctgcagcaggaaatggagctgctgaatgcttatcagtcaaaaattaagatgcaaaccgaagcccagcatgaaagggaactccagaaactcgaacagcgtgtttctctgcggcgcgctcacctggagcagaaaatagaggaggagttggctgccttacagaaggaacgtagcgagcggattaagaatcttcttgaaaggcaggaaagagagatcgagacttttgatatggaatccttaaggatgggttttggcaacctggttacactcgacttccccaaagaggactacagatag

SEQ ID NO: 46737 - DNA, 2697 bp, Artificial Sequence
  Description of Artificial Sequence: Synthetic coding sequence
atgcggaagggcgtgctgaaggaccccgagatcgccgacctgttctacaaggacgacccagaagagcttttcattgggctacatgagatcggccacgggagtttcggggctgtctactttgcaactaatgcgcacacgtcggaggttgttgccataaaaaagatgtcttactcgggaaagcagactcatgagaaatggcaagacatccttaaggaagtgaaattcctcaggcaactcaagcaccctaataccattgagtataagggatgctacttaaaagaacatacggcctggttagtgatggaatactgtttggggagtgcttctgatcttttggaagtgcacaaaaaacccctgcaagaggtcgagatcgcggccattacgcacggcgccttgcacggcctcgcatacctccactcccacgctctgatacaccgtgatataaaagctgggaacatcctactcaccgagcccgggcaggtgaagctggccgatttcggttcagccagtatggcaagtcctgctaatagcttcgtgggtacgccctactggatggccccagaagtgatcttggcaatggatgaggggcagtacgatggcaaagtggatatttggtctctggggattacctgtatcgaactggctgaacggaagcccccgctcttcaatatgaatgcgatgagcgccctgtaccatattgcacagaacgactccccaacattacagtctaatgagtggacggatagcttccgtagatttgttgattactgccttcagaagatccctcaggagagaccaacatctgcagagcttcttcggcatgattttgtgaggagagataggcctttgcgcgtgcttatagatttgatccaaagaacgaaagatgccgtcagagagttagataacttgcaatatagaaaaatgaagaagatccttttccaggaaacgcggaatggcccgctgaacgagtcacaggaggacgaagaggatagtgaacacgggaccagcttaaatagagagatggactcactgggaagcaatcattccattccatctatgtccgtttcaactgggagtcagtctagcagcgtcaatagcatgcaggaagtaatggatgagagtagctctgagctggtcatgatgcatgatgatgaaagcactataaactcgtcgtcatctgtcgtgcataaaaaggaccacgtgttcatccgagacgaggctggccacggggacccacggcccgaaccccgcccaactcagtctgtgcagtcccaagccctgcattatcgcaatcgggaacgattcgctacaataaagtccgcgagcctggtgaccagacagatccatgaacatgagcaggagaacgagctgcgggaacaaatgtccgggtataaacgcatgcgaagacagcaccagaagcaacttatagccctcgagaacaaactaaaggccgagatggatgaacaccggttgaaactgcaaaaagaagttgaaactcacgccaacaacagctcgatagagctcgagaagctggcaaagaagcaggtggccataatcgagaaggaggctaaggtcgctgccgctgatgagaagaagtttcaacagcagatcctggctcagcagaaaaaagatctgacaacattcctcgagagccagaaaaagcaatacaaaatatgcaaagagaagattaaggaagaaatgaacgaggatcacagcacccccaagaaagaaaagcaggagcggatcagcaagcacaaagaaaacctgcaacatacccaggccgaagaagaagctcatcttctgactcaacagaggctgtattacgataaaaactgccgcttttttaaaaggaaaattatgattaaacgacatgaagttgagcagcaaaacatacgcgaagagctcaacaaaaagaggacccagaaagaaatggaacacgctatgctcatccggcacgatgaatccaccagggaactagagtaccgacaacttcacactctccagaagctcagaatggatcttatacgtctacagcatcagacagagcttgaaaatcagctcgaatataataagcgtagggaacgcgagctacatagaaaacatgtgatggaactgagacagcagcctaaaaatctgaaagcaatggagatgcagatcaaaaagcagtttcaagatacttgtaaggtgcagacgaagcagtacaaggcacttaagaaccaccagctcgaggtcactcccaaaaatgagcacaaaacaatattgaagacgcttaaagacgagcagactagaaaactggcgatcctcgctgagcagtacgaacaaagcattaacgagatgatggcttcccaggccctgcggctggacgaggcacaggaggccgaatgccaggccctccgtctgcagctgcagcaggagatggaactgctcaatgcatatcaatccaaaatcaaaatgcaaacagaggctcagcacgagagggaacttcagaagctggaacaacgggtgtctctgcgccgcgcccatctggagcaaaagattgaggaagagttggctgctctgcagaaagagagatccgaacgtatcaagaacctcctggagagacaggagcgcgagattgaaacttttgacatggagtcattgagaatgggcttcggaaatctggtcaccttagatttcccaaaggaggactatcggtag

SEQ ID NO: 46738 - DNA, 411 bp, Artificial Sequence
  Description of Artificial Sequence: Synthetic coding sequence
atgcggaagggcgtgctgaaggaccccgagatcgccgacctgttctacaaggacgaccccgaggaactcttcataggcctgcacgagattgggcacgggtccttcggcgcagtgtattttgcaaccaatgctcacacctccgaggtggttgcaatcaagaaaatgtcatatagcgggaaacaaacacacgagaaatggcaggatatccttaaagaagtgaagttcttgaggcagcttaagcacccaaacactatcgagtataaggggtgctatctgaaggagcacaccgcatggctggtgatggaatactgcctgggctccgccagtgatttactggaggtgcacaagaaacctttacaggaagtcgagatcgccgcgattacacatggcgccctgcacggtctagcctag

SEQ ID NO: 46739 - DNA, 57 bp, Artificial Sequence
  Description of Artificial Sequence: Synthetic coding sequence
atgcggaagggcgtgctgaaggaccccgagatcgccgacctgttctataaggattag

SEQ ID NO: 46740 - DNA, 282 bp, Artificial Sequence
  Description of Artificial Sequence: Synthetic coding sequence
atgcggaagggcgtgctgaaggaccccgagatcgccgacctgttctataaggatgacccggaggagctttttattgggctgcacgagatcggacacggaagcttcggggccgtctatttcgctaccaatgctcacacctcagaagtcgtggcaattaagaaaatgtcttactcaggaaagcagactcatgaaaaatggcaggacattttgaaggaggttaaattcctccgccagctcaagcaccccaataccattgagtacaaaggttgctatctgaaatag

SEQ ID NO: 46741 - DNA, 66 bp, Artificial Sequence
  Description of Artificial Sequence: Synthetic coding sequence
atgcggaagggcgtgctgaaggaccccgagatcgccgacctgttctataaggatgaccccgaatag

SEQ ID NO: 46742 - DNA, 189 bp, Artificial Sequence
  Description of Artificial Sequence: Synthetic coding sequence
atgcggaagggcgtgctgaaggaccccgagatcgccgacctgttctataaggatgatccagaagagctcttcatcgggctccacgagatcggccacggctcattcggtgccgtgtattttgccaccaatgctcataccagtgaagtggtggcaataaagaagatgtcttacagtggaaaacagacctag

SEQ ID NO: 46743 - DNA, 111 bp, Artificial Sequence
  Description of Artificial Sequence: Synthetic coding sequence
atgcggaagggcgtgctgaaggaccccgagatcgccgacctgttctataaggatgacccagaggaacttttcataggtttacatgagattggacatggaagcttcggctag

SEQ ID NO: 46744 - DNA, 174 bp, Artificial Sequence
  Description of Artificial Sequence: Synthetic coding sequence
atgcggaagggcgtgctgaaggaccccgagatcgccgacctgttctacaaagatgaccccgaagagctgttcatcgggctgcatgaaatcgggcatggctcgtttggtgcagtctatttcgcaactaacgcccacacaagcgaagtggtcgctatcaagaaaatgtcatattag

SEQ ID NO: 46745 - DNA, 1407 bp, Artificial Sequence
  Description of Artificial Sequence: Synthetic coding sequence
atgggcacccaggagggctggtgcctgctgctgtgcctggccctgagcggcgccgctgagactaaaccgcaccctgcggaaggccagtggcgggcagtggacgtagtactggactgctttctcgcgaaggatggggcgcaccgtggcgccctggcatccagtgaggaccgcgcgcgggcctccctggtcctcaaacaagtccctgttctggatgatggcagtttggaggacttcacagactttcagggcggaaccctcgcccaggacgaccctccaattatatttgaggcaagcgttgaccttgtgcagatcccccaggccgaggccctcttgcatgctgactgcagtggtaaggaagtcacttgcgagatctccaggtatttcctgcagatgaccgaaacaacagtgaaaacagcagcttggtttatggcaaacatgcaggtctctgggggcgggccgagcatttccctggtgatgaaaaccccccgcgtgactaagaacgaagccctgtggcaccccacattgaacctgcccttatcaccccaggggactgtcaggacagcagttgagtttcaggttatgacacagacccagtctctgtcgttcctgctgggttcgtccgcatccctggattgcggattctcaatggcccctggcttggacctgatcagtgtggaatggcggttacagcacaagggccgcggccagcttgtgtatagctggacagctggacagggccaggccgtaagaaaaggggcaactctggaacctgcccagctgggtatggcaagggacgcctcgctgactctccccgggctaactattcaagatgaaggaacctacatttgtcagatcactacatcactgtacagagctcagcagataatccagctgaacatccaagctagccccaaggtgcgtctatctctcgccaacgaagctctgctgcccacactgatctgtgacatagctggttattaccccctggacgtagtggttacttggacccgagaggagcttggaggctcacccgcccaggtgtccggtgcctctttttccagtctaagacagagcgttgcgggaacgtatagtatttctagctcccttacagcagagcctggcagcgctggcgctacctacacctgtcaggtgacgcacatctctttagaggagcctctgggagcgtctacacaggtggtaccccccgagcggagaactgctctcggagtaatatttgcctcatctctgtttctgttagcactcatgttcctcgggttgcaacgtaggcaggctcctacagggttaggactgctccaagctgaaagatgggagactacttcctgcgccgacacccagtctagccaccttcacgaggatcgcacagcacgcgtctcgcaaccaagctag

SEQ ID NO: 46746 - DNA, 1200 bp, Artificial Sequence
  Description of Artificial Sequence: Synthetic coding sequence
atgtgcgtgcagaactgcggccccagcttccagagcctgatcgtgaaaaaagaattcgtcaaggagaatctggtgaaactgctgaaccctcggtacaacctgcccttagatatacagaataggattctgaattttatcaagacttggtcccagggtttccccggcggtgttgatgtgtctgaagttaaggaagtctatttggacctagttaagaagggcgtgcaattccccccttcagaagcggaggccgagaccgccagacaggaaacggcccagatatcatccaatcccccgacctccgtccccaccgcccctgctcttagttctgtcatcgcccccaaaaattccacggtgacactggtcccggaacagattggaaaactccactctgagcttgacatggtcaagatgaacgtgcgagtaatgtccgcaattcttatggaaaatacccccggatccgagaatcacgaagatatcgaattgctgcagaaactgtataaaactggtcgagaaatgcaagagaggatcatggacctgctcgtggtggttgagaatgaggacgttacagtagagctgattcaggtcaacgaggatctgaataacgccatcctcggttatgaaagattcactaggaaccagcagcgaattcttgagcaaaacaaaaatcagaaagaggccacaaacacaacttctgagccatccgctccatctcaggacctactggacctgagcccctccccgcgaatgccgcgggctacccttggggagctgaacactatgaataatcagttgagtggattgaatttctctctgccatcaagtgacgttacgaacaatctgaaaccgtcccttcacccccaaatgaatcttctcgcattggagaataccgagattcccccttttgcccagcggacatcacagaacctcacctcaagccacgcatacgacaacttcttggagcactcaaatagcgtgtttctgcagcctgtgtctcttcagaccatcgccgcagctccctctaaccagtccctgcctccacttccctccaatcaccccgccatgactaaatcagatctccaacctccaaattattatgaagttatggaatttgatccactcgcacccgctgtcactacggaggccatctacgaggagattgacgcccaccagcacaaaggagctcagaatgacggcgattag

SEQ ID NO: 46747 - DNA, 1431 bp, Artificial Sequence
  Description of Artificial Sequence: Synthetic coding sequence
atggccttcggcaagagccaccgggacccctacgccaccagcgtgggtcacctcattgagaaggccacgtttgcgggggtccagactgaggactggggccagtttatgcacatttgcgacatcataaacacaactcaggacggtcccaaggatgctgttaaggctctcaagaaaaggatttctaagaactacaatcacaaagagattcagctaacactgtccctgatcgatatgtgtgtgcagaactgtggtcctagtttccagtcgctaatcgtcaagaaggaatttgttaaagagaatctcgtgaagctgttaaatccacgttataacctgcctttagatatccaaaaccggattcttaattttatcaagacttggagccaggggttcccaggcggtgtcgatgtttcggaagtgaaggaagtgtacttggatctggtaaaaaaaggagtgcaatttccaccctcagaagcggaagcagagactgccaggcaggagaccgcccagatttcctccaatccacctacgagcgtccccaccgcaccagccttgtcatcggtcattgctcccaaaaacagcaccgttaccttggtacctgaacagattggcaaactccactccgagttggatatggtaaagatgaacgtcagggttatgagcgccatactgatggagaatactcccgggtcagaaaatcacgaggacatcgagcttctgcaaaaactgtacaagactgggcgcgaaatgcaggaacggatcatggatttgctggtggtagtggagaacgaagatgtaacagtggagttgattcaggtaaatgaggatctgaacaatgctatcctcggttacgagaggtttacccgaaatcagcaaaggatcttagagcagaacaagaatcaaaaagaggcaaccaacaccacatccgagccgagcgctccatcacaggacctccttgacttaagcccctcacccaggatgccaagggcaactttgggggagctaaacactatgaataatcagctgtctggcttgaacttttcccttccaagcagtgacgtgacaaataacctcaaacctagcctccacccgcagatgaacttgctggccctggagaacactgagatcccgccatttgctcagagaacaagccagaatttgacttcctcccacgcgtacgacaatttcctggaacactccaattcagtgttcttacagccagttagcttgcaaacgatcgcggccgctccctccaatcaatctctgccccccctaccttcgaaccatcccgccatgacaaaatcagatctgcagcctcctaattattatgaggttatggaattcgaccctctcgctccagcggtcactaccgaggcaatctacgaagaaatagacgcccaccagcataagggcgcacagaatgatggagattag

SEQ ID NO: 46748 - DNA, 1200 bp, Artificial Sequence
  Description of Artificial Sequence: Synthetic coding sequence
atgtgcgtgcagaactgcggccccagcttccagagcctgatcgtgaagaaagagttcgtcaaggaaaacctcgtcaagctgctgaacccaagatacaacctacccctggacatacagaatagaattctaaattttattaagacatggtcccagggcttcccgggtggcgtcgatgtgtccgaggttaaagaggtgtacctggacttagtcaaaaaaggcgttcagttcccaccttccgaagctgaagcagagacagcccgccaggagactgctcagattagttccaatccgcccacttcagttccaactgctccggcactgagttctgttattgcccccaagaactcgaccgtgaccctggtgccggagcagattggcaagctgcacagcgaacttgacatggtgaaaatgaacgtgagagtaatgtcagcaattctcatggagaatacccctggctccgaaaatcatgaggacattgaactgctgcagaagctctataaaacaggtcgggagatgcaggagcgcattatggacttactggtggtggtggaaaacgaagatgtcaccgtggagctcattcaggtcaatgaagacctgaataacgcaatcctgggctacgagcgcttcacaaggaaccagcagcgtatactagagcaaaataaaaatcagaaggaggccaccaatacaacttctgagcccagtgccccttcacaggacctcctggatctgagtcccagcccacgaatgccgcgggccaccctcggagagttgaataccatgaacaatcagctgtccggcctgaacttctcgctgccttcaagtgatgtgacaaacaatctaaagcccagtctacacccacaaatgaacctcttggcactggagaacaccgagatccccccatttgctcagagaaccagccagaacttgaccagcagccacgcctatgataatttcctcgagcatagcaactcagtgtttctacagcccgtcagtttacagacaatagccgccgcgccttctaatcagagcctccctcccctcccctccaaccacccggcaatgaccaagtcggacctccaaccccccaactactatgaggtgatggagtttgaccccctggctcctgccgtgacaaccgaagctatttacgaggagattgatgctcatcagcacaaaggtgctcagaatgatggcgattag

SEQ ID NO: 46749 - DNA, 1095 bp, Artificial Sequence
  Description of Artificial Sequence: Synthetic coding sequence
atgtgcgtgcagaactgcggccccagcttccagagcctgatcgtgaagaaggagttcgtcaaagagaatctagtgaaactactcaaccctcgatataatcttcctctggatatccagaatcgaattctcaattttattaaaacttggtcccaaggtttcccgggcggcgtcgacgtatccgaggttaaagaagtgtatctggatctcgtcaagaagggcgtgcagttccctccatctgaagccgaggccgagacggcccgccaggagatcgggaagctccactcagagctggatatggtgaaaatgaatgtccgggtcatgagcgccatactgatggagaatacacccggaagcgaaaatcacgaagatattgagctgcttcaaaagctctacaaaactggcagagaaatgcaggagcggattatggatctgctcgtcgtcgttgagaacgaagatgtcaccgtggaactgattcaggtgaacgaggacctgaataacgcaatccttggttatgaaagattcactcgtaatcagcagaggatcctcgagcagaacaagaatcagaaagaagcgactaataccacatctgagcccagtgccccttcccaagatctgttagatctgtcccctagccctcgtatgccaagagccacactcggagagttgaacaccatgaacaaccagttatcaggattgaacttcagcttacccagctcagacgtgaccaacaatttgaagccatcccttcacccccagatgaatttgttagccctagaaaacactgaaataccaccatttgctcagcgcacaagtcagaacctaacctctagtcacgcttacgataattttctggagcatagtaactcagttttcctccaacccgtttcactccagacaatcgccgcagcccccagcaatcagagtcttccccccctgccttccaaccaccccgctatgacgaaatccgatttacagcccccaaattattacgaagttatggagttcgaccccctcgctcctgccgtcaccaccgaggcgatctacgaagagattgatgcccatcagcacaagggggcccaaaatgacggcgactag

SEQ ID NO: 46750 - DNA, 1431 bp, Artificial Sequence
  Description of Artificial Sequence: Synthetic coding sequence
atggccttcggcaagagccaccgggacccctacgccaccagcgtgggacatctgatagaaaaggctacgtttgcaggggtccaaaccgaggattggggccaattcatgcatatatgtgacattatcaacaccactcaagatggtccgaaggacgccgtgaaggccctgaaaaaacgcatttccaagaattataaccacaaagaaattcagcttacgctttctttgattgacatgtgcgtgcagaattgtggaccctcatttcagtcactgattgtcaaaaaagaattcgtgaaggagaacctagtaaaactactcaaccctaggtataaccttccgcttgacatccaaaataggatcctgaattttattaagacctggtctcaggggttccccggaggagtggatgtatcggaggtgaaggaagtatatctcgacttggtgaaaaaaggcgtccagtttcctccttctgaagctgaggccgagaccgcccgccaggagaccgcacagatcagctctaatccacctacatcggttcctactgcaccagccttatctagcgtgatcgcacccaaaaattcgaccgtgactctcgtaccagagcagatcggaaagctccactcagaactggatatggtgaagatgaatgtacgcgtgatgagcgcaatcttgatggaaaatacccccggcagtgaaaatcacgaggacattgagcttctgcaaaagctgtacaaaaccggacgcgaaatgcaggaacgcattatggacctgttggtagtggtcgaaaacgaagatgtcaccgtggagttgatccaggttaatgaagatcttaacaacgctattctcggctatgagcgtttcacccgtaatcagcagcgcatcttggaacagaataaaaatcagaaggaagccacaaatactacctctgagccttctgccccctcacaggacttactggatttgagtcctagtcccaggatgcccagagcaacactgggcgagctgaacacaatgaataaccagctctccgggttgaacttttcactaccgagctccgacgtcaccaacaaccttaagccgtctctgcatccccaaatgaatttgttggccctggagaacaccgaaatccctccgtttgcccagaggacatcccaaaacctgaccagttcccatgcatatgacaacttcctggaacactctaatagtgtgttcttacagcccgtgtcgttgcagactatcgcagcagctccatccaaccagagcttgccgcctctgccctcaaaccaccctgcaatgacaaaatccgatttacagcctccgaactattacgaggtaatggagtttgaccctctcgctcccgccgttaccaccgaagccatttatgaggaaatcgacgcccaccagcataagggagcccagaacgatggcgactag

SEQ ID NO: 46751 - DNA, 900 bp, Artificial Sequence
  Description of Artificial Sequence: Synthetic coding sequence
atgctggagagccacctgatcatctacttcctgctggccgtgatccagttcctcctgggcatcttcaccaacggcattatcgtcgtggtaaatggtattgacctcataaaacacagaaaaatggctccactggatttactgttgtcctgtctggccgtgagcagaatctttctgcagctctttatcttttatgtcaacgtgattgtgatttttttcatcgaattcataatgtgttcagccaactgtgccattcttttgttcatcaacgagctcgagctatggctcgctacgtggttgggcgttttttattgcgccaaagtcgccagtgtccgacaccccctgttcatatggctcaaaatgagaatttcaaagttggtcccttggatgatcctgggatcccttctctatgtttccatgatatgcgtcttccatagcaagtacgcaggattcatggtgccatattttttaaggaagttttttagtcagaatgctaccatccagaaagaagataccttggccattcagatctttagttttgtggccgagttctccgtgcccctcctgatcttcctttttgcagtccttcttcttatcttttccctggggaggcacacccggcagatgaggaataccgtggccggcagtcgcgtcccggggcgaggggcccccatctcagccctgctaagcatcctgtcattcttaatcctgtattttagtcattgtatgataaaggttttcctgagctccttgaagtttcatatccgtcgctttattttccttttttttatcctggtgatcggcatttacccctctgggcactcattgattctaatcctgggaaaccccaagcttaagcagaatgcgaaaaaatttctgctgcacagcaaatgctgccagtag

SEQ ID NO: 46752 - DNA, 924 bp, Artificial Sequence
  Description of Artificial Sequence: Synthetic coding sequence
atgctgcgggtggtggagggcatcttcatcttcgtggtggtgagcgagtcggttttcggggttcttggaaacggctttattggactggtaaattgcatcgactgcgctaagaacaaactgagcactattggattcatcttaactgggttggcaatttcccgcatctttttaatatggatcatcatcacagatgggtttattcagatattctcccctaacatctacgcctccgggaatctgatcgaatatattagttacttttgggttatcggcaatcagtcctcgatgtggttcgccacttctctttcaatcttttactttctcaagatcgccaatttctctaactacatctttctttggctcaagagccggactaatatggtattgccattcatgatcgtgtttctgctgatttcttcacttctcaactttgcgtacattgcaaagattttgaacgactacaagaccaagaacgatacagtctgggacttaaacatgtacaaatctgaatattttatcaaacagatcttgctgaaccttggtgttatcttctttttcacactctccctgatcacatgtattttcctgatcatttccctatggcgacacaatcggcaaatgcagagcaacgttacgggcctgcgggactccaatactgaggcccacgtcaaggcaatgaaggtccttatttcttttataattctctttatcctgtatttcatcggaatggccatagaaatttcatgttttaccgtgagggagaacaaattactgctgatgtttggtatgactactacagcaatctatccttggggtcattctttcatcctgatcttgggcaatagcaaactgaaacaggcctctctacgggtgttgcaacagctcaagtgttgcgagaagagaaaaaacttgagggtgacgtag

SEQ ID NO: 46753 - DNA, 912 bp, Artificial Sequence
  Description of Artificial Sequence: Synthetic coding sequence
atggagagcgccctgcccagcatcttcaccctggtgatcatcgccgagtttatcatagggaatctttcaaacggcttcattgtccttatcaactgcatcgattgggtgtcaaaacgggagctctcaagcgtggacaaactcctcattattctggctatcagccgaattggactaatctgggaaatcttggtgtcctggtttcttgcgcttcattatctggctatctttgtttcaggaacaggacttagaattatgattttctcatggatagtatccaaccacttcaatctctggctggccacaatcttctctatcttttacttgctgaaaatcgccagcttctcctctcccgcgttcctgtacttaaaatggagagtgaataaggtcatattaatgatcttgctgggcacgctggtgtttctgtttttgaatttgatacagatcaacatgcacatcaaggactggctcgaccgctacgagcggaacaccacgtggaatttcagcatgagtgacttcgagacattttccgtgagcgtgaagtttactatgaccatgttttcgcttaccccatttaccgtagctttcatcagcttcctgcttctaatcttcagccttcagaagcacctgcagaaaatgcagctcaattacaaagggcacagggatcctagaaccaaggtgcataccaacgctctgaagattgtaatcagctttctgctattctatgcttccttcttcctgtgtgtattaatttcgtggatctccgagctttatcagaatacggtgatctatatgctttgtgagacaatcggcgtgttttctcccagctcccacagcttcttattgatactaggcaatgcaaaactgagacaggcattcttactcgtcgccgccaaggtatgggccaagagatag

SEQ ID NO: 46754 - DNA, 954 bp, Artificial Sequence
  Description of Artificial Sequence: Synthetic coding sequence
atgggcggcgtgatcaagagcatcttcaccttcgtgctgatcgtggagttcattattgggaatctgggaaattcattcatagctttagtcaattgtattgattgggtcaagggacgcaaaatatccagcgttgaccgaatactgacagctctcgctattagcagaattagtctggtgtggctcatttttggaagctggtgcgtatctgtgttttttcccgctctattcgccacagagaagatgttccggatgctgacaaatatatggaccgttattaatcacttcagcgtgtggctagcgacagggctggggaccttctatttcttgaaaattgctaatttctccaactccatttttctctatctgaagtggagagttaagaaagttgtcttggtcctgttgctggtgacaagtgtgttcctattcttgaatattgcgcttatcaacatccacattaacgcctccatcaatggataccgcagaaacaagacttgttctagcgactcatctaattttactcgcttttcatccttgattgtgttgacttcaaccgttttcatttttattccttttactctaagcctggccatgtttctactgcttattttctccatgtggaaacataggaagaaaatgcaacacaccgtgaagatctccggggacgccagcactaaggcacaccgcggagtaaagagcgtcattaccttcttcttactttacgctatcttctccttaagtttttttatctctgtgtggacaagcgagagactggaagagaatctaatcatactctcccaagtgatgggaatggcttacccttcttgtcattcatgtgtgctgatcctgggcaataagaagctgcgccaagctagcctgagtgtgttgctgtggctgagatacatgttcaaggacggagaaccttcagggcacaaggagttccgcgagagttcttag

SEQ ID NO: 46755 - DNA, 1017 bp, Artificial Sequence
  Description of Artificial Sequence: Synthetic coding sequence
atgctgggccggtgcttcccccccgacaccaaggagaagcagcagctgagaatgacaaaactgtgcgacccagctgagtctgagcttagtccgttcctgataaccctgattctcgccgttctcttggccgagtatctgattgggattatagcaaatggatttataatggctattcacgccgccgagtgggtacaaaataaagccgtgtccacctctggaaggattctggtcttcttgtctgtgtccaggatagccctgcaaagtctgatgatgctggagatcactatttcatccacaagcctgagtttctactctgaggacgcagtgtattacgcattcaaaatcagttttattttccttaatttctgcagcctctggttcgcagcatggctctctttcttctatttcgtgaagattgcgaatttctcttaccctctgtttcttaagctaaggtggaggatcacaggcctgattccctggttgttgtggctgagcgtcttcatctcattctcccattctatgttttgcatcaatatctgtacagtctactgtaacaactctttccctatacactctagcaactctactaaaaagacatatctgtctgagattaatgttgtgggcttggcattcttcttcaatctgggcatcgtcaccccgctgataatgtttattttgaccgccacccttttaatcctgagcctgaagaggcatacgcttcacatggggtcgaacgcaacaggttccaatgacccatctatggaggcccacatgggagccatcaaagccatcagctactttctgattctgtatatttttaacgccgtggccttattcatctacctttccaatatgtttgatatcaacagcctctggaataacctgtgccaaataatcatggccgcatatccagcttctcactcaatcctgttgattcaagacaatcccgggctgagaagagcctggaagagactccagctgaggttgcatctctacccaaaggagtggactctatag

SEQ ID NO: 46756 - DNA, 957 bp, Artificial Sequence
  Description of Artificial Sequence: Synthetic coding sequence
atggccgacaaggtgcagaccaccctgctgttcctggccgtgggcgagttctctgtgggaattctgggcaacgcatttattggtttggtaaactgtatggactgggtgaagaagagaaaaatcgcttctatcgacctgattcttaccagtctcgctatctcaagaatctgcctactgtgtgtgatacttttggactgcttcatcctggtgctataccccgatgtttatgcaaccgggaaggaaatgcgtataattgatttcttctggacgttgaccaaccatctgtcaatctggttcgcaacctgcctgtccatctattacttttttaaaatcggtaacttcttccatccattgttcctatggatgaagtggaggatagatagggtgatctcctggattcttctagggtgtgtggtactctccgtctttatctcactgccggccactgagaacttgaatgccgactttcgtttctgcgtaaaagccaagagaaagacaaatctgacgtggtcgtgccgggtcaataaaactcagcatgcttcaactaagctgtttctaaacctggccacgttgcttccgttctgtgtgtgcctcatgtcgttttttctcctgatcctttccctccgacgacacatcaggcggatgcagctttccgcaacaggttgtagggatccctcaacagaagcccacgtgagggcgctgaaggcagtaatatcattcctgctactgttcatagcatattacctgagcttcctcatcgccacatcgtcttacttcatgccagagaccgagctggccgtgatctttggtgagtctatagccttgatctatccctcttcgcacagctttatcctgatactaggtaacaacaaattacggcatgcctctctgaaagtgatttggaaggttatgtccatcctgaagggacggaaatttcagcagcacaagcagatctag

SEQ ID NO: 46757 - DNA, 930 bp, Artificial Sequence
  Description of Artificial Sequence: Synthetic coding sequence
atgttcagccccgccgacaacatcttcatcatcctgatcaccggcgagttcattttaggcatactcgggaatgggtacatcgccctcgtcaactggatagactggattaagaagaaaaaaatttcaacggtggattatattctgactaacttggtaatcgccaggatctgtctaattagtgtcatggtcgtcaacggaatcgtgatagtgctgaatcctgacgtatacacaaagaacaagcagcagattgtcatctttactttttggacattcgccaattatcttaatatgtggattacaacatgcctcaatgttttttatttcctgaaaatagcaagctccagtcatccattattcctctggctgaaatggaaaatcgatatggtcgtgcactggatcctcttaggttgcttcgcgatcagcttgctggtttcactgattgctgctatagtattaagttgcgactatcggtttcatgctattgcgaaacacaagcggaacatcacagagatgttccacgtttccaagattccatatttcgagcctttaacgttattcaacctgttcgctattgtgccttttatcgtaagcctgatcagcttcttcttgctggtccggagcctctggcggcatacgaaacagataaagctgtatgccacaggaagcagggatccatcgaccgaggtgcatgttcgggccatcaagacaatgactagcttcatcttctttttctttttgtactatatttcttctattctcatgacgttctcctatctgatgaccaagtacaagctcgccgtggaattcggcgaaatcgcggccattctctaccccttgggccactctctgatcctgatcgtcctcaataacaaactgcggcagacattcgtacggatgcttacctgtcggaagatcgcttgcatgatttag

SEQ ID NO: 46758 - DNA, 939 bp, Artificial Sequence
  Description of Artificial Sequence: Synthetic coding sequence
atgcccagcgccatcgaggccatctacatcatcctgatcgccggcgagctcaccatcggcatatggggaaatggattcatcgtgctagtaaattgcattgactggctcaagcgccgcgatatttcactaattgatattatcctaatttcactggctatctcacgaatatgcttattgtgcgtaatctcactagacggattcttcatgctgcttttccccggaacctacggtaattctgtgttggtgagcatcgtgaatgtggtgtggacctttgctaataactcttccctctggtttacaagttgtttgtctatattctatctgctcaagatcgcgaatatcagtcatccattcttcttctggttgaagctgaagattaacaaggtgatgctggccatcctcctgggtagcttcttaatctctctcatcattagtgtgcctaagaacgatgatatgtggtaccacctgtttaaggtgtctcatgaggaaaatatcacttggaaattcaaggtgagtaaaatacccggaacctttaaacagcttaccctgaatctgggcgtcatggtgccgtttatcctctgtctgataagcttcttcctcctgctgtttagcctcgtgaggcacaccaagcagatcaggctccacgcgaccgggttccgggatccctcgacagaggctcatatgagggcgataaaagctgtgataatctttctattgcttctcatagtctattaccccgtattcctggtgatgaccagctcggccttaatcccccagggtaagctcgttcttatgattggagatatcgtcacagtcatttttccttcctcccactccttcatcctgattatgggcaatagcaaattacgtgaggcatttcttaaaatgctccgattcgtaaaatgttttctccgtcgccgcaaaccctttgtcccttag

SEQ ID NO: 46759 - DNA, 3702 bp, Artificial Sequence
  Description of Artificial Sequence: Synthetic coding sequence
atgtggctgagccccgaggaggtgctggtggccaacgccctgtgggttactgaaagagctaaccccttttttgtgttgcagagaagaagaggccatgggcggggagggggattgacaggcctcctggtgggcacactggacgttgtcttagattcgagtgcgcgggttgctccgtaccgcattctgcaccagacacaggattcccaggtttattggaccgttgcctgtggctcctccagaaaggaaatcaccaagcattgggagtggctcgaaaacaatctgctgcagacgctgtccatcttcgacagtgaggaggatataacgaccttcgtcaagggcaagatccacggcatcatagccgaagaaaacaaaaatctgcagccacagggtgatgaagacccaggaaagttcaaagaggctgaactgaaaatgagaaagcagttcggcatgcccgagggcgagaaattggtcaattactactcctgcagttactggaagggcagggtgccgcgccaagggtggctttacttgacagtgaatcatctgtgtttctacagttttctcttgggtaaggaagtgagcctggtggtccagtgggtggatataacccggctggagaagaacgcaaccctgttgttccccgaaagtatcagagttgatacacgggatcaagagctgttcttttccatgttcctcaacattggggaaacattcaaactgatggaacagctggctaatctggccatgcggcaactgctggattctgaaggttttctggaggacaaagctctcccacgcccgattcgaccgcataggaacattagcgcactgaagcgggatctcgacgctagagcaaagaatgaatgttacagagcaacattccgcctcccacgagacgagcgcttagatggtcataccagctgcactctctggactcctttcaataaactgcacatacctggacagatgttcatatcaaacaattatatctgctttgcatctaaagaggaggatgcgtgccatcttatcattcccctgcgtgaggtgactattgtagaaaaggcagattcctcttcagtattgccatcaccactgtcgatcagtacaaaatccaaaatgacttttctgttcgccaacctcaaagacagggattttctggtgcagcggatttccgacttcctgcagaagaccccatctaagcagcctggctcgattggaagtagaaaagcctccgtagtggacccctccactgagtccagtccagcacctcaggaaggcagtgaacaacccgcttcccctgcaagccctctgtcctctaggcagagcttctgtgcacaggaggcacctaccgcatcacagggcctcctgaaactctttcaaaagaattcaccaatggaagatcttggagcgaagggagcgaaggagaagatgaaggaggagtcatggcacatccacttctttgaatacggtagaggggtgtgcatgtacaggactgccaaaaccagggctttggttctgaaagggattcctgaatcgttgcggggggagctctggctgctcttcagcggcgcatggaatgagatggtgactcatccgggatactacgccgagttagtggagaagtcgacgggtaagtactctctagccaccgaggagattgagagggacttgcataggtcaatgccagaacatcccgctttccagaacgagctgggcatcgctgctctgaggcgggtacttaccgcatacgcatttcgtaatcctaccatagggtactgtcaggccatgaacatcgtcaccagcgttctgctgttgtatggcagcgaggaagaggcattctggctgctggttgctctttgcgaaaggatgctgccggactactataataccagagttgtcggggcccttgtagatcaaggtatcttcgaggaactgaccagggactttctgccacagctcagcgaaaagatgcaggatctgggcgtcatcagctctatctcactgagctggtttctgacgctctttctttctgtgatgccttttgagtcagctgtggtgatcgtcgactgctttttttatgagggtatcaaagtcatcttgcaggtggctctagccgttctggatgctaacatggaacagttgttgggctgctcggatgaaggcgaagccatgaccatgttgggaaggtacctggacaatgtggtgaataagcagagcgtatctcccccaattcctcaccttcgagcactgctgagcagcagtgatgacccacccgcggaagtagacatttttgagcttctaaaagtgagttacgagaagttctcatccttgagagcagaggatattgagcaaatgaggtttaaacagcgcctgaaggtgattcagtctctcgaggataccgcgaaacgctctgtggtccgggctatcccagtggatattgggttcagtattgaagagcttgaagatctctacatggttttcaaggccaaacatctcgcatcccagtactggggctgcagtcgaactatggcggggagaagagacccctcgctgccatatctggaacagtacagaattgacgccagtcagtttcgcgagcttttcgcctctctgacaccatgggcatgcggatcacatactcctctgctggcaggaaggatgtttcgactgctggacgagaacaaagactcgctgatcaattttaaagagtttgtgaccggaatgtcagggatgtaccatggagacttaactgaaaaattgaaagttttgtataagctgcaccttccccctgcactgagtccagaagaagctgagagcgcactggaggcagcacattattttactgaggactctagcagcgaagaagcactgccacaggaagagcaggagggttcagggtctgaggaacgtggcgaggagaaggggacttcttcgcctgattacaggcattacctccggatgtgggccaaagagaaggaggcacagaaagagacaatcaaagatcttcctaagatgaatcaggagcagtttatcgagttatgcaagactctctacaatatgttctcagaagaccctatggagcaagacctttaccacgccattgccaccgtcgctagcctactgctaaggataggcgaagtgggcaagaagttttctgcccgtacaggccgaaagcccagggactgcgcaactgaggaagacgaaccccccgcccccgagctacatcaggacgccgcaagggaattgcagccaccagccgccggtgatccacaggcaaaggccggtggggatactcatctgggcaaagcccctcaggaaagtcaggtagtcgtggaaggtggaagcggtgaaggccaaggctccccgtcccaactgctgagtgacgacgagaccaaggacgacatgtctatgtcttcttacagcgttgtgtcgactggctctctgcagtgtgaagacctggccgacgacaccgttttagtgggaggagaggcctgctcccccaccgccaggatcgggggaacagtggatactgattggtgtatcagtttcgagcagattctcgccagcatcttgactgagagtgtcttggttaacttctttgaaaaacgagtcgatatcggcctgaaaatcaaggatcagaagaaagttgaacggcagttctcgactgcatctgaccacgaacagcccggcgtgagcggatag

SEQ ID NO: 46760 - DNA, 3753 bp, Artificial Sequence
  Description of Artificial Sequence: Synthetic coding sequence
atgtggctgagccccgaggaggtgctggtggccaacgccctgtgggtcacagaaagggccaacccatttttcgtactgcagcgccggcgcggacacggtcgcggcggagggctcaccggactgttggtcggcaccctggatgttgttctggacagctctgcccgcgttgccccctaccggatcctgcaccagacccaggacagtcaggtttactggacagtggcgtgcgggtcgagtagaaaggagataactaaacactgggaatggctcgagaataatttgcttcagacgctttccatctttgacagcgaagaggacatcacaacatttgtcaagggcaagatccatgggatcatagcagaggagaataagaacctccaacctcaaggggatgaggatcccggaaagtttaaggaagccgagctgaagatgcggaagcaatttggcatgcctgaaggcgagaaattggtcaattattattcctgttcttactggaaagggcgggtgcctcggcagggctggctttaccttactgtcaatcatctttgcttctactcatttctcctgggcaaggaagtctcgctcgtggtccagtgggtcgatatcacccggctcgagaagaatgccactctgctgttcccggagagcatccgggtggacacccgggatcaggaactatttttttccatgtttttaaacatcggggaaacctttaaactgatggagcaactggcaaatctggccatgcgccagctcctggattctgaaggctttctggaggataaggctctgcccaggcctatcaggcctcacaggaacatttcagcccttaaacgtgacctggacgctagggcaaaaaatgagtgctatcgcgcaacattcagacttccgcgagatgaaagacttgacgggcatactagctgcaccttgtggactccattcaataagcttcatatccccgggcagatgtttatttcaaacaactacatttgtttcgcaagtaaagaggaagatgcctgccacttgataatccctctccgggaggtcacaatcgttgagaaagccgactcctcctctgtcctgcccagccctttgtcaatttccacaaagagcaaaatgacttttttgttcgccaatctaaaggatcgggacttcctggttcaaaggatcagcgacttccttcagaagacacctagtaagcagccaggcagcattggttccagaaaggcctcagtcgtggacccttcgactgaatccagtcctgcaccccaggaaggatcagaacagccggctagccctgcctcccctctgagcagtaggcagagcttttgtgcccaggaggcgccaactgcatcccagggcctgctgaagctgttccagaaaaactcaccaatggaggatctgggcgcgaagggcgctaaagaaaaaatgaaggaggagtcatggcatatacacttttttgagtatggaagaggcgtgtgtatgtaccggacggccaagactcgcgcattagtcctaaaaggaatccccgagtccctccgcggggagttatggctgctgttcagcggcgcctggaatgagatggtgacacatcctggttactacgccgaactggtagagaagagcaccggtaagtatagcctagccactgaggaaatcgagagagacctacaccggtccatgccagagcacccagcgtttcaaaacgaactcggcatcgccgcactccggcgagtgctcactgcgtatgcctttagaaacccaaccatcggttattgtcaggccatgaacatcgtaactagtgtcttgctcctctatggctccgaggaggaggccttctggctgttggtcgctctctgcgagagaatgctgcccgattattataacaccagagtggttggcgcgctcgtcgaccaggggattttcgaagaattaacccgggactttttaccccagctttctgagaagatgcaggacctaggagtgatcagcagtatatctctgtcctggttcttgaccttattcctttcagtgatgccatttgaaagcgccgtcgtcatcgttgactgcttcttctatgagggtattaaggtgatattacaagtagccctggctgtgctggacgccaatatggagcagttgctgggatgctctgacgagggtgaggccatgactatgctgggaaggtacctggataacgttgtgaacaaacagtctgtcagtcccccaatcccccatctgagggccctgctgagcagctctgatgaccccccagctgaggtcgacatatttgagctgttgaaggtatcctacgaaaaattcagtagcttacgtgcagaggacattgagcaaatgcgctttaagcagagactcaaagtcatacagtctctagaggacactgccaagcgtagcgtagtaagggctattcccgtcgatataggcttttcgatcgaggaactggaagacctgtacatggtatttaaagctaagcacctggcctcacagtattggggctgttcccggactatggccggtcggcgcgatccaagcctgccatacctggagcagtatcgcattgacgcctcacagttcagggaactctttgcctccctgaccccctgggcttgcgggtcacatactccacttttagcaggtcgaatgttccgcctgctggacgagaacaaagatagcctgataaattttaaggagttcgtgacgggtatgtccggtatgtaccacggtgacctgacagagaagctgaaagttctgtataagctgcatctgccacctgccttaagcccagaagaagccgagtcagccctggaagcagcccactacttcactgaagatagttcctcggaggcctctcctctcgccagtgatctggacctcttcctcccttgggaggcccaagaggcgctgccacaagaggaacaagagggatctggctccgaggaacgcggagaggaaaagggtacatctagtcccgattacaggcactatctcagaatgtgggcaaaagagaaggaggctcagaaggaaacgatcaaggaccttcccaaaatgaaccaggaacagttcattgagttgtgcaagacattgtacaacatgttttccgaggatccaatggagcaggatttatatcatgccattgcaacagtcgcctctcttctcttgaggataggtgaggtgggtaagaaattcagtgcccgaaccgggcgcaagcctagggattgtgcaaccgaagaagatgagcctcccgctcctgagttgcaccaagatgctgcccgggaactgcaaccacccgcagctggggacccgcaagccaaggcagggggagacacccacctggggaaagcccctcaggagtcacaggtggtcgtcgaaggcggctccggagagggccagggctccccgtcacagctgttgtccgacgatgagaccaaggacgatatgtcaatgtcaagttacagtgtggtcagtaccgggtccctccagtgtgaggatctggccgacgatacggtgttagtgggcggcgaggcgtgctctcccactgcgaggatagggggcacggtggatacggattggtgtatttcttttgagcagattctcgcatccatccttactgagtccgtccttgtcaactttttcgaaaagcgggtggacatcgggctgaagatcaaagaccaaaagaaagtcgaacgtcaattctcaactgcaagtgaccacgagcaacccggcgtcagtggctag

SEQ ID NO: 46761 - DNA, 1176 bp, Artificial Sequence
  Description of Artificial Sequence: Synthetic coding sequence
atggccggccggcgggaccccagcctgccctacctggagcagtaccgcatagacgcctcccagtttcgagagctgtttgcctctctgaccccttgggcatgtgggtcccataccccactgttggcagggagaatgttccggctgctggacgagaacaaagatagtctgatcaactttaaagaatttgtaacaggcatgtcagggatgtaccacggggatctcactgaaaagctgaaggtcctctataagctgcacctccctccagctctgtccccagaggaggccgaaagcgccctcgaagccgctcactacttcacagaggatagttccagcgaggaggcccttccgcaggaggagcaggaaggctccgggagtgaggagcggggcgaagagaagggcacctcctcacccgactacagacattaccttcgaatgtgggcaaaggagaaggaggctcagaaggaaacaatcaaggacctccccaaaatgaaccaggaacagttcattgagttgtgtaaaacactgtacaatatgttctctgaagatccgatggagcaggacctctaccatgcaatcgctactgtcgccagtttgctgcttcggattggagaagtaggcaagaagttcagcgcccgcaccggtcgaaagccaagagattgcgccacggaggaggatgagcctcctgcccctgagctccaccaggacgccgcccgagaattacaacccccagcagcaggggacccacaggctaaggccgggggagatacacaccttggcaaagcccctcaagaaagtcaggtcgtggtcgaggggggatcgggtgaaggacagggttcacccagccagttattaagtgacgatgagaccaaggatgacatgtcgatgtcatcctacagcgttgtgagtacaggatccctccaatgcgaggacctggcagatgacactgtcctggttggaggtgaagcctgcagcccgaccgccaggatcggtggtacggtggacaccgattggtgtatttctttcgagcaaatactggctagtatcctcaccgaatcagttcttgtgaattttttcgaaaagcgggtggacatcggattaaagattaaagaccagaagaaggtggagaggcagttcagtacggcgtccgaccacgaacagccgggggtgtctggatag

SEQ ID NO: 46762 - DNA, 975 bp, Artificial Sequence
  Description of Artificial Sequence: Synthetic coding sequence
atgggcgacctgctgccccgggcctggcccggcgccggctgcaccgagacacagactacatcacaaggcccacaggaactggcagtgcccaccgccgagtgctactcctgcagtttctacttctgcgtttgtcccgaagccttgccacaggaggagcaagaagggtccggatccgaggagaggggggaggagaagggtacttcatcacccgactacaggcattatcttcgcatgtgggcgaaggaaaaggaagcccagaaggaaaccattaaggacctgcccaaaatgaatcaggagcaatttatcgaactgtgtaagacgctgtacaatatgttttctgaagatccaatggaacaagacctgtaccacgcgatagcaaccgtcgcctcgctgcttctgagaatcggcgaggttgggaagaaattttcagcaaggaccggacgaaaacctagggactgcgccactgaggaagacgaacctcccgctcccgagctacaccaggatgccgcacgagagctgcaaccccccgctgcgggcgacccgcaagccaaggcagggggtgatactcatttaggcaaagcaccccaggagtcacaggtggtcgttgaggggggttcgggcgagggtcaaggctctccatcgcagctgttaagcgacgacgagaccaaagacgacatgtccatgagttcctattctgtcgtcagcactggaagcctacagtgcgaagacctggccgatgatactgttttggtgggaggggaagcatgtagcccaaccgcccggataggcgggacggtggataccgactggtgcattagtttcgagcaaattctggcctccatactgaccgagagcgtcctggtaaactttttcgagaaacgcgtggatatcggcctaaagatcaaggatcagaaaaaggtagagcgccaattcagcaccgcttccgaccacgaacagcccggagtgagtggctag

SEQ ID NO: 46763 - DNA, 1137 bp, Artificial Sequence
  Description of Artificial Sequence: Synthetic coding sequence
atgagcaaggagcccctgatcctgtggctgatgatcgagttctggtggctgtatttaacacctgtcacatcagagaccgttgtgaccgaggtgctgggccacagggttactctgccttgtctctacagcagttggagccataatagcaacagtatgtgctggggaaaggatcagtgcccgtacagcggatgcaaggaggccttgatccgtaccgacgggatgagggtcacaagccggaaaagcgccaagtacaggctccaaggtactatccccaggggcgacgtctcccttactattcttaatcctagcgagagcgacagtggtgtgtactgttgccgaattgaggtccccggatggtttaacgatgttaagattaacgtccgcctgaatctgcaaagagcctctaccacaacccaccgcacagccacaaccacaacccgccgcactactaccacgagcccaacgacaactagacagatgacgacgacgccagctgccctcccgaccacagtggtgacgaccccagatctgacaacgggtacacccctccaaatgactactatcgctgtgttcacgaccgcaaatacatgcctgtctctgacgccatctacattgccagaggaggcaaccggcttgctaacccccgagccgagcaaagaaggtcccatcctcacagctgaatcggaaactgttctgcctagtgacagttggagcagcgtggagtccacctctgctgacactgtgttgctcaccagcaaggagtcaaaggtgtgggatctgcctagtactagccatgtgtcaatgtggaaaacgagcgactccgtgagctctccacagcctggcgcatcagacaccgcggttccggagcagaataagaccacaaagaccggccagatggacggcatccccatgagcatgaaaaacgagatgcccattagtcagctgctgatgataattgcccccagcctgggattcgtcctgtttgccctgtttgtggccttcctgcttcgcgggaagctgatggaaacatactgctcgcagaagcatactcgacttgactacatcggcgactccaagaacgtgctgaatgacgtgcagcacggtagagaggatgaagatgggctcttcactctgtag

SEQ ID NO: 46764 - DNA, 1053 bp, Artificial Sequence
  Description of Artificial Sequence: Synthetic coding sequence
atgagcaaggagcccctgatcctgtggctgatgatcgagttctggtggctctacctcaccccagtcactagtgagactgtagtaaccgaggttctgggtcatagagttacccttccgtgcctgtattcctcttggagtcataactctaattcaatgtgttggggcaaggatcaatgtccatacagtggctgcaaggaagcactaatcagaactgatggtatgcgtgttactagcaggaagtcagctaaatatcggctccaaggaacaattcctcgcggagacgtttcactgaccatcttgaatccaagcgagagcgactcgggtgtctactgttgtagaatagaggtaccaggatggtttaatgacgtgaagattaacgtgaggctcaacctccagcgggctagcacaacgacgcatcggacagcaactacaactacacggcgcacgaccaccacgagccctactactactcgacagatgaccacaacccctgcggccctgccaacaacagtggttaccactcctgacctgacaaccgggacgccactccaaatgactacaatagccgtatttaccacagcaaacacatgcctctcccttacgccgtctaccctgcctgaagaggcaactgggctgcttactccagaacccagcaaggaaggaccaattcttacagcagagtctgaaactgtcttgccttcagactcttggtccagcgtagagagtaccagcgccgataccgtgctgctgaccagtaaggcctctgatacagcagtcccagagcagaacaaaacgaccaagacgggtcagatggacggaatacccatgagcatgaaaaatgagatgcctattagtcaactgttgatgattatagctccttcccttggcttcgtgctgtttgccctattcgtggcattcttgctcaggggaaaacttatggagacttattgttctcagaaacatacgaggctcgactacatcggagatagtaaaaacgttctaaacgacgtacagcacggtagggaggacgaagatggtctcttcactttgtag

SEQ ID NO: 46765 - DNA, 3504 bp, Artificial Sequence
  Description of Artificial Sequence: Synthetic coding sequence
atgcccaacagcgtgctgtgggccgtggacctgttcggccgggtgtacacattaagcaccgctggccagtattgggaaatgtgcaaagactcccaattagagtttaagagggtctcagccactacacagtgctgctggggcatcgcatgtgataatcaggtgtacgtatatgtgtgtgcaagtgacgtccctatccggcgacgcgaggaggcatatgaaaaccaacggtggaatcccatggggggcttttgtgaaaaactgctgctatcagaccgctggggatggtctgatgtcagtggccttcaacataggcctctggatcgtgtggcgcttcccagcccccactgggaatgggaatccgattggtacgtggacgagaattttggcggcgaacctacagagaaaggtggctggacctacgcgatcgacttccccgccacctataccaaggacaaaaaatggaatagctgtgtgaggagaagaaagtggatccgctaccgcaggtataagtcacgcgacatttgggctaagatcccttctaaggacgatcctaaggagctgcccgatccgttcaatgaccttagcgtgggcggttgggagataaccgaggagcctgttggtcgccttagcgtatgggctgtgtcgctccaggggaaagtgtggtacagggaggatgtttcccactccaaccccgagggttcatcatggagcctcctcgataccccaggtgaggtcgtgcagatctcttgcggtccccacgatcttctctgggccacactctgggaagggcaggccctggtcagggaaggaatcaatcgctccaatcccaagggttccagttggtcaattgtggagccacccgggtccgagaatggagtcatgcacattagtgttggggtttctgtggtgtgggctgtgaccaaagactggaaagtgtggtttcgtaggggtgtcaacagccataacccctgtggcacctcttggatcgaaatggtcggcgagatgaccatggtgaatgtggggatgaatgaccaagtttggggaattgggtgcgaggatcgggccgtgtactttcgccaaggtgtgactccatctgagctttcaggcaagacttggaaggctataattgcggcccgggagtgcgataggtcccacagcggtagtagttcttccctgctctcagctgggtgtttcttcggggacgaggtcagagggagtggggaaagcgcgccctctgatactgatgcctcgagtgaggtggagcggcccggtcctggccaaattctacccgcagagcccctggatgactccaaaaatgccaccggcaactctgcttccgggctcggcgccggaaggactgctgaggacacggtagaagatgcctgcccagctgagggctcccgagaggccaggccaaatacccaccccggtcctgccccaaccccagccgagctcccctggaccaacattgacctgaaggaagcaaaaaaagtgccatcccactccgcggcaggctttcctgaaactacatcattaagcagccttgggcttctcccattagggcttgaggaaccctacggcgtggatgatcaccctctgtgggcttgggtgtcagggggtggatgcgtcgtggaagcctgcgctatgccacggtggtttactgtccaagctgcaggcctctccagcagcgtgcacatgctgtctctgtcgataactccagcccagacagcagcatggcggaaacaaatattccagcagttgaccgaacggacaaaaagagagctagagaatttcaggcactacgaacaggccgttgagcagagcgtgtgggttaagactggggcgctgcagtggtggtgcgactggaagccccacaagtgggttgacgtgcgcctagctctagagcagtttacagggcatgatggtgtccgggactctattctcttcatttactacgttgtgcatgaagaaaagaagtatatacacatttttctaaacgaggtggtggccctggtgccagtattgaatgaaaccaaacacagcttcgctctgtacacaccagaacggacaaggcagaggtggcccgtgcggctcgccgccgccaccgaacaggacatgaatgattggttggcgctactctccctgtcctgctgcgagtctaggaaagttcagggaagacccagtccccaggccatatggagcatcacttgtaaaggcgacatcttcgtctctgagccaagccccgacctggaggcacacgaacacccgctgccgtgcgatcagatgttctggcggcagatggggggccatttacgcatggttgaagccaatagtcgaggcgtggtgtggggcataggctacgatcacaccgcctgggtgtatacaggggggtatgggggcggctgctttcaggggctcgcgagttccacatctaacatctatacccaaagcgacgtgaagtgtgtgcacatctacgagaatcagcggtggaatcccgtgaccggctacacaagctccagaggcctcccaacagatcgctatatgtggagtgacgcaagtgggctgcaagagtgcaccaaagctggaacaaagccgccttccctgcagtgggcctgggtgtctgactggttcgtcgattttagcgtgcccggagggactgaccaggaaggctggcagtacgcaagtgacttccctgcatcataccacggcagtaagacgatgaaggacttcgtgcggaggcgatgttgggcgcgcaagtgcaagctcgtaacaagcggcccttggcttgaagtccctccaatcgctttgagggacgtgtcaattatcccagaatctcctggagctgaaggcagcgggcactctatagctctatgggccgtatccgacaagggcgacgtgctttgtcggctgggagtgtctgaacttaaccctgcagggtcatcatggctgcatgtgggcactgaccaacccttcgcatcgatatccattggagcttgttatcaggtgtgggcagtcgcccgggacggaagcgccttttaccgcggctcagtctatccttcccagccagccggagactgttggtaccatattccatcccctcctcgtcaacgattgaagcaggtgagcgcaggacagaccagcgtgtatgcccttgatgaaaatgggaacttgtggtaccgtcagggtatcactccctcatatccccagggaagttcctgggaacacgtcagcaataacgtgtgccgagtatcagtaggccccttagatcaggtctgggtgatcgccaacaaagtgcaggggtcacactcgttaagcaggggaaccgtctgccacaggactggagtgcagccacacgagcctaagggacatggatgggattacggcattggagggggatgggaccacattagtgtgcgggcgaacgctacaagggctccacggagctccagtcaggaacaggaaccctctgcgccccccgaggctcacggccccgtctgctgctag

SEQ ID NO: 46766 - DNA, 306 bp, Artificial Sequence
  Description of Artificial Sequence: Synthetic coding sequence
atgcccaacagcgtgctgtgggccgtggacctgttcggccgggtgtataccctctctaccgctggccagtactgggagatgtgcaaagatagtcagctagagttcaagagggtttctgctaccacccagtgttgttggggaattgcctgcgataaccaggtgtatgtgtatgtgtgtgcttcagatgtgccaatccgtagaagagaagaagcctacgaaaaccagcgctggaaccctatgggcgggttctgcgaaaagctcttgttgagcgatagatgggggtggtccgatgtgtctgggctgtag

SEQ ID NO: 46767 - DNA, 3498 bp, Artificial Sequence
  Description of Artificial Sequence: Synthetic coding sequence
atgcccaacagcgtgctgtgggccgtggacctgttcggccgggtgtacacactctctacagccggccagtactgggaaatgtgcaaggatagccaactggaatttaaacgcgtgagcgcaactacccagtgttgctggggaatcgcctgcgacaaccaggtatacgtttatgtatgcgctagcgatgtaccaattcgcaggagggaggaagcatacgagaatcagcgatggaaccctatggggggtttctgtgaaaaactcttactgtcagaccgttggggttggtccgatgtcagtggtttgcaacacaggccactggatagggttgctttaccctctccccattgggaatgggagtcagactggtacgtagacgaaaacttcggaggcgaacccacagaaaaaggcggttggacatatgccatcgacttccccgcgacgtatacaaaagataagaagtggaactcgtgcgtgagaaggcgcaagtggatacgttatcgccggtataagtctcgcgatatttgggccaaaataccctcgaaggatgaccccaaagagctcccagaccccttcaacgacttatctgtgggcggttgggaaatcacggaagagcccgttggtcggctgagtgtttgggcagtgtcgctccagggaaaagtgtggtatcgggaagatgtcagccactcaaacccagaggggagcagttggtccctgcttgatactcccggcgaagtggtacagattagttgcggaccacatgatttattgtgggccaccctgtgggagggccaggctctggtgcgcgagggtataaaccggtccaaccccaaaggatccagttggtccatcgtggaaccccccggttccgagaacggtgtgatgcacatttccgttggggtcagcgtggtgtgggcagtgacgaaggactggaaggtgtggttcaggcggggcgttaactctcataacccctgcggcactagttggattgagatggtgggcgagatgaccatggtgaatgtcggcatgaacgatcaggtgtgggggattggctgcgaggatagagctgtgtattttaggcagggagtgaccccaagcgagctgtccgggaagacatggaaagctatcatcgccgcgcgggaatgtgaccgcagtcattctggcagcagctcaagcctcctaagcgccggttgcttctttggggacgaggtacggggttctggcgaaagcgccccctccgataccgacgcctctagcgaagtggagcggccaggccctgggcagatattgccggctgaaccacttgacgactcaaaaaatgccactggcaatagtgcaagcgggctgggagctggtcgaaccgctgaggatactgtggaggatgcttgtccagccgaaggcagccgtgaagctcgaccaaatactcatcccggcccagctcccactcccgctgagctcccatggactaacattgatctgaaagaggccaaaaaggtcccatcacactctgccgcagggtttcccgagaccacaagcctcagcagcctgggcttattgcctcttgggctggaagaaccgtacggcgtggacgatcatcccttatgggcatgggtttccggcggcggttgcgtcgtggaagcctgtgcgatgccacgctggtttaccgtccaggccgggctttcgagcagcgttcacatgctttcactgtcaattacacccgctcagacagcagcatggaggaagcaaatcttccagcaactaaccgaaagaaccaaaagggagctggagaacttcagacactatgagcaggcggtcgagcaaagcgtttgggtgaaaacaggagctttacagtggtggtgcgattggaaaccacataagtgggtggacgtgcggttagcattggagcagtttaccggccacgacggagttcgggatagtattcttttcatttattacgttgtacacgaggagaagaagtacatccatattttcctcaatgaggttgtggctctggtgccagttctgaatgagacaaagcactcattcgctctttatactccagaacgcacgcggcagagatggcctgtcaggctagccgccgctaccgaacaagatatgaatgattggctcgcactgctcagtctgtcatgctgcgagagccgtaaggttcaaggcaggcctagtcctcaggcaatttggtcaatcacatgtaagggggatatattcgttagcgagccatccccagatcttgaggcccacgagcatcctcttccctgcgatcagatgttttggcggcagatgggtggccacttgagaatggttgaagccaatagccggggagtggtgtggggcattgggtacgaccacacagcctgggtatacactggtggctatggagggggttgttttcaaggccttgcctcaagtaccagcaacatctatactcagtcagacgtgaaatgtgttcacatctatgagaaccaaaggtggaaccctgtgaccggctacacctccagggggctgcctacagatagatatatgtggagcgacgcctccggtctgcaggagtgcacgaaagccggaacgaagcccccatccctccagtgggcttgggtgtcagactggttcgtagatttcagtgtcccaggggggaccgatcaggagggctggcagtatgcgtctgacttccctgcttcctatcacggctccaagacgatgaaagacttcgtaaggaggagatgctgggccagaaagtgcaaactggtgacgtctggcccctggctggaggtgcctcctatagccctgcgggacgtttcaattatccctgagtcacccggtgcagagggttctggtcacagcatagcgctgtgggccgtcagcgataagggagatgtgctttgccgacttggcgtctctgaacttaaccctgcaggcagctcctggctgcatgtgggaacagaccagccctttgcctcgataagcataggagcatgctaccaggtatgggccgtggcccgggatggttctgctttttatagagggagcgtctatccatctcaacccgcaggagactgttggtatcacattccgagccctcctagacagagactgaagcaagtctcagccggtcagaccagcgtctacgcattagatgaaaatggtaacctgtggtaccggcaaggcataacgccctcttacccccagggcagcagctgggagcacgtctccaacaacgtttgccgggtctctgtgggcccacttgatcaggtgtgggttattgcaaacaaggtccagggtagtcattcactgagccgaggaacagtttgccaccgtacaggggtccagccgcacgaacctaaaggtcatggttgggattacggcatcggggggggctgggaccatatttctgtgagggcgaatgctacaagggccccccgctctagctctcaagagcaagagccaagtgcccccccagaagctcacggtccagtctgctgctag

SEQ ID NO: 46768 - DNA, 2331 bp, Artificial Sequence
  Description of Artificial Sequence: Synthetic coding sequence
atgggcggcttctgcgagaagctgctgctgagcgaccggtggggctggtccgacgtgtccggccttcagcatagacccctggatcgcgtggccttaccatccccccattgggagtgggagtccgattggtacgtggacgagaacttcggaggtgaacccaccgagaaaggaggatggacttacgccatagatttccccgctacttacacgaaggacaagaagtggaattcctgtgtaaggcggagaaaatggatccgttaccgccgctacaaatctcgggatatctgggccaagatcccatcaaaagatgatccgaaggaactgccagaccccttcaacgatctgagcgtagggggatgggaaattaccgaggagcccgttgggcggcttagcgtgtgggcagtgagtctgcagggaaaagttctttgtccctgtcttgcatcacaggtgtggtaccgtgaagacgtctcacatagtaacccagaaggtagctcctggagcttgctggacacccctggagaggtagtccagataagctgcggcccgcacgatctgctgtgggcaacactctgggagggccaggccttggtgcgagaaggcatcaatcggtctaaccctaaaggaagctcttggtcaatcgttgagccccctggctccgaaaatggtgttatgcacatttcagtgggagtcagcgtcgtctgggccgtcacaaaagattggaaagtttggttccgccgcggggtaaactctcacaacccatgcggcacctcttggatcgagatggtcggcgaaatgaccatggtgaatgtgggaatgaacgaccaagtgtgggggattgggtgtgaggaccgtgcggtgtacttcaggcagggcgtgacaccaagtgagttatctgggaaaacgtggaaagccattatcgccgcaagagaatgcgacagatcacactccggatcctcctcgtcgcttttaagcgcaggctgtttcttcggtgacgaagttaggggatcgggcgagtccgcgccttccgataccgacgcctcatcagaggtcgaacggcctggaccagggcaaatactccccgctgaacctctggatgactcaaagaacgccacgggtaacagtgcctccggactcggcgccggcaggacggccgaggataccgtggaggatgcctgccctgctgagggatccagggaggcccgccctaatacccatcccggcccagctcctaccccagcggagctgccatggaccaacatcgaccttaaagaggccaaaaaggttcccagtcacagcgctgcaggattcccagagacgacgagcctatctagcctgggcctactccccctgggactggaggagccatacggggtggatgaccaccctctgtgggcttgggtgtcaggaggcggctgcgtggtggaagcctgcgccatgccccgatggttcacagtgcaggctgggcttagcagttctgttcatatgctgtctctttccattacccctgcccaaaccgccgcttggcggaagcaaattttccagcagttgacagagcggactaaacgggagcttgagaattttaggcactacgagcaggccgttgaacagtccgtgtgggttaaaactggagcgttacagtggtggtgcgactggaaacctcacaagtgggtggatgtccggttggcgctggagcaattcacaggacatgacggggtgcgcgactcaatcctgtttatctactacgtggtacacgaagagaagaaatatatccatatcttccttaatgaggtggtcgccttggttcccgtactgaatgaaaccaaacatagctttgcactgtacacacctgagcggacacgccaacggtggcctgtgcggctggcagccgctaccgagcaggacatgaacgactggctagccttgctgagcttgagttgctgcgaaagccgcaaagtgcagggacgcccatcacctcaagcaatctggtccatcacctgtaagggcgacatttttgtgagcgaaccgtctccagatctcgaggcacacgagcaccccctgccctgtgaccaaatgttttggcggcagatgggcggccatctcaggatggtcgaggccaactcaagaggggtagtgtgggggatcggctacgaccacacagcatgggtgtatacaggtggctatgggggaggctgtttccagggcctcgcttctagcacctccaacatctacacccagagcgacgtcaaatgtgttcatatttacgagaatcagcgctggaaccctgtgacaggctataccagtagtagagaccgcatttcaccatgctggtag

SEQ ID NO: 46769 - DNA, 627 bp, Artificial Sequence
  Description of Artificial Sequence: Synthetic coding sequence
atgccccccaagaaggacgtgcccgtgaagaagcccgccggcccctcaattagcaagcccgccgccaagcccgcagcggcaggcgctccccccgcaaaaacgaaggctgaacccgctgtgccacaagctccccaaaagacccaggaacctcctgtcgacctgtccaaagtggttatcgagttcaataaagaccagctcgaagaattcaaagaagcatttgaactctttgaccgcgttggcgacggaaagatcttgtacagccaatgcggcgatgtcatgagagccttgggccaaaatccaaccaatgcagaagtgctgaaggtcctgggaaacccgaaaagcgatgaacttaaatcaagaagagtggattttgagacattcctgccaatgctccaggccgtagcgaagaacagaggtcagggcacttacgaggactatctggaaggcttcagggtctttgacaaggagggcaatggcaaggtcatgggtgcagagctgaggcatgtcctcaccactctgggggaaaaaatgacagaagaggaggtggaaacagtgctcgctggccacgaagacagcaacgggtgtatcaactacgaagccttcctaaaacacatcctgtctgtctag

SEQ ID NO: 46770 - DNA, 2790 bp, Artificial Sequence
  Description of Artificial Sequence: Synthetic coding sequence
atgaccaagaagcggaagcggcagcacgacttccagaaggtgaagctgaaagtgggcaaaaagaagccgaagctacagaacgccacgcctaccaattttaaaactaaaaccattcatcttccagagcagctgaaagaggacgggaccctccccaccaacaatagaaaattaaatatcaaggacctgctatcccagatgcaccattacaacgcaggcgtcaagcaaagtgcccttctgggcttgaaggatctcctgtcccagtatccgtttatcatagacgcccatctgagcaacatcctgtctgaagtgaccgctgtcttcaccgacaaggacgctaatgtcagactggctgccgtgcagctgctgcagtttctggcccccaagatcagggccgaacagatttctcctttctttcctctcgtatccgcacatctgtcatcggcaatgactcacatcacggaagggatccaggaagacagcttgaaggtgcttgatattctactggaacagtatcccgcattgattacggggaggagttcaatactgctcaagaacttcgtggagctgatctcacaccagcaactgagcaaggggctgataaatcgcgatcgctcacagtcttggatactgtcagtcaatccgaaccggaggttgacaagccagcagtggcggcttaaagtgctggtgcggttgtcaaaatttttgcaggccttggccgatgggtcttctcgtctgagagagagcgagggcctgcaggaacagaaagaaaatccccatgcgactagcaacagtatcttcataaattggaaagagcatgcgaacgaccagcagcatatccaggtctacgagaacggtggatctcagcctaacgtctcctcacaattccgcttgagatacttggtgggagggctgtcaggggtggacgaagggctctctagcaccgagaatttgaaagggtttatagaaatcatcattcctttactaattgagtgctgggtcgaagcagtgcctccccagcttgcgacccccgtaggaaacggcatagagagagaaccactccaggtgatgcagcaggtcctaaatattatttcacttctgtggaagttatccaaacaacaagacgaaacacataaacttgagtcttggttacggaaaaattacttgatagattttaagcaccattttatgtcccggttcccttatgttctcaaggaaatcactaagcacaagcgtaaagagcccaacaagtccattaagcactgcaccgtcttgtctaacaacattgaccatctgcttctcaatctgacacttagcgatataatggtgagtctcgccaacgcatccaccctgcaaaaagactgcagttggatcgagatgattagaaagttcgtgactgaaactttagaagatggatcccgcctgaactcaaaacaactcaataggctcctgggggtgtcctggagactcatgcagatacaacctaacagagaggataccgaaaccctgattaaagcggtatataccctctatcagcagagggggctcatcctgcccgtcagaactctgctcctcaaattcttttccaaaatctatcagaccgaggagttgcgatcctgtagatttcggtatcggtcaaaagtgctaagccgatggcttgctggcctaccgctgcaactcgcccacctgggcagccggaatcctgaattatctacacagttgatcgacatcatacacactgcagctgcacgcgctaataaagaactgcttaaatctttacaggccacagcactgaggatctacgatccccaggagggcgcagtggtggtacttcctgctgacagtcagcagaggctcgtccagttggtctattttctcccaagcttgcctgcagacctgttgtctagactgtcccgctgttgcatcatgggcaggctgagcagttctttggcggcgatgctaattggtatactccacatgcgctctagtttttcagggtggaagtacagcgccaaagattggcttatgagcgacgtagactattttagcttcctattcagcaccctgacggggttctcaaaagaggaattgacctggctgcaatctctaaggggtgtgccccacgtgatacagactcagctttctcctgttctcctgtacctcaccgatcttgaccaatttctgcaccactgggacgtgactgaggctgtgttccactccctattggttataccggcccgcagccagaactttgacattttgcagtcagctataagcaagcacctggtagggttaacagtcattcctgactccacggctggttgtgtgtttggggtgatttgtaaattgctggatcacacttgtgtagtgtcagagaccctgttgcctttcctcgcaagctgctgttactctctgttatattttcttctgacgatcgagaaaggagaggcagagcacttaagaaaacgcgataagctttggggggtgtgtgtgagtatactcgcactccttcctagagtcttgcggttgatgctccaatccctgcgtgtgaatcgagttggcccggaagaactgcccgtcgtcggccagctgctccgccttttgttacagcacgcaccccttaggacccacatgctcactaatgctatactagtgcagcagatcataaaaaatatcacaactctcaaaagtggctcagtgcaggagcagtggctcacagatctccactattgttttaacgtctatatcacaggccaccctcaaggtccttccgccctcgccaccgtttactag

SEQ ID NO: 46771 - DNA, 516 bp, Artificial Sequence
  Description of Artificial Sequence: Synthetic coding sequence
atgcagcaggtgctgaacatcatcagcctgctgtggaagctgagcaagcaacaggacgagacccacaagctggaatcttggctgagaaaaaactaccttattgattttaagcatcatttcatgagtcgcttcccatatgtattgaaggaaattaccaagcataaaagaaaagagcctaacaagtcgatcaagcattgcacagtgctgagcaataacattgaccacctcctgctgaatttgacattgagcgacattatggtgagcctagccaacgcctccaccctccagaaagactgcagctggatagaaatgatccgcaagtttgtgactgaaacgcttgaggacgggagtagactgaacagcaaacagttgaaccggctcctgggagtttcctggcgcctgatgcaaatccagcctaatagagaggataccgaaacattgatcaaagctgtttacactctgtatcagcagcggggcctcatcctacccgtccgtacattgttgcttaagttttag

SEQ ID NO: 46772 - DNA, 2394 bp, Artificial Sequence
  Description of Artificial Sequence: Synthetic coding sequence
atgaccaagaagcggaagcggcagcacgacttccagaaggtgaagttgaaggtcgggaaaaagaaaccaaaactccagaacgccacaccgaccaattttaagaccaagaccatccacctgccggaacagttaaaagaagatgggacactgccaaccaacaatcgcaagctgaacatcaaggatctgctttcccagatgcaccactacaacgctggtgttaaacagtcagccttgttgggactgaaagacctgctttcacagttcctcgcacccaaaattcgagccgaacagatctctccattctttcccctagcactggccgacggatcctccagattacgcgagtccgaaggtctccaggaacaaaaagagaatcctcatgctacctccaacagtatctttatcaactggaaagagcatgccaatgaccagcaacacatacaggtttatgaaaatggcggatcacaacctaatgtgtcctcccagtttcgtctacgctatttagtgggcgggctgtccggggtggatgagggcctttcctctactgagaatcttaaaggcttcattgaaatcattattcctctgctgatcgagtgctgggtggaagcagtgcctccccagcttgctacgcctgttggcaacggaatcgagagagaacccctgcaggtgatgcaacaggtcttgaacattatatctctgttgtggaagctcagcaagcaacaagacgagacacacaaattagaatcctggttgaggaaaaactacctgattgatttcaaacaccacttcatgagccgctttccttacgtgttgaaagaaatcacaaagcacaagcggaaggaacccaataagtcaatcaaacattgtacagttttaagtaacaatatcgatcacttgcttttgaacttgaccttatccgatattatggtgtcacttgcaaacgcttctactctgcagaaagactgcagctggattgaaatgataagaaaatttgtgaccgaaaccctcgaggatgggtcaaggctgaatagtaagcagctgaatcgcctgcttggagtatcatggagactcatgcaaatccagcctaatagagaagataccgagaccttaataaaggcagtgtacacgttataccagcaaaggggcttgattttgcctgtcagaactttgctcctcaagttcttctcgaagatctatcagacggaggagctgaggagttgcaggtttcgataccgctccaaagtgttgagccggtggctcgcggggctgcctctgcagcttgcccatctcggctccaggaatccagagttgtctacgcagctgattgatattatccacaccgctgcagcgcgcgccaataaggagttgctgaaaagtttgcaggccactgccctacggatctacgatccacaagaaggggccgttgttgtcttacctgcagattcccagcagagattagtgcaattggtctatttcttgccttctttgcctgctgacttgttgtctcgcctgtcaagatgttgcataatgggtcgtctaagctcttctctggctgctatgctgatagggatcctacacatgcgttccagcttctctggttggaagtacagtgctaaggattggctcatgtctgatgtggattacttctccttcctgttcagcactctcactggtttttccaaggaagaactgacctggctccagtcgctgaggggagtaccgcacgtgatccagacccagctgtcgccagtgctgctgtatcttacggacctggatcaattcctgcaccactgggacgttaccgaggctgtcttccatagcctcctggtgattccagctaggagccagaactttgacattctgcagagtgctatctcaaagcacctggtgggtctgacagtgatcccagacagtaccgcagggtgtgtattcggtgtaatctgcaagcttctggaccacacatgtgtggttagcgagaccctcctgccctttctggcatcctgttgctattcacttctttactttctgctgactattgagaaaggggaagcagaacatctccggaagagagacaagttatggggagtgtgtgtatcaatcttggcacttcttcctcgcgtattacgcttgatgttgcagtctctgcgtgtcaatcgtgtgggtcctgaggagttgcctgtagtggggcagcttcttcgccttcttttgcagcacgcaccccttaggactcacatgctgaccaacgcaattctcgtacagcagattattaagaatattacaacactgaaatccggatcagtgcaggagcagtggctgaccgacctgcactattgtttcaatgtctacatcacgggccaccctcaagggccaagcgcacttgcaactgtgtattag

SEQ ID NO: 46773 - DNA, 2742 bp, Artificial Sequence
  Description of Artificial Sequence: Synthetic coding sequence
atgagccggatgaccaagaagcggaagcggcagcacgacttccagaaggtcaaactgaaggtcggtaaaaagaagcctaagctgcaaaatgcaacacctacaaatttcaagacgaagactattcacctccctgaacagctcaaagaagatggcacattgcccactaataacaggaaactgaacatcaaggacttgttgtcacagatgcatcactataacgccggggtcaagcagagcgctctgttaggacttaaggacctattatctcagtaccctttcattatcgatgcgcacctgtctaacatattgtccgaggttaccgccgtgttcacagataaggacgccaatgttcgactcgccgcggtgcagttgctgcagtttttggcccccaagatccgggccgagcagatttctcccttctttccgctggtgtcagcccatctgagctccgctatgacccacatcactgaaggcattcaggaggattccctcaaagttcttgacattttgttagagcagtatcctgcactgatcaccgggcggagctcaatcctcctgaaaaattttgtcgagctaatatcccaccagcaactgtctaagggcctgattaatagggatcggtcgcagagctggattctgtccgtcaacccaaaccgccgattgacttcacagcagtggcggttgaaagtcctggtgagattatcaaagttcctccaggctttggcggatggttcttctagactgagagagtccgaggggctccaggaacagaaggagaatccccacgccacctctaacagcatttttatcaactggaaggaacatgcaaatgatcagcagcatatccaggtttacgagaatggcggcagccagcctaacgtcagctcccagtttaggttgagatatcttgtgggtggtttaagcggcgtggacgaggggctttcctctaccgagaacttgaaaggattcattgagatcatcatcccactgctgattgagtgttgggtcgaagctgtgcctccacagcttgcgacgcccgttggcaatggcatagaaagagagccactgcaagtcatgcagcaggtgctcaacataatcagtctcctgtggaagctgtctaaacagcaagacgagactcataagttagaatcctggctgcgaaagaactatctcattgatttcaagcaccatttcatgtcccgcttcccgtacgtcctcaaagagattacaaagcataagagaaaagagccaaataagtcgataaaacattgtacagtgctatctaataatatcgaccacctgttgctcaacctgacactgtcagacattatggtctccttggccaatgcctcaacactgcagaaggattgctcttggattgaaatgatccgtaaatttgtaaccgagactttggaggatgggagtcgactgaactccaagcagctgaaccgtctgctgggggtgagttggcgcctaatgcagatccagcctaacagggaagacacagaaaccctgatcaaagccgtgtacacactgtatcagcagagaggactcattctgcctgtccgcacactgctgttgaaattctttagtaagatctaccagaccgaagagctcaggtcatgtcgattcagatacagaagtaaagtgctgagcaggtggttggctgggctgcccttacagttagcgcatctgggctcccgcaatccagaactcagcacccaactgatcgatattattcacaccgctgcggccagagccaataaagagctgctgaagagtttacaggccactgccctccgcatatatgaccctcaagagggggcggtggtcgtccttccggccgacagccaacagagactcgtgcagttggtttattttcttccatcactgccagcagacctgctgtcacggctctctagatgttgtatcatgggtagactcagctccagcttagctgcgatgctgattggcatcttgcacatgaggagttcttttagcgggtggaagtatagcgcaaaggattggctcatgagcgatgtggattacttcagcttcctgttcagcaccttaactggatttagcaaggaagagctcacatggttgcagagcctgcgaggggtcccccacgtgattcagacgcagttgtcacccgtcctgttatatctgactgatttggatcagtttttgcatcattgggacgtgacagaggccgtgttccattctctccttgtgattccagcccgctctcaaaactttgatatcctacagtcggccatctccaagcacctcgttggactgacagtgattcctgattcaaccgctggctgtgtatttggagttatctgcaaactgcttgatcacacctgcgtggtgtccgagacgctgttgccctttttagccagctgctgctattccctcctctacttcctgttaactattgagaagggtgaagctgagcatctcaggaagagactgatgctgcaaagcctgcgtgtgaaccgcgtcggacctgaagaacttccagtcgtaggacaactactccgcctgttgctacagcacgcaccactcagaacacacatgttgacgaatgctattctggttcagcagattatcaaaaacatcacgactcttaaatcaggcagcgttcaggaacagtggctcacagacctgcattactgtttcaatgtttacatcacgggccacccccaggggccatcggcgctggcgacggtctattag

SEQ ID NO: 46774 - DNA, 1302 bp, Artificial Sequence
  Description of Artificial Sequence: Synthetic coding sequence
atgcaccactacaacgccggcgtgaagcagagcgccctgctgggcttgaaagatttactgtctcaatatccattcatcatcgatgcgcatctgagcaacatcctctctgaagttacggcggttttcacagacaaagacgccaacgtgcgactcgcagcggtccaattactgcagtttttggctcctaagatccgtgcagagcagatctcccctttcttccctctggtgtctgcacacctatcatctgcaatgacccatatcaccgagggcatccaggaggattcacttaaggtgttagacatactgttggagcagtaccccgctctgatcaccggacgctctagcatccttctcaagaattttgtcgaactaatctcccatcagcagctctcaaaaggactaatcaatcgggatcgaagtcagtcttggattctgagcgttaatcccaatcgacgtctaactagccagcagtggcgcttgaaggttctggtgaggctgtcaaaattcctgcaggcccttgccgatggctcctcacgcctgcgtgagagcgagggtttacaggagcagaaggagaatcctcatgctaccagtaactccatattcattaactggaaggagcacgccaacgaccagcagcacattcaggtgtacgaaaatggtggctcacagccgaacgtctcctctcagtttcggcttaggtacctggtcggcgggttaagtggagtggacgagggactgtccagtaccgagaacctgaagggcttcattgaaattattattcccctcttaattgaatgttgggttgaggccgtgccgccgcagctggccactcccgttggtaacggcattgagagagagcccctgcaagtcatgcagcaagtacttaacattataagtttactttggaaactgagcaaacaacaagacgagactcacaaattggagtcctggttgcgcaaaaactatcttatcgatttcaagcaccatttcatgtctaggtttccatatgttttgaaggagattactaagcacaaaagaaaggaaccaaataagtcgattaaacattgtacagtgctcagcaataacattgatcatctgctgttgaacctcactctgtctgacattatggtatccctggcaaacgcgagcacactccaaaaagattgcagttggatagagatgataagaaagttcgttacagaaaccctcgaagatggaagccgtttgaactccaagcaactcaataggctgctgggcgtgtcatggaggctcatgcagattcagcctaacagagggcgctag

SEQ ID NO: 46775 - DNA, 3405 bp, Artificial Sequence
  Description of Artificial Sequence: Synthetic coding sequence
atgaccagcctgtacggccggcacgccgagaagaccaccgacatgcccaagccatcagcccccaaagttcatgttcagcgctctgttagcagagataccatagcaattcacttcagcgctagcggcgaggaggaggaggaggaagaagaggagttccgggagtactttgaggaggggcttgacgatcagtccatcgtgacagggcttgaagctaaagaggatctgtatctggagccgcaggtgggccacgacccggccggccctgcggcaagtcccgtcttggccgatggactaagcgtgtctcaggccccggctattcttccagtgagtaagaatactgtcaaactgctagagagcccagtgcccgccgcccaagtgctgagcaccgtacctctggccgtatcaccgggcagttctagcagtggtcccctggcaagctctccctcggtgagctcactgtctgagcagaagacatcctcctcctcgccgttgagcagtccttctaagtctccaatcctgagttcttctgccagcacatctacactgagcagcgctaaaccattcatgagtcttgtgaagagtctgtcaaccgaggttgaaccgaaggagtctccccatcctgctcgacatcggcacctaatgaagaccttagttaagtcactgtctactgacacttcgaggcaggagtcggacaccgtctcatacaagcctccagacagtaaattgaatctccatttgtttaagcagtttacccagcccaggaatacgggcggagattcaaaaacggccccgagttcccctttaacgagtccttccgatactaggagcttttttaaggtgccggaaatggaagcaaagattgaggacacaaagcgtcggctgtccgaggtcatctacgagccattccaattactgtcaaagattatcggggaggagtccggttctcaccgtcccaaagcgctgagcagctcagcctctgagttatctaacctgagttcgttgaatggccatcttgaatcgaataataattattccataaaggaagaagaatgcgattccgagggcgacgggtacggatcagatagtaacatccctcggtctgatcacccgaaaagtacaggcgagcctacgagggaaattgagcttaaaagctcccagggctcaagcctcaaagatctgggattgaagactagcagtctggtcctagagaaatgctctctgtctgcgcttgtgtctaaggaagacgaggagttttgtgaactttacacagaagactttgatcttgaaaccgagggcgagtctaaggtggacaaactgagtgacattccactcaagcccgaggtcctcgctgaggacggcgtggttctggattcggaagacgaagtggatagcgccgtgcagcatccggagctgccagtgaaaactttgggcttcttcatcatgtgcgtgtacgtgtacctcatcttgccactgccacattatgttagcgggctatttctgggcatcggcctcgggtttatgacagcagtctgcgttatttggttttttacaccaccaagcgctcataaataccacaagctgcataagaacttgcggcactggaatacaagatcgctggacatcaaggagccagaaatcctcaaaggatggatgaatgagatctacaattatgatcccgaaacctaccacgcaaccttgacccattccgtctttgtccgccttgaagggggtacccttcgcttatcaaaaccaaataagaatatctccagaagagcgtcctacaacgagcccaaacctgaggttacgtacatcagccagaagatctacgacttgagcgattcgaaaatctatttagtccctaaaactctggcccgcaaaaggatatggaacaaaaagtaccctatctgcattgagctcggtcagcaggacgattttatgagtaaggctcagacagacaaggagacctcagaagaaaagcctccagcggagggaagcgaggacccaaagaaaccgcctaggccccaggaggggacccgaagcagccagcgtgaccagatactgtacctgttcggccgaactggccgggagaaggaagaatggttcaggagattcatcctcgcaagcaaactgaagagcgagatcaaaaaatcgtctggagtatcaggcgggaagcccgcccccgttttccttgcccctggattgctgcctgcccatagcaggcacaactccccaagcggccatctgacccacagccgtagctcaagcaagggtagcgtcgaggaaatcatgtcccaacccaaacagaaagaactagcaggaagcgtgagacagaagatgctgctagactactctgtgtatatgggcaggtgtgtaccacaggagtcccgctcacctcagcgatcgcccctgcagagcgcggaatcttcacccactgccggaaagaaactgcccgaggtgcctccctctgaggaggaggaacaagaagcctgggtcaacgccctcctcggacggattttctgggacttcctaggagaaaagtactggagcgatctcgtcagcaaaaagatccagatgaaactgtcaaagattaaactcccatattttatgaacgaattaacgctgactgagttggacatgggagtggccgtgcctaaaatcctgcaggcatttaagccctatgttgaccaccaggggctgtggatagatcttgaaatgagctacaacggttccttcctaatgactttagaaacaaaaatgaacctaaccaagctggggaaagagcctcttgtcgaagccctcaaagtgggggaaatcggtaaggaagggtgtcgcccaagagctttttgcctggctgactccgacgaagagtcgtctagtgctggcagttcagaagaagatgacgctccggaaccttccggtggtgacaagcagcttcttccaggggccgaaggctatgttggtggacaccggacctccaagattatgagatttgtcgataagattaccaagtccaagtactttcagaaagctactgagacagagtttattaaaaaaaaaatcgaagaagtttctaacacgcccctactcctgacagtggaggttcaggagtgcagagggacacttgcagtcaacatccctcctccacccacagatcgcgtctggtacgggttccggaaacccccccatgtggaactgaaggccagaccgaagttgggagagcgggaggtgactctggtgcatgtgacagattggatcgagaagaaactagaacaagagtttcaaaaggtgttcgtgatgccaaacatggatgacgtttatatcacaattatgcactctgccatggatcccaggtctacatcatgtctgctaaaagaccctccggtcgaggcagccgatcagccatag

SEQ ID NO: 46776 - DNA, 591 bp, Artificial Sequence
  Description of Artificial Sequence: Synthetic coding sequence
atgtggttcatgtacctgctgagctggctgagcctgttcatccaggtggccttcatcacgttggcagtcgctgccggactctactatctcgctgaactcatcgaggagtacacggttgcaactagccgcattattaagtatatgatatggttcagcactgcagtactaatcgggctgtatgtgtttgaacgcttccccacgtccatgattggggtaggcctgttcaccaacctggtttatttcggcctgttacagacttttccctttatcatgctgacaagcccaaatttcatcttgagctgtggcctggtagtggtcaatcactacctggcgttccagttctttgccgaggagtactatcctttctccgaagtgctcgcatacttcaccttttgtctgtggatcatcccatttgcattctttgtgtccttgtcagccggcgagaacgtgttgccaagcactatgcagcccggggacgatgtcgtttcaaactacttcactaagggcaagagggggaagaggttgggaattctggtggttttcagctttattaaggaggctatcttgccttctcgccaaaaaatctactag

SEQ ID NO: 46777 - DNA, 1233 bp, Artificial Sequence
  Description of Artificial Sequence: Synthetic coding sequence
atggtgctgaaggccgagcacacccggagccccagcgccaccctgcctagtaacgttcccagctgtcgaagtctgtcgtccagtgaggatggccccagtggacccagctcattggccgatggaggcctcgctcacaatctgcaagactcggtgaggcaccgtattctgtaccttagtgaacagctgagggtcgagaaggctagccgggacggaaataccgtgtcttacctcaaattggtgagtaaggccgacagacatcaggtgcctcatatacagcaggccttcgagaaggtgaatcagagggccagcgccaccatcgcgcagatcgagcacagactgcaccagtgtcaccaacagctgcaagaactcgaagaagggtgcaggcccgaaggactcttgctgatggccgagtccgatccagccaactgcgagcccccgtcggagaaggcactcctcagtgaaccgcccgaaccagggggagaagatgggcctgtaaacctcccccacgctagtagacccttcatacttgaatccaggttccaatccctgcaacagggcacctgcctcgagaccgaggatgtggctcaacaacagaacctactgctgcagaaagtgaaggccgagctcgaggaggcaaagagattccatatttcattgcaggagagctaccactcccttaaagagaggtccctgactgacctgcaattactcttggagtcacttcaagaagagaaatgccggcaggctctcatggaagaacaggtcaacgggcgcttgcagggccaattgaatgaaatctataacctcaagcacaatctcgcctgctcagaggaacgaatggcttacctttcatacgaacgggctaaggagatttgggagatcacagagactttcaaatcccgcatttccaagctcgaaatgctgcagcaggtgacacagctcgaggccgctgaacatctccagtctagaccacctcagatgctgttcaagttcctgagcccaaggctttccttggccacagtgctgctggtctttgtatccacgctttgtgcctgtccgagctctctaatatcctcacgtttatgcacctgtacaatgctcatgctgataggactcggggtcctggcctggcaacgctggagggcgatacctgctaccgactggcaagagtgggtacctagcagatgtcgactgtattcgaaggactctggccccccggctgatggcccttag

SEQ ID NO: 46778 - DNA, 1233 bp, Artificial Sequence
  Description of Artificial Sequence: Synthetic coding sequence
atggtgctgaaggccgagcacacccggagccccagcgccaccctgccatccaacgttccatcctgcagatcactgagcagcagtgaggacggaccgagcgggccctcatcattggccgacggcgggctcgcacacaacctgcaggattcggtgagacatcggatcctgtatttgagcgagcagctgcgcgtcgagaaagcatcccgcgacggcaacacagtctcataccttaagctggtatccaaggccgaccgccaccaggtaccacatattcagcaggcttttgagaaggtcaaccaacgggcatctgccaccatcgcccagatcgagcatcgcctgcaccagtgtcaccagcagctacaggaactggaagaggggtgccggccagagggtctcctcctgatggccgaatcggatccagccaactgcgagccgccaagcgagaaagcactcttatctgagccacctgagccagggggcgaagacggccctgtcaaccttccgcatgcatctagaccgttcattctggagagccgcttccagagcctccaacaaggaacctgtcttgaaaccgaggatgttgcacaacagcagaacttactgcttcagaaagtgaaggcggagctagaagaagccaagcgattccatatatcactccaggagtcctatcattcgctgaaggaacgaagcctcacggatctacagcttctactcgagagtctacaagaggagaagtgccgtcaggctctgatggaggaacaagtgaacggacgcctgcaagggcagctgaatgagatttacaacttgaagcacaatttggcgtgctccgaagagaggatggcttacctgagttacgagcgcgcgaaggagatatgggaaatcactgaaacatttaaaagccgcatttcaaagctggagatgctgcagcaggtgacccagctggaagccgccgaacacctacagagcagaccccctcaaatgttattcaagttcctctcacctagactgtctctggctaccgtactcctggtgttcgtcagcaccctgtgcgcctgtccttctagcctcatcagttcacggctgtgtacctgtaccatgctcatgctgataggcctgggcgttcttgcatggcagagatggcgggcaatccctgctacggactggcaggagtgggtgcctagcagatgcagactgtactcaaaggacagcggcccccctgccgatggaccttag

SEQ ID NO: 46779 - DNA, 1068 bp, Artificial Sequence
  Description of Artificial Sequence: Synthetic coding sequence
atggaggagggcgagcggagccccctgctgagccaggagaccgccgggcaaaagcctttgtccgttcaccgacctcctacatctggttgccttggaccagtgccgagggaagaccaagctgaagcctggggttgttcctgctgtcctccagaaaccaaacaccaggctctgagcggaacaccaaagaaggggcctgcaccctcactctccccaggaagttcctgcgtgaagtaccttatatttttgtccaattttccgttctctctacttgggctgcttgcactcgccataggactgtggggcctcgctgtcaagggctcccttggctctgacctcgggggtcctttacccgccgatcccatgctgggtctggccctcggggggctggtggtgtctgcagttagcctggctgggtatctgggtgccttgtgcgaaaatacatgccttttacgtggcttcagtgggggcattctcgccttcctggtcctcgaggccgtggcaggagcacttgtcgtagccctgtggggtcctctgcaggacagcctggagcacacacttcgggtggcaatcgcgcactaccaggatgatcccgatttgcgttttctcttggatcaggtccagctcggcctcaggtgctgtggcgctgcatcttaccaggattggcaacagaacctctactttaactgctccagcccgggggttcaagcttgtagtttacccgcctcctgttgtatcgaccctagagaggatggcgcttctgtcaacgatcagtgtgggtttggggtgctgaggctggacgccgatgctgctcagcgggtggtgtatctggaaggctgtggaccgccgctgcgcaggtggctgcgggccaacctggccgctagtgggggatatgccatcgcggtagtcctgttgcagggcgctgaactgctcctggccgccaggttgctgggggcactggcggcgcgaagaggcgcggcgtatgggcccggggctcgcggggaggatagggccggcccacagtcccccagccccggagcaccccctgccgccaaaccagcccgaggttag

SEQ ID NO: 46780 - DNA, 708 bp, Artificial Sequence
  Description of Artificial Sequence: Synthetic coding sequence
atggaggagggcgagcggagccccctgctgagccaggagaccgccggccagaagccccttagcgtgcataggccgcccacatccggctgcctcggccctgtccctcgagaggaccaagcagaagcatggggatgctcctgctgtccacctgagactaaacaccaagccctgagtgggaccccaaaaaagggccctgcgcctagcttgtccccggggagttcctgtgtgaagtatctgatctttctctccaactttcccttcagcctcctaggcctgctcgcattagccattggactgtggggtctcgcggtgaagggctctttgggctctgatctgggcggtcccctgcccgctgaccccatgctgggactcgcattgggcggcctcgtggtgtcagccgtgtcactagcggggtacctgggcgctctgtgcgagaatacatgtcttttaagaggattctctggtggcatcctggccttcctggtgctggaagccgtggccggggccctggtcgtggcactctggggaccactgcaagattctctcgaacatacactgcgggtagctattgcccattatcaggacgatcctgacctccgatttctgttggaccaagtgcagttgggcctaaggtgctgcggagcggcatcttatcaggactggcaacagaatttatactgtttatcatccccttgctcaagtcagtag

SEQ ID NO: 46781 - DNA, 762 bp, Artificial Sequence
  Description of Artificial Sequence: Synthetic coding sequence
atggcccactacaagaccgagcaggacgactggctgatcatctacttgaaatacttactgtttgtttttaactttttcttctgggtgggcggcgccgctgtccttgcggtcggtatctggactctggttgaaaagagcggctacttgtccgtcttggccagctccaccttcgccgcttccgcttatattctcatcttcgccggcgtgctggtcatggtaaccggatttctaggtttcggagctattctttgggaaaggaaaggatgcctcagtacatacttttgccttctgctggtcatatttctcgtcgaattagtcgccggcgttctcgcccatgtctactaccaacgcctttcagatgaactcaagcagcatctcaacaggactctagcagagaactacggacaaccgggagccactcaaatcactgcctcggtggaccggctccaacaggacttcaagtgttgcggctctaactctagcgcggactggcaacactctacctatatcctgctacgggaagccgagggaaggcaggttcccgatagttgctgtaaaaccgttgtcgtcaggtgcggccagcgggcccatccatctaacatatataaggtcgaagggggatgcctgaccaaactggagcagtttttggccgaccacctgttgctaatgggagcggtaggaattggcgtggcgtgcctacagatttgtggaatggtgctgacttgttgcctgcatcagcggttgcagcggcatttttattag

SEQ ID NO: 46782 - DNA, 732 bp, Artificial Sequence
  Description of Artificial Sequence: Synthetic coding sequence
atgcggagcggcggcggccggaacgcctgggacacccggggcgcctgtgagcaggtggggggagccgccgtcttggccgtaggcatatggacactagtggagaagagcggctacctgtcggtgttggcaagttcaacctttgccgcatctgcttatatactgatctttgctggagtgctcgttatggtgacaggcttcctgggctttggagcgattctgtgggaaagaaaggggtgtctgtccacttacttttgtcttcttctcgttattttcctagtcgaacttgtagccggtgtgctggcgcacgtgtattaccagaggctgtccgatgaactgaaacagcacttgaacaggacactggccgagaattacggccagcccggcgctacccagattacagcttctgtggatagactgcagcaggacttcaaatgctgcgggtctaattcctccgcagactggcagcattctacctacattcttttgagggaagccgaaggccggcaagtgccggactcatgttgcaaaactgttgtcgttcgctgcggacagagagcccaccctagtaacatatacaaagtggagggcggatgtctgacgaagctcgaacagtttctcgccgatcacttgctcctgatgggcgcggttggcatcggcgtggcctgccttcagatttgtggcatggtgctcacgtgctgccttcatcagcggctgcagcggcacttctactag

SEQ ID NO: 46783 - DNA, 762 bp, Artificial Sequence
  Description of Artificial Sequence: Synthetic coding sequence
atggcccactacaagaccgagcaggacgactggctgatcatctacctgaagtatttactttttgtattcaattttttcttttgggtaggcggtgctgctgtactggcagtgggaatttggactctcgtggagaagtccggttatttgtccgttctagcttcttctaccttcgctgccagcgcctatatccttattttcgctggagtgctcgtcatggtcacaggcttccttggctttggcgccatcctgtgggagagaaagggctgcttgtccacctatttctgtctgctgctggtgatctttctcgtggaattggtcgccggagtcctggcccatgtgtattatcagcgcctgagcgatgagttgaaacagcacctgaatcggaccctagcggaaaattatgggcagcctggggccactcagatcaccgccagcgtggatagactacagcaagatttcaagtgctgcggcagcaacagctccgctgactggcaacactctacgtatattctgttgcgggaagcagaagggcggcaggtgcctgactcctgctgcaaaacagtggtcgttaggtgcggccagcgcgcccacccatccaatatctacaaggtggaaggtggctgtttgacaaaactggagcagtttctggcagatcacctgctgctcatgggcgccgtgggaattggagtggcttgcctgcaaatttgtggtatggtcttgacatgttgccttcatcaacgactccagagacacttttactag

SEQ ID NO: 46784 - DNA, 642 bp, Artificial Sequence
  Description of Artificial Sequence: Synthetic coding sequence
atgcactactaccggtacagcaacgccaaggtgagctgctggtacaaatatttgctgttttcatacaacatcattttttggttggccggcgtggtttttcttggagtcgggctgtgggcatggagtgagaagggcgtgctgagtgatctcactaaggtgacaaggatgcatgggatcgacccggtggtgctggtcctcatggtgggggtggtgatgtttaccttggggtttgccggatgtgttggggcccttagggaaaatatatgccttttaaacttcaaccagtgttgcggcgcctatggtcctgaggattgggatctcaatgtttacttcaactgctcaggcgcttcatattctagagaaaagtgcggcgtgcctttcagctgttgtgtgccagaccctgcacaaaaagttgtgaatacgcagtgtgggtacgatgtcagaatccagttaaaatctaaatgggatgaatccatcttcaccaaggggtgcatccaggctttggaatcttggctgccaagaaacatatacattgtcgctggggtgtttatcgcgatttcgttgctccagattttcggaatattcttagctaggacgctgataagtgacatcgaagctgtgaaggctgggcaccatttttag

SEQ ID NO: 46785 - DNA, 813 bp, Artificial Sequence
  Description of Artificial Sequence: Synthetic coding sequence
atgcactactaccggtacagcaacgccaaggtgagctgctggtacaaatatctgttattttcctacaatatcatcttctggctggccggagtcgtgttcctgggtgtgggactatgggcctggtccgagaagggcgtcttgtcagatctcaccaaggtgactagaatgcatgggattgaccccgtggtgctagtgttaatggttggagttgtaatgtttacattaggtttcgccggctgcgttggcgcgctcagggagaatatctgcctgctgaacttcttttgtggaacgattgtgctcatcttctttctggaactcgctgtggccgtgctcgcatttcttttccaagactgggtccgcgacagatttagagaatttttcgagtccaatatcaagtcctacagggatgatatagatttgcagaaccttattgactccctgcaaaaggccaatcagtgttgtggcgcttatggtcctgaagattgggacctaaacgtatactttaattgttccggtgcctcatattcacgagaaaaatgcggagtccccttttcatgctgcgttccggacccagctcagaaagttgtgaacacccagtgcggctatgacgtgagaattcagctaaaatccaaatgggacgagtctatcttcaccaaggggtgcatccaggccctggagtcatggctgccacgtaacatatatatagtcgccggcgtttttattgccattagcttactgcagattttcgggatctttctcgcgaggactcttattagcgacatagaagctgtcaaggccggtcaccacttttag

SEQ ID NO: 46786 - DNA, 672 bp, Artificial Sequence
  Description of Artificial Sequence: Synthetic coding sequence
atggagcggaaggtgctgccctgcttcctgtgcctgttccagggcgtgcttagtgatctgacaaaagtgactcgaatgcacggcatcgaccctgtcgttctggtactgatggtgggggtcgtcatgttcaccttgggttttgctggctgtgtcggagccttaagggaaaatatctgcctccttaacttcttttgcggcaccattgtcctaatcttctttttagagttagctgtcgcggtcctggccttcctgttccaggattgggtgagggaccgcttccgggagtttttcgaaagcaacatcaaatcttacagggacgacatcgacctgcagaatctaattgacagcctccagaaggcaaaccagtgctgcggggcatatggcccagaagattgggatctcaacgtctacttcaactgttcaggagctagttacagtagggagaagtgcggtgttccattttcttgttgtgtgccagatcccgcccagaaagtggttaacacccagtgtggctatgacgtccggattcagctgaaatctaagtgggacgagagcattttcacaaaggggtgtatccaggccttggagtcttggctaccacgcaatatctatatagtggccggtgtatttattgctatatctctgctgcaaattttcgggatcttcctatag

SEQ ID NO: 46787 - DNA, 813 bp, Artificial Sequence
  Description of Artificial Sequence: Synthetic coding sequence
atgcactactaccggtacagcaacgccaaggtgagctgctggtacaaatacctgctattctcctacaatataatcttttggcttgctggcgtcgtcttcctaggcgtcgggctgtgggcctggtcggagaagggagtgctttctgacctgaccaaagtgactagaatgcatgggatcgatcctgtggttctggtgctgatggtgggagtggttatgttcactctaggctttgccggctgcgttggcgcgctcagagagaacatttgcctgctcaacttcttctgtggtacaatcgtgctgatattcttccttgaactcgccgtagccgtgctggcattcctgttccaagactgggtgcgagataggtttcgggaattttttgaaagcaacataaaatcgtacagggatgatatagatctgcagaacctgatcgattcactccaaaaggccaatcagtgctgtggagcttacggtcccgaagattgggacctgaacgtctattttaactgcagcggcgcatcatactcacgcgagaagtgcggtgtgccctttagctgctgtgtgcctgaccccgcgcagaaggtggtcaatactcagtgtggctatgacgtgaggatccagttgaagtctaagtgggatgaatctatttttacgaaaggatgcatccaggctttagaatcatggttacctagaaatatttacatagtcgccggcgtcttcatcgcaattagtctgctccagatctttggaatctttctggctcgaacactcatatctgatatagaggcagttaaggcaggtcatcatttttag

SEQ ID NO: 46788 - DNA, 450 bp, Artificial Sequence
  Description of Artificial Sequence: Synthetic coding sequence
atgcactactaccggtacagcaacgccaaggtgagctgctggtacaagtacctgctcttctcttataacatcatcttctggttggcaggagtagtgtttctcggtgtagggctttgggcgtggagcgaaaaaggagtattgtcagacctgactaaagtcactcgaatgcacggcatcgatcctgtcgtgctggtccaccccctttccggaagctgtcaaaggtacttttcatgccctgtgttcctatctcttgccttcctgtcgcacccaaaaaacctcccacggccatatgggtcactcccttttttcccgaggcaattgctgatctgggccgtctgcactccctcttttgcacctccaactatgccccacgtggccgagtcctgccttagtcagctcagtacactggcatttttctctctgtgcagtactaggcattgtacatcttag

SEQ ID NO: 46789 - DNA, 762 bp, Artificial Sequence
  Description of Artificial Sequence: Synthetic coding sequence
atgcactactaccggtacagcaacgccaaggtgagctgctggtacaaatacttgttgttctcatacaacataatattttggggcgtgttatcagatctcacgaaggtgaccaggatgcacggtatagaccctgtcgtgctagtgctgatggtgggagttgtgatgtttaccctgggctttgccggctgtgtaggcgccttgagggaaaacatttgtcttctgaattttttctgtggcactatcgtcctaattttcttcctggaattggccgttgccgtattggccttcctctttcaagattgggttcgtgataggtttcgagagtttttcgagagtaacataaaaagctatcgcgacgatatcgacctgcagaacttaatcgactccttacaaaaggctaaccagtgctgtggcgcgtatggacctgaggattgggacttgaatgtgtactttaactgctctggagcctcttattccagggagaaatgcggagtgccattttcatgctgcgtccctgaccccgcgcagaaagtcgtaaacacccagtgcggctacgatgttaggatccagctcaaatctaagtgggatgagtctattttcacaaaaggctgcattcaagcactggagtcatggcttcctagaaacatttatatagtcgcgggcgtgttcattgcaatctcccttttgcagattttcggcattttcctggcacgaacactgattagcgatattgaggctgtgaaggctggccatcacttctag

SEQ ID NO: 46790 - DNA, 813 bp, Artificial Sequence
  Description of Artificial Sequence: Synthetic coding sequence
atgcactactaccggtacagcaacgccaaggtgagctgctggtacaagtacttacttttttcttacaatataatcttctggttggcaggggttgtatttctcggagtcggcttgtgggcctggtcagagaagggagttctgtctgatttgactaaagtgacacggatgcatggcatagatccggttgttttagtgcttatggtcggcgtggtaatgttcaccctcgggtttgctgggtgcgtcggtgctctccgtgagaatatctgtctactcaattttttttgcgggacgatagttctcattttcttcctggagctggcggtcgctgtgttggcattcctgtttcaggactgggtccgagacagattccgtgagtttttcgagtccaacattaagtcctaccgtgacgacattgatctgcagaatctcatcgattctttacagaaagctaaccagtgttgtggagcttatgggcccgaagattgggaccttaacgtgtactttaattgctcaggcgcgtcttattcacgggaaaagtgtggcgtcccttttagttgttgcgtccccgacccagcccagaaggtcgtgaacacacagtgcggctacgatgttagaattcagctgaaatccaagtgggacgaaagcatattcactaaaggctgcatacaagccctcgagtcgtggctcccccgaaacatatacatcgtggccggggtgttcatagctatctctttgctgcaaatattcgggatcttcctagcaaggacgctcatatccgatatcgaagctgttaaggccggccaccatttttag

SEQ ID NO: 46791 - DNA, 444 bp, Artificial Sequence
  Description of Artificial Sequence: Synthetic coding sequence
atgcactactaccggtacagcaacgccaaggtgagctgctggtacaagtaccttctgttctcctacaacataatcttctggaatcagtgctgcggcgcgtatgggcctgaggattgggatttgaacgtgtattttaactgcagcggggcatcgtactctcgcgagaaatgtggggtgcccttttcctgttgtgtgcctgacccggctcagaaggtagtcaacacccagtgcggctacgacgtgagaatccagcttaagtctaagtgggatgaatccatcttcacaaagggctgtattcaggctctcgagtcttggttacctcggaacatctacattgtcgccggtgtgttcatcgcgatctcccttcttcaaattttcggcatttttttggcgaggacattaatttcagatattgaggccgtgaaggctggccatcacttctag

SEQ ID NO: 46792 - DNA, 738 bp, Artificial Sequence
  Description of Artificial Sequence: Synthetic coding sequence
atggccgagatccacaccccctacagcagcctgaagaagctgctgtcacttctcaacggatttgtggcagtgagcggcattatccttgtgggattaggtataggggggaagtgtggtggcgctagcctgactaatgtcctgggcctctcatccgcttatctgcttcacgtgggtaatctatgtcttgtaatgggatgtatcactgtcttgctgggctgcgccgggtggtatggtgccacaaaagaatctaggggtacacttttgttctgtatcttgtcgatggttatcgttctgattatggaagtgacagccgcaactgtggtgctgctgttcttcccaatcgtgggagatgtggctctcgagcatacatttgtcaccctgagaaagaattaccgcggctacaatgagcccgatgactactccacacaatggaacctggtaatggaaaagctgaagtgttgcggcgtaaacaattacaccgacttcagtgggtcttccttcgagatgactaccggacacacctacccgcgctcatgttgtaagagcatcggatccgtgtcctgcgacgggcgcgatgtttcacccaatgttattcaccagaagggatgcttccacaaattgctaaaaattacaaaaactcagagctttacgctgagcggctcttcattgggagccgctgtgattcagcgctgggggtccagatacgtggcacaggccgggctagagctcctggcctag

SEQ ID NO: 46793 - DNA, 483 bp, Artificial Sequence
  Description of Artificial Sequence: Synthetic coding sequence
atggccgagatccacaccccctacagcagcctgaagaagctgctgagtctgctgaacggcttcgtcgcagtgtccggaatcatcttagtaggacttgggattggtggaaagtgtggtggagctagcctgacaaacgtcctggggctgtctagcgcatacctgctgcatgtgggtaatttgtgtctggttatgggctgcattacagtactcctcgggtgcgccggttggtacggcgccacaaaggaaagccgcggcaccctcctgttttgtatcctgtctatggtaatcgtgctgatcatggaggtgacagctgcgaccgtagtgctgctattctttcccattgtcggcgacgtcgcattggaacatacctttgtgaccctgcggaagaactaccgggggtacaatgagcccgacgattattccactcagtggaacctcgttatggagaagggtctgtctaaatacttctttagctccctatag

SEQ ID NO: 46794 - DNA, 999 bp, Artificial Sequence
  Description of Artificial Sequence: Synthetic coding sequence
atgcccggcaagcaccagcacttccaggagcccgaggtgggctgctgtggaaaatacttcttattcggcttcaacatcgtcttctgggtgttaggcgccttgtttctcgccataggtctttgggcatggggagaaaaaggcgtgctcagcaatatcagcgcgttgacggacctgggagggttggatccggtgtggctgtttgtggtggtgggcggagtgatgtccgtccttgggtttgccggatgtataggtgccttgcgagagaacactttccttctgaagtttttttctgtatttctgggcttgatttttttcttggaattagctactggcatattggcgttcgttttcaaagattggatccgggatcagctgaaccttttcatcaacaacaatgtcaaagcctaccgggatgacattgatctgcagaacctcatcgatttcgcccaagagtattggtcttgctgcggcgccaggggccccaatgattggaatctgaacatttacttcaattgcactgatcttaatcccagtcgcgaacgctgcggcgtgccattttcctgttgcgtcagagaccccgcagaagatgttttaaacactcagtgcggttatgacgtgagactgaagttagttcgcggtgagctcgagcaacaagggttcattcacactaaaggctgcgtgggacaattcgaaaagtggctgcaggataacctgattgtagtggcaggagtctttatgggcattgcactactgcagatttttgggatttgccttgcacagaatctggtgtctgatatcaaggcagtcaaagcaaactggtccaagtggaatgatgattttgagaaccattggctgacaccaacaatcagtgaggtgctgtcaacagcagggccgcagcagaactccttgacaggcgcccctggaccggccccgccaagcagacacgtgtttttcggactgggagggctctaccctgaaccaacttttaaaaattggtag

SEQ ID NO: 46795 - DNA, 801 bp, Artificial Sequence
  Description of Artificial Sequence: Synthetic coding sequence
atgcccggcaagcaccagcacttccaggagcccgaggtgggctgctgcggaaaatacttcttgtttgggttcaatattgtgttttgggtgctaggagctctgtttttggccataggactatgggcatggggtgagaagggggtcctctcaaacatatccgcgttaacagatctggggggcctggacccagtgtggctgttcgtcgttgttggaggggtgatgagcgtcctcggatttgctggctgtatcggcgcattaagggagaacacctttctacttaaattcttctccgtgttcctcggtctcatcttcttccttgaattagccacaggcatcctggccttcgtgttcaaggactggattcgcgatcagctgaacctgtttataaacaacaatgtgaaggcatatagagatgatattgatcttcaaaacctcattgattttgcccaggagtactggtcttgctgcggggccagaggccccaacgactggaatctgaatatttactttaactgcactgatttgaacccttcacgcgagcgatgcggagtcccattctcctgctgtgtcagagatcctgctgaagatgtacttaatactcagtgtggctatgacgtgcggctgaaactggtgaggggagagctggaacagcagggtttcatacacacgaaaggttgtgtgggccagtttgaaaaatggctgcaggacaatttaatagtggtggctggtgtgtttatgggaatcgccttgctgcaaatctttggtatttgcttggctcagaaccttgagcagatggaatag

SEQ ID NO: 46796 - DNA, 990 bp, Artificial Sequence
  Description of Artificial Sequence: Synthetic coding sequence
atgcccggcaagcaccagcacttccaggagcccgaggtgggctgctgcggcaagtacttcttatttggtttcaacatcgttttttgggtgcttggcgctctgttcctcgctattggcttatgggcctggggagagaaaggggtgctgtcaaatatctcagccttgacagatctgggagggttggaccccgtgtggctatttgtggttgtcgggggcgttatgtccgtattggggtttgcggggtgtataggggcactgagagaaaataccttcttgttaaaattcttttccgtgttcctgggattgatcttttttttagagctcgcgaccggaattttggcctttgtttttaaggactggatccgcgaccagctgaatctttttatcaataacaatgttaaagcctaccgggacgacatcgaccttcagaacctcattgattttgctcaggaatattggagctgttgcggtgcaagagggccgaacgattggaatctgaacatctacttcaattgtacggatctgaatccatctcgagagaggtgcggggtcccattttcctgctgcgtcagggaccccgcggaagatgtgctcaacacacagtgtggctatgacgtacgactcaagctcgagctagagcagcagggcttcatacacaccaagggttgtgtgggacagttcgagaagtggctccaggataacctgattgtggttgcaggggttttcatgggtatcgctctgctgcagatcttcggtatatgtttagctcagaatctggtatctgacatcaaggctgtgaaggccaactggagtaagtggaacgacgatttcgagaatcattggttgactcccaccatatcggaggtgctctctaccgctggccctcagcaaaacagtctgacaggagctccagggcctgctccccccagcagacacgttttcttcggtctgggagggctgtaccccgagcctacttttaagaactggtag

SEQ ID NO: 46797 - DNA, 792 bp, Artificial Sequence
  Description of Artificial Sequence: Synthetic coding sequence
atgcccggcaagcaccagcacttccaggagcccgaggtgggctgctgcggaaagtacttcctattcggcttcaatattgtattttgggttttgggtgccctgtttctggccattggtctttgggcctggggcgaaaagggagtgctgagcaatatttccgccctgacagaccttggaggactcgaccccgtgtggcttttcgttgttgttggtggggtgatgtctgttctgggattcgcgggttgcattggagccctgagagaaaacaccttcctcttgaagtttttctctgttttcctgggcctcattttcttcctggaactcgctaccggaattttagccttcgtgtttaaggactggattagagaccagttaaatctcttcatcaacaataatgtgaaagcataccgggacgacattgacttgcagaatctcatagattttgcccaggagtactggtcatgctgcggagcgcggggccccaacgattggaatcttaacatctacttcaactgtacagatctgaatccatcccgggagagatgcggagtcccgttttcttgttgtgtaagggacccggccgaagatgtgctcaacacacagtgcggatacgatgtccgtctaaaactggagctcgagcagcaggggttcatccataccaagggctgcgtcggccagtttgagaaatggctgcaagacaatcttattgtggtggccggcgtcttcatgggaatagcgctgctgcagatattcggaatttgtctggctcagaatcttgaacaaatggagtag

SEQ ID NO: 46798 - DNA, 747 bp, Artificial Sequence
  Description of Artificial Sequence: Synthetic coding sequence
atggagggcgactgcctgagctgcatgaagtacctgatgttcgtgttcaactttttcatcttcctcggtggagcgtgtcttctcgctatcggaatctgggtgatggttgaccccactgggttccgggagattgtggctgctaacccattactccttaccggggcttacatactactagccatgggaggactgctgttcctgctgggctttctgggctgctgtggggccgtccgggagaacaaatgcctgttgttgttttttttcctgttcattctaattatatttttagctgaacttagtgctgccatcctggcattcatcttcagagagaatctgacaagggagttttttacaaaagagcttacaaagcactatcagggaaacaacgacacagatgtgttttctgctacttggaactcagttatgattacgttcggatgctgtggcgtgaacggccccgaggatttcaagttcgccagtgtctttcgtcttttgacgctcgatagcgaagaggtgccggaagcatgttgcaggagggaaccacagagccgagatggggtcctcctgtcccgagaggagtgcctactcgggcggtcgctctttctgaacaagcagggctgctacacagttatattgaacacgtttgaaacgtacgtgtatttagctggtgccctagcaatcggagtcctggccattgaactcttcgccatgatctttgctatgtgtctcttcaggggcatccagtag

SEQ ID NO: 46799 - DNA, 816 bp, Artificial Sequence
  Description of Artificial Sequence: Synthetic coding sequence
tgatggagcaccatggagggcgactgcctgagctgcatgaagtacttgatgttcgtgttcaatttcttcatttttcttggcggggcatgtctcttagccataggaatttgggtcatggtggacccaacgggtttcagagagattgtggctgcaaacccactgttgttgactggggcctacatcttgctggcaatgggcgggctcctattccttttaggcttcctcggctgttgcggtgccgtacgcgaaaataaatgcttgctgctgttcttcttcttgttcattctgatcattttcctggcagagctgagtgcagccatcctggcgtttattttcagagagaacctgacgagggagttcttcactaaagaactaacaaaacattatcaggggaacaacgatacagatgtgttctcagccacatggaactcagtcatgattacctttggctgttgtggagttaacgggcctgaagatttcaagttcgccagcgtcttcaggctgctgaccctggacagcgaggaagtacccgaggcttgctgtagaagggaacctcagtccagagacggagtcttactctctcgcgaggaatgtttattaggcagatcgctgttcctgaacaagcaaggttgttatacagttattctgaacactttcgagacatacgtatacctggctggggctctagctatcggggtgctcgcaattgaagaagagagggcccactccgtgtcgcaggccactggcattctttatcagctaccggcctctcctcaagcttttcagagtccaggaactttaggggcaaccgcgtag

SEQ ID NO: 46800 - DNA, 747 bp, Artificial Sequence
  Description of Artificial Sequence: Synthetic coding sequence
atggagggcgactgcctgagctgcatgaagtacctgatgttcgtgtttaacttcttcatcttcctcggaggagcctgcttactggccattggaatttgggtgatggttgacccaaccggcttccgcgaaatcgtggccgccaatcccctgctcctcaccggggcatacatcctcctcgcaatgggagggctccttttcttactcggattcctcgggtgctgcggtgccgttcgcgaaaacaagtgtctgctccttttcttcttcctgttcatcttaatcattttcctagctgaactgagcgccgcaatcctggctttcatcttcagagagaacctgacgcgcgagttcttcacaaaggagcttacaaagcactaccagggtaataatgacacagatgttttcagtgccacgtggaactcggttatgatcaccttcgggtgctgtggagtgaacggcccagaggatttcaagtttgctagcgtttttcggcttttaaccctggattccgaagaggtgcccgaggcctgctgtcggagagaaccacagagccgggatggtgtcctgttgtcacgtgaagaatgcctcctcgggcggtccctgttcctcaacaaacaaggctgctataccgtcattttgaacacattcgaaacgtacgtgtacctcgcaggcgcgctggctattggagtgctcgccattgagcttttcgcaatgatctttgcgatgtgcctattcaggggtatccaatag

SEQ ID NO: 46801 - DNA, 240 bp, Artificial Sequence
  Description of Artificial Sequence: Synthetic coding sequence
atggagggcgactgcctgagctgcatgaagtacctgatgttcgtgttcaacttttttatttttctggggggtgcatgtctactggccattgggatatgggttatggttgatccgacgggcttcagggagatcgtcgctgcaaatcccttgctgctgactggcgcatatatacttctcgcaatgggcgggttgctgttcttactgggtttcctcggatgttgcggcgctgtgagagaatag

SEQ ID NO: 46802 - DNA, 441 bp, Artificial Sequence
  Description of Artificial Sequence: Synthetic coding sequence
atggagggcgactgcctgagctgcatgaagtacctgatgttcgtgttcaatttttttattttcctgggcggagcttgtctccttgcaatcggcatctgggtgatggtggaccctacaggatttagagagatcgtagcggccaatcccttactcctgactggggcttatatcctcctcgccatgggcgggctgctgttcctgctgggattcttgggctgttgtggcgccgtccgcgagaataaatgcctgctccttttcttttttctattcatactgattatttttctcgctgagctttcagccgctatcctggcctttattttcagagagaacttaacacgggagttctttactaaggaactgacaaagcactatcagggcaataacgacaccgacgttttctccgcaacctggaacagcgtgatgatcacagttagctag

SEQ ID NO: 46803 - DNA, 852 bp, Artificial Sequence
  Description of Artificial Sequence: Synthetic coding sequence
atggcccggcggccccgggcccccgccgccagcggcgaggagttctcattcgtgagtcccttggtgaagtacctgctgtttttcttcaacatgctgttttgggtgattagcatggtcatggtagccgtgggggtgtacgctcggctgatgaaacatgccgaagccgctcttgcttgtctagcagtagacccagctattcttctcatcgtggtgggggtgctgatgttcctgctgaccttttgtggctgtatcggatccctccgggagaacatttgcctcctccagaccttttctctgtgtctcaccgcagtttttctgcttcagctggccgctggcattctaggatttgtgtttagtgacaaggctagggggaaggtgtcggagattattaacaatgcaatagtgcattatagggatgacttagacttacagaatctgatcgattttgggcagaaaaagttctcttgttgtggcggaatttcgtacaaggattggtctcagaacatgtatttcaactgttccgaagataaccctagcagggaaagatgctccgtgccctactcgtgctgcctgcctacacccgaccaagccgtcatcaacaccatgtgtgggcagggaatgcaggcattcgattatctggaagctagcaaagtcatttatactaatggatgcatagacaagctagttaactggatacactccaacttatttctgctgggcggcgtggcgttgggcttggcaatcccccagctcgtggggatcctattgtcccaaatcttggtcaatcagatcaaagaccagatcaagctacagctgtataatcaacagcacagggctgatccgtggtactag

SEQ ID NO: 46804 - DNA, 1338 bp, Artificial Sequence
  Description of Artificial Sequence: Synthetic coding sequence
atggccgagtacgacctgaccacccggatcgcccacttcctggaccgccacctagtgtttccgttgctggagtttcttagcgtgaaggaaatttataatgaaaaagagctcctccaggggaagctggatctgctgtctgatacgaatatggtggactttgctatggatgtctacaaaaacctgtattctgacgacattccacacgcactcagggagaagagaactactgtagtggcacagcttaagcagctgcaggccgaaacggagcccatcgttaaaatgtttgaggaccccgagaccactagacagatgcagtccacgagagatggccgtatgttgtttgactatctggctgacaaacacggtttcagacaggagtacctagacaccctctaccgctacgcgaagtttcaatatgagtgcggtaactactccggtgcagccgagtacttgtatttttttagggtcctggtacctgccactgatcgtaacgccctttccagcctgtgggggaaactggcaagcgaaatcctgatgcagaattgggatgcagcaatggaggacctgacgagactgaaggaaacaattgacaataacagcgtctccagcccgttgcagtccctacagcagcgcacctggcttatccactggtccctcttcgttttttttaaccaccccaagggtcgtgacaacattattgacctcttcttataccagccccagtatctcaacgcgatccagaccatgtgccctcatatcctgaggtatctgacaaccgcggtcatcacaaataaagacgtgcgtaagagaaggcaggttctgaaagatctggtgaaggtaatccagcaggagtcctacacctataaagacccaatcacagagttcgtcgagtgcctttacgtgaatttcgactttgacggggcacaaaagaagctcagggaatgcgagagtgtactagttaacgatttctttctggttgcctgcctcgaggatttcatcgagaacgccagactttttatattcgagactttctgcaggatccatcagtgtatctccatcaacatgttggcggataagttgaatatgactccagaggaggcagagcgatggatcgtgaatctgattcggaatgctagactcgatgcaaaaattgattcgaaactggggcatgttgtaatggggaacaatgctgtcagcccgtaccagcaggtgattgaaaaaacaaagtctctgtccttcaggtctcagatgctggccatgaatatagaaaagaagctgaatcaaaattcaagaagcgaggctcccaattgggctactcaagattccggcttctactag

SEQ ID NO: 46805 - DNA, 5586 bp, Artificial Sequence
  Description of Artificial Sequence: Synthetic coding sequence
atgctgaaggccgtgctgaagaagagccgggagggcggcaagggcggtaagaaggaagctggatctgacttcggccctgagacatcccccgttctacatctagaccactccgccgactcacccgtttcttctctccccaccgcggaggatacataccgcgtgtccttagctaaaggtgtgtcgatgtcattgccctctagccctctacttccccggcagtcgcatctagtgcagtcacgggtgaacaaaaagtctcctggtcccgtacgaaagcccaagtatgtggagtccccacgggtgcccggcgacgccgtcattatgccgtttcgtgaagtagcaaagcccactgagcctgacgagcatgaggcgaaggccgataatgagcctagctgttcccctgccgcccaagagctcttgacacgtctcggattcctactcggtgagggcatacccagtgctactcatatcacaattgaagataagaatgagactatgtgtactgcactctcgcaagggatttccccttgtagcactttgacctcttccactgcttcgccatcaaccgactcaccctgttccactctaaattcttgcgtgagcaaaaccgcagctaacaagagcccctgcgaaacaattagctcgccctccagtacactagagtcgaaggactccgggatcatcgccaccatcacctcttcctccgaaaacgacgacagatccggctcttctctggaatggaataaagacgggaacctgcgccttggcgttcagaaaggcgtgctccacgaccgcagagccgacaactgctcccctgtggccgaggaagaaacgaccggctctgcagagagcaccctgcccaaggcggagagcagcgcaggcgacggaccagtgccgtactcccagggcagtagctccttaatcatgcctcgccccaattcagtcgccgcaacgagttcgaccaagctagaggatctgtcgtacctcgacggacagaggaacgccccgctacggacaagcattaggttgccatggcataatactgcaggcgggcgggctcaagaggtcaaggcccgttttgcaccatacaagccacaagatatcttgctgaagcccctgctattcgaggtgccctccattacaaccgacagcgttttcgtgggaagggattggctcttccatcagatcgaggagaaccttcggaataccgagctggctgagaatagaggcgcagtcgtggtcgggaacgtgggatttggcaagactgccatcatctcgaaactcgtggcgctcagctgtcacggttcccgcatgcggcaaatagcaagcaattctccagggtccagtccaaaaacaagcgatccaactcaagatctccactttacgccccttttgtctccatcgtcatctacaagcgcaagctcaacagcaaaaacccctttaggctccatcagtgcggaaaatcagaggccccgtgaagacgcggtgaagtacttggcctctaaggtcgttgcctaccactattgccaagcagataatacctatacttgtttggtacctgagtttgttcatagcatagccgccctgctatgccgatcgcaccagttggcagcatacagggacttgctcattaaagaacctcagctgcaaagcatgctcagtttgcgaagctgcgtacaggatcccgttgcagctttcaagcggggtgttctggagcctctgactaatctgcgtaacgagcagaaaattcctgaggaggagtatattatcctcattgacggtcttaacgaagcggagttccacaagccagactacggcgatacattgtcttccttcataaccaagattatcagtaaattccccgcctggctgaagctcatagtgactgttagagctaattttcaagagatcatcagcgccctgccgttcgtcaaattgagcctggacgattttcccgataacaaggacattcatagcgatctccatgcttacgttcagcatagggtacactcatctcaggacattctgtctaacattagcctgaacggcaaggccgatgctacactgattggcaaggtgtcatcccatttggtactgagaagtctaggttcttacctgtacttgaaactgactttggatctcttccagcgcggtcaccttgtgattaaatcagcctcatataaagtggttcctgtttccctgagtgagctgtacttgttgcagtgtaatatgaagttcatgacacagtctgcattcgagcgcgccctcccaattttgaatgttgccctcgcctcgctgcacccgatgactgatgaacagatctttcaggccatcaatgcaggacacattcagggagagcaaggctgggaagacttccagcaacggatggacgcactatcctgcttcttaattaagaggcgcgacaagacccgaatgttctgccacccatcattcagggaatggctggtgtggcgtgccgacggagagaacaccgcatttctgtgtgaacctcgcaacggacatgctctgctcgcatttatgttctctagacaggagggcaaactgaatagacagcaaactatggaactaggacatcacattcttaaagcgcacattttcaaggggttaagcaagaagaccggcatctcatcttcacatctccaggcactctggatcgggtatagtactgagggtctatctgcagctctcgcaagcctaagaaatctctacactcccaatgtgaaggtgagtcgacttctaattttaggcggcgccaatgtcaattaccgcacagaggttcttaacaatgcccctatactgtgcgtgcaatctcacctgggccatgaagaagtggtcacactgctcttggaattcggagcttgcctggacgggaccagcgagaatggcatgactgcactctgttacgccgctgcggcagggcatatgaagctcgtctgtcttctcaccaagaagggagtgagggtggaccatctggataagaaggggcaatgtgccctggttcatagcgccctgagaggccacggagacatcctccagtacctcttgacctgtgaatggtcgccaggtccacctcagcccggcactctccgaaagagccatgccttgcagcaggccctgacggccgctgcgtcaatggggcattcatccgtagtgcaatgtttgttgggcatggaaaaggagcacgaagttgaagtgaacgggaccgataccctctggggagaaactgccctaaccgctgctgccggacggggtaagctggaggtgtgcgaactgctcctggggcacggggcggccgtgagtcgaacaaataggcgcggcgtgcccccactgttttgcgctgccaggcagggccactggcagattgtgcggctgctgttggaaaggggatgtgacgtcaacttatcagacaaacagggcagaaccccactgatggtggctgcttgcgaaggccatctatctacggtagaatttctgctcagcaaaggagctgcactgagcagtctagataaggagggcctcagcgctttgagctgggcttgtctgaaaggtcacagggccgtggttcagtatcttgtagaggaaggagcggcgatcgaccaaaccgacaagaatgggcggaccccactggacctcgccgcgttctatggcgacgccgaaaccgtactgtacttagtcgagaagggagcagtgatagaacatgtggaccacagtgggatgagacctctggatcgcgctatcgggtgccgaaacacgtccgttgtcgttgctcttttacgtaagggagcaaagttgggaaacgctgcctgggccatggctacctctaagccagatatactaattattctgttgcaaaagcttatggaagagggcaacgtgatgtataagaagggcaagatgaaagaagcggctcagcgatatcagtacgcgctccgcaaatttcctcgcgagggttttggtgaggatatgaggccgttcaatgagttgcgggtgtccctatacctgaacctgagtaggtgcagacggaaaaccaacgatttcgggatggcggaggaatttgcttcgaaggcccttgaactaaaacctaagagttacgaagctttttatgcgcgagcccgggccaagaggaatagtcgacagttcgtggctgctctggccgacttacaggaggcagtcaagctttgtcccactaatcaggaagtgaagagacttctcgcgcgtgttgaggaagagtgcaagcagttgcagaggtctcagcagcagaagcagcaaggacctctgccggctcccttaaatgactcggagaacgaagaagacacccctacccctgggctttcagatcacttccatagcgaagaaactgaggaagaagaaacgtcccctcaagaagagtcggtcagtcccactcctaggagtcagccctccagcagcgtcccatcctcatacatcagaaatcttcaggaaggactccagagcaaaggtagacctgtgtctccacaatctcgcgctggcatcgggaaaagtctcagagagccggtagcccagcctggcctactgctgcagccatctaaacaggcccagatcgtgaagacctcacaacacctcggttcaggccagagtgcggtgcgcaacggctcaatgaaggtgcagatttcttcccaaaatcctcccccatcacctatgccaggccgcattgctgcaacccccgctggtagtaggacacagcatctggagggcacggggacattcactacccgcgccggctgtggacactttggagacagattggggccttctcagaatgttcgcctgcagtgtggcgagaatggtcccgcacaccccctcccctccaagacaaagactactgaaagactgctgagccatagttccgttgccgtcgatgcagctcctccgaatcagggcggcctcgcaacctgtagcgacgtaagacaccccgcctcactgacgtcgtccggctcttccggaagcccttccagttcaattaaaatgtcctcttcgacaagctccctgaccagcagttcttcgtttagtgatggattcaaggtgcaagggcctgatacgcggatcaaagacaaggtggttacgcacgtgcaatccgggacagccgagcatcgccctcgtaacactccattcatgggtatcatggacaaaactgcacgcttccagcagcagtctaaccccccctcacggagttggcactgcccggccccagaggggctgctgactaatacgtcttctgcggccggacttcaatctgctaacaccgagaaaccgtcgctgatgcaagtgggaggctataataaccaggccaagacctgcagcgtatccaccctcagtgcaagcgtacacaacggcgcccaagtcaaagaattagaggaaagtaagtgtcagatacccgtccattcccaggagaatcgtattacaaaaaccgtctcacacctctatcaagagtcgatatctaaacagcaaccacatatttctaacgaagctcaccgctctcatcttaccgccgccaaaccgaagcgatctttcatcgaatccaacgtgtag

SEQ ID NO: 46806 - DNA, 5268 bp, Artificial Sequence
  Description of Artificial Sequence: Synthetic coding sequence
atgctgaaggccgtgctgaagaagagccgggagggcggcaagggcggcaaaaaagaggctgggagcgacttcggccctgaaacctcccccgtgctgcacctggatcacagcgccgactcccccgtttccagcctgcctacagcagaggacacgtatcgcgtcagcctagccaaaggcgtcagcatgtccctgcccagctctcctctattgccccgacaaagccatttagtgcagtctcgcgtgaataagaaaagcccgggaccggtgcgaaagcccaagtacgtcgaatcacctcgagtaccaggcgatgctgtgattatgccatttcgagaggtagctaagcccacggagccagacgagcacgccaccatcacgtcctcaagcgagaatgacgatcgctccggatcgtcactggaatggaacaaggatggcaacttgagactgggggtccagaagggagtgctccatgacagaagggcagacaactgctccccggtagccgaggaggagacgactggctccgctgagagtaccttgcccaaagctgagtcaagtgctggcgatggcccagtgccctatagccagggatcgagtagcctgataatgccaagaccaaacagtgttgcggcgacaagtagtacaaagctggaagacctcagttaccttgatggacagcgcaacgcaccactgaggacgagcattagactcccctggcataacactgcaggaggcagagcccaagaagtgaaggcccgcttcgcaccgtataaaccacaggacatcctgctgaaaccgttgctgtttgaggtaccaagcattacaacggatagtgtattcgtcggccgtgattggcttttccatcagatcgaagaaaatctgcgcaacaccgaattggccgagaatcgaggagcggtggttgtggggaatgtgggcttcggaaaaaccgctataatctcaaagctggtggctcttagctgtcacggatctagaatgagacagattgcctctaacagtcctggcagttccccaaagacttcagacccgacacaagatctccattttactcccctcctcagcccatcttcttccacaagcgctagcagtactgctaaaacccccttagggagcatctcagcagagaaccagagaccgagggaagacgcagtgaagtacctggctagtaaagtcgtcgcctatcactactgtcaggccgataacacatatacttgcttggtgcccgagttcgttcactctatcgcagccttgctctgccggtcacatcagctggctgcatatagagatctcctaattaaagagccacaactgcagtcaatgctgagcttacggtcctgcgtacaggatcctgtggccgcctttaagcgaggggtccttgagcccctgacaaatctccgcaatgagcagaaaattcccgaagaggaatatattattctgattgatggcttaaacgaagcagagttccataaacctgactacggagacaccctttcatctttcattaccaaaatcatttccaagttccctgcatggctcaaacttatcgtgacagttagagccaactttcaggagatcataagtgctttgccatttgtcaaactctccttagatgactttcctgataataaagatatccatagcgatcttcacgcctacgtccagcaccgggtgcattctagccaggatatactgagcaacatctcccttaatggaaaagccgatgccacactgattgggaaggtgagttcacatctggtccttcgcagtttgggttcgtacttatacctcaaactgacccttgatctctttcagcggggccatcttgtcatcaagtccgcttcatataaggttgtccctgtctccctgtccgagctgtacctcctgcagtgcaatatgaagtttatgactcagtcagccttcgagcgggccctgccgatcctgaatgtagctctggccagcttgcaccccatgactgatgagcagatcttccaagccattaatgccgggcatatccaaggggagcaggggtgggaggactttcaacagcgtatggacgccctttcctgttttttaatcaaaagaagggacaagaccagaatgttctgtcacccatctttccgcgaatggttggtgtggagagccgatggcgagaacacagctttcctctgcgaacccaggaacggacacgcccttctcgccttcatgttctcaaggcaggaagggaaacttaatcggcagcaaactatggaactcggccaccacattcttaaagctcacatctttaaaggcctgagcaaaaagaccggcatctcctcatcccacctccaagccctgtggataggttacagcacagagggtctgagcgctgcccttgcctcgctgagaaatctgtacacccccaacgtgaaggttagccggctcctgatcctgggcggtgctaatgttaactatagaaccgaggtgctgaacaacgcgcccattctgtgcgtgcagagccacctggggcacgaggaggtcgtaactctcttgctggagtttggcgcctgcctggacgggacatcagaaaacggcatgaccgccctttgctatgccgctgccgccggacatatgaagctcgtttgcctgctgactaagaagggagtcagggtggatcatcttgacaagaagggtcagtgtgctttggtgcactcggccctgagaggacacggggacattctgcagtatctccttacgtgtgagtggtcccccggccccccccagcccggtacccttaggaaatcccacgctcttcagcaagcactgacagccgctgcctctatggggcattcctccgtcgtccagtgtttgctggggatggagaaggagcatgaagtggaagtgaacggaacagataccctgtggggcgagactgcactgacagcggccgcagggaggggaaagctggaggtgtgcgaacttctgttgggccatggggctgccgtctccaggacaaataggagaggcgtccccccccttttttgcgccgccaggcaaggccattggcagatcgtgcgcctgctgctagagagaggctgcgatgtgaacctatcggacaagcagggaagaacaccccttatggttgcagcctgcgagggacacctgtctaccgttgagttcctcctctccaaaggtgccgcattgagcagtctcgacaaagaggggctgagtgctctgtcgtgggcctgtctcaaaggccacagggctgtggttcaatatctggtcgaagagggcgccgccattgaccaaacagataagaatggacggactcctctggatctggctgctttttatggtgatgcggagacagtcctgtacctggttgaaaaaggcgctgttatagaacacgtggatcactccggaatgagaccattagatcgagcaatcgggtgtcggaatactagcgtggtggtggccctgctgcgcaaaggagcaaagctgggcaatgctgcttgggctatggccaccagcaagccggacattctaataattttactgcagaagttgatggaggaaggcaacgtgatgtataaaaaaggtaaaatgaaggaagccgcacagcgctaccagtatgccctcagaaagttcccacgggagggctttggagaggatatgcgcccattcaatgaactcagagttagtctttacctcaacctgagccggtgtcggcgcaagacgaatgatttcggaatggccgaagagtttgcctcaaaagcactcgaacttaaaccgaagagttacgaggctttctacgccagggctagagccaaacgtaacagccggcagttcgtggccgctctcgcagacctgcaggaggctgttaagctgtgtcccacgaatcaggaggttaagcgtctcctcgctagagtcgaagaggagtgtaagcagctgcagcgtagtcaacagcagaaacagcaaggacccttacccgctccgctgaacgactccgaaaacgaagaggacacaccgaccccgggactgtcagaccattttcatagcgaggagaccgaggaagaggaaacatccccgcaggaagagagtgtcagtcctacccctcggagccagccgtcgtcctccgtgccatcgtcttacatccgcaacctccaggaaggcttgcaatccaaggggcggccagtgtcgccccagagtagagccggcatcggaaaaagcctcagagagcccgtggcccaaccaggccttttgcttcaaccctccaagcaggcccagatcgtgaagacatctcagcacctcggcagcgggcaatcggccgtcagaaacggcagcatgaaggttcagatctccagtcagaaccctcccccaagcccaatgccggggagaatcgcagcaacccctgctggtagccgcacccagcacctggaagggaccggaactttcacaacccgggctggttgcggtcatttcggggatagactgggcccctcccagaatgtaaggttgcagtgtggcgaaaatggaccggcacaccccctgcctagtaagactaagaccactgagcggctgttgtcacattctagcgtggccgtggacgctgcccctcctaatcagggaggtctggccacctgcagtgacgtgagacatcctgcctctcttacttcttccggaagtagcggtagcccgagtagtagcatcaagatgagctccagcacctcttctctcaccagttctagttcgttttcagatgggttcaaagtgcagggacccgacacacgcataaaggacaaggtggtcacccacgtgcagtctggcacagctgaacatcgtccccgtaacacgccattcatgggtattatggataagacggcaaggttccaacaacagtccaatccgccttcacggtcgtggcactgccctgccccagaaggactgctgaccaatacctcttcagctgccggactgcaatcggccaataccgaaaaacctagcctaatgcaagtcggaggctacaacaaccaggccaagacatgctctgtttccacgctgtctgcatccgtacacaatggcgcccaagtcaaagagctggaagagagtaagtgccagattcctgtccatagccaggagaatagaattaccaagaccgtgtctcacttgtaccaggagagcattagcaagcagcaaccgcacatatcaaatgaggcacataggagtcacctcactgctgccaaaccaaaacgatcttttattgaatcaaatgtctag

SEQ ID NO: 46807 - DNA, 2139 bp, Artificial Sequence
  Description of Artificial Sequence: Synthetic coding sequence
atggcccagagcagcccccagctggacatccaggtgctgcacgacctccggcagcggtttccagagatccccgaaggcgtggtctctcaatgcatgctccagaataataacaatctggaagcatgctgtagagctctctcccaggagtcatccaagtatctctatatggagtatcactctcctgatgacaacaggatgaatcggaatcgcctgctgcatatcaacctaggaattcatagtccaagttcataccaccctggggatggtgcacagctgaacggtggacggactctcgtgcactcctcaagcgacggacacattgaccctcagcacgcggcgggtaagcaactcatatgcctggtgcaggaacctcatagtgctccggcggtcgttgccgccacgcccaactacaatccgtttttcatgaatgagcagaatcgcagcgctgccacacctccctcacaacccccacagcaaccatcgagtatgcagacagggatgaacccctccgccatgcaggggccgagtcctccacctccaccacctagctatatgcacataccccggtactccaccaacccgattaccgtgaccgtgagccagaacctccctagcggacagaccgtgccacgagctctgcagatcttgccgcaaatcccttctaacctgtatgggtctccaggtagtatctatatacggcagacttcacagtcctcctcaggacgccagaccccgcaaagcacaccttggcagtctagccctcagggccccgtgccacattactcacagcgaccactccctgtgtacccacatcagcagaattatcagcctagccaatactcgcctaaacagcagcaaatcccccagtctgcctatcattcgccgccccccagccagtgtcctagccctttttcctccccacagcatcaagtccaacccagccagctcgggcatatcttcatgcctccttctccctctacaactccacctcacccataccagcagggccctccgtcttatcagaaacagggctctcacagcgtggcctatctcccttatacggcctcttctctgtccaaaggaagcatgaaaaaaatagagataacagtcgaaccatctcagagacccggtacggccatcaatcggagtccctcacccatcagtaaccagccaagcccttggaatcaacacagcctgtatacagctaccacacccccctcatcatcgccaagccgcggcatttcctcacagccaaaacccccattttccgtcaaccccgtatacataacctatactcagcccaccggtccttcctgtacacctagcccctctcctagagtcattcccaacccaaccactgtatttaagatcactgttggaagagctaccacagagaacctgttgaacttagtggaccaggaggaaaggtccgccgcccccgaaccaatccagccaatctctgtgattcctgggagcggaggggaaaaggggagtcataaatatcagagatcgtcaagttctgggagcgatgactatgcatatacccaggcccttctccttcaccagagagcgcggatggaaaggctggcaaaacagctcaaactggaaaaggaagagctcgagaggctgaagagcgaagtaaacggaatggaacacgatctgatgcaaagaaggctgaggagggtgagctgcactacagccatcccaactcctgaagagatgacacgcctgaggtccatgaaccgccagttgcagatcaacgtggattgtacactgaaggaagtagatctgctccagagcagggggaacttcgatcctaaagcaatgaataatttttacgataatatcgaacccggacccgtggttccacctaagccttctaaaaaagactcatctgatccctgcaccatcgaaaggaaagctcggcgcatcagcgtgacatcaaaagtgcaggcggatatccatgatacacaggcggctgccgccgacgaacaccggaccggatctactcagtctccacggacccagcccagagatgaagactatgagggtgccccctggaattgcgactcttgcacctttctaaatcacccagcccttaatcgctgtgaacaatgtgaaatgccacgttatacctag

SEQ ID NO: 46808 - DNA, 252 bp, Artificial Sequence
  Description of Artificial Sequence: Synthetic coding sequence
atggagcacgacctgatgcagcggcggctgcggcgggtgagctgcacgacggccattccaacacctgaggaaatgaccagactgcggtccatgaaccgccagctgcagatcaatgtggattgcacactgaaggaggtagacctcctgcaatcccgggaagtttattactccaggagcagcttaaaactgagcttcacccagctgacacgcttggagatggtgtttatattttgtggaaagtataccgattag

SEQ ID NO: 46809 - DNA, 2139 bp, Artificial Sequence
  Description of Artificial Sequence: Synthetic coding sequence
atggcccagagcagcccccagctggacatccaggtgctgcacgacctacgccagaggtttccggagatcccagagggcgtggtgagccagtgcatgctgcaaaataacaacaatttggaggcgtgctgccgagcgctgtcccaagaaagttccaaatacctttatatggagtatcactctcccgacgacaatagaatgaatcggaacagactcctgcacattaacctcggtatacattctcccagtagctatcaccctggggacggagctcagcttaacgggggcagaaccctggtccatagctcctcggatggccatattgacccacagcacgcagcaggcaagcagttaatttgcctggttcaagaaccccactctgcgccagcagtggtcgcagccacccccaactataatcctttcttcatgaacgaacagaaccgatccgctgctacacctccaagtcaacccccacagcaaccctcatccatgcaaaccggaatgaatccatccgctatgcaggggccaagtcctccaccacctcccccttcctacatgcatataccacggtattctacaaatcccataactgtcacagttagccaaaacctaccatccgggcagactgtaccaagggcgcttcagatcctgccacaaatcccttccaacttgtatgggtctccaggctccatctatattcggcagacttcacagtcttcttctggccgacaaaccccccagagcacaccctggcagagctccccgcaaggtcctgttccacattatagccaacgcccattacccgtgtacccacatcagcagaattaccagccatcacagtacagccccaagcagcagcaaataccccagagcgcctatcatagtcctcctcctagccagtgcccatccccctttagttccccacagcatcaggttcagccctcccagctcgggcatatatttatgcccccctctcctagtaccactcctcctcacccataccagcaggggcccccctcttaccagaaacagggaagtcacagcgtcgcctatctgccctacactgcaagttctctgtctaaaggatccatgaagaagatcgagatcaccgtggagccttcccaacgccccgggacagcgatcaatcgatccccaagtccaatctctaaccagccatcgccttggaatcagcactctctttacacagccaccacacctcccagttcctctccatctcgtggcatctcttctcagcctaaaccacctttcagcgtaaacccggtgtacattacttatacacagcctacaggacccagttgcacccccagtcctagcccccgggtgataccaaatcctactactgtgttcaagatcacggtggggagagccacaaccgaaaacttgttaaacctggtcgaccaagaggaacggagcgcagcgccagaacctatccagcctattagtgttatccctggatctggtggggaaaaggggtctcacaaataccagcggagcagcagcagtggctcagacgactacgcttacacgcaagctctcctgttgcatcagagagcccgcatggaaagattagctaagcagctcaaactggagaaggaggaattagagcgccttaaaagcgaagtcaacggaatggaacatgatcttatgcaaaggaggcttaggcgggttagctgtacaaccgccatccctactcctgaggaaatgactcgcttgcgcagcatgaacagacagctccagatcaacgtagattgcacactcaaagaggtagatctattacagagcagggggaattttgatccaaaggcaatgaataacttttacgacaacatagagccaggccccgtcgtcccccctaagccctccaaaaaagactcctccgatccctgcactatagagcggaaggcgcggcgaatcagcgtaaccagtaaggtgcaggcagacatacacgacactcaggcagcagcagcagacgagcacaggaccgggtcgacacaatctccacgcacacagccacgggacgaggactatgagggggctccatggaactgcgatagctgcacttttttgaaccatcctgcactgaaccggtgtgagcagtgcgaaatgccacgatatacctag

SEQ ID NO: 46810 - DNA, 2055 bp, Artificial Sequence
  Description of Artificial Sequence: Synthetic coding sequence
atggcccagagcagcccccagctggacatccaggtgctgcacgacctcaggcaacgcttccctgaaatcccagaaggagttgtgagccagtgtatgctgcagaacaacaacaacctggaagcttgctgccgcgccctttctcaggaatccagtaaatacctgtacatggaataccattctcccgatgacaaccggatgaaccgtaatcgactcctgcacatcaatctgggcatacactctcccagctcttatcaccccggcgatggtgcccagttgaatggcggacgcactctcgtgcactcatcgtccgatggccatatcgacccacagcatgctgcaggcaagcagctgatctgcctggttcaagaaccacatagtgctcccgccgtggtggccgctaccccaaattataatcccttcttcatgaacgagcaaaacaggtcggcggcaactcctccgtcccaacccccacaacagcccagtagtatgcaaactggaatgaatccttctgctatgcaaggaccctctccccctcctccccctccctcttacatgcacataccaaggtatagcacaaatcctatcacagttacagtctcacaaaatttgccttctggtcagactgtgcctcgggctctacagatcctgccacagatcccaagcaatctgtatggatccccaggctccatctatatccgccagacctctcagtcttcatctggtcgacagactccacagtcgaccccctggcaatcctctcctcagggcccagtcccccactactcccaaaggcccctgccggtgtaccctcaccagcaaaactatcaaccgagccagtactcccccaaacagcaacagatccctcagtctgcctaccactcgccgcctccctctcaatgccctagcccctttagtagcccccagcatcaggttcagccgagtcagcttggccacatcttcatgccgccaagcccctccacaacacctccgcacccgtatcagcaaggccctcccagctaccagaaacaggggtcgcattccgtcgcgtacctgccttacacagcgtcttctttgtccaaaggatccatgaagaagattgaaattaccgttgagccttcccaaagaccaggtacagcaattaatagatcaccttcacctatctcaaaccaaccttccccgtggaaccagcactccttgtacactgcaacgacccctccatcctccagtccgagcagaggcatatcttcccagcccaagcccccgttcagcgtgaacccagtgtatattacctacacccagcccacgggcccatcctgtacaccgtctcctagccctagagtcatccccaatccaacgacagtttttaaaattactgttggccgcgccactaccgaaaatctccttaacctagtggaccaggaggagcgttccgccgctcctgagccaatccagcctatttcagttattcctggttctggcggagaaaaaggctcacataagtatcagcgttcttcatcttccgggtctgatgattacgcatatacacaggccttgcttctgcatcagagagcacggatggaacgccttgccaagcaactaaagctggagaaagaggagctcgaaaggttgaaatccgaggtgaatggaatggaacacgatttgatgcagaggcggctccgcagggtgtcttgtaccacagcaattcctacaccagaggaaatgacccggctgcgctcaatgaatagacaactgcagatcaacgttgattgcaccctaaaggaggtggacctcctgcagagtcgcgattcttccgacccatgcaccattgaacggaaggcgaggaggatttcggtaaccagcaaggtgcaggccgatatacatgatacccaggccgccgctgcagacgagcaccgaaccggcagcacgcaatctccgcgcacacagcctcgtgacgaggactacgagggggccccatggaattgcgacagctgtacttttcttaatcaccccgctcttaaccgatgcgaacaatgcgaaatgcctcgatatacatag

SEQ ID NO: 46811 - DNA, 2139 bp, Artificial Sequence
  Description of Artificial Sequence: Synthetic coding sequence
atggcccagagcagcccccagctggacatccaggtgctgcacgacctgaggcagcgcttccctgagattcccgaaggtgtggtctcccagtgtatgctgcagaacaacaataacctcgaggcctgctgcagagcactttctcaagagagctcgaaatatctctacatggaatatcatagcccagacgacaaccgcatgaaccggaacaggctgctacatatcaatcttggtatacactcaccatctagttatcatcccggcgacggggcgcagttgaatggcgggaggaccctggttcatagcagcagcgatggccacatcgatccacagcatgccgcagggaagcaattgatctgcttggtccaagagccccattctgctcctgccgtggtggcagccactccaaattacaaccctttctttatgaacgagcagaaccgaagcgccgctactccaccctcccagccaccacagcagcccagctccatgcagaccggtatgaatcccagtgcgatgcaagggccctccccaccccccccccctccttcttacatgcacatccctcgatactccacaaaccctataacggtgacggtgtctcagaatcttccatcaggtcagaccgttcccagagcccttcaaatattaccacagatccctagtaatctgtacggatctcctggatccatatatatcaggcagacgagtcagtcatcctcaggaagacagacaccacagagtactccatggcaatcctctccgcagggacccgtgcctcattattcacagaggcctctcccagtgtacccccatcagcaaaactatcaacccagccagtactcccctaaacaacagcaaatcccgcaatctgcttaccacagcccacctccctcacagtgcccctccccattctcatctccacagcaccaggtgcaacccagtcagctgggacacatttttatgcccccctcgccctcaacgacaccaccccacccataccagcaaggcccccccagctaccagaagcaggggtcccactctgtggcctacttaccatacactgcttcttcactgtccaaaggctccatgaagaaaatcgaaatcacagtggagccttctcaaagaccaggtaccgccatcaaccggtctccctctcctatttccaaccaaccatcaccatggaatcagcactctctgtacaccgcaaccactcctccttccagttccccgtctcgaggcatctcatcccagccaaagccccctttctctgtgaacccagtgtacattacatatacccaaccaacagggccatcatgcacacccagcccttctccccgcgtaatacctaacccgaccaccgtgttcaaaataacagttggccgggcaactacagagaacctgttgaacctggttgatcaggaagagagatccgctgcccccgaaccaattcaacctatttcagtcattccaggatccggtggtgaaaagggctcccacaaatatcaacgctctagcagctctggatctgatgattacgcctacacgcaggctcttctgctccaccagcgggcacggatggagagactggctaaacagctcaagttggagaaggaagaactggaacgactcaagtcagaggtgaatgggatggagcacgatttgatgcagaggcgtttaagaagagtgtcctgcaccacagctatccctaccccagaagaaatgaccagactgcggtctatgaacagacagcttcagatcaatgtggattgcaccttaaaggaggtcgacctcttgcagagccggggcaacttcgaccccaaggccatgaataatttctatgacaacatcgaacccgggcctgtggtgccacctaaaccctccaaaaaagattctagcgacccatgcacgattgagcggaaggcacggcggatctctgtgacgtccaaggtccaggctgacattcacgacacacaggcagccgccgcggacgaacaccgaacggggtctacccaatctccaagaacccagccaagggatgaggattacgagggagctccctggaattgtgacagttgtacttttctgaaccaccctgccctcaatcgttgtgaacaatgtgaaatgccgcgctacacctag

SEQ ID NO: 46812 - DNA, 723 bp, Artificial Sequence
  Description of Artificial Sequence: Synthetic coding sequence
atgctgcggagctgcgccgcccggctgcggaccctgggcgccctgtgcctccccccagttggtcgtagattgccgggttccgagcccaggccagaattgcggagcttctcatcggaagaggtgatcttgaaggactgctcagtgccaaatcccagctggaacaaggatctgcggctgctgttcgatcagttcatgaaaaaatgcgaagacggatcttggaagcggctacccagttataaacggacacccaccgaatggatccaggacttcaaaacccatttcctggatcccaaactgatgaaagaggagcagatgtctcaggcccagctgttcacaagaagtttcgacgacggattgggctttgagtacgtgatgttctataatgatattgagaaacgcatggtgtgtctgttccagggcgggccctacctggaaggtcccccaggttttattcacggcggcgccatcgctacgatgatcgatgctacagtcggaatgtgcgccatgatggccggtggtatcgtcatgaccgccaacctgaatatcaattacaaacgacctattcccctttgcagcgtggtgatgatcaactctcagctggacaaggtggaggggaggaagttttttgtttcttgtaatgtgcaaagcgtcgatgaaaaaacgctttacagtgaagcaaccagcctgtttattaaattgaacccggccaagtctcttacttag

SEQ ID NO: 46813 - DNA, 744 bp, Artificial Sequence
  Description of Artificial Sequence: Synthetic coding sequence
atgatccggcggtgcttccaggtggccgcccggctgggccaccaccgaggattactggaggcccctcgaattctccccaggttaaatcccgcttccgccttcggcagctctactgactcaatgttctcccgctttctacctgaaaagaccgatttaaaagattatgctctgcccaatgcatcgtggtgcagcgacatgcttagcctataccaggagtttcttgagaaaacaaaatcctctgggtggatcaaactgccatcctttaaaagtaaccgcgaccatattagaggactgaagctgcctagcgggctggcagtctcgtccgataagggcgactgtcgaatcttcaccagatgcatccaagtggagggccagggattcgaatatgttattttttttcagcccacccagaaaaaatccgtgtgtctgttccagccagggagctacctggaaggcccacctggctttgcgcatggaggatcccttgccgctatgatggatgagacctttagcaagacagcttttctggccggcgagggcctgtttacactgtctttaaacatccgttttaaaaatctgatccctgtagactctctggtagtgatggacgtcgaactagacaagatcgaggaccagaaactctatatgtcttgtatcgcgcacagccgggatcaacagacagtgtacgcaaaatcttctggcgtctttttacagcttcagctggaagaggagagtccacagtag

SEQ ID NO: 46814 - DNA, 5883 bp, Artificial Sequence
  Description of Artificial Sequence: Synthetic coding sequence
atggcccagcaggccgccgacaagtacctgtacgtggacaagaactttataaataaccctctggctcaagctgattgggcggccaaaaagctggtgtgggtgcctagcgacaagtcaggtttcgaacctgccagccttaaggaagaagtgggagaggaggctatcgtggaactcgtggagaacggcaagaaggtgaaagtaaataaagacgacatacagaaaatgaatcctcccaagttcagtaaggttgaggacatggcggagttgacctgtctgaatgaggcaagcgtcttgcacaacctaaaagagaggtactatagcggcttaatctacacttattcagggctgttctgcgtggttatcaatccatacaaaaatcttccgatctactctgaggaaatcgtcgagatgtacaagggaaagaagcggcatgagatgccgccccacatctatgctataacagacactgcatacagaagtatgatgcaggaccgggaggaccaaagtatcctctgtactggcgagagcggcgcaggtaagacggaaaacaccaagaaggtgatccagtatctcgcatacgtcgcttcttcgcacaagtccaagaaggatcagggtgaattggagcgccaactgcttcaggctaatccaatattggaggcgtttgggaatgccaaaaccgtgaaaaatgataactcttctaggtttggtaaatttatccgcattaattttgatgtcaatggttacatagtaggagcaaatatagaaacctatctgctcgaaaaatctcgcgcaatccggcaggccaaagaagagaggaccttccacattttttattacctcctgtcaggggcaggcgagcatctgaagactgaccttttgctggaaccatacaataaatacagattcctcagcaacggccacgtaaccattcctggacagcaagataaggatatgttccaggagacaatggaagcaatgcgaattatgggcatacctgaggaagagcagatgggccttttacgagttatttctggggtattacagctgggtaacatcgtttttaagaaggagagaaatacagaccaggcgtcaatgcctgacaacaccgctgcccaaaaagtctcacatcttctgggcataaatgtgacagatttcacccggggaattcttacacctagaattaaggtgggacgggattatgtgcagaaggcccagactaaggagcaggccgattttgctatcgaggcactggcaaaagccacctacgaacggatgttccgctggctagtgcttagaattaataaagcgcttgataaaacaaagcgacagggagcatcttttatcgggatcctggacatcgcagggtttgagatttttgatttgaatagtttcgaacagctatgtattaactacacgaatgagaaattgcagcagctgtttaatcatacaatgttcatattagaacaggaggagtaccaacgggagggtatcgagtggaatttcatcgactttggtcttgatctgcagccatgcatcgacctaatcgagaaaccggccggcccaccaggaatcctggccctactggatgaggagtgttggtttcctaaagccaccgacaagtcttttgtcgaaaaggttatgcaggagcagggcacgcaccctaaatttcagaagcctaaacagctcaaagataaagctgacttctgtataatccactacgcgggcaaggtcgattataaggctgatgaatggttgatgaaaaacatggaccccctgaacgataacatagccactctactccatcagtccagtgacaagttcgtatccgagctttggaaggacgtcgaccggataatcgggctagaccaagtagctggaatgagtgagacggcactgccaggcgcattcaagacacgcaagggcatgtttaggacagtgggtcagttgtacaaagaacagctggccaagctgatggccacactccgaaataccaaccccaacttcgtacggtgcatcattcccaaccatgagaagaaagccggcaaactcgatccacacctggtccttgatcagctacggtgtaacggagtccttgagggtatccggatttgcagacagggctttcccaatagggtcgtgttccaggaatttcgacaaagatacgaaatcctgacccctaatagcatccctaaaggttttatggacgggaaacaggcatgcgtgttgatgattaaggcgcttgaactggatagcaacctttacaggatcggccagtccaaggtcttctttagagcaggggtcttggctcatctcgaggaggagcgcgatctgaagataaccgatgtgatcatcggattccaggcatgctgtcggggctatcttgcccgaaaggcttttgccaaaagacagcaacagctcaccgctatgaaggtcttgcaaaggaattgcgctgcctatctaaagcttcggaactggcagtggtggcggctgtttactaaagtgaaacccctcctacaggttagcagacaggaagaagagatgatggcgaaggaagaagagctggttaaggtgagggagaaacagctggccgctgagaatagattgacagagatggagacgctccagagtcagttgatggccgaaaagctccagttgcaggagcagttacaggccgagaccgagctgtgtgctgaggcagaagaattacgcgcccggctcacagcaaagaagcaggagctcgaggagatatgtcatgacttagaggctcgtgtggaggaagaagaggagcggtgccaacaccttcaggccgagaagaagaaaatgcagcaaaacattcaagagctcgaagaacaactggaagaagaggagtctgccagacaaaagctccagctggaaaaagtgaccaccgaggccaagctcaagaaactggaggaagagcagattatcctggaagaccagaactgcaagcttgcaaaagaaaaaaaattgctggaagatcgcattgctgagttcactaccaacttgacagaggaagaggagaaatccaagtctcttgcaaagctcaaaaacaagcacgaggctatgatcactgacctggaggaaaggctccggcgcgaggagaaacagcggcaggagctggagaagaccaggcggaagcttgagggagacagtaccgacctgagcgaccaaatcgcagagctgcaggcccagatcgccgagcttaagatgcagctcgctaaaaaagaggaagaactccaggctgccctcgcaagagttgaggaggaggctgcacagaagaacatggccttaaaaaaaatccgggagctggagtctcagatctcagagcttcaagaggatctggagtctgagagggctagcaggaataaagcagagaaacagaaacgagacttgggtgaagagttggaggctttaaagaccgaactagaggatacgttggattccactgctgctcagcaggaactgcggtctaagcgggagcaggaggtcaacattttgaagaagacattggaagaggaggccaagacacacgaggcacagattcaagagatgcggcagaaacattcccaggccgtggaggagctcgctgaacaactcgagcaaacaaagcgggtgaaggccaacctcgaaaaggccaaacaaacactggagaacgaacgcggtgaactggccaacgaagtgaaggttctgttgcagggcaagggcgacagtgaacacaagagaaagaaagttgaagcccaactacaggagttacaggttaagtttaacgagggggagagagtgaggaccgaacttgctgataaggtgaccaagctgcaggtggaactcgacaatgtgaccggccttctcagtcagagtgatagcaagtccagcaagttgacaaaggatttcagcgctctggagagtcagttacaggacacccaggaactgctccaagaggagaatagacagaaactgtctctctctactaaactaaagcaggtagaggatgagaagaattcctttcgagaacagctggaggaggaagaggaagccaagcacaacctagaaaagcagatagccacccttcatgcacaggtggcagatatgaaaaagaaaatggaggacagtgtcggctgtctggagaccgcggaagaggtgaagcgcaagctgcagaaagacctcgaaggcctctctcagaggcatgaagagaaagtcgcagcctatgataaactcgaaaaaacaaagactcggttacagcaggaactcgatgatctgcttgttgacctggaccatcagcggcagagcgcgtgcaacctcgaaaagaaacagaagaagtttgatcaactcctggcagaagaaaagaccatttctgcaaagtacgccgaggagcgtgatagggccgaggctgaagctcgggagaaggagaccaaggctctgtccctcgccagagcgctggaagaggcaatggagcaaaaagccgagctggaaaggctgaacaagcagttcagaacagaaatggaagatttgatgtcctcaaaggatgatgtaggcaagtctgtgcacgagctcgagaaatccaagagggctcttgaacagcaagtcgaggaaatgaagacacagctggaagaattggaggatgagctgcaggccacagaggatgccaaacttcgcctcgaagttaatctgcaagctatgaaggcccaatttgaacgcgatctgcaagggcgagatgagcaatcagaggaaaaaaaaaaacagctggtgaggcaggtgcgcgagatggaggctgagctcgaggatgagcgcaagcagcggagcatggccgtagcagcccggaagaagctcgagatggatcttaaagacctcgaggcgcacatcgattccgctaacaagaatagagatgaagcgataaagcagcttcgaaaacttcaggcccagatgaaagattgcatgcgcgagttagacgacaccagggcgtctagagaggagatcttggctcaggccaaagagaacgaaaagaagctgaagagcatggaagcggaaatgatccagctgcaagaggaattagctgctgcagagcgcgccaaacggcaggcccaacaggagcgagacgaactggccgacgagattgccaactcatcaggcaaaggggcccttgctctcgaagagaagcggaggctagaagcgaggattgcccaactcgaggaggaactagaagaggaacaggggaacacagagctaatcaatgaccggctcaagaaagcgaacctgcagatcgaccagattaacaccgatctgaaccttgagagatcccacgcccagaaaaacgagaacgcaaggcagcaattagaaaggcaaaataaggagctcaaagttaagctgcaggagatggagggcaccgtcaagtcaaagtacaaagccagcattactgcactcgaagcaaagattgcccaactggaagaacagctcgataacgaaacaaaagagaggcaagcagcttgtaagcaggtgcgacggaccgagaagaaactcaaagatgtgctgctccaagttgacgatgagcgccgcaatgcagagcagtacaaagatcaggcagataaggcctcaactaggttaaaacagctgaagcgccagttggaagaggccgaagaggaagcccaacgggccaatgcatcccggcgcaaactgcagcgcgaactggaggacgctaccgaaacggccgatgcaatgaacagggaggtgtccagcctgaagaacaaactgcgtagaggcgatttgcccttcgttgtgccacgtcgcatggcacgaaaaggagccggggatggcagcgatgaagaggttgatgggaaggccgacggtgccgaagctaagcctgccgagtag

SEQ ID NO: 46815 - DNA, 501 bp, Artificial Sequence
  Description of Artificial Sequence: Synthetic coding sequence
atggcccagcggctgctgctgcggcggttcctggccagcgtgatcagccggaagccttcgcaaggtcagtggccgccattgacttctcgggctctgcagaccccccagtgctcaccgggcggcctgaccgtgacccctaacccggccagaacaatttatacaacgaggataagcctgactaccttcaatatccaggatggtcctgacttccaggatagggtggttaacagtgagactcccgtggtagtggactttcatgcacagtggtgtgggccatgcaaaattcttggcccacgcttagaaaaaatggtggccaagcagcatgggaaagtggtgatggcaaaggtagatatcgacgaccacactgatctggcaatcgagtacgaggtgtcagctgtcccaactgtccttgccatgaaaaatggggatgtagtggacaagtttgtcgggatcaaggacgaagatcagctggaagccttccttaaaaagttgattggctag

SEQ ID NO: 46816 - DNA, 2877 bp, Artificial Sequence
  Description of Artificial Sequence: Synthetic coding sequence
atgagcgagtgcggcggccggggcggcggcagcagcagcagcgaggacgccgaggatgagggcggaggaggtggaggccccgctggcagcgactgtctcagcagtagccccacactggccaccgcctcttcggcagggcgattgagacgcggtctgcgaggagcctttctgatggcccgccagaggcccgaactattatgtggagcagtggcactcggctgtgcccttttactggcgttaaaattcacttgcagcagagctaaagacgtaattatacccgccaagccaccagtgtccttcttttctctgaggtcaccggtgctggaccttttccaggggcagttggactacgcagagtatgtaagacgggactccgaggtcgttcttctgtttttctatgcgccctggtgcggacagtccattgccgccagagcagagattgagcaagccgctagccgtctgagcgaccaggttcttttcgttgccataaattgttggtggaaccagggtaaatgtcggaaacagaagcatttcttttatttcccggtgatatacctctaccacagatcctttggaccaatcgagtataagggtcctatgtcagccgtgtatattgaaaagttcgttcggcgggtcatgaagccgctgctgtatatcccttcacaatcagaactcttggatttcctttctaactacgaacctggagtcctcggctattttgaattctcgggatcccctcagccacctggctatctcactttctttacttcggccctgcactcgcttaagaaggattacctgggcacggtgcggttcggggtgatcacaaataagcacctggccaaactagtctctttggtccattccggttccgtgtatctgcaccggcatttcaacacatcactagtcttcccgagggaggtgctcaattataccgcagaaaatatttgtaaatgggctctcgaaaatcaggaaacactatttaggtggctaagacctcacggaggtaagtctttgctgctgaataatgaactcaaaaaggggcccgctctcttcctgttcatcccctttaaccccctcgctgagagccaccccctgatcgacgagataacagaagtggctctggaatacaataactgccatggcgatcaggtcgtggagcgcctgttacagcacttgcgtagagtggatgctcctgtgctggagagcctcgctctggaggtgccagcgcagttgcccgatcctccaacgattactgcctccccatgttgcaataccgtcgtattgccccaatggcatagctttagtagaacacacaatgtgtgtgagctgtgcgttaaccagactagcgggggcatgaaaccgtcctcagtgtcagttcctcagtgctccttcttcgagatggcagcagcacttgactcattctatctgaaagagcagactttttaccacgtggcgtccgactctattgagtgctcgaactttcttacctcctatagccctttctcatattataccgcctgctgccggacaatcagcaggggcgttagcgggtttatcgacagcgagcagggtgtgtttgaagcccccaccgtcgcttttagcagtcttgaaaaaaagtgcgaggtcgacgcgccctccagtgtgccccacattgaagagaatcggtacttgtttccggaagtagacatgactagtaccaacttcacgggcctaagttgcaggacaaataaaactttgaacatataccttctagattctaacctattctggctctatgcagaacgtcttggagcccccagtagtacacaggttaaagagtttgctgcgattgtggatgttaaggaagaatcacactatatcttggatcccaaacaggctctgatgaaacttactctagagtcttttattcaaaacttttcggtcctttactcacctttgaagaggcatcttattggatcaggctccgcgcagttcccatcccagcatctcattaccgaagttacaacagacacattttgggaggttgtcctccagaaacaagacgtgctgcttctgtattatgctccgtggtgtggattctgcccttccctcaaccacatatttattcagctggcacgtaacttgcccatggacactttcactgtggccagaatagacgtgtcccagaacgaccttccatgggaatttatggtcgaccggctgcctactgtgctctttttcccttgcaatcggaaagacctgtcagtgaaatacccagaagatgttccgattactctgcctaatctcctgcggtttatcctccatcattcagacccggctagttctccacaaaatgtggccaattctcccacaaaagaatgcctgcaatctgaagctgtgttgcagcggggccacatcagccaccttgagagagagattcagaagctccgggctgaaatctcgtctctccagcgggctcaggtgcaggttgagagccagctgagctcagccagaagagacgaacaccgcctgcgacagcagcagagagccctggaggagcagcacagcctgttgcatgcacattctgagcaactgcaggcactctatgagcagaaaacgcgcgaattgcaggaactggctcgaaaacttcaggagctggccgacgccagtgaaaacttgcttaccgagaacacctggttgaagattctggttgcaacaatggagcgcaagctggagggccgggatggagccgagtccctggccgctcaacgagaggtccatccaaagcagccagaaccctccgcgactccccagctgcctggaagctctcctccccccgctaacgtttcagccactctggtctctgagagaaataaagagaaccggactgattag

SEQ ID NO: 46817 - DNA, 2958 bp, Artificial Sequence
  Description of Artificial Sequence: Synthetic coding sequence
atgagcgagtgcggcggccggggcggcggcagcagcagcagcgaggacgccgaagatgagggggggggagggggcggcccggccggcagcgactgcctcagctcctcaccaactctggctaccgccagttccgcaggcaggctgcgcagagggcttcgcggagcttttcttatggctaggcagagaccagagctgctgtgcggggcagtcgcccttgggtgcgcactgctgctggcactgaaattcacctgcagtcgcgccaaagacgtcatcatccctgccaagcctccagtatcattcttttccctaagatcccccgtcctcgacctgtttcagggccaactggattacgctgagtacgtgaggagagactcagaagtcgtgttactgttcttctatgcgccttggtgtggccaatccatagcagcccgggccgaaattgaacaggctgcaagccggctttctgatcaggtgcttttcgtcgcaataaactgttggtggaaccagggaaaatgtcggaagcagaagcatttcttctacttccccgtgatctacttataccaccgctcattcgggcccattgagtacaaaggcccaatgtctgcagtttatatcgagaaatttgtgcggcgcgtcatgaagcctctcttgtacatcccctcccagagcgagttacttgacttcctaagcaattacgagcccggtgtgctgggctactttgaattttctggttccccccagccacccggttacttgacatttttcactagcgccctacattctctaaaaaaggccttggagtccacaagcagccctcgagctctggtgagtttcacgggggaatggcacttggaaaccaagatctatgtactggactacctaggaactgttcggttcggcgtgatcacaaacaagcatctcgcaaaacttgtctcgttggttcatagcggctccgtttatcttcacaggcacttcaacacgtccctagttttcccccgcgaggtgctgaactacacagcagaaaacatctgcaagtgggcccttgaaaatcaggagactctgttcagatggctgagacctcatggggggaagtccctgctcctgaacaacgaactgaaaaagggccccgccctgtttctatttataccttttaaccccctcgcagaatcccatcccttgatcgatgagataacagaagtcgccctggagtacaacaactgccacggagatcaagtagtggagcgcttactccagcatctccggagagttgacgcccccgtcctggagagtctggccctcgaagtgcctgcacaactccccgacccccccaccataacagcctccccttgttgcaacactgtggtcctcccccaatggcactccttttcacgtactcataacgtgtgcgaactctgtgtgaatcagacaagcgggggaatgaaaccatcatccgtgtcagtgcctcagtgcagcttcttcgagatggccgctgctttggattccttctatctcaaggagcagacattctatcacgtggcctccgactcaatcgaatgcagcaactttttaacatcctatagcccattcagttactatacagcctgctgcagaaccatctcacggggggtgagtggatttatcgattccgaacagggggtttttgaggcaccaactgtagccttctcctcactcgagaaaaagtgcgaggttgacgcccctagttcagttccccacatcgaggagaacagatatttgtttcccgaggtcgacatgacctctactaattttactggactttcttgccggactaataagaccctgaatatttatcttctagattcgaacctgttttggctttacgcggaaagactcggtgcgccatcctctacacaggtgaaggagtttgcggcaatcgttgatgtgaaagaggagagtcactatattctcgatcccaagcaggcattaatgaaactcacactggaatctttcatccaaaacttcagcgtgctgtactctcctctcaagaggcacttgattgggagcggcagcgcccagttccccagccaacatctgattaccgaggtgacaaccgatacattctgggaggtggtgctccaaaagcaagacgttcttctgctctactacgccccctggtgtgggttctgtcctagcttaaaccacatctttatacagctcgctcgcaatttacctatggatacttttactgtcgctcgcatcgatgtatctcaaaatgacctgccctgggagttcatggttgaccggctacctactgttctgttttttccctgcaacagaaaagatctgtcagtaaagtaccctgaagatgtgcctatcaccctgcccaatctcctacgctttatactgcaccacagcgacccggccagttcaccacaaaacgtggcaaattcacccactaaggagtgcctacagagcgaggccgtactgcagaggggtcatatctctcaccttgaacgggaaatacaaaaattgcgagctgaaatatcctctctgcaacgggcccaggtccaagtggagagccagctctcgtccgcgcgccgggatgagcatagactgcgccagcagcagagggctcttgaagaacagcacagcctactacacgcccatagcgagcaactgcaggccctttacgagcagaaaacgagggagctgcaggagcttgcccgcaaactccaagaactggccgatgcctcagagaatctcttaaccgagaacacctggctgaagatcttagtggcgacaatggaaaggaagctggagggtcgtgatggtgctgagagtcttgcggcccagcgtgaagtacatcctaagcaaccagaaccaagcgcaacaccacagctgcctggcagcagcccgccgccagcgaacgtgtccgcgaccctagtgtctgagcgtaacaaggagaaccggaccgactag

SEQ ID NO: 46818 - DNA, 666 bp, Artificial Sequence
  Description of Artificial Sequence: Synthetic coding sequence
atggcccggcagcggcccgagctgctgtgcggcgccgtggccctgggttgcgcccttctgctcgccctcaagtttacttgttcccgcgcaaaggatgtgataattcctgccaaaccccctgtgtcattcttctctctgcgctcccccgtgttggacctgttccaaggtcagctcgattacgcggagtacgtcaggagggactccgaagtggtgctcctgttcttttacgcgccttggtgtggacagagcattgctgcccgggcggagatcgagcaggctgcaagccgcttgtccgatcaggtgctgtttgtcgctatcaactgttggtggaaccaggggaagtgccgaaagcagaaacacttcttctacttccccgtcatttatttataccatagaagtttcggcccgatcgagtacaaaggacccatgtccgcagtgtacatagaaaagttcgtgaggagagtaatgaagcccctgttgtatataccttctcaaagtgagctgttagacttcctgagcaattatgaacctggagtgctcggatacttcgagtttagtggatccccacagccccccggttatctgacctttttcacctctgctttgcactctctcaagaaagatggggtttccccatgtaggcccggatggtctgcagtagcttag

SEQ ID NO: 46819 - DNA, 1083 bp, Artificial Sequence
  Description of Artificial Sequence: Synthetic coding sequence
atggtgcccgccgccggccggcggcccccccgggtgatgcggctgctgggttggtggcaagtactgctgtgggtactcgggctgccagtgaggggtgtggaggtggctgaggagagtggcaggctatggagcgaagagcagcctgcacacccgcttcaggtaggcgccgtataccttggcgaggaggaactgctgcatgacccgatgggacaagatcgtgctgcagaggaggccaacgccgtgctcggtcttgacacccaaggggaccacatggtgatgttgtctgtgattccaggggaggctgaggacaaagtcagttccgagccgtccggagtcacatgtggggcagggggggccgaagatagcaggtgcaacgtgagggagagcctgtttagtttggacggcgccggcgcacactttccagatagagaggaggaatactacaccgagcccgaagtggccgagtctgatgccgcgccgaccgaagattcaaacaatactgaaagtctcaaatcccccaaggtgaactgcgaagagaggaatatcacaggcctggaaaacttcactctgaaaatcctcaacatgtcccaggatttgatggactttcttaacccaaatgggagcgattgcactcttgtcttgttctacaccccctggtgtagattcagcgcctccctcgcgccacattttaattcactgcctcgagcattccctgcattacactttttagcactcgatgctagtcagcacagctcactctctactaggttcggcacagtggcggtccctaacatcctgctgttccaaggagccaagcccatggcccggttcaaccacaccgatagaactctggagaccttgaaaattttcatctttaatcagacaggtatcgaggccaagaaaaatgtggtcgtcacacaggctgaccagattggccccttgccgtccacgctgatcaaatccgtggactggctgctggtgttctccctgttctttctgatcagctttattatgtacgctacaatcaggactgaaagcatacggtggcttatccctggacaggagcaagagcatgttgagtag

SEQ ID NO: 46820 - DNA, 1035 bp, Artificial Sequence
  Description of Artificial Sequence: Synthetic coding sequence
atggtgcccgccgccggccggcggcccccccgggtgatgcggctgttaggctggtggcaggtgctgttgtgggtcctgggactgccagtccggggcgtcgaggtggccgaggagtcaggccggctttggtctgaggaggagctcttgcatgatcctatgggacaagatcgcgcagcggaagaagcgaatgccgtgctaggactggacacccagggggatcacatggtcatgctatccgtgatccctggtgaggctgaggacaaagtgagctcagagcctagtggtgttacctgcggggcaggcggcgccgaagatagtcgctgtaatgtgagggaaagtctgttctccctcgacggagccggcgcccactttcccgaccgcgaagaggagtattacaccgagcccgaggttgccgagagcgacgctgccccaactgaggactccaataatactgagagcctgaagtcacctaaggtgaactgcgaggagcggaatattactggcctcgagaactttacgctgaaaatcctgaacatgagccaggacctcatggattttctcaaccccaacggctccgactgcacactcgtgctgttctacacgccatggtgcagattttccgctagtttggctccacattttaattccttacccagagccttccccgcgttgcattttctcgccctggacgcctcacagcacagcagcctctcgactcgctttggcaccgtcgccgttccgaatattcttctctttcagggcgcaaaacctatggctaggttcaaccacactgatcggactcttgaaaccctcaaaatcttcatctttaaccagacaggcattgaagccaagaagaatgtcgtcgttacccaggccgatcaaattggccccctgccctccacactgatcaagtctgtggactggcttctggtcttttctctattcttcctgatctcatttattatgtatgccacaattaggaccgagtcaatccgatggctcatccctggacaggagcaggaacacgttgaatag

SEQ ID NO: 46821 - DNA, 1014 bp, Artificial Sequence
  Description of Artificial Sequence: Synthetic coding sequence
atggaggccggccagcagcgggtggtggagaaggtggccgaggagagtgggcgactatggtcagaggaacagccagcacatcctttgcaggttggtgctgtctatctgggtgaagaggaactgctgcatgacccaatgggacaggaccgggccgcggaggaagctaatgccgtgctgggtttggacacccaaggggaccacatggtcatgctcagcgtgattccaggggaagccgaggacaaagtgtcatcagagccttcaggggtgacatgcggagcagggggtgccgaggatagcagatgcaatgtcagggaatcccttttcagccttgatggcgccggcgctcatttcccagaccgggaagaggagtactatacagaacctgaggtcgctgaaagtgacgctgcaccgacagaagacagcaacaacacggaatcgctcaaatctccgaaggtcaattgcgaggaaagaaacatcacaggccttgaaaactttactttgaagattctgaacatgtctcaggatctgatggacttcctaaatccgaatgggagcgactgtaccttggtacttttctataccccctggtgccgcttcagcgcttcattggcgccacatttcaatagcctgcctcgagccttcccagcattgcactttctagcgttggatgcctcacagcactcttcactgagcacgaggttcggcactgtggccgtgccaaacattctcctctttcaaggagctaagccgatggcccggtttaatcacacagacagaactctcgagacattaaagattttcattttcaaccaaaccggtatagaggctaagaagaacgtggtggtgacccaggccgaccaaatcggccccttgcctagcactttgattaaatcggttgactggctgctcgtgtttagtcttttctttttaattagctttattatgtacgctacaatcaggaccgagtccattcggtggctcataccagggcaagaacaagagcatgtggagtag

SEQ ID NO: 46822 - DNA, 1299 bp, Artificial Sequence
  Description of Artificial Sequence: Synthetic coding sequence
atgcccgcccggcccggccggctgctgcccctgctggcccggcccgctgcgctgaccgcactcctcctgctactgcttggtcacgggggcggaggacgatggggagcccgcgcacaagaagccgccgcggcagctgctgatggcccccctgctgccgatggcgaagacggtcaggatccacactccaaacatttgtacacagctgacatgtttacccacggaattcagtcggcagcgcactttgtgatgtttttcgccccctggtgtggccattgccaaaggctgcagcctacctggaacgacctcggcgacaagtataattccatggaggatgcaaaggtgtacgtggccaaggtggattgtacagcacactcagatgtgtgctctgcacagggtgtgcgggggtaccccacccttaaactatttaaacccgggcaagaggccgtgaaataccaggggccaagagactttcagactctggagaattggatgcttcaaaccctgaacgaggaacctgtgacccccgagccagaggtggagccccctagcgctccggagctgaaacaaggtctgtacgagctcagcgcatcaaatttcgaacttcatgtggcacagggtgatcacttcatcaaattcttcgccccgtggtgcgggcactgcaaggccctggccccaacatgggagcagctggcattgggactggagcacagcgaaacggtgaaaatcggaaaggtagattgcacacagcattacgaactgtgttccgggaaccaagtcaggggctatcccaccttgctttggtttcgggacgggaaaaaggtagaccaatataagggcaaacgggacttggaaagcttgcgagagtacgtagagtcccagttgcaacggactgagacaggcgcgacagagactgtcacaccgagtgaagctcccgtccttgctgctgagcccgaagcggacaaaggaactgtgctggctttgaccgaaaataactttgacgacactattgccgaaggaattacttttataaagttctacgccccttggtgtggtcattgtaaaactttggcgcccacctgggaggagctttctaagaaggaattccccggcctcgccggggtgaaaattgcagaggtggattgtaccgcggaacgcaatatctgttccaagtactccgtgaggggataccccaccttgctcctgttcagaggtgggaaaaaagtgtccgagcattctgggggcagggacctggactccctgcaccgatttgttctttcgcaggctaaagatgagctctag

SEQ ID NO: 46823 - DNA, 975 bp, Artificial Sequence
  Description of Artificial Sequence: Synthetic coding sequence
atggaggacgccaaggtgtacgtggccaaggtggactgcaccgcccatagtgatgtgtgctccgcccaaggggtgcggggctacccaaccctgaaacttttcaagccaggacaggaggctgttaaatatcaggggcccagagatttccaaaccctcgaaaactggatgctccaaacccttaatgaggagccagttacaccagagccggaggtagagcccccatccgcgccagaactgaaacagggtttatacgaactctcagcttcaaatttcgaacttcacgttgctcagggcgaccacttcattaaattcttcgctccctggtgtggccattgtaaggcactcgcacccacatgggagcagctcgctctgggcctggaacacagcgaaaccgtgaaaatcggaaaagtagattgtacccagcactacgaactctgtagcgggaatcaagtgcgcggttatccaactctcctgtggtttagagacggtaagaaggtcgatcagtacaagggaaaaagggatctggaaagtctgcgcgaatatgtggaaagccaattgcaacgcaccgagacaggagcaaccgagactgtgaccccgagcgaggcccccgtgctcgcagcagaacccgaagctgataagggtaccgtgctcgctctgacagaaaataattttgatgataccatagccgaaggtatcacttttattaagttctacgccccctggtgtgggcattgtaagaccctggcacctacatgggaggaattatctaagaaagaattccccgggttggctggtgtcaagatcgccgaagtcgattgcaccgccgagcggaacatctgcagtaagtattcagtgcgcggctaccctaccttactgctattcagagggggtaagaaagttagcgaacatagcggtggccgagatttggacagcctgcataggtttgtgctgtcacaggcgaaggatgagctctag

SEQ ID NO: 46824 - DNA, 1083 bp, Artificial Sequence
  Description of Artificial Sequence: Synthetic coding sequence
atgacccagagcgtggacagcaaccggggcaaccggaacgagaagaggtgtggacactgccagcgcctgcaaccgacctggaatgacctgggcgataaatataactctatggaagacgccaaggtctatgtcgccaaagtggactgcactgcacacagcgatgtgtgcagtgctcagggagtgaggggatatcctaccctgaaattgtttaaaccaggccaagaagccgttaagtatcagggacccagagattttcagaccctcgagaattggatgcttcaaactctgaatgaggagcccgtcaccccagagcctgaagtagaaccaccttccgcccccgaactaaaacagggactttacgaactcagcgccagtaacttcgagctgcacgtcgcccagggcgaccatttcattaagttttttgctccctggtgcggtcactgcaaagctcttgctcctacatgggagcagcttgccctgggattggagcacagcgagacggtgaaaattggaaaagtggactgtactcagcactatgagctttgttccggaaatcaagtcagaggctatcccaccctgctctggtttcgggacggaaaaaaagtggatcagtacaagggaaagcgggatctggagtcactgagggagtatgttgaaagtcagctgcagcgtacagaaactggcgcgactgagacagtgacgccatccgaggctcctgtcttggccgcggagcctgaagctgacaaaggcacggtgcttgccctgactgagaataactttgacgacacaatagcagaggggataacatttattaaattttacgccccctggtgcggccactgtaaaaccctcgcccccacctgggaagagctgtctaagaaagagtttccaggtttggccggagtgaagatcgcggaggtcgattgcactgccgaacgcaacatctgctctaagtatagcgtgcgggggtatcccaccctgctgctgtttcgcggaggcaaaaaggtcagcgaacactctggtgggcgcgatctggactccctgcacaggtttgtgttgtcccaagcaaaagacgagctgtag

SEQ ID NO: 46825 - DNA, 843 bp, Artificial Sequence
  Description of Artificial Sequence: Synthetic coding sequence
atggcccccagcggcagcctggccgtgcccctggccgtgctggtgctgcttctgtggggtgccccatggacacacggcagaagatccaacgtgagagtgatcacggatgagaattggagggaactactggagggagattggatgatcgagttctacgccccgtggtgtccggcgtgtcaaaaccttcagcctgagtgggagtcttttgctgaatggggagaggacctagaggtgaatatagctaaagtggacgtgactgaacagccggggctatccggaaggtttatcatcaccgctttgccaaccatctatcactgtaaagacggggaattccgaagatatcagggacccaggacaaagaaggattttatcaactttattagcgacaaggagtggaaatccattgagccagtgagctcctggtttggtcctggctccgtgctgatgtctagcatgtccgcgctgttccagcttagcatgtggatccggacgtgccataattattttatcgaggatctcggcctgcccgtatggggaagctacactgtgttcgccttggccaccctgtttagcggcctgctgctgggactgtgcatgatttttgtggccgactgcctgtgcccctcaaaacgaaggcggcctcagccctacccatatccatcaaaaaagttgctgagcgaatccgcccagcccctgaaaaaggtcgaggaggagcaggaagccgatgaagaggacgtctcagaggaggaagccgaatccaaggaaggaaccaataaggatttcccgcagaatgcgatccgccaaagaagcttgggcccatcactggccacagataagagctag

SEQ ID NO: 46826 - DNA, 891 bp, Artificial Sequence
  Description of Artificial Sequence: Synthetic coding sequence
atggccgtgctggcccccctgatcgccctggtgtacagcgtgccccgactgagccgttggctggcgcaaccctactatctgctgagcgcactgttatccgcggccttcctgctggtgaggaaattgccccccctttgtcacgggctgcccacacagagggaggatgggaatccttgtgacttcgactggcgggaagttgagattctcatgtttctgtctgctatcgtgatgatgaaaaaccggcgtagcattacagtagagcagcacattggcaacatctttatgttttcaaaggtggcgaataccatcctgtttttcagactggacatccggatgggactcttgtatatcaccctgtgcatcgtctttctgatgacttgcaagccgcctctgtatatggggcccgaatacatcaaatatttcaacgacaagacaatcgatgaggaactggagagggataaacgcgtcacatggatcgtggagttctttgccaattggagcaacgattgtcagagttttgctcccatctacgccgacctgtcgctgaaatataattgtacagggctgaacttcggcaaggtggatgtcgggaggtacaccgacgtgagtacaagatacaaggtgtccacctcccccttgaccaagcaactgcctacacttattctcttccaaggggggaaggaagctatgcgtcgtccacagattgacaaaaagggaagagccgtcagctggaccttttcagaggagaacgtcattagggaatttaatctgaacgagctttaccagagggccaaaaaactcagcaaagcaggtgataatatacctgaagagcaacctgtggcctcaactcctacaacagtcagtgacggggagaacaaaaaagataagtag

SEQ ID NO: 46827 - DNA, 777 bp, Artificial Sequence
  Description of Artificial Sequence: Synthetic coding sequence
atggccgtgctggcccccctgatcgccctggtgtacagcgtgcccaggcttagccggtggctagcacagccctactatctattgtccgcgttactgagtgcggcatttcttttggtgagaaagttacctcctctgtgtcacggtctgccgacccaacgggaggatggaaacccctgcgatttcgactggcgggaggttgagatccttatgtttctgtcagcaattgtgatgatgaagaatagacggagcatgtttctgatgacctgcaagcctcctctctacatgggccctgaatatatcaaatacttcaatgacaagacaattgatgaggagttagagcgagacaagcgcgtcacgtggatagtggaattttttgccaactggtccaatgattgtcaaagctttgccccgatctatgccgatctctctctaaagtacaactgtactggcctcaacttcgggaaggtagatgttggacggtatacagatgtgagcacacgatataaggtgtccacgtcccctctgactaaacagctgccgacattaattttatttcagggagggaaagaagccatgagaaggccacagatcgacaagaagggaagggcagtttcctggaccttctccgaagaaaacgtcattagggaatttaacctaaatgaactatatcagcgcgcgaagaagttaagtaaggccggagacaacattcccgaagaacagcccgttgctagtacccccactaccgtgtcagatggcgaaaataaaaaggataaatag

SEQ ID NO: 46828 - DNA, 1365 bp, Artificial Sequence
  Description of Artificial Sequence: Synthetic coding sequence
atggccgcctggaagagctggaccgccctgcggctgtgcgccaccgtcgtggtactggacatggttgtttgcaaggggtttgtggaggacctggatgaatctttcaaggagaatcgaaacgatgatatctggctggtggacttctatgccccttggtgcggccactgcaagaaactagagcctatctggaacgaagtgggtctcgaaatgaagagcatcggcagcccagtgaaagtaggaaagatggacgcgacatcatacagttccattgcatccgaatttggcgtaagggggtaccccactattaagctgcttaagggggatctggcctataactaccgcggaccaaggacgaaggacgatataatcgagttcgctcatcgcgttagcggcgcccttatcagacccctgccttcccagcagatgttcgagcatatgcagaagcggcatagagtctttttcgtctacgttggcggggagtctccgttaaaagagaaatacattgacgcagcatcggaactgatcgtgtacacgtacttcttttcagcatcagaggaggtggttcccgagtacgtcaccctcaaagagatgccagccgtcctcgtgttcaaagatgaaacatacttcgtgtacgatgagtacgaggacggagatctgtcaagttggatcaaccgagaacgcttccagaactatctggcaatggatggcttcctcctttacgaattaggggataccgggaagctagttgctctcgctgttatagatgagaagaacacctctgttgagcacacacgcctgaagagcattatccaggaagtagccagagactatcgggacttgtttcacagagacttccagtttggccatatggatgggaatgactacattaatacactcctcatggacgagctgaccgtaccaaccgttgtggtcttaaatacttcaaatcagcaatacttcctattagacaggcagattaaaaatgtggaggatatggttcagtttataaataatatcttagatggcaccgtggaggcccaagggggggactctatcttacagcgattaaaacggatagtattcgacgccaagagcacaatcgtgtccatctttaagagttcgcctttgatgggctgtttcctttttgggcttccactgggggtgattagtataatgtgctacggaatatacaccgccgacaccgacggtgggtatatcgaggaaagatatgaagtgagtaaatccgagaatgagaaccaagagcagatcgaggaatccaaggaacaacaggagcctagttcaggcggctcagtagtgcccacagtgcaagagcccaaagatgtgttggagaagaaaaaagactag

SEQ ID NO: 46829 - DNA, 594 bp, Artificial Sequence
  Description of Artificial Sequence: Synthetic coding sequence
atggccgcctggaagagctggaccgccctgcggctgtgcgccaccgtggtcgtgctcgacatggtagtatgcaagggcttcgtagaagacctggacgaatcttttaaggagaaccggaacgacgatatctggctggtggacttttatgccccatggtgtggtcattgcaaaaaattagagccgatctggaatgaggtcggcttggagatgaaatccatcgggtcacccgtcaaggtaggtaagatggatgcaacatcctacagctcaattgcttctgagtttggggtgcggggatacccaactattaaactggccctgattcggccccttccatcccagcagatgtttgagcacatgcagaaacggcaccgcgtttttttcgtttatgttgggggcgagtcacccctcaaggaaaagtatatcgacgcggcatcagaactgatcgtgtacacttatttcttttctgcttccgaagaagtggtcccagagtacgtaactttaaaggagatgccggcggtcctggtgttcaaggatgagacttattttgtgtatgacggaaagtttcagatattcaactcttgtaaaactttctag

SEQ ID NO: 46830 - DNA, 1257 bp, Artificial Sequence
  Description of Artificial Sequence: Synthetic coding sequence
atggccgcctggaagagctggaccgccctgcggctgtgcgccaccgtcgtggtgttggacatggtggtatgcaagggatttgtggaggacctggacgaatccttcaaggagaacagaaatgatgatatctggctggtcgacttctacgctccctggtgcggacactgtaagaaactggagcccatatggaacgaagtcggcctggagatgaagagtattggcagtcctgtcaaagtcggtaagatggacgctacgagctactcgtccatcgccagtgagttcggcgtgagagggtaccccaccatcaagctgttgaagggggatctggcttacaactataggggacctcgcaccaaggatgacatcatagaattcgctcaccgggtttcgggcgcactgatacgtccactaccgagtcagcaaatgttcgagcatatgcaaaaacgacacagggtgttctttgtctacgtggggggcgaaagcccattgaaggaaaaatacatcgatgcggcctctgaactcattgtgtacacgtatttcttttctgcttctgaggaagtggtgcctgagtacgtgacgctgaaggagatgccagccgtactcgtcttcaaggatgaaacgtactttgtttacgacgaatacgaggatggagacctgtcaagctggatcaatagagaacggtttcaaaactacttagctatggatgggtttcttctttatgagctaggggataccggcaaactagtcgctcttgctgtcatcgacgagaaaaacacctctgtagaacacacccgattaaaatccattatccaggaggtggccagggattaccgggacttattccatagggattttcagttcggacacatggatggcaatgactatattaatacgttgctgatggatgaactcactgttcctacagtggtggtcctgaacacatctaatcagcagtacttcctactggaccgtcagattaagaatgtggaagacatggtgcagttcattaacaacatcctggacggcaccgtagaagcccaggggggcgactcaatactgcagcgcctgaagagaatcgtgttcgacgccaagagtactattgtgagcatttttaagtccagcccgttaatgggatgttttctgtttggattgccacttggggtgatttcaattatgtgctacggtatctacactgccgacacagatggagggtacatcgaagaacggtatgaggtaagtaaaaagaagaaaaaatag

SEQ ID NO: 46831 - DNA, 1050 bp, Artificial Sequence
  Description of Artificial Sequence: Synthetic coding sequence
atggccggcggccggtgcggcccccagctgaccgccctgctggccgcctggatagcagctgtagcagcaacggccggaccagaggaagctgctctgccgccagagcagagcagggtgcagcctatgaccgcatcgaactggacacttgtcatggagggggaatggatgctgaaattttatgctccatggtgtcctagctgccagcagaccgactctgaatgggaggcctttgccaaaaatggcgaaattctgcagatttcagtgggaaaggtggacgtgatccaggagcctgggctgtctggcagattctttgtgaccacactcccagccttcttccatgctaaggatggcattttcagaaggtatcgcggaccaggaatttttgaggatctgcagaattacattctggagaagaagtggcagtcagtggaacccctcaccggctggaagagccctgccagtctcacaatgagtggcatggccggtctgtttagcatttctgggaaaatttggcacctgcataattacttcactgtgactctgggaatcccggcatggtgtagttacgtgttcttcgtcattgccaccctggtttttggcttatttatgggactggtgttggtggttatctctgagtgtttctacgttccactgcccaggcatctctccgagcgctctgagcaaaatcgtcggagcgaggaggctcatcgggctgagcagctgcaggatgctgaagaggagaaggacgattctaatgaagaggaaaataaggactctttagtggacgacgaggaagaaaaggaagatctaggcgacgaggatgaagccgaagaggaggaggaggaagacaacttggccgccggcgtagatgaggaacgttccgaagcaaacgatcagggcccacctggcgaggatggcgttaccagagaggaggtggaacccgaggaggccgaggagggaatatcagaacaaccctgccccgccgacacagaggtggtggaagattccctgagacaacgcaagtcccagcatgccgacaaaggtttgtag

SEQ ID NO: 46832 - DNA, 1806 bp, Artificial Sequence
  Description of Artificial Sequence: Synthetic coding sequence
atggactggggcaccgagctgtgggaccagttcgaggtgctggagcggcacacccaatggggactcgatctgctggacagatacgtaaaattcgtgaaggagaggaccgaggtggagcaggcatatgccaagcaactccgaagtctagtgaagaaatatctgccgaaacgtcccgccaaagatgaccctgagtcaaagttttcgcagcaacagtcctttgtgcaaatcttgcaggaggtcaatgacttcgctggacaaagggaactggtggctgagaacctatccgtgcgagtctgtcttgagctgactaagtacagccaagaaatgaaacaggagaggaaaatgcactttcaggaaggacggcgtgcgcaacagcaactggaaaatggcttcaaacaattggagaattctaaacggaagttcgagagggactgtcgcgaggctgagaaagctgcacaaacagcagagcgattggaccaggacatcaatgctactaaagcggatgttgaaaaagctaaacaacaagcccatttaaggagtcatatggcagaagagagtaagaacgagtacgcggctcagctccagcggttcaatcgggatcaggctcacttctatttctcccagatgccacaaatcttcgacaaattgcaggatatggacgaaagaagagcaacgcgtttgggagctggttacggccttttatcagaggctgagctggaagtggtgcctatcatcgctaagtgcctggagggcatgaaagtggctgccaatgctgtggaccccaagaatgactcgcacgtgctcattgagctccataagagcggcttcgcccggcctggagacgtagagtttgaggacttctcccagcccatgaatcgtgccccttccgattccagcctgggtacccccagcgatggtcggcctgagctgcggggccctgggcggtcacggaccaagagatggcccttcggtaagaaaaacaaaccacgacctccgcccttaagccctctgggcggcccggtgccatctgccctgcccaacggtcctccttcaccacgcagcggaagggatcctctcgctatcctttccgaaatcagtaagtcagtcaagccaagactggcctcattcagaagtttgcgaggatcaagaggaactgtggttaccgaggatttcagtcacctgccccccgagcagcagagaaagcggctgcagcagcagctggaggagcgcagccgggagctgcaaaaagaagttgaccagagagaagctctgaaaaaaatgaaagacgtttatgagaaaacacctcaaatgggcgatcctgcttctctggagccccagatcgctgagacactttccaatatcgaaaggctcaaactcgaagtccagaagtatgaggcttggctcgctgaggctgagtctcgcgtgctctccaacaggggagattccctgagtaggcacgcaagacccccagaccctccggcctccgctccaccagacagctcaagcaacagcgcgagccaagatacaaaagagagctcagaagaaccaccatccgaggaaagtcaagataccccaatttacaccgagttcgacgaagattttgaggaggagcccacaagtcccatcggccattgtgtggcaatctatcatttcgaggggagcagcgaagggaccattagcatggctgaaggggaagacctgagccttatggaggaggacaagggtgatggctggaccagagttaggagaaaggaaggaggggaaggatatgtgccgacgtcatacttaagggttactttgaactag

SEQ ID NO: 46833 - DNA, 1638 bp, Artificial Sequence
  Description of Artificial Sequence: Synthetic coding sequence
atggactggggcaccgagctgtgggaccagttcgaggtgctggagaggcatacacagtggggtctggacctgttggatcgttatgtcaaattcgtgaaagagcgtacggaggttgagcaagcatatgccaagcagctgagaagccttgtgaaaaaatatcttccgaaaaggccagcgaaagacgacccagagtctaagttctctcaacagcagtcattcgtgcagatcctacaggaagtgaacgactttgcgggacagagggaacttgtggctgaaaacctgtccgtgcgtgtatgtctggagcttactaagtacagtcaggaaatgaaacaggagcgaaaaatgcactttcaggaaggccgtagagcccaacaacagctggagaatgggtttaaacaactggaaaactcgaaacgaaagtttgagcgcgactgtcgggaggctgaaaaggccgcgcagactgccgagagactggaccaggatataaacgccactaaggccgacgtggagaaggcaaaacagcaggcccacttaaggtctcacatggccgaagagtccaagaacgagtacgccgcacagctgcaacgtttcaaccgagaccaagcccatttctatttcagtcagatgccacaaatttttgacaaactgcaggatatggacgaaagacgggctacccgattaggggctggctatggtctgctgagcgaggctgagctggaagtggtcccgataattgccaaatgcctagaaggcatgaaagttgctgccaacgccgtagatcccaagaatgactcacatgtgctgatcgagctgcataaaagcggatttgctaggcccggagacgttgagttcgaagacttttcccagccaatgaaccgggcaccgagtgactcttcgttgggcactccttcggatgggcgacctgaacttaggggtcccgggcggtcaaggaccaagcggtggcctttcggaaaaaaaaataagacagtcgtgacagaggacttttcacatctccccccagagcaacaaaggaagagactgcagcagcagctggaggaacgtagtcgtgagttacagaaggaggtggatcaacgggaggcccttaagaaaatgaaagacgtctacgaaaaaaccccccaaatgggtgaccccgcttctctggaacctcagattgcggagactttgtctaatatcgaaagactgaagttggaggtacagaaatatgaagcttggctggctgaggccgaatccagggtgctcagtaacaggggtgactcactaagcaggcacgcacggccccccgaccctccagccagtgcgccacccgacagctcttctaacagcgcatcccaggacacaaaagagtcctcagaagaacccccctccgaagagtctcaggataccccaatctacactgaattcgacgaagactttgaggaggagccaacaagccccatcggtcactgcgtggctatttaccatttcgaagggtcaagcgaaggcacaattagcatggccgagggcgaggatctgagcctcatggaagaggataagggggatgggtggaccagggtgaggcggaaagagggaggcgagggctacgtccctacatcttacctgcgtgttacactcaactag

SEQ ID NO: 46834 - DNA, 1782 bp, Artificial Sequence
  Description of Artificial Sequence: Synthetic coding sequence
atggactggggcaccgagctgtgggaccagttcgaggtgctggagcgccatacccagtggggccttgacctcctggatcgctacgtgaagttcgtgaaagaacgcacggaagttgagcaagcttacgcaaagcaactgcgctcgttggtgaagaagtacttgccaaaaaggccagcaaaagacgatcctgagagcaagttttcacagcagcaatcgttcgttcagatactccaggaagtgaacgactttgcagggcagagggaacttgtggccgaaaatctgagcgtcagggtgtgcctcgaactgaccaagtactctcaggaaatgaagcaggaacggaaaatgcacttccaagaaggacgtcgtgctcagcagcagctggagaatggttttaagcaactggagaactcaaagaggaagttcgagcgcgactgccgggaagcggaaaaagctgcccaaaccgcagagcgcctggatcaggacatcaatgcgaccaaagccgacgtggaaaaagccaaacagcaggctcatttaagatcacacatggccgaagagagtaagaacgaatatgccgcacagctccagcgatttaacagagatcaggcccatttttatttctctcagatgcctcagatcttcgacaaattgcaagatatggacgaacgcagggctacacgtttgggtgccggttatggccttctctcagaggcggagcttgaagtcgtgcctattattgcaaagtgcctggagggaatgaaggtcgcagccaatgctgtcgaccctaagaacgattcacacgtcttgatcgagcttcataagagtggtttcgcccgtcctggcgacgtcgagttcgaggattttagtcagcctatgaatagggctcctagcgacagcagtctgggcactccttctgatggacgtccagagctacgagggcccggccggtcccgcaccaaacgttggcccttcggcaaaaaaaacaagactgtcgtcacggaagactttagtcaccttccccctgaacaacagagaaagaggttgcagcaacagctggaagagagaagtcgagagttacagaaagaagtggaccagcgcgaagcactgaaaaaaatgaaggacgtctacgaaaagacccctcagatgggcgatccagcctcattggagccgcagatcgctgaaacactctctaacatcgaaagactgaagttggaggtacagaaatatgaagcttggcttgccgaggccgagtctcgcgtgcttagcaaccggggtgattctttgagtcggcatgcccggcctccagatccccctgcctccgccccaccagattccagttcgaactcagctagtcaggatactaaagagtcttctgaagagcccccttccgaagagtctcaggatacgcctatctacaccgagtttgacgaagatttcgaggaggaaccaacctctcccatcggacactgcgttgccatttaccactttgaagacctgggcccccctccaccaccgtcacaaggacctgcccgagccttgtcactatggccaagggtgaaaacctccgtcctgtggaaaaaaacaaagggcacagccggccccgggagcggtgggaagagagaggctcgcgcgacttgtcctcccccaacaagcgagtcacggtcaattgagccatgccagaggagggaagaagggggttgtagactactcctgctcgggcacggtgaaccccaggacctatgtacactgtttttgaccccttggctgcgacttcggcccgtttag

SEQ ID NO: 46835 - DNA, 1299 bp, Artificial Sequence
  Description of Artificial Sequence: Synthetic coding sequence
atggacgaggccgtgggcgacctgaagcaggccctgccctgcgtggccgagtcacctacagtccacgtggaggtgcaccagagaggctcctccactgccaaaaaggaagacataaacctttcagtacggaaactgttgaaccgtcacaacattgtttttggcgattacacgtggacggaatttgacgaacccttcttaacgaggaacgtgcagagtgtttcaattatcgacacagagctcaaggtcaaggatagtcagccgatcgacctttcagcctgcaccgtcgcattgcacatcttccagctcaatgaggatgggcccagtagcgaaaatctggaagaagaaactgaaaatattattgccgctaatcactgggtcctcccggcagctgaattccatggactgtgggactctctcgtatacgatgtggaggtcaaatcacaccttttggattatgttatgaccaccttgctattttcagacaagaatgtgaatagtaatcttattacttggaacagggtcgtgcttctacatggaccgcccggtaccggaaagacgagcctctgtaaggcacttgcccagaagctcacgattagactctcatcaaggtaccgatatgggcagttaatcgagattaactcccacagcttgttcagcaaatggttttcagagtcgggcaaactggtgacaaaaatgtttcagaagatacaggatttgatcgacgataaggacgctcttgtctttgtgctgattgacgaagtggagtcactgaccgctgctaggaacgcctgtagggcgggtactgagccttctgatgcaatcagggtggtgaacgccgtacttacgcagatcgatcagattaaacgccactcaaatgtcgtgatacttactacctctaatattacagagaagattgacgttgctttcgtcgatcgagctgacatcaagcagtacattggcccacctagtgcagcagcaattttcaagatttacttgagctgtctcgaagagctaatgaagtgtcagatcatctaccctagacagcagctgctcacccttagagaactggagatgattggttttattgaaaataacgtgtcaaagctgtccttgctgctgaatgacatctctcgaaagagcgaagggcttagcggtagagtactgagaaagctgccattcctggcacacgctctgtacgtccaggccccaaccgtgaccattgaggggtttctgcaggctctctccctggcagttgataagcaatttgaggagcggaagaagctggcggcgtacatctag

SEQ ID NO: 46836 - DNA, 591 bp, Artificial Sequence
  Description of Artificial Sequence: Synthetic coding sequence
atggacgaggccgtgggcgacctgaagcaggccctgccctgcgtggctgagagcccaaccgtgcacgtcgaggtgcatcagcgcgggtcgagcaccgctaagaaggaggatatcaacctgtcagtgaggaaactgttgaatagacataacattgtattcggcgactacacgtggaccgagttcgatgagccttttctcacacgtaatgtacagagcgtttccatcatcgacacagaattgaaagtgaaggacagccaaccaatagacctgtccgcctgcacggtagcgcttcatatcttccagcttaacgaggacgggcctagcagtgagaacctggaggaagagactgagaacattatcgctgccaatcactgggtgctgccagctgccgaatttcacggcctgtgggattccctcgtgtatgatgtagaggttaagagtcatttacttgattatgtcatgactaccctcctgttttcagacaagaacgtaaacagcaatctcatcaccatcgaggggtttcttcaggcgctgagtctggccgtggataagcagttcgaagaacggaagaagctggccgcttatatttag

SEQ ID NO: 46837 - DNA, 744 bp, Artificial Sequence
  Description of Artificial Sequence: Synthetic coding sequence
atgccccggctgctgcaccccgccctgcccctgctgctgggcgccactctgacctttcgtgccctgagacgcgccctgtgtcgcctgccactgcctgtacatgtccgcgctgatcccctccgcacttggaggtggcataacctgttagtttcgttcgcacactccattgtcagcggaatttgggcccttctgtgtgtctggcaaacgccagacatgttggtggaaatcgagacagcatggtctctcagcggctatctgctagtctgcttctcagccggatattttattcatgataccgtggacattgtggctagcggccagaccagagccagctgggagtacctcgtacaccacgtcatggcaatgggggcgttcttctcaggcatattctggagtagtttcgtgggggggggtgtcttgaccttgttggtggaagtgtctaatatcttccttacaatccggatgatgatgaaaatttccaacgcacaagatcacttgctctatcgtgttaataagtatgttaacttagtcatgtactttctgtttcggctcgctccacaggcatacttgacacactttttcttgcgctatgtcaaccagcgcaccctgggaaccttcttgttgggcattctgttaatgctcgacgtgatgattattatttatttcagccgcctattaaggtcagacttctgccctgagcatgtccccaagaagcagcacaaagacaaatttttgactgaatag

SEQ ID NO: 46838 - DNA, 603 bp, Artificial Sequence
  Description of Artificial Sequence: Synthetic coding sequence
atgggctacagcgccgtgcccaagtgccccccccggggccggggcagagactcagtctggcagacccccgatatgcttgtcgaaattgaaacggcctggtctctcagcggctatctgctcgtatgtttctcagccggttatttcattcacgatacagtagacattgtggcctctggacagacccgcgcctcatgggaatatctcgtccaccatgtgatggctatgggggcattcttcagtggtattttttggtcatcctttgtgggcgggggtgttctgaccctcttagtcgaggtgtccaacatctttctcactatccgcatgatgatgaagataagcaatgcgcaggatcatttgctctatcgtgtgaacaagtacgtgaatctcgtgatgtatttcctcttcaggctcgctccacaggcttatctcacacactttttccttaggtatgtgaaccaaagaacactggggacttttcttctgggtatactgttgatgctggatgtaatgattattatctatttctccaggttgttgcgcagtgatttttgccctgagcacgtcccgaagaaacagcataaggacaagttcctcaccgagtag

SEQ ID NO: 46839 - DNA, 624 bp, Artificial Sequence
  Description of Artificial Sequence: Synthetic coding sequence
atggccgccgcctggcccagcggccccagcgcccccgaggccgtgaccgcgaggctagtgggcgtactgtggttcgttagcgtcacaactggaccatggggcgcagtcgccactagcgctggtggtgaggagtccctgaaatgtgaagatctgaaggttggacagtacatttgtaaggaccctaaaataaacgacgctacccaagaacccgtcaattgcactaactatactgcgcatgtgtcctgttttccggcaccaaacattacctgcaaggattcctccgggaatgagacccatttcaccggcaatgaggtgggcttttttaagccaatatcttgtcgaaacgtgaatggctactcttacaaagtggcggttgctctgagcctctttctaggctggctaggtgccgatcgcttctacctagggtatcccgctctcggtctactgaagttctgtaccgtgggcttctgcggcattggatccctgattgactttatcctcatcagtatgcagatcgtcggcccaagtgatggctcttcatacatcatagactattacggtacaaggctgaccagactgtcaataaccaacgagaccttccggaaaactcagttgtacccctag

SEQ ID NO: 46840 - DNA, 561 bp, Artificial Sequence
  Description of Artificial Sequence: Synthetic coding sequence
atggccgccgcctggcccagcggccccagcgcccccgaggccgtgaccgcgcgactggtcggagtgctttggtttgtcagcgttactactggtccctggggcgccgttgccacctctgccggcggagaggaaagtctcaagtgcgaagaccttaaggtcggccaatacatctgtaaggatccgaagattaacgatgctacccaggaacctgtaaattgtaccaattatactgctcatgtgagctgctttccagcacctaacatcacctgtaaggactcgtccgggaatgaaacccatttcacaggaaatgaggtagggttctttaagcccataagttgtagaaacgttaacggatattcctataaagttgccgttgctctgagtttattcctcgggtggttgggtgcagaccggttctatttgggataccccgcactgggcaaggaaacagtgaccagagaagtgaaaggctttacggaaagcagaggttttcccctgttctgcgacatattcgtggtgatcatattcgtgctgtggatcggtaagctgagtcgggactag

SEQ ID NO: 46841 - DNA, 531 bp, Artificial Sequence
  Description of Artificial Sequence: Synthetic coding sequence
atggccgccgcctggcccagcggccccagcgcccccgaggccgtgaccgctagattggtgggcgtgctgtggtttgtcagcgttactacaggcccctggggtgctgtggcaacttcagctggtggggaggagtccctcaaatgtgaggatcttaaggtagggcagtatatctgcaaagacccaaagattaacgacgctacacaggagcccgtgaactgtaccaattacaccgctcacgtctcttgctttcctgctccgaacatcacttgcaaagatagctcgggaaacgagactcactttaccgggaacgaggtcggtttctttaagcctatcagttgcagaaacgtgaacggatacagctacaaggtggcagtggcgctaagtcttttcctcggctggctgggcgccgataggttctatctggggtacccagccctgggtctcctaaagttctgcaccgtggggttttgcgggattggctcgctcatcgactttatcttgatctccatgcaggtaagttttagcatatag

SEQ ID NO: 46842 - DNA, 810 bp, Artificial Sequence
  Description of Artificial Sequence: Synthetic coding sequence
atgcacatcctgaagggcagccccaacgtgatcccccgggcccacgggcaaaaaaatacgcgcagggatgggacggggctttacccaatgagaggaccattcaagaacctcgccttgcttccgtttagtctgcctctgctcggcgggggaggtagcggctcaggtgaaaaggtgtctgtgagcaagatggctgccgcttggccaagcggccccagcgctcccgaagcagtcaccgccagattggtgggtgtactgtggttcgtgagcgtgacaacaggcccgtggggagccgtcgcaacttcagccggtggcgaggagagtctgaaatgtgaggatctgaaggtgggccagtatatctgcaaggaccccaagatcaatgatgccacccaagagccagtgaattgcacaaattatacagcccatgtctcttgttttcctgctccgaatataacttgtaaagacagctctggtaacgaaacccatttcaccggcaacgaagtgggctttttcaagcctatttcctgccgtaacgttaacggctattcttacaaagttgctgttgccctgtctttattcctcggatggcttggcgctgatcggttctaccttggctatccagcgcttggactcctgaaattttgcacagtggggttttgcggaatcgggagcctcattgattttattttaatttccatgcagatcgtcggacctagcgatggatcctcttacatcattgactactatgggactaggttgaccagactctcaattacaaacgagacgtttaggaaaacacagctgtacccttag

SEQ ID NO: 46843 - DNA, 516 bp, Artificial Sequence
  Description of Artificial Sequence: Synthetic coding sequence
atgaagaagtgcctgctgcccgtgctgatcacctgcatgcagaccgccatctgcaaagaccgtatgatgatgattatgatacttcttgttaattaccgaccggacgaattcatcgaatgtgaagatcccgtggaccatgtcgggaatgccaccgcctcacaggaacttgggtatgggtgtctgaaatttggcggtcaagcttacagtgacgtggagcacacaagtgtgcaatgccacgcgctcgacggaattgagtgtgcgagcccacggacctttctcagggaaaacaagccctgcattaagtacactgggcactactttatcaccactctgctgtatagcttcttcctcggatgtttcggcgtagaccgattctgtctcggtcacacaggtaccgctgtgggtaagctgctgacactgggaggactcggtatatggtggttcgtggacctgattctacttataaccggcggtctgatgcctagtgatggttccaattggtgtacggtgtattag

SEQ ID NO: 46844 - DNA, 516 bp, Artificial Sequence
  Description of Artificial Sequence: Synthetic coding sequence
atgaagaagtgcctgctgcccgtgctgatcacctgcatgcagaccgccatatgcaaagatagaatgatgatgatcatgatcctactggtaaactacagacccgatgagttcattgaatgcgaggatccggtcgatcatgtgggcaacgctactgctagtcaagagctgggatatggatgcctaaagtttggtggccaggcatactccgacgtcgagcatacaagcgttcagtgtcacgctctcgacggaatcgagtgtgcgtcgcccagaacattcttgcgcgagaataagccctgcattaagtacacagggcactactttatcactacactcctgtatagcttcttcctgggttgctttggagttgacagattttgtctggggcatacaggcacagccgtggggaaacttcttacattgggcgggctgggaatttggtggttcgtggacctgattctcctcatcacaggtggtttaatgccctcagatggcagtaattggtgcactgtgtactag

SEQ ID NO: 46845 - DNA, 645 bp, Artificial Sequence
  Description of Artificial Sequence: Synthetic coding sequence
atggtgctgggcggctgccccgtgagctacctgctgctgtgcggccaagccgcactgctacttggaaacttgctgctgctgcattgtgtgtcaagatctcattcacagaatgccacagccgagcccgagctgacctcagccggagctgcccagccggaaggaccaggaggagcagcaagttgggagtatggcgaccctcacagtccagtgattctgtgctcctatcttcctgatgagttcatcgaatgcgaggacccagtggatcacgttgggaacgcgaccgcgagccaggaactcggttacgggtgcctcaaattcgggggccaggcttactcagacgttgaacacacaagtgttcagtgtcacgccctggatgggatcgagtgcgcctctccacggacctttctccgagagaacaaaccatgcataaagtacacggggcactactttatcactactctcctttacagctttttccttgggtgtttcggtgtggatagattttgtctcggtcatacagggaccgccgtgggcaaacttctgactctcgggggccttggtatatggtggtttgtggatctgatcttactaataactggcgggctcatgccctctgatgggtcaaattggtgcaccgtttactag

SEQ ID NO: 46846 - DNA, 516 bp, Artificial Sequence
  Description of Artificial Sequence: Synthetic coding sequence
atgaagaagtgcctgctgcccgtgctgatcacctgcatgcagaccgctatatgcaaagataggatgatgatgataatgatcctgctcgtgaattatcggcccgatgagttcattgaatgcgaagacccagttgatcacgtcgggaacgcaacagcctcccaggaactcggttatggatgcctgaaattcggtgggcaggcctactctgatgtggagcacacctctgtgcaatgccacgcactggacggaattgagtgcgcttcacccagaacatttttgcgggagaacaagccctgtattaaatacacagggcactattttataacaacccttctgtatagctttttcctggggtgtttcggcgtggacagattctgcctgggccacacaggtaccgctgtgggcaagctgttgaccttgggggggctggggatctggtggttcgtcgatctcatccttctaatcactggcggcctcatgccatcagacggttcgaattggtgtactgtgtactag

SEQ ID NO: 46847 - DNA, 192 bp, Artificial Sequence
  Description of Artificial Sequence: Synthetic coding sequence
atgaagaagtgcctgctgcccgtgctgatcacctgcatgcagaccgctatctgtaaggaccgcatgatgatgattatgattctcctcgtgaactatcgacctgacgaattcattgagtgcgaagaccctgtggaccacgtaggcaacgccactgcgagccaggagctcgggtacggatgcctgaaagtatag

SEQ ID NO: 46848 - DNA, 138 bp, Artificial Sequence
  Description of Artificial Sequence: Synthetic coding sequence
atgaagaagtgcctgctgcccgtgctgatcacctgcatgcagaccgcaatctgtaaagatagaatgatgatgatcatgatcctgttagtgaactatagacctgatgagttcatagaatgcgaggaccccgttgactag

SEQ ID NO: 46849 - DNA, 366 bp, Artificial Sequence
  Description of Artificial Sequence: Synthetic coding sequence
atgaagaagtgcctgctgcccgtgctgatcacctgcatgcagaccgccatttgtaaggatcggatgatgatgatcatgattctgttggtgaattaccggccagacgagttcatcgagtgtgaggatcccgtcgatcacgtcggaaacgctaccgcatcacaggagttaggatacggatgcctcaagtttggggggcaggcctattctgacgttgagcatacgtcagtgcagtgccacgcattggacggcattgagtgcgccagcccgcgcacttttctaagggagaacaagccctgcatcaaatatactggccattacttcatcaccacgctgctatacagtttctttctaggttgctttgggtag

SEQ ID NO: 46850 - DNA, 1215 bp, Artificial Sequence
  Description of Artificial Sequence: Synthetic coding sequence
atgccccggcccggcagcgcccagcggtgggccgccgtggccggcagatgggggtgtcgcctgctggctctcctgctgctcgtcccaggccctggcggagcttctgaaattacctttgaattacctgacaatgcaaagcagtgcttctacgaagacatcgcacagggaacgaagtgcactcttgaatttcaagtaattaccggcggccattatgacgtcgattgccggctggaggatcccgacggcaaagtgctatataaagagatgaaaaaacagtatgattcctttactttcacagcaagcaagaatggcacgtataagttttgtttttccaacgagttttccacattcacacataagacagtttacttcgatttccaggtcggtgaagaccccccactcttcccttctgagaacagagtgagcgccctgactcagatggaatcggcctgcgtttctattcatgaggccctgaagtccgtgatagattatcagacacattttcggctcagagaggctcagggccgcagccgagctgaggatcttaacaccagggtcgcctattggcactcggtggacacatctccaggttaccacgagtccgactcaaaaaagtcagaagacctgtccctttgtaacgtagccgaacactccaataccaccgagggaccgacgggcaagcaagagggggcacagtctgtggaagagatgtttgaggaggaggcggaggaggaggtctttctgaaatttgtcatactacatgccgaagatgataccgatgaggcactcagagtccagaacctcctgcaggacgattttggaatcaagcctggaattattttcgccgagatgccttgcggtcgacaacatctgcagaatttggacgacgcagtgaatggcagtgcctggactattctgctgctcactgagaactttttaagggatacctggtgcaatttccaattctacacctccctcatgaattccgttaatcgccaacataagtacaactcggtgataccaatgcgcccacttaacaatccactgcctcgtgaacggacgccattcgctctgcagactatcaatgccctggaagaggagtcgaggggttttccgacacaagtcgaacggatcttccaggagagcgtttataaaacacagcagacgatttggaaggaaacgcgcaacatggtgcagagacagtttattgcatag

SEQ ID NO: 46851 - DNA, 567 bp, Artificial Sequence
  Description of Artificial Sequence: Synthetic coding sequence
atgccccggcccggcagcgcccagcggtgggccgccgtggccggccgctggggctgccggctattagctctgctgctgctggtccctggcccgggaggcgcaagcgagattacatttgagctgcccgacaatgccaaacagtgtttctacgaagatatcgcccaagggacaaaatgtaccctggagtttcaggtgattacagggggccactacgatgtggactgtagactggaagatccagatggtaaagtgctctataaagaaatgaaaaaacagtacgatagttttacattcactgcatctaaaaacgggacttataagttctgcttcagcaacgaattttcgaccttcacacacaaaacagtttacttcgatttccaggtaggcgaggacccaccgctgttcccctctgagaatagagtgagcgccctgacacagatggaaagcgcatgtgttagtattcacgaggcattgaaaagtgtgatcgactaccagacccacttccggctaagggaggcccagggtaggagccgcgccgaggatttaaacactagagtggcgtactag

SEQ ID NO: 46852 - DNA, 375 bp, Artificial Sequence
  Description of Artificial Sequence: Synthetic coding sequence
atgcccgtgcggggccccgacgtggaggcctactgcctgcggtgcgaatgtaaatatgaggagcgatcatcagtaactattaaggtgactataatcatttacctgtcaattctcgggttgctgctgctctacatggtatacttgacactcgtcgaacccattcttaaaaggcggctctttggccatgcccagctaattcagagtgatgacgatattggggatcatcagccgtttgcgaatgcccatgatgtgctggcaaggtccaggagccgagccaatgtgttgaataaagtggagtacgctcagcagagatggaagctgcaggtccaagagcagagaaaatccgtgtttgatcggcatgtcgtactcagttag

SEQ ID NO: 46853 - DNA, 375 bp, Artificial Sequence
  Description of Artificial Sequence: Synthetic coding sequence
atgcccgtgcggggccccgacgtggaggcctactgcctgcggtgcgaatgtaagtacgaggaacggtcgagcgtcacaatcaaagtgactattatcatctacttgtcaattctcggattacttctactgtacatggtctacctcaccctggtggaacctatcctaaagcgcagactgtttggccatgcccagctgattcagagtgatgacgatatcggagaccaccaaccattcgctaacgcccatgatgtactggcgcggtccagatcaagggccaatgtcttgaataaggtcgagtacgcccagcagaggtggaaactgcaggtgcaggagcaacgcaaaagcgtgtttgaccggcacgtggtactgtcgtag

SEQ ID NO: 46854 - DNA, 597 bp, Artificial Sequence
  Description of Artificial Sequence: Synthetic coding sequence
atggccaccctgtggggcggcctgctgcggctgggcagcctgctgtccctcagttgtcttgcactgtctgtgctgctgctagcacaactttcggatgctgctaaaaactttgaggacgtcaggtgcaaatgcatttgtccaccgtacaaagaaaattctggacacatttacaataaaaacattagtcaaaaagactgcgattgcctgcacgttgtggaaccaatgccagtccgtggccctgacgtggaagcctactgcctcaggtgcgaatgcaagtacgaagagcggtccagtgtcaccataaaggtcacaattattatatatttatccatacttggcctgctgctgctgtatatggtctacttgaccctggttgaacctatcctaaagcgacgcctgtttggccacgctcagctcattcagtccgatgacgacataggcgatcaccaaccattcgccaacgctcacgacgtgctagcccggtctcggtcaagggcaaatgtgctgaacaaggtggagtacgcccagcagcgctggaaattacaagttcaggagcagagaaaatctgtttttgatcggcacgtggttctgagctag

SEQ ID NO: 46855 - DNA, 318 bp, Artificial Sequence
  Description of Artificial Sequence: Synthetic coding sequence
atgtaccggcccgtgatggccagctgcaccagcgtgagcctgtggatgatcgcactgttggttttcggggttctagccatctttgggatcactatcggcttactcgttcacttccttgctgtcgcaaataggatttacttttatcagggcagcttcaagatgctggacattccttacaacagcaattacgaacgcgaaacatctcccgaaaataactatctttcccaaatcctggaaacaagatggcttatgcactttaaagtcctggcatttacagataacatctcattcttgaagagctcacactggtgtaaatag

SEQ ID NO: 46856 - DNA, 1413 bp, Artificial Sequence
  Description of Artificial Sequence: Synthetic coding sequence
atgcccggcttcgactacaagttcctggagaagcccaagcggcggctgctttgcccattatgtgggaaaccaatgagggaaccagtccaagtgtccacatgtggtcatcggttttgcgacacctgcctgcaggagttcctctctgagggtgtctttaagtgccctgaggatcagttgcccctcgactatgcaaagatttatcctgacccagagctggaggtccaggtcctcggcttgcctataagatgtatccattccgaggaggggtgtcgctggtcgggacctttaagacacctacagggccatctaaatacatgtagctttaatgtcattccatgccctaataggtgtcctatgaagctgtctcgccgtgacttgcccgcccacttgcagcatgactgtcccaagcgcagattaaagtgtgagttttgtggctgcgacttcagtggtgaggcctacgagtcgcacgagggcatgtgccctcaggagtccgtgtattgcgaaaataagtgcggggctcgcatgatgcggcgtttgttggctcagcacgctacctccgaatgtccaaagcgcacccagccatgcacatactgcacgaaagaattcgtgttcgataccatccaaagtcaccagtatcaatgcccaagactaccagtggcatgcccaaaccagtgtggcgtgggaaccgtggcgagagaggacttaccaggtcatctgaaggattcttgcaacacagcacttgttttgtgcccctttaaggactctgggtgtaagcatagatgccctaaattagccatggcccggcacgtggaggagtctgtaaaacctcacctggcaatgatgtgcgcacttgtatcacggcagaggcaggagttgcaggagctgcgcagggaactcgaggaactgagcgttggatctgacggcgtcctcatttggaaaatcggatcttatggccgaaggctccaggaagcaaaggctaaacccaatttggaatgctttagtcctgccttctacacccataagtacgggtacaagctgcaggtgtccgcttttcttaacgggaacggttcaggtgagggaacacatttgtccttgtatattcgggtgttgccaggggcttttgacaatttgttagagtggcctttcgctcggagggtgacattcagtctgctcgatcagtcagatcctgggctcgctaaaccacagcatgttactgagactttccaccccgatccaaactggaagaatttccagaaaccaggtacttggagagggtcgctcgacgagtcatcgttggggttcggataccctaagttcatatctcaccaagatatccgcaagagaaattacgtgcgtgacgacgccgtgtttatccgagcagccgtcgaattgccccgcaaaatactgtcctag

SEQ ID NO: 46857 - DNA, 588 bp, Artificial Sequence
  Description of Artificial Sequence: Synthetic coding sequence
atgcccggcttcgactacaagttcctggagaagcccaagcggcggctgttgtgtcccctgtgtgggaaaccaatgcgagagccggtccaagtgagtacctgcggacacagattctgtgatacttgcctacaagagttccttagcgaaggcgttttcaagtgtccagaggaccagttgccgctggattacgctaaaatctaccctgatcccgaactcgaggtgcaggtactaggcctgcctatccgctgcattcattctgaagagggatgccgctggtcaggccccctccggcatctacagggccatctgaacacatgctcgttcaatgtcattccctgcccaaaccgctgcccaatgaagctctcgcgaagggacttgcccgcacatctgcaacacgactgccctaaacggcgtctcaagtgtgaattttgtggatgtgatttctcaggggaggcctatgagtcatcacttggtttcggttatcccaagttcatcagtcatcaggacatacgcaagcgcaattatgtgagggatgacgcggtgtttatccgcgctgccgtggagctcccaagaaagatcttgagttag

SEQ ID NO: 46858 - DNA, 504 bp, Artificial Sequence
  Description of Artificial Sequence: Synthetic coding sequence
atgcccggcttcgactacaagttcctggagaagcccaagcggcggctgctgtgcccgctttgtggcaagcccatgagagaacccgtccaagtctctacgtgcggacatagattctgcgacacttgtctgcaggtctccgccttcctgaacggcaatgggagcggagagggcacacacctatcactgtacataagagtcctgcccggggctttcgacaatcttctggagtggccgttcgcacgcagggtgacgttttctctgctggatcagtcggatcccggcctggccaaaccccagcatgtgaccgagaccttccatccggaccccaattggaaaaatttccagaagcctggaacatggcgtggcagcttggacgaatcgtctttaggctttgggtacccaaagttcatctcacaccaagacattcgcaagcgtaattatgtccgcgatgatgcagtgtttatccgggccgctgtggaactaccgagaaagatcctctcttag

SEQ ID NO: 46859 - DNA, 435 bp, Artificial Sequence
  Description of Artificial Sequence: Synthetic coding sequence
atgcccggcttcgactacaagttcctggagaagcccaagcggcggctactgtgtcctttgtgcgggaagccaatgagagagcctgtgcaggtgtcaacttgcggtcacaggttctgcgatacgtgcctgcaggaatttttatccgagggcgttttcaagtggcccttcgctcgccgggtcaccttctccctgttagaccaatctgatcctgggctggctaaaccacagcatgtaacggagacatttcaccctgatcccaattggaaaaattttcagaaaccggggacctggcgaggatcccttgacgaatcatctttgggtttcgggtatcccaagttcatcagccaccaggatattagaaagcgaaactacgtaagggatgatgcagtcttcattcgagcagccgttgaactccctcgaaaaatactcagctag

SEQ ID NO: 46860 - DNA, 549 bp, Artificial Sequence
  Description of Artificial Sequence: Synthetic coding sequence
atgcccggcttcgactacaagttcctggagaagcccaagcggcggctcttatgccccctgtgtggcaagcctatgcgcgaacccgtgcaggttagtacttgtggccacaggttttgcgatacttgtctgcaggaattcttgtcagaaggtgttttcaagtgcccagaggatcaattgccactggactatgcgaaatttccccatccctaccctcagatttaccctgatcccgaactcgaagtacaggtgctcgggctgccaattcggtgcatccatagcgaagaaggatgcagatggtccggacctttgagacaccttcagggccacctgaacacctgtagctttaatgtcatcccctgccctaatagatgtccaatgaaactctctagaagggacctgcctgctcatcttcagcacgactgccccaagaggcgcctcaaatgtgagttctgtggctgcgatttttcaggcgaagcatacgagagccatgagggcatgtgcccacaagagagcgtgtactgcgagaacaaatgtggtgcaaggatgtag

SEQ ID NO: 46861 - DNA, 1179 bp, Artificial Sequence
  Description of Artificial Sequence: Synthetic coding sequence
atgcccggcttcgactacaagttcctggagaagcccaagcggcggctcttatgtcccctgtgtggcaaacccatgagagaacctgtgcaggtgagtacttgcggccataggttttgtgatacctgcctgcaagagtttctgtcagagggtgtttttaagtgcccagaggaccagctgccactggactacgccaaaatctatccggatcccgaactcgaagtgcaggtccttggattgcccattcggtgcatccactccgaagaaggctgcagatggagcgggccactacggcatctgcagggccatctgaatacctgcagttttaacgtcatcccttgtcccaatcggtgcccgatgaagctgtctcgccgggacctccccgcgcatcttcagcacgattgcccaaaaaggcgcctcaaatgtgaattctgtggatgtgatttctcaggagaagcgtacgaaagtcatgaaggaatgtgtccacaggagtctgtttattgcgagaacaagtgcggcgcacgtatgatgcggcgcctccttgctcagcacgccactagtgaatgtcccaaaaggactcagccttgtacatactgtaccaaggaatttgtcttcgataccattcagtcacaccagtaccagtgcccgcgccttcctgtcgcctgtcctaatcagtgtggcgtaggtaccgtggcaagagaagacctgcctgggcatctcaaagactcatgtaatactgctctggtgctatgcccatttaaagactcgggttgtaaacatcgatgcccgaagcttgcaatggccaggcatgttgaagagagtgtgaagccccatttagctatgatgtgcgccttagtctccaggcagcgccaagagctgcaggagctgcggcgcgagctagaagagttgagcgtcggctctgacggtgtgcttatttggaaaattgggtcttatggcaggagactccaggaggcgaaagcgaagccgaacctagagtgctttagccctgcattttacactcacaagtacggttacaaactgcaagtctccgctttcctgaacggaaatggctctggggaagggacccacctctccctgtacatacgcgttctgcctggtgcattcgacaacctgctcgagtggcccttcgctaggcgggtgacattttcgcttctcggctag

SEQ ID NO: 46862 - DNA, 597 bp, Artificial Sequence
  Description of Artificial Sequence: Synthetic coding sequence
atgcccggcttcgactacaagttcctggagaagcccaagcggcggctcctgtgtcctctatgtggcaagcctatgcgagagcctgtgcaggtgtctacctgcgggcatcgcttttgtgacacttgcctgcaggaatttttaagcgaaggggtgtttaaatgcccagaggatcagctgcctctggactatgccaagatttacccagatccggaactggaagtccaggtccttggtctgccaatccgctgtatccactccgaggagggctgtagatggtctggacccttgcgacatctgcaagggcatctgaacacttgcagctttaacgttataccctgtcctaacaggtgccccatgaaactgagccgaagggatctccccgctcaccttcaacatgactgtccaaagcgacgcctgaagtgcgaattttgcgggtgcgatttctccggcgaagcttacgagagtcatgagtcttccctagggtttggctacccaaaatttatcagtcatcaggatattagaaagcgcaactatgttcgagatgacgccgtgttcatccgggcagccgtggagctgcctcggaaaatcctatcctag

SEQ ID NO: 46863 - DNA, 2436 bp, Artificial Sequence
  Description of Artificial Sequence: Synthetic coding sequence
atgcggctgatccggaacatctacatcttctgcagcatcgtgatgaccgcagagggggatgctcccgagttgcccgaggagcgcgaactgatgacgaactgctctaatatgagcttaaggaaagtccctgccgatcttaccccagctacaacaacactggacctttcttataacctcctcttccagctccagagtagcgacttccacagcgtgtccaaattgagggtgctgattctgtgccataaccgaattcagcagttggacctgaaaacttttgagtttaacaaggagttgcgctacctcgatttgagtaacaacaggctgaaatctgtcacctggtatttacttgctgggctgcggtatttggacctgtctttcaacgactttgataccatgcccatctgcgaggaagccggaaacatgtcccacctcgagatattgggactgtctggtgcgaaaattcaaaaaagtgacttccaaaagatcgcccatctgcatttaaacacagtttttctaggcttcagaactttgccgcactacgaggaggggtccctcccaatcctgaacaccacaaaactgcacattgtgcttcctatggataccaacttttgggtactactccgggatggaatcaaaacttctaagattctggagatgaccaatattgacggcaaatcccagttcgtaagctacgaaatgcagaggaatttaagcctggaaaacgctaagaccagcgtacttttgctgaacaaagtcgatctcctatgggatgatctgtttctgatcttgcagttcgtctggcacacctcagtggagcatttccagatccgaaacgttaccttcggtggaaaggcctatcttgatcacaactctttcgattacagtaacaccgtgatgaggacaataaagctggaacatgtccatttcagagtgttctacatccagcaggataagatctacctcctgctaacaaagatggacatcgaaaatttgacaatctctaacgcccagatgcctcatatgttattccccaactatcccactaaattccagtacctaaatttcgccaacaacatccttaccgatgagctgtttaaaagaactattcagctgccccatctgaagacgttgatccttaatggcaacaagctcgaaaccttgtcactggttagctgcttcgcaaataatactcccttagaacacttggacctttctcagaatctgttgcagcataagaatgatgagaactgcagttggcctgaaactgtcgtcaacatgaacctgtcttacaacaaactttccgactccgtcttcaggtgtctccccaagagcattcagatactggatctgaacaacaaccaaattcagaccgtgcccaaagaaacaatccacctgatggccctcagagaattaaacatcgccttcaattttctcactgatctgccgggatgttctcatttctctcgtctttctgttctgaacatagagatgaactttatcttatctccatctctggactttgtccagagttgtcaagaggtcaaaacactcaatgctgggaggaatccttttcgctgtacctgcgaacttaagaactttatccaactggagacatattcggaggtgatgatggtgggttggagcgatagttatacctgtgagtaccctctcaacctgagaggaactagattgaaagatgttcatctgcacgaactcagttgtaacaccgcactcttgatcgtcacaatcgttgtgatcatgcttgtattgggcctggctgtggctttctgctgcctgcacttcgacttgccgtggtacctcaggatgctgggccagtgtactcaaacttggcaccgcgtgcgtaaaacaacacaggagcaattaaaaagaaatgtgagattccacgcctttatctcttacagtgagcacgacagtctttgggttaagaatgaattgattccaaacttagaaaaagaagatgggtcaatcctgatatgtctgtacgaatcatattttgaccctggaaagtctatctccgaaaacatcgtctcattcattgaaaaaagctataaatctattttcgttctctctcccaactttgtgcagaacgaatggtgccactatgagttctatttcgcccaccacaatctgttccatgaaaatagtgaccacatcattcttatcttgttagaacccatccccttctactgcattcctacaaggtatcataagctcaaggccctgcttgagaaaaaggcatatctagagtggcccaaggacaggcggaagtgcgggttgttttgggccaacctccgcgctgctattaacgtgaacgtgcttgccacccgggagatgtatgaactccagacctttacagagctcaacgaagaaagcagggggtcaacaatttcccttatgaggacagactgcttgtag

SEQ ID NO: 46864 - DNA, 2436 bp, Artificial Sequence
  Description of Artificial Sequence: Synthetic coding sequence
atgcggctgatccggaacatctacatcttctgcagcatcgtgatgaccgccgagggcgacgcccctgaattacctgaggaacgggagctcatgacgaactgcagtaacatgagcctgcgcaaggtgccggcagatttaacccccgcgactacaacgctcgatcttagctacaacctgctcttccaactccagtcctccgattttcattcagtcagtaaattgcgggtgttgatcctctgccataaccgcattcaacaattggacctgaaaaccttcgagtttaacaaggaattacggtacttggacctctctaacaataggttgaagtctgtgacatggtacctgctggcgggtctgcgctatttagacttgtcatttaacgatttcgatactatgcctatttgtgaggaggcaggaaatatgtctcatctagagattctgggtctcagtggggctaagatccaaaagtccgatttccagaagatcgcccacctacacctgaatacggtgttcttgggcttcaggacgcttcctcactatgaagaaggcagcttaccaattttgaacactacaaagcttcatatcgttctgccaatggataccaacttctgggtgctgctgcgggatgggattaagacgagtaagattctcgaaatgactaatattgatggcaaatcccagttcgtctcctatgagatgcagagaaatctatcccttgagaatgcaaaaacctcagtccttcttctgaacaaggttgatctgctttgggacgatctctttctgatactacaattcgtgtggcatacctctgtagagcacttccagatccggaacgtgacctttggcggcaaggcctatctggaccataatagtttcgattacagcaacaccgtcatgcggaccatcaaactggagcacgtgcacttccgcgtgttttatattcaacaagataagatctacttgctactgactaagatggacatcgagaatctcactatctcaaatgctcagatgcctcacatgctgttcccaaattaccccacaaaatttcagtacctaaattttgccaataacatcttgaccgacgaattattcaagcggactattcagctgccccacctcaagactctcatacttaatggcaataagctggaaactttgtcactagtgtcatgctttgcgaacaatacccctttagaacatctcgatctgtctcagaatctcttgcaacacaagaatgatgaaaattgctcttggccagaaaccgtggtcaatatgaatttgagctacaataagctgtccgattctgtcttcaggtgcttgccaaagagcattcagattctggatctgaataacaatcagatacaaactgtccccaaggagaccatccatctcatggcccttagggagcttaacatcgcctttaacttcctcaccgatttgcctggatgttcccacttcagtcggctgtccgtgctcaacattgagatgaatttcattctgtcccctagtcttgactttgtccaaagctgtcaggaggtgaagacattgaatgcaggacgcaatccctttcgatgcacatgtgagctgaagaatttcatccagctggagacctattctgaagttatgatggtgggatggtcggactcctacacctgtgagtatcctcttaacctgagaggtacaagattgaaggacgtgcacctgcacgaactctcttgtaacacagcactccttattgtcaccatagtcgtgatcatgttggtccttggacttgccgtcgctttctgctgtttgcacttcgatctaccttggtacctgcgaatgctggggcagtgtacccaaacttggcaccgagtacgcaagactacccaggaacaattgaagcggaatgtgcgattccacgccttcattagctattccgaacacgactccttgtgggtcaaaaacgaactgatcccaaacctagaaaaagaagacggctccatcttaatttgtctgtacgaatcttacttcgatcccggaaaatccattagtgagaatatcgtgtctttcatcgaaaagagctacaagagtatcttcgtcttgtcgcccaattttgttcagaacgagtggtgccactacgagttttattttgctcatcacaacctcttccatgaaaattcagaccacatcattctcattttgctggagcctatacccttttattgtatccccaccagatatcacaaactgaaagccctgctagaaaaaaaagcctacttagagtggcccaaagatcggaggaagtgtgggttgttctgggccaacctcagggccgcaataaatgttaatgtgctcgccacacgcgaaatgtatgagctgcagacgttcactgagctcaatgaagagtcccgcggctccacaatttccctgatgagaacagattgcctatag

SEQ ID NO: 46865 - DNA, 2436 bp, Artificial Sequence
  Description of Artificial Sequence: Synthetic coding sequence
atgcggctgatccggaacatctacatcttctgcagcatcgtgatgaccgcagaaggagacgcccccgaacttcccgaggagagagaactgatgacaaattgttccaacatgtccctgagaaaagtgcctgctgacctgacgccagctaccactacgctggatctcagttataacctgctcttccagctgcagtcaagtgattttcactctgtcagtaagctacgagtgctgatcttgtgccataatcgtatacagcagttggacctaaagactttcgagttcaataaggaactgcgctacctggatctctctaataatcgcctcaagagtgtgacctggtacctcctggccggcctacgatacctggatctgtcatttaatgatttcgataccatgccgatttgcgaggaagcaggaaacatgagccatcttgagatattgggtctgagcggggctaaaatccagaaatcggacttccagaaaatcgcacacctacatcttaacacagtgttccttggattcaggaccctgcctcactatgaggagggctcactccctattctgaatacaacgaaattacatattgtcctgcccatggacacaaatttctgggttcttttgcgggatggcatcaagaccagcaagatccttgaaatgacaaacatagacggcaaaagtcagttcgttagctacgaaatgcagcggaacctgtccctggagaacgccaagacttctgtcctactgctaaataaagtggatctgctatgggatgaccttttcctgattctgcaatttgtttggcacacatcggtcgagcactttcagattcgtaacgtaaccttcggggggaaagcctatctggaccataattctttcgattattctaacaccgtgatgcggaccatcaagctcgagcacgttcacttccgcgtgttctacatccagcaagataaaatttacctcctgctgacaaaaatggatattgagaatctgaccatcagcaatgcacagatgcctcacatgctgttccctaactaccccaccaaattccagtacctcaatttcgcaaacaatatcctgaccgatgagttgtttaagcggaccattcagctgccccacctaaagaccttgatcttgaacggaaacaaactggagacgttatccctggtgagctgttttgccaacaacactccactcgagcacctcgatctgtcccagaatctgctgcagcataagaacgacgagaattgctcatggcctgaaaccgtcgtaaatatgaatctgagctataacaagctctccgactctgtctttaggtgcttacccaagtctatccagattctagacctcaacaataaccaaattcagactgtgcctaaggagacgatccacttgatggctctgagggaactgaacatcgctttcaatttcttgaccgacctacctggctgcagccacttcagcagactaagtgtcctcaacatagaaatgaacttcatcctgtctcccagtctggactttgtgcagtcttgccaggaagttaagacactgaatgccgggcgaaaccctttcagatgtacctgcgagctgaaaaacttcatccagctcgagacatacagcgaagttatgatggtgggttggagcgactcctacacctgcgagtacccacttaacttgcggggaactcggttgaaagacgtccaccttcacgagctttcatgcaacacagccctcctgatcgttacgattgtcgttatcatgctggtactcggattggccgtggccttctgctgcttacatttcgatctgccttggtatctccgaatgctaggacagtgcactcagacctggcatagggttaggaagaccacccaggagcagctgaaacgaaatgtccggttccacgccttcatcagctattctgagcatgactcactctgggttaaaaatgaattaatcccgaatttggagaaggaagatgggtctattctcatttgcttgtacgaaagttacttcgatcccggaaagtcaatctcagaaaacatcgtgagctttattgaaaaaagctacaaatcaatttttgtgctgagtcccaatttcgtgcagaatgagtggtgtcactacgagttttactttgcccatcacaatctgttccatgagaattcggaccacattatactaatcctgctggagcccatcccattctactgcattccaaccagataccacaagctgaaggccctgctcgagaagaaagcctatcttgagtggccaaaggatcgaaggaaatgcgggctcttttgggccaatctccgagccgccatcaatgtcaatgttctggcgacccgtgagatgtatgagctccagacattcaccgaactgaacgaggagagtcgtggatccactatcagccttatgcgtactgattgtctgtag

SEQ ID NO: 46866 - DNA, 2436 bp, Artificial Sequence
  Description of Artificial Sequence: Synthetic coding sequence
atgcggctgatccggaacatctacatcttctgcagcatcgtgatgacagcggagggcgacgcacccgagctgcctgaagagagagagctgatgactaactgctccaacatgagtctgcgaaaagttcctgccgatctaaccccagctacaaccaccctcgacttaagctacaacttgctgttccaattacaaagctccgacttccatagtgtgtcaaaattgagagtgctgatcctatgccataaccggatccagcagcttgacttaaagacttttgaatttaacaaagagttgcggtacctcgacttaagcaataatcgcctgaaaagcgttacgtggtacctcctggccgggcttagatatctggatctgagtttcaacgactttgacaccatgcccatctgcgaggaggctgggaacatgtcacacctagagatcctgggtcttagtggggcaaaaattcaaaaatctgacttccaaaaaattgctcatctccacctaaatacagtgttccttggttttcgaaccctgccacactatgaagagggctcccttcccattcttaatacaaccaagctgcatatcgtcctgcccatggacacaaacttttgggtccttctgcgggacgggatcaaaacaagtaaaatcttggagatgactaacatcgatggcaagtcacagtttgtgtcctatgaaatgcagcgcaatctgtctcttgagaatgctaagacttcagtccttctgctgaacaaggtggatctgttatgggatgaccttttcctgattctccagttcgtctggcatacctctgtcgagcatttccaaatacggaatgttacattcggcggcaaagcatatctggaccataactcattcgactactctaacactgtgatgaggaccattaaactagagcacgtgcacttcagggtgttctatatccagcaggacaaaatctacctgcttctgactaagatggatatcgaaaatctcacaatcagcaacgcccagatgccccacatgctatttcctaattatcctaccaaatttcagtatcttaattttgcaaacaacatactgacagacgagctgttcaagaggacgatacaattgccgcaccttaagaccctgatccttaacgggaataaactcgagacacttagcttagtctcttgcttcgccaacaacacacctctcgaacatctggacctctctcagaatctgctgcagcacaagaacgacgagaactgtagctggccagaaactgttgtgaatatgaatctctcatacaataaattatctgactccgtctttcggtgcctgccgaagagcattcagattcttgatctgaacaacaaccaaattcaaacagtgcccaaggaaaccattcatcttatggccctgagagagcttaacatcgcgttcaactttctgactgacctgccagggtgcagtcacttctccagattgagtgtgctgaacatcgagatgaacttcatcctgtccccgagtttggactttgtccagtcatgtcaggaggtaaaaacactgaacgcagggaggaaccccttccgttgcacatgcgagctcaaaaattttatccagttagaaacttattcagaggtcatgatggtgggctggagtgattcgtacacctgtgaatatccccttaacctcagaggaactagactgaaagatgtccatctgcacgagctttcatgtaatactgctttacttatcgtaactattgttgtaattatgcttgttcttgggctagctgttgcgttttgctgtctccactttgacctgccttggtatctcagaatgctaggacagtgtacccaaacttggcaccgggttcgaaagactacccaggagcagctgaagaggaacgtgcgattccacgccttcatctcatactccgagcacgattcactctgggtgaaaaacgaacttatcccaaacctggagaaggaagacggcagcatactcatttgcctatacgagtcatacttcgaccccggaaagtccatttctgaaaatatcgtgagctttatcgaaaagagctacaagagtattttcgtactgagcccaaattttgtgcagaacgagtggtgccactacgaattctacttcgcacaccacaatctattccatgagaacagtgaccacattattctgatactgctcgagcctattcccttctactgtattcccacgagataccacaagctgaaagccctgctggagaagaaggcctatctagagtggcccaaagaccgaaggaaatgcggtttattctgggcgaatctgcgcgccgcaataaacgtgaacgtgctcgccacgcgagaaatgtatgagcttcagacatttacagagctgaatgaagaatcacgcggcagcaccatcagtcttatgagaacagactgcttgtag

SEQ ID NO: 46867 - DNA, 1215 bp, Artificial Sequence
  Description of Artificial Sequence: Synthetic coding sequence
atgccccggcccggcagcgcccagcggtgggccgccgtggccggccgctggggctgtcgcctcctggctctgctgctcttagtacccggcccagggggtgcttcagagataacttttgagttgccagataatgccaagcagtgcttttatgaagatattgcccagggaaccaagtgtacccttgagtttcaggtcatcaccgggggtcactatgacgtggactgccggctcgaagaccccgatggtaaagttctgtataaggagatgaagaaacagtacgactcttttacattcaccgcatctaagaatggcacttacaagttttgtttctctaacgagttctcaacctttacccacaagactgtctattttgattttcaagtgggggaagatcctcccctctttcccagtgaaaaccgggtttcagcactgactcaaatggagagcgcctgcgtgtccatccacgaagcccttaagagtgtgatcgattatcagacccacttcagattaagagaggctcagggtcggtcccgagcagaggacctcaacacccgggtcgcctactggcactctgtggatacatcaccagggtatcacgaatcagattcaaagaagtccgaggatctgtccctttgtaatgtagccgagcattctaacacaacggagggacccacgggcaaacaagaaggtgcacagagtgtggaagagatgtttgaagaggaggctgaagaggaagtttttctgaaatttgtgatcctgcacgctgaagacgacacggacgaggcactccgcgttcaaaatcttttacaggacgatttcgggatcaagccaggaattatctttgcagaaatgccatgcggacgacaacatctacagaatctggacgatgccgtaaacggaagcgcctggactatattactgctgaccgaaaacttcttaagggacacctggtgtaactttcaattctacacatcactgatgaattccgtgaacaggcagcacaagtataattccgtgatccctatgcgcccactcaataaccccctaccacgtgaacggacgcctttcgccctgcagaccattaacgccctggaagaggaaagcaggggcttccctacccaggtggaaagaatattccaggagtctgtctacaaaacacagcagacaatctggaaggagactcgaaatatggtacagcggcaatttattgcctag

SEQ ID NO: 46868 - DNA, 708 bp, Artificial Sequence
  Description of Artificial Sequence: Synthetic coding sequence
atgggcatcggcaagagcaagatcaacagctgccccctgagcctgtcatgggggaaacgacactccgtggatacctcccccgggtatcatgagagcgattcaaagaaatcggaggacctctccctttgcaatgtcgccgaacattccaataccaccgagggacccacaggaaagcaggagggggctcagagcgtggaagagatgtttgaagaggaggcagaagaggaggtctttcttaaattcgtaattctgcatgccgaggatgacaccgacgaggcgctccgggtgcaaaacctgcttcaggacgatttcgggattaagccaggaatcattttcgcggaaatgccctgtggtcgccagcatctccagaatttagacgatgcagtcaatggctctgcatggacaatattgctgctgaccgaaaacttcctcagagacacatggtgcaacttccaattctacacttcccttatgaactctgttaatcgtcagcataagtataactcagtaatccccatgaggccacttaacaacccactccctagagagagaaccccgttcgccctccaaacgattaacgctctcgaagaagagtcacgtggatttcctactcaggtggaaaggatttttcaggagtcagtttacaagactcagcagaccatctggaaagaaaccaggaatatggttcagcgccaatttattgcatag

SEQ ID NO: 46869 - DNA, 1137 bp, Artificial Sequence
  Description of Artificial Sequence: Synthetic coding sequence
atggccggcgacggccggcgggccgaggccgtgcgggagggctggggggtctacgtgacgccccgcgcccccattagagaaggccgcgggcggctcgccccacaaaacggaggaagctccgacgccccagcataccgcacacccccgagtcggcaagggcgcagagaggtgagatttagtgacgagccaccagaggtatacggggacttcgaacctcttgtggcaaaagagaggtcccccgtgggcaaaagaactcgactggaggagtttagatcagacagcgctaaggaggaagttcgggagtcagcttactatctgcgatccaggcagcgtcggcaaccccgccctcaggagaccgaggaaatgaagacacgtaggaccacaaggctccagcagcagcatagtgaacagccccctctgcaaccgtcgcccgtgatgacacgtcgtggacttagagactcccacagctcagaggaggacgaggcttcatcccaaaccgacctctcacagactatctcgaaaaaaaccgtgaggagcatccaggaagctcctgtttctgaagaccttgttattcgtttgagacgcccccctctcaggtacccaagatatgaggcaacctcagtgcagcaaaaggttaacttcagtgaagagggcgagaccgaggaagatgatcaggactccagtcactcttctgtcaccaccgtgaaggcacgctcccgggactccgatgagagcggggacaaaacaacgcgatccagttcacagtatattgagtctttctggcagtcttcgcagtctcagaacttcactgcccacgacaagcagcccagcgttttgtccaagggatccactcttattttctacaaatattgtgatcacgagaacgcggcttttaaggacgtcgctttggtgttaacagtgcttctagaagaggaaacactgggtaccagtctgggacttaaagaagtggaagagaaggtgagagattttcttaaagtgaagttcacaaattctaacactcccaattcgtacaaccacatggatcctgataagcttaatggtctctggagcaggatttcacacttggtgctacccgtgcagccagaaaacgctctcaaaagaggcatctgtctgtag

SEQ ID NO: 46870 - DNA, 1752 bp, Artificial Sequence
  Description of Artificial Sequence: Synthetic coding sequence
atggccggcgacggccggcgggccgaggccgtgcgggagggctggggagtctatgtcacacctcgggctccaatcagagaaggtcgaggtcgcttggcaccccagaatggcgggagttctgatgcgcctgcgtaccggacccctccctcccggcagggccggagggaagtgagattttctgacgagcctccagaagtgtatggggatttcgagccactcgtggcaaaggagaggtcaccagtaggcaaaagaactcgcctggaagaattccggtcagactctgctaaggaagaggtgcgcgagtcagcttattatcttaggagccgccagagaagacagcctaggccacaggaaacagaggagatgaagacccgcaggacaactcgtttacagcaacagcattcggagcagccacccctgcagccttcccctgtcatgacgcgacggggcctgagggatagtcacagctcagaagaggacgaggccagtagtcaaaccgatctgtcacagacaattagcaagaagactgtcagatccatccaggaggctcctgttagcgaggacctggtgatacggctccgccggccaccgctgcgctatccaagatacgaagcgaccagtgtgcagcaaaaagtaaatttcagcgaagaaggtgagaccgaagaagacgaccaggactcctcacactctagcgttaccaccgtgaaggcccgctcgagagattccgacgaatcaggtgataagaccactcgctcttcttctcagtacatcgagtccttttggcagagctcacagagccagaactttacggcccacgacaaacaacctagcgttctctcaagcggctatcaaaaaacccctcaggagtgggccccgcagactgccagaatacgaacacgtatgcagaatgactctatcctgaaatcggaattgggcaaccagtctccttcaacatcttccagacaggtgaccggacaacctcagaatgctagcttcgtgaaaagaaataggtggtggcttctgccactcatagctgctttggcttcaggatccttctggtttttttcaacacccgaagtcgagactactgccgtgcaggagttccagaatcaaatgaaccaattgaagaataaataccagggacaggacgaaaagctctggaagcggtcacaaaccttcctggagaagcatcttaactccagccatccacgctcgcagcccgctattctgctccttacagcagctcgcgacgctgaagaagctctgcgctgcctctcagagcaaatcgcagacgcgtatagctcattcagaagcgtgcgcgcgatccgcatcgatggtactgataaagccactcaggacagcgatacggtgaagctggaggtggaccaggaactgtctaatggattcaagaatgggcagaacgccgccgtggtccacaggttcgaaagcttcccggccggatctaccctgatcttctataaatactgtgatcatgaaaatgccgcgtttaaggacgtggccctggttctcaccgtgctactggaagaggaaaccctgggtacctcactgggcctgaaagaggtcgaggaaaaagtgagggacttcctaaaagtgaagttcacaaactccaatactccaaactcatacaaccatatggaccccgataagctgaacggactttggtcccggatcagccaccttgtgcttccagtgcaacctgaaaacgctttaaaacgcggtatttgcctatag

SEQ ID NO: 46871 - DNA, 1413 bp, Artificial Sequence
  Description of Artificial Sequence: Synthetic coding sequence
atggccgacagcggcctgcgggagccccaggaggacagccagaaggatttggaaaacgaccccagcgtaaatagccaggcccaggaaactactattattgcctccaatgccgaagaggccgaaattttgcacagtgcgtgcggactgtccaaggaccaccaggaagtagagactgaaggtcccgagagcgcggatactggggataagagcgagtcacccgatgaagcaaatgtcgggaaacaccccaaagataagaccgaggatgagaacaagcaaagtttcctggatggagggaagggccatcacctcccctctgaaaatttgggtaaggagcccctggatccagacccttctcactcaccctctgataaggtgggaagagccgacgctcatcttgggtcttcgtccgttgcactgcccaaggaagcctcagacggaacaggagccagccaagaaccacctactactgattcccaggaggcacagtctcctggccacagttccgctggccaggaaggggaggatacccttagacgtcggctgctcgcgcccgaagcaggatctcatccgcagcagacccaaaagctcgaggagattaaggagaatgcgcaggatacgatgagacagatcaacaagaaaggcttttggagttacggaccagttatcctcgtggtcctcgtggttgccgtggttgctagcagtgtgaacagctactattctagccccgcccaacaggtccctaagaatcccgctcttgaggccttcttggcccagttttctcaattggaggacaaatttcctggccagtcctcatttctctggcaacggggccgcaaatttcttcagaaacatctgaatgcctccaacccaacggaaccagccactatcattttcacagccgccagagaaggaagagaaactctgaagtgcctttcacaccatgtcgccgatgcttacaccagcagccaaaaggtgtccccaatccagatcgatggcgccgggaggacatggcaagattcggacaccgtcaagttgctagttgacctcgagctgtcatatggattcgagaatgggcagaaagctgccgttgtacaccactttgagtcctttcccgctggatcaacgctcatcttctataagtattgtgatcacgagaacgctgcttttaaagacgtggctctcgttctgactgtgcttcttgaggaggagaccctggaagcttccgtggggccccgcgagactgaggaaaaggtgagggatttactctgggcgaagttcaccaactccgatactccaacaagcttcaaccatatggattcagataagttgtctggcctgtggtcacggatttctcatttagttctaccggtccagcccgtttcatccatagaagagcagggatgcctcttctag

SEQ ID NO: 46872 - DNA, 1014 bp, Artificial Sequence
  Description of Artificial Sequence: Synthetic coding sequence
atgcgggccgtgttcatccagggcgccgaggagcaccccgccgccttctgctaccaagtcaatggaagctgtccacgcactgtgcatacgttgggaatccaattagtgatctatctggcctgtgcagctggaatgctgatcatcgtgttaggtaatgtcttcgtagcttttgcggtgtcatatttcaaggccctgcacacccctaccaacttcttactgctgtcactggccttggccgacatgtttctgggcctcttagtgttgcccctcagtaccatcagatccgtggagagctgttggttttttggagacttcttgtgtcggctgcatacttacttggacactctgttctgtctgacaagtatatttcacctgtgttttatctctatcgatagacactgcgccatctgtgaccccttattgtacccttcaaagttcactgtccgggtggcactgagatatatcttagctggctggggggtacctgccgcatacactagcctcttcctttatactgatgtggtggagacgagactgtcccagtggctcgaggagatgccttgtgtgggttcctgccagctgctgctgaacaagttttggggctggcttaattttccactgttcttcgtcccgtgtcttatcatgatctctctgtacgttaaaatctttgttgtggccactcgtcaggcgcagcagataaccactttgtcaaaatcactggctggcgcagcaaaacacgagcggaaggcggccaaaaccttgggcattgccgttgggatatatctgctgtgctggctgcccttcacgattgacacaatggtggacagcctcctgcatttcataacccccccacttgtctttgacatctttatttggttcgcgtattttaattctgcatgtaaccctatcatttatgtctttagttaccagtggttcaggaaggcgctcaagctcactctgtcgcagaaagtgttctcaccacagacccgcactgtggacctttaccaggaatag

SEQ ID NO: 46873 - DNA, 1029 bp, Artificial Sequence
  Description of Artificial Sequence: Synthetic coding sequence
atgaccagcaacttcagccagcccgtggtgcagctgtgctacgaggacgttaacggctcctgcatcgagaccccgtattcgccagggtcacgcgttattctctataccgcatttagctttgggagtctgctggcggtctttgggaatttgctcgttatgacgagtgtcctccattttaaacagctccacagtcctacgaacttcctcatagcgtccttagcatgcgccgactttctggtaggagtgaccgtgatgctgttcagcatggttagaaccgtggaaagttgctggtacttcggagccaaattttgcaccttacactcttgctgtgatgtggctttctgctattcctccgtcttgcatctctgcttcatctgcatcgatcgctacatagtggtgaccgacccgttggtgtacgcgaccaaattcaccgtctctgtgtcaggaatctgtatttccgtcagctggatcctgcccctgacctacagtggagcagtcttttatacgggggtgaatgatgacggtctggaagaactagtctctgccttgaactgcgtgggaggatgtcagataatagtgtctcagggttgggtgctgatagactttttactattcttcatccccacccttgtgatgatcatcctgtatagtaagattttcttgatcgcaaaacagcaggcgattaaaattgaaaccaccagctctaaggtcgaatcctcgtccgaatcctacaagatcagggtagccaagcgggaacggaaagccgctaagactctgggcgtcacagtcctggctttcgttatttcttggctgccctacacagtggacatcttaatcgacgcattcatgggatttctcacacccgcctatatctacgaaatttgctgttggtccgcttactacaactcagccatgaatccacttatctatgccctcttttacccatggttcagaaaggctattaaattgattctttctggagacgttctgaaggcctctagctcaacaattagtttatttctcgaatag

SEQ ID NO: 46874 - DNA, 3780 bp, Artificial Sequence
  Description of Artificial Sequence: Synthetic coding sequence
atggacgccagcgaggagcccctgccccccgtgatctacaccatggaaaacaagccgattgtcacttgtgcaggagaccagaatctgttcacctctgtgtaccccaccctctctcaacagttgccccgggaacccatggagtggcgtcgcagctacggcagggcccccaagatgattcacctcgagagcaacttcgtgcagttcaaggaggagctacttccaaaagagggcaacaaggctctgctgaccttcccttttctacatatctattggaccgagtgctgcgacacagaggtctataaagccaccgttaaggatgatctcactaagtggcagaatgttctaaaggcacactccagtgtggactggctgattgtgattgtcgaaaacgacgcaaagaaaaagaataaaacgaatattctgccccggacttctatcgtagataagatccgtaatgatttctgcaataagcagagtgaccgttgtgtcgtgttgagcgatcccctgaaagacagttcacgcacccaggagagttggaatgcatttttgacaaaattgagaactctcctgctgatgagtttcaccaagaacctggggaaatttgaagatgacatgcgtaccctccgcgaaaagcgcactgagccaggctggagtttttgcgaatacttcatggtgcaagaagagcttgctttcgttttcgagatgctacagcagtttgaggatgccttagtccaatatgacgagttggacgccctattctcccaatacgtggtgaacttcggagcgggggacggggcaaactggctgacattcttctgtcaacctgttaagtcatggaatggcctaatcctccgcaagcccattgacatggaaaagagagagagtattcaaagacgagaagctaccttgttagatctgagatcctatctgtttagtagacagtgtaccctgctgctctttttgcagaggccatgggaagtcgctcagcgggccctggagctgctgcacaattgtgtccaggagcttaagctccttgaagtctcagtaccccccggcgctcttgattgttgggttttcctctcatgtctggaagtactgcaacgaatcgagggttgctgtgaccgcgctcagattgatagtaacatagcccacactgtgggtctgtggtcctacgccacggagaagctgaaaagcttgggatatctgtgtggtctcgtgtctgaaaaagggcctaactcagaggatcttaataggacagtggacttgctggctggtctgggggcagaacggccagagaccgcaaataccgcccaatcgccatacaaaaagctgaaggaggcattgtctagtgtcgaagcgttcgaaaagcactatctggatctttcacatgcgactatcgaaatgtatacaagcattgggcggatccgctctgccaaatttgtgggtaaagacctcgcagagttttacatgaggaagaaagcaccccaaaaagcagagatctacttgcaaggcgcacttaagaattatctcgccgaaggctgggctctccccataacgcacactcgcaaacagcttgccgagtgccagaagcacctggggcagattgagaattatctccagacttcctcactcttggcttcagaccatcatttaacagaggaggaaaggaagcacttctgccaggaaatcttggatttcgcctcccagcccagcgactcgccaggacacaagatcgtgctgccaatgcactcgtttgctcagcttcgggatctccattttgatccctcaaatgccgtagtgcacgtgggaggtgtcctgtgtgtcgaaattacaatgtattcacagatgcctgtcccagtgcacgtcgagcagattgtggttaatgttcactttagtatcgagaagaacagctatcgtaaaacagcggagtggcttactaagcataagactagcaatggcattatcaactttccccctgagactgccccctttcccgtctcgcaaaacagtcttccagctttggaattgtacgagatgtttgagagaagcccatccgataatagcctgaataccacaggcatcatctgccgcaatgtgcacatgctactcaggaggcaggagtcctcttcaagcctcgaaatgcccagcggggtcgcactggaagagggcgcccacgtgctgaggtgctcccacgtaaccttggagccaggggcaaaccagatcacctttcgcacccaggccaaagaaccagggacctatacgctgaggcaactgtgcgctagcgtagggtccgtctggttcgttctgccccatatttaccctattgtgcagtatgatgtctattctcaggagccccaactccacgtcgagccgctggctgatagtctcttggctggcatcccgcagcgtgtgaagttcacagtcactacaggccactataccattaagaacggcgacagtctgcagctgtccaacgctgaggccatgcttattttgtgccaagcggagagcagagcagtagtgtacagcaatactcgcgaacagtcttccgaggccgctcttcgcattcaaagttccgacaaggtgaccagtatatctttgcctgttgcccccgcataccatgtgatagaatttgagcttgaagtgctcagtttaccaagtgcccccgctttgggcggcgaatccgacatgcttggtatggctgagccgcatcgcaagcataaggataagcagcgtactggtcgttgtatggtcacaacggaccataaggtgagcatcgactgcccgtggtccatttactcaacagttatcgcattgaccttctccgtgccgttcaggacaacccacagcctcctgtcttctggcacacgcaagtacgtgcaagtctgtgtgcagaatctctccgaacttgacttccagctgtcggacagttatctggtggacacaggcgacagcaccgatctccagctggtccccttgaacacccaatcccagcagccaatttacagcaaacaaagtgttttttttgtgtgggaacttaagtggacggaagagccaccccctagcttgcactgccgcttctccgttggtttcagccctgcctcagaggagcagttgagtatttcattgaaaccttacacatatgagttcaaggtggagaatttcttcactctttacaatgtgaaggcagagatattcccgccgtccggcatggagtattgccggacaggtagcctgtgtagtctggaggtccttatcactaggctttcggacttattggaagtggacaaggatgaggctctaacagaatccgatgagcatttctctaccaagttgatgtatgaggttgtcgataactcttctaattgggccgtgtgtggtaaatcatgtggcgtgatctctatgcccgtggcagcccgagcaacccatcgagtgcatatggaagtcatgccgcttttcgctggctacctgccactgccagacgttcgtctgtttaagtacctgccacatcatagtgcacatagctcacagctcgacgcagactcatggattgagaacgacagtctcagcgtggacaagcatggtgacgatcagcccgactccagctctttaaagagccgagggtccgtgcattccgcttgttcatccgagcacaaaggcttgcccatgcctcgtctccaggcactacctgcaggccaggttttcaactcctccagcgggacacaggtactggttattccttcacaggacgaccatgtcctggaggtttcagtaacatag

SEQ ID NO: 46875 - DNA, 1173 bp, Artificial Sequence
  Description of Artificial Sequence: Synthetic coding sequence
atgctgatcctgtgccaggccgagagccgggccgtggtgtacagcaacactcgagcccccgcacttggcggggaatctgatatgctgggcatggctgaaccccatcgaaaacataaggacaaacaaaggacagggaggtgtatggtcacaactgaccacaaagtgtcaatcgactgtccctggtctatctattccaccgtaatcgcattaacattttccgtccctttcaggactacccattccttgctcagttccgggacccggaagtacgtccaggtgtgtgtgcagaacttgtcagaactggacttccagttgagcgattcctacttggtggatacgggcgacagcactgatcttcagctggtccctctgaacacccagtcgcagcagccaatttattccaagcagtcggtcttcttcgtatgggagcttaaatggaccgaagaacctccgcccagcctgcattgtcgattctccgttggattcagcccagcatccgaggagcagctgtccatttctctcaaaccttatacatacgagtttaaagttgaaaactttttcacgctgtataacgtcaaggccgagatttttccaccttccggaatggaatactgtcgcaccggtagtctgtgcagtcttgaggtactaattacccggctctctgatttgctggaggtggacaaagatgaggctctgaccgaaagcgatgagcatttctctaccaagctcatgtacgaagtagttgacaattcttctaactgggccgtttgcggaaaatcttgcggggtgatcagcatgccagtcgccgctagagcaactcacagggtgcacatggaagtaatgcctctgtttgctggttaccttcccctaccggacgtgcgtctttttaagtaccttccacaccactcggcccactcttctcagctcgatgctgacagctggatcgagaacgacagcttgagtgttgacaaacacggtgatgatcagccagatagcagctccctgaagtcccgagggagtgttcacagcgcttgctcatcagagcacaaagggctacctatgcctcggttacaggcactacctgcaggacaagtctttaatagctcaagtggaacccaggtgttggtcatcccttcgcaggatgaccacgtcctggaggtgtccgtgacgtag

SEQ ID NO: 46876 - DNA, 423 bp, Artificial Sequence
  Description of Artificial Sequence: Synthetic coding sequence
atgagcggcagcttctacttcgtgatcgtgggccaccacgacaaccccgtttttgaaatggaatttcttccagctggcaaagccgagtctaaggacgaccataggcatcttaaccagttcattgctcacgccgctttggatctagtggatgagaacatgtggttgagtaacaatatgtacctgaagacagtcgataaattcaatgagtggttcgtgtcagccttcgtcactgccggtcacatgaggtttatcatgctacacgacatcagacaggaagacggtataaaaaattttttcactgacgtgtacgacctttacatcaagttctcaatgaatcccttctacgagcctaacagccccattcgctccagtgcgttcgaccgcaaagtgcagtttttgggaaaaaagcaccttctcagctag

SEQ ID NO: 46877 - DNA, 567 bp, Artificial Sequence
  Description of Artificial Sequence: Synthetic coding sequence
atggaggcccggttcacccggggcaagagcgccctgctggagcgggctctcgcccgacctcggacagaggttagccttagtgcttttgccttattgttcagcgaattagtgcagcattgtcagtctagagtgttctctgttgcagaacttcagtcgaggctggccgcactgggaaggcaggtgggagcaagagtgctggacgcactggtggccagggagaaaggcgcaagacgagagaccaaggtactcggggcactcttgtttgtaaagggggccgtgtggaaagccctgtttggaaaggaggcagacaagcttgaacaggcgaacgatgacgctcgcaccttctacattatcgagcgcgagcccctcatcaacacttatatctccgtgcccaaggagaactctaccttaaattgcgcctccttcactgccgggatcgtggaggcagtcctgactcacagcggattccctgctaaggtcaccgcacattggcacaaaggaaccaccctgatgatcaaattcgaagaggctgtgatcgcccgagatagggcgttggaggggcgatag

SEQ ID NO: 46878 - DNA, 567 bp, Artificial Sequence
  Description of Artificial Sequence: Synthetic coding sequence
atggaggcccggttcacccggggcaagagcgccctgctggagcgggcactggcaagaccaaggaccgaagtgtccctgtctgcttttgccctgttattcagcgaacttgtacagcattgtcagtcaagggtgttctccgttgctgagcttcaatcacggctcgcagctctggggagacaggtgggggcccgcgtgctggatgccctggtggcccgcgaaaagggcgcgcgccgcgagacaaaggtgctaggcgccctactcttcgtcaaaggggccgtgtggaaggctctattcggcaaagaggcagataagcttgaacaagcaaacgatgatgcccggacattttatataatcgagcgcgagccattaatcaacacctacatttctgtccctaaggaaaatagcaccctaaattgcgctagtttcacagcaggaattgtggaagccgtcctgacgcacagtggcttcccggccaaagtgaccgcccactggcataagggtaccaccttaatgattaaattcgaggaagccgtgattgcacgggatcgcgcgttagagggaagatag

SEQ ID NO: 46879 - DNA, 567 bp, Artificial Sequence
  Description of Artificial Sequence: Synthetic coding sequence
atggaggcccggttcacccggggcaagagcgccctgctggagcgggccctagctcggccaaggactgaggtatcgctgtccgcttttgcgctcctgttctcggagctcgttcagcattgtcaatcccgggttttcagtgttgccgaactccagagcaggttggctgccctcggcagacaggtcggtgcacgcgtcctcgatgcactggtggcccgggagaagggcgctcggcgcgaaactaaagtattaggggccctgctgtttgttaagggcgcagtctggaaggcactgttcggtaaagaagcggacaaacttgaacaggctaacgacgacgcccggaccttttacattatagagcgagaaccgcttataaacacatatatatccgttcctaaggaaaactctacgttgaactgtgctagcttcaccgccggaattgtggaagccgtgttgactcacagtggcttcccggccaaggtaactgcccattggcataaaggcaccacgcttatgatcaagttcgaggaagctgttatcgcaagggatcgggcattggagggaagatag

SEQ ID NO: 46880 - DNA, 522 bp, Artificial Sequence
  Description of Artificial Sequence: Synthetic coding sequence
atggccgacaccgtgctgttcgagttcctgcacaccgagatggtggcagagctctgggcgcatgatcccgacccaggtcccggtgtgtctgccggtctcaggggggaggaagcaggagctaccaagggccaaaagatgtccctgtcagtccttgagggcatgggctttcgagttggacaggctttgggggagcgtctaccgagggagactcttgcttttcgcgaggagctggacgtcttgaaatttttgtgcaaagatctgtgggtcgctgtgtttcagaagcagatggactcgctgcgtacaaaccatcagggaacctatgtgctccaagacaattcgtttcctctccttctgccgatggcctcaggccttcagtacctcgaggaagcgcccaaatttctcgctttcacctgtggactactcaggggggccctttacaccctggggattgaatcagtcgttactgcttccgtggccgccctacctgtttgcaaatttcaggtggtgatacctaagtcatag

SEQ ID NO: 46881 - DNA, 480 bp, Artificial Sequence
  Description of Artificial Sequence: Synthetic coding sequence
atggccgacaccgtgctgttcgagttcctgcacaccgagatggtggccgagctttgggctcacgaccccgaccctgggcctgggggccaaaaaatgtctctctccgtcctggagggaatggggtttagagtgggacaagccttgggcgaaaggctgccgcgggaaacgctggctttccgcgaggaacttgatgtgcttaaattcctctgcaaggatctctgggtggcagttttccagaagcagatggatagcctcaggactaaccatcaagggacgtacgttttgcaagacaatagcttccccctcctcttacctatggcatcaggactgcagtatctcgaggaggccccaaaattcttagcatttacatgtggcctgttgaggggcgcgctgtatacactggggatcgaaagcgtcgtaaccgcatccgtggcagcgctgccggtctgtaagttccaggtcgtcatccctaaatcttag

SEQ ID NO: 46882 - DNA, 342 bp, Artificial Sequence
  Description of Artificial Sequence: Synthetic coding sequence
atggccgacaccgtgctgttcgagttcctgcacaccgagatggtggccgagctctgggcccacgaccctgaccctggccccggcgctgctccgggcgacgcaggcttacaaggaggcgctgggtgtccccaggttctcgtacagcgtccagtgggcggcggggtcccagaagctgacggacagccggctcatcaatcccccggcgatctccgacctgccaggcagcagctgccacccccaccccccgatggcctttggcctgctgtgtctggcgggagtacccaggtgcccggcctacatctgaggccgcctgcccgcagacctctgtatccaggccactag

SEQ ID NO: 46883 - DNA, 477 bp, Artificial Sequence
  Description of Artificial Sequence: Synthetic coding sequence
atggccgacgaggccctgttcctgctgctgcacaacgagatggtgtctggcgtctataagtctgccgaacagggagaagtagagaatggaaggtgtatcactaagctagaaaatatgggctttcgtgtgggtcaggggctgattgagcgtttcacaaaagacactgcacggtttaaagatgagctggacatcatgaagttcatttgtaaagacttttggactactgtcttcaagaagcagatcgacaacctccggaccaatcaccaaggcatttacgttctccaagataacaaattccgcctcttaactcagatgtctgcaggaaagcagtatctagagcacgcatccaaataccttgccttcacctgtggcctcatccggggcggattgagcaatctgggaatcaagtccatagtcacagcggaagtctcgtctatgcctgcctgcaaatttcaggtgatgattcagaagttgtag

SEQ ID NO: 46884 - DNA, 393 bp, Artificial Sequence
  Description of Artificial Sequence: Synthetic coding sequence
atggccgacgaggccctgttcctgctgctgcacaacgagatggtgtcaggagtttataagtctgccgagcagggcgaagtagagaacggcaggtgcattaccaagctggagaatatgggattccgcgtgggacaaggactcatcgagaggttcacaaaggacactgctcgttttaaagatgagctggacataatgaagttcatttgtaaggacttctggacgacagtgtttaagaagcaaatcgataatttgaggactaatcatcagtacctggcctttacctgcggcttgattagaggggggctgtcaaacctggggattaaatctatcgtgaccgcagaggtgagtagcatgccggcctgtaagttccaggtgatgatccagaagttatag

SEQ ID NO: 46885 - DNA, 1092 bp, Artificial Sequence
  Description of Artificial Sequence: Synthetic coding sequence
atgttcaagcggcacaagagcctggccagcgagcggaagcgggccctgctatcgcaaagagctacaaggtttatcctgaaagacgacatgcggaactttcatttcctgtctaaattggttctctccgctgggcccttaagacccactccagcagtgaagcatagcaaaaccactcatttcgagattgaaatatttgacgctcagacaaggaaacagatatgcattttagataaggtgacacagtcttccacaattcacgacgtgaaacagaaatttcataaggcatgtcccaaatggtacccctctcgtgtcgggctccagctggaatgcgggggtccttttctgaaggactacatcacaatccaatccatcgctgcatcgagcattgtgaccctctacgctacggatctcggccagcaggttagttggaccaccgtgtttttggccgaatacacaggaccattgctgatttacctacttttttacctaagaattccctgtatctacgacggaaaggagtcggcccgacggctgcgtcaccctgtcgtgcacttagcgtgtttctgccactgtattcactacattcgatatctgctggaaacactcttcgttcacaaggtcagtgccggtcacaccccgctcaagaatttaattatgagctgtgccttctattggggcttcacctcatggattgcatattacatcaaccaccccctttacacccctccttcttttgggaaccgacagatcaccgtctccgccattaatttcctaatctgcgaggcgggcaatcacttcatcaacgtgatgctctcccatccaaaccatacaggaaacaatgcctgttttccatcccctaattacaacccctttacatggatgttcttcctcgtaagttgtccaaactacacttacgagatcggctcctggatctcatttactgtcatgacacagactctaccggttggcatcttcacactgttgatgtcaattcagatgtctttgtgggctcagaaaaagcataagatctacctaagaaaattcaactcctacatccaccggaaatcagctatgattccatttattctgtag

SEQ ID NO: 46886 - DNA, 2262 bp, Artificial Sequence
  Description of Artificial Sequence: Synthetic coding sequence
atggccgccggcagcaccaccctgcacgccgtggagaagctgcaggtgcgattagcaacaaagactgagcccaagaaattggagaagtatctgcaaaaacttagtgctctgcccatgacagcagatatccttgccgagactggaattcggaaaaccgttaagaggctgcggaagcaccaacacgtgggagatttcgccagggatcttgctgcacgctggaagaaactggtgttggtggaccgcaatacgcgaccggggccacaggatccagaggagtccgcttcccggcagagattcggggaggctcttcaggaccaggaaaaggcctggggttttcccgagaatgccacggcgccacgatccccttcccactcccctgaacacaggagaacggccagacgaacccctcccggtcagcagcggccacacccccgttctcacagcagggaacctagagcggaacgcaagtgcccacgcatcgcgcctgctgactccggtagatacagggcttctccaacccgcactgcacccctccgtatgcccgagggaccagagcccgccgccccaggcaaacagcccgggcggggacacacccacgcagcccagggcggtccgctgctgtgtccgggctgtcaaggacagccccagggcaaggccgtggtgtcccattctaagggccataaaagctctagacaagagaagaggccattatgcgcccagggcgattggcactcaccaaccttaattagagagaaatcttgcggtgcgtgccttagggaagaaaccccccgcatgcctagttgggcctccgcgcgagatagacagccatccgacttcaagaccgataaggagggcgggcaagccggcagcggacagagggtaccagccctggaggaggcacctgactcccaccaaaaacggccgcaacacagccattctaataagaagcggccttccctggatggacgagatcctgggaacggtacccatggcctgtcccctgaggaaaaagaacagctttctaacgaccgcgaaacccaggaggggaaaccacccaccgcccatctggatcgaacaagtgtgagtagtctcagtgaggtggaggaagttgatatggctgaagagttcgaacaacctaccctgagttgcgaaaaataccttacttatgatcagcttcgcaagcagaaaaagaagaccggcaaatccgcgacaactgccctcggggataagcaacggaaggcaaacgagtctaagggaacaagggagtcatgggactccgctaaaaagctgccaccggtgcaggaatcacagtccgagcgcttgcaggcagcaggcgccgacagcgccggccccaagacagtcccatctcatgtgttctctgagctgtgggacctcagcgaggcatggatgcaggccaactatgatcccctctctgattctgattctatgacctcacaggccaagcccgaggccctaagcagtcctaagtttcgtgaggaggcagctttccctgggcggcgggtgaacgcaaaaatgccagtctactctggctcacgccccgcttgccaacttcaggtccccacgctgcgccagcagtgcgctcaggtcctcaggaataatcctgatgcgctgtcagatgttggtgaagtaccatattgggtgctcgagccagtcctcgaagggtggcggcccgaccagctgtaccgccggaagaaggacaatcacgccctggtcagagaaactgacgaacttaggaggaatcactgctttcaggacttcaaggaggagaagccgcaggagaacaaaacctggagggagcagtacttgcggctaccagacgcccctgagcagagactccgtgttatgactaccaacattagatctgcaagggggaacaatccaaacgggagggaggccaagatgatctgttttaagagcgttgccaaaactccctatgatacatctagacggcaggagaaatcagccggcgatgctgatccggaaaacggagaaataaaacctgcatctaagccagccggatcctcccatacgccaagttcgcagtcctctagcggcggcggccgggatagctccagtagtatcctacggtggctccccgaaaagcgtgctaacccatgtttgtcctcatctaacgagcacgccgctcccgctgctaagacaagaaaacaggcggccaagaaagtggccccgcttatggctaaggcaattcgcgattataaaagacgatttagcaggcgctag

SEQ ID NO: 46887 - DNA, 1641 bp, Artificial Sequence
  Description of Artificial Sequence: Synthetic coding sequence
atggccgccggcagcaccaccctgcgggccgtgggcaagctgcaggtgagactggctaccaagacggaacccaaaaagctggagaaatatcttcagaaactcagcgccttaccaatgaccgcagacatcttggctgagacaggtatacgcaagaccgtaaaacggctcaggaagcaccagcacgttggagacttcgccagggatttggccgcacgttggaaaaagcttgtactggttgacagaaataccgggcccgacccacaggacccagaagagtcggccagtcgtcagcgcttcggggaggccctgcaggagagagagaaggcatggggttttcccgagaacgccactgcaccaaggtcaccttcccattctcctgagcaccggcgcactgcacggcgaacccccccgggacagcagcgaccacatcctcgcagtccctctagggagccacgcgcagaaagaaaaagaccaagaatggcaccagctgactccggccctcacagggacccccccacccggacagctcccttaccaatgcccgagggtcctgagcctgccgtcccaggcgaacagcccggaagagggcatgcacatgcggctcagggcgggcctctgctcggccagggctgtcagggccagccacagggcgaggccgtagggtcccatagcaagggacataagtcatcaaggggcgcctccgctcagaaatcccccccagtgcaggagtctcagagtgaaagactgcaagctgccggagcagactctgctggcccaaagacagtgcccagtcacgtttttagtgaactgtgggatcctagcgaggcctggatgcaagcgaactatgatctgctgagcgcctttgaagcaatgacctcccaggctaatcctgaagcccttagcgccccagccctgcaggaggaggctgcgtttcccggccggagagtcaacgcaaaaatgcccgtgtattcagggtcacgcccggcctgtcagctccaggttcctacactccgccaacagtgcctgcgggtaccgaggaacaaccctgatgctcttggggacgtggagggggtcccatatagcgtactcgagcccgtactcgaaggctggacccccgaccagctataccgcacagagaaggacaacgccgctttggctcgggagacggacgagttgtggcgcattcactgcctgcaggacttcaaagaagagaagccccaagaacacgaaagctggagggagttgtacttgcgtttgcgggatgcccgcgagcagcgcttacgagtcgtgacaacaaagatccggagtgccagagagaacaagccctcgggtcgacagacaaaaatgatctgtttcaatagtgtggccaagacaccatatgatgcttccagacgccaggaaaagagtgcaggagcagccgatccggggaacggcgagatggagccagcccctaaaccggcggggtcatcgcaggcacccagcggactgggggatggggatggcggctccgtttcgggcggcggctcttccaatcgccacgcggcacctgccgacaagacccggaaacaggctgcgaaaaaggtcgcgcccctgatggcaaaggccatccgcgattacaaggggagattttcacgccgttag

SEQ ID NO: 46888 - DNA, 1641 bp, Artificial Sequence
  Description of Artificial Sequence: Synthetic coding sequence
atggccgccggcagcaccaccctgcgggccgtgggcaagctgcaggttagactggctacaaagaccgagcccaaaaagctagagaagtatctccagaaattgagcgctttacccatgactgccgatattctggctgagacagggatccggaagacagttaaacggctccgaaagcatcaacacgtgggggattttgctagagatctcgccgccagatggaaaaagctagtccttgtcgacagaaatactggaccagatccccaagatccggaggagtcagcttccagacagcgatttggagaagccctgcaggagcgggaaaaggcttgggggttccctgagaatgctaccgctcccaggtccccttcccacagccccgaacaccgtcgaacagcccggcgcacacctccagggcagcagagaccgcacccccggtctccaagtcgggagccacgggcagagcgaaagcgccctcgcatggccccagccgatagcggaccacacagagatccgccaacaagaacggcaccattaccgatgcccgagggccccgagcccgccgtccctggcgagcagccaggacgcggacatgcacacgcagcccagggaggtcccctcctgggccagggctgccaggggcagcctcaaggggaagccgtcggctcacacagcaaaggccacaaatcttctagaggcgcctccgcccagaagagccctcccgtccaggagagtcagtccgagcgcctgcaggcggctggtgcagattccgctggccccaagacagtgccgagccacgtgttcagcgaattatgggatccaagtgaagcctggatgcaagctaattatgatctgctctcagctttcgaagccatgacctctcaggccaatcctgaggctctctcggcacctaccctccaggaagaggccgctttccctggcagacgagtgaatgcaaaaatgccagtgtactctggcagtcgccccgcctgtcagctgcaagtccctacactgcggcaacagtgtctgcgggtccctcgcaacaatcctgatgccctgggggacgttgagggcgtgccctacagcgtgttagaacccgtgcttgaaggctggactcccgaccaaccatataggaccgaaaaagataacgctgctttagcgagggaaactgacgagctgtggcgaattcactgcttgcaagacttcaaggaggaaaagccccaggaacacgagtcatggagggagttatacctgcggcttcgagatgcacgcgagcagcgtctccgcgtggtaacgacaaaaattagatctgctcgggaaaacaaacctagtgggcggcagaccaaaatgatttgtttcaatagcgttgctaagaccccctacgacgcctcccggcgccaggagaagtccgccggcgccgcggaccctggtaatggggaaatggagccagcccccaaacccgccggcagttctcaggcacccagcggcctgggcgacggagacggggggtccgtgtccggcggaggaagctctaatagacacgcagcccccgccgataaaaccaggaagcaagcagctaagaaggtcgcccccctgatggccaaagcgattcgtgactacaagggccgcttcagtaggcgatag

SEQ ID NO: 46889 - DNA, 1083 bp, Artificial Sequence
  Description of Artificial Sequence: Synthetic coding sequence
atgagcggcagcgtgctgttcaccgccggcgagcggtggcggtgctttctcacgcccagtcgctcttccttgtactgggccctgcataacttttgctgtagaaaaaaaagtactacgccaaagaagatcacacctaatgtgacgttctgcgacgaaaacgcgaaagaaccagaaaacgccctagacaaactgttttcaagtgaacaacaggcctcaatcttacatgtactgaacaccgcatctaccaaagagctggaagcattcagactcttacggggaaggagatcgatcaatatcgtggaacaccgagagaatttcggcccatttcagaatttggagtcactcatgaatgttccacttttcaaatataaaagcaccgttcaggtctgcaatagcatcctgtgccctaagacgggacgtgagaaaaggaaaagcccagaaaataggtttttgagaaaactattgaagcctgatatcgagcgcgaacggctgaaagctgtgaactctatcatcagtatcgtgtttggcaccagacgcatcgcctgggctcacctggatcgtaaactaactgtgctggattggcaacaatcagacaggtggtctctcatgcgaggaatttattcatctagcgtgtacctggaagagatttcttccatcatatctaagatgcccaaagccgacttctacgtgttggaaaaaaccggcctgtctatccagaacagctccctgtttcctatcttgctccacttccatatcatggaggccatgctctatgctctgctgaacaaaacttttgctcaggatgggcaacaccaggttcttagcatgaatagaaatgccgtgggaaaacatttcgaattaatgatcggcgactccaggacgagcggcaaggagctggttaaacagtttttatttgactccattctcaaagctgatccacgggttttctttccaagcgacaaaatcgtgcactatcgacagatgttcctgtctaccgaactgcagcgtgtcgaagagttgtatgactctctgctgcaggcaatcgccttttatgagctcgccgtatttgactctcagccttag

SEQ ID NO: 46890 - DNA, 1083 bp, Artificial Sequence
  Description of Artificial Sequence: Synthetic coding sequence
atgagcggcagcgtgctgttcaccgccggcgagcggtggcggtgcttcctcacacctagtcggtcttctttgtactgggcactgcacaatttttgctgtcggaagaagtctactaccccaaagaagattaccccaaacgttaccttctgtgatgagaatgccaaggaaccagagaacgcactggataagctgttttctagcgagcaacaagcaagtatactgcacgtgctcaacacggcgagcacgaaggaattggaggcttttagacttctgagaggcaggcgcagcataaatatagtggaacatagagagaattttggccccttccagaatttagagtccctgatgaatgtgcccctgttcaaatataagagcacagtccaagtctgtaacagtatactgtgcccaaaaacggggcgggaaaaacggaaaagtcccgaaaatcgattcttacgcaagttgctgaagcccgacatcgagcgagagcgcctgaaggccgtgaattctatcataagcattgtgttcgggacgagaagaattgcctgggcacatctggatcgcaagctgaccgtcctggattggcagcaatccgatcggtggagtctgatgagagggatatacagttctagcgtgtacttggaggagatttcctctataataagtaagatgcctaaagccgatttctacgttctggagaaaacaggcttgagtatccagaatagctcactatttcctatcctgttgcactttcacatcatggaggctatgttgtacgctttactcaataagacctttgcccaagacggacaacatcaggtgctaagcatgaacagaaacgctgtgggcaagcactttgagctgatgattggggattcccggacatcgggcaaggagttagtgaagcagtttctcttcgatagcattctgaaggctgacccccgcgttttctttccaagtgacaaaatcgtgcactaccgccaaatgttcttgtcaaccgaattacaaagggtggaggaattgtatgacagcctcctgcaggctatcgccttctacgaactcgcagtctttgatagccagccatag

SEQ ID NO: 46891 - DNA, 546 bp, Artificial Sequence
  Description of Artificial Sequence: Synthetic coding sequence
atgagcggcagcgtgctgttcaccgccggcgagcggtggcggtgcttcttgaccccctcccgctctagtttatattgggccttacacaacttctgctgcagaaaaaaatctactacccctaagaagataacgcccaatgtgactttctgcgatgagaatgctaaagagcctgaaaatgccctcgataagttatttagctcggagcagcaggcttcgattctgcacgtcctgaatacagcctcaacaaaggagctagaagcattccgcctgctgcgcggacgccgaagcattaatattgttgaacatcgcgaaaattttggtccctttcagaaccttgaaagcctcatgaatgtgcccctgtttaagtataagtctaccgtgcaggtatgtaactcaatcttatgtcccaagacgggccgggaaaaaaggaaatcgcccgagaacagatttctgagaaagttgctcaaacctgacatcgagagggagcggctcaaggtatactccagttgcttgctttactgtctcatatttgaaaatctgctgtag

SEQ ID NO: 46892 - DNA, 1191 bp, Artificial Sequence
  Description of Artificial Sequence: Synthetic coding sequence
atgtggatccccgtggtgggcctgccccggcggctgcggctgagcgctctggctggagccgggagattttgtatcttaggcagcgaggctgctacaagaaaacatctccctgccaggaatcattgcggcctttccgactcctccccccagctttggcctgagccagacttccgcaatcctccccggaaggccagtaaagcttctctggattttaagaggtacgttaccgatcgccgtcttgccgagaccttagcccagatctacctgggaaagccttccagacctccccatttactccttgaatgcaacccagggccggggattctgacgcaggccctcctggaggcgggtgccaaggtggtggctctggaaagtgacaagacattcatccctcaccttgagtctctgggaaagaaccttgatggaaaacttagggttatacactgcgacttctttaaactcgatccaagatccggaggagtaattaagcctcccgccatgtccagccgcggtctctttaaaaatctggggattgaagcagtcccatggaccgccgacattccactgaaagtggtcgggatgttcccttctcgaggagaaaaaagggcgctttggaagctagcctacgatctgtatagctgcaccagcatctataagttcggaaggatcgaggttaatatgttcatcggcgaaaaggaatttcaaaaattaatggcggaccctggaaacccagacctctatcatgtgctgagcgtcatctggcagctggcttgtgagataaaagttcttcacatggaaccctggtctagctttgatatatacactcgaaaaggtccgctcgagaacccgaaaaggcgggagctcctggaccagttgcagcagaaattatacctgatacagatgatcccgaggcagaatctctttaccaagaacttgacaccaatgaattataatatttttttccacctcctgaagcactgcttcggtcgccggagcgctactgtgatagatcacctgagatccctaacaccactggatgcacgagacatactgatgcagatcggaaagcaggaagacgaaaaggtcgtgaatatgcacccgcaggattttaagaccctgttcgagactatcgagcggagtaaagactgcgcttacaagtggctatacgacgagacactcgaagaccgttag

SEQ ID NO: 46893 - DNA, 414 bp, Artificial Sequence
  Description of Artificial Sequence: Synthetic coding sequence
atgtggatccccgtggtgggcctgccccggcggctgcggctgagcgcgttggctggagcagggcggttctgcatattaggttcagaagctgcgaccaggaagcaccttccggcacgcaaccattgtgggttatccgactcctctccccagttgtggcccgagcctgacttcagaaacccaccaagaaaagcaagtaaggcatcactggactttaagaggtacgttaccgataggaggctcgccgagacactggcacagatctatctcggtaaaccgtcccgcccccctcatctgctgcttgagtgcaacccaggccccgggattctcacccaggcacttctggaagctggcgcaaaagtggtggccctcgagtcagataaaaccttcattccacatctggaaacaagcttatag

SEQ ID NO: 46894 - DNA, 1896 bp, Artificial Sequence
  Description of Artificial Sequence: Synthetic coding sequence
atggccgcccacctggtgaagcggtgcacctgcctgctgcgggaggcagccagacaagcccccgccatggcccccgtggggagactgaggttggcctgggtggctcataaaaccctaacctcaagcgccacctctcccatttcccatttacctggttccctcatggagccagttgaaaaagagagagcttcaaccccctatattgagaaacaagtcgatcacctaatcaaaaaagccaccaggcccgaggagttgctagaattgctgggcggaagtcacgatctggatagcaaccaggcagcaatggtgctgattagattgtcccatctgttgagtgagaaaccagaggataaagggctgctgattcaggacgcacacttccaccagctgctctgcttgctcaactcccagattgcctccgtatggcatgggacactatctaagcttttgggctctctctacgcacttgggatccccaaggctagcaaggaacttcagtccgtggagcaggaagttagatggcggatgagaaagttgaagtacaaacatctggccttcctcgcagagtcctgtgccaccctctcacaggagcaacacagtcaggaattgcttgcagaattgcttacacatctggagagaagatggaccgagatcgaggatagccacactctcgttactgttatgatgaaggtgggacacctgtctgaacctctgatgaataggctggaggacaagtgtctagagctcgtggagcatttcggccctaacgagctccgcaaagtactcgtgatgttggcagcccaatcaagacgatccgtccccctgttgagagctataagctaccacctggtccaaaagcctttcagtctgacaaaggatgtattactcgatgtcgcatacgcgtatggcaagctctccttccatcaaacacaggtctcacagcgtctggcaaccgatttactgtcgcttatgcctagccttacttcaggggaggtggcccattgcgcaaagagctttgcactgctcaaatggctatctctcccactgtttgaggcctttgctcagcatgtactgaacagggcacaagacattacactacctcatctctgtagcgtgctcctcgcctttgccagactcaactttcaccctgatcaagaagatcaatttttctccttagtacacgaaaagctgggcagcgaacttccagggctcgagccagccctgcaagtagatctggtgtgggctctgtgcgtcttacagcaagccagggaggcagagttgcaagccgtcctgcaccccgaattccatatccagtttctgggcgggaaatcccagaaggatcaaaacacattccagaaattgctgcacattaatgctaccgcactcttagaatacccagaatattccgggccgctgttgcctgcttctgctgtggcacccggcccgagcgccctggataggaaggtgactccgttgcagaaggaactgcaggagacccttaaaggcctcctcggtagtgccgataaaggatcacttgaggttgccacacaatacggctgggtactggacgctgaggttctactggactcagacggtgaattcctgccggtgagggatttcgttgcgcctcacttagcccagcctacagggtcccaaagtcccccgcctggcagcaagcgactggcatttctgcgctgggaattccccaattttaactccaggtccaaagacctgttggggcggttcgtgcttgccaggcgccacatcgtagcggcaggattccttattgttgacgtgccattttacgaatggctggagctcaaatctgagtggcagaaaggtgcttacctgaaagacaagatgcgaaaggcagttgcggaagagctggcaaaatag

SEQ ID NO: 46895 - DNA, 1566 bp, Artificial Sequence
  Description of Artificial Sequence: Synthetic coding sequence
atggccgcccacctggtgaagcggtgcacctgcctgctgcgggaggcagcccgacaggcacccgccatggcgcccgtgggaaggctgcgactggcatgggtggcccacaagactttaaccagtagcgccaccagccccatttctcacttgcccgggtccttgatggagcctgtggagaaagaacgggctagcaccccttatatcgagaaacaggtggatcatctgatcaaaaaggccacacgccctgaagaactgcttgagctgctgggaggatctcacgatttagactcaaaccaggccgccatggtgttaattcgcctgtcccacctcctgagtgagaaaccggaggataaaggcttgctgatacaagacgcccattttcatcagctgttgtgcttgctgaacagccagattgcctctgtgtggcacggaaccctcagcaaactcctggggtctctctacgccctcggcattccaaaggctagtaaggagctgcaatccgtggagcaggaggtgagatggcgaatgagaaagctaaagtacaagcacctcgcgtttctggccgagagttgtgccactctcagccaggagcaacatagtcaggaattgctggccgagctcttgactcacttggaacggaggtggactgaaatagaagacagtcacaccctggtgaccgtgatgatgaaggttgggcacctctcagagcctctgatgaatcgactagaagataagcacgtgctgaatagggctcaagatatcacactgcctcacctctgcagtgttttgctcgcatttgcacgtttgaactttcatcccgaccaagaggaccagttcttcagcctcgtgcacgagaagctgggctctgagctccccggccttgagcccgccttgcaggtagatcttgtatgggccctttgcgtcctccagcaggcaagagaggcggaattgcaggccgtgctgcaccctgagttccatatccagtttctgggaggtaagtcgcagaaagatcagaacacattccagaaacttttgcacataaacgctacggctctccttgagtacccagagtactctggccccctgttaccagcaagtgcagtggcaccaggcccaagtgccttagaccgaaaagtcacgcccctgcagaaggaactgcaagagacgctgaagggtctgttgggtagcgccgataaagggtcattagaggtcgccacgcagtatggctgggtgctggatgctgaagtgctgttggactccgatggagaatttttgcccgttcgcgactttgtagcacctcacttagctcaacctacagggtctcaatcgccccctcctgggagcaagcgtcttgctttcttgaggtgggaattcccaaactttaactcacggagtaaagacctattgggccggttcgtgttagcgaggagacatatcgtggcagctggttttttaatagtggatgtgcctttttatgaatggctagagttgaagtccgaatggcaaaaaggtgcctacctgaaggacaagatgagaaaagccgtggctgaggagctggccaaatag

SEQ ID NO: 46896 - DNA, 1566 bp, Artificial Sequence
  Description of Artificial Sequence: Synthetic coding sequence
atggccgcccacctggtgaagcggtgcacctgcctgctgcgggaggcagcccgccaggcacccgccatggcccctgtcggccggctgagactggcctgggtagctcataaaactctgacatcttcagcaaccagtcctatcagccacctgcctggctcgttgatggagccggtggaaaaagagagagccagtaccccctacatagaaaaacaggtcgatcaccttattaaaaaggctacccgtcccgaggagttgctcgaactgctgggggggagtcatgacctggattcaaaccaggccgcaatggtgcttatcagactgtcacacctgctaagcgaaaagccagaagataaaggtcttctcatccaagacgcccatttccaccagctgttgtgtctgctgaactctcagatcgctagcgtctggcatggcacactttccaaactgctgggcagtttgtacgctttgggaatccccaaagcttccaaggagctgcagtccgtggagcaggaggtcaggtggcggatgcgcaagttgaagtacaagcacctggccttcctcgcagaatcttgcgccaccctcagccaggagcagcattcacaagaactcctggctgagttgcttacgcacttggaaagacgctggacagagatagaggactcacataccctggttacggttatgatgaaggtgggtcacctctccgagccgctcatgaaccgcctcgaggataagcacgtccttaatagggcacaggatataacattgccacacctctgctcagtgctcctggctttcgcccggctgaatttccatcccgatcaggaagatcaattttttagcctcgtgcacgagaagctgggctctgaacttcctggcctggaacctgctctccaggtcgatcttgtgtgggcactgtgcgttctgcaacaggcacgggaggcagagctgcaggccgttctccatcctgagtttcacattcagtttcttgggggaaagtcacagaaggaccagaacaccttccagaaattgctccacattaacgccaccgccctgcttgaataccctgagtattccggtccactgctgcctgcatccgctgtggctcccgggcccagtgccttggatcggaaagtgactccactacagaaagagttacaggaaaccctgaaggggctgctggggtctgctgacaaaggatcccttgaagtggccacgcagtacggctgggttttggatgcagaagttctccttgatagcgacggggagttcctgcccgtacgcgactttgtagcgccccacctggcccagccgactggctcccagtcaccccccccgggtagcaagcggctcgcgttcctcagatgggaatttcccaattttaactctcggagcaaggacttacttggacgattcgtgctggccagacgccatattgtggccgccgggttcctaattgttgacgtcccattctatgagtggctcgaactgaaaagtgagtggcaaaagggagcctacctcaaggataagatgcgaaaggccgttgccgaagaacttgccaagtag

SEQ ID NO: 46897 - DNA, 387 bp, Artificial Sequence
  Description of Artificial Sequence: Synthetic coding sequence
atggccgcccacctggtgaagcggtgcacctgcctgctgcgggaggcagcccgtcaggctccagccatggcacccgtggggcgactgcggctcgcgtgggttgcccataagactctgacctcttctgcgacctccccaatcagccacctgccgggcagtcttatggagccagttgaaaaagagcgcgctagcaccccctatatcgagaaacaggtggaccatttgataaaaaaagccacccggcccgaagaattactcgaattactgggcggatctcacgatctggactcgaatcaagccgcgatggtactcattcgcctatcccaccttctgagtgagaagccagaggacaagggactgttgatacaggacgctcacttccattag

SEQ ID NO: 46898 - DNA, 357 bp, Artificial Sequence
  Description of Artificial Sequence: Synthetic coding sequence
atggccgcccacctggtgaagcggtgcacctgcctgctgcgggaggccgccagacaggctcctgccatggcccccgtgggaaggctgagactggcttgggtggcacataaaaccttgacctcgagcgccacatcaccaatcagccatctgcctgggtcattgatggagccggtggagaaagaaagagcgagcacgccctatattgagaaacaggtggaccatttgatcaagaaagcgacgcgaccagaggaactcttagagctgctcggaggctcccatgacttggattctaatcaagctgccatggtcctgatacgtctctcccatcttcttagcgagaagccagaagacaaatag

SEQ ID NO: 46899 - DNA, 1896 bp, Artificial Sequence
  Description of Artificial Sequence: Synthetic coding sequence
atggccgcccacctggtgaagcggtgcacctgcctgctgcgggaggcagcgagacaggcgccagccatggctccagtgggtcgcttacggctggcctgggttgcacacaagacactcacaagctcggccacaagccccatctcgcatttgcctgggtcattgatggaaccagtcgagaaggagagagccagtactccctacattgaaaaacaagtggatcacctgatcaaaaaggcgacgcggcccgaggagttacttgagttactcggcggaagccacgacctcgatagtaatcaggccgccatggtgctcatccgtcttagccatttgctgtcagaaaagccagaggataagggactcctgatccaggacgctcacttccaccagttgctatgcctcctcaacagtcagatcgcgtccgtctggcatggaaccctttccaagctgttaggttctttatacgccctcggtatccccaaggcatctaaggagttacagtctgtggaacaggaagtgagatggcgcatgcggaaacttaagtataagcatcttgcgtttttagccgaatcgtgcgctactctgtcccaggagcagcattcccaggaactgctcgccgagctgctaactcatttagagcgccggtggaccgaaattgaggacagtcacactctggtgacagtgatgatgaaggtgggccacctctctgagcccctgatgaaccggttggaggataagtgccttgaacttgttgagcatttcgggccaaatgagcttcgcaaagtccttgtgatgctggctgcccaaagcagacgaagtgtaccgctgctcagggccattagctatcacctggtacaaaaaccattttcactcaccaaggatgtgctgttagacgttgcatatgcttatggtaaattaagttttcaccaaacacaggtttctcagagacttgctaccgatctgctgtctctgatgccttccctgacctctggcgaggtagcccactgcgccaaaagcttcgccctcttgaagtggctatccttgccactcttcgaggccttcgcccagcacgttctgaacagagcccaggatattaccctcccgcatttgtgctcagtgctgttggctttcgccaggcttaactttcacccagaccaggaagatcagtttttttccttggtacacgagaaactgggatcagaattacctgggctcgaacctgccttacaggtggatctggtgtgggccctctgcgtgctccaacaagctcgcgaagccgagctgcaggccgtgctccaccctgagtttcatatccagtttctgggcgggaagtcccagaaagatcagaacacgttccagaagttgctccatattaacgccactgctttattggaatatcccgaatacagtggaccattactgccagccagcgctgtggcgcccggcccttccgccctggacaggaaggtgacgcctctccagaaagagctccaggagacactgaagggcttgctgggctcagctgacaagggcagcctggaggttgccacacagtacggctgggtgctagatgctgaggtactccttgacagcgatggcgagttcttaccagtacgtgattttgtggcaccgcacctggcacagcccaccggaagccagtccccacctcctggctcaaagagacttgcattcctgcgctgggaattcccaaactttaattcccgctcaaaggatcttctggggaggtttgtcctggctcggaggcacatcgtggccgccgggtttctcatagtggacgtgcccttctacgaatggctggagttaaagagtgagtggcagaagggagcatatctgaaagataagatgcgtaaggctgtggcagaggagctggccaaatag

SEQ ID NO: 46900 - DNA, 312 bp, Artificial Sequence
  Description of Artificial Sequence: Synthetic coding sequence
atggccgcccacctggtgaagcggtgcacctgcctgctgcgggaggccgcacgccaggcaccagcaatggccccagtcgggcgccttagattggcttgggtcgcccataagaccctaacttcctctgccactagcccgatcagtcatctccctggcagtctgatggagcccgtcgagaaggaaagggccagcaccccctacatcgagaaacaggtggatcatctgattaagaaggcgactcgtccggaggagcttctggaactgctggggggctcccacgaccttgattctaaccaggcagctatggtgtag

SEQ ID NO: 46901 - DNA, 2547 bp, Artificial Sequence
  Description of Artificial Sequence: Synthetic coding sequence
atggagggcagccccagcctgcggcggatgaccgtgatgcgggagaaggggcgccggcaggccgtcaggggccccgcctttatgtttaatgatcgtggaaccagtctgacagcagaagaagagcgctttctggatgctgcggagtacggtaacattcccgtcgtgcgcaagatgctggaagaaagtaaaaccctcaatgtgaattgcgtcgattatatggggcagaatgccctccagctcgctgtcggaaacgagcacctggaggttaccgaactgcttctaaagaaggagaatctagcaagaattggagatgccttgctgctggcaatctctaaagggtacgtgcggatcgtcgaggcgatcttgaaccacccaggctttgccgcttctaaacgtcttaccctttccccatgcgaacaggagctgcaagatgacgatttctacgcatacgacgaggacgggaccagattcagtccagatatcacccccatcatcctggctgcacattgtcaaaagtatgaggtggtgcatatgctgctaatgaaaggcgcacgcattgagcggccccacgactatttctgcaagtgtggcgactgtatggaaaagcagcggcacgacagcttcagtcactcacggtccagaattaacgcatacaagggcctggcttcaccagcctacctgagcctttccagtgaggacccagtcctaactgccctcgagctctccaacgagctggccaaactggcaaatatcgaaaaggaattcaagaatgattatcggaaactctccatgcagtgcaaagattttgttgtcggcgtgctcgacctctgccgggatagtgaggaggtcgaggctatcctgaacggtgacttagagagcgctgaacccctggaggtccatcgacacaaggccagcctgagccgggtcaaacttgcgattaaatacgaagtgaaaaagtttgtggctcacccgaattgtcagcagcagctcctaaccatttggtacgaaaatctgtctgggctgagggaacagaccatcgcaatcaagtgtcttgttgtcctggtcgtggctctcggcctgcctttcttagcgatcgggtattggatagccccttgttcccgcttgggcaaaatcctgcggagtccatttatgaaattcgtggcccatgctgcctcttttatcatcttcctgggtctcctcgtcttcaacgcatcagaccgtttcgaaggtataacgactcttcccaacattaccgtgacggactatcccaagcagattttccgggtgaaaactacccagtttacgtggaccgagatgttgattatggtgtgggttctaggaatgatgtggtccgagtgtaaagagctctggctcgagggtccccgggagtatatccttcagttgtggaatgttttggacttcgggatgctctccatcttcatcgctgcctttacggcacgctttctggcctttcttcaggccacgaaagcccagcagtacgtggatagttacgtacaggagtctgacctctctgaggttacactgccccccgagattcagtattttacttacgcaagggataagtggctgccaagcgatccccagataatcagtgagggcctgtacgcaattgctgtggttctcagtttctccagaatcgcttatatactgccagccaacgagagcttcggcccactccagattagcctcggaaggaccgtgaaggatatcttcaaattcatggttctgtttatcatggtgtttttcgctttcatgattggcatgtttatcttgtatagctactacctgggagctaaggtgaacgccgctttcacaaccgtggaggagtccttcaagaccctattctggagcatctttggactctcagaggttacctctgtggtcttaaaatacgaccacaaatttatcgaaaacattggctacgttctgtacggcatttacaacgtcaccatggtagttgtgcttttgaatatgctaatcgctatgattaatagtagctaccaggagattgaggacgacagtgacgttgaatggaagtttgctagaagtaagctgtggcttagttacttcgatgacgggaagacattgcctcctccatttagcctggtcccatcccccaaatcctttgtttattttataatgaggatcgtcaatttcccgaagtgtcggaggcgaaggctacagaaagatattgaaatgggtatgggaaattctaagagtaggctgaaccttttcactcagagcaactctcgagtgtttgaatcacacagtttcaactcgatcctcaaccaaccaacccgttaccagcagattatgaagcggctgataaagaggtatgtgttgaaggcccaggtggacaaagaaaacgacgaggtgaacgaaggggaactgaaagagattaagcaggatatcagcagcttacggtatgaactgcttgaggataagtcacaggctactgaggaactggccatcctcatccacaaactgtccgagaagctaaacccttcaatgctgcgctgtgagtag

SEQ ID NO: 46902 - DNA, 2766 bp, Artificial Sequence
  Description of Artificial Sequence: Synthetic coding sequence
atgagcaccaaggtgcggaagtgcaaggagcaggcccgggtgacctttcctgctccagaggaagaagaggacgagggtgaagatgaaggcgcagagccccaacggcgccggcgaggctggcggggcgttaacggcggcctcgaaccaaggagtgctccctctcaacgcgaaccacatggctactgtccgcctccctttagccacggcccagacctgagtatggagggctccccctccctccgacgaatgaccgtgatgagggagaaggggaggagacaggccgtgcgtggtccagccttcatgtttaacgatcgggggacgtcccttacagccgaggaagaacgttttctggacgccgccgagtacgggaacatacctgtggtgcggaaaatgcttgaagaaagcaaaacgctgaacgtgaactgcgtggattacatgggacagaatgccttgcaactcgccgtgggtaacgagcaccttgaggtcaccgagctcctcctgaaaaaggagaatctggcaaggattggcgatgctcttctgctggccatctccaaaggttatgtccggatcgtggaagccattttaaaccatcctggcttcgccgcttctaaaaggctgaccttgtcgccttgcgagcaagaactgcaggacgatgacttctacgcctacgacgaggatggtacgcgattctctcccgacattaccccaatcatcctggcagcacactgccagaagtacgaggttgtgcacatgctgttgatgaaaggagcgcggatagagcgcccgcacgactacttttgtaagtgtggggattgtatggaaaagcagcgacatgattcattttcacatagcaggagtaggataaatgcctataaaggactcgcatccccggcctatctgtcgttgagcagtgaggacccagtccttacggccctggaactgagcaacgagctggccaagctcgcaaatatcgagaaagagtttaagaacgactatcggaagctgtctatgcagtgcaaggacttcgttgttggcgtattggacctatgtcgcgatagcgaggaggtggaagctatcttgaacggtgatctggagtcagccgagcctctcgaggtgcatagacacaaggcttcactgtccagagtgaaacttgccatcaagtatgaagtcaagaagtttgtcgctcatccaaactgccaacagcagctcctgaccatctggtacgagaatctttctgggctcagagagcagactattgcaatcaaatgtctcgtggtcctcgtggtggccctcggactccccttcttagccattgggtactggatcgcgccctgcagtcgcctcggtaagatcctccgatcgcccttcatgaagttcgtggcccacgctgctagcttcatcatcttcttaggcctccttgttttcaacgcctcggatcgcttcgagggcatcacgaccctgccgaatataaccgtaaccgactatcccaagcagattttccgcgtgaaaactacccagtttacctggactgaaatgttaatcatggtctgggtgctggggatgatgtggagtgaatgtaaagagctctggcttgagggtcctagagagtacatcctccaattgtggaacgtccttgattttggcatgctgtccatctttattgccgccttcacagctagattcctcgccttcctgcaggcaaccaaggcacagcaatacgtcgacagctatgtgcaagaatctgacctctccgaagtaacgttgccacccgaaatccaatactttacctatgctcgagataaatggctccccagtgatcctcagatcatcagtgaaggattgtatgctattgctgttgttctcagctttagcagaattgcttacatacttcctgcgaatgagtcctttggtccacttcagatcagcctggggagaacagtaaaggatattttcaagtttatggtgctgttcataatggtcttcttcgccttcatgatcggcatgttcatcctgtatagctactacctaggagcaaaggttaatgcagcatttacaacagtggaggagtcatttaagactcttttttggagcattttcggcctgagtgaagttacctctgtcgtgctgaaatacgatcataaatttatcgagaatattggctacgtattatacggtatatacaatgtgactatggtggtggtgctgctaaatatgctaattgccatgatcaattcttcctaccaggagatcgaagatgactccgacgtggagtggaaattcgctcgttccaagctgtggttgtcctactttgacgatgggaagacactgccccctccattcagcttagtgcctagcccaaagtcattcgtgtactttatcatgagaatcgtgaactttcctaaatgcagacggagaagactgcaaaaggatattgagatgggtatgggcaacagtaagagtagattgaacctgtttactcaaagcaattcaagggtctttgaatcacatagcttcaactccattttgaaccaaccgacacggtatcagcagatcatgaagcggctgatcaagagatacgttctgaaagcccaggtagacaaggagaacgacgaggttaatgagggcgaactcaaggagataaaacaggatatctcctccctccggtacgaactcctggaggacaagtcccaggctactgaagagttagctatcctgatacataaattgagcgagaaactgaacccatcaatgctaagatgcgaatag

SEQ ID NO: 46903 - DNA, 282 bp, Artificial Sequence
  Description of Artificial Sequence: Synthetic coding sequence
atggagggcagccccagcctgcggcggatgaccgtgatgcgggagaaaggtcgacgtcaggccgttagaggacccgccttcatgtttaatgaccggggcacatccctcaccgctgaagaagaaagattcttggatgctgccgaatacggtaatatccccgtggtgagaaagatgctggaggagtcaaaaaccctgaacgtgaattgcgtggattatatgggacagaacgcgctccagctcgcagtgggtaatgagcaccttgaggttacagagctgctttag

SEQ ID NO: 46904 - DNA, 2382 bp, Artificial Sequence
  Description of Artificial Sequence: Synthetic coding sequence
atggagggcagccccagcctgcggcggatgaccgtgatgcgggagaagggccgccgccaagctgtcagaggtcctgccttcatgtttaacgataggggtacgagtctgacagccgaggaagagcgtttccttgacgccgctgagtacgggaatatacctgtcgtcaggaaaatgctggaagagtctaagaccttgaacgttaactgcgtggattacatgggccaaaatgccctccagctggccgttgggaacgaacacctcgaggtgactgaactgttgctgaaaaaggagaacctcgctcgaattggggacgcgctgctgctcgcaataagtaaaggctatgtaaggattgtggaagccattcttaaccaccccggttttgctgcctccaagcggctgactctgtccccttgtgaacaggagctgcaagatgacgatttctacgcctatgatgaagacggaacccggttttctcctgacattacccctataattctggcagctcactgccagaagtacgaagttgttcatatgttactgatgaaaggtgcaagaatcgagcgacctcacgattacttttgcaagtgcggcgattgtatggaaaagcagagacatgattcattcagccatagcaggtctcggattaatgcctacaaagggttggcaagccctgcttatctatctctgtcttccgaagatcccgttcttactgctctagagttgtccaatgagctggctaaactggccaacatcgaaaaggagtttaaaaacgattaccgaaaactgtcgatgcagtgcaaggatttcgtggtcggcgtgcttgatttgtgccgggactctgaagaggtcgaggcaatcttgaacggggacttagaaagtgctgagccgcttgaggtccatcgccacaaagcaagtctatcaagagttaagctagccattaaatacgaggtgaaaaaactggggaagattttgaggtccccttttatgaaatttgtcgcacacgccgctagcttcataatctttctaggtttgttagtgttcaacgcctctgataggtttgaggggattactaccttaccaaacattactgttaccgattacccaaagcaaatcttcagggtgaagacaactcaattcacttggactgaaatgctgattatggtgtgggtactggggatgatgtggtctgaatgtaaggagttgtggctggaaggcccccgcgagtacatccttcagctgtggaacgtgcttgactttgggatgttatctatcttcatcgccgcttttacggcccgcttcctggcgtttttgcaagcgacaaaagctcagcagtacgttgactcatatgtgcaggagtctgacctgagcgaggttaccctcccacctgagatccagtatttcacgtacgcgagagataagtggctgccctctgatccccaaatcattagtgaggggctgtatgctatagcggtggtgctatcctttagccgcatagcctatattctgcccgcgaatgagtcttttggtccgctacagatttccttaggtagaacagtaaaggatatcttcaagtttatggttctgtttatcatggtcttctttgcctttatgattgggatgttcatcctgtattcttattacctgggagccaaggtgaatgcagcgttcacgacagtggaagagtcatttaaaacccttttctggtctattttcgggttgagcgaggtgacatccgtggtgctcaaatatgatcacaaattcattgagaacatcggttacgtgctttatggcatatataatgtcacaatggtggttgttcttttgaacatgctgattgccatgattaacagttcataccaggagatcgaggacgactcagacgtagagtggaaattcgcccggagtaagctgtggctcagttactttgacgacggaaagactctgcctccacctttcagcctggtgcccagtcccaaatccttcgtgtatttcataatgcgtatcgtgaacttccccaagtgcagaagacgcagattgcaaaaggacattgagatggggatggggaacagtaagagcaggctgaatctctttacccagagtaactctcgtgtgtttgaatcccacagcttcaacagcatcctgaatcagcctaccaggtatcagcagatcatgaaaagactgatcaaaaggtatgtcttgaaagcacaggtggataaggaaaatgatgaggtcaatgaaggggaattgaaagagatcaaacaagatattagtagccttagatacgaactgcttgaggataaaagccaagcaactgaagaattggccattctcatccacaaactttctgaaaagctcaacccatctatgctgaggtgcgagtag

SEQ ID NO: 46905 - DNA, 747 bp, Artificial Sequence
  Description of Artificial Sequence: Synthetic coding sequence
atgatctgcaccttcctgcgggccgtgcagtacaccgagaagctgcacagatccagcgcgaagcggttgctgctcccctatattgtcttaaataaagcttgtctcaaaacagagcctagtctcagatgcggcctccagtaccaaaaaaaaacgctacgcccacggtgcattctgggggtgacccagaagacgatatggacacaaggaccctcgcctcgaaaggcaaaagaagacggcagcaagcaggttagtgtgcaccgatcacagagaggtggaacagccgttcctacatcccagaaggtgaaagaagcaggtagagattttacataccttatagttgtgctcttcggaatctctataactggcggactgttctataccatctttaaggagcttttttccagtagcagcccttctaagatctacgggagagccttggagaaatgtcggtcacaccctgaggtgataggagtctttggggagagtgtcaaggggtatggcgaagtgacccgacgcggcagacgccaacacgtcaggttcacggagtatgtgaaggacggtttgaaacacacgtgcgtaaaattttacattgaaggatccgaacccgggaagcaagggactgtgtatgctcaggtgaaagagaaccctggttcaggcgagtatgatttccgatacatttttgtggaaatcgagtcttaccccagacgtaccattatcattgaggataataggagccaagacgattag

SEQ ID NO: 46906 - DNA, 405 bp, Artificial Sequence
  Description of Artificial Sequence: Synthetic coding sequence
atggagggcggcggcggcagcggcaacaagaccaccggcggcctggctggtttcttcggggcaggtggggcgggctactctcacgcggatctggctggtgttcccctgacagggatgaaccctctttctccgtacctcaacgtcgaccctaggtatctagtgcaggatacggatgaattcattctacccactggcgctaataagaccagaggaagatttgagctggcctttttcacaatcggtggctgctgcatgacaggcgccctgtgggcaaacacactggggagcctggccctactgtattccgcttttggcgtcataattgaaaagactaggggcgccgaagacgacttaaacacagtagctgcgggtactatgacaggaatgctttacaagtgcacctag

SEQ ID NO: 46907 - DNA, 516 bp, Artificial Sequence
  Description of Artificial Sequence: Synthetic coding sequence
atggagggcggcggcggcagcggcaacaagaccaccggcggcctggcgggatttttcggagctggcggtgcagggtactctcacgcagatctggccggcgtgcctttgacaggcatgaatccccttagcccctatttaaatgtggatcctcgctacctcgtccaggatacagatgagttcatcttgcctaccggcgccaataaaacaagaggacggttcgaactggccttctttaccattggaggatgctgcatgacaggcgccgctttcggcgccatgaacggcctgaggctgggactgaaagaaactcagaatatggcctggagcaagccgcgtaatgtgcaaatccttaacatggtgacaaggcagggcgcactatgggcaaacaccctggggtcattggccctgctgtatagcgctttcggagttatcatagaaaaaacccgcggagccgaagacgatctgaacactgttgcagcaggaacgatgaccgggatgctgtataagtgtacttag

SEQ ID NO: 46908 - DNA, 450 bp, Artificial Sequence
  Description of Artificial Sequence: Synthetic coding sequence
atgaccggcgccgccttcggcgccatgaacggcctgcggctgggcctgaaagaaactcagaatatggcatggtcaaagccacgaaatgtgcagattcttaatatggttacccgccagggagccttgtgggctaatacactaggctcactcgccctgctgtattctgctttcggggtgattattgaaaaaacccggggtgctgaagacgacctgaacactgttgcagcaggtacaatgaccggcatgttgtacaagtgcaccgcgtccgccagtcagggcgccggaatcgccgacggcgtctccttcactcaatgctctatgttgccaagactggagtgtagtggagtaatctctgcctcttacaacttgcacctcccggctgcgtgtcttggcctccccaagtgcagggactgttccttatgccccgcagctactccttccggtaagtag

SEQ ID NO: 46909 - DNA, 372 bp, Artificial Sequence
  Description of Artificial Sequence: Synthetic coding sequence
atggagggcggcggcggcagcggcaacaagaccaccggcggcctggcgggcttttttggcgcaggcggcgcaggttacagtcatgccgatctggcgggagtccccctaactgggatgaatcctctctcaccctacctgaacgtcgatccgcgttacttagttcaagacacagatgaatttattctgccaaccggcgcaaacaagacacgcggtagattcgaactggcattctttactatcggcggatgttgcatgaccgcactgctttactccgccttcggtgttatcattgaaaagaccagaggagctgaagacgacttgaacacagttgcggccggaacgatgactggcatgttgtacaagtgtacatag

SEQ ID NO: 46910 - DNA, 1371 bp, Artificial Sequence
  Description of Artificial Sequence: Synthetic coding sequence
atggccagcgccctgagcctgggcaacaagtgcgaccccttcctgcggtgtgtgctgtgtagaggcggcggcgctctgcagggccctagaggacgcgggccagatgattttgaaagccagttgtcccctcctggaagcgcaagaaggcttgtccggagcaagcgggcttgtggcaatcctcccgatgccttcggtctgagtcgagcctccgtgcacccccccctgcccagagtctcaattggttgtagttcagggcccgggcgggccaagagggaaagagtcggcggagctgcctggaggcaaaggaaaatggcggccagtgctgcagtcttttcccggctgaggtccggcctgcgtcttggctcccgcgggctgtgtacccgactggccacaccgccacgacgagcccctgaccaggctgcagaaatcggatcaagaggatccacaaaggcacaaggtccccagcaacagcctgggtctgagggcccatcatacgcaaagaaggtagccctgtggcttgccggcctgctgggggccggtggaaccgtttctgttgtttatatctttgggaacaatcccgttgacgagaacggagccaaaatacctgacgagttcgacaatgatcctatcctggtccaacagctgcgcaggacctacaaatattttaaagactacagacagatgatcatcgagcccacgagcccttgcctgttgccggaccctctccaggagccttattatcaacctccctataccttggtgctcgagctgactggcgttctcctgcacccagagtggtctctggcaacaggctggaggtttaagaagcggccagggatagagacgttattccagcagctcgcccccctgtacgagatagtaattttcacttctgaaaccgggatgaccgctttcccactgattgattcggtcgatccccacggatttatttcgtataggctcttccgggacgccacccgatacatggacggccaccacgtaaaggacatttcctgcctgaatagggacccagcgcgcgtcgtcgtggttgactgtaaaaaagaggcctttcgccttcagccttataatggtgtcgcccttaggccctgggatggaaatagcgatgaccgcgtactgctggatctgagcgctttcctgaaaaccattgccctgaacggggtcgaggatgttcggaccgtcttagaacactatgccctggaagacgatccactggccgcattcaaacagcgtcagtctagattggaacaggaagaacaacagcgactggcggagctgagtaagagtaataaacagaatctgttcctaggctctcttacctcgaggctctggcctaggagcaagcaaccatag

SEQ ID NO: 46911 - DNA, 723 bp, Artificial Sequence
  Description of Artificial Sequence: Synthetic coding sequence
atggtgccccggttcctgatgagcagcaccatgatgatcatcgagcctacttctccctgcctgttgcccgaccccctgcaggaaccgtattaccagcccccttatactctggtgctcgagctgactggcgtgctcctccatcccgagtggtcacttgccaccggttggaggttcaagaaacgcccaggaatagaaaccctttttcagcagttggcccctctgtatgaaatcgtgattttcacatctgaaacaggcatgaccgctttccccttgatcgattctgtagacccccacggatttatcagctatcgactcttcagggatgctacacgatacatggatggacaccacgttaaagatataagttgtctgaaccgcgacccagctagagttgtggtggtggactgtaaaaaggaagcgtttagattgcagccttataacggcgtggcactacggccatgggacgggaattccgatgatcgcgttctgctagatcttagcgcctttctcaagaccatcgccctcaatggagtcgaggacgtgagaaccgtcctggagcactatgcgctagaggacgacccgctggctgctttcaagcagcgtcaaagtcgcttggagcaggaggaacagcagagactcgccgaactgtctaaaagtaataagcagaacctctttttagggtcactcaccagccggctgtggcctcggtctaaacaaccctag

SEQ ID NO: 46912 - DNA, 252 bp, Artificial Sequence
  Description of Artificial Sequence: Synthetic coding sequence
atggccgagctgggcgaggccgacgaggccgagctgcagcggctggtggcggctgagcaacagaaggctcaattcacagcccaggtccatcattttatggagctgtgttgggataagtgtgtcgaaaaacctggaaacagactggactcaagaacggaaaactgcttgtcttcctgtgtggatcggtttattgatactacgctggccatcacctccaggtttgcacagatagtccaaaaaggtggacagtag

SEQ ID NO: 46913 - DNA, 297 bp, Artificial Sequence
  Description of Artificial Sequence: Synthetic coding sequence
atgcggaagcacagctgccggaaggtggccagcctgcggcggaccatggccgagctcggggaggcagatgaagctgagttgcagaggcttgtggctgccgagcaacagaaagcccagttcacagcccaggtccatcatttcatggaactttgctgggataagtgtgtcgagaagccagggaatcgactggattcgcgcacagaaaattgtctttccagctgtgtcgatcggttcatagatactacactcgctattacttcccgattcgcccagatagtgcaaaagggcggccagtag

SEQ ID NO: 46914 - DNA, 858 bp, Artificial Sequence
  Description of Artificial Sequence: Synthetic coding sequence
atggaggtgcccccccccgccccccggagcttcctgtgccgggccctgtgtctatttcctagggtatttgccgctgaggcagtgaccgccgactccgaggtattggaagaaagacagaaacgccttccatatgtaccagagccctactacccagagtcaggttgggaccgccttcgtgagctattcggcaaagatgagcagcagagaatcagcaaggatctcgctaatatctgtaagactgccgcaactgccggcatcatcggctgggtttatggaggtatccctgcattcatccacgccaagcaacagtatatcgagcagtctcaggcagagatctaccacaacagatttgacgctgtgcagtcggcccacagggccgccacgagagggttcattcggtacgggtggcggtggggctggagaaccgccgtttttgtgacaatcttcaatacagtgaacacaagtcttaatgtttacaggaacaaggacgctctgagccactttgtgatcgccggagccgtgacagggtccctctttcgtattaacgtagggctgcgcggcctcgtggccgggggcataataggcgcgcttctcggaactccagtcggcggactgcttatggccttccagaagtactctggtgaaacagttcaggagaggaagcagaaggatagaaaagcactgcacgagctgaaattagaggaatggaaagggaggctgcaagtcaccgaacaccttccggagaagatcgagtctagcttacaggaggatgagccagagaacgacgccaagaagattgaggccctcctgaatttgccccgcaacccctctgttattgacaagcaggacaaggactag

SEQ ID NO: 46915 - DNA, 438 bp, Artificial Sequence
  Description of Artificial Sequence: Synthetic coding sequence
atggtgggccggaacagcgccatcgccgccggcgtgtgcggcgccctgttcatcggctattgcatctactttgatagaaagaggaggtctgacccgaattttaagaataggcttcgagagcgcagaaagaagcaaaaattagccaaggaaagagcaggcctgtccaagctacctgatttgaaagatgcagaagccgtgcagaagttttttttggaagaaatccagcttggagaagagctcctggctcagggcgagtacgagaagggcgttgaccatttgacaaacgccattgccgtatgcggacagccccagcagttgcttcaggttctgcagcagacgctcccacctccagtctttcaaatgctcctgactaagctgccaacaataagccagaggatcgttagtgcccagtccctcgctgaagacgacgtggagtag

SEQ ID NO: 46916 - DNA, 459 bp, Artificial Sequence
  Description of Artificial Sequence: Synthetic coding sequence
atgcccagcgtgcggagcctgctgcggctgctggccgccgccgccgcatgtggcgcgttcgcatttcttggatattgtatatatctgaacagaaagcggagaggcgaccccgccttcaagcggcgactccgggacaaaaggagggctgaaccacagaaagccgaagaacaagggacccaactgtgggatcctactaagaataagaaactgcaagagttgtttttgcaggaagtgcgaatgggtgaactctggctgtcccgcggagagcaccgtatgggtatccagcaccttggtaatgccctgctggtgtgcgaacaaccacgcgaactgttgaaggtgttcaaacacacactgcctcccaaagtgtttgaaatgttgctgcataagatccctctcatttgccagcagtttgaggccgacatgaacgaacaggattgtctcgaggacgaccctgactag

SEQ ID NO: 46917 - DNA, 930 bp, Artificial Sequence
  Description of Artificial Sequence: Synthetic coding sequence
atggcccccaagttccccgacagcgtggaggagctgcgggccgccggcaatgaaagcttccgcaatggacaatatgctgaggcctcggcactctacggtagggctcttcgagtcctccaggcgcaggggtctagcgatcccgaggaggagtcggtgttatacagtaatcgggcagcctgtcacctgaaggatggcaattgcagggactgcatcaaggactgcacgtctgccttggccctcgtgccattttctatcaagcccttactgaggcgggctagcgcttatgaagccctcgaaaagtatccgatggcatacgttgactataaaaccgttcttcagatagacgacaatgtgactagcgcagtggaaggaataaatagaatgacacgcgccctcatggacagcttaggaccagagtggaggctgaaattgccgagtattcctttagtccccgtctcagctcagaaacggtggaactcgctaccttccgaaaatcataaagagatggctaagtctaagtcgaaagagaccaccgctactaagaaccgagtaccgtccgccggcgatgtcgagaaagctcgggtgcttaaggaagaagggaatgagctggtgaaaaaaggcaatcacaaaaaggccattgagaaatatagcgagtccttgctttgcagcaacttagaatccgccacctattctaatcgagccttgtgctacttagtcttgaagcagtacacagaagcagtgaaggactgtaccgaagccctgaagctggatggaaaaaatgtcaaggctttctatcgccgggcccaagcacacaaggctctgaaagactacaaaagtagcttcgctgacatatccaatttgctgcagatagaacctcggaacgggcccgcacaaaaactccggcaagaagtcaaacagaacttgcactag

SEQ ID NO: 46918 - DNA, 927 bp, Artificial Sequence
  Description of Artificial Sequence: Synthetic coding sequence
atgggcaacaccctgggcctggcccccatgggcaccctgccccggcggtccccccgacgtgaagagccactgccaaatcctgggtctttcgatgagctgcataggctgtgtaaggacgtgttcccggcccagatggaaggcgttaagcttgtggtcaataaagtcctgtcctcgcactttcaggttgctcataccatccacatgtctgccttgggactgcccgggtatcacttacacgctgcttacgctggggactggcagcttagtccaacggaagtcttccctactgtggtcggggacatggacagttccggatctctcaacgcacaggtcctcttgttgctcgcagagcgcttaagagcaaaagccgtatttcagacgcagcaggcgaaatttttgacctggcagttcgatggtgagtatcgcggcgacgactacactgcaacacttacgctgggaaatcccgacctgatcggcgagagtgtgatcatggttgcacatttcctgcagtctctgacacacaggctggtgctgggcggcgagctcgtttatcaccggagaccaggagaggagggagctattctgactctcgcagggaagtactcagccgtgcactgggtggccacgcttaatgtaggctccgggggcgcccatgcttcttattaccaccgggccaatgaacaagtgcaggtcggcgtggaattcgaagcgaacactaggttgcaagacacaactttctcctttgggtatcacttaactctgccccaggccaatatggtgtttcgaggcttggtggactccaactggtgtgtgggcgcagtgctggagaagaaaatgccccctcttccagtgacgcttgccctgggagcttttctgaaccattggaggaacaggtttcattgtgggttttcaatcactgtggggtag

SEQ ID NO: 46919 - DNA, 927 bp, Artificial Sequence
  Description of Artificial Sequence: Synthetic coding sequence
atgggcaacaccctgggcctggcccccatgggcaccctgccccggcgctccccaagacgcgaggagccattgcctaatcccggaagttttgatgaattacaccgactttgtaaggacgtgttccctgcccagatggaaggggtgaaactggtagttaataaagtcctctcttctcacttccaagtggcacatactatccacatgagcgcactgggactccctgggtatcatctccacgcagcatatgcaggcgactggcaattaagtcctaccgaagtcttcccaacggttgttggcgatatggattcgagcggatccctcaacgcccaggtcttattgctgttagctgagagactgagagctaaggctgtatttcagacccagcaggcgaaattcctcacgtggcagtttgatggcgaataccgaggggacgactataccgcaacacttacactgggaaatcccgatttgatcggtgaatctgtgattatggtggcccactttctgcagtcactcactcaccgcctggtcctggggggggaactagtctaccacagacgcccaggggaggagggggctattttgaccctcgccgggaaatacagtgcagtacactgggtggccaccctgaacgttgggtctggcggagctcatgcgagttactaccaccgcgccaacgagcaggtgcaagtgggagtagaatttgaggccaataccagactgcaggacactacgtttagctttggttaccatttaacactcccccaagcgaatatggtgttcagagggctggtggactccaactggtgcgtgggggccgttctggagaagaaaatgccccctctgccggttacactcgctctcggcgccttcctgaaccactggaggaaccgattccactgcgggttctcgattactgtgggttag

SEQ ID NO: 46920 - DNA, 633 bp, Artificial Sequence
  Description of Artificial Sequence: Synthetic coding sequence
atgagctgcaccgtgtacgccaaggtggcccacaccatccacatgagtgccttggggctgcctgggtaccatctgcatgcagcctatgcaggcgactggcagctctcacccactgaagtcttcccaaccgtggtgggcgatatggatagcagcggttctttaaacgcgcaagtccttctgctgctagctgagcggctgcgcgctaaggccgtttttcaaacacagcaggccaagttcctgacctggcagttcgacggcgaatatcggggcgacgattatacggctactctgacactcgcgggtaaatactcagctgttcactgggtagctacactcaatgtgggatccgggggcgcccatgccagctactaccatcgtgccaacgaacaagtgcaagtgggagtagagtttgaggctaacacacgactgcaggatacaacctttagcttcggctatcacttgactttgccacaggcgaacatggttttcagaggcctggtggactcaaattggtgcgtcggagccgtgttggagaagaagatgccacctcttccagtgaccttggccttgggggcattcctgaaccactggcggaaccggtttcactgcggattctcaattacggtgggctag

SEQ ID NO: 46921 - DNA, 825 bp, Artificial Sequence
  Description of Artificial Sequence: Synthetic coding sequence
atgggcaacaccctgggcctggcccccatgggcaccctgccccggaggagtccgaggagagaggaacctttgcccaaccctggaagctttgacgagctgcaccggctgtgtaaggacgtttttcccgcacagatggaaggggtcaaactggtagtaaacaaggtcctctcctcgcatttccaggtggctcacacaatccacatgtcagcactgggcctccccggctatcacttacacgctgcatacgccggagactggcaacttagtcctaccgagactcagcaggctaagtttctcacttggcaatttgacggggagtacaggggagacgactatactgccacgttgaccctgggcaatcctgacctcatcggagagagcgtaataatggtcgcccatttcctgcagtcactaacacatcgcttggtactggggggcgaattagtgtaccacaggcggcctggggaggaaggcgcaatcttaaccctggccggcaagtacagtgcagttcactgggtcgccacattaaatgtgggctcaggcggagcccatgcatcatactaccacagagcaaacgagcaagtgcaggtgggcgtggaattcgaggccaataccagactccaggatactacttttagttttggttatcaccttacactgcctcaggccaatatggtttttagggggctcgtggattctaattggtgcgtgggagccgtactagaaaagaagatgccccccctcccagtgactctggccctgggcgcttttctaaaccactggcgcaaccgcttccattgtggcttttctattaccgtgggttag

SEQ ID NO: 46922 - DNA, 156 bp, Artificial Sequence
  Description of Artificial Sequence: Synthetic coding sequence
atgttccggatcgagggcctggcccccaagctggaccccgaggagatgaaacgaaagatgagggaagacgtgatctcatcaataagaaactttctcatatatgtcgctttactgcgcgttacccctttcatcctgaagaaactggactcaatttag

SEQ ID NO: 46923 - DNA, 258 bp, Artificial Sequence
  Description of Artificial Sequence: Synthetic coding sequence
atgttccggatcgagggcctggcccccaagctggaccccgaggagatgaaaagaaaaatgcgggaagacgtgataagctctatacggaactttctgatatacgttgcactgctgcgagtgtctgaatgcttgcctgggtgcgactgcgaaacatcaggggagctcaccgacggtcatccgctcactctccggggtcacagggggctgcgcactgaacttaacgctccttttattttaaaaaagctggatagtatctag

SEQ ID NO: 46924 - DNA, 279 bp, Artificial Sequence
  Description of Artificial Sequence: Synthetic coding sequence
atgttccggatcgagggcctggcccccaagctggaccccgaggagatgaaaagaaaaatgcgggaggatgtgatctcctccatccgcaactttttaatctatgttgctcttctgagagtgtccgaatgcctccctggatgcgactgcgagacctctggggaactcaccgatggacatcccctcacactaaggggacaccgcggacttaggactgagttgaatggcagtggggagcagggcggctgcgcactgaaggccacgggcatctgtgccgtgtag

SEQ ID NO: 46925 - DNA, 225 bp, Artificial Sequence
  Description of Artificial Sequence: Synthetic coding sequence
atggccagcagcaccgtgcccgtgagcgccgccggcagcgccaacgagacccccgagattccagataatgtgggggactggctgcgcggggtataccggtttgcgaccgatagaaacgactttcgaagaaatttgattttgaatctcggcctgtttgctgccggggtatggctagcaaggaacctgtccgatatagacttgatggcgccgcagcccggtgtctag

SEQ ID NO: 46926 - DNA, 225 bp, Artificial Sequence
  Description of Artificial Sequence: Synthetic coding sequence
atggccagcagcaccgtgcccgtgagcgccgccggcagcgccaacgaaacaccagaaatacccgacaacgtaggcgattggttgcgcggagtctataggtttgctactgatagaaatgattttaggagaaatctcatccttaacctgggcctgttcgccgccggtgtttggctcgctaggaacctgtcagacatcgatctcatggccccgcagccaggggtttag

SEQ ID NO: 46927 - DNA, 168 bp, Artificial Sequence
  Description of Artificial Sequence: Synthetic coding sequence
atggtgaagctgagcaaggaggccaagcagcggctgcagcagctgtttaagggttctcagttcgctattcggtggggtttcattcccctggtgatctacctgggcttcaaacgcggggctgatccgggaatgcccgagccgacagtactcagccttctgtggggctag

SEQ ID NO: 46928 - DNA, 1827 bp, Artificial Sequence
  Description of Artificial Sequence: Synthetic coding sequence
atggccgccagcaagcccgtggaggccgccgtggtggccgccgccgtcccctcctctggcagcggcgtgggtggcggtgggacggccggaccaggtacaggcggcctcccccgctggcagctagccctggcagtaggcgcaccgctgctgctcggcgccggcgccatctatctgtggtcacgccagcagagacggcgggaagcacgggggaggggcgacgccagcggactgaaacgaaattcggagcgcaagactccagagggtcgggcaagtcccgcccctggctctggacaccctgaggggcccggtgcccatctggacatgaactcactcgaccgagctcaggctgctaagaataaaggaaacaaatacttcaaagccggtaagtacgagcaggcaattcagtgttataccgaggcgatcagcttgtgccccactgagaagaatgttgacctgtcgacattttaccagaaccgggcagctgcttttgaacaactgcaaaaatggaaggaagttgcacaggactgcacaaaagccgtggaactgaatcctaagtacgtcaaagctctgttccgcagagccaaagcgcacgaaaagttggataacaaaaaagagtgtctcgaagatgtgaccgcagtgtgtattctcgagggtttccagaatcaacagtccatgctgttggctgacaaggtgctgaagctcctcgggaaagagaaagccaaggagaaatacaaaaaccgggaaccattaatgccgtcgcctcagttcatcaagtcttatttcagcagttttactgacgatatcatctctcaacctatgctgaagggcgagaaatccgatgaggataaagacaaggagggagaagcactggaggtgaaggaaaattctgggtaccttaaggccaagcagtacatggaggaagagaactatgacaagattattagcgagtgctcaaaagagatcgatgccgagggcaaatatatggcggaagcactgcttctgagagctaccttctatctgctgatcgggaatgcgaacgccgctaaaccagatctcgacaaggtcatttccctcaaagaggccaatgtgaagctccgggccaatgcactgatcaagcgcgggtccatgtacatgcaacagcagcagcccctgctttcaacccaggactttaacatggctgcggatatcgatccacaaaacgccgatgtgtaccatcatagaggacaacttaaaatacttctcgatcaggtcgaagaggccgtcgccgactttgatgagtgtatccgattgaggcccgagagtgcattggctcaagctcaaaagtgtttcgccttatacagacaggcatacacaggcaataatagcagtcaaattcaggcagcgatgaaggggttcgaggaggtaattaagaaatttcctcgatgcgccgaggggtatgccctgtatgcccaggccctgactgaccagcagcagtttggcaaggcggatgagatgtatgataagtgcatagacctagaacccgacaatgccactacgtacgtgcataagggtttgctgcaacttcaatggaaacaggatctagaccggggcctggagctcatctcgaaagcaatagagattgataataaatgcgattttgcgtacgagactatgggcaccattgaggtccaacggggcaatatggaaaaagctattgacatgttcaacaaggctattaatcttgcgaagagtgaaatggaaatggcacacctttactcactgtgtgacgccgcccatgcccagacggaggtagccaaaaaatacggtctgaaacctcctaccctctag

SEQ ID NO: 46929 - DNA, 1506 bp, Artificial Sequence
  Description of Artificial Sequence: Synthetic coding sequence
atgaacagcctggaccgggcccaggccgccaagaacaagggcaacaaatacttcaaggccggcaagtacgaacaggctattcagtgttacaccgaagcgatctccctgtgtcccacagaaaaaaacgtggatctaagcactttctaccagaatcgtgctgccgcatttgagcagctccagaagtggaaggaagttgctcaggattgcaccaaggctgtggagctcaacccaaaatacgtcaaagctctttttcggcgcgcgaaagcacacgagaagttagacaataagaaagaatgcctggaagatgtaaccgctgtctgcatcttagaaggctttcagaaccaacagagtatgttgttggcagacaaagtactcaaactcctaggcaaagagaaggccaaggaaaagtataaaaatcgggagcccctcatgccaagcccccagttcataaagagctacttctcaagctttactgatgacataatttctcagcccatgctgaagggcgagaaaagtgatgaggacaaagacaaagagggagaggcattagaggttaaggaaaacagtgggtacttaaaagcgaagcagtacatggaagaggaaaactacgataaaatcatcagcgaatgctccaaagagatcgatgcggagggaaagtatatggccgaggccctgctgctcagggctacattctatctgctaatcggcaatgccaatgccgccaagcccgacctggataaagtcatatccctgaaagaggccaacgtgaagctgcgcgccaatgccctcatcaaacggggttctatgtacatgcagcaacaacagcccttgttaagtacacaggatttcaatatggccgccgatatagacccacaaaatgccgacgtgtaccaccacagggggcaacttaagatattgctcgatcaggtggaggaagctgtcgccgattttgatgagtgcatccgcttacggccagagagtgctctagcacaggcccaaaagtgtttcgccttgtaccgccaggcttacaccggcaacaactctagtcagatccaagcagccatgaagggatttgaggaggtcattaagaagttcccccgctgtgctgaagggtatgcactgtatgcacaggccctaactgaccagcagcagtttggcaaggccgatgagatgtatgacaagtgcatcgacttggaaccagataacgccaccacctacgtccacaaagggctgctgcagctgcagtggaaacaggatctcgataggggacttgagctgatcagcaaggccattgaaatagacaacaaatgtgatttcgcctatgagaccatggggactattgaggtgcagagagggaacatggaaaaggcaatcgatatgttcaacaaagcaataaaccttgccaagtctgaaatggagatggcccacctgtacagtctgtgtgatgccgctcatgctcagactgaggtggcaaaaaagtacggactgaagcccccgaccctgtag

SEQ ID NO: 46930 - DNA, 1125 bp, Artificial Sequence
  Description of Artificial Sequence: Synthetic coding sequence
atggccatccggaagaagagcaccaagagcccccccgtgctgagccacgagttcgtgcttcagaaccatgcggacatcgtttcctgcgtggccatggtatttctgctggggctcatgtttgagatcactgccaaagcctccataatcttcgttaccctgcaatacaatgtgactctgcctgcgaccgaggagcaggccaccgagagcgtcagcctgtactattacggcataaaggatctggccactgtctttttttacatgctcgtggcgatcataattcatgccgtgatccaggaatacatgttagacaagattaaccgccggatgcattttagcaaaaccaagcactcaaaatttaacgagtcgggacagttgtccgctttctatttgtttgcgtgtgtgtggggcaccttcattctgatctccgagaactatatttcagatcccacaatcctctggagagcttaccctcataaccttatgacattccagatgaaatttttttacatctcccagcttgcgtactggttgcacgccttcccagagttgtatttccagaaaaccaagaaggaggatatccctaggcagctggtgtatatagggctgtatctattccacatcgcaggggcatatttgctaaacctcaatcatctgggtcttgtgcttctggtcctgcactacttcgtggagtttctgtttcacatctctaggcttttctactttagtaatgagaagtatcaaaaagggttcagtctctgggccgtcctattcgtgctgggccggcttctgacattgattctttcagttttgacggtagggttcggactcgctcgtgcagagaaccaaaaactcgatttttccacgggcaacttcaatgtgcttgcggtgagaatcgccgtcttagcctcaatttgcgtgacccaagcatttatgatgtggaaatttatcaactttcagcttaggagatggagagaacactcagccttccaggcccccgccgtaaaaaagaaaccaacagtgacaaaaggcaggtcttctaaaaaggggaccgagaatggtgtaaacggcacactcacgagcaatgtggcggatagcccacgtaataaaaaggagaagtcctcatag

SEQ ID NO: 46931 - DNA, 1032 bp, Artificial Sequence
  Description of Artificial Sequence: Synthetic coding sequence
atggtgttcctgctgggcctgatgttcgagatcaccgccaaggccagcattatcttcgtcacgcttcaatacaatgtgacactcccagcgacggaggagcaagctaccgagtcggtctccctgtactactacggaattaaggatctggccactgtgtttttctatatgctcgtcgcgatcataatccacgccgttatccaagagtacatgctcgacaagataaatcggagaatgcacttttctaagaccaagcacagcaaattcaatgagagcggccaactcagtgccttttatctattcgcatgtgtgtggggcacttttatactcatttccgaaaattacatatctgatcctactatcttatggcgggcctatcctcacaacctcatgactttccagatgaagttcttttacatcagccagctagcttattggttacacgcattccccgaactctatttccaaaaaacgaagaaggaggatataccaagacagttagtgtatattggactctacctgtttcatattgctggcgcctacctcttaaacctcaaccacctaggcctggttctgttagttctgcattacttcgtggagtttttgttccatatctcaaggctcttttatttttctaacgagaaatatcagaaggggttctccctctgggctgtgttgtttgttctgggccgattgttgacattgattctttccgttctgactgttggttttgggttagcacgagccgaaaaccagaaactagatttcagtactggcaactttaatgtcctggctgtccgcatcgcagtgttagcatctatctgtgtaactcaggcgtttatgatgtggaaattcattaatttccagctgaggcgctggagagaacattctgctttccaggccccagccgtgaaaaaaaaacctacggtcacgaaggggaggagcagcaagaagggtactgagaacggcgtgaatggcactctgacgtccaatgtagctgattcgcctcggaacaagaaagagaaatcttcatag

SEQ ID NO: 46932 - DNA, 1110 bp, Artificial Sequence
  Description of Artificial Sequence: Synthetic coding sequence
atgggcctgcggaagaagagcaccaagaacccccccgtgctgagccaggagtttatcttacaaaatcatgctgacatcgtgtcctgtgtcgggatgttcttcctgctaggtctcgtgtttgaaggcacagcagaagcatctatcgtcttcttgacattgcagcattcggtagcagtgccagctgcagaagagcaagcaacagggtcaaagtcactttactactacggggttaaggatcttgccactgtcttcttttacatgctggtggcaatcatcattcatgctacaattcaagaatatgtgctggacaaaattaacaaacgcatgcagttcaccaaagccaagcaaaataagttcaacgagagcggccagttcagcgtgttctacttcttttcttgtatttgggggaccttcattctgatctctgagaactgtctgtccgaccccacattaatctggaaggcccgaccacattccatgatgaccttccagatgaaattcttctatatctctcagctggcctattggtttcatgcctttcctgagctgtattttcaaaagactaaaaagcaagatattcctaggcagctggtttacatcgggctccatctgttccacataaccggcgcctacctgctgtaccttaatcatctggggctcctcctactggtcctacactactttgttgagctcttgagtcatatgtgtggtctgttctacttcagcgatgagaagtaccagaaaggcatcagcctgtgggccattgtctttattttaggcaggctcgtgacgctgatcgtaagcgtgctgaccgtgggttttcatctagccgggagccagaatagaaatccagacgccctcaccggtaacgtgaatgttcttgccgcaaagatagctgtgctttcgagtagctgcacaatccaagcatacgttacatggaatctgattaccctttggttacaaagatgggttgaagactcaaacatccaagccagttgcatgaagaaaaaaagaagtaggtccagcaagaaacgcacagagaacggggttggagtggaaactagcaatcgtgtcgactgccctcccaagagaaaagagaagtcttcttag

SEQ ID NO: 46933 - DNA, 1113 bp, Artificial Sequence
  Description of Artificial Sequence: Synthetic coding sequence
atggccttccggcggcggaccaagagctaccccctgttcagccaggagttcgtgattcataaccacgccgatatcggtttttgccttgtgttgtgtgtccttatcggactcatgtttgaggtaaccgcaaaaaccgcttttctatttatactcccccagtataatatatccgtacctacagcggatagcgaaactgttcactaccattacggcccgaaagacctggtcaccatcctgttttacattttcattacaattattttgcatgcagtcgtgcaggagtacattttggataagataagcaagagactacatctttccaaagtcaagcactcgaaatttaacgaatcagggcagttagtggtgtttcacttcacgtctgttatctggtgcttctatgtggtggtcactgaaggatacttaacaaatccacggagcctgtgggaagattatccccatgtgcacttgcccttccaagtaaaattcttctacctctgtcagttagcgtactggctccatgctttacccgaattgtacttccagaaggtaaggaaggaggagatccccaggcaactgcagtacatttgcctttatctggtgcacatcgccggcgcatatctgctgaatctttctcgcctgggtctgattctccttctgttgcagtacagtacggagttccttttccacacggcacgactcttctacttcgccgacgagaacaatgagaagctcttctccgcatgggcagctgtctttggagttacccggctgttcatcttgactctcgcagtgctggctatcgggttcggcctggcccgcatggagaaccaggcattcgacccggagaaaggtaatttcaatactttattctgtcgtctgtgtgtgctgctcctcgtgtgtgcagcccaggcgtggttaatgtggaggtttatccacagtcaactgcggcattggcgcgagtattggaacgagcagtcggctaagagaagagtacccgctacaccacggctaccagccagactgatcaagcgcgaatctgggtaccatgagaatggggtggtcaaggcagaaaacggcacttctcccaggacaaaaaagttaaagtcaccatag

SEQ ID NO: 46934 - DNA, 513 bp, Artificial Sequence
  Description of Artificial Sequence: Synthetic coding sequence
atgcggctgcagggcgccatcttcgtgctgctgccccacctgggccccattctggtctggctgttcacaagggaccatatgagcggatggtgtgagggccctcgaatgctgtcatggtgcccgttctacaaggtgctgctgttggttcagaccgcaatttattcagtcgtcggctatgcctcctatctggtgtggaaggaccttggagggggcctgggctggccattggcgcttccacttggactatatgccgttcaactgaccatctcttggaccgttctggtcttattttttaccgtacataatcccggtctcgccttactgcacctattgctgctatatggcctggtcgtcagcaccgcgctgatctggcatccgataaacaagctggctgccttgcttttactcccctatctcgcctggctcacagtgacgtcggcgctaacctatcacctgtggagggacagcctatgcccagtccaccaacctcaaccgactgagaagtccgattag

SEQ ID NO: 46935 - DNA, 513 bp, Artificial Sequence
  Description of Artificial Sequence: Synthetic coding sequence
atgcggctgcagggcgccatcttcgtgctgctgccccacctgggcccaatcctagtgtggttgtttacccgggatcatatgtctggctggtgcgaaggccctcgcatgctcagctggtgccctttttacaaagttctcctgcttgtgcaaaccgcaatctactcagtcgtggggtacgcgtcctatctggtttggaaggatctgggcggggggttgggctggcccctcgcattacccctcggcctctacgccgtgcagctgacaatctcctggactgtgctggttttgtttttcaccgtgcataatcccggtcttgccttgcttcacctcctgctcttatatgggctggtagtgtcaacagctctaatttggcatccgatcaataaactcgccgcgcttcttttgctgccctacctggcttggttgacggttacatcagccctgacttatcacctctggagggatagcctgtgtcctgtccaccagccacagcccacagagaagagtgactag

SEQ ID NO: 46936 - DNA, 1047 bp, Artificial Sequence
  Description of Artificial Sequence: Synthetic coding sequence
atgcggctgggcctgctgagcgtggccctgctgttcgtgggcagcagccacctttactcagatcactactctccatcaggtcgccaccggctgggaccaagcccggagcctgccgcaagttctcagcaggcagaggccgtgaggaagcgactgcgccggaggcgggagggcggagcacatgctgaagattgcggaacagcacctttaaaggacgtgctccaaggatcgcgtatcatcggaggtaccgaggcacaagcaggagcatggccatgggtggtgagcctccagattaaatatggccgggtcctggtccacgtgtgcggggggacactggtccgagaacgctgggtgctaaccgcagcccactgtaccaaagatgcctctgaccccctgatgtggactgccgttatcggtaccaacaacatccacggtcggtacccacataccaaaaaaattaagattaaggccattattatacatccaaacttcatcttggaatcctatgtaaatgatattgcactgtttcatctgaaaaaggccgtgagatataatgactacatccaacccatctgtctacccttcgacgtgttccagattctggacggtaacacaaaatgctttatatcaggttggggaaggacaaaagaagagggcaacgcgacaaacattctgcaggacgccgaggtgcactatatttctcgggagatgtgtaatagcgagcggtcctacggcggcattataccaaatacatctttctgtgctggagatgaggacggcgccttcgacacctgcaggggagactcgggtggccctttaatgtgctacctccctgaatataagaggtttttcgtgatggggatcacctcttacgggcacggttgcggacgtcggggatttcctggcgtttatataggcccttccttttaccagaagtggttgacggagcatttctttcacgcgtctacccaggggatcttgaccattaacatactgcgaggccagatcctgattgccctttgtttcgtgatcctactcgccacaacgtag

SEQ ID NO: 46937 - DNA, 606 bp, Artificial Sequence
  Description of Artificial Sequence: Synthetic coding sequence
atgggcagccggaagtgcggcggctgcctgagctgcctgctgatccctttagcattatggtcaattattgtcaatattttactttacttccccaacgggcagacctcttatgcttcgagcaacaagctcaccaattatgtgtggtacttcgagggaatttgcttcagtggcattatgatgctgattgttaccacggtgctgctggtgctggagaataacaataactacaagtgctgtcagtcagagaattgctccaagaaatatgtcacactgctctccataattttcagttcacttggcattgccttctctggctactgtttggtgatatcggctctgggcctcgtgcaggggccttactgtagaacgttagacggctgggaatacgcattcgagggcacggctggtcggtttcttacagactcaagtatctggatacagtgcctagagccagcccacgtggtcgaatggaatattatcctgttctcaatccttatcacactgagcggtttgcaggttatcatatgtcttataagagtcgttatgcaacttagtaaaattctttgcggatcctacagtgtcatatttcaaccaggtattatatag

SEQ ID NO: 46938 - DNA, 606 bp, Artificial Sequence
  Description of Artificial Sequence: Synthetic coding sequence
atgggcagccggaagtgcggcggctgcctgagctgcctgctgatccccctcgcactgtggagcatcattgttaacatcctcctctactttcctaacgggcagaccagctatgcctctagtaacaagttaaccaactacgtatggtatttcgagggcatctgcttcagcggcattatgatgcttatcgttacaaccgtcctgcttgtattagagaataataataattacaagtgctgtcagagcgagaattgcagcaaaaagtatgtgaccctcctgagcattatcttctccagcctgggcatcgctttcagtggatattgccttgtgatctccgccctgggcctggtgcaaggcccgtactgcaggacgcttgatgggtgggagtacgcattcgagggaactgcgggacggttccttaccgactcaagtatctggattcagtgccttgagccagcccacgttgtcgagtggaatattattttgttctcaattttgataactttatccggtctccaggttatcatctgcctcatccgcgtggtgatgcagctgagcaagattctgtgcgggagctactcagtgatcttccagcccgggataatttag

SEQ ID NO: 46939 - DNA, 480 bp, Artificial Sequence
  Description of Artificial Sequence: Synthetic coding sequence
atgggcagccggaagtgcggcggctgcctgagctgcctgctgatccctctggccctatggtccataattgtcaatatcctcttgtatttccccaacgggcagacctcttacgctagttcaaacaaactcaccaattatgtatggtacttcgaaggtatctgtttctctggcatcatgatgttaatcgtcacaaccgtgttgctggttttggagaacaataataactacaaatgttgccagtcggaaaactgtagtaagaagtatgtgaccctattatctatcatcttcagcagcttgggcattgcgttcagcggctactgtctcgttatcagcgccctgggacttgtacaaggcccttactgtagaaccctcgatggatgggagtacgcgtttgaaggaactgctggacgctttctaactgacagctctatctggatccagtgcctagagcccgctcatgtggtcgagtggaatatatag

SEQ ID NO: 46940 - DNA, 630 bp, Artificial Sequence
  Description of Artificial Sequence: Synthetic coding sequence
atggtgagcagcccctgcacccaggccagcagccggacctgcagcagaatcctcgggctgtctctcggaaccgcagcgcttttcgcggccggcgccaacgttgcgttactcctgccaaattgggatgtgacatacttattgagagggctgctcggtagacatgccatgctagggactggtctgtgggggggcgggctgatggtgctgacagctgctatactgatttccctgatgggctggagatacggctgttttagcaaaagcggcttatgtcggtcagtcctgacagcgctcctgtcagggggcttagcgttgttgggcgcccttatctgttttgtcacaagtggagttgcccttaaagacgggcctttttgtatgtttgacgtgagtagttttaaccagacacaggcctggaagtatggctacccattcaaggatttgcactcccgcaattatctctatgacagaagcctgtggaactcagtttgtttggagccgtctgctgcagtggtttggcatgtctcccttttcagcgcacttctgtgtatctcgctccttcagctgctcctggtggtggtccacgttatcaactcgctgctggggctgttttgctctctctgtgagaagtag

SEQ ID NO: 46941 - DNA, 630 bp, Artificial Sequence
  Description of Artificial Sequence: Synthetic coding sequence
atggtgagcagcccctgcacccaggccagcagccggacctgcagccgcatactgggtctgtccttgggcacggccgctctcttcgccgcgggcgccaacgtcgccctcctacttccaaactgggacgtgacgtatctacttagaggcttgctcggccgccacgcaatgctcggcaccgggctctggggtggcggccttatggtactcactgcggctatccttattagcctgatgggatggaggtatggctgtttcagcaaatctggcttgtgtagaagcgtgctgaccgctctgctgtcaggagggctggcactgctgggtgctctgatttgttttgtgacctctggagtcgccctgaaggacggtcccttttgtatgttcgatgtctccagcttcaatcagacccaggcttggaagtacggatacccttttaaagacttgcattcccgaaactacctgtacgataggtcgctgtggaatagcgtgtgtctggaacccagtgccgccgtcgtgtggcacgttagcctgttctccgcgttgctctgtatcagtctgttgcagctgctgctagtggtggttcacgtgattaactctttgctcgggctattctgctccctgtgcgaaaagtag

SEQ ID NO: 46942 - DNA, 552 bp, Artificial Sequence
  Description of Artificial Sequence: Synthetic coding sequence
atggtgagcagcccctgcacccaggccagcagccggacctgcagcaggatcctgggcctgtcactcggaaccgctgccctcttcgctgcaggggctaacgtggcactcctcctgccaaattgggacgttacctatctacttagaggtctgttgggaagacacgccatgctgggtacgggactttggggtgggggcctgatggtcctaacggctctcttatcgggaggtcttgcattgctcggagccctgatctgtttcgtgacttccggcgtggcactgaaggacggacctttttgcatgtttgacgtgtcaagcttcaatcaaacacaggcttggaaatacgggtatccattcaaagatttacactcacggaactatctgtacgatcgctctttgtggaattccgtgtgcctcgaacccagtgcggccgtggtgtggcacgtctccttgttttcggcccttctttgtatcagcttgctgcaactgctcttggtagtggtccacgttatcaactctctgttggggcttttttgttccctctgcgaaaagtag

SEQ ID NO: 46943 - DNA, 690 bp, Artificial Sequence
  Description of Artificial Sequence: Synthetic coding sequence
atgacctgctgcgagggctggaccagctgcaacggcttcagcctgttagttctgctcctacttggcgtggtcctgaacgctatcccccttatcgtgtcactcgtggaggaggatcagttcagccaaaatccaatttcttgtttcgaatggtggtttcccggaattatcggcgctggcctgatggcaatcccagcaacgaccatgtctctaactgctcgcaagcgcgcctgttgcaataacagaacagggatgttcctctcaagcctcttttctgttattaccgtgataggggccctgtactgtatgctgattagtatccaagcactattgaagggacccctgatgtgcaactcccccagcaattcaaacgcgaattgcgagtttagcttgaaaaatatctcagatatccatcctgaatcttttaacctacagtggttcttcaacgacagttgcgctccaccaacgggttttaacaaaccgacaagtaatgacactatggcttccggctggcgggccagctctttccactttgactccgaagagaacaagcaccggctgatccacttcagtgtgtttctaggccttttgctggtcggcatccttgaggtgctttttggactcagtcaaatcgtgatcgggttcctaggctgcctctgcggcgtcagcaaacgacggtctcagattgtttag

SEQ ID NO: 46944 - DNA, 45 bp, Artificial Sequence; identical to SEQ ID NO: 22980
  Description of Artificial Sequence: Synthetic coding sequence

SEQ ID NO: 46945 - DNA, 1821 bp, Artificial Sequence
  Description of Artificial Sequence: Synthetic coding sequence
atgaccgtggtgggcaacccccggagctggagctgccagtggctgcctattctcattctcctccttggcactggacacggcccgggagtcgagggagtgacacactacaaggccggcgaccccgtgatcctgtatgtgaataaagtgggcccttaccacaatccacaggagacctatcattactaccagttgcccgtctgttgcccagagaagattcgacacaaatctttaagcctgggagaggtattggacggggaccggatggcagagtccttatacgagatcagatttagggagaacgtggagaagagaattttgtgtcatatgcaactgagctctgcgcaggtggaacagcttaggcaggccattgaagaactctattatttcgagttcgtagtggatgatctgcctattaggggattcgttggctacatggaagaatctgggtttttgcctcattcccacaaaatcggactgtggacccatctggatttccacttagagtttcacggagatcgtattatttttgcaaatgtttccgtccgggatgtcaaaccacacagcttggacggattgcggcctgacgagtttctcggtcttacccacacttattccgtgcgctggtccgaaacgagtgtcgaaagaagatccgaccgaagacgaggggatgatggagggttctttccacgcactctggaaatccactggctaagcattattaactctatggttctggtgttcctccttgtgggattcgtggcggtgattctaatgagggtgttgcgcaatgatctggctcggtacaacctcgatgaggagactacttcggcgggatcaggtgatgactttgatcagggcgataacgggtggaagatcattcacactgacgtgtttcggttccctccataccggggtcttctgtgtgctgtcttgggcgtaggggctcaattccttgccctgggaaccggaattatcgtgatggcattgctgggcatgtttaatgtacataggcacggagctattaactcagcagcaatcttactctatgccttaacatgctgcatctctggctatgtgagctcacatttttatagacagatcggcggggagagatgggtctggaacattattttaaccacaagtcttttcagcgttcctttctttcttacctggtctgtagtaaattcagtacactgggccaacgggtccactcaggctctcccagccacgaccattctcctgctgctgacagtctggttactggtggggttcccacttacagtcattggaggcatttttgggaaaaataacgcctcaccttttgatgcaccctgcagaaccaagaatatcgccagagagatcccccctcaaccttggtacaaatctacagtgatccacatgaccgttggcggtttcctaccgttttctgccatatccgtagagctctattatatcttcgctaccgtgtggggtcgagagcagtacacactgtatgggattctctttttcgtttttgcaattctgctgagcgtgggcgcctgtattagcatcgcgctcacatacttccaactgtccggagaggattatagatggtggtggcgtagcgtcttatccgtcggtagcaccggactgtttatattcctctatagtgtattttattacgcccggaggtccaatatgtccggcgctgtgcagacagttgagtttttcggttactccctcctcactggctacgtgttcttcctcatgctcgggactatctctttttttagctctctgaaattcattaggtacatatatgttaacctgaaaatggattag

SEQ ID NO: 46946 - DNA, 1470 bp, Artificial Sequence
  Description of Artificial Sequence: Synthetic coding sequence
atgaccgtggtgggcaacccccggagctggagctgccagtggctgcctattctaattctcctgttgggaacggggcatgggcctggagtggaaggcgtcacccattataaggctggtgaccccgtgattctgtatgttaataaggtggggccctaccacaatcctcaggagacctatcactactaccagcttcccgtgtgctgtccagaaaaaatccgccataaaagtctcagtctgggtgaggtgcttgacggagacaggatggcagaaagcctgtacgagattcgttttagggagaacgtggagaagcgcatcctgtgccatatgcagttgtcttctgcccaggtggagcaactacgccaagccatcgaagagttgtactatttcgagttcgttgttgacgatctacccattagaggttttgttgggtatatggaggaatcgggcttcttaccacacagtcataagatcggtttgtggacccatctggatttccacctggaattccatggtgatagaattatcttcgcaaatgtctccgtgcgcgacgtcaagccacactccttagatgggctgagacctgatgagttcctgggcctcacccacacgtattccgttcgttggtctgagacttctgttgaaaggcggagcgaccggcggaggggggacgatggcggcttttttccccgaacactcgagatccactggctgagcatcattaacagtatggtcctcgtgtttctattggtgggtttcgtggcagtcatccttatgcgcgtcctgcgcaatgaccttgcccgatacaacttggatgaagagactacttctgcagggtctggggacgactttgatcaaggggacaacgggtggaaaattatccacacagacgtgttccgtttccccccataccgaggactactgtgtgcagttctaggcgtgggtgcccagtttctggcattaggcactggaatcatagtcatggcgttattagggatgtttaatgtgcataggcatggcgcaattaacagtgcagctatcctgctatacgcccttacctgctgtatatcaggctatgtgagcagccacttttacaggcagatcgggggtgagagatgggtgtggaacataatcctgacaaccagcctctttagcgttcccttcttcctcacatggtcagtggtcaacagtgtccattgggcaaacggcagcacccaggccctccctgctactaccatcctgctgttactgacagtgtggctgcttgtaggattcccgttgactgtcataggggggatctttggtaagaataatgccagtcccttcgatgccccttgtaggaccaaaaacatcgcgcgcgaaatcccgccacaaccttggtataagagtactgtgattcatatgaccgttggaggtttcctcccctttaggtacccccccttcattccatggttattgctgtctgggtcctag

SEQ ID NO: 46947 - DNA, 729 bp, Artificial Sequence
  Description of Artificial Sequence: Synthetic coding sequence
atgaccgtggtgggcaacccccggagctggagctgccagtggctgccgattctgattttactattggggaccgggcacggaccaggcgtggagggagtgactcactataaagcgggagatccagttatactgtatgtaaacaaggtcggaccgtatcataacccccaagaaacgtaccattattatcagctgccggtttgctgccctgaaaagatccgccataaaagcctctctttgggtgaggtgctggacggcgacagaatggcagagtctctctacgagatacggttccgggaaaatgtcgaaaagaggatactgtgtcatatgcagcttagctctgcacaggtggagcagctcagacaggctatcgaggagctatattactttgaattcgtggtggacgatctccctatccgcggcttcgttggttacatggaggaatcagggttccttcctcactcccacaaaattgggctctggacgcatcttgacttccatttggagtttcacggcgatcgaatcatcttcgcaaacgtatccgtgagagatgttaagccccattctttggacggccttaggcctgacgaattcctgggactcacccacacctatagtgtacgatggtcagaaactagcgtggaaagacggtccgataggcgaagaggtgatgacggaggcttctttccgcgtactctggagatccactggctgagtatcatcaactcttag

SEQ ID NO: 46948 - DNA, 633 bp, Artificial Sequence
  Description of Artificial Sequence: Synthetic coding sequence
atgaccgtggtgggcaacccccggagctggagctgccagtggctgcctattttgattttgctacttggaaccggccacgggccaggcgtagagggcgtgactcactacaaggcgggcgaccccgtgattctctacgttaacaaagtagggccttatcacaatccacaggagacctatcattattaccaactccctgtgtgctgcccagaaaaaatcagacataagtccctctctctgggcgaagtattagacggagatcgaatggccgagtctctctacgagattcgatttcgagagaatgtagaaaagcgaattctgtgtcacatgcagctttcgagcgctcaagtcgagcagcttcggcaggccatcgaggagttgtactacttcgaatttgtggtggacgacctgccaattcgagggtttgtcgggtatatggaagagtccggttttttgccccactcccacaagatcggactctggactcacctggactttcatctggagttccacggggatcgcatcattttcgcaaatgtgtcagtccgcgatgtgaagccacattcactggacggtctacgacccgacgaatttttaggtctaacccatacatactccgtacgctggagtgaatag

SEQ ID NO: 46949 - DNA, 906 bp, Artificial Sequence
  Description of Artificial Sequence: Synthetic coding sequence
atgaccgtggtgggcaacccccggagctggagctgccagtggctgcccattcttattctgctcctcggtactgggcacgggccaggcgtcgaaggtgttacccactacaaagccggggatcctgttatcctgtatgtcaacaaggtgggtccttatcacaatcctcaagaaacatatcactactaccaactgccagtgtgttgccctgaaaagattcgacataagagcctgtcattaggggaggtgctggatggggaccgcatggctgaaagtctttacgagatcagattcagggagaatgtggagaaacggatactatgccacatgcaactgagtagtgcccaggtcgagcaacttcgccaggctatcgaagaattatattacttcgaattcgtggttgatgacctgccaatccgcggattcgtaggctatatggaggaaagtggattcctgccgcactctcacaagatcgggctttggacacatctcgattttcatctggagtttcatggagatcgaattatattcgcaaatgtttcggttagggacgtaaagccgcatagtctcgacggactcagaccagatgagttcctcggactaacccacacctattccgtgcgctggtccgaaacctccgttgagcgacgctctgatcggaggcggggagacgacgggggattcttccctaggaccctggaaattcattggttgagcattatcaactccatggttctggtgtttctactggtgggattcgttgccgtcatcctcatgcgcgtgctgcggaacgatttggcccgctacaaccttgacgaggaaactacctctgcagggagtggggatgatttcgatcagggcgataacggctggaagatcatccacactgacgtatttcggttcccatag

SEQ ID NO: 46950 - DNA, 774 bp, Artificial Sequence
  Description of Artificial Sequence: Synthetic coding sequence
atgaccgtggtgggcaacccccggagctggagctgccagtggctgcctattttaatcctgcttcttggcaccggtcacggccccggtgtggagggagtgacacattacaaggctggggatcccgtcatcttgtacgttaacaaggtcggcccttatcacaatcctcaggaaacctatcactattaccagctgcccgtctgctgccctgaaaagatccggcacaaaagtctgtctctcggagaagtcctagacggtgacaggatggccgagagcctgtatgaaattaggttccgcgagaatgtggaaaaaagaatactgtgccacatgcagctgtcctccgctcaggtagagcagctgaggcaggctatagaggagctctattacttcgagttcgtggttgatgacctgcctatccggggattcgttggctacatggaagaatccggctttcttccgcactcccacaagatcggcctgtggacacatcttgacttccacctcgagtttcatggtgacagaattatcttcgctaacgtgtcagtacgagacgtcaaacctcactccctcgacggactgcggccagacgagttcctgggactgactcacacctactctgtgcgttggagcgagacctcggtggaaagaaggtctgacagaaggaggggggatgatggaggattttttccacggaccctcgagatccattggcttagcattattaattctatggtcctggtgttcctgctggtcgggtttgtggcagtaattctctag

SEQ ID NO: 46951 - DNA, 2448 bp, Artificial Sequence
  Description of Artificial Sequence: Synthetic coding sequence
atgagcggcctgggccggctgttcggcaagggcaagaaggagaaggggcccacacctgaagaagctattcagaagctgaaggagaccgaaaagatcctcatcaaaaagcaggaatttcttgaacagaagattcagcaggaactgcagacagctaagaaatatggaacaaaaaacaagcgcgccgctttgcaagctctgcgtcgtaaaaagcgcttcgaacagcagctcgctcagaccgatgggaccttatcaacattggagtttcaacgtgaagccatcgaaaacgcaaccactaacgctgaggtgctcagaaccatggagttagccgcccagtctatgaagaaagcctaccaggatatggatattgataaggtggatgagctgatgacagacatcacagagcagcaagaggtagcccaacaaatttcagatgccattagtcgccccatggggttcggggacgacgttgacgaggatgaactgctggaagaattggaggagctggagcaggaggaactggctcaggagttactgaatgttggggacaaagaagaggagccatcggtaaaattgccttctgtgccctctacccacctgcctgcaggacccggaagcaccgcacttcgaatgacagtcgtcggcaacccccgcagttggagctgccaatggttacctatcctgattcttctgctcggaactggccatgggccaggtgtggagggcgttacacactataaagccggcgatcctgtcatactgtatgtgaacaaagtggggccttatcacaacccccaggaaacataccactactaccagctacccgtatgttgccctgagaagataaggcataagagtctgtccttgggagaagtgctagacggagataggatggctgagagtctctacgagatcagatttagggagaacgtcgagaaacggatcctatgtcatatgcagctgagcagtgcacaggtggagcagctgcggcaggctatcgaagagctatactactttgagttcgtggtggatgacctcccaatacgggggttcgtcgggtatatggaggagagcgggtttctgccacactcccacaagatcggactttggacacatctcgatttccaccttgagtttcatggcgatagaataatcttcgccaacgtgtctgtcagagatgtgaagccccacagtcttgatgggctccggcctgacgaattcctggggctgacacatacctactccgtacgatggagtgagacctccgttgaaagacggagcgatcggcgacgaggggacgacggcggtttctttccaagaaccctcgagatccattggctatctatcatcaactcaatggtgctggtgttcctgctggtgggctttgtggccgtcattctgatgagagttctccggaacgatctcgcacgctacaacctggatgaagagacaacaagcgccggctccggggatgatttcgatcagggagataacggctggaaaattattcatacagacgtgtttcgctttcctccatatagaggactcctgtgcgctgttctgggagtgggagcccaattcctagctctcggtaccgggattatcgtcatggcattgttgggtatgttcaacgttcatcgccacggagcaattaacagtgctgccattctcctatatgcccttacttgctgcatctccggatacgtgtcatcacatttctatcgtcagatcggcggcgagcgttgggtgtggaacatcatcctaacgacaagtctgttttccgtcccattcttcctgacctggtcggtagtaaacagtgtgcactgggccaacggcagtactcaggccctgccagcaaccacaatcctgcttcttctaacagtgtggttgctggtaggctttccactgacagtgatcgggggaattttcggcaagaataatgcctcaccgttcgatgccccatgccggaccaagaatatcgctagagaaatccctccccaaccctggtacaaaagtaccgtgatccatatgaccgtaggcgggtttttgccgttctcagcaataagcgtcgaactctattatatcttcgcaaccgtgtggggtcgcgagcagtataccctatacggtattctcttttttgtatttgcaattttgttgagcgtgggcgcatgcatttccatagccctgacctacttccagctctctggcgaggactaccgttggtggtggcgttcagtactctccgtgggatctacaggcctctttatcttcctgtacagcgtgttctattatgctagaagatccaacatgagcggagccgttcaaaccgtggagttcttcggttactccttgttgactggatacgttttctttttgatgttgggaactatcagcttcttttccagtctgaagtttatcaggtacatatacgtgaatctgaaaatggattag

SEQ ID NO: 46952 - DNA, 2448 bp, Artificial Sequence
  Description of Artificial Sequence: Synthetic coding sequence
atgagcggcctgggccggctgttcggcaagggcaagaaggagaagggacctacacccgaagaggctatacagaaactaaaagagacggagaagatactaataaaaaagcaggagtttctggagcaaaagatacagcaggaactccagaccgccaagaaatatggcacaaagaacaaaagagcagccctccaggcactccgccgaaagaaacgctttgagcaacagttagcacagactgacggcactctttctacccttgagttccagcgggaggctattgagaacgcaaccactaacgctgaagtgctgcggaccatggagctggctgcgcagagcatgaagaaggcgtatcaggatatggatatcgataaagtggacgagcttatgactgatataacagaacagcaggaggttgcccagcagatcagcgacgcgatctctcgacctatgggcttcggagatgatgtggacgaagatgagctgctggaggaactggaagaactggaacaggaagagctggctcaggagctgctgaacgtaggtgataaggaagaagagccctcagtaaagttgcctagtgtgccatccactcatcttcccgctggtcccggctctaccgcgctccgaatgaccgtcgtggggaatccccgatcttggtcttgccaatggctgcctattcttatccttctcctgggcactggtcatggcccaggggttgagggcgtgacccattacaaggccggcgatcctgtgattttgtatgtgaataaagtggggccttaccataatcctcaggaaacctaccactattaccagcttcctgtgtgctgcccagagaaaattaggcataaatctctgtccctgggagaggtactggacggggatagaatggctgagagcctctacgagattaggtttcgggagaacgtcgagaagcgcatcctgtgtcacatgcaactcagcagtgctcaggtggaacagctcaggcaggctatcgaggagctgtactacttcgagttcgtagttgacgaccttcctatccgcggtttcgtaggttacatggaggaaagcggattcttgccccactcccacaagattgggctttggactcatctcgactttcacttagagtttcatggtgaccgaattatatttgccaacgttagcgtgcgcgatgttaagccgcattcgctggacggcctaaggccggacgagttcctcggcctaacacatacctattccgtcagatggtccgagacctccgtggagcgaaggtcagatcgtcgccggggcgacgacgggggattctttcccaggacgcttgagatccattggctgagtataatcaactcgatggtgctcgtatttctgctcgtaggtttcgtggcggtgatcctcatgcgcgtgctgagaaatgacctggccagatacaacctagatgaggagacgaccagcgccggatccggcgacgatttcgatcagggagataatggttggaagatcatccacactgacgtatttaggttccccccataccggggcttgctctgtgccgttctcggtgtgggagcccagtttctggcactgggcaccggcatcatcgtgatggccctgttgggcatgttcaacgttcacagacacggagcaatcaactcggccgccatccttctctacgctctcacatgttgcattagtgggtatgtgagtagccacttttatcggcagatagggggggagaggtgggtttggaacatcattcttaccacttcccttttctcagttcccttcttcctgacctggtcagtcgttaattccgtccattgggccaacggcagcactcaggccctgccagccactaccattctgttgctcctgactgtctggctgttggtaggatttcccctgactgtaattggcgggatcttcggtaaaaataacgcctctccatttgatgctccctgtcgtacaaaaaacatcgcgcgtgaaatccctccccagccttggtacaagtccaccgtgattcatatgaccgttggcggtttcttgcccttttcggctatcagcgtcgaactttattacatcttcgccaccgtctggggtcgggagcagtataccctctacggcatactgtttttcgtattcgccatactcctttccgtgggggcctgcataagcattgccctcacttactttcagctctccggagaagactacagatggtggtggcgcagcgtgctgagtgttggcagtaccggactgtttatctttctttatagtgtgttctactacgcacgccgaagtaacatgtcgggcgctgtccaaaccgtggagtttttcggctacagcctgctgactggctacgtatttttcctgatgctggggactatcagcttctttagttccctgaaatttatacgctatatatatgtcaatttgaaaatggactag

SEQ ID NO: 46953 - DNA, 1992 bp, Artificial Sequence
  Description of Artificial Sequence: Synthetic coding sequence
atgagcgcccggctgcccgtgctgagccccccccggtggccccggctcctcctcctttcactcttgttgctgggcgctgtgccaggtccacggcggtctggtgctttttatctacctgggctcgctccagttaacttctgtgatgaggagaagaagagtgacgagtgtaaagcggagattgagctatttgttaatcgcctggactctgtcgaatcggtattgccatacgagtataccgcctttgatttttgtcaggcgagcgaggggaaaagaccctctgaaaacctgggacaggtgttgtttggtgaaaggatcgagccttccccttataagtttactttcaataagaaagaaacgtgcaagctggtgtgtactaaaacttaccacacagaaaaagcggaggacaagcaaaagctggagttcttgaaaaaaagcatgttgctcaattaccaacatcactggattgttgataacatgcctgtcacgtggtgttatgacgtggaagatgggcaacgcttttgtaatcctggcttccccattggatgctatattactgacaagggtcacgctaaggatgcttgtgtcatcagctccgactttcatgaaagggatacattttatatttttaatcacgttgatataaaaatttactaccacgtggtggagacgggctccatgggagccaggttggtggccgctaagctggaaccaaagagttttaagcacacacacatcgacaagcctgattgtagtgggccccccatggacatatcaaacaaagcttccggcgagataaagattgcctacacctacagtgtatcattcgaggaggacgacaagatacgttgggcttcgcgatgggattatatcctggagtccatgccacatactcacatccagtggttttccataatgaatagcttagtgatcgtgctctttctcagtggaatggtggctatgattatgctgaggacactccacaaggatatcgcacgctacaatcagatggattcaacagaagatgctcaagaggagttcggctggaagctcgtacatggcgacattttccggccgccaaggaaaggtatgctattatcggtgttccttggttcgggaacccaaatcctgattatgacgttcgtgacattgtttttcgcatgcctgggctttttgagtcctgctaatagaggcgcactgatgacctgcgccgtggtactttgggttcttcttgggactccagctgggtacgtcgctgctaggttttataagagcttcggcggggagaagtggaaaactaacgtgctgctcacctctttcctttgtcccggcattgtttttgccgacttctttatcatgaatcttattctgtggggcgaagggtcatcagctgccatccccttcgggactctggttgccatcctggcactttggttctgcattagcgtcccgctgacttttataggcgcatattttggattcaagaaaaacgcaatagaacatcccgtcaggacgaatcagattcctcgccagattccagagcaaagtttctacaccaagcctctccccgggatcatcatggggggcatcctgcccttcggatgtatttttatccagctctttttcatcttgaacagcatttggtctcaccagatgtactatatgttcgggttcctgtttttggtattcatcatcctggtcattacatgctccgaggccaccattctgctgtgttacttccacctgtgtgctgaagactaccactggcagtggagaagttttctgacaagcggcttcacggccgtctattttttgatctacgctgtgcattacttcttcagcaagctccagataactggtactgccagcactattctgtacttcggttacaccatgatcatggtgctgatcttctttttatttaccgggactatcggattttttgcctgcttctggttcgtcacaaaaatttactccgtcgtgaaggtggattag

SEQ ID NO: 46954 - DNA, 1770 bp, Artificial Sequence
  Description of Artificial Sequence: Synthetic coding sequence
atgcggcccctgcccggcgccctgggcgtggccgccgccgccgccctctggcttctgctcctgttgctcccacggacccgcgctgacgaacacgagcacacctaccaggataaagaagaggtcgtcttatggatgaacaccgtgggcccgtatcataaccgtcaggaaacttacaagtactttagcctccccttctgtgttggctcaaagaagagcattagccattaccacgagacgttaggtgaagctttacagggggtggagcttgaattctctggactcgatatcaagtttaaagacgatgtgatgccagcgacctattgtgagatcgatctcgataaggaaaaacgggacgcatttgtgtatgctattaaaaatcactactggtaccagatgtacatcgatgatctcccgatctggggaatcgtgggcgaggccgatgaaaatggcgaggattactatttgtggacatacaaaaagctggagatcggctttaatggtaatcggattgtggatgtgaaccttacatccgaggggaaagttaagctcgttccaaacaccaagatccaaatgtcatactccgttaagtggaagaaaagcgatgtcaagttcgaggaccgctttgacaagtacctcgacccctccttcttccagcacagaatccactggttcagcatcttcaatagcttcatgatggtgatttttcttgttggtttggtgagtatgatactcatgcgcaccctgcggaaagactacgctcgttattccaaagaagaagagatggacgatatggacagagacctgggcgatgaatatggctggaagcaggtgcacggagatgtgtttcgtccttcttcccatcccttgatatttagttccctcataggctccggctgccagatttttgccgtcagtctgatcgtcattatcgtggctatgattgaagatctatacaccgagcgcggcagtatgctgtctactgctatattcgtctatgccgcaacaagtccagtaaatggctatttcgggggatcactttatgccagacagggagggcggcggtggatcaagcagatgttcatcggggcgttcctgatccctgctatggtgtgcgggaccgctttctttatcaattttatcgccatttactaccatgcgagccgggctataccctttggtactatggtggcagtgtgttgtatatgtttctttgtgattttgcctttaaacttggtgggaaccatactgggaaggaatctgtccggccagccaaatttcccctgtagggtgaatgcagtgccccgtccgatcccagaaaagaaatggtttatggagcctgctgtaattgtctgccttgggggtatccttcccttcggatccatattcattgagatgtactttattttcacctctttctgggcctataagatctactatgtctacggctttatgatgcttgtcctggttatcctttgcatcgtcacagtgtgtgttactatcgtgtgcacttattttttgctgaacgcagaggattacagatggcaatggacttcctttttgtctgcggcttcaaccgctatctatgtgtatatgtactcattttactactacttcttcaagacaaagatgtatggtctgttccagacttccttctactttgggtacatggcagtgttcagtacggccctaggtatcatgtgcggcgctataggctatatgggaactagtgcattcgtaagaaaaatttatacgaatgtgaaaatcgactag

SEQ ID NO: 46955 - DNA, 765 bp, Artificial Sequence
  Description of Artificial Sequence: Synthetic coding sequence
atgaacaccgtgggcccctaccacaaccggcaggagacctacaagtacttctctcttccattttgcgtaggatcaaaaaagagtatctcgcattatcacgaaaccctgggggaagctttacagggggtggaactcgagttcagtggccttgatataaagtttaaggacgatgttatgcctgctacatactgtgagattgaccttgataaggaaaagcgagatgcatttgtctacgctatcaagaatcactattggtaccagatgtatattgacgaccttcccatctggggtatcgtcggcgaagcggacgaaaatggagaggactattacctgtggacttataaaaaactcgaaatcggattcaacggcaatcgtatcgtggacgttaatctgacaagcgagggcaaggtcaagctcgtacctaatacgaagatccaaatgtcttattcagtgaagtggaagaaatccgatgtgaagtttgaagatagatttgacaaatatcttgaccccagttttttccagcaccgcatacactggttttctatttttaatagtttcatgatggtgatcttcctcgtgggactggtcagcatgattctcatgagaacccttagaaaggattacgcacgatactctaaagaggaggaaatggatgacatggacagagacctgggcgatgagtatggatggaagcaggtgcatggcgacgtatttcggccttcgtcacatccgcttatttttagcagccttattggctctggatag

SEQ ID NO: 46956 - DNA, 765 bp, Artificial Sequence
  Description of Artificial Sequence: Synthetic coding sequence
atggcctggcagggcctggtgctggccgcctgcctgctgatgttcccttccaccacggcagactgtctgtcgaggtgttccctgtgtgccgtgaagacgcaagacggcccaaaaccgataaacccactaatctgcagccttcaatgccaagcagcgctgctgccttccgaggagtgggaacgctgtcagtcatttctgagcttctttacgccctctaccctcggcctcaacgataaggaagatctggggtcaaaaagcgttggagagggaccatactctgaacttgcgaagctgtccggcagcttcctcaaagagctggagaagtccaagttcttgcccagcattagcacgaaggagaatacactctccaagtcgctcgaggaaaaactacgcggcttaagcgacggattcagagagggagcggaatctgagctgatgagagatgcccaacttaatgatggtgccatggaaacaggaaccctgtatttggctgaagaggaccccaaagagcaggtcaagcgatatggaggattcctgaggaagtacccaaagagatcttctgaagtagcaggcgaaggtgatggggactccatgggccatgaagacctgtataagaggtatggcggcttccttcggcggatacgaccgaaacttaagtgggataaccagaaaagatacggaggattcctgcgacgacaattcaaagtggtcacaagatcacaggaggacccaaacgcctacagtggcgagctgtttgatgcgtag

SEQ ID NO: 46957 - DNA, 1929 bp, Artificial Sequence
  Description of Artificial Sequence: Synthetic coding sequence
atggccaccgccatggactggctgccctggagcctgctgctgttcagcctcatgtgtgaaacctccgctttctacgtccccggtgtggctcctatcaatttccatcaaaacgacccagtggagatcaaggcagttaaactaacatctagtaggactcagttaccatatgaatactacagtctgcccttctgccaacctagcaagatcacctataaagccgaaaatctgggcgaggtcttgcggggagatagaatagtgaacacaccatttcaggtcctgatgaactcagagaagaagtgcgaagtgctgtgctcccagtcaaataagcctgtgacattgaccgttgagcagtcccgcctagtcgctgagcggatcaccgaagattactacgttcacctgatcgcagacaatttgccagtggccacacggctggaactgtattcgaatcgagactctgatgataaaaagaaggagaaggacgtacagttcgagcacggataccgcctgggctttacagacgttaacaaaatttacctgcacaaccatttgagcttcatcctgtactaccaccgtgaggacatggaggaagatcaggagcatacatatagagttgttcgctttgaagtgatcccccagtcaattaggttggaggacctgaaggccgacgagaagtccagctgcacattacccgaaggcacaaactccagtccccaggagattgatccaaccaaagaaaaccagctgtatttcacatactccgtgcactgggaggaatcagacatcaaatgggctagtagatgggacacatatctcactatgtcagatgttcagattcactggttttctattattaacagtgttgtggtagtcttcttcctcagcggtatattatccatgattattattaggaccctgcgtaaagacatcgcaaactataataaggaggatgatatcgaggacactatggaggaaagtggctggaaactggtgcatggagatgttttccgcccaccgcagtatcccatgattctgtcatcattgttaggaagcggtatccaactgttttgcatgatcctgattgtgatttttgtcgctatgttggggatgttgtccccatcatcccgaggcgctctcatgaccactgcctgctttctgttcatgttcatgggcgtcttcggcggattttccgccggacgcctgtacaggacgctaaaggggcatcggtggaaaaaaggggcattttgcaccgctacactctatcctggtgttgtattcggcatttgcttcgttctcaactgctttatatggggaaaacactcatcaggcgccgtaccattccctacaatggttgccctgctgtgtatgtggttcggcatatcgctgcccttggtttacctgggatactattttgggttccgaaaacagccttatgataaccctgtgcgcacgaatcagatcccacgccagattcctgaacagcggtggtatatgaatcgatttgtcggaatactgatggccggaattctgccattcggggccatgtttattgaactgttcttcatattctcagctatttgggagaatcagttctattatttgtttggtttcctgtttctggtgtttatcatactcgtagtgtcttgtagtcagatttctattgtgatggtttatttccaactgtgcgccgaagattaccgctggtggtggagaaatttcttggtatcaggcggaagtgcgttctatgtgttagtgtatgccatcttttattttgttaataagctggacatagtggagtttattccaagcctgttgtatttcggatatacagcactgatggtgctcagtttttggctactcacgggcaccatcggcttctacgcggcctacatgtttgttagaaaaatctatgccgcggttaaaattgactag

SEQ ID NO: 46958 - DNA, 735 bp, Artificial Sequence
  Description of Artificial Sequence: Synthetic coding sequence
atggcccagatgttcctggagcccctggccgacaagttcatctactgtcaagtgttgatgaatagtgagaagaagtgcgaagtgctgtgctcccagagcaataagcctgtcaccctgaccgtcgagcagagcagactggtggccgaaaggatcaccgaggattactatgtgcatctcatcgccgacaatctgccagtggcgacccgactggagctgtatagcaacagggactccgatgataaaaaaaaagagaaagatgtgcagtttgaacatgggtacaggctgggatttacagatgttaacaaaatttatctgcacaaccacttgtctttcattctgtactatcaccgggaggacatggaagaggatcaggagcatacatatcgggtggtcaggttcgaggtaataccccaaagcatacgccttgaagatctgaaagccgacgagaagtcctcctgcaccctcccagaaggaaccaacagtagccctcaggaaatcgaccccacaaaagaaaatcagctctactttacctactccgtgcactgggaagagtctgacataaagtgggcctccaggtgggacacttacctcacaatgtccgacgtccagattcattggtttagcatcatcaactccgtcgttgttgtgttcttcctttccgggattctgtctatgatcataatcagaacattgcgcaaggacattgctaattataacaaagaggacgacatatag

SEQ ID NO: 46959 - DNA, 1425 bp, Artificial Sequence
  Description of Artificial Sequence: Synthetic coding sequence
atggtgcagcggttcagcctgcggcggcagctgagcaagatcgagcggctcgaagtgtcaagtttggcccaaacctcaagcgcggtggccagcagcacagacgggtccattcacacggattctgtggatggaactcccgatccccagaggaccaaggccgccatcgctcatctgcagcaaaagattctgaaactcaccgaacagattaagatcgcccagaccgcccgcgatgacaacgtcgcggaatatctcaagctggcaaatagcgcagacaagcaacaagcggctaggattaagcaggtctttgagaagaaaaaccagaaatcggctcaaaccatattgcaactgcaaaagaaactcgagcattaccaccggaagctgcgcgaggtggagcagaatggaatccctaggcagcctaaagatgtgtttcgggacatgcaccagggtcttaaggatgtgggtgctaaagttacgggattcagcgaaggggtcgttgacagcgtgaaaggcggattcagttctttcagccaggccactcatagcgctgccggagcggtggtcagcaagccacgggaaattgcctccttgattagaaataagtttggcagcgccgacaatatcccgaacctgaaggacagtctcgaggaaggacaggtggacgacgctggcaaagctctcggtgtgatcagtaatttccagagctccccgaaatacgggtcagaagaggattgcagtagtgccaccagtggctctgtcggtgccaacagtaccactggcggaatcgcagtcggcgcttcctctagcaagaccaataccctcgatatgcagagttctggttttgacgcactattacacgaaatacaagaaattcgagaaactcaggcgagacttgaagagtcttttgaaaccttgaaagaacactatcagcgcgattattctctcataatgcagactcttcaggaggagcgctataggtgcgagcgcctggaagagcagttgaatgatctaaccgagctccaccagaatgagatcctgaacctgaagcaggagctcgcctcgatggaggagaagatcgcttaccagtcttatgagcgggccagggatatacaggaagccctcgaggcctgtcagacgcgtatttcaaagatggagctgcagcagcagcaacagcaagttgtgcaactggaaggcttagaaaatgccacagcaagaaacttacttggaaaactcatcaacatcctactcgccgtgatggctgtcctactggttttcgttagcaccgtggctaattgcgtggttccattgatgaagactcggaacagaacattctcaaccctgttcttggtcgtcttcattgctttcctatggaaacattgggacgcactgtttagctatgtggagcgatttttctctagccctaggtag

SEQ ID NO: 46960 - DNA, 1962 bp, Artificial Sequence
  Description of Artificial Sequence: Synthetic coding sequence
atggagcccagcggcagcgagcagctgttcgaggaccccgaccccggaggcaagtctcaggatgccgaggcccggaaacagacagaaagcgaacagaaactctccaagatgactcataatgcactagagaatatcaatgtcatcggacaaggcctgaagcatctctttcaacaccaaagacggcgatcttccgtttcaccgcacgacgtgcagcaaatccaggctgatcccgagcctgaaatggacctggagtcccagaacgcctgtgctgaaattgatggcgtgcctactcacccgactgcgctgaatcgcgtcttacagcagattcgagtcccccctaagatgaagcgaggcacatccctgcattcacgccgaggcaaacccgaagcaccaaaaggttcgcctcagattaatcgtaaatcgggccaggagatgaccgccgtgatgcaatccggcagacctagatcaagctcaaccactgacgccccaacttcttcggccatgatggaaattgcttgtgccgcagcagctgccgctgcagcgtgcttacctggtgaagagggtacagccgagcgaatcgagaggctcgaggtgtcatcccttgctcagacatcaagtgcagtcgccagtagcacggatgggagtatccacacagatagcgtggacggcaccccagatcctcagcggacaaaagccgcaattgcacacctgcaacaaaagatccttaagttgacagagcaaattaaaatcgcacaaaccgctcgagacgataatgtggcagaataccttaagttggcaaattccgcagacaagcaacaggctgctagaataaaacaagtgttcgaaaaaaagaatcagaaaagtgcgcagacaatcttgcaattacaaaaaaagcttgagcactaccaccgcaaattaagggaggtagagcagaacgggatcccccggcagcccaaagatgtcttcagggacatgcatcagggcctgaaagatgtaggggccaaggtcaccggattttctgaaggggtggtagattctgtgaaaggaggcttcagttcttttagtcaagcaacccactccgccgccggtgccgtagtttccaagccgagagaaatagcttcgcttattcgtaataagtttgggtccgccgataacattcctaatcttaaagacagcctggaggagggtcaggtcgatgatgccggtaaggcgctgggcgttatctccaacttccaatcaagtcccaagtatgggtctgaggaggattgttccagtgctacgtcaggcagcgtaggcgcgaatagtacaacaggtggtattgcagttggtgcatcttcctctaagacaaatacgctggacatgcaaagctccggcttcgacgctctccttcatgaaattcaggaaattagagagacccaggccaggctggaagaatcgtttgagacactgaaggaacactatcaacgcgactacagtctgataatgcagacccttcaggaggaacgatatcgctgtgagcggctcgaggagcaactgaacgatcttaccgagctgcatcaaaacgagattcttaacctaaagcaggagctcgcatctatggaggaaaaaattgcataccagtcatacgaaagggctcgggatattcaagaagcattggaagcttgccagactcggataagtaaaatggagctccaacagcagcaacaacaggtcgttcagctggaggggctagagaacgctacagcccgcaaccttctgggaaagttgatcaatatactgctggcggtgatggccgtgctgctggtgtttgtgagcaccgtagccaactgcgtggtccctttaatgaaaacacgcaacagaaccttcagcactttgttcctggtggtctttattgcgttcctgtggaaacactgggatgccctttttagctatgttgaacggttcttttcctctccaaggtag

SEQ ID NO: 46961 - DNA, 1620 bp, Artificial Sequence
  Description of Artificial Sequence: Synthetic coding sequence
atgaagcggggcaccagcctgcacagccggcggggcaagcccgaggcccccaaagggtctcctcaaatcaataggaagtctgggcaggagatgacagctgtgatgcaatctggccgccccagatcctccagtacgacagacgctcccacttcatccgcgatgatggagatagcctgtgctgccgccgcagcagcagccgcctgcctccccggtgaggaaggcacggcagagcgaatagaaagactggaagtgagcagcctggcccagaccagttctgcggtggcatcatctactgatggctccatccataccgactctgtggatggaacccctgacccccagcgaaccaaagcagccatcgcgcacctacagcagaagatccttaaactgacagaacaaattaagattgctcagaccgctagggatgacaacgtcgcggagtatttaaagttggccaatagcgccgataaacagcaggcggcacggattaagcaggtgtttgagaaaaagaaccagaagtcggcccagactatcctacagctgcaaaaaaagctggaacactatcaccgcaaactgagggaggtcgaacaaaatggaatccctcggcagccaaaggatgtttttcgtgatatgcaccaaggccttaaagacgtgggggctaaagtgaccggattctcagaaggtgtagtcgattccgttaagggtgggttcagcagctttagccaagccactcatagtgctgctggcgccgtggtgtcgaagcccagggagattgccagtctcattaggaacaaatttggctcagctgacaacataccaaacttgaaggatagcctggaagaaggacaggtggatgatgccggaaaggccctgggtgtcatttccaattttcagtcttctcccaagtatggttctgaagaggactgttcttccgctaccagtggctccgttggcgccaatagcacaacaggcggaattgcagtgggggccagctcctctaagacaaacacactggacatgcagagcagcggttttgatgctttactgcacgaaattcaagagatccgcgaaacacaggcaagactagaagagagcttcgagaccctgaaggagcattatcagagagattactccctgatcatgcagaccctacaggaagagcggtatcgttgcgagcgcttagaggagcagttgaacgatctgactgaactgcatcagaacgagatcttgaatctgaaacaagaactcgccagtatggaagaaaaaattgcttatcagagttacgagcgggctcgggatattcaggaggcccttgaagcctgccagacacggatctcaaagatggaactccaacagcagcagcagcaggtagttcagctggagggtttggaaaatgccacagcgaggaaccttctggggaagctaatcaacattctcctcgccgtgatggctgtgctgctcgtgtttgtgtcaactgtggccaactgtgtggtgcccctgatgaaaaccagaaaccggaccttcagtacacttttcctcgtcgtgttcatcgccttcctttggaagcactgggatgccttattttcttacgtggagcgcttcttttcatcccctcgctag

SEQ ID NO: 46962 - DNA, 990 bp, Artificial Sequence
  Description of Artificial Sequence: Synthetic coding sequence
atgcaccagggcctgaaggacgtgggcgccaaggtgaccggcttcagtgagggtgtagtcgacagcgtcaaaggtggattctcatctttttctcaggcgacccattccgccgccggtgccgttgtgtctaagccacgagaaatcgccagcctgatcaggaacaagtttgggtcggccgacaatattcctaatctgaaggactccctggaggagggccaagtggacgacgcaggcaaggctctgggcgtgatttcaaacttccagtcgagtccgaagtacggctcagaggaagattgttcgtccgctacctccgggtccgtgggcgctaatagtacaaccgggggaattgcggtgggcgcctcctcctccaagaccaacactcttgacatgcagtcgagcggcttcgacgccttactgcatgaaattcaggaaattcgagaaacgcaagcaaggttggaagagtcttttgagacattaaaggaacattaccaacgcgactattctttgattatgcagaccttgcaggaggagcggtatcgctgcgagaggctggaggagcagcttaatgatctcacggagttacatcaaaacgagatacttaatttgaaacaggagctggcctccatggaagagaagattgcctatcagtcctatgaacgcgcgagggatattcaggaggccctggaggcgtgtcaaactagaatttccaagatggaattgcagcagcagcagcaacaggttgtgcagttggagggtttggagaatgccacagcaagaaatctcctggggaaactcattaacatcctcctcgcagtgatggccgtattattggtgttcgtgtctactgttgcaaactgtgttgtacctttaatgaaaacaagaaatcggaccttctcgaccctctttctagttgtgtttatagccttcctctggaagcattgggatgcactgttctcctacgtagagaggttttttagcagcccccgatag

SEQ ID NO: 46963 - DNA, 1410 bp, Artificial Sequence
  Description of Artificial Sequence: Synthetic coding sequence
atgaagagcaaggaggaggagaccgccgtggacaagggcgacctggtcgctctcagcttgcctgccggccacggagacaccgacggtcccatctcattggatgtgcccgatggagcccccgacccacaacgaactaaagccgctatcgaccacctgcaccaaaagattctgaagatcacagaacagatcaaaatcgagcaggaggcccgggacgacaatgtcgccgaatatctgaagctggctaacaatgccgacaaacagcaggtatcccgcattaagcaggtcttcgagaagaagaatcagaagagtgcacaaacaatcgcccagctgcataaaaaactggaacactatcgccgtcggctgaaagagattgaacagaatggaccatcgaggcagccaaaggatgttttacgtgacatgcaacagggtttgaaggatgtgggggccaacgtaagggcggggatcagcggcttcggcggaggagtggtcgaaggggttaaggggagcctgagtggcctgtcccaggctacccacacagctgtagtgtctaaaccaagggagtttgcctctttgatccgaaacaagttcggtagtgccgacaacatagcccacctgaaagatccacttgaagatggtcctccagaagaggctgcccgggctttaagtggaagtgctaccttggttagttctccaaaatatggcagcgacgatgagtgttcgagtgctagtgcatcctccgcaggagcggggagcaactccggagcgggtcctggcggagcgctcggatcgcctaagagtaatgccttgtacggggctcctggaaacctcgacgccctcctcgaagagctccgggaaatcaaggaaggccagagccacctggaggattccatggaggatttgaagactcaactacagagagattatacttatatgacccagtgtctccaggaggagagatacaggtatgaaaggctcgaagagcaattgaatgacctgactgaactccatcagaatgaaatgacgaatctgaagcaagagttggccagcatggaagagaaggtggcttatcaatcatacgagcgggcacgcgatatccaagaagcagttgagtcctgtctcacacgggtgactaaactggagctccaacagcagcagcagcaggtcgtgcagcttgaaggtgtggaaaatgccaacgcgcgggcgttattggggaagtttatcaacgtgatcctggccctaatggcagtgctcctcgtatttgtgtctacaatcgctaactttatcaccccccttatgaaaacccggctcagaatcacatctacaaccctgctcgtgctcgtgctctttctcttgtggaagcactgggacagccttacctacctgctggaacacgtgctgctgccaagttag

SEQ ID NO: 46964 - DNA, 1455 bp, Artificial Sequence
  Description of Artificial Sequence: Synthetic coding sequence
atgaaccaggtggtgcagcccctgatgagccggcacagcgcctgcaggggaagccaggcccatctgtcgtgggttgacaaaggcgacctggtcgcgctttccctgcctgcaggacacggggacactgacgggcccatttctctggacgtgccagacggggctcccgacccccagaggacaaaggcagcaattgatcacctccatcagaagatccttaaaatcaccgaacaaattaaaatcgaacaagaggctcgggacgacaacgtcgcagaatacttaaaattggcaaataacgcagacaaacagcaagtatccagaatcaagcaagtgttcgaaaagaagaaccagaaatctgcgcaaactattgctcagctgcacaagaagctcgagcactatcggaggcgcttgaaagagattgagcagaatggtcctagcaggcagcccaaagacgtgttacgggatatgcagcagggcttgaaggatgtgggagccaacgttcgggctggcatcagtggcttcggtggcggagtggtggaaggtgtcaagggatccctgtcaggactgtcacaggctacacatacagccgtggtgtccaaacctcgggagtttgcaagccttataaggaataaatttggctcggcagataatatcgctcaccttaaggatccgttagaggacggccctcccgaagaagccgcaagggctttgagtggtagtgcgacactggtgtccagtcccaaatatggttccgatgacgagtgttctagcgccagtgcgtctagtgcgggcgctggctctaactctggtgccgggcctggcggcgccctggggtcgcccaagagcaacgcactttacggtgcccccgggaacctcgacgcgcttttagaagaactgagagaaataaaagaaggtcaaagtcacttggaagattctatggaagaccttaaaacacagctgcagagagactacacatacatgacgcagtgccttcaggaagagcgctaccggtacgagcgtttggaagagcagttaaacgatttaaccgaattgcatcagaacgagatgacaaatttaaagcaggagcttgcgtccatggaggagaaggttgcatatcagagctacgaaagagccagagacatccaagaagcagtggagtcatgcctgactagggttacaaagctcgagctacagcagcagcagcagcaagtggtgcaattggaaggagtggagaacgcaaacgccagggccctgctgggtaagtttataaacgtcatcctggcactgatggccgttcttctcgtgttcgtgagcaccatcgcaaatttcatcacgcctctaatgaagaccagactcaggattaccagcacaaccctgcttgtgttggtgctgtttcttttgtggaagcattgggatagcctgacgtatttgttggagcacgtgcttctgcctagctag

SEQ ID NO: 46965 - DNA, 2130 bp, Artificial Sequence
  Description of Artificial Sequence: Synthetic coding sequence
atgaagcggtgccggagcgacgagctgcagcagcagcagggcgaggaggacggagctggcctggaggatgccgctagccatctgccaggcgccgatctaaggccaggagaaaccactggggccaattccgcgggcggaccaacttcggacgctggggcagctgcagctcctaatcctggaccacgcagcaagccccctgatctgaaaaagatacagcaattatctgaaggcagtatgtttggccacggtcttaaacatctctttcattccagacgacggtccagggagagggaacatcagactagccaggattcacagcagcatcagcaacagcagggcatgagcgatcatgactcccctgacgaaaaagaacggtcccctgagatgcatcgcgtcagctacgctatgtcattacatgatttgccggcccgccccacagcgttcaacagagtgctacagcagattcggagtagaccttctattaagagaggcgccagtctccattcttcttcagggggcggaagctcgggatcatcttccaggcgcaccaagagctccagtcttgaacctcagcgtgggagccctcacctgctccggaaagccccccaagattctagcctggctgctattttacaccagcaccaatgtcgaccaagatcctctagtacaaccgacaccgcgttgcttctagcagacggaagcaacgtgtatctgctcgccgaggaagcggaagggattggcgacaaggttgacaagggtgacttagtggctctgtctctccccgccggccacggtgataccgatggccctatttctctggacgtaccagacggcgctccagatccacagcgcaccaaggcggccatcgatcacctgcatcagaagattctgaagattacagaacagatcaaaattgagcaggaggctcgggatgacaatgtcgccgagtacctcaagctggccaacaatgcagacaaacagcaggttagccgaataaagcaagtttttgagaagaaaaatcagaagtcagcccagactatcgcacagctccacaaaaagcttgaacactatcgcaggcggctgaaagagattgagcagaacggaccctcacgccagcctaaggatgttctgcgcgacatgcaacaggggcttaaagacgtgggggcaaacgtgagagccggaatcagtggttttggcgggggcgtcgtggaaggagtaaaggggagcctgtctgggctctctcaagccacccatactgctgtggtcagcaagccgagggaattcgcatctctcatccgaaataaatttggaagtgcagacaatattgcccatctcaaggatccattggaagacgggccccccgaggaggcagccagagcactgtccgggtcggccactctcgtctcaagtcccaagtacgggagtgacgatgagtgtagttcggcaagcgcaagttcagccggggctgggtcgaattccggggccgggcctggcggggcactggggagtccaaaatcaaatgctctttacggcgcccccggcaacctggacgcactgctggaagagctgagagagatcaaagaagggcagagtcatctggaagacagcatggaagacctcaaaacgcaactccagagagactacacctacatgacgcaatgtctccaggaggagcgttacagatatgaacgcctagaggagcagctgaacgatttgactgagttacatcagaacgagatgacaaacctaaagcaggagttagcgagcatggaggaaaaggtggcctatcagtcctatgagagagccagagacattcaggaggccgttgagagctgcttaacgagagtgacaaagctggagttgcagcagcagcagcagcaagtggtccagctggagggcgtagagaatgcaaacgcacgtgctttactggggaagtttatcaacgtgatcttggccctgatggccgtgctgctcgttttcgtcagcactattgctaatttcattacacctttaatgaagactagactacggataacatcaaccactcttctggtactggtcctgtttctcctgtggaaacactgggattctcttacctatttgctggagcacgtcctgttacctagctag

SEQ ID NO: 46966 - DNA, 771 bp, Artificial Sequence
  Description of Artificial Sequence: Synthetic coding sequence
atgaaccaggtggtgcagcccctgatgagccggcacagcgcctgccgggggagtcaagcacacctgtcatggctgtggacatccgtcccgttgtgttggcctcttactgaatttcctgctggcacagtgaagatgaaatctaaggaggaagaaactgccgtcgataaaggcgacctggtggctctctctttaccagccggccatggggacactgacggccctatttcattggacgtgccagatggggcacccgacccccaacgaaccaaagcggctatagaccacttacaccagaaaatcctgaagattacggaacagattaaaatcgaacaggaagcgcgagacgacaacgtagccgaatatttgaaacttgccaataacgctgataagcagcaggtgagccggataaaacaggtgtttgaaaagaaaaaccagaaaagcgcacagaccattgctcagttgcacaagaaactggagcattacaggcgtcggctgaaggaaatcgaacagaatggaccctcacggcaacctaaggacgtgttgagagacatgcagcaaggtttaaaggacgtaggagcaaatgtgagagcaggaatctccggctttgggggaggcgttgtggagggggtgaaaggatctctgagcgggctgtcccaagccactcacactgctgtggtgagtaagccccgtgaatttgcgagtctgattagaaataaatttggatccgcggacaacattgcccatctgaaggatccactggaggatggctag

SEQ ID NO: 46967 - DNA, 1896 bp, Artificial Sequence
  Description of Artificial Sequence: Synthetic coding sequence
atgttcggccacggcctgaagcacctgttccacagccggcggcggagtcgcgaacgggagcaccagacctctcaggattcacaacagcatcagcagcaacagggcatgagcgaccacgatagccccgacgagaaagaacggtcccctgagatgcatcgggtatcatatgccatgtcactgcatgatcttcccgcaaggcccacagctttcaatcgggtcctgcagcagattaggagtcgaccatctatcaagcgtggggcttcacttcattcctcttctggcgggggtagttccggaagtagctccaggaggaccaagtcctccagcctagaaccccagcgtggcagcccccatctgctgcgcaaagcgcctcaggactcttcgctggcagctatcctccaccagcaccagtgcagaccccggagtagctccacaacagacaccgccttactcctggccgatggatcgaatgtgtacctgttggccgaggaagccgagggcataggtgacaaggtcgacaaaggagatctggtcgccctctcactacccgcaggtcacggtgacacagatggacctatcagcttggatgtgccggacggcgccccagatccccaacgcaccaaggcagcaattgaccatctccaccagaagattcttaagataactgagcaaatcaagatcgagcaggaagcccgggacgacaatgtcgcagaatatctgaagctcgctaataacgctgataagcaacaggtgtcccggattaagcaagtcttcgagaagaagaatcagaagtcagcccagacgattgcccaattgcataaaaaacttgagcactacagacgccgactcaaggaaatcgagcagaacggcccttctaggcagccaaaagacgtcctgcgggacatgcaacaggggctaaaggatgtaggggccaacgtgcgtgctggcatctctggattcggtggaggcgttgtcgaaggcgtaaagggctctctgtctggtctgagtcaggcaacccatactgctgtggtgagcaaaccacgagaattcgccagtctaattcgcaacaagttcggaagtgcagataacattgcccatctgaaagacccgttggaagacggacccccggaggaagcagcaagagctctaagcggctcagccactttggtgtcttcacccaagtacggctctgatgatgaatgtagcagcgcttctgcttctagcgcaggagctgggtcaaacagcggcgccggccccggaggcgcgcttggtagtccaaagagtaacgcactgtacggcgctcccgggaacctggacgccttactggaggaactgcgtgagattaaagagggacaatcccacttggaagactccatggaggacctgaaaacgcaacttcagagggactatacatatatgacccagtgtctgcaggaggagcgctataggtacgagaggctcgaagaacagctaaatgacctcacagagctccaccagaatgagatgaccaatttaaagcaagagctcgctagtatggaggagaaggtggcctaccagtcttatgaacgggctcgggatattcaggaggctgtggaaagctgtctgacgcgggtgactaagctggagctgcagcagcagcagcagcaggtggttcaactcgaaggagtggagaacgctaatgcccgagccttactaggtaagttcatcaatgtcatcctggccctgatggccgtcttactcgtgttcgtgagcaccatagccaatttcataacacctttaatgaaaactcgcctgcgaataaccagcaccaccctgcttgttttagtgctgttcctcctgtggaagcactgggactctctgacgtacctgctggagcatgtcctcttgcctagctag

SEQ ID NO: 46968 - DNA, 1434 bp, Artificial Sequence
  Description of Artificial Sequence: Synthetic coding sequence
atgcccggcagcgacaccgccctgaccgtggaccggacctacagctatcccggacgacaccacaggtgcaaatctcgcgtggaaagacatgacatgaatactctgtccttgcctctcaatattcgtcgcggaggaagtgatactaatctgaactttgacgtgcccgacggcatcctggattttcataaagtgaagctgaccgcagatagtctaaaacagaagattttaaaagtgactgagcaaatcaagatcgaacaaaccagtagggatggaaatgtggcagagtacctgaagctcgtgaataacgccgataaacagcaggcaggaagaataaaacaagtgttcgagaagaaaaaccagaagagcgcccatagtatagctcagctgcagaagaagttggagcaataccatagaaaattgagggagatcgaacagaatggcgccagtcgttcatccaaggacatatcaaaggaccaccttaaggacattcatagatctttgaaagatgcccacgtgaagtcccggacagcaccacactgcatggagtcatctaagtcagggatgcccggcgtgagcctcactccccccgtctttgtctttaacaaatcccgcgagtttgcgaatctgatcaggaacaagtttggatctgctgacaatattgcacacctaaaaaacagcctggaggaatttcgtccggaggcctcggcacgcgcctacggaggaagcgctaccatcgttaataaaccaaagtatggctcggatgacgagtgcagctccggaacctcaggctccgctgattccaatggcaatcaatcatttggggccgggggagcctccactctggacagccagggaaaactggccgtcatcctcgaagagcttcgtgagatcaaagacacacaggcccagctggcggaagacatcgaagccctgaaggtacagttcaaaagagaatacggcttcataagccagaccctgcaagaggagcgctaccgctacgaacgtctcgaagatcagttgcatgacctgactgacctgcatcaacacgagacagccaacctcaaacaagagctggctagcattgaagaaaaggtggcatatcaggcctacgagaggagtcgtgacatccaagaagccctagagagttgccagacacgcattagcaagctcgaactgcaccaacaagagcagcaggcacttcagaccgatacagtgaacgcaaaggtacttttgggcaggtgtataaatgttattcttgccttcatgacagttattcttgtctgcgtatctacgatcgccaagtttgtatctcccatgatgaaatcacgctgccacatactggggacattttttgcagtgactctattagccattttttgtaagaactgggaccacattttgtgcgctatcgagagaatgataatccctaggtag

SEQ ID NO: 46969 - DNA, 549 bp, Artificial Sequence
  Description of Artificial Sequence: Synthetic coding sequence
atgagcaccagcagcagcagcagctgggacaacctgctggagagcctgtcactcagtacagtgtggaattggatccaagcttcctttctcggcgaaacatctgcaccccagcagactagtctcggtctactcgataatttagcacccgccgtgcagattattctgcggatatcattcctgattctgctggggattgggatctacgccctttggaagcgcagcatccagtcaatacagaaaaccctactttttgttatcactctttataagctctacaagaagggcagtcacatcttcgaagcactgttagccaacccggagggtagtggattgagaatccaggacaacaataatctgtttctctcattaggcttacaggagaagattctgaaaaaactgaagactgtggaaaataagatgaaaaacttagagggcatcattgtggcccaaaaaccggccaccaagcgcgattgctcttctgaaccctactgtagctgctcagattgccagtctccgctttccacctccggattcacgagtccaatttag

SEQ ID NO: 46970 - DNA, 2034 bp, Artificial Sequence
  Description of Artificial Sequence: Synthetic coding sequence
atgaaggtgctgggccggagcttcttctgggtgctgttccccgtgttgccttgggcagtgcaagctgttgaacatgaggaagtggcccaacgagtgattaagttacatcgggggagaggggtcgcagccatgcagtccaggcaatgggtgagagattcctgcaggaaactgtctggtctgctccggcagaagaatgcggtcctgaacaaactcaaaacggcgatcggcgcagtggagaaggacgttgggttatcagacgaagagaagctgttccaggtacacacctttgaaatatttcagaaggaattaaacgagagcgaaaacagcgtattccaggctgtctacggattacagcgcgcactgcaaggcgactataaagacgttgtgaacatgaaagaaagcagtcgccagcgcctggaagcacttcgtgaagctgctatcaaggaggagaccgaatatatggaactgctggccgcagagaagcaccaggtggaagcacttaagaatatgcagcatcagaatcagagcctttcaatgctggatgagatccttgaagacgttcgaaaagccgccgacagactcgaagaagagattgaagagcacgccttcgatgataataaatccgtcaagggtgtgaattttgaggcagtgctgcgggtggaagaagaggaagcgaattccaagcaaaacataacaaaaagagaggtcgaagatgatctggggctgtctatgctgattgactctcaaaacaaccagtacatcctcaccaaaccgagggatagcactatccctagagcagaccaccactttattaaggatattgtgacaatcgggatgctgtccctgccttgcggctggctctgcaccgcaattggcctccctactatgttcggatatatcatctgcggagtgctgcttggtccatctggtcttaattcaattaagtctattgtgcaggttgagactctgggagagtttggggtattcttcactcttttcttggtcggtctggagttttcccctgagaaactgcgcaaagtgtggaagattagtctccaaggcccatgttacatgactcttctgatgatcgcatttggtctgctctggggccacctcctgcgaattaagcccacacagagcgtgtttatttcaacatgcctgtccttgagctcaactccgttggtgagccgcttcctgatgggatctgcacggggcgataaagagggagacattgattacagtacagtcttgttgggaatgctagtcacacaggatgttcaactgggcctctttatggctgtgatgccgacactcatccaggccggggcaagcgctagctcttcaattgttgtcgaagtgttgaggatccttgttctcatcgggcaaattctgttctctctggctgccgtctttctgttgtgccttgtgattaaaaaatacctgattggcccttattatcggaaattgcatatggaaagcaagggtaataaagagatactcattctcggaatctcggccttcatattcctcatgcttacagtgaccgagctcctggacgtttctatggaactggggtgcttcctggccggcgccctagtgagcagccaggggcccgtggttacagaagagattgccacctccattgaacccattcgcgactttctggcgatcgtctttttcgccagcatagggctgcacgtgtttcctacatttgtggcttacgaactaaccgtcctcgtgttcttaactctcagcgtcgtcgtaatgaaattcctgctcgcggctttggtactgagcttgatcctgcctcggtcatcgcaatacataaagtggatcgtaagcgccggcctcgcacaagtgtctgagttctccttcgtgctggggagtcgcgccagaagggcaggtgtcatcagccgggaggtgtacctactcatcctgtccgtgactacattgagccttctgcttgccccggtgttgtggcgggccgccataacaagatgtgtgcctaggcctgaacggcggagctccttatag

SEQ ID NO: 46971 - DNA, 1905 bp, Artificial Sequence
  Description of Artificial Sequence: Synthetic coding sequence
atggccatgtggaaccggccctgccagcggctgccccagcagcccctggtcgccgaacccacggccgaaggggagccccatctgcctactggtcgggaacttacggaggctaatcgctttgcgtacgcagccctttgtgggattagcctttctcagctatttccagaaccggagcactcgagcttctgcaccgagttcatggccgggcttgtgcaatggttagaactgtccgaggccgtcctgccaactatgaccgctttcgcctctggtctaggaggcgaaggggccgatgtttttgtgcagatccttcttaaagacccaatactgaaagacgatcccaccgtaataactcaggacttgttgtccttctctctgaaggatggacactatgacgctagggccagggtcctggtgtgtcacatgacctccctgctgcaggtacccctagaagagctggacgtcctggaagaaatgttcctggaaagcctgaaggaaatcaaggaagaagagtctgaaatggctgaagcatctagaaagaagaaagaaaatcggagaaagtggaagcgttacctgttaattgggctggctacagttggaggcgggactgtgatcggagttactggcggcctggccgcccctttggtggctgcaggggctgcgaccattataggctcagcaggcgctgccgcattaggctcagcagcgggtattgctataatgacatccctcttcggggcagcaggggcaggactgactggatacaagatgaaaaagcgggtcggggccattgaggaatttacatttctccctttgaccgaggggcgacagttgcatataacaatagccgtgaccgggtggctggccagcggcaagtaccggacattttctgccccctgggcagcgctggctcactctagagaacagtactgcctcgcttgggaggcgaagtacttgatggagctgggcaatgctcttgaaactatcctgagcgggttagcgaacatggtcgcccaggaagccctgaaatacactgttctgtctgggatcgtcgccgctcttacatggccggccagtcttctgtcagtcgccaatgttatcgacaacccttggggcgtgtgcctccacagaagcgcagaagtgggtaagcatcttgcacatatcctactttcccgacaacaagggcgccgtcctgtgacccttattggcttttccctgggggcgagggtaatttatttctgtctgcaggagatggctcaggagaaggactgccaaggcattatcgaagacgtgattctgctcggggcccccgtcgagggggaagccaagcattgggagcccttcaggaaagttgtgagtggacgaatcatcaacgggtattgccggggcgattggctcctgtcctttgtttataggacgtcctcagtgcaactacgagttgccgggctgcagccagttttactacaggatagacgagtcgaaaatgtcgatctgacctccgtagtcagcggccatctggattacgctaaacagatggacgccattctcaaagccgtggggatcaggactaagccaggctgggacgagaagggactgctgctggctcccgggtgcctcccttctgaagagcccaggcaggctgctgccgccgcatcttcgggtgagacgccccatcaggtcgggcagactcaagggcctatcagcggagacacctcaaagctggctatgtccacggacccctcccaagcacaagtgcctgtcgggttagatcagagcgagggggctagtctgcctgctgcggctagtcctgagcggccccctatatgcagtcatggcatggaccccaacccactgggttgtccagattgcgcctgcaagacccaaggaccgtcaaccggactagattag

SEQ ID NO: 46972 - DNA, 1785 bp, Artificial Sequence
  Description of Artificial Sequence: Synthetic coding sequence
atggccatgtggaaccggccctgccagcggctgccccagcagcccttggtagccgaaccaacagctgagggtgagccccatcttcctaccggtcgggaactgacggaagctaaccgctttgcatacgcagccctgtgtggcataagtctaagccagctttttccagaaccggagcattcctccttctgtacagaattcatggcgggacttgtgcagtggctggagttaagcgaggcagtccttcccacaatgacagcatttgcaagcggactgggtggggaaggcgccgacgttttcgttcaaatcctgcttaaggaccccatcctcaaggacgaccctactgtgatcacacaggatttgctgagctttagtcttaaggacggccattacgacgccagagcccgggtgttggtctgccacatgacaagtctgctacaggtgccactggaggagcttgatgtgctggaggagatgttcttagaaagccttaaggagattaaagaagaggaatccgagatggcagaggcaagccggaagaaaaaggagaaccgtcgaaagtggaagcgatatctgcttatcggcttagcaacagtaggcggcggcaccgtgattggcgtaactggcgggctggctgctccacttgtggcagccggcgctgcgaccattataggatctgcaggcgctgcagcactcgggtcagccgccgggatagctattatgacttccctcttcggagctgccggtgccggcctgaccggtacgttttcggcaccctgggccgccctagcccattcacgggagcaatattgcctggcatgggaggctaagtacctgatggaactcggtaatgcactcgaaactatcctttcaggtctcgctaacatggtggcccaggaggctctcaaatacaccgtcctctcaggaatcgttgccgcccttacatggcccgcttcactgcttagcgttgcaaacgtcatagataacccctggggagtgtgtctgcaccggagtgccgaggtcgggaaacatctggcccacatactactctcacgccagcaaggacgccgccccgttaccttaataggcttttcactgggggcgagagtgatttacttctgtctgcaggaaatggcccaggaaaaggactgccagggaatcattgaagatgtgattctccttggagctcccgtggaaggggaagccaaacactgggaacccttccgcaaagtagtgagtggcaggatcatcaatggttattgtcggggagactggcttttgtctttcgtgtaccgaaccagtagcgtgcagcttcgggtcgccggcttgcagcctgtgctcctgcaggacagacgcgtggaaaacgtggacctgaccagcgtggttagtggtcacctcgattatgccaagcaaatggacgctatcttaaaggctgtgggaatccgaacgaagcctggttgggacgagaaagggctcctgctggcacctggttgcctcccttcggaagagccacgacaagctgccgccgctgcgagctcaggagagaccccccatcaggtcggccaaacccagggaccaatctccggagacacttcgaaactggctatgagcaccgacccctcccaggctcaggtacctgtgggactcgatcaatccgagggggcctctctccctgcggctgcttccccagaacgcccaccaatttgctcccatggcatggatcctaatcctctgggttgtcctgattgtgcgtgcaaaactcagggaccctcaaccggcctggattag

SEQ ID NO: 46973 - DNA, 1743 bp, Artificial Sequence
  Description of Artificial Sequence: Synthetic coding sequence
atggccatgtggaaccggccctgccagcggctgccccagcagccccttgtagccgaacccaccgcagagggggaacctcacctgcctacgggccgggaacttaccgaagcaaaccgtttcgcctatgctgcgctgtgtggcatttcactatcccagttgtttcctgagccagagcattccagcttctgcacagaattcatggccgggctggtgcaatggcttgaactctcagaggcggtgctccctaccatgacggccttcgcctcaggactgggcggtgagggcgccgacgtcttcgtgcaaatcctcctgaaggaccctatccttaaggacgaccccaccgtcatcactcaagacctgttgtccttttcactgaaggatgggcattacgacgcccgagcccgcgtgttggtgtgtcacatgacttcactcctgcaagtcccactggaggaactcgatgtgctggaagagatgttcttggagagcctgaaagaaatcaaagaagaagagagtgagatggcggaagcctccaggaagaagaaggagaatcggagaaaatggaagagataccttcttatcggactcgcgaccgtaggaggtggtactgtcattggggtcaccgggggcctcgctgcaccactggtggccgccggagcagccacaattatcggctcagcaggggccgccgcgctgggctcagccgcaggtatagccataatgacatcactattcggggccgcaggagctgggcttactggctataagatgaaaaagcgcgtgggcgcaatagaggagttcacattcttgccactgaccgagggccgtcaattgcacatcaccatcgcggtcaccggctggctggctagcggcaaataccggacattctcagctccctgggcggcactggctcatagcagggaacagtattgcctggcgtgggaggctaagtacctgatggaattgggcaatgcactggagaccattctcagcggcctcgcaaatatggtcgcacaggaagccctgaagtataccgtcttgtcgggcattgtggcagctctcacctggccagcttccttgctgtccgtagctaatgtcattgacaacccttggggggtgtgcctgcaccgaagtgctgaagtgggcaaacacctggcacacattctgctcagcaggcagcaaggacgcagacccgtgacattgatcggtttctctcttggagccagggttatatacttctgtctgcaggagatggcgcaggagaaggactgccagggtatcattgaggatgtcattttacttggcgctcctgttgagggggaagccaagcattgggagcccttcagaaaagtcgtgagcggcaggattattaatggttattgccgtggcgattggcttctcagctttgtgtatagaacctcgagcgtccagcttagggtggcgggactgcagccagttctactgcaggataggcgcgtcgaaaatgtggacctgacctcagtcgtgagtggtcacctcgattacgccaagcagatggacgcaattttaaaagctgtcggcataaggacaaagcctggctgggacgaaaaagggctgctccttgcacccgggtgcctcccttctgaggagccccgacaagccgccgctgctgcatctagcgcactcgagtctggctgtccgtccggggggcctgagggaagtctgggacccgaggcaccgacacctgccctgccgtggccccaatag

SEQ ID NO: 46974 - DNA, 867 bp, Artificial Sequence
  Description of Artificial Sequence: Synthetic coding sequence
atggagatcagccggctggcccagagcaagcggaacatcatcagcctgaacatggacctggagcgtgacacacagagaattgatgaggctaaccagaaattgctattgaagatacaggagcgggaagataagattcaacgactggagagcgagatcattcagactaggggattagttgaggacgaggaatgggaaaaagagaatcgaaccaccatggagagagagagggcgttgcaggagctcgaggaggaaaccgccaggctcgaacgcaagaataaaacgcttgtgcactctattacggagctccagcaaaagctgactagaaagagccaaaagattactaattgcgagcagagcagtccagatggtgctcttgaagagacaaaggttaaactgcagcagttggaggcctcctatgcctgccaggagaaagaactcctcaaggtgatgaaggagtatgctttcgttacccagttatgtgaagatcaagcactatacatcaagaagtaccaggagacactgaagaaaatcgaagaagagcttgaagcgctcttcctggaacgcgaagtgtctaagttggtctcaatgaatcctgtcgaaaaggagcacaccagccagaataatgagggtaccccaactcagaaaactgccaggctcttctctaagaaaatattttgctgtttgttcttcatcacactgttcttcatcaggctcctttcatatatgttcttccacgtaagatttatcaatccggatctactggtaaacgtactacctaaagtacttggacgatccacgctgtggaagctccggtgctttttttttccctccttaaccctcgagaccgaagatatgctcccacactag

SEQ ID NO: 46975 - DNA, 687 bp, Artificial Sequence
  Description of Artificial Sequence: Synthetic coding sequence
atggagatcagccggctggcccagagcaagcggaacatcatcagcctgaatatggacctggagcgtgatacacagcgaatcgacgaggccaatcagaaactgctgcttaaaatccaggaacgcgaggataagattcaaaggctcgagagcgaaatcatccagacgagaggactagtagaggacgaagagtgggagaaggagaaccgtactacgatggagagggagagagccctacaggagctggaggaggaaacagctcggcttgagaggaagaacaagaccctagtacactctataaccgagctccagcaaaagctgacgagaaagtcccagaaaatcacaaactgtgagcaatcgtcaccagacggggccctagaggagaccaaggtgaaacttcaacagttggaagcaagttatgcctgtcaggaaaaggagctcttgaaggtcatgaaggagtacgccttcgtgactcagttatgtgaggaccaggcgctatatattaaaaaataccaagaaactctgaagaagattgaagaagaactagaagccttatttctagagcgagaggtgagtaagctggtgtccatgaatccggtggagaaagagcatacttcgcagaacaacgaaggtacacccactcaaaaaacagcccggttgttctccaaaaattggcaccatagtttttag

SEQ ID NO: 46976 - DNA, 246 bp, Artificial Sequence
  Description of Artificial Sequence: Synthetic coding sequence
atggagatcagccggctggcccagagcaagcggaacatcatcagcttaaacatggacctggaacgagatacccaacgcatcgatgaggccaatcaaaaactgctgctaaagatccaagaacgcgaggataagatccagagactggagagtgaaatcattcagaccagggggcttgttgaagatgaagaatgggaaaaggagaacagaacgacgatggagcgcgagagggctctgcaggagctgtag

SEQ ID NO: 46977 - DNA, 435 bp, Artificial Sequence
  Description of Artificial Sequence: Synthetic coding sequence
atggagatcagccggctggcccagagcaagcggaacatcatcagccttaacatggatctggaaagagacactcagagaatcgacgaggctaaccagaaactcctcctgaaaatacaagaacgggaggacaaaatccagaggttagagtctgagataattcagactaggggtcttgtggaggacgaggaatgggagaaggagaacaggactaccatggaaagggagagagcattgcaggagttggaggaagaaactgccagactcgaaaggaagaacaaaacgctcgtccactcaatcacagagctccagcaaaaactgactagaaagtcccaaaagatcaccaattgtgaacagagctcaccagatggtgccctggaggagactaaggtcaagctccaacagctcgaagctagctatgcgtgccaagaaaagtag

SEQ ID NO: 46978 - DNA, 687 bp, Artificial Sequence
  Description of Artificial Sequence: Synthetic coding sequence
atggagatcagccggctggcccagagcaagcggaacatcatcagcttaaatatggatctggagcgagacacacagagaatcgatgaggcaaatcagaagctgttgcttaagatccaggagagagaggataaaatccaaaggttggagagtgaaatcattcagacccgtggattagtcgaagacgaagagtgggaaaaggaaaacaggacgacaatggagagggaacgggctctgcaggagctcgaggaggaaactgccaggctggagcgaaaaaacaagactcttgtccatagtatcaccgagctccaacagaaactcacgagaaaatcccaaaagattaccaattgcgagcaaagctcacctgacggagctcttgaggagaccaaggtgaagctgcaacaactcgaggcatcctacgcctgccaggaaaaggagctactaaaagtcatgaaagaatatgccttcgtgactcaactctgcgaggatcaggccctgtacatcaagaagtatcaggagactctgaaaaaaatcgaggaggagctggaggccctatttttggagcgtgaggtgtcgaagctggtttccatgaaccccgtggagaaagaacacacctcccagaacaatgagggaacccccacccaaaagacagctcgcctctttagcaaaaagtgggcttcatctttttag

SEQ ID NO: 46979 - DNA, 216 bp, Artificial Sequence
  Description of Artificial Sequence: Synthetic coding sequence
atggagatcagccggctggcccagagcaagcggaacatcatcagcctgaatatggaccttgagcgggatacccaacggattgacgaggccaaccagaaacttttactgaaaattcaagaacgggaggataaaattcaaaggctggaatcggagatcatccagactagaggtttggttgaggatgaggaatgggagaaggaaaaccgtaccacttag

SEQ ID NO: 46980 - DNA, 3285 bp, Artificial Sequence
  Description of Artificial Sequence: Synthetic coding sequence
atggccgcccggcaggccgtgggcagcggcgcccaggagacctgcggcctcgaccggatcctggaggccctaaaactgttactatctcccggcggctctggcagctcaagcctgcaggtgacaaagcacgacgtgcttttagctacgctcaaaagcaacctcagcgcactggaagacaaattcctaaaggatccacagtggaaaaacctgaaactgttgagagacgagatcgccgacaaagctgagtggccacagaactccgtcgacgtcacctggtcttttacctcccagacacttcttctcttgctgtgtctgaaggaaactatgatcaggcttgccgccaattttaaccccggcaaaccgaaccccaggactccagaggtggccccagccttaagcccggacgctctgtcaataagtcagcagaaaaccgtccaatttgtcctacagtttgtggtgacattgggaatctgcccataccttatgccgggagtcggggtccccctgcggtaccgtacagaatttggcgcagtggtgcaggacgtggtttgtttcgacgccgctcctgacgccactcggagactgtatactagctgtaaggcactgctgaatgttgcacaacacaccagtctcggcagcttgatcttttgtcaccactttggagatattgctgcagggctgtgtcagctgggattctgtccgaccaagcggaagctcttgacacctgcagaagaagtgttgaccgaggaggagcggaccctctctcgtggcgctctccgagatatgctcgatcaagtctaccagcctctggccgtgagggagctgcttatcctgcaggggggtcccccacaaagttgcactgatgttaagacccagatgagatgtcgcgctcccgcttggctgcgacgactatgcggccaactcttgtccgaacgcttgatgagaccaaatggcgtccaagctgttgtgaggggaattttagaaggagcaggagctggggccgccggaggcagcgacgctgaggtgaccgcagcagactggaaaaagtgtgacctcattgccaagatccttgctagctgtcctcagcagtccttgagccccgagaactattacagagacatctgtccacaggtgcttgatctttttcatttccaggacaagttgaccgctcgccagtttcagcgcgtagcgacgactacttttatcacgttatcccgcgagaggcctcacctggccgcaaagtatctactgcagcctgtacttgcgccattgcatcgatgtctgaacactgccgaactgtctgagtccgacatggtacccgggacaattttggtcactgaagaggagctctccagatgtatcgaggatgtgtttaaagtatatgtggtaggcaatgagccactcacagtcttaatggacagcttactccccgtgttaggggttcttttcctgctgtattgcttcacaaagcagtcagtatcgcacatccggagtctctgccaggagattttgctgtggatcttgggaaaactggaacggaagaaggcaattgcttcgctcaagggtttcgccgggttagacaaggccgttccaagtctgcattcgttgtgccagttcagggttgctacacaaggcggtatcatgattactatcaaggaagcaatctcagatgaagacgaagatgaggccttgtatcagaaggtgtccagcgaacagggccgggtggaacacctgggagatctgctcagtcactgtcaagagtgcgggctggctggcgatttcttcatcttttgcttaaaagaactgacccacgtggcgagtgagaatgagactgagctgaagacggagccattttcgagtaagtccctgctagaactggagcagcatcaaacgctgctcgtggagggccaagaacgtaaactgctcgtgctccagctgatggccgtgctgtgtgagcgaatgtcagaacaaatatttaccaatgtgacacaggtcgtcgatttcgttgctgccacattgcagcgggcctgtgcatccctagcccaccaggcagagagtacagtggagtctcaaactctgtccatgagcatggggctggtggcagtcatgctcggcggcgctgtccaactcaagtcctctgactttgctgtcctgaagcagttactacccttactggaaaaagtgagtaatacctacccagacccggtcatccaagaactagccgttgacctgaggattaccatctctacccacggcgcctttgcaacagaggcagtcagtatggccgctcagtccaccctcaatcgtaaagacctcgagggtaagatagaggagcagcaacagacttcccatgagcgtcctaccgatgttgcccacagccacttggagcaacaacaaagtcacgaaactgctccacagacaggcttgcagagtaacgccccaatcattccacaaggtgtcaacgaacctagtaccactacctctcagaagtccgggagcgtgactaccgagcagctgcaagaggtgctgctgtctgcctatgacccgcagatccccacaagagcagccgctcttcgaaccctctcacactggatcgagcaacgtgaggcgaaagcccttgaaatgcaggaaaaactgctcaagatcttcctcgaaaacttggagcatgaagacacgtttgtgtacctaagcgccatccagggcgtagccctcctgtccgatgtgtacccagaaaagattctgccagatcttcttgcccaatacgactcctccaaagataaacataccccagaaacaaggatgaaagtaggagaggtgctcatgcgcatcgtcagggcattgggcgacatggtgagtaagtacagagaacctttaatccacacctttctgcgcggtgtgcgagatccagatggggctcaccgcgcatcctcccttgccaatctcggcgagctgtgccagcgcctggactttctgcttggatccgttgtccacgaagtaactgcttgtctaatagctgtagcgaagactgatggggaggttcaagtcaggagagccgctatccatgtagtggtgctgctgctgcgcggcctttctcagaaggcaaccgaagtgctatctgctgtactgaaggacctgtatcacttgctcaagcacgtggtctgtttggaacctgatgacgtagcgaagctccacgcacaattagcattagaggaactcgacgatatcatgaagaacttcttattccctccacagaagctggagaagaaaatcatggtcctcccttag

SEQ ID NO: 46981 - DNA, 789 bp, Artificial Sequence
  Description of Artificial Sequence: Synthetic coding sequence
atggcctggaagagcagcgtgatcatgcagatgggccggttcctgttgctggtgatactgtttttaccaagagagatgacgtcatccgtgctgacagttaacggcaagacagaaaattacatactggacacgacccctggtagtcaggcaagcctgatctgtgccgtgcagaatcacacaagggaagaggagctgctgtggtatcgcgaagaagggcgtgtggacctgaaatccgggaacaagataaattcatccagcgtctgtgtaagtagcatttctgaaaacgacaacggtataagcttcacgtgtcggctaggaagagaccagtctgtatccgtttctgtggtgctgaatgtcacctttccaccccttctgtccggcaatgatttccagacagtcgaggaaggaagcaacgtgaagctggtgtgtaatgtcaaggccaacccacaggctcagatgatgtggtataagaattccagtctcctcgacttggagaagagtcgtcaccagatccagcagacatctgagagctttcagctgtctatcactaaggtggagaaacctgacaatggtacatactcttgtatagctaagagcagcttgaagactgagtctctagatttccatctaatagtcaaggacaaaaccgtgggagtaccaattgagcctattattgctgcttgtgtggttatctttctgaccctctgcttcggactcatcgcaaggcgaaagaagattatgaagctgtgtatgaaagataaagacccacattctgaaaccgcgctatag

SEQ ID NO: 46982 - DNA, 657 bp, Artificial Sequence
  Description of Artificial Sequence: Synthetic coding sequence
atggcctggaagagcagcgtgatcatgcagatgggccggttcctgctcctcgtaatccttttcctcccaagagagatgaccagcagtgtcctaacggtgaacgggaagactgagaactacatcctagataccacccctggctctcaggcttcgcttatctgcgcagtgcagaaccacacaagggaagaagagcttctctggtacagggaggaaggcagggtcgatctgaagtcaggcaacaagattaactcctccagcgtgtgtgtctcctcaatctctgaaaatgataacggaattagtttcacttgtaggcttggcagggatcagtctgtatcagtgtccgtggttctgaacgttacgttcccccctcttctgtctggcaatgattttcagacggtggaagaaggatctaacgtcaaactcgtgtgtaacgtgaaggcgaacccacaggcgcagatgatgtggtacaagaatagctccctcttggatcttgagaagtcaagacaccagatccagcagacttctgagtctttccaactcagcattacaaaggtagagaaacccgacaatggaacctatagctgtattgcgaagtccagcctgaaaaccgagagtctagactttcacctcatcgttaaggcactgcagcaaggatag

SEQ ID NO: 46983 - DNA, 849 bp, Artificial Sequence
  Description of Artificial Sequence: Synthetic coding sequence
atgggcagccccggcatggtgctgggcctgctggtgcagatctgggcccttcaggaggcttctagtttgtcggtccaacaaggccccaatctgctgcaggtacgccagggttcacaggctactctcgtttgtcaagtcgaccaggccaccgcctgggaacgcttgagggtgaagtggaccaaagatggtgctattctgtgccagccctatatcacaaacggctctctgtctctcggcgtttgtggcccgcagggcaggctcagttggcaggcccccagccaccttactcttcagctggatcctgtcagcctcaaccatagcggagcttatgtgtgctgggccgccgtagagattccggagctggaagaagctgaaggcaacatcactcggctgtttgtagatccagatgaccctacacagaacaggaatcgtatcgcctctttccccggctttctctttgtcctgctgggtgtcgggtccatgggcgtagcagcaattgtctggggcgcttggttctggggacgccgtagctgtcagcaacgggatagcggaaactcccctgggaacgccttctactcgaatgtgctctatcgccctagaggagctcctaagaaatccgaggattgtagtggagaaggcaaggaccagagaggacagtcaatctattcaacgtccttcccccagcctgccccacgtcagccacacctggcatctcgaccatgcccttctccccgcccatgtccaagcccacggcccggccacccagtatcaatggttcgggtaagccccagacctagccctacccaacagccgcgcccaaaaggctttcctaaagtaggcgaggaatag

SEQ ID NO: 46984 - DNA, 2325 bp, Artificial Sequence
  Description of Artificial Sequence: Synthetic coding sequence
atgaaccccttctacttccacgccgtgaacatcatcctgcactgcctggtgacgcttgtgcttatgtacacctgcgacaagactgtcttcaagaaccgcggactcgcatttgtcactgctctgctatttgcagtgcacccgattcacactgaggcagtcgcgggaatcgtgggtagggcagatgtgcttgcatgtctcctgttcctgttggctttcctaagttataaccgcagcctcgatcagggatgtgttgggggctcatttccaagtactgtgtctccatttttcctccttctttcactgtttttaggaacatgtgcaatgctggtgaaagagaccggcattaccgtgttcggagtttgtctggtgtacgacttgttcagtttgtctaataagcaggacaagtcttccaatggggccctgtgcccccgcagcccccagcagccagggtcccctcagccgagcagtctgcctggtcacccacaccgcgaaaatggaaaacaacagcgctttccacacaaaggcgcctggggaggctgccacagtccattaccgcccgagccaaagagttccggatttccagtgtctcctcgggccgtctggagtatgatgcgctttcttacttacagctatctcctggcatttaacgtttggctgctgctcgctcctgtaaccttgtgctacgactggcaggtggggtctattccgctggtggagacaatatgggatatgcgtaacttggcaacgatattcctcgcggtggtgatggcccttttgagtctgcattgcctggcggccttcaagagactggaacacaaggaggtcctagtcggactgttatttctcgtcttccctttcatccccgcaagcaatctcttttttcgcgtggggttcgtagtagctgaacgtgttctgtacatgccctctatggggtactgtatcctattcgtacatggcctctccaagctgtgcacttggctcaaccgctgtggcgcaacaacactcattgtatcaactgttctgctgctgcttctcttctcttggaagacagtgaagcaaaacgagatttggctgagcagggagagtctgttccggagtggcgtgcagacattgccacataacgccaaggtacattacaactatgccaactttctcaaagaccaagggcgcaataaggaggccatttaccattatcggactgcgctgaaactgtacccacgacatgcaagcgcccttaataatttgggaactctgactcgtgatacggccgaggcaaagatgtactaccaacgagcccttcagctccatcctcagcacaatcgggctctctttaaccttggtaacctcctgaagagtcaggagaaaaaagaagaagcgatcacattactgaaagactccataaaatatgggcccgagttcgcagacgcctacagtagtctcgcttctcttctggccgagcaggagagattcaaggaggctgaggagatctaccagaccggcattaaaaattgtcctgatagctcagacctgcacaacaattacggagtctttctggtcgatacggggctaccggagaaggccgttgcacactaccagcaggctattaagctctctccctctcatcacgttgctatggtgaacctgggcaggctgtatagaagtctgggcgagaattctatggccgaggaatggtataagcgggccctgcaagtagcacacaaggcggaaatcctgagcccattaggcgccctgtactataataccggacgttacgaggaggccctgcaaatttatcaggaggctgccgctctgcaaccctcacagcgggagttacgactcgcgcttgcccaggttctcgccgtcatgggccaaacaaaagaggctgagaagatgacaaaccacattgtgtccgaagaaacagggtgtctggagtgctatcgcttgctgagcgcaatctattctaaacaagagaaccacgacaaggcacttgatgccatagacaaggcgcttcagttaaagcccaaagacccgaaagtcatctccgaactgtttttcaccaagggtaaccagctccgtgaacagaacctattagacaaagcttttgagagctacagggtggccgttcagctgaatcctgatcaagcgcaagcttggatgaatatgggcgggatccagcacattaaaggaaaatatgtgtccgcgcgcgcgtactatgaaagagccctacagctggtccccgactcaaagttactcaaggaaaacctggcaaaattagaccgattggagaaacggttgcaagaagtgcgtgaaaaggatcagacatag

SEQ ID NO: 46985 - DNA, 1725 bp, Artificial Sequence
  Description of Artificial Sequence: Synthetic coding sequence
atgaaccccttctacttccacgccgtgaacatcatcctgcactgcctggtgactctggtcctgatgtacacctgcgacaaaactgtgttcaaaaatcggggccttgctttcgtgacagctcttctcttcgccgtgcacccgattcacaccgaagccgtggcagggattgtgggccgggcagatgtattagcctgcctcctattcctgttagccttcctctcatataatcggtcactcgatcagggatgcgttggcggaagcttcccaagcacggtcagtccattcttcctactgctgagcctgtttctggggacctgtgcaatgctggtcaaagaaacaggaatcaccgtctttggcgtctgcttagtatacgatctttttagcttaagtaacaagcaggataagtcaagcaacggcgcactgtgcccgcggtccccccaacagcccggtagtccccaacctagctcacttccaggacacccccatagggagaacggaaagcagcagaggtttccgcacaaaggtgcatggggaggttgccactccccccttcctccagagcctaagtccagtggattcccggtcagcccaagagctgtgtggagtatgatgcggtatctgagagcctcttccaaccgtaatttcctgcttacaatgcggcctttccttaagcgcgctatactggtcctttcttacgtgctcgtcatcctgtatttcagactttggatcatgggcggctccatgcccctattctcagagcaggataatcctgcgtccttttcaccctacatcctgactcgtttcctcacttactcttatctgctcgccttcaatgtgtggttgctgttggccccggtgactctctgttacgactggcaggtcggttcaatcccactggtggaaacgatttgggatatgcggaatctggctaccatttttctagcagttgtcatggctcttctatcacttcattgtctggccgctttcaaacgcctggaacacaaggaggtcctcgtcggactcctttttctggttttcccttttattcccgcaagcaacttattcttcagagtcggctttgttgttgctgaaagggtgctgtacatgccgtctatggggtattgcatcctcttcgtgcacggtctgtctaaactttgcacatggttgaacagatgcggagcaacaacattaatcgttagcacggtgcttctactgctgcttttttcctggaaaaccgttaaacaaaatgagatctggctctctagagaaagcctgttccgatccggggtgcagactctaccacataatgccaaggtccactataactatgccaactttctgaaggatcagggccggaacaaagaagccatttatcactataggacagcactgaaactgtatccccggcatgccagcgcgctgaataatttggggacattgactcgggacaccgccgaggcaaagatgtactatcaacgtgctcttcagctgcacccgcagcacaaccgggcactcttcaacctgggcaacctgctgaagagccaggagaaaaaagaagaggccatcactctgctcaaggattcgattaagtacgggcctgagttcgccgacgcttactctagcctggcctctttgctagccgagcaggtaatagtttcccattcaagcttttttcagtgctattgctatatgtacaagctgatgttacaccgcttcttgtactag

SEQ ID NO: 46986 - DNA, 2649 bp, Artificial Sequence
  Description of Artificial Sequence: Synthetic coding sequence
atggtggtgaccaccagcgcccggggcggcggcggcgaccggaccccatctcggaggcgggggtgtggtctcgcccctgcaggagccgccgctctcctagcaggcgcatcgtgcctttgctatggcagaagcttacaaggcgagttcgtccacgatgacgtgtgggccatcgtgaataatcctgatgtgcgcccaggtgcaccgttacggtggggaatttttacaaatgacttttggggtaaaggtatggctgaaaatacctcacataagagctaccgccccctgtgcgtgctcacatttaagctgaatatatttctcacaggaatgaatccattttactttcatgcagttaatattatacttcattgtctcgtcactctggtacttatgtatacctgtgacaaaactgtttttaaaaacagaggtttggctttcgttacagcactcctattcgcagttcatccgatccacacagaagccgtagctggaatcgttggacgcgccgatgtgctggcgtgcctcctgttcctcctcgccttcctctcatataacaggtctctggatcagggctgtgtgggaggcagcttcccgtcaacagtttctcccttcttcctgctccttagcctgtttctgggaacttgtgctatgctcgtgaaggaaacaggtattactgtgtttggcgtgtgtctggtgtatgacctcttctcgctctccaacaaacaggacaaaagtagcaacggcgcattgtgccctaggtcaccgcagcagcctggatccccgcagccatcctcactgcctggacacccccaccgcgaaaatgggaaacagcagaggttcccgcacaaaggagcttgggggggctgccactcacctttgcccccagaaccaaagtccagcgggttccctgtgagccctagagcagtctggagtatgatgagattcctgacttactcttatctgctggcttttaatgtttggctgctgttagcccccgtgacactctgctatgattggcaagtgggctcaattccattagtcgagactatctgggatatgcgcaacctcgccaccatattcctggccgttgtaatggctcttctgagcctgcattgcctcgcagctttcaaacgcctcgaacacaaggaagtgttggttggcctgctctttctcgtgttcccatttattccagcttccaatctgtttttccgcgtgggatttgtagtcgcagagcgcgtcctgtatatgccaagtatggggtattgtatcctgttcgtgcatggcctaagcaagctgtgtacctggctgaataggtgtggagctaccaccctaattgtctccaccgttctcttacttcttctgttctcttggaagacagtcaagcagaacgaaatctggctgtcaagggaatcacttttccgatccggcgtccaaacacttcctcacaacgccaaagtgcattacaattatgcaaacttcctcaaagaccagggacgaaataaggaagccatttaccattatagaaccgcactgaaactgtatcccaggcacgcctcagccttgaacaatctcggaacattgacgcgagatactgccgaggccaagatgtactaccagcgcgctctccaactccacccccagcataatcgcgcgctttttaatctcggtaacttgctgaagagccaagaaaaaaaagaggaggcaattactctgcttaaggactcaatcaaatatggtccagagttcgccgacgcatatagtagtctcgccagcttgctggccgaacaagaaaggtttaaagaggctgaggaaatttaccagactggcattaaaaattgtcctgattcctctgatttgcacaataactatggggtttttctggtcgacacaggccttcctgaaaaggccgtggcacactatcagcaggccatcaaactgagccctagtcatcatgtcgctatggtcaatttgggcaggctctatagaagccttggagagaactccatggcggaggagtggtataaacgagctcttcaggtggcccacaaggccgaaatcttaagtccactgggtgcactgtattataataccgggagatatgaggaggccctgcagatctaccaggaggctgcggccctccagccttcacagagagagctgcgactggctttagcccaggtgttggctgtaatgggccaaacaaaggaggccgaaaagatgaccaatcacattgtgtccgaggagactggctgcctggaatgttacagactcctttccgcgatctactcaaaacaggaaaaccacgacaaagctctcgatgctattgacaaagctttacagctgaaacctaaggatccaaaagttatttctgagctgttttttaccaagggtaatcagctgcgggaacaaaatcttctcgacaaggcgttcgagtcatatagggtggcagtgcaactcaacccggatcaggctcaggcatggatgaatatgggaggcatccagcatattaaaggaaagtatgtgtctgctcgtgcatactacgagcgcgcattacagctggtgcctgattccaaactgctaaaggagaacctggccaaactggatcgtctggaaaagcgattacaggaggtgcgcgaaaaggatcagacttag

SEQ ID NO: 46987 - DNA, 1938 bp, Artificial Sequence
  Description of Artificial Sequence: Synthetic coding sequence
gtgaccgagcgggacagcgtgagcaagaagaagaagaagcggtacttacgggcgagttcgaaccggaacttcctgttgacaatgcgaccttttctcaaaagggccattcttgtactttcctatgtgcttgtcatcctgtacttccgtctgtggatcatgggcggatcaatgcctctgttttcagagcaggataacccggctagtttttcgccctacatcctgacacgatttctgacttacagctaccttctggcgtttaatgtgtggctgctgctggctcccgtgactctctgctatgactggcaggttggcagcataccactggttgaaacgatctgggatatgaggaatctggcaacaatatttttggccgtcgttatggcactcttaagtctgcactgtctggcagcttttaagcggttggaacataaggaggtactggtgggcttgttattcctcgtgttcccttttatcccagcttctaacctgttctttcgcgtcggttttgttgtggccgaacgcgtcctgtatatgccctcaatgggttactgcattctctttgtgcatggccttagcaaactgtgtacctggcttaaccggtgtggcgccacaacactgatagtttctaccgtcctgctactgttgctattcagttggaagaccgtcaaacaaaatgagatctggctgagccgggaaagtctgtttaggtcaggggtgcagaccttgccccacaatgccaaagtgcattacaactacgccaacttcctcaaggaccagggcagaaacaaagaggccatttaccactacaggacagctctgaaactttaccctcgccatgctagcgccctcaacaatttgggtacccttacaagggataccgcagaggccaaaatgtattaccagagagcactgcaactgcatccacagcataatcgcgccctcttcaacttgggaaacttactaaagagccaggagaagaaggaggaggccatcacactccttaaggattcaatcaaatacggaccagagttcgcggacgcctattcctcactcgcatctctgcttgccgaacaagagaggtttaaggaggcagaggagatctaccagactgggattaaaaattgtccggattccagcgaccttcataataattacggggtcttcctcgtcgacacggggctacctgaaaaggccgtggcacattaccagcaagcgattaagttgtctccaagtcatcatgtagccatggtaaatctgggccgcctatacagaagtttgggcgagaatagcatggcagaagagtggtacaaaagagctttacaagtggctcacaaagccgagattcttagtcctctcggggccctgtactacaacaccgggagatacgaagaggctctgcagatctatcaggaggctgccgcgttgcagcctagccagcgggagctgcgtctggccctggctcaagtactggccgtgatggggcaaaccaaagaagctgagaagatgaccaatcacattgtgagcgaagagaccggttgcctcgagtgttataggctcttgagcgctatctatagtaaacaggaaaatcacgataaggccctggatgcaattgataaagctctgcagctgaagcccaaagatccaaaagttatttctgaactgttctttacaaagggaaaccaattgagggaacagaatttgttggacaaggcgtttgagtcctaccgcgttgctgtacagctaaatcctgatcaggctcaggcctggatgaacatgggcggcattcaacacattaaaggaaaatacgtctccgcgagagcatactatgaacgagcgctgcagcttgttcctgatagtaaattactaaaagagaacctggcaaagcttgatcggctggaaaagcggctacaggaggtcagagagaaagaccaaacttag

SEQ ID NO: 46988 - DNA, 2835 bp, Artificial Sequence
  Description of Artificial Sequence: Synthetic coding sequence
atggtggtgaccaccagcgcccggggcggcggcggcgaccggacccctagcaggcgcagaggctgcggtctggctcccgctggcgccgcagccctcctggccggagcctcttgtctttgttacggacgctcgttgcagggcgaatttgtacacgacgacgtgtgggctattgtgaataatccggacgtccggcctggggcccctctgcgatggggtatattcactaatgatttctggggcaaaggaatggcagaaaacacctcgcataagagttatagacccctctgcgtgcttacctttaagctgaacatattcctgacaggtatgaatccattttatttccacgccgtgaacattatcctacactgtctggttactctggtgcttatgtacacctgtgataaaacagtgttcaagaaccgaggactggcattcgtgacagcccttctgttcgctgtgcaccctatccataccgaagccgttgccggcattgtggggagagccgatgtcctcgcatgcctgttgtttctgctggctttcctgagctacaatagatctctcgaccaggggtgcgtcggaggatcattcccttccacggtctctcctttctttttgctcttgagccttttcctcgggacgtgtgcgatgcttgtaaaagagaccggcatcacagtgttcggtgtgtgcttggtgtatgacctgttttcgctctccaacaagcaggataaatctagcaacggcgcactgtgtcctcgatccccccagcagcccgggtcgccccagccatcctcacttccggggcaccctcacagagagaacggcaaacagcagcggtttcctcacaagggcgcttggggcggatgccattctccactccccccggagcctaagagctccggatttcctgtgagcccccgggccgtctggtctatgatgcggtacctgagggcctcctcaaatagaaactttctattaaccatgcgaccatttctaaaaagggccatcttggtgctttcctatgtgcttgtaattctgtactttcgcttatggattatggggggcagtatgcccctttttagcgagcaggacaaccccgcctcattctctccttacatacttactcggtttctcacctacagctatttgctggcctttaatgtttggctgctactagcccctgtgactctgtgttatgactggcaggtcgggtcaatccccttggttgaaactatctgggacatgcggaatttggccacaatctttcttgcggttgtgatggccctgctcagtttgcactgccttgcggctttcaagagactggagcataaagaggtgctcgtcggcctgctgtttctggtcttcccgtttatcccggcgagcaatctgttcttccgcgtggggtttgtcgtggccgagagggtgctctatatgccatctatggggtactgtatcttgtttgtgcacggactgtcaaagctgtgcacgtggctgaatagatgtggggcaaccaccctcatagtcagcaccgtgctgttgttacttctttttagttggaagacagtgaagcagaatgagatttggctctccagggagtccctattccgatccggggtccagacactgccgcataacgcgaaagtgcattataactatgctaacttcctgaaggaccaaggcagaaataaggaagccatttaccattatagaaccgcgctcaagctgtatccgcgccacgccagcgctctgaacaatctgggaaccctgacacgcgataccgctgaagcgaaaatgtactaccagcgggctctccagcttcacccccaacacaacagagccttgttcaatctagggaacctactgaagtctcaggagaagaaagaagaggctatcaccctgctgaaggactccatcaagtatggacccgaattcgctgacgcatatagttctctcgcatccctgttggctgagcaggagagattcaaggaggcagaggaaatttaccaaacgggaatcaaaaactgcccagactcgagtgatctccataacaactacggcgtattcctcgtagataccggcttgcccgaaaaagctgtcgcccattaccaacaggcaatcaaactgtcccccagccaccacgtcgccatggtaaatctaggccgtctgtacagatccctgggcgagaattcaatggcagaagaatggtacaaacgcgcgctccaggtggcccataaagctgaaatcttatcccctctcggcgctctctattacaacaccgggagatacgaggaggccctgcaaatttatcaagaggcagctgcactccaaccttctcagcgcgagctacgcttggcattggcacaggtgttagctgttatggggcagactaaggaggcggagaagatgacaaatcatattgtcagcgaggagactgggtgtttggagtgctaccgcctgctgtctgcaatttattccaagcaagaaaaccacgacaaggcactggacgctatcgacaaagctctccagctgaagcctaaagatcctaaggtaatcagtgaactgttcttcacaaaaggcaaccagctgcgcgagcaaaatttgctcgacaaagcattcgagagttacagagtcgcggttcagctgaatccagatcaagcccaggcctggatgaatatgggaggcatccagcatatcaaaggaaagtacgtatccgcacgagcatattacgaacgcgctctccagctcgtccccgactccaagctgctgaaggaaaatctggccaagctggatcgcctggaaaagcgccttcaggaagtcagagagaaggatcagacatag

SEQ ID NO: 46989 - DNA, 2511 bp, Artificial Sequence
  Description of Artificial Sequence: Synthetic coding sequence
atgatcgccgagctggtgagcagcgccctgggcctggccctgtaccttaacaccctgtccgcagatttctgttacgacgattctcgtgcaatcaagactaaccaggacctattacctgaaaccccctggacacacatcttctataatgatttctggggaacactactaactcatagcgggagtcacaaatcttatagacccctctgtactcttagttttcgcctgaatcatgcaattggcggactgaacccttggtcataccacctcgtaaatgtacttttgcacgctgccgtcacagggttgtttaccagcttttcaaagatcttactgggagatggctactggacatttatggcaggcctaatgtttgctagccatcccattcatactgaagcagtggcaggaatcgtggggcgcgctgacgtgggcgccagtctgtttttcctgctgtctctgctctgctatatcaagcattgttccacccgcggatattcggctaggacatggggctggtttcttggcagcggcttatgcgcaggttgctccatgctctggaaagaacagggcgttactgtcttagcagtcagtgccgtgtacgatgtgttcgtttttcatcggctgaagatcaagcagattctccctaccatttacaaaaggaaaaacttaagcttgtttctgtcgatttcgcttctaattttttggggctcctctctgttgggcgctagactgtactggatgggtaataagcccccttctttctcaaacagcgataatccagccgctgactcagactctctgttgacaaggactctgacatttttttacctccctaccaagaacctgtggcttttattgtgcccagacaccctgtcatttgactggagcatggacgcagtgcccctgctgaagactgtttgtgactggcggaatctacacacagtggcattttacaccggtcttctgctgttagcctactatggactcaagagccctagtgtcgacagagagtgcaacggtaaaacggtcacaaatggaaagcaaaacgccaatggccactcatgcctctcagatgtggagtatcagaactccgagaccaaaagtagcttcgcgagcaaggtcgaaaatggaattaaaaatgacgtttctcagaggactcagctcccctccactgaaaacatcgtggtcttgtcgctttccttactgatcatcccttttgtgcccgccaccaacctattcttctatgtcggctttgtgatcgcagagagagtgctgtatattccttcaatggggttctgcttactgattacagttggcgctagggcattgtacgtcaaagtgcagaaaaggtttctcaaaagcctgattttttatgcaaccgcgacgctgatagtcttttatggactcaagacggccatcaggaacggggactggcagaacgaggaaatgctgtataggtcgggtatcaaggtgaatcctgcaaaggcctggggcaatcttggcaacgttctgaaaagtcagtctaagatttctgaggctgaatctgcatacaggaatgcactgtattatcgatcaaatatggcggacatgctgtacaaccttggactcctcttacaagaaaatagccgatttgccgaggcactgcactactataaactcgctatcggctccagacccacgctagctagcgcctatctgaacacaggcattatactgatgaaccaaggtagaacagaagaagcacgacgaacctttctaaagtgtagtgagatccccgacgagaatctcaaggacccacatgcacacaagagcagcgttacatcttgtctctacaacttgggcaaactctaccatgagcaaggacattacgaggaggccctgagcgtctacaaggaggccatacaaaagatgccccgccagtttgccccccagagcttgtataatatgatgggcgaggcttacatgcggctgagcaagcttccagaagctgagcactggtatatggaaagtctccggtctaagaccgatcatatccctgctcatctgacttacggcaaactgctggctcttacagggcggaagtccgaggcagagaagctgttcctgaaagccatcgagctggacccaaccaaggggaattgctatatgcactacgggcagttccttctggaagaggcacgtctcatcgaagcagctgaaatggcaaagaaagctgccgagctcgactctactgaatttgatgtggtcttcaatgctgctcatatgctccgacaagcctcgctgaatgaggccgcagagaaatactatgatcttgccgcacgactgcggcctaattatcccgctgcacttatgaacttgggtgccatacttcacctgaatggcagactccagaaagccgaagccaactacctgagagcccttcagcttaaaccagatgacgtgataacacaaagtaatctgcgaaagttgtggaatattatggagaagcaaggattgaagacatctaagacctag

SEQ ID NO: 46990 - DNA, 2745 bp, Artificial Sequence
  Description of Artificial Sequence: Synthetic coding sequence
atggccaacatcaacctgaaggagatcaccctgatcgtgggcgtggtgacagcatgttactggaactcacttttctgtgggttcgtgttcgacgatgtgtccgccattcttgataacaaggacctccaccctagtacacctctcaagacattattccagaatgatttctgggggacccctatgtccgaagaaaggagccataaatcctaccggcccctgacagtgttaacattccgtcttaactatctgctgagtgagcttaaacctatgtcttaccatctgctgaatatgatctttcatgctgtagtttctgtcatcttcctaaaggtgtgtaaactgttccttgacaacaagagtagcgttattgcatcccttctctttgccgttcatccaatccacacagaagctgtgactggggtcgtggggcgtgctgaactgctgtcttctatctttttcttggctgccttcctttcatatacacgtagtaaaggacccgataactcaattatttggacacccatcgcgcttacagtctttctggttgcagtggcaaccctttgtaaggagcagggtatcacagtcgttgggatctgctgtgtgtatgaagtgttcattgctcagggctacacccttcctcttctctgtacaaccgccgggcagtttttgcggggtaagggatccattccttttagtatgctacagaccctggtaaagctgatagtgctcatgttcagtacactcctgctggtggtaatcagagttcaggtgattcaatcccagctaccggtgtttactcggtttgacaacccagccgcagtttcccccactcccacccgccagctgacctttaattatctacttcccgtgaacgcctggttgttgctgaacccctcggagttatgttgtgactggactatgggtactatccccctgatcgaatccttgttggatatccggaatctggccactttcactttcttttgtttcctgggcatgctgggggtgtttagcattaggtattctggggattcctccaaaacagttctcatggcactgtgcttgatggctctgccattcatccctgcttctaaccttttttttcccgtggggtttgtggttgccgaaagggttctttacgttccctccatgggtttctgtattttagtggcgcacggttggcaaaagatctctaccaaatccgtgttcaagaagctatcctggatttgtctatccatggtaatcctgacacactcattgaaaacattccacaggaactgggattgggagagcgagtatactttatttatgagtgccctgaaggtcaataaaaacaacgccaaattgtggaataacgttggtcacgcactggaaaatgagaagaatttcgaaagggcgctcaagtacttcctgcaggccacccacgtgcagcccgacgacatcggagcacacatgaacgttggaaggacctataagaacctgaaccggactaaggaagcagaagaaagttacatgatggccaagagcttgatgccacaaatcatccctgggaagaaatacgcggccagaattgctccgaaccatctgaatgtctatattaaccttgccaacctaatcagagccaacgagtctcgactggaagaggcagatcaactttaccggcaggccatctccatgagacccgatttcaaacaggcgtacatatcacgaggagaattactgctgaagatgaataaaccgctgaaggccaaagaggcctacctgaaggcactggagcttgacaggaacaatgcagatctctggtacaacctggcaatcgtacacattgagcttaaggagccgaacgaggctctgaagaactttaatagagccttggaactgaaccccaaacacaaactggcgctgtttaactcagcgattgtaatgcaggaatccggggaggtcaagctacggcccgaggcccggaaacgcctgctgtcctacatcaacgaggagcctctggatgctaatggttatttcaacctgggaatgctcgcaatggacgacaaaaaggataatgaggcggagatctggatgaagaaagctatcaagctgcaagccgacttccggtccgcactgtttaatctggctctgctctactcccagacggccaaggaactaaaggctcttcccatcctggaggaactgttgagatactaccctgaccacattaaaggactgattctcaaaggcgacatcctgatgaatcagaagaaggacatcctgggcgcgaaaaagtgttttgagcggatcctggagatggacccttcaaacgtgcagggtaaacacaacttgtgtgtggtatattttgaagagaaggatctcctgaaagcagagaggtgcttactggagacgctcgctctcgctccacatgaagaatacatccagcgccatcttaacatcgtccgcgacaagatctcctcatcttctttcatcgaaccgatattccctacatccaagatcagcagtgtagagggcaaaaaaatccccaccgagagtgtaaaagagatccggggtgagagtcgacagacacagatcgtgaagactagcgataataaaagtcagtcaaagtcaaataagcagctgggcaagaatggcgacgaggagaccccccacaagactacgaaagatattaaagagattgaaaagaaaagggtagccgccctcaaacgcctggaggaaattgaaaggattcttaacggggagtag

SEQ ID NO: 46991 - DNA, 447 bp, Artificial Sequence
  Description of Artificial Sequence: Synthetic coding sequence
atggccaacatcaacctgaaggagatcaccctgatcgtgggcgtggtgacagcctgctattggaattctctattttgtggcttcgtatttgatgatgtctccgccattctggacaacaaagaccttcacccctccacacccctgaaaacactgttccagaacgatttctggggtacacctatgtcggaggagcgttcgcacaagtcatatcgccccctgaccgtgctcaccttccgcttgaactacctactgtctgagctcaaacctatgtcatatcacctgctaaatatgattttccacgcagttgtatctgttatctttttgaaagtgtgtaagttgtttctagataacaagagtagcgtgatcgcttctctgctgtttgctgttcatcctattcataccgaggcggtgactggggtcgtcggcagggcagaactgctgagctag

SEQ ID NO: 46992 - DNA, 1893 bp, Artificial Sequence
  Description of Artificial Sequence: Synthetic coding sequence
atggccgtgctggacaccgacctggaccacatcctgcccagcagcgtcctgccgccattctgggcaaaattagtggttgggtcagtggccatcgtttgcttcgccagaagttatgacggcgacttcgtgtttgatgattcagaggctatcgtaaataacaaggtggccggagtagttggtagggcggatctgctctgcgcgctctttttcctgctctcattcctgggatattgcaaggccttccgtgaaagtaataaagagggcgcccacagttcgaccttctgggtgttgctctccatctttttgggcgcagtggcgatgttgtgcaaagaacagggcattactgtgttggggctgaacgctgttttcgatattctagtgataggcaagtttaatgttctcgaaatcgttcagaaagtactccataaggacaaatcactcgaaaaccttgggatgctacgaaatggggggttgcttttccgtatgacactcctgacgagtggaggagccggtatgctgtatgttcgctggcgtatcatggggacaggccccccagcttttacggaagtcgataatccggcttcattcgccgattcaatgcttgttcgtgctgttaattacaattattattatagccttaatgcatggcttctgttatgcccatggtggctgtgtttcgactggtccatggggtgcatacctctgattaagtcaatttccgattggagggttattgccttggccgcactctggttctgcctaatagggctcatctgccaagcactgtgctcagaagatgggcataaaagacggatcctgactctggggctgggttttctggttatccccttcctgcctgcctcaaatttattcttccgggttggctttgtagtggcggagagagttctctacttgccaagcgtcggttactgcgtgcttctcacatttgggtttggagccctgtctaagcataccaaaaagaagaagttgattgctgctgtggtgctcggtattttattcatcaacacactcagatgtgtgctccgctccggcgagtggagatcagaggagcagctgttccggtccgcattatctgtctgtcccctgaatgccaaagttcactacaatatcggtaagaacctggccgacaagggcaaccagaccgctgcaattcggtactacagggaggcagtgcggcttaatccaaagtacgtgcatgcaatgaataatctggggaacatcctgaaggagcggaatgagctacaggaagctgaagaactgttgtcactggccgtccaaatccagccagactttgccgctgcctggatgaatctcgggattgtgcagaattcacttaagagattcgaggcagccgaacagagctatcgtactgctatcaagcatagacgtaagtaccccgactgttactacaacttgggcagactttatgccgatctgaataggcacgtagacgctttgaatgcgtggcgcaacgccactgtactgaaacctgagcattctctggcctggaataacatgatcatcctcctggacaacaccgggaatctggctcaggccgaagccgtgggaagagaggcactggagctgattccaaatgatcattctttgatgttcagcttggccaacgtgcttggtaagtcgcagaagtataaagagtctgaagctcttttcctgaaagccattaaggcaaaccctaatgctgccagctatcatggtaatcttgccgtattatatcatcggtggggtcaccttgacctagcaaagaaacactatgagatcagcctgcagctggacccaaccgcttcaggcaccaaagagaattatggattactgaggcgtaagctggaactgatgcagaaaaaggccgtgtag

SEQ ID NO: 46993 - DNA, 2283 bp, Artificial Sequence
  Description of Artificial Sequence: Synthetic coding sequence
atgatccccaaccagcacaacgccggcgccggcagccaccagcccgccgtgtttaggatggccgtccttgacactgacctggaccacatcctcccttcatctgtccttcctcccttttgggccaaactggtcgtgggttctgttgccatcgtgtgcttcgctagaagctacgatggtgactttgtattcgacgactccgaagcaatcgtcaataacaaggacttacaagctgaaacacctctgggcgatctttggcaccacgatttctggggttctcgactgagttcgaacactagtcataaatcctatagacctctcactgttctgacctttaggatcaactattatctgtctggtggctttcatcccgtggggttccacgtggtcaacatcctgctccacagtggcatctccgttttaatggtggatgtcttctcagttctgtttggggggctccaatacacaagcaaagggcgacggctgcaccttgccccccgggcctcgctgctcgccgctctgctcttcgccgtgcatccagtacatactgaatgtgtcgccggagtagtgggcagggccgatctgctgtgtgctctcttttttttgttaagctttctagggtactgcaaagcattccgggaaagtaacaaggagggagctcacagctccacattctgggtcctcctgtcaatctttctgggcgccgtggctatgctgtgtaaagagcaaggcatcactgttctggggctcaacgccgtgttcgacatcctggttatagggaagttcaatgtgctggaaatcgttcagaaggtcttgcacaaagacaaaagcctggagaatcttgggatgttaaggaacggcggcctgttattcagaatgacccttctgacgtcaggaggcgcaggcatgttatatgtgcggtggcgtattatgggaaccgggcctccagccttcaccgaggtcgataatccagcgtcctttgccgacagtatgttagtacgggccgttaattataactattattactctcttaacgcctggctgctgttgtgtccctggtggttgtgcttcgattggagcatgggatgtatccccctgatcaaatccatcagcgactggcgggtgattgccctcgcagcactttggttctgtttgattggtctgatctgccaggcattgtgcagtgaggatgggcataaaaggcgtattcttacactgggactggggtttttggtgattccatttcttcccgctagcaatctgtttttccgggtgggtttcgtggtggccgaacgggtgctgtatctcccctctgtcggctattgcgtgttactcacctttggtttcggtgccctgtctaaacatacaaagaaaaaaaagctgattgcggcagtagtgctcggcatcctgttcatcaacacgcttcggtgtgtgctgcgtagtggagagtggcgctctgaggagcagctgtttagaagtgccctgagtgtctgcccgctcaacgcgaaggtacattataacattggcaagaatctggcagacaaaggcaatcagacagctgccatccggtactatagagaagctgttcgcttgaaccctaaatatgtccatgccatgaacaacctgggcaacatcctcaaagagaggaatgaacttcaggaggccgaagaactgctctccctggccgtgcagatccagccagactttgcggcagcctggatgaatttggggattgtccagaacagccttaagcgcttcgaagctgccgaacagtcctacaggaccgctataaaacatcggcgcaagtaccctgattgttattacaatctcggtcgtctctatgccgacctcaaccgccatgtggatgctctgaatgcctggaggaatgcaaccgttctgaagcctgagcatagccttgcatggaacaacatgattatccttctggacaataccggcaatctggcccaggctgaggctgttggacgcgaggctctcgaactgattccaaacgatcactcccttatgtttagcttggctaatgtgcttggcaaatcccaaaagtataaggagagcgaagctctctttctgaaagccatcaaggccaaccctaatgcggcctcctaccatgggaaccttgctgtactgtaccacagatgggggcacctggacctggctaagaaacactacgaaataagcctgcagctggaccctaccgcctcaggtaccaaggaaaattatggccttctcagacgcaagctggaactcatgcagaaaaaggccgtatag

SEQ ID NO: 46994 - DNA, 2226 bp, Artificial Sequence
  Description of Artificial Sequence: Synthetic coding sequence
atggccgtgctggacaccgacctggaccacatcctgcccagcagcgtgttgccacctttctgggcaaaattggtggtgggttcagtggcgattgtgtgtttcgcccgctcttatgacggagactttgtttttgatgacagtgaagctatagtgaacaataaggacctgcaggctgagactcccttaggggatctgtggcaccatgacttctggggctcgcggctgagcagcaacactagtcacaagagttataggcctttgacagtgcttactttcaggattaactactatctgtcgggtgggttccacccggtgggttttcacgttgtcaacattctgctgcattctggcatcagcgtactgatggtcgatgtgtttagcgttttatttggtggcctacagtataccagcaaggggaggcgattgcatctcgcccctagagcctccttgctcgcggcactcctatttgcagtgcatccagtccacactgagtgcgttgccggcgtcgtgggccgtgccgatcttttgtgcgccctgtttttcctgttgagtttcctcggttattgtaaggcattccgcgagtctaataaggaaggggcccactctagtaccttctgggtgctcctgtcgatcttcctaggtgccgtggcgatgctttgtaaggagcagggtatcaccgtgctcgggttgaatgccgtgttcgacatactggttatcggtaagttcaacgtgctcgagattgttcagaaggtcctgcataaggataagagcctggagaacttaggtatgcttagaaatggcggactgctctttcgaatgactcttctcacaagtggcggtgctggaatgctgtatgtccgatggcggattatgggaacaggtccccctgccttcaccgaggttgacaaccccgctagtttcgccgacagcatgctggtccgcgccgtaaattacaactactattatagcctgaatgcttggctcctgttgtgcccttggtggctctgtttcgactggtctatgggctgcatcccacttatcaaatctatcagcgattggcgagtaatagccctggcggccctctggttttgtctaatcggtctgatctgccaagccctctgttctgaggacgggcacaagcggcggatactgacgctgggccttgggttcttagtgatcccttttcttccagcatctaacttgttctttcgggtcggctttgtcgtggcagagagagtgctgtatcttccgtcagtaggctactgcgttctgctcactttcggtttcggagcgctgtccaaacacactaaaaaaaaaaaactgattgccgccgtggtgttgggtatcctgttcatcaacacactgcgctgtgtcctccgatccggcgaatggagaagcgaggagcagctattccgatccgccctgagtgtgtgcccgctgaatgccaaggtacattataacattggaaagaacctggcagataaggggaaccagaccgctgccatccggtactaccgtgaagcagtaagactgaaccccaagtatgtccacgcgatgaataaccttggtaacatcctaaaggaaagaaatgagttgcaggaagctgaggagctgttatcattggccgttcagatacagccagattttgcagcagcttggatgaatttgggcatcgtccagaactcactgaagagattcgaggccgctgagcagagttatagaaccgccataaagcacaggagaaaatacccggattgttactataatctgggacgactgtacgctgatttgaatagacacgtcgatgccttgaatgcgtggaggaatgcgactgtcctgaaacctgaacactccctggcctggaataatatgataattctccttgacaatacggggaacctggcccaggctgaggccgtaggaagggaagccctggaactcatacccaatgaccactccttaatgttttcccttgccaacgtgttaggtaaaagtcagaagtacaaagagtcggaagccctcttcttgaaagctattaaggccaaccctaatgcagctagttatcacgggaatcttgctgttctttaccaccggtggggacacctcgatctggcgaagaaacactacgaaatctccctgcaactggaccccaccgcctcaggcacgaaggaaaactatgggttgctccggcggaagcttgaattgatgcagaagaaagctgtctag

SEQ ID NO: 46995 - DNA, 165 bp, Artificial Sequence
  Description of Artificial Sequence: Synthetic coding sequence
atggccgtgctggacaccgacctggaccacatcctgcccagcagcgttctgccacccttctgggctaagttagtggtaggcagcgttgctatcgtttgcttcgctaggtcttacgatggcgacttcgtctttgatgatagcgaggccattgtcaataataagtag

SEQ ID NO: 46996 - DNA, 222 bp, Artificial Sequence
  Description of Artificial Sequence: Synthetic coding sequence
atgatccccaaccagcacaacgccggcgccggcagccaccagcccgcggtgttccggatggccgtactggacacggacttggatcacatactgcccagctctgtgctcccaccattctgggccaagcttgtggtcggctcagttgctattgtctgctttgcacggtcctacgatggggattttgtgttcgatgactctgaggcaatcgtcaataacaaatag

SEQ ID NO: 46997 - DNA, 741 bp, Artificial Sequence
  Description of Artificial Sequence: Synthetic coding sequence
atgaccctgatcgagggcgtgggcgacgaggtgaccgtgctgttctcggtactggcatgcctgttagtattagcgttagcttgggtgtctacgcacacagccgagggaggcgaccctttgccacagccttcaggtacccccacaccatcgcagcccagcgccgcaatggctgcaaccgatagtatgaggggagaggcccccggagccgagacccccagtctcaggcatcgcgggcaggccgcacagcccgaaccctccacaggttttactgcaaccccccctgcccctgattctccccaggagcctctggtgctccggctcaagttcctgaatgacagcgaacaagtggccagggcctggccacacgacacaatcggcagcttgaagaggacacagtttccagggagggagcagcaggttaggttaatataccaaggacagcttttgggggacgatacacaaacactgggttcactacacctgcctcccaactgcgtgctgcattgccacgtgtcaacgagagttggtcctcctaacccaccttgccctcccggatccgagcctgggcctagcggcttggagataggctctctgctccttcccctgctcctgctccttctgctgctgctgtggtattgccagatccaataccgaccgtttttcccgctgacagcaaccctgggtctggccgggttcaccttgttgctgtcgcttctagcatttgccatgtacagaccctag

SEQ ID NO: 46998 - DNA, 741 bp, Artificial Sequence
  Description of Artificial Sequence: Synthetic coding sequence
atgaccctgatcgagggcgtgggcgacgaggtgaccgtgctgttctctgtgttagcatgcctgttagtcttggccttggcctgggtctcaactcatacagccgaagggggcgaccctttaccgcagccctccggcacccccacgccgtctcagccaagtgctgctatggccgcgaccgatagcatgagaggcgaagcgcccggtgccgaaacaccttctctgcgacatcgcggacaggctgcacaaccagagccctccacaggcttcaccgccacacctcccgctccggattccccccaggaacctcttgtgctgcggttgaaattcctgaatgattctgagcaggtcgctagagcctggccacatgacacgataggtagcctgaagcgtacgcagttcccaggaagagagcagcaggttcgtcttatttaccaggggcagctattgggagatgatacccaaactctaggatcactgcatctgcccccaaattgtgtcttgcactgtcacgtctcgactcgcgtcgggcctcctaaccccccgtgtccgccaggcagcgagcctggcccatcaggtcttgaaataggctctctgctactgcccttactgttacttttattgctcctactgtggtattgccagatccaatatcgcccctttttccctctgacggccacactgggactagccggattcacactcctgttgtcactgcttgcttttgctatgtacaggccatag

SEQ ID NO: 46999 - DNA, 741 bp, Artificial Sequence
  Description of Artificial Sequence: Synthetic coding sequence
atgaccctgatcgagggcgtgggcgacgaggtgaccgtgctgttctctgtcctggcctgcttactcgtgctcgcactagcttgggtcagcacccacactgccgaaggaggagaccccctgccccagccgtcaggcacaccaaccccctcccagccctccgccgcaatggctgctacagatagtatgagaggagaggcccctggcgcagagactccatcgctgcgccaccgggggcaggccgctcagcccgagcctagtactggtttcacagcaacaccacctgctccagattctccccaggagcccttggtgctcagactgaaattcctgaacgactccgaacaggttgcccgtgcttggccccatgacaccatcggatccttaaaaaggacacagtttcctggacgagagcagcaggtacgattgatctatcagggccagctcctgggcgacgacacacaaactctgggatctttacatctcccccctaactgtgtgctacactgccacgtctcgactcgggtcggtcctcctaaccccccctgccctccaggctcagagcccgggcctagtggtctcgaaatcggctctctgttgctgcctctgcttctgttgttgcttcttctgctgtggtactgtcagatacagtataggccgttttttccgttaacagccactctcggcctagctggattcaccctgctcctatccctgctcgcatttgccatgtatagaccctag

SEQ ID NO: 47000 - DNA, 741 bp, Artificial Sequence
  Description of Artificial Sequence: Synthetic coding sequence
atgaccctgatcgagggcgtgggcgacgaggtgaccgtgctgttctccgtgctggcttgtttacttgtgctagccctcgcatgggtttcaacccacacggcagaggggggtgatcccctacctcagccctccggtactcctaccccgtcccaaccctccgccgccatggcagccacagactctatgcggggggaggcgcccggtgccgagacgccatctctgagacaccgcgggcaggctgctcaacccgaaccatcaactgggttcaccgccaccccccccgcccccgacagcccccaagaacccttagtgctgcgtctgaagttcctcaacgattcggagcaggtcgccagagcatggcctcacgataccatcggctcacttaaacgaacccagttcccaggccgagagcagcaggtccgccttatttaccagggtcagctgctgggcgatgacacccagactctgggctctctccacctgccacctaactgtgtcttgcactgccatgtttctacgcgagtaggcccccctaaccctccatgccccccaggatctgagcccggacccagtggactggaaattggttccctgcttttgcccttactgctgttactgctcctgctgctgtggtattgtcagattcaatatagaccgttcttcccacttactgccacattagggctggctggctttacactgctccttagcctattggcgttcgcaatgtacagaccgtag

SEQ ID NO: 47001 - DNA, 741 bp, Artificial Sequence
  Description of Artificial Sequence: Synthetic coding sequence
atgaccctgatcgagggcgtgggcgacgaggtgaccgtgctgttctctgtattggcgtgtctgttagtgcttgccctggcttgggtaagtacacacacagccgaaggtggcgacccactcccccaaccttcgggtaccccgacaccctcccagccatccgccgcgatggcagctactgattccatgagaggagaggcccccggcgccgaaaccccatccttgaggcatagaggccaggcggcccagcccgaaccatcaacaggctttaccgccaccccccccgcccccgacagcccccaggaacccttggtgctgcgtctgaagtttctcaacgactccgagcaggttgcccgtgcctggcctcacgacaccattggaagcctgaagcgaacgcaattcccaggaagggagcagcaggtgcgtctgatataccagggtcaattattgggggatgatactcagactctggggtccctgcacctgcctcctaattgtgtcctgcactgccatgtttccacaagggttggtccaccaaaccccccatgcccccctggcagtgaacctggcccgagcggcctggagatcggctctctgctcctgcccctgctgcttttactcttgcttctcctgtggtactgtcagatccaataccgcccattcttcccacttaccgctacactggggctagccggattcacgcttcttctatcactgctcgctttcgcaatgtatcggccctag

SEQ ID NO: 47002 - DNA, 516 bp, Artificial Sequence
  Description of Artificial Sequence: Synthetic coding sequence
atgaccctgatcgagggcgtgggcgacgaggtgaccgtgctgttctccgtgctggcatgtttgctggtgctggctctggcatgggtgagcactcacactgcagaggggggcgacccgttaccacagccgagtggaacccccacgccttcccagccttcagcagcaatggctgctaccgatagtatgcggggagaggcacccggcgctgaaacccccagtctgcggcacagaggccaggccgcccaacctgagcccagtaccggatttacggctactccacccgcaccagactctcctcaggaaccgctcgtactgagactcaagtttttaaatgactccgaacaggtagcccgcgcttggccacacgacaccatcggcagcctcaaacggacccaatttccaggaagagaacagcaggtacgtctgatttatcagggccagctcttgggcgacgatacccagaccctgggtagcctgcaccttccaccaaattgcgtgctgcactgccacgtgtag

SEQ ID NO: 47003 - DNA, 459 bp, Artificial Sequence
  Description of Artificial Sequence: Synthetic coding sequence
atgaccctgatcgagggcgtgggcgacgaggtgaccgtgctgttctccgtgctagcttgcctcctagtgttagcgcttgcttgggtatccacgcataccgcggaagggggcgatcccctcccacaaccgtccgggacgccgacaccgtcacagccaagcgccgccatggctgccaccgatagcatgaggggtgaggcccctggcgctgagaccccaagtttgcggcatcgcgggcaggccgctcagcctgagcccagcaccggcttcacagccaccccccccgcccctgattcaccccaggaaccgcttgtgttgcgcctgaagtttctgaacgactccgaacaggtggcccgtgcttggcctcacgacacaatcggcagcttgaaacgtacacagtttcctggtcgggagcagcaggtccgcttaatttatcagggacagttactgggcgacgactag

SEQ ID NO: 47004 - DNA, 906 bp, Artificial Sequence
  Description of Artificial Sequence: Synthetic coding sequence
atggagctgagcgacgtgaccctgatcgagggcgtgggcaacgaggttatggtagtagctggcgtggttgtactgattctggccttggtgctggcctggcttagcacatatgttgcagacagcggctcaaatcaattattgggagccatcgtgtccgccggcgacactagcgtacttcacctggggcacgtggaccatttggttgctggacagggcaaccccgaacccacggaactaccacatccctctgaaggaaacgatgaaaaggccgaagaagcaggcgaagggcgaggtgactcgactggagaagccggagccgggggcggggtggaaccaagcttggagcatcttctcgacatccaggggcttcctaaaaggcaggctggagcgggctcatcctcccctgaggctcccctgcgtagtgaggacagcacctgccttcctcccagccctgggcttataactgtcagactgaagttcctgaatgacacagaagaacttgccgtggcacgaccagaggacaccgtgggtgccttgaaaagcaaatactttcccggacaggaatcccagatgaaactcatatatcagggccgtctgctgcaggacccagcccggactctgcggagtctcaacatcacagataactgcgtgatccactgccaccgctctcctccagggagcgctgtgccgggacccagtgcgtctcttgcaccaagtgcaactgagcctccttccctgggagttaatgtgggctccttgatggtgccagtgttcgtcgtgctgttaggagttgtgtggtattttcgtatcaattaccgccaattcttcactgcacccgctacagtgtctctcgtgggcgtcaccgtcttcttcagcttcctggtttttggcatgtacggcagatag

SEQ ID NO: 47005 - DNA, 906 bp, Artificial Sequence
  Description of Artificial Sequence: Synthetic coding sequence
atggagctgagcgacgtgaccctgatcgagggcgtgggcaacgaggtcatggtcgtcgctggcgtggtagttttgatcctggcccttgtcctcgcctggttgtctacctacgtcgccgactcagggagtaaccagctgcttggtgctatagtgagtgccggagatacttccgtccttcatctaggccatgttgatcatctcgtggcaggccaggggaaccccgagccaacagagctgccacatccctctgagggtaatgatgagaaagcagaggaggcaggcgagggaagaggagactccactggcgaagccggagctggcggaggggtcgagcccagcttggagcacttactcgatatccagggattacctaagagacaagctggagccggttcttcctcccctgaagccccactgcgcagtgaggacagtacatgcttacctccaagcccaggcctgattacggtgcgactgaaatttttaaacgacaccgaggagctcgccgtggcacgccccgaggacacagtgggcgcacttaagtccaagtatttccccggccaagaatctcagatgaaattgatctatcagggtcgcttactccaggacccagccaggacgctgagaagcctgaacattactgataactgcgttattcactgccacaggtctcctcctggcagcgccgtccccgggccttccgcctcacttgccccttccgctacggaacctccctcacttggagtgaatgtgggatcattgatggtgcccgtcttcgtggtgctgcttggcgtcgtatggtacttccgaattaactatcgacaattctttaccgcccccgccactgttagtctggtgggagtgactgtgttcttctcttttctcgtgttcgggatgtacgggaggtag

SEQ ID NO: 47006 - DNA, 795 bp, Artificial Sequence
  Description of Artificial Sequence: Synthetic coding sequence
atggagctgagcgacgtgaccctgatcgagggcgtgggcaacgaggtgatggttgtggcaggcgtagtggtactgattctcgctctggtgctggcatggcttagcacatacgtggccgattcaggctctaaccagttactcggtgcaatcgtgtctgccggcgacacctcagtcctacacctaggtcacgtcgaccatctggtagccggacagggcaacccggagcctaccgagctgcctcacccaagcgaagggctgcccaagaggcaggccggagccggatcaagtagtcccgaggcgcctctcagatcagaggatagtacatgcctgcccccaagtcccggactgatcacggtgaggctaaagttccttaacgacacagaagagctggccgttgcaaggcccgaggatactgtcggagcactcaagtctaagtacttccccgggcaagagagtcagatgaaacttatatatcagggcagactcctgcaggatccggctaggactcttagaagcctcaacatcactgacaactgtgtgattcactgccaccgatctcctcctggttcagcagtgcctggcccctccgcgtccctcgccccatctgccactgagcctccttccctgggagtgaatgtgggttctctcatggtgcctgttttcgtggttctattgggcgtggtgtggtactttagaattaactatcgccaattctttacagcccccgctactgtgtccctggtgggcgtcaccgtcttcttttccttcctcgtgtttggaatgtatggcaggtag

SEQ ID NO: 47007 - DNA, 966 bp, Artificial Sequence
  Description of Artificial Sequence: Synthetic coding sequence
atgatcagccggcacctgcagaacaacctgatgagcgtggaccccgcgtcttctcaggccatggagctgtctgacgtcactctgatcgaaggtgtcggaaacgaggtgatggtagttgcaggggtggtcgtcctaattctggccctggtgttagcatggctctctacttatgtggccgactcaggctcaaatcagttactcggtgccattgtgtccgcgggcgataccagcgttctgcaccttggtcacgtggaccatctggtggctgggcagggaaatcctgagccaacagaactgccacatccttccgaaggcaacgatgagaaggccgaggaggccggagagggacgaggggacagcaccggtgaggccggagcaggcggcggggtggagccaagcttagagcatcttctggacatccagggcctgcctaagaggcaggctggtgccggcagcagttccccagaggcccctcttaggtcggaagacagcacttgccttcctccaagcccaggactgatcacggtgcgacttaagtttctgaacgacaccgaagagctagccgtggcccgaccagaagataccgtcggggccctgaagagtaaatatttccctggccaagagagtcagatgaaactcatctaccaggggagactcctacaggacccggcccgcacattaaggtctctgaatatcaccgataattgcgttattcactgtcatcgcagcccaccaggatccgcagtgcctgggccatccgcctcactggcaccgagcgccaccgagccgcctagtctcggggtgaacgtgggctccctcatggtgccagtctttgttgtgctgctgggcgtggtgtggtactttaggatcaactataggcagttttttaccgcccccgccacagtctctcttgtcggggttacagtttttttttcctttctcgtgtttggtatgtatgggcggtag

SEQ ID NO: 47008 - DNA, 936 bp, Artificial Sequence
  Description of Artificial Sequence: Synthetic coding sequence
atgagcaaccccagcgccccccccccctacgaggaccggaaccccctgtaccctggaccccccccacctggtggttacggccagccaagtgtcctcccaggcggatatcctgcctaccccggatatccacagccggggtatggccaccccgcgggttatcctcagccgatgccacccacacatcctatgcccatgaactacggacccggacatggctacgatggagaggaaagagcagtcagcgactccttcggcccgggagaatgggatgaccgcaaggtgaggcatacatttatacgcaaggtgtattcaatcatcagtgtgcagctgctgatcaccgtcgcaataattgctattttcacgttcgtcgaaccagtcagcgcctttgtcagaaggaatgtagcggtgtactatgtatcatacgctgttttcgtggttacgtaccttatcctggcatgttgtcagggcccacggcgaagattcccttggaacataatcttgcttacgctttttacgttcgccatggggttcatgacgggaactatcagcagtatgtaccagactaaagcagtcatcattgccatgattataacagctgtggtgtcaatcagcgttaccattttttgtttccagacaaaggtggattttacgtcatgcacagggctgttttgtgtgctcgggattgtccttctggtgacaggcattgtcacatccatcgtgctctacttccagtatgtgtattggttgcatatgctgtatgcagcactcggagctatctgttttacattgtttctggcttatgatacccaactggttctcggtaatcgtaagcacaccattagtccggaagactacattaccggtgctctccagatctatactgatataatttacatctttactttcgtgctacaacttatgggcgatcggaactag

SEQ ID NO: 47009 - DNA, 936 bp, Artificial Sequence
  Description of Artificial Sequence: Synthetic coding sequence
atgagcaaccccagcgccccccccccctacgaggaccggaaccccctgtaccctgggcccccacccccaggcggctatggccagcccagtgtcttaccagggggttacccggcttatccgggatatccgcagcccggatacggccaccctgccggatacccacagcctatgccaccaactcacccaatgccgatgaactatggtcccggtcacgggtatgatggggaggagcgagctgtatcagacagtttcggacctggggagtgggatgatcgtaaagttaggcacacattcattcgcaaggtttacagcatcatatctgtgcaacttttaattactgttgctattattgccattttcactttcgtggagccggtatccgcctttgtgcgccgaaatgtggccgtgtattacgtatcctacgccgtgttcgtagtgacatacctcattctggcctgttgccagggtccccgccggcgattcccgtggaacattatactcttaacactatttaccttcgccatgggttttatgacgggcacaattagcagtatgtatcagactaaggctgtcatcatagcaatgattataaccgcagtggtgtctatctcggtgacaattttctgcttccagaccaaggtggacttcacctcttgcacgggactcttctgcgttctgggcatcgtgctcctcgtcacagggattgtcaccagtattgtgctctacttccagtatgtttactggcttcacatgttgtatgcagctcttggtgccatatgtttcaccttgttcttggcttacgacacccagttagtgctcggaaaccgtaaacacactatctcccctgaggactacattacaggagcactgcagatctacactgacattatttacatctttacctttgtgctccaactaatgggcgaccggaactag

SEQ ID NO: 47010 - DNA, 141 bp, Artificial Sequence
  Description of Artificial Sequence: Synthetic coding sequence
atgagcaaccccagcgccccccccccctacgaggaccggaaccccctgtacccaggtcctccccccccaggcggctacggtcagcccagcgtcctccccggaggatatcctgcctatcccgggtacccccagcccggctag

SEQ ID NO: 47011 - DNA, 456 bp, Artificial Sequence
  Description of Artificial Sequence: Synthetic coding sequence
atgagcaaccccagcgccccccccccctacgaggaccggaaccccctgtatcctggtcccccgccgcccggtggatacggacaaccctctgtgctgccaggtgggtatcccgcatacccaggataccctcaacccggatacggacatccggccggatacccacagcctatgccaccaactcacccaatgcccatgaattacggtcccggccacggatatgatggcgaagaaagagctgtttcggactccttcgggcctggcgaatgggacgatcggaaagtgcgccatacctttatccgtaaagtatactctattatcagtgtgcaactgttgattactgttgctataattgcaatctttacctttgtggagcccgtgagcgcattcgtgagacggaacgttgctgtgtattatgtgagctatgcagtctttgtcgtaacctaccttatactttag

SEQ ID NO: 47012 - DNA, 27 bp, Artificial Sequence
  Description of Artificial Sequence: Synthetic coding sequence
atgagcaaccccagcgcccccccctag

SEQ ID NO: 47013 - DNA, 504 bp, Artificial Sequence
  Description of Artificial Sequence: Synthetic coding sequence
atgagcaaccccagcgccccccccccctacgaggaccggaaccccctttatcctggtccccccccccctggaggttatggtcagcctagcgtgcttccaggaggctacccagcctacccaggctatccccaacctggttatgggcaccccgcaggctatccacagcccatgccacctacacacccaatgccaatgaactatggtcctggacatgggtatgacggggaggagcgcgcagtaagtgactcttttggcccaggcgagtgggatgaccgcaaggtgcgtcatacatttattaggaaagtgtactcaattatcagcgtgcaattactgattaccgtggcgataatagctattttcaccttcgtcgagcccgtctccgctttcgttcggcggaatgtggctgtctactacgtgagttatgcggtctttgtggtgacatatctgattcttgcatgctgccaggggccgaggcggaggttcccctggaacatcattctatag

SEQ ID NO: 47014 - DNA, 516 bp, Artificial Sequence
  Description of Artificial Sequence: Synthetic coding sequence
atgagcaaccccagcgccccccccccctacgaggaccggaaccccctgtatcctggccccccccccccgggcgggtatggacagccttccgttctaccgggaggatatcctgcttaccctgggtatcctcaacctggatatggccaccctgctggataccctcagccaatgccacccacccatcccatgcccatgaactacggccctggacacggatacgacggggaagagagagctgtgtctgacagcttcggacccggcgagtgggacgatcgtaaagtgaggcacacctttatccgaaaggtgtactccatcatctcagtgcaactcttaattaccgttgcaatcatcgccattttcacctttgtggagcccgtttctgcgttcgtgcgacgtaatgtagccgtttactacgtgtcatacgctgtctttgttgttacctaccttatcttagcctgctgccagggccccagacgcagattcccatggaatatcattctgctgacactgttttag

SEQ ID NO: 47015 - DNA, 207 bp, Artificial Sequence
  Description of Artificial Sequence: Synthetic coding sequence
atgagcaaccccagcgccccccccccctacgaggaccggaaccccttatacccaggaccccctccaccaggcgggtatgggcagccctccgtgctgcctggagggtatcctgcttatccagggtatccccaaccagggtatggccatccagccgggtacccacagcctatgcctccaactcaccccatgccaatgaactatggttag

SEQ ID NO: 47016 - DNA, 648 bp, Artificial Sequence
  Description of Artificial Sequence: Synthetic coding sequence
atgagcaaccccagcgccccccccccctacgaggaccggaaccccctgtacccagggcccccgccaccggggggatatggacaaccaagcgtgctgccgggtggctacccggcctaccccggctacccccagcctggttacgggcacccggcaggctacccacagcctatgccccccacccaccccatgcctatgaattacggaccaggacacggctacgacggtgaagagagagccgtaagcgacagctttggccctggcgagtgggacgatcggaaagtgcgccacactttcattcgaaaggggacttgtcaacgcctgtgcgaagaaaaatgcggctgcctgctccgagtcctgtgctgtttaagatgccacctgcctgacccttgcttactgccagggacacagacaccattccccatggagcaccacagtgctgacccattctatttttgccatggactccatgatgggcaccatttccagtatgtgcccaaccagtctaggcaccactgcaacgatcaccactgtggcggcatccatttttcgcatcacttgctactatctgatcagggcggcctgcatctcgtgcaccggcctttgctctgtccaggcaactgcgccccaggcgattgggactgccattag

SEQ ID NO: 47017 - DNA, 324 bp, Artificial Sequence
  Description of Artificial Sequence: Synthetic coding sequence
atgagcaaccccagcgccccccccccctacgaggaccggaaccccttatatccgggcccacctcctccgggcggttacggccagcctagtgtgctgccaggaggctacccagcctatccaggatatccccaacccggctacggccaccccgccggctaccctcagcctatgcccccgacacatcccatgccaatgaattacggacctgggcacgggtacgacggcgaggagagagccgtgagcgacagcttcgggccaggcgaatgggacgataggaaggtgaggcacaccttcattcgaaaggtgtacagcattatctcatag

SEQ ID NO: 47018 - DNA, 273 bp, Artificial Sequence
  Description of Artificial Sequence: Synthetic coding sequence
atgagcaaccccagcgccccccccccctacgaggaccggaaccccctatatcccggacccccccccccaggcgggtacggtcagccgtccgtgctccccggcggttaccctgcatacccagggtacccgcaaccggggtacgggcaccccgccggttatccccagccaatgccacctacccaccccatgcccatgaattatggtcctgggcacggttacgacggggaggagcgtgcggtatcggactcgtttggaccaggggagtgggactag

SEQ ID NO: 47019 - DNA, 321 bp, Artificial Sequence
  Description of Artificial Sequence: Synthetic coding sequence
atgagcaaccccagcgccccccccccctacgaggaccggaaccccctctatcccggtccgccccccccgggaggttacgggcagccctccgtcttacccggtggatacccggcctatcccggctacccacagccgggatacggccatcctgccgggtacccgcagcctatgcctcctacacacccgatgcccatgaattatggaccaggccatgggtatgatggcgaagaaagggcagtctcggatagtttcggtcctggagaatgggacgacaggaaggtaagacatacatttattaggaaggtttatagcattatctag

SEQ ID NO: 47020 - DNA, 936 bp, Artificial Sequence
  Description of Artificial Sequence: Synthetic coding sequence
atgagcaaccccagcgccccccccccctacgaggaccggaaccccctctaccctgggccaccacctcccggcgggtacggtcaaccatcggtgctgcccggcggttaccccgcttatccaggctatccccaaccgggatacggccatcctgctggatatcctcagccaatgcctcccacacaccccatgcctatgaactatggaccaggtcacggatatgacggggaagaacgtgccgtctccgatagcttcggacctggggagtgggatgaccgaaaagtgagacacacgttcataaggaaagtctatagcataatctccgtgcaactactcattactgtggcaatcatcgccattttcacattcgtggagcccgtttcagccttcgtgcggcgaaacgtggccgtatactacgtgagctacgcggtatttgtggtaacgtacctgattttagcgtgctgccagggcccacgcaggcgctttccctggaacattattcttttgactctgtttacatttgcaatggggttcatgaccggcactattagcagtatgtatcagacaaaagctgtgattatcgcaatgattattaccgcagttgtttctatttctgtaactattttttgcttccagactaaagtagatttcacatcctgtaccgggctattctgtgtccttggaattgtgcttctggttactggcatagttacctcaatcgtgttgtacttccagtacgtgtactggctgcacatgttatatgcagccctgggggccatttgctttacacttttcctcgcctacgatacccagctagtattgggtaataggaagcataccataagccccgaggactacatcacaggagcgctgcagatctacaccgatattatttacatctttacatttgtcctgcagctcatgggtgaccggaattag

SEQ ID NO: 47021 - DNA, 414 bp, Artificial Sequence
  Description of Artificial Sequence: Synthetic coding sequence
atgggcttcatgaccggcaccatcagcagcatgtaccagaccaaggcagttatcattgctatgataattaccgccgtggtgagtatctccgtcacaatcttttgcttccagaccaaggtggacttcacctcctgtacagggctgttttgcgtcctgggcatagtgttgctggtgaccggcattgtcacaagtattgtcttgtatttccaatatgtttattggctgcacatgctgtacgctgcactaggggcaatctgctttaccttgttcctggcatacgacacccagctggtattgggtaatcgaaagcatacaatcagccccgaggactacatcaccggagcactacagatctatacggatatcatctatatcttcactttcgtattgcaactgatgggagacagaaactag

SEQ ID NO: 47022 - DNA, 222 bp, Artificial Sequence
  Description of Artificial Sequence: Synthetic coding sequence
atgagcaaccccagcgccccccccccctacgaggaccggaaccccctctacccggggccgccacccccaggcgggtatggacagccctctgtcttgcccggtggctatccagcgtaccctggctatccgcagcctgggtacggacaccctgcaggctatccccagcctatgccgcccacacaccctatgcctatgaattatggaccaggacacgggtactag

SEQ ID NO: 47023 - DNA, 255 bp, Artificial Sequence
  Description of Artificial Sequence: Synthetic coding sequence
atgagcaaccccagcgccccccccccctacgaggaccggaaccccctctaccctggccccccaccacctggcggctatggccaacctagcgttctgcccggcgggtatccagcttatcctgggtacccccagcccggttacggacatcctgctggctatccccagcctatgccccccacccacccaatgcctatgaattatgggcccggccacggatacgacggcgaggagcgcgccgtgtctgattcattctag

SEQ ID NO: 47024 - DNA, 279 bp, Artificial Sequence
  Description of Artificial Sequence: Synthetic coding sequence
atgagcaaccccagcgccccccccccctacgaggaccggaaccccctgtatcctggtccgcctcctcctggtgggtacggccagcccagcgtactgcccggcggttaccccgcctacccggggtaccctcagcctggttacggtcacccagcaggctatccccagccaatgccccccacccatcccatgcccatgaactacggacccggtcatggatacgatggcgaagagcgtgccgttagtgattcctttggtccgggagaatgggacgatcggtag

SEQ ID NO: 47025 - DNA, 750 bp, Artificial Sequence
  Description of Artificial Sequence: Synthetic coding sequence
atgcccatgaactacggccccggccacggctacgacggcgaggagagggcagtgtccgattcatttggtcccggcgaatgggatgatcggaaggtacgtcacacctttatacgaaaggtgtattcgatcatttctgttcagctcctgattactgtggccatcatcgccatttttacctttgtagagcccgtgagcgcctttgttcggcgcaacgtagctgtctattatgtctcttacgctgtatttgtcgtgacatacctgatcttagcatgttgccagggaccaagacggcggttcccctggaatattatattgctaaccctgttcacattcgctatgggctttatgacaggaaccatcagctccatgtatcagacaaaagccgtgatcattgcaatgattattactgcagtggtttccatctctgtgaccatcttttgtttccagactaaagtcgatttcacaagctgtaccggtctgttctgcgtactgggaatcgtgctgctggtcactggtatcgtcacctcaatagtgttatacttccaatacgtgtactggctgcacatgctatatgcagctctgggggctatctgtttcacactctttcttgcatacgacacccagctggtgctcggaaatcgtaagcatactatctccccggaagactacataaccggagctctgcagatatacacagacataatctacatctttaccttcgtcctacaactgatgggggacaggaactag

SEQ ID NO: 47026 - DNA, 717 bp, Artificial Sequence
  Description of Artificial Sequence: Synthetic coding sequence
atggccgaccccgacccccggtacccccggagcagcatcgaggacgatttcaattacggaagctccgtggcaagcgcaacagtacacatccggatggcctttcttagaaaagtttactcaattctgtcattgcaagttctgttgacaacagtcaccagcactgtgttcctgtacttcgagagcgtgagaacctttgtgcacgaatccccggccttaatcctgctctttgctttggggtcgctaggcttgatcttcgcccttatactgaatcggcataagtatcctctgaacttgtatttactgttcgggttcacactcctggaagccctgactgtggcagttgtcgtaaccttttatgacgtgtacataatcttacaggccttcatacttacgactactgtgttcttcggacttactgtctacacactgcagtcaaaaaaagatttctccaagtttggcgcaggcctgttcgcactgctgtggattttgtgtttgtctggctttctgaaatttttcttttattctgaaatcatggaactggtgcttgcagccgcgggcgccctgctcttttgcggattcataatttacgatacccactccctgatgcacaaattgagccctgaggagtacgtgctcgctgcaatcagtttatatcttgatataatcaatttattccttcacctgctacggtttcttgaggccgtgaacaaaaaatag

SEQ ID NO: 47027 - DNA, 636 bp, Artificial Sequence
  Description of Artificial Sequence: Synthetic coding sequence
atggccgaccccgacccccggtacccccggagcagcatcgaggacgactttaattacggttcatccgtcgctagtgccacagttcacattaggatggctttcctccgcaaggtgtattccattctgtccctccaggtgcttctgactaccgtcacgtccactgtttttctgtattttgagagcgtacgaaccttcgtccatgagtctccagctctgatcttgttgttcgccctcggctcattaggactcatttttgctttgatactcaaccgccacaaataccccctgaacttatatcttttgttcgggttcactctgttggaagctctgaccgtagccgtcgtggtcaccttttatgacgtgtacattattttgcaagcttttattctgactactacagtgttttttggcctcacagtgtatacactgcagagcaagaaagacttcagtaagtttggcgcaggacagagtgccctgctggtcgatatcgtcccagtaaggatactggaagtctttttttattcggagattatggagctcgtgctggcagcggccggtgcactgctgttttgtggcttcatcatttacgatactcattctcttatgcacaagctaagtcccaaatcaacatactag

SEQ ID NO: 47028 - DNA, 852 bp, Artificial Sequence
  Description of Artificial Sequence: Synthetic coding sequence
atggccgaccggccccccgtgcccagcctgagcatcgaggacgacttcaattacggatctagcgttgctagcgcaacagtccacatcagaatggtgctgcaacgtgactgcacattctccaaacagtacatgcggattccaagtgccccgtccgccaccctgaatatcatccgcttcttccatctgcgtcagagcggacggtccggaatggtcaatatcttttataaggggcctacattcctgcggaaggtttactcaatcttgagcctccaggtgctgttgaccaccgtgacctctaccgtatttctgtacttcgagagtgtaaggacttttgttcatgagagccccgcgctgatccttctgttcgccctaggatctttaggactcatcttcgcgctgatcctgaaccgtcacaaataccctttgaacctgtacctgctgtttggttttacacttctggaagcactgacagttgccgtggtggttactttttacgacgtgtacattattctgcaggccttcatcctcaccaccaccgttttcttcggactgacagtgtacacactgcagagcaagaaagatttttctaagttcggagctgggctgtttgcactgctctggatcctgtgcctgagtgggctagaagtgttcttctattctgagatcatggaactcgtccttgccgcagctggtgcattgctgttctgcggattcatcatatatgacactcatagcctcatgcacaaactgagtcccgaggagtatgtcctcgctgccatatctctctaccttgacattattaacctctttttgcatctcctacggtttctggaagccgtgaataagaaatag

SEQ ID NO: 47029 - DNA, 507 bp, Artificial Sequence
  Description of Artificial Sequence: Synthetic coding sequence
atggccgaccccgacccccggtacccccggagcagcatcgaggacgactttaattacgggagcagtgtggcatctgctaccgtgcatatcaggatggcattcctacgcaaggtatacagcatactgtcgctgcaggttttgctaactaccgtcacaagcacggtattcctgtatttcgagtctgttagaacattcgtacatgagtcccccgcgcttatcctgctgtttgctctgggttccctggggctaatcttcgcccttatactcaacagacataagtatcctttgaacctgtaccttctttttggatttaccttgctggaggctctgacagtcgccgtagttgtcaccttttatgacgtttacatcatactccaggcctttattctcacgacaactgtgttttttggcctcactgtctataccctccaatcaaaaaaggatttctcgaaattcggtgcgggcaggtgtagaagcccctcttttctgtggattcatcatttgtag

SEQ ID NO: 47030 - DNA, 714 bp, Artificial Sequence
  Description of Artificial Sequence: Synthetic coding sequence
atgaacatcttcgaccggaagatcaacttcgacgccctgctgaagttttcacacataacgcccagtacgcagcaacacctgaagaaggtgtatgcctccttcgccctttgcatgtttgtggcggctgcaggagcctacgtacacatggttactcactttattcaggcgggtttgctctctgctttgggcagcctcatattgatgatatggcttatggcgaccccccactctcatgagacagagcaaaaaagacttggacttctcgccggatttgccttcctgactggtgttgggttgggacccgctctggagttctgcattgctgtcaatccatcgattcttcccaccgcctttatggggaccgccatgattttcacgtgttttaccttgtctgccttgtacgcaagaagaagatcctacctttttctggggggcatcctgatgagcgctctttctcttctcttgctgagcagtctgggaaacgtcttttttgggagcatttggctgttccaggcaaacctctacgtgggtctggtagttatgtgcggctttgtcttattcgacactcaactgatcatagagaaggcggagcacggggatcaagattacatatggcactgcatcgacctatttctcgacttcatcaccgtgttccgcaaattgatgatgatactggcaatgaacgagaaggataagaaaaaggagaagaaatag

SEQ ID NO: 47031 - DNA, 714 bp, Artificial Sequence
  Description of Artificial Sequence: Synthetic coding sequence
atgaacatcttcgaccggaagatcaacttcgacgccctgctgaagtttagccatattacacccagcacccaacagcacctgaaaaaagtgtacgcgagctttgctctgtgtatgtttgtggcagcagccggcgcctacgtccacatggtgacgcactttatccaggcaggcctgcttagcgcactgggaagcctcatcctcatgatttggttgatggcgacacctcatagccacgagactgagcagaagcgattaggtttactggcaggctttgccttcctcacgggagtcggtcttgggcccgcattggagttttgtattgccgttaaccccagtatcctcccaacagccttcatgggcactgcgatgatctttacttgttttacactatctgccctatatgctcgccggagatcatacctatttctcggtgggatactgatgagcgcgctcagcctgctgctgttatcctcactgggaaacgtgttctttggctccatctggctcttccaggcaaacctgtacgtgggcctggtggtcatgtgtggatttgtactcttcgacacacagttgatcatcgagaaggcggaacacggtgaccaggactacatttggcactgcatagacctgttccttgacttcatcacggttttcagaaaactcatgatgatcctggcaatgaatgagaaagacaaaaaaaaggaaaagaaatag

SEQ ID NO: 47032 - DNA, 888 bp, Artificial Sequence
  Description of Artificial Sequence: Synthetic coding sequence
atgagccacagcagcgtgacccgggaggccccccagctgctgagccagaggcagagaagggaggtgagaggagtttggggttggggttgcttacctgggccgagagggggcccagccttgttcggactagtgaccttcggccagtccggagactgttgtacggactccggaaccatgaatatctttgaccggaaaattaactttgacgcgcttttgaagtttagccatattaccccctcaactcagcagcacttgaagaaggtttacgcttcatttgccctctgcatgttcgtcgcggcagccggcgcctacgtgcacatggtcacccactttatacaagccggactcctgtcagcacttggaagcctgatcctgatgatctggttaatggctacaccacatagtcatgagacggagcagaagaggctgggtctgctggccggtttcgcgtttctcaccggggtcggccttggccccgcgctggagttctgtatcgcagtcaacccaagcatcctccccacagcctttatgggaacagcaatgatcttcacatgcttcacactgtcggcgttgtacgcacgccggaggagttatctgttcctcgggggaatcctgatgtctgccctgtccttactactgctgtcatccctaggcaatgtctttttcggctccatatggttatttcaggccaacctgtacgttggactcgtggtcatgtgcgggttcgtgcttttcgacacgcagctgatcatcgagaaagcagagcatggggaccaggactatatctggcactgcatcgacttgtttctagactttatcaccgtgttccggaagctgatgatgatcctcgctatgaacgaaaaggataagaaaaaggagaagaaatag

SEQ ID NO: 47033 - DNA, 381 bp, Artificial Sequence
  Description of Artificial Sequence: Synthetic coding sequence
atgaacatcttcgaccggaagatcaacttcgacgccctgctgaagttttcccatattactcccagtactcagcagcaccttaagaaagtgtacgcgtcatttgccttatgcatgttcgtcgcggcagcgggtgcttatgttcatatggtcacccacttcattcaggcgggactgctctcagccctcggttccctaatcctgatgatttggttgatggccacgccacacagtcacgaaaccgagcaaaagcggcttggtttactagcaggttttgcatttctgactggcgttggactgggacctgctctcgagttttgcatagctgtaaacccgtctatcttgccaactgcctttatgggaactgctcttatctctagctag

SEQ ID NO: 47034 - DNA, 714 bp, Artificial Sequence
  Description of Artificial Sequence: Synthetic coding sequence
atgaacatcttcgaccggaagatcaacttcgacgccctgctgaagttcagtcatattacccctagtacccagcagcacctcaaaaaggtgtatgccagcttcgcgctgtgtatgttcgtagcagctgccggggcttacgttcatatggtgacgcacttcattcaggctggtctcctttccgctctgggatcacttatcctgatgatctggttgatggctaccccacattcccacgagaccgagcagaagaggctggggctcttggcagggtttgcattcctcacgggcgtgggattaggacctgccctggagttctgcatagcagtcaaccctagcatcttgcctaccgcctttatgggcacagccatgatctttacttgctttacattgtcagctctgtacgcccgccgcaggtcttacctgttcttagggggcatcctgatgtctgcgctgtcactcctgcttctctctagtctgggaaatgtgttttttgggtcaatctggttatttcaagcaaatttgtatgttgggctcgtcgtcatgtgcggtttcgtgctttttgacacccagctgatcatcgagaaagccgaacacggagaccaggactacatatggcattgtatagacctgttcctcgacttcatcaccgtgttcaggaaattgatgatgatcctggccatgaacgagaaggacaagaaaaaggagaaaaaatag

SEQ ID NO: 47035 - DNA, 438 bp, Artificial Sequence
  Description of Artificial Sequence: Synthetic coding sequence
atgaacatcttcgaccggaagatcaacttcgacgccctgctgaagttctcccacattactccatctacccagcagcatctgaaaaaggtatatgcttcatttgcactgtgtatgttcgtcgctgccgcaggtgcatatgtgcacatggtgacccactttatccaggcgggcctgctaagcgctcttgggtcccttattctgatgatatggcttatggcaactcctcactctcacgagaccgaacaaaaaaggctcggtctgctggccgggtttgccttccttacaggtgtaggcctaggaccagccctcgagttttgtattgccgtaaacccgagtatcctgcctactgcatttatgggcaccgccatgatcttcacgtgttttactctgtctgccctgtatgcacgcagacgaagctatctttttctgggagggtag

SEQ ID NO: 47036 - DNA, 291 bp, Artificial Sequence
  Description of Artificial Sequence: Synthetic coding sequence
atgaacatcttcgaccggaagatcaacttcgacgccctgctgaagttcagtcacattactccaagcacccagcagcatctcaagaaggtgtatgcaagttttgcgctgtgcatgttcgtggcagcagctggggcatacgtgcacatggtgacccacttcatacaagcgggcctgctgtccgccttaggatccctgattcttatgatatggttgatggcgaccccgcattcacacgagaccgagcagaaaaggctggggctcctggcaggattcgctttcctcaccgggtag

SEQ ID NO: 47037 - DNA, 291 bp, Artificial Sequence
  Description of Artificial Sequence: Synthetic coding sequence
atgaacatcttcgaccggaagatcaacttcgacgccctgctgaagttctcccatatcacaccatccacgcagcagcatctgaaaaaggtttacgcctccttcgcactgtgcatgtttgtggccgctgctggagcctatgtgcacatggtgacccactttatccaggctggtctgctttctgctctgggctccttaattttgatgatatggcttatggcaactccccacagccatgagaccgaacagaaaaggttaggacttctggcggggtttgcatttctgaccggctag

SEQ ID NO: 47038 - DNA, 417 bp, Artificial Sequence
  Description of Artificial Sequence: Synthetic coding sequence
atgaacatcttcgaccggaagatcaacttcgacgccctgctgaagttttcccacatcacaccaagtacccagcagcacctcaagaaagtgtacgccagcttcgctctttgtatgttcgtggcggccgcgggcgcttatgtacacatggttacacacttcatccaagcagggcttctctcagcactgggttcactcatccttatgatttggctgatggccaccccccattcacatgagacagagcagaaaagactgggattgttagcggggtttgcgtttctcaccggggttggattgggccctgccctcgaattctgcatcgctgtgaatccatctatcctcccgactgcttttatggggaccgccatgatatttacctgctttactctgagcgctttatacgctcggcgccgatag

SEQ ID NO: 47039 - DNA, 393 bp, Artificial Sequence
  Description of Artificial Sequence: Synthetic coding sequence
atgaacatcttcgaccggaagatcaacttcgacgccctgctgaagttctcgcacattacccctagcactcaacagcatctcaaaaaagtgtatgctagttttgctctttgcatgtttgtggctgctgcaggcgcatacgtgcacatggtgacacattttatccaggctggcctcctgagcgcgctgggatccttaattctaatgatctggttaatggctactcctcactctcacgaaacagaacagaagcggctggggcttttagccgggtttgccttcctgacaggggtgggtctgggcccagcactggagttctgcatcgctgtgaaccccagcatcctgccaacagcttttatgggcactgctatgatctttacctgcttcacactgtag

SEQ ID NO: 47040 - DNA, 33 bp, Artificial Sequence
  Description of Artificial Sequence: Synthetic coding sequence
atgaacatcttcgaccggaagatcaacttctag

SEQ ID NO: 47041 - DNA, 36 bp, Artificial Sequence
  Description of Artificial Sequence: Synthetic coding sequence
atgaacatcttcgaccggaagatcaacttcgactag

SEQ ID NO: 47042 - DNA, 51 bp, Artificial Sequence
  Description of Artificial Sequence: Synthetic coding sequence
atgaacatcttcgaccggaagatcaacttcgacgccctgctgaagttctag

SEQ ID NO: 47043 - DNA, 270 bp, Artificial Sequence
  Description of Artificial Sequence: Synthetic coding sequence
atgaacatcttcgaccggaagatcaacttcgacgccctgctgaagtttagccatatcactccgagcacccaacagcacctcaaaaaggtatacgcttccttcgctctgtgtatgtttgttgctgccgcaggcgcctatgtacacatggtcactcactttatacaagcagggctgttgtccgccttgggatctctcatcctcatgatttggctcatggcaacgccacattcgcatgagacggaacagaagcgactggggctgctggcatag

SEQ ID NO: 47044 - DNA, 714 bp, Artificial Sequence
  Description of Artificial Sequence: Synthetic coding sequence
atgaacatcttcgaccggaagatcaacttcgacgccctgctgaagtttagtcacatcacgccatccacccaacagcacctgaaaaaagtctatgcttctttcgccctgtgtatgttcgtagctgccgccggtgcctacgtacacatggtgacccactttatacaggcgggactgttaagcgcattgggctcactgatcttaatgatctggctgatggctaccccccacagccacgaaacagaacaaaagcgactgggattgctggcagggttcgcattcctgaccggtgtggggttgggacccgctctggaattttgcattgccgtgaacccatctatcttaccgaccgctttcatggggactgctatgatctttacctgttttactctctctgcactctacgcccggagacggtcttacctcttccttggagggatactgatgtcagccctctcattgctgctcctcagcagtcttggaaacgtgttctttggaagcatttggttgttccaggcgaatttgtacgtgggacttgttgtgatgtgcgggtttgtgctgtttgatactcagcttattatagaaaaagcagagcacggcgatcaggattacatatggcactgcattgacctgttcctagattttatcaccgtcttccgaaagctgatgatgattttagctatgaacgaaaaagataaaaagaaagagaaaaaatag

SEQ ID NO: 47045 - DNA, 291 bp, Artificial Sequence
  Description of Artificial Sequence: Synthetic coding sequence
atgaacatcttcgaccggaagatcaacttcgacgccctgctgaagttctcacacatcaccccatccactcagcagcacctgaagaaggtgtatgcctcgttcgctctatgtatgttcgtggctgcggccggggcgtacgttcacatggtcacacacttcatccaggccggccttctcagcgcattaggcagtctcatcttaatgatctggctcatggctaccccacactcccatgaaacagagcagaaaagacttgggcttctggccgggttcgccttcctcacagggtag

SEQ ID NO: 47046 - DNA, 327 bp, Artificial Sequence
  Description of Artificial Sequence: Synthetic coding sequence
atgaacatcttcgaccggaagatcaacttcgacgccctgctgaagttctcacacattactcctagcacacagcagcatctaaaaaaagtctatgcttccttcgcactgtgcatgttcgtcgctgctgcaggcgcctacgtgcatatggttacacactttatccaggccggcttacttagtgcgctgggatccctcatcctgatgatttggctgatggccacaccgcacagccacgagacagaacaaaagcggcttggactgctggcaggattcgcttttctaaccggcgtggggctcggtcccgcccttgaattctgtatcgcgtag

SEQ ID NO: 47047 - DNA, 438 bp, Artificial Sequence
  Description of Artificial Sequence: Synthetic coding sequence
atgaacatcttcgaccggaagatcaacttcgacgccctgctgaagttcagccacattaccccgtctacccaacagcaccttaaaaaagtgtatgcctccttcgctttgtgtatgttcgtggccgccgccggcgcttatgtacacatggtcacgcactttatccaggccgggctgttgtcagctttgggttcgctgattttgatgatatggctgatggccaccccacacagtcacgaaacagagcaaaagagactcggacttcttgctggctttgcattcctaacaggtgtgggactaggccccgccttagagttctgtattgctgtaaacccaagcatcctgccgacagcctttatgggaacagccatgatctttacctgttttactctgagcgctctgtatgcccggaggcggagttacctgtttttgggcgggtag

SEQ ID NO: 47048 - DNA, 135 bp, Artificial Sequence
  Description of Artificial Sequence: Synthetic coding sequence
atgaacatcttcgaccggaagatcaacttcgacgccctgctgaagttttctcatatcacaccatccacccagcaacacctgaaaaaagtgtatgccagttttgccttgtgcatgttcgttgcagctgcaggatag

SEQ ID NO: 47049 - DNA, 126 bp, Artificial Sequence
  Description of Artificial Sequence: Synthetic coding sequence
atgaacatcttcgaccggaagatcaacttcgacgccctgctgaagttttcccatatcaccccgtcgactcagcaacacttgaaaaaggtttacgcaagcttcgccctctgtatgttcgtggcttag

SEQ ID NO: 47050 - DNA, 618 bp, Artificial Sequence
  Description of Artificial Sequence: Synthetic coding sequence
atgaacatcttcgaccggaagatcaacttcgacgccctgctgaagttcagccacatcaccccatctacgcagcagcacctgaaaaaggtctacgcatcctttgctctctgtatgttcgtcgccgctgccggcgcctacgttcacatggtgacccatttcatacaagcaggcctgctgagcgccctcgggtcactgattctcatgatctggcttatggcaaccccgcactcacacgaaaccgagcaaaagagactggggttgctggctggattcgcatttttgacgggcgtaggactgggccctgccttggaattttgtattgcggtgaatccttctattttgcccaccgcttttatgggcaccgctatgatcttcacatgttttacactatccgctctttatgctcgtcggcgcagttatctgtttttggggggaattcttatgtcagccctgagtctgttgctgctctcttcccttgggaacgtttttttcgggtccatctggctcttccaggcaaatctatatgtcggcttggtcgtcatgtgcggcttcgtgttgtttgatacacaactgataatcgaaaaggctgaacacggggatcaggattacatttggtag

SEQ ID NO: 47051 - DNA, 888 bp, Artificial Sequence
  Description of Artificial Sequence: Synthetic coding sequence
atgagccacagcagcgtgacccgggaggccccccagctgctgagccagagacagcgacgcgaagtcaggggggtatggggatggggctgcctgccgggacctcggggggggcccgccctcttcggtctcgtcaccttcggacagtctggggactgctgcactgactcagggacgatgaacatcttcgatcggaaaataaactttgacgcactcctcaagttcagtcacataacaccctcaacacaacaacatttaaagaaagtgtacgcgagcttcgcactgtgtatgtttgtcgcagctgcgggtgcttacgttcatatggttacacactttatccaggcaggcctactctcagctttgggcagccttattctgatgatctggttaatggcaacgccacactctcacgagactgaacagaagcgcctagggctgctggcaggcttcgcgttcctgactggcgtgggactcggtcccgctctagagttttgcatcgcggttaatcctagcatccttcctactgctttcatgggtaccgccatgatcttcacttgctttacccttagcgcactgtacgctaggagaaggagttacctcttcctgggaggaatccttatgagcgcgctgagcctcctgttattgagctctctgggcaacgtgtttttcggctcaatctggctgtttcaggcgaacctctatgtcggactggttgtgatgtgtggcttcgtcctgttcgacacccagctcataatagaaaaggcagaacatggagaccaggattacatatggcactgtatcgacctgtttttggattttatcacagtgttcaggaagttgatgatgatactagctatgaatgagaaggacaaaaaaaaagagaagaagtag

SEQ ID NO: 47052 - DNA, 3303 bp, Artificial Sequence
  Description of Artificial Sequence: Synthetic coding sequence
atgaagaccagcaaggccagccagcggtaccggggcatccggcggaacgcctcccagtgctacctatatcaggagtcgctgcttctgtctaatttggacgactcatttagcgcagacgaaacaggcgatagtaatgaccctgagcagattttccagaatatacagttccagaaggacctcatggctaatattaggtgccgcccgtggaccatgggccaaaagctgcgggctctccgccaagcaaaaaacatcgtgctgaagttcgaagggcggctaacgaggacacggggctaccaggcggcaggagccgaactgtggcggaagttcgctcgtttagcttgcaactttgtagtgatttttataccatgggagatgaggataaaaaagatagagtcacatttcggctctggagtggcctcatatttcatcttcctccgatggttgttcgggatcaatattgttttgacaattatgacaggtgcctttatcgtcatccccgagctgatcgccgggcaacccttcgggtcaacagcgcggaagaccatccctaaagagcaggtctccagtgctcaggatctagacacggtttggtccctcggcgggtatctacaatactcagtcctcttttatgggtattacgggcgtgagcggaagataggaagagctgggtaccgtctcccattggcttacttcctggtcggcatggcagtgtttgcttactcatttattattctgctaaaaaagatggccaagaactcaagaacatctctggcttctgccagcaacgaaaactacaccttctgttggcgggtgttttgtgcctgggactatctcattggtaaccctgaggcggccgagtccaaaacagccgccatcgttaactccatccgggaagccatccttgaggaacaagaaaaaaaaaaatctaaaaacttggccgtcactatctgcctcagaattattgccaatatcctcgtgctgctttccctggccgggtccatttatctcatctattttgtcgtggataggagtcagaagctggagcagtccaagaaggaactcaccctgtgggagaaaaacgaggttagcgtcgtcgtgtcattagtaacaatgatcgccccctctgccttcgaccttatagccgcgttagagatgtatcacccacgtacaacactgagattccagttggcccgggtgttggtattatatctagggaacttatacagtctgatcattgccctcctcgacaaggtgaattcaatgagtatcgaagagatggcaacgaagaataatactagtcactggatcgactccacaactttctttgctactaggaccgcgcccgaagaagagaagtggtctacatcccggcccgggatggggcttagaaggaacaacacctgggccctagaggagacgtctatttctgcgtacaccatgccattgatcaaggcaaataaaacctcattgcatacacagtccccccaagatcaatgctgggagacctatgtggggcaagagatgctgaaattgagcataattgacatgttgttcaccgtagcatctattctgctgatcgatttctttcgagggctatttgtgaggtatctttcagattactggtgctgggacttggaatctaagttccccgagtacggcgaattcaagatagcagagaatgtcctgcatctggtgtacaaccagggcatgatttggatgggagccttctttagcccatgcctccccgctttcaatgtgctgaagctgattgggctgatgtacttgcggtcatgggctgttctgacttgtaatgtgccccatcaacaggtcttccgagcttccagaagcaacaacttctacctagctatgctcctcttcatgctgtttctgtgcatgcttcccactatttttgccatcgtgcggtacaagcccagcttgaactgcgggccattcagcggccaggaaaagatttatgacatcgtgtctgagaccattgagaaggacttccctgtgtggttcgggagtgtcgttggtcacatcagctctccagtggtgatactgccagccgtgctcttacttttcatgctgatatattacttacaaagcatcgccaggtcactcaaattgtctaaccatcaacttaagatgcagatccagaacgctcgatccgaggataagaagaaggttgctcagatggtggaagccagaatccaaacacaggaggagagcacgaagaagttaccaaatgatagcgatttgaccagtcagttgagctccgcacacagcggcacccctcagaacaatggcaatgtggctcatttcgattctggttccagtaagtctggacgcatagagaccgtcgcccagtctatgccacagtccccaaggccaggagatcgggctccttcatccccattgcctggcgttcccaagtccagactggaacatgagaccaatcggtacctccatggcttatgcgcatcaaccagcgacctccatcgcaatagatctcgaacgccaatgacttttactacacacatcgaggatgttcatagtgaacccctttttcgcaaggacttccaacagatcaatcctcctcataggggtccccaggcgtcgaccttgctggctcaaggtcctcgcccacacgctccacgctactatgtaattaatgagtgcgactcttacaagaaaaagcaccttaacgtgtggcctgaaaggcactttaaaattgatgccagcggagacatcgtagaactgtatccaagaaacgtgcgacaatatgcctcccgggtgcctcgccagcccccctcaccccagctatctgaggaagaagaagagacgccctccagggattggattaaacgatctcttccccctagatccctgattgaccttcgtcgtgccccgcacttttatattggggaaaggagcgagagccaaacccgggatcctgaacatcaggggcgcgtccattataagtcctggaatgaagactttgagggccacctcgagagaccagcctacgtgcctagaaaacctcggtcacggaattttcagtatccacagcctccactgaaacctcggggtaagcctagattcgagccttccctgacagaatccgactcagtgtctgctgccagttcctccgaccagcagaacagttctgctgaccagtacttgcaggttactcattctcaggggcggttcccacggagtgtggggcagccaagccgaaggaaggccaaatccgggcaggaacttacggtagatctcgacgatctgatctgtagcgatgtgtag

SEQ ID NO: 47053 - DNA, 3306 bp, Artificial Sequence
  Description of Artificial Sequence: Synthetic coding sequence
atgaagaccagcaaggccagccagcggtaccggggcatccggcggaacgcatcacagtgctatctttatcaggagtcccttttactgtccaaccttgacgactcattctccgccgacgaaactggcgatagtaatgaccccgaacagattttccagaatatccagttccaaaaagatctgatggccaatatccgttgtcgtccttggacaatgggtcagaaactgcgcgcactgaggcaggctaagaatattgtattaaaattcgagggtaggctgactaggacacgtggttatcaagccgctggggctgagctgtggagaaagtttgcacgtctcgcctgcaactttgtcgtaatcttcataccttgggagatgcggattaaaaagatcgaatctcactttgggagcggggtagcctcatactttatttttcttcgctggctgtttgggatcaatattgttctgacaattatgacgggcgcttttatcgtgatcccggaactgattgcaggccagcctttcggcagtaccgcccgcaagaccatacctaaagagcaagtgagctccgcgcaggatctggacaccgtgtggagccttggggggtacctgcagtattctgtcctgttctacggatattatggacgggaacggaaaattggtagggctggttatagactacctttggcttacttcttggtgggaatggccgtcttcgcttattccttcatcattctactgaaaaagatggctaaaaattcgcgcacatcattagcttctgcctcaaacgaaaactatacattttgttggcgcgtattttgtgcttgggactacctgatcgggaatccagaggccgccgagagcaagacagccgcaatcgtcaactccatacgggaggcaatcttggaagagcaggagaaaaagaagtctaagaatttggccgtgactatctgcctgcgtatcatcgccaacatattagtgttgttgtcccttgcgggttctatctatctgatttattttgtcgtggataggagccagaagctcgagcaaagcaaaaaggagctgacgctgtgggaaaagaacgaacaggtgtctgtcgtggtcagcctcgtgacaatgattgcaccgtctgcctttgatctgatcgcagccctggagatgtaccacccccggaccaccctgagattccaactcgcgcgggttctggtcctgtaccttggcaatctgtattctctgattatcgctctgctggacaaggtcaactcgatgtcaatcgaggagatggctacaaaaaataatacctcccactggatcgattcaaccacattctttgctacaaggaccgctccagaagaagagaaatggagtacatctcgtccaggtatgggcctgaggcgaaacaatacttgggccctggaagagacttccatctccgcgtatactatgccactgataaaagccaacaaaacgagcttgcatacacagagccctcaggaccagtgttgggaaacctacgtgggtcaggaaatgttaaagctctccattatcgacatgttgtttactgtcgctagtatcctgttgatagattttttccgagggttatttgtgaggtatctgtctgattattggtgctgggatctggaaagcaagtttccggaatacggcgagtttaaaattgccgagaatgttctgcacctggtctacaaccaaggcatgatttggatgggcgcattcttcagcccttgcctacctgctttcaacgttttaaagctgattgggcttatgtacctgcgcagctgggctgttctcacctgcaacgtgccacatcagcaggtttttagggcatcaaggagcaacaacttttatcttgctatgctgcttttcatgttgttcctatgcatgctgcccactatcttcgccatcgtgcgctacaagcccagcctgaactgcgggcccttcagcgggcaggaaaagatttatgacatcgtatccgaaacaattgagaaggacttccccgtttggttcggatcagtagtagggcatatcagttccccggtagtgatattgccagcagtgctgttgcttttcatgctgatctactatctccagagcattgccagaagcttaaagttatcaaatcaccagttaaaaatgcaaatacagaatgcccgttctgaggacaagaaaaaagtcgctcaaatggttgaggcgcgaatacagacacaagaggagtctaccaaaaagctgccaaatgactctgacctgacatcccaactgtcaagcgcccattctggtacaccacagaacaatggcaacgtcgcccatttcgactccgggtccagcaaaagcgggagaattgagactgttgcccagtcaatgccgcagagtccccgccctggcgaccgtgctcctagtagcccactgccaggcgttcctaaaagtcgattagaacatgagaccaacaggtatctacacggactgtgtgcgagtacaagcgatcttcaccggaaccggtccaggactcctatgacatttacaacccatatcgaagatgtccacagcgagcccctttttcggaaagacttccaacaaatcaatcccccgcaccggggcccgcaggcctcaactttgctcgcccaagggcccaggccccacgctcccaggtattacgtaattaacgagtgcgattcatataaaaaaaaacacttaaatgtttggcccgaacggcatttcaaaattgacgcttccggggacattgtcgagctctacccaagaaatgtgagacagtacgcgtccagggtcccccgacagcctccttccccccaattatcggaggaggaggaggagacaccgtctcgagactggataaagcgctccctgccgcctagatcactgatcgacctgcgtagggcaccccacttctacataggggaacgatctgagtcccagacccgtgaccctgagcaccagggcagggtccactacaagtcctggaacgaagacttcgagggacacctcgagcggccagcttacgtaccaaggaagccccggagtaggaatttccagtacccacagcccccgctcaagcccagaggaaaacccaggtttgaaccatccttaactgaatccgactcagtctcagccgcgtccagctccgaccagcagaatagtagcgctgaccagtatctgcaggtgacacactcgcagggccgttttccgcgcagtgtaggtcaaccttctagaagaaaggcgaagtcaggacaggagctgaccgtcgatctggacgatcttatatgttccgatgtgtag

SEQ ID NO: 47054 - DNA, 2121 bp, Artificial Sequence
  Description of Artificial Sequence: Synthetic coding sequence
atggaggagaaccccaccctggagagcgaggcctggggcagcagccgaggatggttggctccaagggaggccaggggcgggccgagcctcagttcggtgttgaacgaactgcctagtgcagcgacactgcgctatagggaccccggtgtattaccttggggtgccctcgaggaggaggaagaggacggaggccggtccagaaaagcattcactgaggttactcagacggagttacaagatccccatccttcccgtgaacttccgtggccaatgcaagcgcggcgagctcaccgccagaggaatgcctcccgcgaccaggtggtctacggcagcggcactaaaacagatagatgggctaggcttcttcggaggtctaaggagaagaccaaggagggtttgaggagcttgcaaccctgggcttggactctgaagcgaataggtgggcagttcggggccggaaccgagagctacttttctttgctgagattccttctgctgcttaacgtgctggctagcgtgttaatggcctgtatgactctgctgccaacttggctcggaggtgctccacccggccctcccggacccgatataagctcgccgtgcggctcatacaacccgcattcacagggactggttacattcgctacacagttattcaatctcctgtcgggtgaaggctatctggagtggagtccgctgttctacggattctaccccccccggcccaggctggctgtgacgtacctctgttgggcgtttgccgtgggtctgatctgcctacttttaattcttcacagaagcgtctccgggctaaagcagacactgctcgctgaaagcgaggctctgacgagctactcccaccgggtgttttcagcttgggattttggattgtgtggagatgtgcatgttagactaagacagcgcatcattctgtacgagctcaaagtggagctggaggagactgtagtgcgacgtcaggcagccgtgcggactctgggccaacaggctagagtgtggctcgtgcgcgtgcttttaaatctcttggtggtggcattactcggcgccgcattctatggggtttactgggccaccggctgcactgttgaattacaagagatgcccctcgttcaagaactgcccctgctgaaacttggggttaactacttaccctccatttttatcgccggggtgaacttcgtacttcccccagtgttcaagctcatagcacccttggaaggctatacacgctcacgacagattgtattcatcctattacgaacagtcttcttacggttagcatccctggtggttctgctgttctctctgtggaatcagataacttgtggaggtgatagcgaggcggaagactgtaaaacgtgcggttataactacaagcagctcccctgttgggaaactgtcctcggccaggaaatgtataagcttctgctcttcgatcttctgacagtactcgcagtggccctgttgattcaattccctaggaagctcctgtgcggattatgtcctggagctttgggccggctggcaggtacacaggagtttcaggtccccgacgaagtgttggggctgatctacgcccagaccgttgtgtgggttggctcatttttctgccccttgctcccgttacttaacactgtaaagtttctgctgctgttttatctgaagaagcttaccttgttctctacatgttcacccgcagccaggaccttcagagcctccgctgctaactttttctttccactcgtcctcctgctgggcctggccatctcctccgtgccgttgctttactccatcttccttattcccccgtcaaagctgtgcggaccattcagaggacagtcgtccatttgggcacagatccctgagagtattagtagcctgcctgaaaccacacaaaacttccttttctttttgggcacccaagccttcgcagtgccactacttcttatttcatctatcctgatggcttacacagtcgccttagccaactcttatggcagattaatttccgagttgaagcggcagcgccagaccgaggcccaaaataaagtgttccttgccagaagagccgttgcgctgacctccactaaacctgcattgtag

SEQ ID NO: 47055 - DNA, 2139 bp, Artificial Sequence
  Description of Artificial Sequence: Synthetic coding sequence
atggaggagaaccccaccctggagagcgaggcctggggcagcagcagagggtggctggctcccagggaagcccgtggggccccctgctctagtccaggcccatccttgtccagcgtcctgaatgagctcccctccgccgcgactctgcgttatagggaccctggggtacttccgtggggggctttggaggaagaggaagaagatggaggcaggagtagaaaagcctttaccgaagttactcagactgaactacaagacccccacccaagtagggagctgccctggccaatgcaggccaggagagcccaccgtcagagaaatgcaagcagggaccaagtagtttacggcagcggaaccaaaactgaccgatgggcaagactgctgaggagatcaaaagagaagacgaaagaaggcctccggtctcttcagccgtgggcctggaccttaaagagaattggaggacaattcggagcagggaccgaatcgtacttttcactcctgcgctttctgctcttgctgaacgtactggcttccgtgcttatggcgtgtatgaccttgctcccgacctggctggggggggcacctccaggtcctccaggacctgacatatcatccccatgtggatcttataatccacacagtcaaggtctcgtgacattcgccactcagctgtttaacctgctgtccggcgaaggatacctcgagtggtcccctctcttctatggcttctatcctcctcggccccgcttagccgtgacatatttgtgctgggctttcgctgtgggattgatctgcctactcctcatcctgcaccgtagcgtgtccggccttaagcagacactgttggcggagagcgaagccctgacaagctactcccaccgggtgtttagcgcctgggatttcggcctgtgcggggacgtgcacgtgcgccttcggcaacgcatcatcctctatgagctgaaggtcgaattggaggaaacggtggtcagacggcaggccgctgtccgcaccctcggccaacaggctcgcgtttggcttgtccgcgtgctgttgaatctgctagtagttgccctcctgggcgcagccttctatggggtctactgggcgacagggtgcactgtcgagctgcaggagatgccccttgtacaggagctccctctgctaaagctgggagttaattacctacccagtattttcatcgctggggtgaacttcgtccttccccctgtgttcaaactgattgcgcctctggaggggtacacccgatctcggcaaatagtgtttattctgctacgcacagtgtttttgcgattggcaagcctggtggtgttgctcttctcactgtggaatcagataacgtgtgggggtgatagcgaggctgaagactgtaagacctgcggatataactacaaacaattaccatgctgggagacagtactgggccaggagatgtacaagctgctattgtttgatctcctgaccgttctcgccgtcgccttgctcatccagtttcctaggaagcttctgtgtggcttatgcccgggcgccctgggtcggctcgctgggacgcaggagttccaggtgcccgacgaggtcttgggtctaatttatgctcaaacagttgtctgggtcggttctttcttctgccctctactcccgcttctgaataccgtgaagtttctactcctgttctatttgaaaaagctgacgctgttttcgacatgttctcctgcagctcgtacatttcgtgcctctgccgcgaacttcttcttcccacttgtgctgctcttggggcttgctatatcctcggtcccactgctgtactccatcttcctgattcccccatcgaaattgtgcggtccattcagaggacagtcctctatctgggcacagattcctgaaagcatatcttccctccccgaaacaacccaaaacttccttttcttcctgggcacgcaggccttcgccgtgcctttacttttaatctccagcattcttatggcatacacagtggccctggcgaattcttatggacgcctgatctcagagctaaaacggcaacgtcaaactgaggctcaaaataaggtgttcctggcccggcgggctgtggcactgacgtccacaaaaccagcactgtag

SEQ ID NO: 47056 - DNA, 885 bp, Artificial Sequence
  Description of Artificial Sequence: Synthetic coding sequence
atgaagggcggcggcggccagcgggacgtgggcgccgaccggaccgttttcttgaggttggcttctctggtggtcttgctgttctctctctggaaccagataacttgtgggggggattcggaagcagaagactgcaaaacatgcggttataactacaagcaactcccctgttgggagactgttctgggacaggagatgtacaagctgcttctgttcgaccttcttacggtgttagcggtggcactgctgattcagttcccccgcaaactcctgtgcggtctttgcccaggtgcactgggcagactggctgggacccaagagttccaagtgcccgatgaggtattggggttaatctacgcccagacggtagtctgggtcggctcatttttctgtccactgctgccacttctcaacaccgtgaaatttctgctgcttttttacctgaagaagctgacactattcagcacctgctcgccagccgcccgtacattcagagcaagcgccgccaattttttctttcctctggttctgctgttgggactggccatttcatctgttccgctgctctactccatctttttaattcctccaagcaaactgtgtggcccttttaggggtcagagcagtatctgggctcaaattcccgagtcaatctctagcctgccagagacgactcagaactttctcttcttcctgggcacacaggcgtttgcagtgccactcctgctaatttcttccattcttatggcatataccgtcgccctcgctaatagctatggtaggctaattagcgaactgaagaggcaaagacagactgaagcccagaataaggtgtttttagcacgtcgggctgtggcgctgacatccactaagccagccctgtag

SEQ ID NO: 47057 - DNA, 1377 bp, Artificial Sequence
  Description of Artificial Sequence: Synthetic coding sequence
atggccgcccagggcgccgccgccgccgtggccgccggcaccagcggggtggccggcgaaggggagccaggacccggggagaacgccgccgccgaggggaccgctccttctcctggaagagtctcgccccccacgcctgcccgaggggaacccgaggtcacagttgaaataggagagacgtacttatgcaggcgccctgacagtacgtggcacagcgccgaggtgatccaaagccgcgtgaatgaccaggaggggagagaggaattttatgtgcattacgtcggatttaataggcgcctggacgagtgggtggataagaatcgccttgccctgactaaaacagtgaaggatgccgtgcagaaaaattctgaaaaatatctgtccgagcttgccgagcagcctgagagaaaaatcacccgcaaccagaaacgcaagcacgatgagataaaccatgtgcaaaagacctatgcagagatggatcctacaactgccgcgcttgagaaagagcacgaggccatcacaaaggtgaagtatgtagataagatacacattggcaattacgagattgacgcatggtattttagccccttccccgaggattatgggaagcagcccaagttatggctgtgtgaatattgtttaaaatacatgaaatatgagaagtcatatcgcttccacctgggacaatgccagtggcgacagcctcccggaaaagaaatctacagaaagagcaacatctcggtttacgaagtggatggcaaggaccataagatatattgtcagaatttatgcctgctcgcaaaactatttttggatcataagacactgtattttgacgtggagcctttcgttttctacatcctgactgaggttgatcgacaaggagcacacattgtaggttacttttccaaggagaaagaatcgcctgacgggaataatgtagcctgcatactaaccctgccaccatatcagagacgaggttatgggaagttcctgattgctttctcgtacgaattgtccaagctggagtccacagtgggctcccctgagaagcccctctccgacctggggaaattgtcttacagatcatactggtcctgggtcctcctggaaattttgcgagacttccgaggaaccctctcaatcaaagaccttagccagatgacctccatcacccagaacgacatcattagtaccctccaatccttgaacatggtgaaatactggaagggacagcacgtcatctgcgttacacctaaactggtcgaggagcatctgaagtccgcccagtacaagaagcctcctattaccgtggatagtgtgtgtctgaagtgggctccgcccaagcacaaacaggtcaagctctctaaaaagtag

SEQ ID NO: 47058 - DNA, 2847 bp, Artificial Sequence
  Description of Artificial Sequence: Synthetic coding sequence
atgagcgcctactaccggaacaactggagcgaggaggaccccgactaccctgactacagcggctcgcagaaccgaacacagggttatctgaagacacaggggtacccagacgtgccgggacctctcaacaacccagactatccaggaacaagaagcaacccttactccgtggcgtcccgcaccaggcctgactatccgggttccttggccgagccaaattaccccaggtccctgagcaaccctgattacagtggcacacgcagcaacgcctattccgcggcaagtaggacatcccccgaccaccccactagcctgcctgaaccagattactcagagttccagtcccacccataccatagagccagttcacgccagccagattatcctggtagccagcggaatcccgactttgctgggagctcaagctctggtaattacgctggcagtcgtacacatcctgaccacttcggtagtctggagccggattacccaggtgctcagtccaacagcgaccatcccggaccccgggcaaatctgaatcatccagggagcagaaagaacctcgagcacacctcttttcggattaacccgtacgctgactctctcggcaagccagattaccccggcgctgatattcagccaaactcccccccattttttggcgaaccagattatccaagtgcagaagacaaccagaacctcccctccacctggcgggaaccagattattctgatgccgaaaacggtcatgattacggatcctctgagacccccaagatgacccgcggcgtgctaagccggacttcctcaatccaaccatcttttcggcaccggtccgatgatccagtcggttcgctgtggggggaaaacgattatcccgagggtattgagatggctagcatggaaatggccaactcgtacgggcattctctgcccggggcccccggatccggttacgtgaacccagcctacgtcggagagtccgggcctgttcacgcctatgggaatcctccattgtccgaatgtgattggcataaaagtccacaaggccagaagctaatcgcctccttaattccgatgacatctcgcgacaggatcaaggccatcaggaatcagcctaggactatggaggaaaagcgaaatctgcgtaagatcgtcgacaaggagaaatcaaaacagactcatcgtatcctgcagctgaactgctgcattcaatgcctgaactctatcagtcgcgcctatagacgaagtaagaattctctgtcagagattctcaacagtatatcgctatggcagaaaacacttaagataattggggggaagtttggtaccagtgtattatcgtacttcaattttcttcggtggttgctgaagtttaacatcttctcttttatcttgaacttctcattcattattattcctcagttcacggtggccaagaagaataccttgcagttcactggccttgagttctttacaggagttgggtattttcgcgataccgtgatgtattacgggttttataccaactctactattcagcacggcaactctggcgcaagttacaacatgcagcttgcttatatttttacgatcggggcctgcctgactacctgttttttctccttgctcttttctatggccaagtacttcaggaataactttattaatccccatatttacagtgggggtattacaaaactgatcttctgctgggacttcacagtcacgcatgagaaggccgttaaactgaagcagaagaacctctcaacagagatccgggagaacttgagcgaactgcgtcaggagaatagcaagctgactttcaatcagctgctgacacgattttctgcatatatggtcgcgtgggtggtgtcaactggggtcgctattgcctgttgcgcagccgtgtattatttggctgagtacaatttagaattcctgaagacccactctaatcccggcgccgtgttactcctccccttcgtcgtatcctgtatcaacctggcagtaccctgcatctattcaatgttcaggctagttgagcggtatgaaatgccaaggcacgaagtgtatgttttgctgattagaaatattttcctgaaaatcagcattatcggaatcctctgttactattggctgaatactgtggctctgagcggggaagagtgctgggaaaccctcatcggtcaggatatatataggttgctcctcatggacttcgtattctcccttgtcaactctttcttgggagaattcctgaggcgtatcatcggaatgcaactgatcacatcactggggctccaggaattcgacatcgccagaaacgtcctcgaactgatctacgcccagactctggtttggatcggtatctttttctgtcccctgctgccatttatacaaatgatcatgctatttatcatgttttactccaagaacatctctcttatgatgaatttccagccgccctccaaagcttggcgggcatctcagatgatgacattctttatctttctgcttttcttcccctcttttaccggcgtgctttgcactttagctattacaatctggagaattattacctacctctattggcagattacagaaggccggaagatcatgattcgtctgctgcatgaacagatcatcaatgagggcaaagacaagatgtttctgatcgagaagctaatcaaactacaggacatggagaagaaagcaaatccatcatccctcgtgctggagaggcgcgaagtggaacagcagggctttttacacttaggggagcacgacgggagtctagatctgaggtctcgccgctctgtccaggagggaaatccccgcgcctag

SEQ ID NO: 47059 - DNA, 3021 bp, Artificial Sequence
  Description of Artificial Sequence: Synthetic coding sequence
atgagcgcctactaccggaacaactggagcgaggaggaccccgactacccagattattctggatcacagaaccggacccagggatacctcaagacccaaggctatcccgatgtgcccggccccctgaacaatcccgactatcccggtacaaggtccaacccttacagtgtcgcctcacgcacccgaccagactatcctggctctctggctgagccgaactaccctaggtctctgagcaaccctgattatagcggaacacgcagtaatgcctatagtgccgccagtagaacatctcccgaccatccgactagtctccctgagcccgattattccgaattccagtcacacccttaccatcgggcctctagcaggcaacccgactaccctggaagccaacgtaatccagattttgccggtagctcctcctctggaaattatgccggtagccgcacacaccccgatcactttggttccctcgaaccagattatccaggcgcacaaagcaacagcgatcacccaggaccccgagctaacctgaaccaccccggctcacggaagaaccttgaacacaccagttttagaatcaacccttatgcagatagcctggggaagccagattatcccggtgctgatattcaaccaaactcacctcccttttttggagaacctgactatccgagcgccgaggacaatcagaacttaccctccacttggcgagaacccgactattcggatgccgaaaacggacatgactatggaagcagtgaaacccccaagatgacaagaggcgtactgtcccggacaagctcaatccagccttccttccgccaccgcagcgatgacccggttgggagtctttggggagagaatgattatcctgaggggatcgagatggcctctatggagatggcaaactcatacggccattcactcccaggggctcctggttctggttacgtcaaccctgcttacgtgggcgagtccgggcccgtgcacgcttacggcaacccccccttgtctgagtgcgattggcacaagtcaccccagggacagaagttaatagccagcctgatccctatgacatctagggatcgcataaaggccatcagaaatcagcccaggacaatggaggaaaagaggaacctgaggaagattgtcgataaggagaaaagcaagcagacgcatcgaattctgcagctgaactgttgcatccagtgtctgaactccatttcgcgggcctacaggagatcaaagaattcgctgagcgaaattttaaactccatcagcctgtggcagaagactctgaagatcatcggtggaaagtttggtacctctgttctgtcctacttcaatttcctaagatggctcctcaaatttaacatttttagtttcatcctcaacttcagctttatcattattccccagttcacagttgctaaaaaaaatactctgcagttcactggcctggaattctttaccggagttggctattttcgagatactgttatgtactatggattctataccaattccaccatccagcatggtaactctggggcatcttacaatatgcagctggcctacatctttacaattggggcatgtttgactacctgtttcttcagcctgctcttctccatggctaaatactttcgaaataactttattaacccacatatttattcaggaggaatcacgaaactcattttttgctgggacttcacagtgacccacgagaaggccgtgaaactgaaacagaaaaacttatctaccgaaatacgggaaaatttgagcgagctgcgccaggaaaatagtaaattgacgtttaaccagctgctgactcggttcagcgcgtacatggttgcttgggttgtgtccactggagtggctatcgcttgctgcgctgctgtttactatcttgctgaatataatctggagtttttgaagacacattccaaccccggagccgttttactcttaccttttgttgtatcatgtattaaccttgctgttccatgtatatactcaatgttcaggctggttgagcgttatgaaatgccaaggcacgaagtttacgtgctcctgatccggaacatcttccttaaaatctccataatcggaatactctgttactattggctcaataccgtggccctgagcggagaagaatgttgggaaactcttataggacaggatatctatcgcctgttgttaatggacttcgtgttcagtctggtgaatagctttctcggggagtttctgagaagaatcattggaatgcaactgatcaccagcttaggcctgcaagaatttgatattgcgcgcaatgtcctggaacttatctacgctcagactttggtgtggatcggcatctttttctgccctctactgccctttattcagatgatcatgctgtttattatgttttacagtaagaacattagtctgatgatgaactttcagccaccctcgaaggcatggagagcaagccagatgatgacattcttcatctttctgttgttttttcctagtttcacaggagtgctgtgcaccctggccatcacaatatggcgacttaagccgagtgcagactgcggcccctttcggggcctaccgctgtttatccactctatctatagttggattgacactctgagcacacgtcccggctatctgtgggttgtgtggatctaccgcaacctgataggttctgtccacttctttttcattcttaccctcatcgtgctgataatcacgtacctgtactggcagattacagaaggccgcaagattatgataagactgctccatgaacagatcataaatgaggggaaagacaaaatgttcctcatcgagaagctgatcaaactgcaggacatggagaaaaaggcaaatccaagctccttggtcttagaacgcagggaggtggaacagcagggattcctgcatctgggggagcatgatggcagtctggatttgcggtctcgaaggagcgtgcaggaaggtaaccctagggcctag

SEQ ID NO: 47060 - DNA, 2103 bp, Artificial Sequence
  Description of Artificial Sequence: Synthetic coding sequence
atgctgagcgacgaccacgtgaacgagatcatcatccagaagctgatcgctagcttaatcccaatgacctcccgcgatagaataaaagctatcaggaatcagccccgcacaatggaggaaaaaaggaacctgtccagggggggcctgactatcaccaccgaggacgagggtagggccaaagcacatttaacttggtggaaaatcgtggataaggagaaaagtaaacagactcacagaattctgcaactaaactgctgcatacagtgcctgaatagcatcagtagagcataccggagatcgaagaactcgctatctgagatactgaactctataagtctgtggcagaagacattgaaaattatcggcggaaaatttggcacttccgtcttgagttattttaactttctccgctggttgcttaaattcaatatctttagcttcatcctcaacttcagtttcattatcatcccacagttcacagttgccaaaaagaacacgctacagtttacgggtctagaattctttacaggcgtaggctactttagagatactgtaatgtactacggtttttacaccaatagtactatacagcatggcaactctggggcaagttataatatgcagctggcttatatatttacgatcggcgcttgtctgacaacctgcttcttttcactgctcttttcgatggcaaaatatttccgaaacaacttcataaacccacatatctatagtggcggcatcaccaagttaatattttgctgggattttaccgtcacccatgagaaggccgtgaagctcaagcagaaaaatctcagtacagagattagagaaaatttgtctgagttgcgtcaggagaacagcaaattgacatttaaccagttgcttacgcgttttagtgcgtatatggtcgcctgggtcgtgtctaccggggtggctatcgcatgttgcgccgcagtctactacctggctgaatacaatttggagttcttaaaaacacactccaatcccggtgccgtcctgctcctgccttttgtggtgtcatgcatcaatctggccgtcccttgcatctacagcatgttcaggctggtagagagatatgagatgccacgccatgaggtctacgtgctgctcatccgtaacatatttctgaagatcagtatcatcgggatcctgtgctactactggcttaatactgtggctctgtccggggaggaatgctgggaaaccctcattgggcaggacatataccgactattgctcatggattttgttttctcactcgtgaatagctttcttggggagtttctgcgccggattataggcatgcaactcataacatcactggggctgcaagaatttgatatcgctcgcaacgtcctcgaactgatttatgcccagacattggtttggatcggcatattcttctgtcctctgctgcctttcatccagatgattatgctgtttattatgttttattccaaaaacatctctctcatgatgaatttccagcctccatcgaaggcctggcgtgcttcccagatgatgacattctttatcttcctgcttttctttccctctttcaccggcgttttgtgcaccttggcgattacgatctggagactgaagccgagcgctgattgtggccctttcagagggcttcctctgttcattcactctatctacagctggatagacaccctgtccacacgtccaggctacctgtgggtggtatggatctatagaaacttgataggcagcgtccatttcttcttcatcctcacccttatcgttctgattatcacatacctgtactggcagattaccgaaggcagaaaaattatgatcagattgctgcacgagcagattataaacgagggtaaggataagatgttcctaatcgagaaactgatcaagctgcaggacatggaaaaaaaagctaatccttcgagtctcgtgctcgaacgccgcgaggtcgagcagcagggcttctgtatttgggggaacatgatggctgtattaacctgtgacctcgaagatcagtttaaaaaagtaattcaaggcccagatgactcatttggcaaccaaacgccaattaagtag

SEQ ID NO: 47061 - DNA, 2865 bp, Artificial Sequence
  Description of Artificial Sequence: Synthetic coding sequence
atgagcgcctactaccggaacaactggagcgaggaggaccccgactatccagattactctggttcacaaaatcgtactcagggctacctcaagacacagggctaccctgatgtcccggggcccctcaacaaccccgactacccaggcacccggtccaatccttactcagtcgcttcccggacaagaccggactatcccggatccctggctgaaccaaactatcccaggtctctcagtaatcccgactactcaggaactaggtctaacgcctactccgcagccagtcggaccagccctgaccatccgacatctctgcccgagcctgattatagcgagttccagagtcatccttatcaccgcgcttcatctcgccaaccagactacccaggcagccagcggaaccctgattttgcaggtagttcatcctccggcaattacgctggcagtcgcacacatccagaccactttggttcactcgagccagattatcctggcgcccagtccaatagtgatcatcctggcccacgagccaatttgaaccaccctggatcccgcaaaaacctcgagcacaccagtttccggatcaacccctatgcggattctctcgggaaaccagactatcccggtgccgacatccagccaaattcaccacccttctttggggagcctgactacccgagcgccgaggacaaccagaatttgccttctacctggcgggagcccgactactccgacgccgaaaatggacatgattatgggtcctcggagactcctaagatgacccggggggtactgagccggacatctagcatacagccatcatttaggcacagatctgacgatcctgtcgggagcctgtggggggagaatgattatcccgagggcattgagatggcgtcaatggaaatggccaactcctacggacattcgctcccaggcgcgccaggtagtggctacgtaaatccggcatatgtgggcgagtctgggccagttcatgcatacggaaacccgcccctgagcgagtgcgactggcataaatctccacagggccagaagcttatcgcctccttgatcccaatgacttcacgtgataggatcaaagccattcgaaaccaaccacgaactatggaggagaaaagaaacctgcggaaaatagtcgataaagaaaagtctaaacagacccaccggatccttcagctcaactgttgtatccagtgtctcaacagtatcagcagggcctacagacggtctaaaaactccctgtcggagattctgaattcaatttctctttggcagaaaaccctgaaaattattggtggcaaattcgggacatctgttctgagttattttaactttctgaggtggttattgaagtttaatattttttccttcattctgaactttagtttcatcatcatccctcaatttacggtcgccaaaaaaaatacgctgcaattcaccggcctcgaatttttcactggcgtcggatacttccgcgatacggtgatgtattatgggttctacactaattccacaattcagcatggaaactctggtgctagctacaacatgcagctcgcctacatttttactataggtgcttgcctgactacatgctttttttccctcttgttttccatggcaaagtactttcgaaacaactttatcaacccgcatatatacagcggcggcattacaaaactcatattctgctgggactttactgttacacatgaaaaagccgttaaattaaagcagaaaaatctgtcaaccgaaatcaggttcctgaaaacccatagcaacccgggcgccgtgctgctgctgcctttcgtagtcagttgtattaaccttgctgtaccgtgtatatattctatgttccgattagttgagagatatgagatgcccagacacgaagtctatgtattgttaattcgaaacatttttcttaagattagcatcatcggtatcttgtgctactattggctgaacaccgtagccctttccggtgaggaatgttgggagactctcattggccaggatatttaccgcctcctgctcatggactttgtctttagcctggtcaacagttttctcggggaatttctgcgccggatcatagggatgcagctcataacgtcactcggactccaggaatttgatattgccagaaatgtgctggagctgatctatgcacagactctcgtctggatcgggatttttttttgcccacttctaccctttatacaaatgattatgctctttattatgttttattccaagaacatcagcctgatgatgaattttcagccaccatcgaaggcctggagagcttcccagatgatgacctttttcatcttcttattgttctttccttccttcacaggagtgctgtgcacactggccatcactatatggcggctgaagccctccgcggactgcggcccattcaggggccttcctctattcatccattcgatttattcatggatagataccctcagcacaagaccgggttacttgtgggttgtgtggatctatagaaatctgatcgggtcagtccacttctttttcatcctgacccttattgtgcttatcatcacatacctatactggcagatcactgaaggccgcaagataatgattcgcctgctccatgagcagatcattaacgaagggaaggacaaaatgttcctaattgaaaaacttattaagctacaggacatggaaaagaaagcaaatcccagttcgcttgttcttgagaggagagaggtggagcagcagggtttcctccatctgggagaacatgacggctccctggatttacgctcccgaaggtcggtgcaggaaggcaacccacgtgcctag

SEQ ID NO: 47062 - DNA, 3021 bp, Artificial Sequence
  Description of Artificial Sequence: Synthetic coding sequence
atgagcgcctactaccggaacaactggagcgaggaggaccccgactatcctgattatagcggtagccagaacaggacccagggatatcttaagacacaggggtaccctgacgtccccggccccctgaacaaccccgactacccaggcacccgaagcaacccatattctgtcgcatctaggacccgccctgactaccccggatccctcgccgaacctaactaccccagaagtctgtctaaccctgactattctgggaccaggagcaacgcttactcagccgcatcaaggactagccctgatcaccccacgtcactgcctgaaccggactatagcgaatttcaatcacatccatatcaccgtgcgagctcccgtcagcccgactaccctggcagccagaggaacccggattttgccggctcgagctcatcaggaaattacgcggggtcccgtacccatccagatcactttgggtccctcgagccagattacccaggagcacagagcaattctgaccatcccggcccccgagccaacctgaaccacccaggcagtagaaagaatctggaacataccagtttcaggattaacccttacgctgactctcttgggaaaccagactaccctggcgctgacatccagcctaatagcccacctttctttggggagcctgactacccttctgccgaagataatcaaaatttaccatccacttggcgggagccagactattccgacgcagaaaacggccatgattacggctcttcagaaacacccaaaatgactaggggtgtcttgtcacggacttccagcatacagccatcgttccgccatcgttccgatgatccagtgggcagcctctggggggagaatgactatccagagggcatcgagatggcttcgatggagatggccaatagttacggtcatagcctgcctggggctccaggatctggttacgttaatcctgcctatgtgggggagagcggcccagtgcacgcttatggaaacccgccattaagcgagtgcgactggcataagtctcctcagggccaaaaattgatcgcctcgctcatcccaatgacttcccgcgacaggattaaggcgataaggaaccagccccgcacgatggaagagaaacggaatctgaggaaaatcgtagataaggaaaagagcaaacagacccaccgcatcctccagctcaattgctgtatccagtgcctgaactcaatttcccgtgcctacagaagaagcaaaaatagcctttcagagattcttaacagcatctctctctggcagaaaaccctgaaaattattggcgggaaattcggcacaagcgtgctttcctactttaacttcctccggtggcttctgaagttcaacatcttcagctttatcttgaactttagcttcattataatccctcagtttacagtcgctaaaaaaaataccctgcagtttacaggcctggaattcttcactggcgtgggctactttagagataccgtcatgtactatggcttctacaccaacagcaccattcaacatggtaattcaggggcgtcttataacatgcagctggcctacatcttcacaatcggcgcttgcctgacgacttgcttcttttccctgctgttctccatggccaagtatttcaggaataattttataaacccacacatatatagcggcggaataactaaactgatcttttgttgggactttacagttacgcatgaaaaggctgtcaaactgaaacagaaaaatctgagcaccgagatccgtgagaacttaagcgaacttcgacaggaaaattccaagcttacattcaatcaattgcttactcgattcagcgcttacatggtggcctgggtggtgtcgacgggggtcgccattgcctgctgcgctgccgtgtactatttggccgagtacaacttagagttcctgaagacccactctaaccctggagcagtacttctgttgccctttgtggtgtcctgcataaaccttgctgtgccctgtatttatagcatgtttaggttagtggaacgctacgagatgcccagacacgaagtctacgtgttactcatccgtaacattttcctgaagattagcattatagggatcctgtgctactactggctgaacacagtggctctgtctggtgaagaatgctgggagacgctgatcggccaagatatataccgtctcctgctaatggatttcgtgttttctctcgtaaacagtttcctgggtgaattcctcaggcgcattattggaatgcagctcattacttcactcgggctccaggagttcgatattgcccgcaatgtgctggagctcatctacgctcagacacttgtttggatcgggatctttttctgtccactcctgcccttcattcagatgataatgctttttatcatgttctactccaagaatatttcccttatgatgaacttccaacccccctccaaggcgtggcgtgcatcccagatgatgactttcttcatttttctgctgttttttccatcctttaccggtgtcctatgtactctggccattacaatctggagattgaaacccagcgctgactgcggaccattcaggggcctgccactgttcattcattcgatatactcatggatcgataccctctccacacgcccaggctatctctgggttgtttggatttatagaaatctgatcggaagcgtgcacttcttcttcatcctcacattaattgtacttatcattacctacctgtattggcagataacggaggggaggaagatcatgattcgcctgctgcacgaacaaatcataaacgagggaaaggacaagatgttcttgatcgagaagcttatcaagttacaggacatggagaaaaaagctaatccttcatctctagttttggaaaggcgcgaggtagagcagcagggcttcctgcacctgggggaacacgacggttcactggaccttaggtctcgacggtctgtgcaggaggggaacccaagggcttag

SEQ ID NO: 47063 - DNA, 2172 bp, Artificial Sequence
  Description of Artificial Sequence: Synthetic coding sequence
atgagcgagagcagcggcagcgccctgcagcccggccggcccagccgtcagcccgcagtccatcctgagaacttgtctctcgattcttcatgcttttcctccccccccgtgaattttctgcaggagctgcccagctaccggtccatcgcacgcaggagaactacagtgcattcaagggacaaacaatctggcaccctgctgaagcctacagattcttattcctcacagcttgaagacaggatcgccgagaatctttcgtcccattctcttaggaattatgcattgaacatctcagaaaaacgacggctccgcgacattcaagagacccagatgaaatatctctcagaatgggaccaatggaagcgctattccagcaagtcctggaagcggttcctcgagaaggcacgggagatgacgacccacttggagctgtggcgggaggatattcggtccatagagggaaagtttggcaccggaatacagtcttatttcagtttcctgcgctttctggtcctcctcaacctggttattttcctgattatttttatgttagttctcctgccggtgctcctgactaaatacaaaatcactaattccagctttgtactcatccccttcaaggatatggacaagcagtgcaccgtgtatccagtctcatcaagcggcctgatttacttctattcttatattattgacctgctgtcaggaactggctttctcgaggaaacctccctgttctacggacattatacaattgatggggtgaagtttcagaatttcacctacgacttgccactggcttatctcctgagtacaattgccagtctggcccttagcttgctgtggattgtgaaacgtagtgttgagggcttcaagattaatctgattagatccgaggaacactttcagtcctattgcaataagattttcgccgggtgggatttctgcatcaccaatcgctctatggctgatctaaaacacagttctctgcgatacgagttacgagcagatcttgaggaggaacggatgaggcaaaagatcgctgagcgaacatcagaggaaaccatcaggatctatagtctgagactgtttttgaactgcatcgtgctggctgtcctgggcgcatgtttttacgccatttacgtggcaaccgtgtttagccaggaacatatgaagaaagaaatcgacaagatggttttcggcgaaaatttgttcatcctctatctgccaagcattgttatcacgctcgccaactttatcacccctatgatcttcgccaaaatcataagatatgaggactacagtcctgggtttgaaatccgtctgacgatcctgagatgcgtgtttatgcgtctggccactatttgtgttctcgttttcacgttgggtagtaagattaccagctgcgatgatgacacttgcgacctgtgtggatacaatcagaagctgtatccatgctgggagactcaggtgggccaggagatgtataagcttatgatttttgatttcattataatcctggccgtcaccctttttgtggattttcctaggaagctgctggtgacctactgtagctcctgtaagctgatccaatgctggggacagcaggagttcgccatccccgacaatgtgctgggaatcgtttatggccagacaatctgctggatcggcgcctttttttccccgctcttgcctgcaatcgctacgttgaaatttattatcattttctatgttaaagaatggtctctgctttatacatgcagaccttcccccagaccctttagggcctctaatagtaactttttcttcctgctggtgctgttaatcggtttatgtctggctattatccctctgacaatctcgatatcccggattccaagtagcaaagcctgcggtccatttactaacttcaatactacatgggaagtgatccctaagaccgtgtcgacattccctagctctctgcaaagctttatccacggcgtaacaagcgaggcctttgcagtgcctttttttatgatcatctgcctcataatgttttatttcatagcattagcaggcgcacacaaacgtgtcgtgattcagctgcgcgagcaactttcgctcgaatctcgggataagtgttaccttattcagaaacttactgaagcacagcgggacatgaggaactag

SEQ ID NO: 47064 - DNA, 1842 bp, Artificial Sequence
  Description of Artificial Sequence: Synthetic coding sequence
atgaagtacctgagcgagtgggaccagtggaagcggtacagcagcaagtcttggaagcgtttcttggagaaggctcgtgagatgacgacccacctcgaattatggagggaggacatccggtccattgagggaaagtttggcacagggatccagtcttacttcagcttccttcgctttttggtgctcctgaacctcgtcatcttcctgataatctttatgctggtcctgctgccagtcctccttacaaaatataaaattacaaattcgtcttttgttctgatcccatttaaggatatggataaacagtgcacggtctacccagtgtcttccagcggcctgatctatttttactcctatattattgatctcttgtctggaacggggttcttggaagagacctccctcttctacggccattacaccatcgacggggtgaagttccagaactttacttacgacctccccttggcctacctgcttagcacaattgcaagtctggcgctgagcctattatggattgttaaacgcagtgtggaaggctttaaaatcaacctcatcaggagcgaggagcatttccagagttactgcaacaaaatttttgccgggtgggatttttgtattactaatcgaagtatggcggaccttaagcacagctctctgcggtatgaactgcgcgccgacctcgaggaggaacggatgcggcagaaaatcgcggagagaacttcagaggaaacaatccgcatctatagtcttagattgtttctgaattgcattgtgctggccgtacttggtgcttgcttttacgctatctacgtagcgactgtctttagtcaggagcacatgaagaaagagatcgacaaaatggtgttcggggaaaatttgtttattctttatttgccctctatcgtgattaccctggctaacttcatcacccccatgatttttgctaagatcattagatatgaggattactcccctggcttcgagattagacttactattctgcgctgtgtatttatgagacttgcaactatctgtgtgctggtgttcacgctcgggagcaagataactagctgtgatgatgacacatgtgatttgtgtggttacaatcagaagttgtacccatgctgggagactcaagtgggccaagagatgtacaagctaatgatatttgatttcatcattattctggccgtcacacttttcgttgactttccccggaagctccttgtgacttattgtagtagctgtaagttgatccagtgctgggggcagcaagagtttgcgattcccgacaacgtgctggggatcgtctacgggcagacgatttgctggatcggcgccttcttctcaccgctgcttcccgcaatagctacactcaagttcataataatattctacgtgaaagagtggagtctgctctacacttgcaggcctagcccccgcccattcagggctagcaattctaacttcttctttctgttagtgcttttgatcggtctttgccttgctatcataccccttacaattagcatctctaggattccttcatctaaggcatgcggcccgttcacaaacttcaatacaacctgggaggtgatccctaagaccgtgtctacatttccatcttctctccagagcttcattcacggcgtcaccagtgaggcatttgccgtgcccttctttatgattatatgcttgatcatgttttattttattgccctggccggcgcccataagcgggtggtgatccagctccgcgaacaattaagcctggagagccgagataaatgctatctcatacagaaactgaccgaagcccagcgcgacatgcgtaattag

SEQ ID NO: 47065 - DNA, 606 bp, Artificial Sequence
  Description of Artificial Sequence: Synthetic coding sequence
atggtgaccctggccgagctgctggtgctgctggccgccctgctggccaccgtcagcggctactttgtcagcattgacgcccacgcagaggagtgcttctttgagagggtcacttctggcactaagatgggactgatatttgaagtggcggaaggtggtttcttggacattgacgtcgagattacggggccggacaataagggcatctacaagggcgatagggagagcagcggaaaatatactttcgctgcccacatggacggaacttacaagttttgtttttctaatcggatgtccacaatgacgcctaagatagtgatgttcactatagacatcggggaggcgccgaagggccaggacatggagactgaggctcatcagaacaaactcgaagaaatgattaatgagcttgcggtggccatgaccgccgttaaacacgagcaggagtacatggaagtaagagagagaatccaccgggctattaacgacaacacaaattcacgagtggtgctctggagctttttcgaagccctggtcctggtcgccatgactctggggcaaatctattacctgaagaggttttttgaagtgagacgggttgtgtag

SEQ ID NO: 47066 - DNA, 510 bp, Artificial Sequence
  Description of Artificial Sequence: Synthetic coding sequence
atggtgaccctggccgagctgctggtgctgctggccgccctgctggctaccgttagtggttattttgtttccattgatgttgagataacaggacccgataataaggggatctataaaggtgatagagagagtagtggtaaatacacctttgccgcccatatggatggaacttacaagttttgcttcagcaaccggatgagcactatgacgcccaagatagtgatgtttactattgatatcggtgaggcacctaaggggcaggatatggaaacggaggcacatcaaaataagctcgaggaaatgattaacgagctagctgtggcgatgaccgctgttaaacatgagcaggagtacatggaggtgagggaacggatccaccgcgccattaatgataataccaacagcagggtcgtcctgtggagtttttttgaagccttagtgttagtcgcaatgactctggggcagatctactaccttaaacgattcttcgaagttaggagggtcgtgtag

SEQ ID NO: 47067 - DNA, 456 bp, Artificial Sequence
  Description of Artificial Sequence: Synthetic coding sequence
atggtgaccctggccgagctgctggtgctgctggccgccctgctggccactgtgtccggatatttcgtttccattgacgcccacgcagaagagtgtttctttgaacgggttacctctggaactaagatggggctgattttcgaggtagccgaggggggttttctcgatattgacgtggaaatcaccgggcccgataataagggtcaagatatggagaccgaggcccaccagaacaaactggaggaaatgattaatgaactcgcagtggctatgacggccgttaagcacgagcaagagtacatggaggtgagggagagaatccaccgagccatcaatgataacacaaacagcagagtggtgttatggtctttcttcgaagcccttgtgctcgtggccatgactttgggtcagatctattacctgaagcggtttttcgaagtgagaagagtcgtgtag

SEQ ID NO: 47068 - DNA, 654 bp, Artificial Sequence
  Description of Artificial Sequence: Synthetic coding sequence
atgggcagcaccgtgccccggagcgccagcgtgctgctgctgctgctcctgcttcgcagggccgaacaaccatgcggggcagaactgacctttgagctgccagacaacgctaagcagtgtttccacgaagaggttgaacagggagtgaaatttagccttgactatcaggttataacaggtgggcattatgacgttgactgttatgttgaagaccctcagggcaacactatctatcgagagaccaaaaagcagtatgactcgtttacctaccgagctgaggtgaaaggcgtctaccagttctgtttctcaaatgagttctctactttcagccataagaccgtctacttcgattttcaggttggggatgagcccccaatcctgccagatatgggtaatagggttaccgcccttacccagatggagtccgcctgtgtgacaatccatgaggcattaaagaccgttattgatagtcaaacccactaccgcctacgcgaggctcaggacagggcccgcgccgaggacctgaatagtagggtgtcttactggagcgtgggagaaaccatcgccctgttcgtggtgtcgttctcccaggtgctgctactgaagagtttcttcaccgagaagcgtccaatcagtagagccgtgcattcctag

SEQ ID NO: 47069 - DNA, 522 bp, Artificial Sequence
  Description of Artificial Sequence: Synthetic coding sequence
atgggcagcaccgtgccccggagcgccagcgtgctgctgctgctgctgttgcttcggcgcgccgagcagccctgtggcgcagaattgacatttgaactgcccgacaacgctaaacagtgctttcacgaggaagtcgagcagggggtgaaattttccctggattatcaggtcataacaggaggtcactacgatgtagactgctatgtggaagatccccagggtaacaccatttaccgcgagacaaaaaagcagtacgattcttttacctacagagcagaggtgaagggggtgtaccagttttgtttttcaaatgaattttccaccttttcccacaagactgtgtattttgactttcaggtgggggatgaaccccccattctccccgatatgggaaatagggtgacggccctgacacagagatttcggggtgcctactggaaagaggtggacaagatggtagattacatgcagcccggggggacgccagccactgagggcctggggagactggcacctagctag

SEQ ID NO: 47070 - DNA, 489 bp, Artificial Sequence
  Description of Artificial Sequence: Synthetic coding sequence
atgggcgacaagatctggctgcccttccccgtgctgctgctggccgcactcccacccgttttacttccaggggccgcaggctttacaccaagcctggacagcgactttacattcacacttcctgctggccagaaggaatgtttttaccagcctatgcccctgaaggcctccctagagatcgaataccaggtcctggacggggctggtcttgatatcgatttccatctggcttctccagagggcaagacactggtatttgaacagagaaaatccgacggtgttcacaccgtggagacagaggtcggagactacatgttctgcttcgataacacattttcaaccatctcggagaaggtgatattttttgagctcatcctagacaacatgggggagcaggcccaggagcaggaggactggaagaagtacataaccggcaccgatatactcgacatgaagctggaagacatcctcgtttctatggtgttctag

SEQ ID NO: 47071 - DNA, 690 bp, Artificial Sequence
  Description of Artificial Sequence: Synthetic coding sequence
atgggcgacaagatctggctgcccttccccgtgctgctgctggccgcactgccccccgtcctcctgccaggcgcggccggattcacaccgagcctggactccgacttcacctttaccctgcctgcgggccagaaagaatgcttctaccagcccatgcctttaaaggcctctctcgaaattgagtaccaggtacttgacggagcaggcttagacatcgattttcacctggcctcccccgaaggcaaaactttggtattcgagcagcgcaagtctgatggagtgcatacagtggaaactgaggtcggggactacatgttctgttttgataatacttttagtaccatttctgaaaaggttatattcttcgagctcatcctggacaatatgggcgaacaagcacaggaacaagaggactggaagaaatatattaccggtactgacattcttgatatgaaactggaagatattctggagagcattaactctataaaatccaggttaagtaagtctggacatatacagacattgctgagggcgtttgaggcccgcgacagaaatattcaggaaagcaattttgatagggtgaatttttggagcatggtcaaccttgtggtgatggtcgtcgtatccgccatccaggtgtacatgctcaagagcctcttcgaagataagagaaagtcgcggacgtag

SEQ ID NO: 47072 - DNA, 582 bp, Artificial Sequence
  Description of Artificial Sequence: Synthetic coding sequence
atgggcgacaagatctggctgcccttccccgtgctgctgctggccgcattgccgcccgtacttctgccaggtgccgctgggttcactcccagtctggattctgattttacattcaccctaccagcaggccagaaggagtgcttttatcagcctatgcccttgaaagcgtccctcgaaattgagtaccaggttctggacggtgcaggcctggatatcgatttccatctggcttctccagagggcaaaacattggtgtttgagcaacggaagagtgatggagtccacacagtggaaaccgaggtaggtgactacatgttctgttttgacaataccttctccaccatcagcgaaaaggtgatcttcttcgaactcatactagacaacatgggagagcaggcacaggagcaggaagactggaagaagtatatcaccggcaccgatatactggacatgaagttggaggacatcctagaccctataattaagattgcgtctgatgtgcaaatcaggctccatctgggaattcaccagcagcatcaggttcaaaccaagcaaaagtgggctcatacaaactccgcatag

SEQ ID NO: 47073 - DNA, 537 bp, Artificial Sequence
  Description of Artificial Sequence: Synthetic coding sequence
atgcccctgaaggccagcctggagatcgagtaccaggtgctggacggtgccggactggatattgactttcacttggccagtccagagggtaagaccttagtattcgaacaaaggaaatctgatggggtccatacagtggaaaccgaggttggggattatatgttttgcttcgacaatactttctccacaatttcagagaaagtcatcttcttcgaactaattcttgacaatatgggcgagcaggcccaggagcaggaagattggaagaagtacatcacggggacagatattctggatatgaagctggaagatatccttgaatccatcaattcaattaagtcccgcctgtccaagtctggacatatccagaccctgcttagagcattcgaagctagagataggaacattcaggagagtaatttcgaccgcgttaacttttggagcatggtcaatcttgtagtcatggtagtggtgtccgccatccaggtgtacatgttgaaaagcctttttgaggacaaacggaagagcaggacttag

SEQ ID NO: 47074 - DNA, 723 bp, Artificial Sequence
  Description of Artificial Sequence: Synthetic coding sequence
atgagccccctgctgttcggcgccggcctggtggtgctgaacctggtgacttccgcacgatctcaaaagactgagcccttgagtggctctggtgaccagccccttttccgaggcgcagatcgctacgattttgcaatcatgatcccccccggtgggacagaatgcttttggcagtttgcacaccagacaggatatttttatttctcgtacgaagtacagaggaccgtgggaatgtcccacgataggcacgtggcagccacagcccataatcctcagggctttttgatcgatactagtcagggggtgcggggacaaattaatttctccacacaggaaacaggcttctaccagctttgcctgtcaaaccagcacaaccactttggctcagtacaagtgtacctgaattttggcgtcttctatgagggacccgaaacagaccacaagcaaaaagaaaggaagcagttgaacgataccctggacgcgatcgaggacggcactcagaaggtgcagaacaacatttttcatatgtggagatactacaactttgctcgcatgagaaagatggcagatttcttcctcatacaatccaactataattatgtgaactggtggtctacggcacagagcttggtgattatcctgtctggcattcttcaactctactttctgaagagactgttcaacgtgccaacgaccacagacaccaagaagcccagatgctag

SEQ ID NO: 47075 - DNA, 675 bp, Artificial Sequence
  Description of Artificial Sequence: Synthetic coding sequence
atgccccggcccggcagcgcccagcggtgggccgccgtggccggccggtggggatgccggctcctggccctgttgctgctcgtaccgggcccaggaggagccagtgagattactttcgagcttcccgataacgccaagcagtgcttctacgaggatatcgctcagggcactaaatgtacgcttgagtttcaggtaattacaggaggccactacgacgtagactgtaggttggaagacccagatggaaaggtcctgtataaggaaatgaaaaaacaatacgacagtttcacgttcaccgcgagtaagaacggcacctacaagttctgctttagtaatgagttttctacatttacccataaaaccgtgtattttgactttcaggttggcgaagaccctcccctgttcccctccgagaacagggtgtccgccttgacacagatggaatccgcttgtgtgtctatccatgaagccctcaagtctgtgatcgactaccagacacacttccgccttcgcgaagcccagggtaggtccagggcagaggacttgaacacacgagtggcttactggagcgttggagaagcccttatactcctcgttgtttccattggacaggtgtttttgctgaagagtttcttttccgacaagagaactacaaccacaagggtgggcagctag

SEQ ID NO: 47076 - DNA, 249 bp, Artificial Sequence
  Description of Artificial Sequence: Synthetic coding sequence
atgccccggcccggcagcgcccagcggtgggccgccgtggccggcaggtggggctgccggctgttagccctcctattactcgtaccaggtcccggtggagcctccgagataactttcgagctccctgataacgctaagcaatgcttctatgaggacatcgcccaggggaccaaatgtaccctggaatttcaagtaattacaggaggtcattacgatgtggattgtcgcctggaagatcccgatggctag

SEQ ID NO: 47077 - DNA, 651 bp, Artificial Sequence
  Description of Artificial Sequence: Synthetic coding sequence
atgcaggccggcaagcccatcctgtacagctacttccggagcagctgctcatggagggttaggatcgccctcgcactgaagggaatcgactacgagacagtccccataaatttgattaaggacgggggtcaacagtttagtaaggattttcaggcccttaaccccatgaaacaagtgcctactctcaagattgacgggataactatccatcagtctttagccattattgaatacctcgaggagatgcgtcccaccccccgcctcctgccccaggaccccaaaaagagggcctccgttcgaatgattagtgacttgatagctggtggtattcagcctttacagaatctgtccgtgctcaaacaggtcggcgaagagatgcagcttacatgggcgcagaacgccattacgtgcggctttaacgccttggaacagatcctccagtctacggctgggatttattgcgtgggcgatgaagtaacaatggcagatttgtgtctggtaccacaggtggctaacgccgagcgatttaaagtagacctaacaccatatcctacaatttcttcaattaacaaaagactgttggtattagaggcatttcaggtctcccacccatgccgccagccagatacccctactgagctgagagcgtag

SEQ ID NO: 47078 - DNA, 708 bp, Artificial Sequence
  Description of Artificial Sequence: Synthetic coding sequence
atggccgtggagctgggcgtgctgctggtgcggccccggcccggcaccggcctcgggcgtgttatgaggaccctgttgttggtgttgtggctggcgactcgtggaagtgccctctattttcacatcggggagacagagaaaaagtgctttattgaagagattcccgatgagacgatggtgataggaaattaccgcacccagctttatgacaaacagcgggaagagtaccagcccgccaccccagggttgggaatgttcgtcgaagtgaaagatcccgaagataaagttattcttgccagacagtacggctctgaagggcgttttaccttcacatcccacacaccaggagagcaccaaatctgccttcattcgaactcaaccaaattctccctatttgccggaggaatgctaagagttcacctggatatccaggttggcgagcatgctaatgactatgctgaaatagcggccaaggataaacttagtgagctccagctccgcgtgcgccagctggtggagcaggtcgaacagatccagaaagagcagaattaccaaaggtggcgggaggaacgatttcgacagacgtctgaatccacaaatcagcgcgttctgtggtggagcatcctgcagacacttattctggtcgcaattggcgtgtggcaaatgcggcatttaaagtcctttttcgaagcaaaaaaacttgtttag

SEQ ID NO: 47079 - DNA, 822 bp, Artificial Sequence
  Description of Artificial Sequence: Synthetic coding sequence
atgatcctgaagggctgcctgctgtaccccctgtgcagcccccggaataaacagagatgcgccaggctgtggaagattgcttacgggggtctgctcaaaattgtgaccggatccctgctcactttctacgtggtgctgtgccttgatggaggcatggtgcttatgcgcaaacaagtgccttccaggtttatgtatccaaaagagtggcagcacctcaccatgtttatcctgttgactttgaatgggtgtgtagattttatgagcaagaatgtgctgccacagcggtgtgtcggcttagaaaagggaacactggtgttaattatatatgagctccttttactcatggtgagtcacgtcaaggattccgagggtgtggagttgcacgtatacagccttctgatcctcgtggtgtttctgttgctacttgttttgacagccgagctgtgggcacctaacatgtgtcacttgcagctcatggaaacatttctgatcctgatgatggggagttggctgatgcaagccggcttcatcctgtatcggcccgtatcgggctatccctggcaagacgacgacatttccgatattatgttcgtaacaacctttttttgctggcatgtgatgattaatgcgtcttttctgctcgggatttacgggttttcgagtttttggtaccactgcttcagaccaagtctcaaactcacgggacccaaagaagcaccatactatgccagcaccccgggcccattatacaagttactacaggaagtggagcagagcgagaaggaagatcaagcgctccttctacccaagtcttccccctag

SEQ ID NO: 47080 - DNA, 1338 bp, Artificial Sequence
  Description of Artificial Sequence: Synthetic coding sequence
atgaacgagagcccccagaccaacgagttcaagggcaccaccgaggaggctccggccaaagagagcccccacacatccgagtttaagggcgccgccctggtcagcccgatttccaagcgtattttcggcgtgttcctggtcctgctggacgttaccctgctcctggccgatttgatcttcactgatagcaaactgtatatccctctcgagtataggagcatctccttagcaattggcctctttttcttgatggatgtgctcttgagagtttttgttgagggatggacccaccttgtcagactgctccggctgataatcttgattcggatctttcacctgttgcaccagaaacggcagctggagaaacttatgcgtcggctggtaagtgagaataagcggagatatacacgcgacggatttgacctcgatcttacatacgtgactgaaaggatcattgctatgtcctttccctcctccggacgacaatccttctatcggaatccaatagaggaggtcgtgagattcctggacaaaaaacatcggaatcattaccgcgtttacaatctgtgctctgaaagagcttacgacccaaaacacttccacaaccgcgtttcgagaatcatgattgacgatcacaatgtgccaactctgcacgaaatggtggtattcacgaaggaggtgaatgaatggatggcacaggatctggaaaatatagtggccatacactgtaaagggggaaaaggtcggactggtacgatggtgtgtgcgctacttatagcctctgagatcttcctaaccgcagaggagtccctatactacttcggcgaacgccgaactaataagacccacagtaacaaattccagggtgtagagaccccttcccaaaatcgctatgtggggtactttgcgcaggtaaaacacttgtataactggaatctgcccccacgaagaatactttttattaagcgctttattatatactctatccgcggggacgtctgcgacttgaaagtccaggtggtgatggagaaaaaagtggtgttctcaagcactagcttagggaactgctccatcctccatgacattgaaactgataagatattgatcaatgtctatgacgggccccccctgtacgatgatgtcaaggtacagttcttctcatccaatctccccaagtattatgataactgccctttcttcttttggttcaatacttccttcatccagaacaacagactctgtttacccaggaacgaactggacaaccctcataagcagaaagcatggaagatttacccacctgaattcgcagtggagattctgttcggcgaaaagtag

SEQ ID NO: 47081 - DNA, 1467 bp, Artificial Sequence
  Description of Artificial Sequence: Synthetic coding sequence
atgaacaccagcccccagaccaacgagttcaagggcaccaccgaggaagctcccgccaaagaatctccgcacacttctgaattcaagggagccgccctcgtgtccccgattagcaaatctatgctggagcgtctcagtaagtttgaagtagaagacgctgaaaatgtcgcgagctacgactccaagattaaaaaaattgttcattcaatcgtgtcctcttttgcattcggcatctttggcgtatttctggttcttttggatgtaacactgctgctcgctgatcttatctttaccgattctaagctgtacataccattagaatatcgttccatctcactggccatcggccttttctttctgatggacgtgctactaagggttttcgtggagggtcgacagcagtatttctccgatctgttcaacatcctggatactgccatcatcgtgatacccctcctggtagatgttatctatatattcttcgacatcaaactccttcgaaatatccctcgatggacgcacttagtgcggctactgcgcctcatcatactcatacgcatcttccatctgctccatcagaaacggcagcttgagaagctgatgagacgcctggtctcagaaaataagcggcgctacacacgggatgggttcgacctcgatctgacatacgtgaccgagcggatcatcgcaatgtcctttccctcgagcggaaggcaaagcttctaccggaacccaatcgaagaggtggtgcggttcttagacaagaagcatagaaaccactatcgggtgtataacctgtgctccgaaagagcctacgatcccaagcattttcacaatagggtgtcaaggattatgatcgatgatcacaacgtgcctacgctccacgaaatggtcgtatttacaaaagaggtgaatgagtggatggcacaggatttggagaatattgtagctattcattgtaaaggtggcaaagggagaacagggaccatggtttgtgcactgctgattgccagtgagatatttctgacagctgaggagagcctttactatttcggagagaggagaacaaacaaaacacattctaataaattccagggtgtggaaactcctagccaaaaccggtatgtgggctacttcgctcaggtgaaacacttatataattggaatttgccacctaggcgtatcttattcatcaagcgcttcatcatttactcaatccgtggagacgtgtgtgaccttaaagtccaggttgttatggaaaagaaagtggtcttttccagcacctcgctagggaattgttccattctgcacgacatagagacagataaaattctaataaacgtctatgacggccctcctctctatgacgatgtcaaggtgcagtttttcagcagcagagctgaaaaacgcgccgcacaccgggccaattggaaaggagagccaagtcgacgacccgtactagactag

SEQ ID NO: 47082 - DNA, 1449 bp, Artificial Sequence
  Description of Artificial Sequence: Synthetic coding sequence
atgaacgagagcccccagaccaacgagttcaagggcaccaccgaggaagctcctgctaaggagtcgcctcatacctcagagttcaaaggcgccgcgttggtctcgccaattagcaagtcaatgctggagaggttgtccaagtttgaagttgaagacgctgagaatgtggccagctacgattccaagatcaaaaaaattgtgcacagtatagtctcaagcttcgcatttggcatcttcggggttttcttggtcctcctcgatgtgactctcttgttggctgacctgatcttcactgactcgaagctctacatccccctggagtaccgcagtatctctctcgcaatcggtctattctttctgatggatgttctactcagagtgttcgtcgaagggtggacccacttagttcggctgttgcgactgattattctgatccgcattttccatctgctgcatcagaagcgacagcttgaaaaactgatgcgacggttagtgtccgagaacaagcgacgctatacaagagatggatttgatctggatttgacctacgtgacggagcgcatcatcgccatgagctttcctagctcaggtcggcagagtttttatcggaaccccatagaggaggtagtgcgcttcctggataagaagcaccgtaatcattatcgcgtgtataatctctgtagtgaaagggcctacgatccgaaacacttccataacagagttagtaggattatgattgatgatcacaatgtgcccactctgcatgaaatggttgtgtttaccaaggaagtcaatgaatggatggcccaagatctcgagaacatagtggctatccactgtaagggcggtaaaggccgtactggaacaatggtgtgcgctttgctgatcgctagtgaaatcttcctgacagccgaagagtccctgtactacttcggcgaaaggagaaccaataagacgcacagtaacaagttccagggtgtggagacaccttcccagaatcgttatgtaggctatttcgctcaagtgaagcatctctataactggaacttaccgcctcgaagaattctctttataaagaggttcatcatatactccatccgaggggatgtctgcgacttgaaggtccaagtggtcatggagaagaaggtggttttttcttccacatctctgggaaactgctccattctacatgatattgaaacagacaagatcttgattaatgtttacgatgggccacctttgtatgatgatgtgaaagtgcaattttttagctccaacctgcccaagtattacgacaattgtcccttctttttctggtttaatacgtccttcattcagaataacaggctatgcctcccacgaaacgaactggataacccgcataaacagaaggcatggaaaatctatcctcccgaattcgcggttgagatcttatttggggaaaagtag

SEQ ID NO: 47083 - DNA, 1569 bp, Artificial Sequence
  Description of Artificial Sequence: Synthetic coding sequence
atgaacgagagcccccagaccaacgagttcaagggcaccaccgaggaggcaccggcaaaagagtccccgcacacatctgaattcaagggggccgcactggtgagtcctatctccaagtccatgctggaaagactgtcgaagtttgaggttgaggacgccgaaaatgtggcatcttacgactctaaaattaagaagatcgtgcacagtattgtgtcgtcttttgcatttgggatcttcggcgtctttctcgtgctactggatgttaccctgctgcttgcagacttgattttcaccgatagcaaattgtatatacccctggaatatcgcagcatctccctcgcaattggccttttcttcctgatggacgtcctcttaagggtcttcgtcgagggtagacaacagtactttagcgatctgttcaatattcttgacacggccatcatagttatccctctgcttgttgatgtaatttacattttctttgacattaaattgctccgcaacatcccccgctggacccatctggtaagattgctgcgtcttattatcctgatccgcatttttcacctgctgcatcagaaacgacagttggagaagcttatgaggaggctcgtctccgagaacaagcgccgctacactcgggacggcttcgatctggatctgacttacgtaacagagcggatcattgcaatgagctttccctccagcggcaggcaatccttttaccggaatcccatcgaagaggtggtaagattcctggataagaagcacagaaaccattacagagtgtataatttgtgcagcgagagggcctacgaccctaaacattttcataacagagtgagtcgcataatgattgatgaccacaacgttccaacactgcacgaaatggttgtgttcaccaaggaagtgaacgagtggatggcccaggaccttgagaacatagtagcaattcattgcaaagggggcaagggacggacagggaccatggtgtgtgcactgctgatagcgagcgagatcttcctgacagccgaagagagtttgtattatttcggcgagagaagaactaacaagacccattctaataaattccagggggtggaaacccccagccagaataggtacgttggctatttcgcccaggtgaaacatctgtataactggaacctgcctcctagacgcatcttgtttattaaacggttcataatctattcgatcaggggcgatgtttgcgatctgaaagttcaagttgtcatggaaaagaaagtggtgttctcctcaaccagtcttggaaattgtagcatcttgcacgatattgagacagataagatccttataaacgtctacgacggccctcctttatatgatgacgttaaagttcagttttttagctctaatctgcctaaatactacgataattgccccttctttttctggtttaacacttcttttatccagaacaacagactctgcttaccaaggaacgaattggataatccccacaaacaaaaagcttggaaaatatacccgccggagttcgccgttgagatactcttcggtgagaagtag

SEQ ID NO: 47084 - DNA, 1338 bp, Artificial Sequence
  Description of Artificial Sequence: Synthetic coding sequence
atgaacgagagcccccagaccaacgagttcaagggcaccaccgaggaagctccggcaaaggagtcgcctcacacttccgaattcaaaggagctgccctggtgagccctatatctaagaggatattcggagtgtttctggtgttgcttgatgtcactttattactggccgacttgattttcacagattccaagctctacatacctctcgagtaccggagcataagcctcgctatcggcctcttctttctgatggatgtactcttaagagtgttcgtggagggatggactcacctcgtgaggctgctcagattgattatactgattcgcatttttcacctgctgcatcagaagcggcagctggaaaaactgatgagaaggcttgtgtcagagaacaaacggaggtatacccgggacgggtttgatctggatcttacatacgtgacagaacgtatcatcgcaatgtcttttcctagcagcggtagacagtcattttacagaaacccaatcgaagaagttgtgcgatttctcgataaaaaacatagaaaccattacagggtctataatctgtgttcggagagggcctacgacccaaagcatttccacaatcgggtctcgcggattatgatcgatgaccacaacgtgcccactttacatgagatggtcgttttcaccaaggaggtcaatgaatggatggcccaggacctcgagaatatcgtcgccattcattgcaaaggaggtaaagggcgcaccggaacgatggtttgtgctcttttaattgctagcgaaatttttctgaccgctgaggagagcctctattacttcggcgaaaggcgaacgaacaagacacattccaacaaattccagggtgtggaaacgccatcccagaaccgatacgtgggttatttcgcacaagtaaagcatctctataattggaatttaccgcctcgtcggattctgtttatcaagcggttcattatatactctattcgtggtgatgtgtgcgacctcaaagtgcaggtggtgatggagaaaaaggtggtgttttcttctacctcccttggcaattgctcaatcttgcatgatatcgaaaccgataagatattgataaatgtttacgacggaccccccctgtacgacgatgtgaaagtacagttctttagcagcaacctgcccaagtactacgacaattgtccgttcttcttttggtttaacactagctttatccagaacaaccggctctgtctgccaaggaatgagttggacaatcctcacaagcaaaaagcctggaagatatatccacctgagtttgccgttgaaatcctttttggagagaagtag

SEQ ID NO: 47085 - DNA, 1236 bp, Artificial Sequence
  Description of Artificial Sequence: Synthetic coding sequence
atgaacgagagcccccagaccaacgagttcaagggcaccaccgaggaagcacccgccaaagaatccccacacactagcgagtttaagggagcggccctggtgtcaccaataagcaagagcatgctggagcgtctgtctaagttcgaagtcgaggacgctgaaaatgtcgcgtcttacgaatggactcacctggtaaggctacttagactgatcattcttattcgtatattccacttactacaccagaaaaggcagttggagaagctcatgaggcggcttgtgtctgaaaacaaacgcagatataccagggatggctttgacttggatctaacttacgtgaccgagcgcattatcgctatgagctttccctctagcggacggcagtcattctaccgaaatcccatcgaggaggttgtgcgctttcttgataaaaaacataggaaccactacagagtttataacttatgctcagaacgagcctatgatcctaaacattttcataaccgggtcagccgcataatgatcgacgaccataacgtccctactctccatgaaatggtcgtgtttacgaaggaagtcaatgagtggatggcccaggatctcgagaatatcgtagctatccattgcaagggcgggaaggggaggacagggaccatggtttgtgccctgctcatagcatcagaaattttcctgacggccgaagaaagcctttactattttggagaaaggcgaacaaacaaaacacattcaaataagttccaaggagtcgaaacaccgtcccagaaccgctatgttgggtattttgcacaggtgaaacatctgtataattggaatctgccccctcggaggatccttttcattaagagatttattatttatagcatccggggagacgtgtgtgacctaaaggtccaagtcgtaatggagaagaaagtggtcttcagcagcacctcactgggcaactgcagtattcttcacgacattgagactgacaagatcctcatcaacgtctacgacggaccccccctttacgatgatgtaaaagtgcagtttttctcctccaatttacccaaatactacgacaattgccccttcttcttctggttcaatactagtttcatccagaataacagattatgtcttccgagaaacgaactggacaatcctcataagcagaaagcctggaagatctacccccccgagttcgcagtggagatactgtttggggagaagtag

SEQ ID NO: 47086 - DNA, 1569 bp, Artificial Sequence
  Description of Artificial Sequence: Synthetic coding sequence
atgaacgagagcccccagaccaacgagttcaagggcaccaccgaggaggcccctgccaaagagtctcctcacaccagcgagttcaagggtgctgccctggtgagccccatcagtaaaagcatgctagagcgcctctccaaattcgaagtggaggacgccgaaaacgtggctagctacgacagtaagataaagaagatcgtgcactctattgttagtagcttcgccttcggcatttttggcgtattcctggtgctcttagacgtgacactgttactggctgatctcattttcacagattccaaattatatattccactggagtaccggtccatatctctcgccattggactctttttcctgatggacgtcctgttaagggttttcgtggagggaaggcagcaatacttttccgacctcttcaatatcctggacaccgccatcatcgtgatcccacttctggtcgacgtgatctacattttcttcgatatcaagcttttgagaaatatcccacgatggacccacttggtacgcctgctccgtctgataatccttataagaatctttcatctcttacaccagaagaggcagctagaaaaactgatgcgtagactggtttccgagaataaacgccgatacactagagatggcttcgatctggacctgacttacgttactgaacggattatagcaatgtctttcccttccagcggacggcagagtttttaccgcaaccctattgaagaagtagtccgcttcttggacaagaaacaccggaaccactatagagtctacaatttgtgttcagagcgggcctacgacccgaagcactttcacaatagggtgtctcgcattatgattgacgatcataacgtcccaacgctgcacgagatggtggtgtttactaaagaggtgaatgagtggatggcccaggatttggaaaacatcgttgccatacactgcaaaggcggaaaagggagaaccgggaccatggtttgtgcattgctaatagcaagcgagatctttctgacggccgaggagtcactgtactactttggcgagcgccggaccaataagactcattcaaataagttccaaggggtcgaaaccccttctcagaaccggtacgtgggctactttgcgcaggtgaaacacctctataattggaacctaccccctcggcgcatactgtttattaaacggttcatcatttatagcattcgcggcgacgtatgcgatctcaaagtacaggtcgtgatggagaagaaagttgtgttcagttcgacgtccctaggaaattgttccattcttcatgacatcgaaacagacaaaatactgataaatgtttacgacggccctccactctatgatgatgtcaaggtgcagtttttctcatccaatctgccgaagtattacgataattgcccctttttcttctggttcaacacgtcattcattcagaataaccgcctgtgcctgcctcgcaatgagctagacaatccccataaacagaaggcttggaagatctatcctcccgagttcgccgttgagatactgtttggcgagaaatag

SEQ ID NO: 47087 - DNA, 975 bp, Artificial Sequence
  Description of Artificial Sequence: Synthetic coding sequence
atgaacgagagcccccagaccaacgagttcaagggcaccaccgaggaggcccctgctaaagagagtccacatacaagcgaatttaagggcgccgcgcttgttagcccaatttcaaagagatggacacatctcgtgagactcctgagattgataatcctcattcgcatatttcacctactccaccagaaaagacaacttgagaagttgatgagacgcctggtcagtgagaacaagagaaggtacaccagagacgggttcgacctggatcttacctacgtgactgagcgaataatagccatgtcattcccatccagcggcaggcagtcattttacagaaatcctattgaggaggtcgttcgtttcctggataagaagcatcgtaatcattatagagtctacaatctatgttccgagcgagcctacgatccgaaacattttcataaccgagtgagtcgcatcatgattgacgaccataatgtgcccactctgcatgaaatggttgtgtttactaaagaagtcaacgagtggatggcccaggaccttgaaaatatcgtggctattcactgtaaaggcggcaaaggccggaccggcaccatggtctgcgcacttttgattgcctccgaaatcttcctgaccgccgaggagtctctgtactattttggcgaacgacggacaaacaagacccactcgaataagttccagggcgtggagacaccctcacagaatcggtacgtcgggtattttgcccaagtcaagcatctgtacaattggaatctacctcccaggagaatactgttcattaaaaggtttatcatttatagtattcgcggcgacgtctgcgatctcaaggtgcaggtggtgatggagaaaaaagtcgtgttctctagcacaagcctgggaaattgctcaagggaagaaggctcaactagggcgaattggaagggggaacctagtcggcgccccgtgctggattag

SEQ ID NO: 47088 - DNA, 1236 bp, Artificial Sequence
  Description of Artificial Sequence: Synthetic coding sequence
atgaacgagagcccccagaccaacgagttcaagggcaccaccgaggaagcccctgctaaggaatcaccacataccagtgagtttaagggcgctgctctcgtgtcccccatttcaaagagtatgctggaaaggctctctaaattcgaggtggaggacgccgagaacgtcgcttcttatgaatggacccacttggtcagactgttgcggctcataattttgatccgcatctttcatcttctccatcaaaagcgccagctcgaaaagctcatgcggcggcttgttagcgagaacaagagaaggtacacccgggacggcttcgacctggacctgacctacgtcaccgaacgaatcatcgcaatgtcctttccgtcttcagggcgtcagtctttctacaggaacccgattgaagaagtggttaggtttctggacaagaagcaccggaaccactatcgcgtatataatctatgcagcgagcgcgcttatgaccccaaacatttccacaatcgcgtgtccagaattatgattgacgaccataacgtcccaacactgcacgagatggtagtgttcaccaaggaggtgaatgagtggatggcccaggacctcgaaaatattgtggctatacactgcaagggaggcaaaggacggaccggcaccatggtgtgtgccttgttaatcgcatctgaaattttcctcaccgccgaagaaagtctatactacttcggcgaaaggagaacaaacaaaactcattccaataagtttcaaggcgtggaaacgccatctcagaacaggtatgttggttacttcgcccaggtgaaacatctgtacaattggaatttacccccccgcaggatcttatttatcaagagattcattatctactccatcagaggtgacgtgtgcgatttaaaagttcaggtcgtgatggagaagaaagtggtgttctccagcacaagcttgggcaattgtagtatcttacacgacatagagacggacaagattttaataaacgtatatgacggcccgccactgtatgatgatgttaaggttcagtttttttcctcaaaccttcctaagtattacgacaattgtcccttttttttttggttcaacacgagctttatccagaacaaccgcttgtgcctgcccaggaatgagctggataatcctcataagcagaaggcctggaaaatctatccccccgaattcgctgtcgagatcttgttcggggagaagtag

SEQ ID NO: 47089 - DNA, 1257 bp, Artificial Sequence
  Description of Artificial Sequence: Synthetic coding sequence
atgtaccggcccgcccgggtgaccagcaccagccggttcctgaacccttatgttgtatgttttatcgttgtggctggcgtagtgatcctggccgtcacaatcgccctccttgtttatttccttgcatttgaccagaagagctacttctatcgctcatctttccagctgctcaacgtggagtataactcccagttaaatagtcccgcaacccaagagtataggactttatctgggaggattgagagcttgatcacaaaaacattcaaggaaagcaatctgcggaaccagtttatccgggcacacgttgctaagctgcggcaagatggctcaggtgttagggccgacgtggttatgaagtttcaattcacacgcaataataatggagcttcaatgaaatcgcggattgagtcagtccttcgccagatgctgaataactcaggcaatctagaaatcaatccttctacggagattacgagtctgacggatcaggcagccgctaattggctcatcaatgagtgtggggccgggccagatctgataacgttgtctgaacagagaatactgggggggacggaggctgaagaaggctcctggccatggcaggtaagcctcagacttaataatgcccaccactgtggcggaagtctgattaataatatgtggattctcacagccgcccactgtttccgcagtaacagcaacccacgggattggatcgccacatccggcatctctactacattccctaagctgcggatgagagtccggaacatcttaatccataataactataaatcagccacacacgaaaatgatattgccctcgttagactggagaacagtgtgacattcacaaaggacattcattccgtgtgtctaccagcagccacccagaacattccccccggcagcaccgcttacgtgactgggtggggcgcacaggaatacgccggacacacggtgcccgaactaaggcagggtcaggtgcgtatcatttcaaacgacgtgtgcaacgccccacacagctacaacggggccattctttcaggcatgctttgtgcaggggtgcctcaaggtggcgttgatgcttgccagggcgattctggtgggccacttgttcaggaggactctcggcgcttatggttcattgtcggaatagttagctggggggaccagtgtggactgcccgacaagcctggcgtgtataccagggtgactgcctatctggattggatccggcagcagaccggcatttag

SEQ ID NO: 47090 - DNA, 906 bp, Artificial Sequence
  Description of Artificial Sequence: Synthetic coding sequence
atgaagttccagttcacccggaacaacaacggcgccagcatgaagagtagaattgagtcggtgctgcgccaaatgctaaataattctggcaacctggagatcaaccccagcaccgaaatcactagtctgaccgaccaggccgccgccaattggcttattaacgaatgtggggccggccccgacctgataaccttgtctgagcagaggatccttgggggcactgaagccgaagaaggtagttggccctggcaggtatctctgcgtctgaacaacgcccaccactgtggaggttcccttattaataacatgtggattcttacagccgcacactgtttcagatctaacagtaatccccgggactggatcgcaacatcaggcatatccacgactttccccaaactgagaatgcgggtgaggaacattctgatccataataactataaatccgccacccacgagaatgatattgccttagtgcgcctcgagaattccgtgacattcacgaaagacatccactccgtgtgtttacccgccgctactcagaacatccctcccggttctacggcatacgttactggatggggagctcaagagtacgccggccataccgttccagagttgcgccagggccaggtccggatcatatcgaatgatgtttgtaacgcacctcattcctataatggtgccatactctccggaatgttatgtgcaggtgttccccagggcggggtcgacgcctgtcagggcgactctggcggtccactggtgcaagaggattcccggcggctgtggttcatagtggggattgttagttggggagaccaatgcggacttcccgacaaaccaggggtgtacaccagagtcaccgcttatttagattggattcgacagcagacggggatctag

SEQ ID NO: 47091 - DNA, 3060 bp, Artificial Sequence
  Description of Artificial Sequence: Synthetic coding sequence
atgggcagcaagcggggcatcagcagccggcaccacagcctgagcagttatgagattatgttcgccgccctttttgctatactcgtcgtgctatgtgcaggactcattgcagtttcctgcctgactattaaggagtcccagcggggggccgccctgggacagtcgcacgaggctcgcgccactttcaaaatcacgagcggggtaacttacaatcctaatcttcaagataagctctccgtggacttcaaagtcctcgccttcgatcttcaacagatgattgacgaaatcttcctgtcttccaatctgaaaaacgagtataaaaatagtagggtccttcagtttgagaatggttcgattatcgttgtgttcgatctgtttttcgcacagtgggtttcagatgaaaatgtgaaggaggagctaatacaggggctcgaggccaataaatcaagccagctcgtgacctttcatatcgatctgaattccgtagatattctcgacaagcttaccactacttctcatctcgccactccggggaatgtgtctatcgagtgtctgcccggcagttctccttgtaccgatgcactgacgtgcattaaggccgatctgttctgcgatggagaggttaactgcccggacggcagtgatgaagacaacaaaatgtgcgccacagtgtgcgacggccgttttttgcttacaggcagctctggcagcttccaagcaacacactatcctaaaccaagcgagacaagtgtggtttgccagtggatcattagagtaaatcaggggctgagcatcaaactgtcttttgatgacttcaacacatattatacggacattcttgatatatatgagggcgtcggttcttcgaagatcctgagggcttccatatgggaaaccaatcccggcacaattagaattttcagcaatcaagtcaccgcaaccttcctcattgaaagtgatgagagcgattatgtcggtttcaatgccacttatacagcttttaactcaagcgagttgaacaattacgagaagatcaattgcaacttcgaggacgggttctgtttctgggtccaggatctgaatgacgacaacgagtgggagcgaatccagggatctaccttctccccctttaccggacctaattttgaccatactttcggaaacgcatccggcttctacatctctaccccgacaggcccgggaggccggcaggagagagtcggactcctctcactgccactggatccaaccctggaacccgcctgtctcagcttctggtaccacatgtatggagagaatgttcacaagttgagtattaatatttctaacgaccagaacatggagaaaactgtgttccagaaggaggggaattatggggataactggaactacgggcaagtgacgctgaacgagacagtcaaattcaaggtggccttcaacgcattcaagaataagatcttatcagatattgcactggatgatatatccctcacatatggcatttgtaatggatcactttacccagagcccacgctggtgcccacgcccccacctgagctacctaccgactgcggaggcccgttcgagctgtgggaacccaacaccacgttctcaagcaccaacttcccaaattcctatcctaatcttgctttctgtgtgtggattctcaatgcacaaaaagggaaaaacattcagttgcactttcaagaatttgacttagaaaacataaatgatgtggtcgagatccgcgacggcgaggaggctgactctctcctactggcagtctatacaggccccggccctgtgaaagatgtttttagcactactaatagaatgacggtgctgctcattactaacgacgtgctggctagaggcggattcaaggccaactttactactggttatcaccttggaattcccgaaccttgtaaggccgaccattttcaatgcaaaaacggtgagtgcgtgccactggtgaacctctgtgatggacaccttcactgtgaagacgggtcagacgaagccgactgtgtgcggttcttcaacgggacgacaaataacaatggacttgttcgtttccggattcagagtatttggcatactgcctgtgccgagaactggaccactcaaataagtaatgacgtatgccagctactaggcctcggcagcggcaactccagcaagccaatcttccctaccgatggcggaccttttgtgaaattaaatacagcacccgacggacacctgatccttaccccctcacagcaatgtctgcaggattccctgatacgccttcagtgtaaccacaaatcttgtggaaagaaactggccgcccaagacatcacccccaagattgtgggcggctccaacgccaaagaaggggcttggccttgggtcgtaggactatactacggagggcggttgctctgcggagcctcactggtcagctctgactggcttgtttccgcagcacactgtgtatatgggaggaacctggagcctagcaagtggaccgctatcttaggcctgcacatgaagtccaatctgacgtcaccccagactgtcccacggctcatcgatgaaatcgtcatcaaccctcactacaaccgtcgacgtaaggataacgacatagcaatgatgcacctcgaattcaaggtgaattatactgattacattcagcccatatgccttccggaagagaatcaggtgttccctcccggacggaactgctcaattgctggatgggggaccgtcgtttaccagggcacgactgcgaacattctgcaagaggctgacgtccctctactgagcaacgagcggtgccagcagcagatgccagaatacaatatcaccgagaatatgatctgcgccggatatgaggaaggaggaatagacagttgccagggcgattccggaggtcccctaatgtgtcaggaaaacaataggtggttccttgcaggggtcacatccttcggctacaaatgcgcccttccaaaccggccgggggtctacgctcgcgtgagcaggttcactgagtggatccagagttttctacattag

SEQ ID NO: 47092 - DNA, 2154 bp, Artificial Sequence
  Description of Artificial Sequence: Synthetic coding sequence
atgttccggatcaccaacatcgagttcctgcccgagtaccggcagaaggaatccagagaatttctgagcgttagccgcactgtacagcaggtaatcaacctggtatatactacctctgccttcagcaagttttacgaacaatccgttgttgctgatgtcagcaataataagggcggccttttggttcatttctggattgtgttcgtaatgccacgagcaaagggccatatattctgtgaggactgtgtagccgcgatccttaaggactcaatccagacatctattatcaacaggacgagtgtaggttcgctacagggactggccgtagatatggattccgtggtcctgaacgacaagggatgttcccagtatttttacgccgaacacctgagccttcactaccccttagagatcagtgctgctagtggtaggctgatgtgccactttaaacttgtagcgatagtgggatacctcattagacttagtataaagtccattcagatcgaagcagataactgcgtgaccgatagcctcacaatctacgactccctgttacctatccgtagcagtatcctttaccgaatttgcgaacccactagaacccttatgtcctttgtgtcgactaataatctgatgcttgtcaccttcaagtccccgcatataaggaggttaagcggcattcgggcttacttcgaagtcattcctgagcagaaatgcgaaaatacagtcttggtgaaagatatcacaggctttgaggggaaaattagcagcccctattaccccagttactatccgccaaagtgcaaatgtacatggaagttccagacctcactgtccactttggggatcgccctcaaattttataactactccatcactaaaaagtcgatgaagggatgcgaacatggatggtgggagataaatgaacacatgtattgcggtagttatatggatcaccagactatcttcagggtgccttcccccttagtacacatacagctccagtgttcaagtcgcttgtctgataaacctttgttggcagaatacggaagctataacatcagccagccctgccctgtgggatcattccggtgctcttctggcctgtgcgttcctcaggcccaacgctgtgatggggttaacgattgctttgatgagtccgacgagctgttctgcgtcagccctcagccagcgtgcaacactagcagctttcggcagcacggcccacttatttgtgatgggtttcgggactgtgagaacgggagggacgagcagaactgtacccagtccatcccatgcaacaataggacatttaagtgcgggaacgatatctgttttcgaaagcaaaatgccaagtgcgacggtactgtcgattgccctgacggcagcgatgaagagggctgtacatgcagcaggtcctccagcgccctgcaccggataataggaggcaccgatactctggagggaggatggccttggcaggttagccttcactttgtggggagcgcctactgcggggccagcgtcattagcagggagtggctgctatccgccgcccattgttttcacggcaaccgtctaagcgatcccaccccctggaccgcacacctcggtatgtacgtgcagggcaatgctaagttcgtgagcccagtccgcagaattgtggtgcacgagtactataatagccagacatttgactacgatatagcgctattgcaactgtcaatcgcatggcccgagaccttaaaacagctgatccaacctatctgcattcctcctaccgggcagcgagttcgatcaggggaaaagtgttgggttacaggctggggtagaaggcacgaagcagataataaaggttctctggtgcttcaacaagctgaggttgaattgatcgaccaaacactgtgtgtctctacctatgggattattacatctagaatgctgtgtgcgggcattatgtcaggcaaaagggacgcctgcaaaggcgacagtggtgggccattaagttgccgcaggaaatccgacggaaaatggatactcactggaatcgtctcctgggggcacggcagtgggcgccccaattttccaggggtgtacactcgcgtctctaacttcgtaccatggattcacaaatacgttcccagcctattgtag

SEQ ID NO: 47093 - DNA, 2454 bp, Artificial Sequence
  Description of Artificial Sequence: Synthetic coding sequence
atggacaaggagaacagcgacgtgagcgccgcccccgccgacctgaaaatctccaacatcagtgtgcaggtcgtcagcgcccaaaaaaaacttccacccggtcgccgccccccccagcgacctatcggcaaggccaagcctaaaaaacaatctaaaaaaaaagtgcccttctggaacgttcagaacaagattattctgtttacagtgttcctgttcattctggccgtgatagcttggacactgctctggttatatattagtaagaccgaaagcaaggatgctttttactttgcaggcatgttcaggattacaaatatcgaatttttacccgagtacaggcagaaggagagcagggagtttctatcagtgagtaggacagtccaacaggttatcaacctcgtctacaccacatcggccttttcaaagttctacgagcaaagcgtggtcgccgatgtgagttcgaataataagggaggtttattggtgcacttttggattgtttttgtgatgccccgggccaaaggtcacatcttctgcgaggactgcgtggctgccatactgaaggatagcattcagacatctatcattaatcgaacctccgtgggcagcctacagggcttagccgtggacatggactccgtggtactcaacgacaaagggtgttcgcagtacttttacgccgagcacctgagcttgcactatccattggaaatctcagctgctagcggccgcctcatgtgtcactttaagctggtcgctattgtggggtacctcatcaggctctcaataaagtcgatacagattgaagccgataactgcgtcactgattcactcactatttacgactccctgctgccaattcgttccagtattctctaccgtatttgcgaacccactaggaccctgatgtcattcgtatcaacaaataatctgatgttggtgacgttcaagagcccccacataagacgtctttcagggattcgcgcttactttgaagtcataccggagcaaaagtgtgaaaacaccgtgctcgtcaaagacattactgggtttgagggtaagatttcttctccctactatccttcatattatccgcccaaatgtaaatgtacctggaagtttcaaactagcctctcaacccttgggatcgctcttaagttttataattattctatcacgaaaaagagtatgaaaggatgtgagcatggatggtgggagatcaatgagcacatgtattgcgggagttacatggatcaccaaactatctttcgagttccatcccccctggtgcatatccagctccagtgcagtagtcggctcagtgacaagcccctgcttgcagaatacggtagctacaacatttcacagccgtgccccgtgggcagtttccggtgtagcagtggcctgtgcgtcccacaggcacaaagatgtgatggcgtcaacgattgtttcgatgagtccgatgagctgttctgtgtgagtccccaacccgcatgtaacacttcctccttccgccaacacggccccctgatttgtgacggttttcgcgactgcgagaacggccgcgacgaacagaactgcacccagtccattccgtgtaataaccgcactttcaagtgtgggaacgacatctgttttaggaagcagaacgcgaagtgcgatgggaccgtggattgccctgatgggagcgacgaagagggttgtacctgttcacggtcttcctccgcgctgcatcgtatcatcggcggaactgacaccctagagggaggatggccttggcaggtgtcacttcactttgtgggctctgcctactgtggggcgagcgtgatttcacgcgagtggctgctcagcgcagcacattgctttcacggtaaccggttgtcggacccaactccttggactgctcacttaggaatgtacgtccagggaaatgcaaaattcgtaagccctgtgaggcggattgttgtgcacgagtactacaatagccagacattcgattacgatatagctcttctacagttgagtattgcatggcccgaaaccctgaaacagctcatccagcctatctgtatcccacccaccggacagagggtgcggtcaggcgagaaatgctgggttacgggctggggccgccgccatgaggccgacaacaaaggatcacttgtcctgcagcaagcagaggtcgagctgatagatcaaacgctttgcgtttcgacctacggcattattaccagtcggatgctgtgtgccggaataatgagtgggaagcgtgatgcctgcaagggagatagcggagggcccctgtcttgtaggagaaagtccgacgggaagtggattctcactggaatagtcagttgggggcacgggtcagggaggcccaactttccaggggtctataccagggtcagcaactttgtgccctggatccacaagtacgtgccctctctactgtag

SEQ ID NO: 47094 - DNA, 2496 bp, Artificial Sequence
  Description of Artificial Sequence: Synthetic coding sequence
atggacaaggagaacagcgacgtgagcgccgcccccgccgacctgaagatctccaatatcagtgtgcaagttgtcagcgcccagaagaagttgcctcccgggcggagacccccacaaaggccgataggcaaggctaaacctaaaaagcagtccaagaagaaggtgcctttctggaacgtgcagaacaagatcatcctgtttacagtgttcctattcattctggctgtgatagcttggacactgctgtggctatacatctccaagactgaatctaaggatgccttctattttgccggcatgtttcggatcacaaatattgagttccttcctgaataccgccagaaggagtctagggaatttctgtccgtaagccgcacagtgcagcaggtcatcaatcttgtatacaccacctcagcattctcaaaattttacgagcaaagcgtcgtggccgacgtgtctagcaataacaaggggggcctgcttgtacacttctggatcgtgtttgtaatgcccagagccaaaggacacatattctgtgaagattgtgtggccgcaatcctgaaagatagtatccagacctccatcatcaatcgcacatctgtgggctccctccagggactcgccgtggatatggactccgtggttaacgccgcaggcctacgcagcgactactcgagcacaataggcagcgccgacaaagggtgttcacagtacttctatgcggagcacctgagcctccattacccactggagatcagcgccgctagcggaaggctgatgtgccatttcaaattagtggctattgtggggtacctcatccgtctttcaattaagagtatccagattgaagctgacaactgtgtgacggattcgctcacaatttacgactctctgctcccaattcggtcaagcattctgtaccgaatctgtgaacccaccaggacactgatgtcttttgtcagtacgaacaatctaatgctggtaacattcaaatcacctcatatacgtcgtctgtccggaattagggcatattttgaggtgattccggagcagaaatgcgaaaacaccgtcctggtgaaggacataactggatttgaaggcaaaatctcaagcccctattaccccagctattacccgcctaagtgcaagtgtacatggaaatttcagacgtccttaagcacgctgggcatcgctctgaagttttataattattctattacaaagaaatcgatgaagggctgcgagcatggttggtgggagattaacgagcatatgtactgcggcagctacatggatcaccagaccattttccgggtgccctccccgttggttcatatccagttacaatgctcttctcggctgtcggacaagccattactggctgaatatgggtcctacaacatcagccagccgtgccccgtgggatctttccgctgctcctccggattgtgtgtaccacaggcacaacgatgcgacggggtaaacgattgctttgatgagtccgacgaattgttttgcgttagtccacaaccggcctgcaacacatctagctttaggcagcatggaccactaatctgcgatggcttcagggactgcgaaaacggccgggacgagcagaattgcacccagagtatcccctgcaataaccgaacattcaagtgtggtaacgacatatgtttccgcaagcaaaacgctaagtgtgatgggaccgttgactgtccagatgggtccgacgaggaagggtgtacctgtagtagatcctcaagcgctctccaccgaataattggggggactgatacactcgaaggtgggtggccttggcaggtgtccctacacttcgtagggagcgcctactgcggtgcctcggtgatttcccgagagtggctgttgtccgctgcacattgcttccacggaaaccggttgtccgacccgactccctggactgctcaccttggtatgtacgtccagggcaatgccaagttcgttagccctgtgcggaggatcgtcgtgcacgagtattacaacagtcagacatttgactacgatatcgcactgttacagttgagtatcgcttggcccgaaacattgaaacagttgatccaaccaatatgtatccctcccacaggtcaaagagtgcggtcaggtgaaaaatgctgggttacaggatggggccgaagacacgaggctgataacaaaggttcgcttgtgctgcaacaggctgaggtggaactcatcgaccaaaccctttgtgtctcgacatacgggattataactagccgcatgctttgcgccgggatcatgtctggcaagagagatgcctgcaagggggatagtgggggccccttgtcgtgccgcagaaagagcgacgggaagtggattctaacagggatcgtgtcctggggccatggttctgggcgcccaaacttccctggagtatacaccagagtgtcgaacttcgtaccttggattcataagtacgtgccatccttattgtag

SEQ ID NO: 47095 - DNA, 2532 bp, Artificial Sequence
  Description of Artificial Sequence: Synthetic coding sequence
atggacaaggagaacagcgacgtgagcgccgcccccgccgacctgaaaatcagcaatatttccgttcaggttgtgagtgctcagaaaaagctgcccgtgcggcggcctccgctgccaggccgccggttacccctgcctgggaggaggcccccccagcggccgattggtaaggcaaagccaaaaaaacaatctaagaaaaaggtccctttctggaatgttcagaataagattatcctttttacagtgtttctattcattctggcagtgattgcatggactctcctgtggctctacattagcaaaaccgaaagcaaagacgcattttattttgctggcatgttcaggatcacaaatattgagttcctcccagagtacagacagaaagagtcaagagagtttctgtccgtttcaaggacagtgcagcaggtgattaatctggtctataccacgagcgcattttccaagttctacgaacagagtgtcgttgcagatgtgagcagtaacaacaaagggggcctgctggtgcatttttggatcgtcttcgttatgcctcgcgctaaggggcatatcttttgcgaggattgcgtggctgccatcctcaaggatagtatccagacatctataatcaaccggacctcagtaggatcactccaaggtctcgccgttgacatggattctgtggtcctgaatgcggggttgcgctcagactacagtagtaccattggctcagacaaaggctgctcccagtatttctacgctgaacacctgtctctgcactaccctcttgaaatttcagctgcgagtggccggctgatgtgtcattttaagttggtggctatcgttggatatttaatccggctgagcatcaaaagtatccagatcgaggccgacaactgtgtgacagacagcctcaccatctacgatagcctgttaccaatcagatcttcgattctgtatcgaatctgcgagccgacgcgtacgcttatgtcattcgtttcaaccaacaacctgatgttggttactttcaagtcacctcatatccgcagactgagcggaatcagagcctattttgaggtaatacccgaacagaaatgtgagaacacagtactcgtgaaggatatcacaggattcgagggtaaaatttcaagtccctattaccctagctattaccccccaaaatgtaaatgcacctggaagttccagacaagtctcagtacgctgggtatcgcactgaagttttataattacagcataactaagaaatcaatgaaaggctgtgagcacggatggtgggagatcaacgagcatatgtactgcggaagctatatggatcaccagactatctttcgagttccgagccctctcgtccatatccagctccagtgttcatcacggttgagcgacaaacctcttctggcggaatacggtagctataatatctcccaaccttgcccagttggaagctttcgctgtagttccgggttgtgtgttcctcaggcacaacgatgtgacggtgtgaatgactgcttcgatgagtcagacgagctcttctgtgtgtccccgcaacccgcctgcaacaccagctcgtttagacagcacggccccctgatttgcgacgggttcagagactgtgagaatggaagggatgagcagaactgcacccagtctatcccatgcaataaccggacattcaaatgcggaaacgacatatgttttcgcaaacaaaatgcgaagtgtgatggaacggtggactgccctgatggctccgatgaggaggggtgcacatgcagccgcagcagtagtgcacttcatagaatcataggtgggaccgatacccttgaaggtgggtggccctggcaggtctccctccattttgtcggaagcgcctattgcggtgcttccgtcattagccgagagtggctattatctgcggcgcattgtttccacgggaatcgtctgagtgatccaactccttggaccgctcatctcggcatgtacgtacagggcaacgctaagttcgtgtccccggtcaggcggatcgtggtacacgagtactataattcacagacttttgattacgatatcgctctgctgcagctctctattgcatggcccgagaccctgaaacagctcatccaaccaatttgcatcccaccgactggccagagggtccgatccggggagaagtgttgggttaccggttgggggcgcaggcacgaagccgacaacaagggaagcttagtgctgcagcaggccgaagtcgagctgatcgaccagactttgtgcgtgtccacctatggaattatcactagccgcatgctgtgcgccgggattatgagtggaaagagagatgcgtgtaagggcgactccggaggtcccttgtcttgccgccgcaaatcagatgggaagtggattctgacaggaatcgtgagctggggacacgggtcaggacgcccaaattttcccggtgtgtatacacgggtcagtaacttcgtgccgtggatacacaagtatgtcccttccctactctag

SEQ ID NO: 47096 - DNA, 3180 bp, Artificial Sequence
  Description of Artificial Sequence: Synthetic coding sequence
atggagcccaccgtggccgacgtgcacctggtgccccggaccaccaaagaggtgccggccctcgatgctgcctgctgtcgcgccgcatcgataggcgtggtggccacgtctctagtcgtcctgactctgggcgtgctgctggcctttttatcaactcagggatttcatgtggaccacacagccgaattacgtggaatccgttggacgtccagcctgcgaagggagacctctgattaccatcgcacgttgacccccactctggaggccttattacactttttgttgagacctctccaaaccctgtctctgggattggaagaggaacttctgcaacgtggcattcgtgcgagacttagagaacatggtatctccctcgccgcatatgggacgatcgtgagcgcagaactgactgggcgccacaagggcccgttagctgagagggactttaaatctgggaggtgtccaggcaactccttttcttgcgggaactctcagtgcgtgaccaaggttaatcccgagtgcgatgatcaggaagactgctctgatggctcggatgaagcacactgcgaatgtggactacagcccgcctggcgcatggccgggcgtattgtcgggggcatggaagcatccccaggcgagtttccgtggcaggccagcctacgcgaaaataaggagcacttttgtggagccgccattataaatgctcgttggctggtgtctgctgctcattgtttcaacgaattccaggacccgacaaagtgggtggcatatgtcggcgccacatacctttccggaagcgaagcgtccacagtgcgcgcgcaggtagttcagatagtcaagcatccactttataatgccgacaccgctgacttcgatgtagctgtgttagagctcacttccccactccctttcgggaggcacatccagccagtctgtctgccagctgccactcacatcttcccaccttccaagaaatgtctcatttccggctggggctatttaaaggaggattttctggtgaagcccgaagtgctccagaaagccacagtggaactcttagaccaagcactttgcgcttcactctatgggcactcccttactgatcggatggtctgtgctggctatctcgacgggaaagtggattcctgtcagggtgacagcggtggtcccttggtctgtgaggagccgagcggaaggttctttctggcaggcatagtctcgtggggcatcgggtgtgctgaagcccgcaggcccggggtgtatgcccgggtcactcgccttcgcgattggatccttgaggctaccacaaaggcttcgatgccattggctcccacaatggccccggcccctgccgcgcccagcacagcctggccgaccagcccggaatcccccgtagtctctactcccacaaaaagcatgcaggcattgtccactgtccccctcgattgggtgactgtgcccaaactgcaggaatgtggcgcgcggcctgccatggagaagcccacaagggtagttggcggctttggcgctgcctcaggcgaggttccatggcaggtgtccctcaaggagggaagccggcacttttgtggtgctaccgtcgtgggcgacagatggctgctcagcgccgctcattgcttcaaccacacaaaagtagagcaggttcgagcccatctcggaactgccagccttctggggctcggtggttcgccagtcaaaattggcctgaggagggtcgtgcttcatcccctgtataatccaggcatcttagacttcgacctggccgttttggaactggcatcccccctggctttcaataaatatatccagccagtctgtctcccgttggctatccagaaattcccagtcgggcgcaaatgtatgatttctgggtgggggaatacacaagaagggaacgccactaagcccgaattactgcagaaagcttcagtgggtattatagatcagaagacatgtagcgtattgtataacttctctctgaccgatcgcatgatatgtgccgggtttctggagggaaaagtagactcatgccagggcgatagcggcggcccattagcctgtgaggaggcccctggcgtgttctatttggcaggtattgtttcatggggcatcggatgtgcccaggtaaagaaacccggcgtctatacgaggatcaccagactgaaaggctggatccttgaaatcatgtctagccaaccgttacctatgagccctccctctactacacggatgctggctaccactagcccccgaactacagctgggctcacagtacctggagcaaccccgtctagacctacacctggtgcagcttcaagagtcacaggccagcctgctaacagcaccctgagtgcagtttccaccaccgcccggggccagacccccttccccgatgcccctgaggcgactacccatacccaactacctgactgcggtctggcgcctgctgccttaacaaggattgtgggtggcagtgcagcgggtagaggtgagtggccatggcaggtgagcctgtggttacgccgcagagagcatcgctgtggtgccgtgctggtagccgaacgatggctgttgtcagctgcacactgcttcgatgtttacggtgaccccaaacaatgggcagcttttctgggaaccccctttctgtcaggtgccgaaggccagcttgaacgagtggcgagaatctacaagcacccgttctataatttgtacacgctggactacgacgtggcactgctcgaactggcgggaccagtaagacggagccggttggtgcgcccaatctgcctgcctgagcctgcaccccggccaccagacggcacccgctgcgtgattacgggctggggtagcgtgcgagagggagggagcatggctcggcaactccagaaagccgccgtcagattgctgagcgagcagacttgcaggaggttctatccggtgcagatttcatcacgcatgttatgcgccgggttcccacaggggggggtggattcctgtagtggtgacgccggaggacccctcgcctgtagagaaccttcaggccgttgggtgcttactggagtgacatcatggggctatgggtgtggcagaccccattttcccggagtttacacaagagtggcagctgtccgagggtggataggtcagcacatacaagagtag

SEQ ID NO: 47097 - DNA, 1596 bp, Artificial Sequence
  Description of Artificial Sequence: Synthetic coding sequence
atggagcccaccgtggccgacgtgcacctggtgccccggaccaccaaagaagtccccgcactggacgcggcctgttgtcgcgctgcatccattggggtcgtggcaacatccttggtggtgttgacactgggagtcctgcttgcatttctaagcacccaagggttccatgtggaccataccgctgagctcaggggaatacgctggaccagtagcctgagacgcgagaccagcgactaccatcgaacgctcacacccacacttgaggccctattcgtctcctcgtttcagaagacagagttagaggctagttgtgtgggctgctcagtgctgaactaccgtgacggaaatagcagtgtgctggtacactttcaactacatttcctgttaaggccacttcagacgctttctctggggttagaggaagagctgttgcagcgagggataagagccagattgagggaacacggcatcagcctagccgcatacggtacgatcgtgagtgccgagctgaccggacggcataagggtcccctagccgagagggattttaaaagcggtcgctgccctggcaatagcttttcctgtggcaactcacagtgtgttacgaaggtgaacccagagtgtgacgaccaggaggattgtagtgatggatcggacgaggctcactgcgagtgtggtctccagccggcttggcggatggccggcagaatagtgggtggcatggaagcctccccaggcgagtttccctggcaagcttcactgagagaaaacaaagagcatttctgtggtgccgcaataattaacgccagatggcttgtgtcggctgcacactgtttcaacgagttccaggatcctacaaagtgggtcgcttacgtaggggccacatacctgagtggaagcgaggccagtaccgtgcgtgctcaagtggtacagatcgtcaaacacccgctgtacaatgcggatacagcggattttgatgtggcggttttggagttgacttcaccgctgcctttcggacggcatatacaaccagtctgcctgccagctgccacccatatcttccccccatcgaagaagtgcttaatctcggggtggggctatctgaaggaggactttttagtgaagccagaagtcttacagaaggcgacagtggaactgctggatcaagccctttgcgcttcattgtatgggcatagcctcacagaccgcatggtctgcgccggctatttggacggaaaagtcgattcatgccaaggcgacagcggggggccgttagtttgtgaagaacccagcggccggttctttctggccgggattgtttcgtggggcatcgggtgtgcagaggccagacgaccgggcgtgtatgcaagggtcacccgcctccgggactggatcctggaagccaccactaaagccagcatgcctctggctccgactatggctcccgcacctgccgctcccagcaccgcttggcccacatctccggaatcccccgtagtgtctacacccaccaaaagtatgcaagccctgtcaaccgtgcctctggattgggttactgtgcccaagctccagggcatctttggtgcagaaaggtag

SEQ ID NO: 47098 - DNA, 405 bp, Artificial Sequence
  Description of Artificial Sequence: Synthetic coding sequence
atgaccgaggagcccatcaaggagatcctgggcgcccccaaggcccatatggccgcaactatggaaaaatctcctaagtctgaggtggtcattacaaccgtgccactggtcagcgaaatccagctgatggccgctactgggggaactgagttatcttgctatcggtgcatcatccctttcgctgtagttgttttcattgctggtatcgtggtgaccgctgtggcttatagttttaatagtcacggctcaattatatctatctttggccttgtggtcctgagtagcggactctttctgttagcttccagcgccctatgctggaaagttaggcagcgaagcaagaaggcaaagcgaagagaaagccagactgcactggtggctaaccagcgttcgctgtttgcttag

SEQ ID NO: 47099 - DNA, 405 bp, Artificial Sequence
  Description of Artificial Sequence: Synthetic coding sequence
atgaccgaggagcccatcaaggagatcctgggcgcccccaaggcccatatggctgccacaatggagaagtctcccaaatctgaggtagtgattactaccgtccccctggtcagtgaaatacagctgatggccgctacaggggggaccgaactatcatgttaccgttgcataatcccatttgccgtggtggtcttcatcgctggcatcgtcgtgacagctgtggcttactcatttaattcacatggatccattattagcatttttggcttggtagtcttgagctcgggcctgtttctgctggcttcgtcggctctgtgttggaaagtcagacagcgttctaagaaggctaagcggcgtgagtcacagacagctctcgtggccaatcaacgttcacttttcgcatag

SEQ ID NO: 47100 - DNA, 405 bp, Artificial Sequence
  Description of Artificial Sequence: Synthetic coding sequence
atgaccgaggagcccatcaaggagatcctgggcgcccccaaggcccacatggcagcgactatggagaagtcgccgaagagtgaggtggtaattaccactgtgccgctggtttctgagatccaactaatggctgccactggcggtaccgaactgagttgttatcgctgcatcatacctttcgcggtggtagtgttcattgccggcatcgtggtgacagccgttgcctattctttcaattcccatggctccatcattagcattttcggcctcgtggtactgtcatctggactgtttttgttggcgtccagtgctctgtgttggaaggtgagacagcgaagtaagaaggccaagcgccgggaatcccaaacagccctggtggccaatcagaggtccttatttgcttag

SEQ ID NO: 47101 - DNA, 633 bp, Artificial Sequence
  Description of Artificial Sequence: Synthetic coding sequence
atgcggaagcggcagcagagccagaacgagggcacccccgccgtgtctcaggcacctggaaatcaaagacctaacaatacttgttgcttctgttggtgttgctgttgttcctgttcttgccttacagtgcggaacgaggagagaggcgagaatgccggccgccctactcacaccacgaagatggagtcaatccaggtccttgaggaatgtcaaaacccaactgccgaggaggtcctgagctggtctcaaaattttgacaagatgatgaaagcccctgcgggccgcaacttgtttagggagttcctcaggaccgaatattctgaggagaatctgcttttctggcttgcgtgcgaagaccttaagaaagagcagaacaaaaaagtcatcgaggaaaaggcccggatgatctatgaggattacattagcatcctgagcccaaaagaagtaagcctcgacagcagggtcagggaggtcataaaccggaacttgttagaccctaatccccacatgtatgaggacgctcagctccagatttataccctgatgcacagagattcttttccccggttcctgaactcacagatctataagtcatttgtggagagcaccgctggtagctcgtctgagtcatag

SEQ ID NO: 47102 - DNA, 600 bp, Artificial Sequence
  Description of Artificial Sequence: Synthetic coding sequence
atgggcgccgccgtgctgtgcgccagcttcatgagcttcggcgtgaagcgtagatggtttgctcttggagctgctctgcaactggccattagcacctacgccgcctatattggtggatacgtccactatggagattggctgaaagtgcggatgtacagccgcacagttgcaattattgggggcttcctggtactggccagcggggcaggtgagctgtaccgccgcaaaccacgctccaggagtcttcaaagcaccggccaggttttcctcggtatttacctgatctgcgttgcatattcgcttcagcacagcaaagaggataggctagcttacctcaatcatctgcctggtggggagctaatgatacagttgttctttgtcctgtacggaatccttgctctggcgttcctgagcggctactatgttaccctcgctgcacagatcctggccgtgctgctaccccctgtcatgctgttaattgacggaaacgtggcctattggcacaatactcgcagggtcgaattttggaaccaaatgaaacttttaggggagagtgtaggtatttttggtaccgccgtgattcttgccaccgacggatag

SEQ ID NO: 47103 - DNA, 774 bp, Artificial Sequence
  Description of Artificial Sequence: Synthetic coding sequence
atggccagcaagatcggcagccggcggtggatgctgcagctgatcatgcagttgggctcggttctgttaacgaggtgtccattctggggatgtttctctcagctgatgctttacgccgagcgggccgaagcccggcgtaagccagacattcccgtgccatacctgtactttgacatgggcgccgctgttctgtgcgcatcatttatgagcttcggagtgaagcgccgctggtttgccttgggtgcggcactacaattggctattagcacatacgcagcttacatcggcggctacgtgcattacggggattggctcaaggtacggatgtactcccggactgtggcaatcattggcggcttcctggtcttggccagcggagccggtgaattgtatcgtcggaagccccggagtcgatcactgcagagtaccggacaggtgtttctgggaatttatctcatatgtgttgcatattccctgcagcattccaaagaggataggctggcctatctcaatcatctgcctggaggggagctgatgatccagttgttttttgtgctgtatgggatactggcgttggccttcttaagcggatactacgtgacgctggccgcccaaatccttgccgtcttgctgcctcctgtcatgctgctgattgacggcaacgtcgcatactggcacaacacccgacgggtggagttctggaatcagatgaaactactaggcgagtcagtcggaatctttggaactgcagtcatcctggccacagatgggtag

SEQ ID NO: 47104 - DNA, 1491 bp, Artificial Sequence
  Description of Artificial Sequence: Synthetic coding sequence
atggccggcgagatcaccgagaccggcgagctgtacagcagctacgtaggcctggtgtacatgttcaacctgattgtggggactggtgccctcactatgcctaaggcttttgcgactgcgggttggctggtctcgctcgttctgctcgtgttcctggggttcatgagtttcgtcaccactacatttgtgatagaggcaatggctgcagctaacgcccaattgcattggaagagaatggaaaacctgaaggaggaagaggacgatgatagctcaaccgcctctgactctgatgtcctgatccgtgacaattatgagcgcgccgaaaagcggcctatcctcagtgtgcaacgccgcggctctcctaacccatttgaaattaccgaccgggtcgaaatgggacaaatggcgagcatgttctttaataaggtgggggttaacctcttctacttctgcatcatagtatatctctatggcgaccttgcaatttatgctgctgcggtcccgttcagcctgatgcaggtgacatgttcagcaacaggcaatgatagttgcggagtcgaagccgacaccaaatataacgatactgaccggtgctggggacctctccgacgcgttgatgcctatcgaatttacttagctatctttacgctgctcttgggtccctttacatttttcgacgtgcagaaaaccaagtatctgcagatattaacaagtttaatgcgatggattgctttcgccgttatgatagtgcttgcactgataagaatcggccatggccaaggcgagggacatccccctctggctgacttttccggcgtacggaacctatttggtgtatgtgtgtattctttcatgtgccagcactccctcccatccctcatcacccccgtaagctctaaaagacaccttactcgtctggtctttctcgattacgtgctgatcctggctttctatgggctcctatcatttacagccatcttttgttttaggggagatagcctcatggacatgtacaccctgaattttgcacgttgtgatgtggtcgggctggccgctgtcagattctttctcggactttttccggtgttcacgatctcaactaactttccaataatagccgtgaccttgcgcaacaactggaagaccctcttccatagagagggaggaacctacccttgggtggtggatcgcgttgtgtttcccactattacactcgtcccgcccgtgctagtcgccttttgcactcacgatctggagtctcttgtgggaatcactggagcttacgcgggtacagggatacagtacgtgattccggcctttctggtataccactgtcgccgggacactcagctggcctttggctgtggagtcagcaacaaacatagatctccgtttcggcataccttctgggtggggtttgttctgctctgggcctttagctgtttcatcttcgtgactgctaatattattctcagcgaaacaaaattatag

SEQ ID NO: 47105 - DNA, 984 bp, Artificial Sequence
  Description of Artificial Sequence: Synthetic coding sequence
atggccggcgagatcaccgagaccggcgagctgtacagcagctacgtgttcgtccgagtggttaaacccaataaaattgccatgctctttattatgttgattcccgggtgggctcggtggctcacgcccgtaattccagctctctgggaagccgaagcaggccggtcaccagaagtaagatcgagcagaccggcttggcccacctgctttgtgaccaccacatttgtgatcgaagccatggccgccgccaacgctcagttgcactggaagcgcatggagaaccttaaagaggaagaggacgacgacagttcgaccgcctccgatagtgacgtgttaatccgggataactacgagagagcagaaaaacgtcctatactgtcggttcagaggcgaggaagcccaaaccccttcgaaattacggacagggtagaaatgggccagatggcatccatgttttttaataaggtgggagttaacctcttctatttctgtattatcgtctatctctacggtgaccttgcaatctacgcagccgccgttcccttcagtcttatgcaggttacatgtagtgctactggaaacgattcttgcggtgttgaggcagatacgaagtacaacgatacagacagatgttggggcccgctccgcagagttgatgcctacagaatctacttggccatttttactctgttgctcggtcctttcaccttcttcgatgtccagaagactaagtatttgcagattctcacttctctaatgcggtggatcgacggacctcctgggagcgtcatgggtcgcgcagaagaggatgcgagccctgcgtggccacggtcaaggtgcaggtgcggtgggaagctcaagctgaattccctctacccaaccagtgctacttgcatggctcccgacgcacctggcgcgggacaggtcaaggtgggggtgaatttcctatgtttaccaccccatcggagcactcggcctacctag

SEQ ID NO: 47106 - DNA, 390 bp, Artificial Sequence
  Description of Artificial Sequence: Synthetic coding sequence
atgctgctgaaggtgcggcgggccagcctgaagccccccgccaccccccaccagggagccttccgtgcaggcaacgtcatagggcagctgatttacctgttgacctggtctctgtttacagcgtggctacgacctccgactctccttcaggggccgcggacctcgccgcagggatccccacctagatcaccatggggggattgtgcagagccttcctgtctttgtgagatgaagattaggcggaggaggcacgaggggcctgcctggggccaaagcggattcttggcagggggtctccatctcgtaccttccagcctctctctggccgcctgtggagtcgtcagaatgaagggcctctgggggaggggcgccggtatccgagggcgctag

SEQ ID NO: 47107 - DNA, 789 bp, Artificial Sequence
  Description of Artificial Sequence: Synthetic coding sequence
atgggcaagaccttcagccagctgggcagctggcgggaggacgagaataaaagtatactgtcctcgaaacccgcaatcgggagcaaagctgtaaactatagtagcacagggtcttcgaagtccttctgttcttgcgtgccatgtgaaggcaccgctgacgcttcattcgtgacgtgtcctacctgccagggaagtgggaaaataccacaggagctcgagaaacagctggttgccctcatcccatacggcgatcagagattgaagcctaagcataccaagttattcgtttttctggcagtcctgatctgcctcgtaacatcaagttttattgtgttcttcctgtttccccggtcagtcattgtccaacccgcaggcttgaattccagtacagtggccttcgacgaggctgacatctacctgaatatcacgaatatcttgaacatttctaacggtaattactaccctattatggtcactcagctgaccttagaggtgctccacctgtcactagtagtcggccaggtgtccaataatctcttgttgcacatcggaccattggcttccgagcaaatgttctacgccgtggccaccaaaatcagggacgaaaacacatataagatatgcacctggctggagatcaaagtgcatcacgtgcttctgcatatacagggcactttgacctgttcatatctgtcccacagcgagcagctggtctttcaatcctacgaatacgttgattgtaggggcaacgcctccgtaccccaccagttgactcctcaccctccttag

SEQ ID NO: 47108 - DNA, 648 bp, Artificial Sequence
  Description of Artificial Sequence: Synthetic coding sequence
atgggcaagaccttcagccagctgggcagctggcgggaggacgagaataagtcaattctttcttctaaacccgccattggatcgaaggccgtgaactacagctctacgggttccagtaagtcgttctgctcttgcgtgccctgtgaggggacagctgatgcttcctttgtgacttgcccgacctgtcagggcagtgggaaaattccccaagagttggaaaaacagctggtcgccctgattccatacggggatcaacgcctcaaacccaaacacacgaaactcttcgtgtttcttgctgtgttaatctgtctggttacaagctcatttattgtttttttcctttttccacgcagtgtaatcgtgcagcccgcggggctgaactcgagtaccgtcgcgtttgacgaggcagatatatatctcaacataactatgttctatgcagtggccacgaagattcgcgacgaaaatacatacaagatttgtacatggctggagatcaaagttcatcatgtgctgctccatatccagggtacgctgacctgcagctatctgtcacactctgaacagctggtcttccagtcctacgaatatgtcgactgcagggggaacgcttcagtgccacaccagttgacgccacatcccccttag

SEQ ID NO: 47109 - DNA, 645 bp, Artificial Sequence
  Description of Artificial Sequence: Synthetic coding sequence
atgggcaccgccgacgccagcttcgtgacctgccccacctgccagggatcagggaagatcccgcaggagctggagaagcaactggtcgcactgatcccctatggtgatcagaggctgaagcccaagcatacaaagcttttcgtttttctagccgtgcttatttgtctcgtaacatcttccttcatcgtgttttttctctttcctagaagcgtcatcgtgcagccggcaggcttgaattcatccacggttgcatttgacgaggcagatatatacctgaacatcaccaacatacttaacattagtaatggcaactattatcctatcatggtgacccagttgaccctggaggtcctgcatctttctctggtcgtgggccaagtgtccaataatcttcttctgcatatcgggcctctcgcttctgagcaaatgttttatgctgtggccacaaagatccgtgacgagaatacgtacaaaatatgtacgtggctagagattaaggtgcatcatgttcttttgcacatccaaggcactcttacatgttcctacctctctcacagcgaacagttagtgtttcaatcttatgagtacgttgactgcagaggcaacgcgagtgtcccccaccagttaacaccccatccaccttag

SEQ ID NO: 47110 - DNA, 696 bp, Artificial Sequence
  Description of Artificial Sequence: Synthetic coding sequence
atgggcagccagcacagcgccgccgcccggcccagcagctgccggcgaaagcaagaggatgacagagatggcctgttggcagaacgcgagcaggaggaagctatcgctcagtttccttacgtggagtttacaggccgagattcaattacatgtctcacgtgtcaaggaactggctatatcccgactgaacaggtgaacgagctggtcgcccttatcccccactctgaccaaagactccggcctcaaagaaccaagcagtatgttttattgagtattctgttatgccttcttgctagcgggctcgtcgtgtttttcctgtttcctcacagcgtgctcgttgatgatgatggcatcaaggttgtcaaagtaacatttaataagcaagactcactcgtgattctcacgattatggccacactaaaaattagaaattctaacttttacaccgtggccgtcacctccctgtcctctcagatacaatacatgaacactgttgtcaattttactggtaaggccgagatgggcgggcccttttcgtatgtgtatttcttctgcactgtaccggaaatcctggttcacaacattgtgatattcatgaggacaagcgttaagatttcatatatcggtcttatgactcagagttccctggaaacccaccattacgtagactgcggagggaatagcaccgcaatatag

SEQ ID NO: 47111 - DNA, 753 bp, Artificial Sequence
  Description of Artificial Sequence: Synthetic coding sequence
atgggcagccagcacagcgccgccgcccggcccagcagctgccggaggaagcaggaggacgaccgcgacggtcttttggccgagcgcgagcaggaggaggctattgctcagtttccgtacgtggagttcacaggacgggacagcataacctgcttgacctgtcagggcaccggttacatcccgactgaacaggtgaatgagctggtggctttgatcccccatagtgatcagcggctgcgcccacagagaaccaaacagtatgttttgctttcgatcttgctgtgtctcttagctagtggcctagtggttttttttcttttcccacatagtgtcttggttgatgacgacgggatcaaggtggtgaaggtgacattcaacaagcaggattccctggtcatcttgaccatcatggccactctaaaaatccgtaattccaatttttacacagtggccgtcacctctctgtcctctcagattcaatacatgaacactgtggtatcaacctacgtgacaacaaacgtctcattaataccacccagaagcgagcagctggtgaattttacaggcaaagctgaaatggggggaccattttcatacgtctattttttttgtacagtcccagaaatcctggtgcataatattgtaatctttatgcgtacgagtgtcaagatatcctacataggactcatgacccagagctccctggagacccaccactatgttgactgtggcggcaactcaacagccatctag

SEQ ID NO: 47112 - DNA, 696 bp, Artificial Sequence
  Description of Artificial Sequence: Synthetic coding sequence
atgggcagccagcacagcgccgccgcccggcccagcagctgccggaggaaacaggaggacgacagagatgggttactggctgaaagggaacaggaggaggctattgcacagttcccgtacgttgagtttactggccgtgacagcattacatgcttaacctgtcaggggacaggctatatcccgacagaacaagttaatgaattagtcgcccttataccccacagcgaccagagactgaggccccagcgtactaagcaatacgttctgctgtcaatcctgctgtgtctgctcgcctcgggactggtcgtcttctttctgtttcctcatagcgttctagtggacgatgatggtataaaggtggttaaggtgaccttcaataagcaagatagcctggtgatactaacgattatggccactctaaaaataaggaatagtaacttctacaccgtggccgtaacctcccttagcagccagatccaatacatgaacacagtggtgaacttcacaggaaaggcagaaatggggggccctttttcctacgtgtattttttctgtaccgtaccagaaatcttggtgcacaatatcgtgatctttatgcgaaccagcgttaaaatatcttacatcggtctgatgacgcagtcaagcctggaaacccatcactacgtcgactgtgggggcaattccactgcaatttag

SEQ ID NO: 47113 - DNA, 753 bp, Artificial Sequence
  Description of Artificial Sequence: Synthetic coding sequence
atgggcagccagcacagcgccgccgcccggcccagcagctgccggcgcaagcaggaggatgatagggatgggctccttgcagaacgtgaacaggaggaagctatagctcaatttccttacgtcgagtttactggcagagattcaatcacctgtctgacatgccagggcaccggatatattcccacagagcaggtcaacgagttagtcgcactaatcccacacagtgatcagcggttgcgaccccagagaaccaaacaatatgttcttctttccatcttgctgtgtctgcttgcaagcggcctcgtggtgttttttctcttcccacattcggtgctggtcgacgatgatggcattaaggttgtgaaagtcacctttaataagcaggattccctggttatcctgaccataatggcaactcttaagattcgcaatagcaacttctataccgtcgccgtaacaagtctgtcatcacagattcaatacatgaacaccgttgtgagcacatacgtgacgaccaacgtctccctcatcccccccaggtcagagcaactggtcaacttcacggggaaggccgagatgggcggtccctttagctacgtatactttttctgtactgtgccagaaatcctcgtccataatatcgtaatcttcatgcgcaccagtgtgaagatatcctatattggcctgatgacacagtctagtttagaaactcaccactatgttgactgcggaggcaactctacagctatctag

SEQ ID NO: 47114 - DNA, 441 bp, Artificial Sequence
  Description of Artificial Sequence: Synthetic coding sequence
atgggccgggtgagcggcctggtgcccagccggttcctgaccctgttggcccacctggttgtagttattacactcttttggtcacgggacagtaacatccaggcctgtctgccactgacctttacgccggaagagtatgataagcaggacattcacccattgcccctgtgcaggctggtagccgctctgtcagtaactcttggactgttcgccgtggagcttgctggtttcttgtccggtgtctctatgtttaacagtacccagtctttaatctcaattggggcccactgttctgcctcggtggccctgagctttttcattttcgaacgttgggagtgcaccacttattggtacatttttgtgttctgctccgcactacccgccgtaacggagatggcattgttcgtgacggtgtttggactgaagaagaaacctttctag

SEQ ID NO: 47115 - DNA, 492 bp, Artificial Sequence
  Description of Artificial Sequence: Synthetic coding sequence
atgggccgggtgagcggcctggtgcccagccggttcctgaccctgctcgcccacctggtcgtcgtcataaccctgttttggagcagggtgcgtccgaccgcagcgctcaatccttccccttttccgtccttgtctgggccctcaccgactctccctccaccctctgtgcttcccagttgggtttttctcttccctgctgcacctagaccagcactccagcctgcgcctttcagtctgctgagcgctggatggtggcctcggagtctgtcaccttgggctagcctacagtggagctggccggtgtcaagccaggaatccccgtgtagcaccgcccctcgggcctcctccgtgtcgtttttgcctgcccatctctctcacacaacgcacttttatcaggacagcttacaaccccctgatacaattgtgtccgcggtggccaacccatcttcctctaagattttcaacgacgtgctcaatccggccgtctactag

SEQ ID NO: 47116 - DNA, 423 bp, Artificial Sequence
  Description of Artificial Sequence: Synthetic coding sequence
atgggccgggtgagcggcctggtgcccagccggttcctgaccctgctcgcgcacctggtcgtggtcatcaccctgttctggtcacgggacagtaatattcaggcttgcctcccactgacctttacgcctgaagagtatgataagcaggatatacaactagtggctgccttgtcagtgaccttgggcctgttcgctgtggaacttgccggcttcctgtccggggtgagtatgttcaacagcacccagtctctgatcagcattggggcccactgttccgcgtcagtcgctttgtctttcttcattttcgagaggtgggagtgcaccacctactggtatatcttcgtgttttgtagtgccctccctgctgttaccgaaatggcactttttgtgacagtttttggcctcaaaaagaaaccattttag

SEQ ID NO: 47117 - DNA, 420 bp, Artificial Sequence
  Description of Artificial Sequence: Synthetic coding sequence
atgggccgggtgagcggcctggtgcccagccggttcctgaccctgctggctcatctcgtcgttgttatcactctcttttggtcacgcgattcaaatatacaagcctgccttccgcttacgtttactcccgaggagtatgataaacaggacattcatccccttcccttatgtcggctagtagccgcgctgagcgtgacgttgggtctctttgccgtggaactggcgggttttctctctggggtttctatgtttaattctactcaaagtctgatctcaatcggtgcccactgttcagcatcagtcgccctctccttctttatttttgagcgatgggaatgtacaacttactgcgccctcccagcagttacggagatggccctcttcgttacggtgttcggtctcaaaaagaaacccttttag

SEQ ID NO: 47118 - DNA, 1728 bp, Artificial Sequence
  Description of Artificial Sequence: Synthetic coding sequence
atgaagcggagcctgcaggccctgtactgccagctgctgagcttcttactgatcctggcgctgaccgaggccctcgcgtttgctatacaagagcccagtccacgtgaatctttgcaggtgctcccctctggaactccgccgggcacgatggttaccgcaccacactcctccacgcgccacacgtctgttgtcatgttaactccaaaccctgatggaccccctagtcaggccgccgcacctatggctactcctacacccagagccgagggacatcccccgacccacacgatcagcaccattgcagcaaccgttacagcgccgcattccgagtcctcactgagcacagggccggcccctgccgcaatggctaccacatctagtaagccagaaggacgccctcgggggcaggccgcaccaacaatcttgctcaccaaaccccctggagccacgagcagacctaccacagctccccctcggactacaacgcgacgcccacccagaccccccggttcatctagaaaaggcgccgggaattctagcaggcccgttccacctgcacctggaggacatagtagatccaaggagggccagcggggacgaaacccttcatccactcccctcgggcagaaacgacctctcggtaagattttccaaatatacaaaggcaatttcaccggttccgtagagcccgaaccctcgaccctcactccccgaacccccctgtgggggtactcaagctctccccaaccccagacggtggcggcaacaacagttccttcaaacacaagctgggctcctaccacaacctcccttggcccggccaaggataaacctggcctaagacgagccgcacagggaggaggttcaacatttacttcccagggggggaccccagacgctacagccgcgagcggcgctccagtatctccccaggcagcgcccgttcctagtcaaagaccccaccacggagacccccaagatggaccctcacactccgattcctggcttacagtaacacccgggacgagtcgaccactatctacatcatccggcgtatttactgctgcaacggggcccacccccgcagcgtttgatacttcagtgtctgcaccttctcagggaattcctcagggcgccagcaccaccccacaggccccaacccatccatccagggtctcagagtcaacgatttccggagccaaggaagaaacagtggctactctcaccatgaccgacagagtaccttcccctctcagcaccgtggtctcgacagccacaggcaattttctcaaccggttggtgccagccggcacctggaaaccggggactgcaggtaacatatcacacgtggccgaaggcgataaaccacagcaccgcgcaaccatctgcttgagcaagatggatatcgcatgggtcatcctagctatcagcgtgcccataagctcttgttctgtgctgcttacagtctgttgcatgaagcgaaaaaagaaaaccgctaatccagagaacaacctttcatactggaacaatacgatcacaatggactacttcaataggcatgccgtggaactgcctagggaaattcagagcctcgagacgtccgaggatcagctcagcgagcctcgcagtccagctaatggcgattaccgggacacaggcatggtgctcgtgaacccattctgtcaggaaacactattcgtcggcaatgaccaggttagtgaaatctag

SEQ ID NO: 47119 - DNA, 1728 bp, Artificial Sequence
  Description of Artificial Sequence: Synthetic coding sequence
atgaagcggagcctgcaggccctgtactgccagctgctgagcttcctgctgattctggccctgacggaagccctggctttcgccatccaagagccctcgcctagagagagcctgcaggtgctcccgtcaggcacaccacccggcactatggtaaccgcaccccacagttccacccgccacacaagcgtggtgatgctaacgccgaatcccgacggacctccatcccaggccgcggcacccatggcgaccccaacccctagagcagagggccatccgcccactcacacaattagtacaatagctgccacggtgactgcccctcactcagaatcttctcttagcacgggtcccgcccccgctgccatggccactacctctagcaagccagagggacgccctaggggacaagctgcccccacaattttactgactaagcctccaggagctacaagtcggcccactacggccccacctagaacgaccacaaggcggcccccacgccccccaggcagttcccggaaaggcgctggcaacagctccagacctgtgccccccgccccaggcggacactccagatcaaaagaggggcaacgcggcaggaatcctagttctaccccgcttggtcagaaaagacccctgggaaagattttccagatttacaagggcaattttaccggatcggtggagcctgaaccctctacactcaccccgcgaaccccactctggggatactccagctctccgcagccgcagactgttgcagcaacaaccgtgccttcaaacacctcatgggcccccaccaccacgagcctgggccccgccaaggacaagccagggctgcgaagagctgcgcagggaggaggctctacctttacttctcagggtggcaccccagatgcaaccgcggctagtggagcccccgtgtcgccccaggccgcaccagttccctcacagaggccacaccacggggacccacaggatggaccgagtcatagtgacagttggctcaccgtgacccccggaaccagccgtccgctgagtacttcctctggagtatttaccgccgccaccggacccacaccagctgccttcgatacaagcgtcagcgccccgagccaaggcatcccacagggagcctctacaacacctcaggcaccaacacacccctctcgtgtgtcagagtcaactatttctggagctaaagaagaaacagtagccacattaacaatgactgatcgggtaccttctcctctcagtacagtcgtgtcaacagccaccgggaactttctcaacagactggtcccagccggaacctggaagcccgggactgcaggtaatatcagccatgtggcagaaggagataagcctcagcatcgggcaacgatatgcctctctaaaatggacatagcatgggtcatcctggctatttccgttccaataagctcttgtagcgtgttgttgaccgtgtgttgtatgaagcgaaagaagaagacagccaatcctgagaataatctgtcttactggaataacacaattactatggattatttcaaccgccacgccgtggagttgccgagagaaatccagagcctcgagacgtccgaggatcagctgtccgagcctcgctctccagcgaacggggactaccgcgacaccggaatggttctcgtgaatccattttgtcaggaaaccctgtttgtgggaaatgatcaggtgagtgagatctag

SEQ ID NO: 47120 - DNA, 318 bp, Artificial Sequence
  Description of Artificial Sequence: Synthetic coding sequence
atgaagcggagcctgcaggccctgtactgccagctgctgaccgtgctgctcactgtgtgttgtatgaagaggaaaaagaagaccgccaacccagaaaacaatctgtcctattggaacaacaccatcacaatggattacttcaaccgccacgctgtcgagctgccgagggaaattcagagcctcgagacctccgaggatcaactgtctgaaccccgcagccccgctaatggtgattaccgagacactggaatggttttagtgaatcctttctgtcaagagactttgtttgttggcaatgatcaggtttctgaaatatag

SEQ ID NO: 47121 - DNA, 462 bp, Artificial Sequence
  Description of Artificial Sequence: Synthetic coding sequence
atgaagcggagcctgcaggccctgtactgccagctgctgagcttcctgttgattttagctctcactgaggctctggcttttgccatacaagagccaagccccagagagtccctccaggtgttaccttctggtacccccccggggactatggtgacagccccacacagctcaacgcgccatacttccgtggtgatgctcactcctaaccccgatgggcccccaagtcaggcagccgctcctatggccaccccaactccccgggcagaaggtcatccacccacacacacaatctctaccattgctgccactgtcacagccccgcactccgaatcaagcttatcaactgggcccgcccccgctgccatggctacaacaagctccaaacccgaaggcaggcccaggggtcaggctgcccctactattcttctcacaaagccacccggagccactagcaggccttag

SEQ ID NO: 47122 - DNA, 219 bp, Artificial Sequence
  Description of Artificial Sequence: Synthetic coding sequence
atgaagcggagcctgcaggccctgtactgccagctgctgagcttcttactgatccttgccttaactgaggccttggcttttgcgatccaggaaccatctccaagagaatcgctgcaggtgctcccctctggaaccccccccgggaccatggttaccgcaccacatagcagtacaagacacacttcagttgtcatgttgacccctaatcccgacggatag

SEQ ID NO: 47123 - DNA, 450 bp, Artificial Sequence
  Description of Artificial Sequence: Synthetic coding sequence
atgaagcggagcctgcaggccctgtactgccagctgctgagcttcctgctgatcttagccctaaccgaggccctggcattcgccatccaggaaccctcgcccagggaaagtctacaggtgttgccttctggcacacccccaggaaccatggtgaccgctcctcatagtagcaccagacatacaagcgtggtgatgctgacaccaaatcctgatggtccaccctctcaggcggctgccccaatggctacaccaacgcctcgggccgaagggcacccgccaacccatacaatctccacaatagccgccacggtgaccgcgcctcatagcgaatcttctctcagcaccggccccgccccagctgccatggcaactacgtcctccaaacccgagggcagaccacggggacaggccgccccaacaatcctcctgacgaaaccacctggtgcttag

SEQ ID NO: 47124 - DNA, 1467 bp, Artificial Sequence
  Description of Artificial Sequence: Synthetic coding sequence
atgaagcggagcctgcaggccctgtactgccagctgctgagcttcttacttatcttggctctgacggaagctctggcctttgccatacaggagccaagccccagggaatcgcttcaggtactgccaagtggaacacctcccggcactatggtcactgccccacatagctctacacggcataccagtgtggtgatgctgacacccaaccccgatggccccccaagccaggccgctgcccctatggccacgcccacacctagggccgaggggcaccctcctactcatactatctccaccatagctgctacagtgaccgccccacacagcgagtcatcgctgagtacaggacctgcgcccgcagctatggccacaactagcagcaagcccgaggggcggccccgggggcaggccgccccgactatccttttgaccaagcctccgggtgccacatctcggccaactaccgctccccctagaaccaccactcggagaccacccagaccgccaggctcaagccgaaagggcgccggcaattcctcacgtccggttccccccgcacccggggggcacagccgcagcaaagaggggcagcggggaaggaacccttctagcactcctctgggccaaaagagacctctgggaaagatctttcagatctacaaagggaacttcactggctccgtcgaacccgagccctccactcttactccgcgcacgcccctgtgggggtacagttcatcaccacaaccacagaccgtcgctgccacgacggtgccatctaacacgagctgggctcccacaaccacatctttaggtccggctaaggacaagcccggcttgcgccgcgccgcgcagggcggcggttccactttcactagccaaggcggcaccccggatgccacagcagcctctggggcaccagtctcaccccaggccgcaccagtaccttcccagcgtccccaccatggcgatcctcaagacggaccatcccattccgattcctggcttaccgtcactcctggaaccagcaggcccctcagtactagttctggcgtgttcacagcagctactggccccactccggcggcatttgacaccagtgtgtcagctccttcacagggaattcctcagggagccagcacaaccccccaggctcccacccacccgtccagggtatcagaaagtactattagtggagctaaagaagaaaccgttgctacattaacgatgacagacagggtaccatcaccactctccactgtcgtaagtaccgccacagggaacttcctcaaccgcctggttcctgcgggcacctggaaacctggaaccgcgggcaacatttcgcatgttgcagaaggagataaacctcaacaccgggccacaatatgcctgtccaaaatggatattgcttgggtcatcctggcaatttccgtccctatcagttcctgtagcgatcctatcacgtag

SEQ ID NO: 47125 - DNA, 1515 bp, Artificial Sequence
  Description of Artificial Sequence: Synthetic coding sequence
atgagcctgatctgcagcatcagcaacgaggtgcccgagcacccctgtgtgagcccggtgtccaaccacgtatatgagcggcgcttgattgagaagtatattgctgaaaatgggactgatcctattaataatcagcctttatcagaggagcagctgattgatataaaagtggctcaccctattaggccaaagcccccctccgccaccagcatcccggcgatcctcaaagctctccaggatgaatgggatgccgtcatgttgcacagcttcactttgcgccagcagctacagacgaccaggcaagagctgtcccacgccttgtaccagcacgatgccgcttgccgggtgatcgcgagactgacaaaggaggtgacagcagcccgcgaggccttggcgacactcaaacctcaagccggattgatcgttccccaggcagtgcccagctctcagccgtcagtagtcggggctggggagccaatggacctgggcgagctagtggggatgacgcccgagataattcagaagttacaggacaaggcaacggttctgaccacggagcgcaagaaaaggggaaagaccgtgcctgaggagctcgtgaagccggaggagctgagcaaataccgacaggtggcctcacatgtgggcctgcatagcgcttcaatcccaggcatacttgccctagatctctgtccgagcgacaccaacaaaatactgaccggcggcgcagacaaaaatgtggtagtgtttgataaatccagcgaacagattctggcaaccctgaaaggccacacgaagaaggtcacatcagtcgtgttccatcccagccaagatctagtgttttccgcctctccggatgcgactattaggatctggagcgtccccaatgcatcttgtgtacaagtggtgcgggcgcacgagagcgccgtgacaggattgagcttgcatgctaccggcgattatctgctgtcctccagcgacgatcagtattgggccttctctgacattcaaactgggagggtgttgaccaaggtgaccgacgaaacctccggctgcagccttacttgcgctcaatttcacccggatggactgattttcggcacgggaactatggactcgcaaatcaaaatttgggacctgaaggagcgaaccaatgtcgctaattttccaggtcatagcgggccaataacaagtatcgcctttagtgagaacgggtattatctggccacagccgctgacgattcttctgttaaattatgggacctgcggaagctcaagaattttaaaaccctgcagctggataataacttcgaagtgaagagtctgattttcgatcagagcggaacttatctcgctctgggaggaactgatgtgcagatctatatttgtaagcagtggactgagattctgcactttacggaacacagtggcctgactactggcgtagcattcggccaccacgcgaaatttatcgcctccaccggaatggaccggagtttgaagttttactcactatag

SEQ ID NO: 47126 - DNA, 705 bp, Artificial Sequence
  Description of Artificial Sequence: Synthetic coding sequence
atggccgccagcagcatcagcagcccctggggcaagcacgtgttcaaggccatcctcatggtactagtcgccttaattttgcttcacagtgccctggcacagagccggcgggattttgcaccccctgggcagcagaagcgagaagcacccgtagacgtgctgactcaaatagggagatcagtcagagggacgcttgatgcctggatcggaccagaaactatgcacctggttagcgagagctctagtcaggtactctgggctatctcctcagcaattagcgtggccttctttgccctctcggggatcgccgcccagctgcttaatgctctgggcttggccggggactatctagcccaggggctcaaattgagccctggacaagtccagacctttctcctctggggcgccggagccctggtggtgtattggctactatcgttactgctgggactggttctggccctgctgggccgtatcctgtgggggctgaagctggtcatctttctcgccggatttgtcgccctaatgcgatctgtgcctgacccgtccacacgcgcactgctacttctagctctgctcacaccttgccctttcctggctttgtccctgaatctccagaatattgatccttgccgaagtcctacctcccaggagaaacaacgcaaaacaatcccccccgcctgcccttgtggtcctgttttctag

SEQ ID NO: 47127 - DNA, 732 bp, Artificial Sequence
  Description of Artificial Sequence: Synthetic coding sequence
atggccgccagcagcatcagcagcccctggggcaagcacgtgttcaaagccattctgatggtgctggtagcgctaatcctgctgcactctgctctggcccaaagtcgtcgggacttcgcaccccccggacagcagaagcgagaagcccctgtggatgtcttgacccagattggtcgcagcgtcagggggactcttgacgcgtggatcggcccagagacaatgcacttggtgtctgagagcagcagtcaggtcctgtgggcgatatcgagcgccataagtgttgctttttttgccctgtcggggattgccgctcaactgctcaacgcccttggcctagccggagattacttggcccagggactgaagctatcaccagggcaggttcagactttcctcctgtggggtgccggagcattggtggtgtactggctcctctcccttctactgggactagttctggctctccttggaagaatcctatggggcctgaagcttgtgatctttttggccgggtttgtcgcactgatgaggagtgtgccggaccctagcacacgggctctactactattggcactgctcattttgtatgctctgctgtctagactcaccggaagtagagcaagtggggcccaacttgaggcgaaggtacgcggactagagcgacaagtggaggaacttcgctggaggcagcgacgtgccgctaagggcgcacggtctgttgaagaagagtag

SEQ ID NO: 47128 - DNA, 579 bp, Artificial Sequence
  Description of Artificial Sequence: Synthetic coding sequence
atggccgcctggggccggcggcggctgggccccggcagcagcggcgggtctgcccgggagagggtgagtctctccgccactgactgctacatcgttcacgagatctataatggtgagaatgcccaggaccaatttgagtatgaactggagcaggcactggaagcccaatataaatatatcgtgatcgagccaacgagaatcggagatgagacagctcggtggatcacagtggggaactgtctgcacaaaaccgccgtgctagctggcaccgcctgcttgtttacaccactagctcttccgcttgactacagtcactacatcagcctgccggctggagtgctgagcttggcatgttgcactctatacggcataagctggcagtttgacccctgctgcaagtatcaggttgagtatgatgcctacaagctctcccgacttcccctacacaccttgacttcctccactcctgtggtcctggtgcgcaaagatgatctgcacaggaaacgtctgcataatactattgcactggccgccctcgtttactgcgtcaaaaaaatatatgagctgtatgcggtgtag

SEQ ID NO: 47129 - DNA, 885 bp, Artificial Sequence
  Description of Artificial Sequence: Synthetic coding sequence
atgcagggccccgccggcaacgccagccggggcctgcccggcggccccccttctactgttgccagtggtgctggaagatgtgagtccggggctcttatgcacagctttggaatctttttgcagggcctattaggggtggtggcattctcaacgctcatgctgaagcgctttagggaacctaagcatgagcggcgaccatggaggatttggttcctggatacaagcaagcaggctatcggcatgctctttatccacttcgccaatgtgtacctagctgacctgacagaggaggatccttgttctctctacttaatcaactttctgcttgacgccacagtcggaatgctgttaatatacgtaggcgttagagccgtatctgtgctggtggagtggcaacagtgggagtctctgcgcttcggcgaatacggggatcccctccagtgcggagcctgggtgggacaatgtgccctctacatagtaattatgattttcgagaagagcgtggtgtttattgttcttctgattttgcagtggaagaaggttgcactcctgaaccccattgagaaccctgatctgaagttagctatcgttatgctgatagtgcctttcttcgtgaatgccctgatgttttgggtggtggacaacttcctgatgcgaaagggcaaaacaaaagccaaactagaagaaaggggtgctaatcaggattcccggaatgggagcaaggttaggtacagacgcgcggcgagccacgaagagagcgaaagtgagatcctgattagcgctgatgacgagatggaagaatcggacgtagaagaggatcttagaagacttacaccgttgaaacctgtgaaaaagaaaaagcaccggtttggcctccctgtgtag

SEQ ID NO: 47130 - DNA, 786 bp, Artificial Sequence
  Description of Artificial Sequence: Synthetic coding sequence
atggccggccccgagctgctgctggacagcaacatccggctgtgggtcgtgctacctatcgtgatcatcacttttttcgtggggatgatcagacactacgtgagcatcttactgcaatccgacaaaaagctgacacaagagcaagtctcagattcccaagtcctgatccgaagccgggtcttaagggagaatggcaaatacatccccaagcagagctttctgacccgcaagtactacttcaataatccggaagacggattctttaagaaaactaagagaaaggtggttcctccaagccccatgacagatccaacaatgctgacggacatgatgaagggcaatgtgacgaacgttctacccatgatcctcatcggcggttggataaatatgacattcagcgggttcgtgactaccaaagtgccctttcccctgactctgagattcaagccgatgctgcagcagggcatcgagctacttactctagacgcatcatgggtttcctcagcctcatggtacttcctcaacgtattcggcctgcgatccatctattccttaatcctgggccaggataatgcagctgatcagtcacgaatgatgcaggaacaaatgaccggggccgccatggctatgccagccgacactaataaggccttcaaaacagagtgggaggcccttgaactcaccgaccaccaatgggccttagacgatgtagaggaagagttgatggctaaggatttacacttcgagggcatgttcaagaaggaactgcagactagtatcttctag

SEQ ID NO: 47131 - DNA, 612 bp, Artificial Sequence
  Description of Artificial Sequence: Synthetic coding sequence
atggccggccccgagctgctgctggacagcaacatccggctgtgggttgtgctgcctattgtgattattacattttttgtgggaatgatacgccactacgtcagtatcttgctgcaaagcgataagaaactgacccaggagcaagtgtcagatcgcaaatatctatccggcctggtccagtggctcacgcctatcatcccagccctgtggggagcagaaatgggcggttccctggagccacgcaatctaaggccaaccttggcagcgtgccaggttctgatcaggagccgcgtgttgcgcgaaaacggcaaatatattcctaaacagagttttctgaccagaaagtactattttaacaacccagaggacggcttcttcaaaaagacaaagagaaaggtagtccccccatcgcctatgacagaccccaccatgcttacagatatgatgaaaggtaatgtcacgaacgtgctgccgatgattttaattggaggttggattaacatgactttcagcgggtttgttacgaccaaggtaccctttccacttacacttagattcaagcccatgttacagcaaggcatcgaactgctgactctggatgcatcctggtag

SEQ ID NO: 47132 - DNA, 1056 bp, Artificial Sequence
  Description of Artificial Sequence: Synthetic coding sequence
atgcagcgggccctgcccggcgcccggcagcacctgggcgccatcctagcttccgcctccgtcgtcgtcaaagcgctgtgtgctgctgtgctatttctttaccttctgtctttcgccgtggacaccgggtgtctcgccgttactcctggttacctgttcccccctaacttctggatctggaccctggccacccatggcctgatggaacagcacgtgtgggacgtagcaattagcttgaccaccgtggtagtggccggccgattactggaaccgctgtggggcgctctggaattgctcatcttcttctcagtagtaaacgtatcggtggggttgcttggagcctttgcctatctgttgacctacatggcctcttttaatcttgtatacctgttcactgtgcgcatacatggagcactgggctttttagggggcgtgctggttgcactgaagcagaccatgggcgactgcgtagttctgcgtgtcccccaagtgagagttagcgtaatgcccatgctgcttttggcattgttgctgctacttaggctggccactctgctccagagccctgccctggcttcttatgggtttggcttactaagttcatgggtatatttgagattctaccagagacactcccgcggacgcggggatatggctgaccattttgccttcgccactttctttccagagatactgcagcctgttgtgggattgctcgccaaccttgtgcactctctcctcgttaaggtgaaaatatgccagaaaactgttaaacgttacgacgtgggcgctccttccagcatcacaattagcctgccaggcaccgacccccaggatgccgagcgccggcgtcaacttgccttgaaggccttaaacgagcggctgaagagagttgaagaccaaagcatttggccaagcatggacgatgatgaggaagagagcggtgctaaagtcgactctcctctgccttcagacaaggctccaacccccccaggcaagggggctgccccagaaagttccttgatcacatttgaggctgctccccctactttgtag

SEQ ID NO: 47133 - DNA, 738 bp, Artificial Sequence
  Description of Artificial Sequence: Synthetic coding sequence
atgaagcacacccagagcggccagagcaccagccccctggtgatcgactacacgtgtcgcgtgtgtcagatggcgtttgtgttctcctctctcataccgctgctgctcatgacacctgtattttgtcttggaaataccagcgaatgttttcagaattttagccagtctcacaagtgtatactgatgcactcacctccaagcgctatggccgagctgccgcctagcgctaatacctccgtttgcagcaccctctatttctacggtattgccattttccttggcagttttgtactcagtctgctcaccatcatggtgcttctgatcagagcccagaccctgtacaagaaatttgtgaagtcaactggctttttgggctctgaacaatgggctgttatccacattgtggaccagagagtccgcttctacccggtcgctttcttctgctgttgggggcccgctgtgatcctaatgatcatcaaattgaccaagccgcaggacaccaagctccatatggcactgtacgtcctgcaggcacttacagccacttcccaagggctgctcaactgcggggtctatggctggacccagcacaagttccaccagctgaagcaggaggcccgcagggacgctgatacccagacaccgctgctgtgcagccagaaacggttctactcaaggggcctgaactcccttgagtcaaccctgactttcccagcctccactagcacaatcttttag

SEQ ID NO: 47134 - DNA, 738 bp, Artificial Sequence
  Description of Artificial Sequence: Synthetic coding sequence
atgaagcacacccagagcggccagagcaccagccccctggtgatcgattatacttgtagggtttgtcagatggctttcgtgttcagttccttgattcccctgttgctgatgacgcccgtcttctgccttgggaacacgtcagaatgctttcagaacttctcccagtcccacaaatgtatcttgatgcattctccgcccagcgcgatggctgaactcccccccagtgcaaatacgtcggtctgctctaccctgtatttttacgggattgccattttcctgggctcatttgtgctgagtctccttactataatggtgttgctgattcgcgcccaaacactctacaagaagttcgtcaaatctactggtttccttggaagcgagcaatgggctgtgattcacatcgtagaccagcgggttcgattctatcccgtggcattcttttgctgctggggacccgccgtgattctaatgattatcaagctcacaaagccccaggataccaaactgcacatggctctgtatgtgttgcaggccttgacggccacgtcgcagggactgctgaattgcggcgtgtacgggtggactcagcataagtttcaccagttaaagcaggaggccagaagagacgctgatacccaaactccactactgtgcagtcagaaaagattttattcccggggattgaatagcctggagtcaactcttacatttcccgcctctacctccaccatcttctag

SEQ ID NO: 47135 - DNA, 225 bp, Artificial Sequence
  Description of Artificial Sequence: Synthetic coding sequence
atggccaccctgagcgtgatcggcagcagcagcctgatcgcctacgcagtgttccacaatatccagaaaagccccgaaattcgaccgctgttctacctgagtttctgtgaccttctgttaggtttatgttggctgactgaaacactgctgtatggtgcaagcgtggcaaataaggatattatctgctataaccttcaagcagtaggacaagtcagtgccacctag

SEQ ID NO: 47136 - DNA, 321 bp, Artificial Sequence
  Description of Artificial Sequence: Synthetic coding sequence
atggccaccctgagcgtgatcggcagcagcagcctgatcgcctacgcagtttttcacaatatccagaaaagtcccgaaatccggccactcttctatttgtctttctgtgatctcctgctggggttatgctggttaacagaaaccttgctatatggtgcaagcgtcgccaataaagatattatctgctacaatcttcaagcagttggtcagatattctacatcagctcctttctctacaccgtgaactatatctggtatctctatactgagctgcgtatgaagcacactcagtccggacagtccaccagccctctcgtctag

SEQ ID NO: 47137 - DNA, 528 bp, Artificial Sequence
  Description of Artificial Sequence: Synthetic coding sequence
atggccaccctgagcgtgatcggcagcagcagcctgatcgcctacgctgttttccacaacatacagaagagtcctgaaatcagacctctgttttacctatcgttctgcgacctattgctgggcctgtgttggctaaccgagactctgctgtatggcgcgtccgtcgccaataaggatattatttgctataacctacaagcagtcgggcagatcttttacatttctagttttctgtataccgtgaattatatctggtatctgtatactgagctcagaatgaaacatactcagtcaggacagagtacttcccccctggtcatcgattacacctgccgggtgtgccagatggcatttgtatttagcagcctaattcctctgctcctgatgacccccgtattctgcctgggaaacacaagtgagtgcttccagaacttctcccagtctcacaagtgcatacttatgcacagcccgccatccgccatggctgagcttcccccaagtgcgaacacttctgtctgtagtacttag

SEQ ID NO: 47138 - DNA, 156 bp, Artificial Sequence
  Description of Artificial Sequence: Synthetic coding sequence
atggccaccctgagcgtgatcggcagcagcagcctgatcgcctacgccgtgtttcacaacatccagaagtcccctgagattcggcctttattttatctgtccttttgcgatcttctgctggggctgtgttggctcacggagaccctcctgtactag

SEQ ID NO: 47139 - DNA, 738 bp, Artificial Sequence
  Description of Artificial Sequence: Synthetic coding sequence
atgaagcacacccagagcggccagagcaccagccccctggtgatcgattatacttgtcgggtctgtcagatggcatttgtgttttcaagtctgatccctctgctgctcatgacgcccgttttctgcctgggaaacacctcagaatgcttccagaatttttctcaatcgcacaagtgcattctgatgcactccccaccctccgcgatggccgagttgcctccttcagccaatacctccgtgtgctctaccctgtatttctatggaatcgcaatttttttgggttcatttgtgttgtcactgctgacaattatggtactgctcatccgcgcccagactctctataagaaatttgttaagagtaccggttttttgggttctgagcaatgggccgtgattcacatagtcgatcagcgagtccgattttatcccgtggcctttttttgttgctgggggccagccgtgattcttatgataattaaactgacgaaacctcaggatactaagctgcacatggcgctgtatgtacttcaggcattgaccgctacaagccaaggcctcctgaactgcggtgtttatgggtggacgcagcacaaatttcaccagctgaagcaagaagctagaagggatgccgacacacaaacccctctcctttgttcccagaagcgcttttattctcgcggcctgaatagcctggaaagcactcttacctttccagccagcacttcaactattttttag

SEQ ID NO: 47140 - DNA, 1014 bp, Artificial Sequence
  Description of Artificial Sequence: Synthetic coding sequence
atggccaccctgagcgtgatcggcagcagcagcctgatcgcctacgccgtctttcataatatccagaagtcccctgaaataagacctctgttctatctttcgttctgcgacctgttgctgggactctgttggttaactgagacgctgctctacggtgccagcgtggcgaataaagacatcatttgctataatcttcaggccgtgggtcagatcttctacatatctagtttcttgtacactgtcaattatatttggtatctctatacagagctcaggatgaagcacacccaatcaggccagagtacatccccactagtcatcgactacacgtgccgggtgtgtcaaatggcatttgtcttctcttccctcattcctctcctgctaatgactccagttttctgtctggggaatacaagtgagtgttttcagaatttctcacaatcacataaatgtatcctcatgcactcccccccatccgcgatggcagaactcccgccctcagcgaatacgagtgtgtgcagcactttatacttttatgggatcgccatcttcttagggtcatttgtgctgagcctgctaactatcatggtccttttgattagagcccagacactttataagaagttcgttaagtctacaggctttctcggctcagaacagtgggctgtgatccatatcgttgatcagcgagtaaggttctaccccgtagccttcttctgttgttgggggcctgccgtcattctgatgatcataaagctgactaaaccacaggacaccaaacttcatatggccctttatgtactgcaggctctgactgcgacctctcagggcctgctcaactgtggagtatatggttggacacagcataaattccaccagctgaagcaggaagcaaggcgggatgccgacacccaaactccactgctctgctcgcagaaacgcttctatagtagaggacttaatagcctggagtcaaccctgactttccctgccagcacttcaaccatattctag

SEQ ID NO: 47141 - DNA, 909 bp, Artificial Sequence
  Description of Artificial Sequence: Synthetic coding sequence
atggccaccctgagcgtgatcggcagcagcagcctgatcgcctacgcggtctttcacaatatccagaagtcacctgaaatcaggcccctgttttacctgtccttttgtgatctgttactgggattgtgctggttgactgagaccttactgtatggtgcatccgttgcgaataaggatattatctgttataacctgcaagccgtgggacaggtcattgactacacatgccgtgtgtgtcagatggcgttcgtgttctcgagcctgatccccctgctccttatgacacctgtgttttgcctcggcaacacctccgaatgttttcaaaacttctcccaaagtcataaatgtatactgatgcatagcccaccctcggccatggctgagctgccgccttccgctaatacatctgtctgctctactctgtatttctatgggatagccatctttctcgggagctttgtgctcagtcttctgactattatggtcctgctgattagggcacagaccctctataagaagtttgtgaaatcaacaggattcctaggaagcgaacaatgggccgtgatccacattgtggatcagagggtgcgattttatccagtggccttcttttgctgctggggaccggcagtgatcttaatgataattaagctgaccaaaccacaggatactaaattgcacatggcactctatgtgctgcaggccttaactgcgacttcccaagggctcctgaactgcggagtctacggttggactcagcataaattccaccagcttaagcaggaagctcgacgagacgctgacactcagacaccgctgctatgttcccaaaagcgcttctactcccgcggactaaactcattagaatcgactctgaccttccccgcgagcacatctaccattttctag

SEQ ID NO: 47142 - DNA, 1545 bp, Artificial Sequence
  Description of Artificial Sequence: Synthetic coding sequence
atgggcaaggacttccggtactacttccagcacccctggagccggatgattgttgcttatctggtgatctttttcaactttctgatatttgctgaagaccctgtgagtcattcgcagacagaagctaatgtcatagttgtcgggaattgtttcagttttgtcacaaacaaatacccaaggggcgtgggatggagaatactcaaagttctcttgtggctgctcgcaatcctcactggtttgattgcaggtaagtttctattccaccagaggctcttcggccagttgctaaggctgaagatgttcagggaggatcacggttcttggatgactatgtttttcagtacaattctctttctatttattttcagccacatatataacacaatcctgctgatggatggcaacatgggtgcctacattattacggattatatgggaattcgaaacgaatctttcatgaagcttgccgcagtgggtacttggatgggtgattttgttacagcgtggatggtgactgatatgatgctgcaggacaaaccctaccccgactggggtaagtccgcccgcgcattttggaagaaggggaacgttaggatcactttgttttggacagtcctgttcacactcacatcagtcgtggtcctcgtcatcactaccgattggatatcttgggataagctgaacagaggtttcctgcctagtgatgaagtgtcccgggcatttctggccagtttcatcctggtgttcgacctccttatcgtgatgcaggactgggaattccctcatttcatgggagatgtcgatgtcaatttgccaggtctgcacacaccccacatgcagttcaagatccctttttttcaaaagattttcaaagaagagtatagaatacatatcaccggtaaatggttcaattatggaatcatttttctggtgctcattctggacctgaacatgtggaagaaccagatcttttacaagccacatgaatacggacagtacatcggtccagggcagaagatctacaccgttaaggatagtgaaagtctgaaggatttaaatagaacaaagctttcatgggagtggaggtcgaatcataccaaccctaggactaacaagacttacgtggagggtgacatgttcttacattctagattcatcggagcatccctggacgtaaagtgcctagcgttcgtgcccagccttatcgcattcgtttggtttggctttttcatctggttttttgggcgcttcctgaagaatgagccgcgcatggagaatcaggataagacatacactagaatgaagcgaaagtcaccatctgagcactcaaaggacatggggattacccgggaaaatacccaggcgtccgttgaagaccccttgaacgaccccagcttagtgtgtatccgctcggattttaacgagattgtatacaagtcatctcatctcacatccgaaaatctctcctctcagcttaacgaatctacctcagctaccgaagctgatcaagatcccactacctctaagtctactcccaccaactag

SEQ ID NO: 47143 - DNA, 789 bp, Artificial Sequence
  Description of Artificial Sequence: Synthetic coding sequence
atgtacatcaaggactgggagttcccccacttcatgggcgacgtggatgtgaatctgcccggactacatacgcctcacatgcagttcaaaatcccctttttccaaaaaatctttaaggaggagtatcgcatccacatcacggggaagtggttcaattacggaataatttttttggtgcttattctagacctgaatatgtggaagaaccagatcttctacaaaccacacgaatacggacagtatattggaccaggtcagaagatctacactgtcaaagatagtgaatcccttaaagaccttaatagaaccaaactttcttgggagtggaggtctaaccacactaacccgagaactaataaaacttacgtggaaggggatatgttcctccattcgcgttttattggagcttcccttgacgtaaagtgcttggccttcgtgccttcacttatcgccttcgtttggttcgggttttttatttggtttttcggacggtttttgaagaatgagcccaggatggaaaaccaggacaagacttacactcgaatgaaaaggaagagtcctagtgagcatagtaaggatatgggaattacccgcgaaaatacccaggcctccgtggaggacccgctgaacgacccaagtttagtttgcatccggagcgacttcaatgaaattgtgtataagtctagccatcttactagcgaaaatctttcgagccagcttaacgagagcacatcggcaacagaagcagaccaggaccccacaacctccaagagcactcccacaaattag

SEQ ID NO: 47144 - DNA, 1233 bp, Artificial Sequence
  Description of Artificial Sequence: Synthetic coding sequence
atggccacctgccacagccaccggaccaacagctggcagatcagcgtaccatcagcatttgtatggtccgtggcgccaatcaagaacgtctccaggagatcctgggtcgtggacgacaatgtcctgcaacacaatagcctgagtcttcacatcttctcacacatccagcacgacagcagtaatggctgggagcacggcgtaactgatatgatgcttcaggacaaaccatatcccgattggggcaaatccgctcgcgccttttggaagaaggggaatgtcaggataacactgttctggaccgtcctgtttaccctcacctcagtggtcgtgctggtgatcaccacagactggattagctgggataaacttaaccgggggttcctgccctctgatgaggttagcagggcctttctggcctcgtttatacttgtgtttgaccttttgattgtgatgcaggattgggagttcccacactttatgggcgacgtggatgtcaacttacccggtctccataccccacatatgcagttcaaaatcccattttttcagaagatattcaaggaagaataccgcattcacataacaggcaaatggttcaattacgggattatctttcttgtgttgattctggacctcaatatgtggaaaaaccagatattctacaaacctcatgagtacgggcagtatataggcccaggtcagaaaatctatacggtgaaagacagcgaatccttgaaagacctgaacaggacaaagctctcctgggagtggcgctccaatcatactaacccccggactaacaaaacgtatgtggagggagacatgttcctgcactcgagattcattggtgcctccctggacgtgaagtgtctcgcctttgtccctagcctaatagctttcgtgtggtttggatttttcatctggttttttgggagatttcttaagaatgaaccaagaatggagaaccaggataagacttacacccgcatgaaacggaagagcccatctgaacattccaaagatatgggcatcacccgcgagaatacacaggcatcagtggaggatccactcaatgatccctctctggtatgcatcaggtctgattttaatgagattgtatacaaaagctctcatctgaccagcgaaaatctgtctagtcagttgaatgagagcacatctgcgacagaggctgatcaagacccaacaacttccaagtctacccccacaaattag

SEQ ID NO: 47145 - DNA, 852 bp, Artificial Sequence
  Description of Artificial Sequence: Synthetic coding sequence
atggtgagcgccgccgcccccagcctgctgatcctgctgctgctgctgctcggctccgtccccgccactgatgccaggtctgtgcctcttaaagccacttttttggaagacgtcgccggctctggggaagccgaaggttcttccgctagctcaccgagcctgccgccaccgtggactcctgcactgtcccccacttctatgggccctcagccaatcacattggggggaccaagtccccctaccaattttctggatggcattgtggatttctttcggcagtatgtcatgctgatcgccgtagtcggaagccttgcttttctgctgatgttcattgtgtgcgcggccgtgattaccagacagaaacagaaagctagtgcctattaccctagctcattcccaaagaagaaatatgtggatcagagcgacagggccggaggcccacgggcatttagcgaggtgccagatagagcaccggattccaggccagaagaggctttggacagctcgcgtcaacttcaagcagatatacttgcagctacccaaaatttaaagtctcccacccgcgccgccctcggaggcggggacggtgcccgcatggtagagggacgaggagcagaagaggaagaaaaaggaagccaggagggggatcaggaagtccaaggccatggcgtccctgtagaaactccagaggcccaggaggaaccctgttcgggagtcttggagggagctgttgtggcaggggaggggcaaggggagctcgaaggaagcttgcttctggcgcaagaagcccagggcccagtggggccccccgaatccccatgtgcttgtagttcagtgcatcctagcgtctag

SEQ ID NO: 47146 - DNA, 654 bp, Artificial Sequence
  Description of Artificial Sequence: Synthetic coding sequence
atgggcccccagcccatcaccctgggcggccccagcccccccaccaacttcctcgacggaattgtggacttcttccgtcagtatgtcatgcttatcgccgttgtcgggagtctagcctttcttctgatgtttatcgtttgcgcagccgtgatcacacggcaaaagcagaaggcttctgcttactatccaagtagctttccaaaaaaaaagtacgttgaccagagtgatagagctgggggcccacgcgcttttagcgaagtgcccgatagagcaccggattcacggccagaggaagccctggactcaagcaggcaactgcaggccgacatcctggccgccacccagaacctgaaatcaccaactcgggcagcactcggtggtggcgacggagcgaggatggtcgagggccgaggcgcggaggaggaagaaaaggggagccaggagggcgaccaggaagtccagggtcatggcgtacccgtggagacacccgaagcgcaggaggagccctgttctggagtgttggagggggcagttgttgctggggaggggcagggcgagttagagggcagtctgctactagctcaggaggctcagggccctgtgggcccgccagaaagtccctgtgcttgttccagcgttcacccctcagtgtag

SEQ ID NO: 47147 - DNA, 87 bp, Artificial Sequence
  Description of Artificial Sequence: Synthetic coding sequence
atggtgagcgccgccgcccccagcctgctgatcctgctgctgctgctgttaggttccgtgcctgccacagatgcaagaagcgtctag

SEQ ID NO: 47148 - DNA, 423 bp, Artificial Sequence
  Description of Artificial Sequence: Synthetic coding sequence
atggtgagcgccgccgcccccagcctgctgatcctgctgctgctgcttctgggctccgtaccagctacagacgctcgatccgtccctttgaaagcaacttttctcgaggacgtcgctggatcgggtgaagcggagggatctagcgcaagctccccaagcctgcccccgccgtggacgcccgccctgtcaccaacttcaatgggacctcagccgatcaccctcggtgggccaagtcctcctaccaactttctcgatgggatcgtagacttctttcggcagtacgtgatgctgatcgcagtggtgggttcactggccttccttttaatgtttatcgtatgtgctgccgtgataactcggcagaagcagaaggccagcgcttactacccctctagttttcccaaaaagaagtacgtggatcagtag

SEQ ID NO: 47149 - DNA, 135 bp, Artificial Sequence
  Description of Artificial Sequence: Synthetic coding sequence
atggtgagcgccgccgcccccagcctgctgatcctgctgctgctgctcctggggagcgtccccgcgacagatgcccgctctgtgcccctgaaggctaccttccttgaggacgtggccggcagtggagaggcttag

SEQ ID NO: 47150 - DNA, 1020 bp, Artificial Sequence
  Description of Artificial Sequence: Synthetic coding sequence
atgagcggccagctggagcggtgcgagcgggagtggcacgagctggagggagaattccaggaactgcaggagacccatcggatatacaaacagaagttggaggagctcgcggcactacaaaccctttgttcaagttccatttctaagcagaaaaagcacttaaaggatttaaagctgacactccaacggtgcaaaagacatgcatcacgcgaagaagctgagttggttcagcagatggcagccaatatcaaagagaggcaggacgtgttttttgacatggaggcttacctacccaaaaaaaatggtctgtacctgaatctggtcttaggaaatgtgaatgtcacgcttctgagtaaccaagcgaagttcgcctacaaagacgagtatgagaaattcaagctgtatttaaccatcatcctcctgttaggagccgtagcttgccggtttgttctgcactaccgtgtcacagacgaagtcttcaactttctgcttgtttggtattattgtacactgaccatcagagaatctattttaatttccaatgggagccggattaagggctggtgggttagtcatcattacgtgagcacattcctgtctggtgtgatgctcacctggcctaacggcccaatttaccagaaatttcgaaaccagttcctggcgttcagtattttccagagttgtgttcagttcctgcagtactattaccagcggggttgtctgtatagactcagggcattgggagagcgcaaccatctcgatttaactgtcgaagggttccaatcttggatgtggaggggactgaccttcctgctacccttcttgttctgcgggcatttctggcagctgtataatgcagtaactttgtttgaactctccagtcacgaagaatgcagggaatggcaagtgtttgttctggcctttacctttttgattttattcttaggaaacttccttactactcttaaagttgttcacgctaagttacagaagaatcgcgggaaaacgaaacagccatag

SEQ ID NO: 47151 - DNA, 1020 bp, Artificial Sequence
  Description of Artificial Sequence: Synthetic coding sequence
atgagcggccagctggagcggtgcgagcgggagtggcacgagctggaaggtgaattccaagagctgcaggagacccacaggatctacaagcaaaaactggaagagctcgcggccttacagaccttgtgcagcagcagtatctcgaaacagaaaaaacacctgaaggacctgaaactcactctccagcgatgcaaaagacacgcaagccgtgaagaggcggagttggtacagcagatggccgccaatatcaaggaacggcaggatgtcttctttgacatggaggcttacctgccaaagaaaaatgggctctacctgaatcttgttctgggtaacgtaaacgtgacccttttgagtaaccaagccaagttcgcctataaggacgagtatgagaaatttaagttatatctcactattattctgctccttggggccgtggcctgcagatttgtgctgcattatcgggttacggacgaggtgtttaacttcttactcgtctggtactactgtacacttaccatccgggagtctatacttattagcaatggttctagaatcaaggggtggtgggtgtctcaccactatgtgtccacctttctttctggcgtcatgctgacctggccgaatgggcctatttatcagaagttccgaaaccaatttcttgcattcagcatctttcagagctgcgtacagttcctgcagtattactaccagaggggctgtttgtacaggctgcgggcccttggggagagaaatcacctcgacctgactgttgaagggttccagagctggatgtggcgcggtctcacttttcttctgccttttctgttttgcggacacttctggcagctctataatgccgtcacccttttcgaactgtcctctcacgaggaatgccgggaatggcaggtattcgtgctggctttcacttttcttatcttattccttggtaacttcttgactactctgaaagtcgtgcacgccaagctccaaaagaaccgcggcaagacgaaacagccctag

SEQ ID NO: 47152 - DNA, 960 bp, Artificial Sequence
  Description of Artificial Sequence: Synthetic coding sequence
atggtgctgcccccccccgaccggcggcacgtgtgcctgaccaccctggtgatcatgggatcgatggccgtcatggatgcctacctggttgaacagaatcaaggcccgaggaaaatcggagtctgtatcatcgtactggttggcgacgtgtgcttcctcttagttctgaggtatgttgccgtttgggtaggggctgaggtgcgcaccgccaagaggggctacgctatgatcctgtggtttctatatatattcgtgctggaaatcaagctgtactttatcttccagaactataaggccgccagaaggggggccgccgatcctgtcgcaagaaaagctctgactctcctgctgagtgtttgtgtgcctgggctttttttgctcctggtcgcgctggatcggatggagtatgttaggactttcaggaagagggaggacctcagggggcggcttttctgggtcgcgctcgacctgctggatctcttagacatgcaagcatcactttgggaaccgccccggtccggcttacctctgtgggcggaagggctcacgtttttctattgttatatgctcttgctggtccttccctgtgttgcattgtctgaggtgtctatgcagggagaacatatagcaccccagaagatgatgctgtaccctgtactctccctggcaaccgtgaacgtggtggctgtgcttgcccgtgcagccaacatggcattatttcgggattcaagagttagtgcaatctttgtcggaaaaaacgtggtggcgctggccacaaaagcatgtaccttcctcgagtaccgccgacaggtgcgagattttccaccgccggccctgagcctggaattgcaacctccccccccacagcgcaactcagtgccgccaccgccccctcccctgcatggccccccagggcgcccccatatgtccagccctacccgcgaccctctggacacttag

SEQ ID NO: 47153 - DNA, 960 bp, Artificial Sequence
  Description of Artificial Sequence: Synthetic coding sequence
atggtgctgcccccccccgaccggcggcacgtgtgcctgaccacccttgtcatcatgggatcaatggccgtgatggatgcctatttagtggagcaaaaccagggcccaaggaaaatcggcgtctgcatcatagtgctcgtgggcgatgtctgctttctcctagtcctaaggtacgtggccgtgtgggtaggagctgaggtcaggaccgcgaagcggggttacgccatgatcctttggtttctgtatatcttcgtgctggaaataaagttatatttcatctttcagaactataaggcagcaaggcgaggcgccgctgatcccgtggcccgcaaagctctcacactgcttctgagcgtatgcgttcctggtctctttctgcttctggtggccctcgatcgaatggagtacgtccgcacattcagaaagcgggaagacctccgcggtcgtctgttctgggtggccctggatttgttagacctgctcgatatgcaggcaagcctgtgggaacccccacggtctggtctgcctttgtgggccgaaggcctgactttcttctactgctatatgctcctgctcgtccttccctgcgtcgctctgagtgaggtcagcatgcagggcgagcacatcgcaccacagaaaatgatgttatatcctgtcctgagcctggctaccgtgaacgtggtcgcagttctcgcacgggccgccaatatggcactgttccgcgactcccgagtatcggccatctttgtgggcaaaaatgtggtcgccctggctaccaaagcgtgcacgtttctggaataccgccgtcaggttcgcgatttccctcctcccgcactgtcactggaactccaaccccctccccctcagagaaattcagtcccccctcccccgcccccactgcacggaccccccgggaggccacatatgtcatcccctaccagagatccgcttgatacatag

SEQ ID NO: 47154 - DNA, 660 bp, Artificial Sequence
  Description of Artificial Sequence: Synthetic coding sequence
atgagcgagcaggaggcccaggcccccggcggccggggcctgcccccagatatgctggccgagcaggtcgagctgtggtggtcacagcagcctaggagatccgccttgtgcttcgtggtggcggtcgggctagttgcaggatgcggcgctggcggggtggccctgctctccacaacctcatctagatcaggagaatggagattggcgaccggcaccgttctctgcctcttagccctcctggttttagtgaagcagcttatgtcctcagctgtgcaggacatgaactgtattaggcaggcacatcatgtggcactgcttcgatcagggggcggtgccgatgctctcgtcgtgctcttgtctggtcttgtgctcctggtcacggggctgacccttgcagggttggcggccgcgccagcacctgctagacctcttgctgcgatgctgtccgtgggcattgcccttgccgctctgggctcacttctgctactgggcctgctgttataccaagtgggcgtttcgggtcactgcccctctatctgtatggctactcccagcactcacagtggacatggcggacatgggagtattttctcaatatcaggccaactctctgcaggccgaaggcacgaaaccacctcatctattgcgtcgctgatctag

SEQ ID NO: 47155 - DNA, 660 bp, Artificial Sequence
  Description of Artificial Sequence: Synthetic coding sequence
atgagcgagcaggaggcccaggcccccggcggccggggcctgccccccgatatgcttgctgaacaagtcgagctgtggtggtcccagcagcctcgaagaagtgccctgtgcttcgtcgtggcagtcggtctggtcgctggatgcggggctgggggcgttgccctgctgtcgaccaccagcagtcgatcaggagagtggagattagctaccgggaccgtactgtgcctcctggcactattggttctggtgaagcagctgatgagttcagccgtgcaggacatgaactgtataaggcaagctcaccatgtcgccctcttgagatctgggggcggggccgacgcattggtggtcctcttgtcgggtttggtgctgctcgttaccggcctcaccctggccggactagctgccgcacccgctcccgctcggccactggctgctatgctttctgtcggtattgcactggccgccctgggaagcttgttacttctagggctgttactgtatcaggtgggggtgagcggccactgtccgtccatctgtatggcaactcctagcacacacagcggacatggaggtcacggatccatcttcagtatcagcggtcagctctcagccggccgccgtcacgagaccacaagtagcatcgcttcgcttatttag

SEQ ID NO: 47156 - DNA, 51 bp, Artificial Sequence
  Description of Artificial Sequence: Synthetic coding sequence
atgagcgagcaggaggcccaggcccccggcggccggggcctgcccccttag

SEQ ID NO: 47157 - DNA, 693 bp, Artificial Sequence
  Description of Artificial Sequence: Synthetic coding sequence
atggtggtgttcggctacgaggccggcaccaagccccgggacagcggagtagtcccagtgggcactgaggaggcaccaaaggtcttcaagatggcagccagcatgcacggacagcctagcccaagtttggaagatgccaaactgcggcgtcctatggttatcgagatcattgaaaaaaatttcgactatcttagaaaagagatgacgcaaaacatctatcagatggccacatttggaaccaccgcaggattttccggaattttctccaactttctgtttaggcgatgtttcaaggtgaaacacgacgctttgaagacctacgccagcctcgctacccttccctttttgtccactgtagtgactgataaattgtttgtgattgacgcgctctacagtgacaacatctccaaggaaaattgtgtgtttaggagcagtctgattggtatcgtgtgtggcgtgttctacccaagctccttggcttttacaaaaaacggacggttggccacaaaatatcacaccgtaccacttcctcctaagggacgggtcctcatccattggatgaccctctgccagacccagatgaaacttatggctattccactcgtgtttcagatcatgttcggcatcctcaatggtctatatcactacgctgtcttcgaagagactctagagaagactatccacgaagagtag

SEQ ID NO: 47158 - DNA, 603 bp, Artificial Sequence
  Description of Artificial Sequence: Synthetic coding sequence
atggccgccagcatgcacggccagcccagccccagcctggaggacgccaaactgaggaggcctatggttattgaaatcatcgagaaaaattttgactatctcaggaaagagatgacccagaatatctaccagatggccacgttcggaaccacagctggcttctccggtatcttctccaattttctgtttaggcgctgtttcaaggttaagcacgacgcccttaaaacatatgcgtccctcgccactcttccttttctcagtacagtggtgaccgacaagctgtttgtgatagatgctctgtattctgataatataagcaaggaaaattgcgtcttcagatcttcacttatcgggatcgtgtgtggtgtgttttacccaagtagccttgcctttaccaagaacggacgactagccacaaaataccatactgtgcctctgccacctaaaggtcgtgtgctgatacattggatgaccctttgccagacacaaatgaagctgatggccatcccacttgtcttccagatcatgtttggcattctcaacggtctctatcactatgccgtctttgaggagactctggaaaaaacgatccatgaagaatag

SEQ ID NO: 47159 - DNA, 513 bp, Artificial Sequence
  Description of Artificial Sequence: Synthetic coding sequence
atggtggtgttcggctacgaggccggcaccaagccccgggacagcggcgttgtgcctgtgggtacagaagaagcccccaaagtcttcaaaatggctgcctcaatgcacggccaaccctcccccagcctggaggacgccaaactgagacgtcctatggtaatcgagatcatcgagaagaactttgactatctgagaaaggagatgacccagaatatctatcaaatggcgacatttggcaccactgcaggcttctctggaatcttctcaaacttcttatttagacggtgcttcaaggtaaagcacgatgcactgaagacttatgctagcctggcaacactgccctttttgagtactgtcgttaccgataaactgttcgtcatcgacgccctgtattccgataacattagtaaggaaaattgcgtctttcgtagctctctgatcggcatcgtatgcggtgtcttttatccttcaagtctcgccttcactaagaatggcaggctggccacaaaatag

SEQ ID NO: 47160 - DNA, 177 bp, Artificial Sequence
  Description of Artificial Sequence: Synthetic coding sequence
atggtggtgttcggctacgaggccggcaccaagccccgggacagcggcgtcgttccggtgggcaccgaagaggctccgaaggacactaaatacatcagtaatggcgacatttggaataactcatggttcctctggaatatcttgaagctgccagttcagaccctgttgcaggggtag

SEQ ID NO: 47161 - DNA, 426 bp, Artificial Sequence
  Description of Artificial Sequence: Synthetic coding sequence
atgccccccttcggctacaagaccgagaccagcaccgccgtggagaagaaggagaaaccgctgccccgcctcaatattcacagcgggttctggatcctcgctagcatcgttgtgacctattacgttgacttctttaagacgctgaaggagaatttccacacgtcctcctggttcctgtgtggcagcgcgctgctgttggtttcactgtcgatagctttctattgtattgtctatctcgagtggtactgtggtatcggcgaatatgacgtaaaatacccagccctgattcctataacaactgcctcatttatcgccgccggtatttgcttcaatatcgccctgtggcacgtctggagcttctttacacccttgttactgttcacacagtttatgggagtggttatgttcataactctgctgggatag

SEQ ID NO: 47162 - DNA, 498 bp, Artificial Sequence
  Description of Artificial Sequence: Synthetic coding sequence
atggacagcagccgggcccggcagcagctgcggcggcggttcctgctgctgccagatgccgaggctcaattggaccgtgagggcgacgccggtcccgagacctccaccgccgtggagaagaaggaaaagcctcttccacggctgaatattcattctgggttttggatcctggcatcaattgtcgttacatactacgtggacttctttaaaacactgaaggagaactttcacacctcaagttggttcttgtgcggctctgccttattgttggtgtctctgagcattgctttttattgtatcgtctacctcgagtggtattgcggcatcggcgaatatgacgtgaagtacccagctctgatcccaatcactactgctagctttatcgctgctgggatctgcttcaacattgcactgtggcacgtttggagttttttcactcctctcctcttgtttacccaatttatgggcgttgttatgtttattacattgctgggctag

SEQ ID NO: 47163 - DNA, 399 bp, Artificial Sequence
  Description of Artificial Sequence: Synthetic coding sequence
atggacagcagccgggcccggcagcagctgcggcggcggttcctgttattgcctgacgctgaggcccagttagaccgcgagggggatgccggacccgaaacctccactgcagtggagaagaaagagaagcctttaccacgactgaatattcacagcggcttctggatccttgcctctattgtggttacgtattacgtggatttttttaaaacgttgaaagaaaattttcacaccagcagctggttcttatgcggttcagcattgctgttggtaagtctgtcaatcgcattctactgtattgtctaccttgagtggtactgcggtatcggtgagtatgatgttaaatatcctgcattgattccaatcacaacagcgtcgtttatcgctgcagggatatag

SEQ ID NO: 47164 - DNA, 498 bp, Artificial Sequence
  Description of Artificial Sequence: Synthetic coding sequence
atggacagcagccgggcccggcagcagctgcggcggcggttcctgttgctgcccgatgctgaagcgcagctggatcgggaaggcgacgccggtcctgagacgagcactgccgtagaaaaaaaagagaagcccttgccgaggctgaacattcattcagggttttggatactggccagcatcgtggtgacatattatgtggattttttcaagacacttaaggaaaacttccacaccagcagttggtttctctgtggctccgccctgctcctggtgtccctgtccatcgccttctactgtatcgtgtaccttgagtggtactgtggtataggcgaatacgatgtgaagtatcctgccctcatccccataacaactgcgtcctttattgccgctggcatttgcttcaacatcgctctttggcatgtctggtctttctttactccgctgctgcttttcacacagttcatgggggtagtaatgtttattactctgctgggctag

SEQ ID NO: 47165 - DNA, 1089 bp, Artificial Sequence
  Description of Artificial Sequence: Synthetic coding sequence
atggacagccccgaggtgaccttcaccctggcctacctggtgttcgcagtctgctttgtttttacccctaacgaattccatgcagccggactgaccgtccaaaatctgctgtccggttggctggggagcgaagatgcggcttttgttccattccatttgcgtaggaccgcagccacgctgctatgtcacagcctgcttcctctgggatattatgtgggcatgtgcctcgctgcttccgaaaagcgcctacatgccctgtcgcaagcaccagaggcgtggcgcctgttcttactcttggccgtcaccttacccagtatcgcctgcatcctcatttactactggagtcgcgataggtgggcatgtcaccccctcgcccgcacactggctctgtacgctctgcctcaatcagggtggcaagcagtcgccagctcagtgaataccgaattcaggcgcatcgataagttcgcaacaggcgcacctggagcccgggtgatcgtgaccgatacttgggtgatgaaagtgaccacgtatcgggtccatgtagcccagcagcaggacgtgcacttaacagtgaccgaatctcggcagcacgagctgagccccgattctaacctgcctgtgcaactgctgactattagagtggcaagtactaacccagctgtccaagcctttgacatctggttgaactctactgagtatggagagctgtgtgagaagctgcgggcacctatccggcgcgccgcccatgtcgtgattcatcagtctttaggcgatctcttcctggagacttttgccagccttgtcgaggttaaccctgcttacagcgtgccatcgtcccaggagctcgaagcctgcatcgggtgtatgcaaacaagagcctccgtcaaacttgttaaaacttgccaggaggcggctacgggagagtgccagcagtgctactgtcgaccaatgtggtgcctgacgtgcatgggaaaatggttcgccagccgccaggacccattgaggccagacacttggctcgcatctcgggtcccctgtcccacctgccgtgctaggttttgtattctggacgtgtgcacggtgcgatag

SEQ ID NO: 47166 - DNA, 1089 bp, Artificial Sequence
  Description of Artificial Sequence: Synthetic coding sequence
atggacagccccgaggtgaccttcaccctggcctacctggtgttcgcggtctgcttcgtgttcacacccaacgagtttcacgccgcgggcctcaccgtccaaaacctgctcagtggctggcttggatccgaggacgctgccttcgtgccatttcatctgcgcagaaccgccgcgaccctgctgtgccactcgctgcttccgcttgggtactacgtcgggatgtgcctggccgctagcgagaagaggcttcacgcgttaagtcaggcacccgaagcttggagattatttctgctgctagcagtaacgctcccatcaatcgcatgcatactcatctactactggtcacgagaccggtgggcttgtcaccctctggcacggacacttgccttatacgcactgccacaaagtggctggcaggctgttgcatcatctgtcaatacggaatttaggcggatcgataagttcgccacgggggcaccaggtgctcgtgttatagtcaccgatacttgggtcatgaaggtgactacataccgagttcatgttgctcagcaacaggatgtgcacctaaccgtgactgagtctcggcagcatgaactgtcgcccgattccaatcttcctgtgcagcttctgactatccgcgtggcctcgaccaatccagccgtccaggcctttgacatctggttgaatagtactgaatacggagagctctgtgagaaacttagggccccaatcagacgcgctgcacatgtggttatccatcagagcttgggagatctgttcctcgaaacgttcgcatccttagtggaagtgaaccctgcctactccgtgccgagttcccaggagcttgaagcctgcatcggatgtatgcagacgagggcaagcgtgaaactggtcaaaacctgtcaggaagccgctacaggagagtgtcagcagtgctattgccggcccatgtggtgtctcacgtgcatgggaaagtggtttgccagtcgacaagaccctctgagacctgacacatggctggcttcgcgggtcccttgtccgacttgtcgagcgcgtttctgcatactggacgtttgcactgtgcggtag

SEQ ID NO: 47167 - DNA, 699 bp, Artificial Sequence
  Description of Artificial Sequence: Synthetic coding sequence
atggacagccccgaggtgaccttcaccctggcctacctggtgttcgccgtctgcttcgtgttcacccccaacgagttccatgccgcaggactaactgtgcagaatctgctgtctggatggctggggagtgaagacgccgctttcgtgccttttcacctccgtagaactgccgccactttgctctgccatagtttgctgccattaggctattacgtcggcatgtgcttggccgcatctgagaaacggcttcatgcactcagtcaggccccagaagcttggaggttgttcctcctcttagccgtgacgctgccatccattgcctgcatcctgatctattattggtcccgggaccggtgggcatgccatcctttggctcgcactctggcgctctacgctctgcctcaatctggatggcaggccgtggcttcctctgtcaacaccgagtttcgccgcattgacaaatttgctactggagccccaggcgctcgagtgattgtgacagacacctgggtgatgaaagtcaccacttaccgggtccacgtagcccagcagcaagacgtgcatctcaccgtaacagagtcccggcagcacgaactgtccccggattccaatctccctgtgcaattgttgaccataagggtggcaagcacaaacccggccgtacaagcttttgacatctggagctggcgaccagcttag

SEQ ID NO: 47168 - DNA, 1272 bp, Artificial Sequence
  Description of Artificial Sequence: Synthetic coding sequence
atggcccaggccgtgtggagccggctgggccggatcctgtggctggcttgcttgcttccctgggctcccgcaggggtggccgcgggtctctacgaattgaacctgacaactgactcacccgccaccaccggagccgtcgtgacaatctctgcaagtctggtcgcaaaggacaatggatcccttgccctgcctgccgacgcccatctctaccgcttccactggattcacacaccccttgtcctgacggggaaaatggaaaagggcttatcctctactattcgggtcgtcggacatgttccaggcgaatttcccgtgtctgtctgggtaacagcggcagactgttggatgtgtcagcccgtcgctcggggttttgtagtactgcccatcaccgagttcctcgtgggggatctcgtcgtgacccaaaacacatccctgccgtggcctagttcatatcttaccaaaacagtgctgaaggtctcatttctcttgcacgaccctagcaattttctgaagacggctttgttcctgtattcttgggacttcggcgacggcacccagatggtgactgaggattcagttgtgtattacaactacagcattatcggcacatttacagttaagctgaaagtcgtcgccgagtgggaagaggtggaaccagacgccacaagagctgttaaacagaaaactggcgatttttccgcctccctgaagcttcaggagacactcagagggattcaggtgctaggccctactctgattcagacctttcagaagatgacagtgaccctcaatttcctgggctcccctcccctgacggtctgctggcgcctgaagccggaatgcctccctctagaagagggggagtgtcatccagtctctgtcgcctcaacggcctacaatctcacacacacgttccgggatcctggtgattactgtttttcgatccgggccgagaacatcatcagcaagacccaccagtatcataagatccaggtctggccgagccggattcaaccggcggttttcgcattcccatgcgcaaccctcatcaccgtgatgctggcttttattatgtatatgaccctgcggaatgcaacccagcagaaagacatggtagaaaaccctgaacctccaagcggagtgcggtgctgttgtcagatgtgttgtggaccttttttgcttgagacgcctagcgaatacctggaaattgtaagggagaaccatggcctgctgccgcctctgtataaatccgtcaagacatacaccgtatag

SEQ ID NO: 47169 - DNA, 966 bp, Artificial Sequence
  Description of Artificial Sequence: Synthetic coding sequence
atggcccaggccgtgtggagccggctgggccggatcctgtggctggcttgcctgttaccttgggccccagcaggcgtcgcagccgagttcttggtgggagacctggtggttacccaaaatacatcccttccatggcccagctcatacttgactaaaaccgtgctgaaagtgtcttttctcttacatgacccaagtaacttccttaagactgccctgttcctgtactcgtgggattttggggatgggacacaaatggttactgaggactccgtcgtctactacaactactcaatcattgggacattcaccgtaaagctgaaagttgtggcggaatgggaagaggtagaaccagacgccacgagggccgtaaaacagaagacaggagattttagtgcgagccttaagctgcaagaaaccctgcggggaatccaggttctgggcccaactcttattcagacttttcaaaaaatgaccgtgacactgaacttcctgggcagcccaccactcaccgtctgttggcggcttaagccagaatgcctgcccttggaggagggtgagtgccaccccgtaagtgtagccagtacagcctacaatcttacccacacctttcgcgatccaggcgattactgcttttctatcagagccgagaatattatctctaagacccaccagtaccacaagatccaggtatggccctcacgcattcaacctgccgtctttgcttttccctgtgccaccctcatcacggtgatgcttgccttcatcatgtatatgacactcaggaatgcaacccagcaaaaggatatggtggaaaacccagagccaccctcgggagtgaggtgttgttgccagatgtgttgcggaccattcctcctcgagacgcctagtgagtacctagagattgtccgggagaaccatggacttctcccgccactgtataagagcgtaaagacttacaccgtctag

SEQ ID NO: 47170 - DNA, 1308 bp, Artificial Sequence
  Description of Artificial Sequence: Synthetic coding sequence
atggcccaggccgtgtggagccggctgggccggatcctgtggctggcctgcctgctgccctgggcaccagcaggtgttgcagcaggattgtacgaactcaacctgaccaccgactcccctgccaccaccggtgccgtggtgaccatatctgcttcactagtggccaaggataatggctccctcgcgctgcccgcggacgctcatttataccggttccattggatccatacaccactcgtactgaccggaaagatggaaaagggcctgtcgtccaccattagggtggtagggcatgtgccaggagaattccccgtgtctgtttgggtaaccgctgccgactgctggatgtgccagcccgttgcgagagggtttgtggtcctccctattacagagtttctggtcggcgatttggttgtcacccaaaacacaagtctgccatggccttctagctacctgactaagacagtcctgaaagtaagctttctgttacacgaccccagtaatttcctgaaaacggccctcttcctctactcctgggacttcggcgacggaacgcagatggtaacggaggactccgtggtgtattacaattactctattataggaacgttcacagtgaaactgaaggtagtggctgagtgggaggaggtggagcccgacgccaccagagctgtgaagcaaaagaccggagatttcagcgccagcctgaaactgcaggagactttgagagggatccaggtgctggggcccactctgatccagactttccagaaaatgaccgttaccctcaacttcctgggaagccccccattgactgtctgttggagactaaagcccgaatgtcttccccttgaggagggtgagtgccaccctgtctctgtagcatccaccgcctacaacctgactcacacctttcgggacccaggggactattgcttttctattagggccgagaacatcatctctaagacccaccagtatcacaagatccaggtgtggcccagcaggattcaaccagcggtgttcgctttcccctgtgcaacacttataaccgtcatgctggcctttatcatgtatatgaccctgcggaatgcgactcagcagaaagacatggttgaggtggcagatttcgacttctctcccatgagcgataagaaccctgagccgcctagcggcgtcagatgttgttgtcaaatgtgctgtggacctttcctgctcgagacacctagcgaatatctggagatcgtgcgcgaaaaccacggcctactcccaccattatataagagcgtcaagacttacaccgtttag

SEQ ID NO: 47171 - DNA, 1215 bp, Artificial Sequence
  Description of Artificial Sequence: Synthetic coding sequence
atggaccccgagctgaccggcagctggggcctgtacgagctgaacctcaccactgactctccagccacaacaggagcagttgtgactatttcggccagtctggtggctaaagataacggttccctcgcactcccagccgatgcccacctataccgtttccactggatccataccccacttgtgctcactggcaaaatggagaaagggctgagcagtaccatcagggttgttggccacgtgccgggggaattccctgtgagcgtctgggtgaccgcggccgattgctggatgtgccagcctgtggccagaggctttgtggtgcttccgattaccgagtttttggttggagatttggtggtgacccaaaacacaagcctcccgtggccctcttcatacctcaccaagacagtcttaaaagtctcatttctacttcatgacccgagcaacttcctgaagaccgccctgttcttgtacagctgggactttggggatggtacacagatggtgacagaggattcggtggtctattacaattactcgattatcggcacatttaccgttaaattaaaggtagtagctgaatgggaagaagtggaaccagacgctaccagggcggtgaagcagaagaccggggactttagtgctagccttaaactgcaggagacactccgtggtatacaagtgctaggtcccaccctgatccagactttccagaaaatgaccgtgacactgaacttcctgggctctcctcctctgacggtgtgttggaggcttaaaccagaatgtctaccactggaggagggcgagtgccaccccgttagcgttgcatctactgcttataacctcacccacacattccgtgaccctggtgactattgctttagtatacgggccgagaacataataagcaaaacacaccagtaccataagatccaggtgtggccctctcggattcaaccagccgtgtttgcatttccctgcgcaactcttattaccgtcatgctggcctttatcatgtacatgactctccgaaatgctacgcagcaaaaggatatggtggagaacccagagcccccttccggtgtgcgctgttgttgtcagatgtgttgcggcccattcctgctggaaactcctagcgaatatcttgagattgtgcgtgagaaccacgggcttttgccgcccctttacaaatcagttaagacctataccgtgtag

SEQ ID NO: 47172 - DNA, 5652 bp, Artificial Sequence
  Description of Artificial Sequence: Synthetic coding sequence
atgggcaagcgggccggcggcggcgccaccggcgccaccaccgccgctgtgtctacaagtgccggcgccggactcgaaccggccgctgctcggagcggcgggcccagaagtgccgccgccgggctcttgggcgcattgcatcttgtaatgacccttgtcgtggccgcggcccgagcggagaaagaggcttttgtgcagtccgagtccatcatcgaagttttgaggttcgacgacgggggcctgcttcaaactgagactaccctggggttatccagttaccagcagaaaagtatatcactgtacagagggaactgtcggcctattcgtttcgaaccaccaatgctggactttcacgaacagccagtgggaatgcccaagatggaaaaggtgtacttacataatccatctagtgaagaaacaatcactctggtgtctattagcgctactactagccactttcacgcatccttcttccagaatagaaagattctgccaggagggaatacgagctttgacgtagttttcctcgctagagtggtggggaacgtggaaaatactttgttcattaacaccagtaaccacggcgtcttcacttaccaggtttttggggttggggtgccaaatccataccggctgagacctttcctaggtgccagagttccggtgaattcttcttttagtcccatcataaatatacataacccccattctgagcccttgcaggtagtcgagatgtattcttccggtggagatctgcatctggaactgcctaccggccagcagggcgggaccaggaagctgtgggagatccccccatacgagactaagggcgtgatgagggcctcttttagttctagagaagcggacaaccacacagccttcatcaggattaagacaaacgcaagtgattccacggaattcatcatcttacccgttgaggtcgaagttaccacagcccccggcatttactctagcactgaaatgttggactttggaactctcagaacccaagacttacccaaggtgctcaacctgcacctattgaactctgggaccaaagacgtgccaatcacatcggtgcgtccaacaccacagaacgacgctatcactgtacattttaagccgataactctaaaagccagcgaatccaaatacaccaaagtagcaagcatatcgtttgacgcctcgaaagccaagaaaccatcacaattttctggaaagatcaccgtgaaggccaaagagaagagttactccaagctcgagattccctaccaggccgaggtcttggacggctacctgggattcgatcacgccgcaacacttttccacatcagggacagcccagccgatcctgtcgaaaggcctatatatcttacgaacactttctccttcgcaatccttatccacgatgtgctgctgccagaggaagccaaaaccatgttcaaagtgcataacttctctaagcccgtgctcattcttcctaatgagagtggctacatatttacacttctgttcatgccaagtacctcctccatgcatatcgataataacatcctgcttatcaccaacgcgtctaagtttcacctacctgtgagggtgtacactggtttcttggactacttcgtgttacctccgaaaatagaagagcgtttcatcgacttcggcgtgttgtccgccaccgaagcatctaatatcctttttgccataatcaattcaaatcctatagagctggctattaagtcgtggcatatcattggcgatggtctttcgattgaactggtggctgtagaaagagggaataggacgaccattatttcttccctgcccgagtttgaaaagtcctcactcagcgatcagagctcagtgacactggcctcaggctactttgccgtttttcgcgtcaagctgacagcaaagaaattggaaggtatccacgacggagctatacagatcaccacagactatgagattctgactattccggtcaaggccgtaatcgctgtgggttcactgacatgttttcccaaacacgtggtgctgccaccatcatttccagggaaaattgtgcatcaaagcttgaacatcatgaactcctttagccagaaagtgaagatccaacagatccgctctctgtctgaggatgtaagattttattacaagagactacggggaaataaggaagatctagagcccggcaagaaatcaaagatcgcaaatatctactttgacccgggtctccagtgcggggaccactgctacgttggattgccattcctgagtaaatctgagcccaaagtgcagccaggagttgctatgcaggaggatatgtgggatgctgactgggatcttcatcagtcactgtttaagggttggactggcatcaaagagaactccgggcatcggctctctgccatcttcgaagtaaatactgatctgcagaagaatatcatatccaaaattaccgctgagctgagctggcctagcattcttagtagccccaggcatttgaaatttcccttaacaaatactaattgtagcagtgaagaagagatcacgctggaaaacccggcagacgtccccgtgtatgtacagttcatccccctggctctttactctaacccaagcgtttttgtggacaaattggtatctaggtttaacctaagcaaggttgctaagatagatctgcgaacccttgagtttcaggtgttcagaaactctgctcaccctcttcagagcagcaccggcttcatggagggcctgagccgccacctgattctgaatctcatcctgaagcccggcgagaaaaagtcggtgaaagtgaagtttacaccagtacacaaccgcaccgtgagcagtctaataattgtgcggaacaaccttacagtgatggatgccgtaatggtgcagggacagggcactacagaaaatctaagagtggcgggaaagctacctgggcccggaagcagcctccggtttaaaatcacagaggctcttctgaaggactgtacggattctttaaaactgagagaacctaacttcacgcttaagcggacattcaaagttgaaaacacggggcagttgcagattcatattgagacaatcgagatctccggctactcttgtgagggctatggatttaaagtggttaattgtcaggagttcacactgtcggctaatgcaagtagggatatcatcattttatttacacctgatttcacagcaagccgcgtaatcagggaactaaagtttatcacaacttccggatctgagtttgtattcatcttaaatgcgagcctgccctaccatatgctagctacttgtgcagaagcactgccgagaccgaactgggagctcgccctatacattattatctccggaattatgtccgctctcttcctcctggttatcggcacagcctatcttgaagctcagggaatatgggaaccgtttcgtcgcaggctcagcttcgaggccagcaatcccccattcgatgtagggcggcctttcgacctgcggaggatcgttgggattagttctgagggaaatctgaataccctgtcgtgtgatcccgggcatagtcgaggattttgcggcgcagggggaagctcctccaggccatccgcaggatctcacaaacagtgcggaccttccgttcacccacatagcagccactcaaatcgcaattctgccgacgtcgagaacgtgcgagccaaaaatagctcctctacgagctccaggaccagcgctcaggccgctagctcgcagagtgccaataaaacctcccctctcgttttagattctaatacggtgacccaggggcacaccgctggcaggaagtctaaaggagccaaacagtcacagcacggatctcaacatcatgctcacagcccgctcgaacaacacccacaaccccccctgcctcctcccgttcctcaacctcaggagcctcagcctgaacggctgtcccccgctcccttggcccaccccagtcaccctgagcgggcatctagcgcccgacacagctccgaagattcggacattacaagccttatagaggctatggacaaagattttgaccatcacgactcacccgccttggaagtgttcaccgagcagccccctagcccgctcccaaagtccaaaggcaagggcaagcccctgcagaggaaggtaaagcccccaaaaaagcaggaggaaaaggagaaaaaggggaaagggaaacctcaggaggatgagctgaaagactccctcgctgacgacgactcatcaagcactaccaccgagacgagtaacccggatacagagcccctattaaaggaggatactgagaaacagaaggggaaacaggctatgccggagaaacatgagagcgagatgagtcaggtgaagcagaagtctaagaaactgttaaatataaaaaaggagatccccaccgacgtcaagccaagttcccttgaactaccctataccccccccctagaatcaaaacagaggaggaacctgccttctaagatccccttacccaccgcaatgacatccggtagcaagtcacgaaatgcacaaaagacgaaagggacgagtaagttggtggacaatcggccgccagcgcttgccaagtttctgcctaactctcaggagttgggtaacacgtcatcttccgagggagagaaggacagccccccacctgaatgggacagtgtacctgtccataagcctggatcctcgaccgactccctgtacaagctgagcctccaaaccctgaatgcagacatcttcctaaaacagcggcagacatctcccacacctgcttctccatctccgcctgctgctccttgcccgtttgttgccaggggttcatatagtagtatcgtaaactccagctcgagttctgatccgaagataaagcagcctaatggctctaaacacaaactgaccaaggccgcctccctgcctggtaagaatgggaaccctaccttcgcagccgtcacggctgggtatgacaagtcaccagggggcaatggttttgctaaagtctccagcaacaaaaccggattctcgtctagccttggcatttcgcatgcccccgtcgacagcgacggcagtgacagtagtgggctgtggagcccagtgagtaacccgtcttctcccgacttcacacccctaaactctttttccgcatttgggaattctttcaacctgactggagaggtcttctccaagttagggctttcacggtcatgcaaccaggccagtcagagatcctggaacgagttcaactcaggcccctcctatctgtgggagtcccctgcaacagacccctcacctagctggcccgcttctagcggctcgccaacccacactgccacgtccgtgttgggcaatacaagcgggttatggtctacaacacctttttcctctagcatttggtcatcaaacctgtcctccgccctgccttttaccaccccggctaatacattggcctcgatcggcctgatgggcacggaaaacagtcctgctccccatgctccctctacatcctctccagcagatgacttagggcagacttacaacccatggagaatatggagtccaactattgggcggaggtcttccgatccctggagtaattcccactttccccacgaaaattag

SEQ ID NO: 47173 - DNA, 999 bp, Artificial Sequence
  Description of Artificial Sequence: Synthetic coding sequence
tgaggcctgctgggcgccctgcacctggtgatgaccctggtggtggcggctgcacgcgcagagaaggaagcctttgtccagtcagagagtattatcgaagtcctacggtttgatgacggtggcctattgcagacagaaaccaccctagggctgtcctcataccagcaaaagagcatctcactgtaccgaggcaattgccgtcccattcggtttgagcctcctatgctggattttcatgaacaaccagtgggaatgcctaagatggagaaagtgtacctccacaacccatcaagcgaggaaactataacgttagtgtctatctccgccacaacatctcatttccacgcctccttcttccagaaccgaaagatactgcctgggggcaacaccagcttcgatgtggtgtttctcgctcgcgtcgtcgggaacgtcgaaaataccttattcatcaacactagcaatcacggcgtcttcacttaccaagtgtttggtgtcggtgtccctaacccttacagattgcggccttttctgggtgcccgagtccctgtaaatagctcgtttagcccaatcatcaatatccacaaccctcactcagagcccctgcaggtggtcgagatgtacagcagcgggggcgatctgcacctggaactcccaacaggccagcaaggcggcacaaggaagctgtgggagattccgccatatgagacaaaaggcgttatgcgggcgtctttctcatcccgggaagcggacaaccatacggcttttatcagaatcaagactaacgcttcagattctacagagtttatcatccttcccgtagaggtggaggtcaccaccgcccccggcatctattccagtacagaaatgctggactttggaaccctgaggactcaggacctgccaaaggtattgaatctgcatctccttaattccggcacgaaggacgtacctattacccaccggcgccagaagtcacacctttcttttctggggaagtag

SEQ ID NO: 47174 - DNA, 969 bp, Artificial Sequence
  Description of Artificial Sequence: Synthetic coding sequence
atgaccctggtggtggccgccgcccgggccgagaaggaggccttcgtccaatctgaatcaataattgaagtgctgagattcgatgacggaggcctgctccaaactgaaaccacactgggcctgtcctcataccaacagaagagcataagcctgtatagaggaaattgcagaccgattcgatttgaaccccccatgttggacttccacgaacaacctgttgggatgccaaagatggaaaaggtgtatctccacaacccttcatcggaggaaaccataacactggtatccatatcagctaccaccagtcatttccacgcttcattcttccaaaatagaaagatcttgcccggcgggaacacaagtttcgacgtggtgtttctcgcacgggtcgtgggcaatgtggagaacactctcttcatcaacacctctaatcacggggtgttcacctaccaggttttcggagtcggagtcccaaatccatataggcttcgcccatttctgggagcaagagtgccagtcaattccagcttttcacctatcatcaatatccacaatcctcactctgagccactgcaggtagtggagatgtactcaagcggaggggatctccacttagaactgccaacaggtcagcaagggggtactagaaaactttgggagatacccccttatgaaacaaagggcgtcatgagagcaagctttagctcgcgcgaggccgataatcacacagcctttatacggataaaaacaaacgcgagtgattcgaccgaattcattatcctgcccgtggaggtggaggtaaccacagcccccggcatctattcttctactgagatgttagattttggcactctgcgaacccaggaccttccaaaagtgcttaacctgcatttactgaacagcggtaccaaggacgtgccaatcactcaccgacggcagaaatctcacctgtcttttctggggaagtag

SEQ ID NO: 47175 - DNA, 3237 bp, Artificial Sequence
  Description of Artificial Sequence: Synthetic coding sequence
atgttcggcgccgccagccggatggacaccaccgccgtgtgcaccggcggagtcacagaaagccgcggaatcgtcgactcattacaaaaattttctagtcttccagcctatctgcctaccaatctgcacatttcgaacgccgaagagagcttctttctcaaagaagctaaccaggatttgacaaggaactctagccttcaggctcgcgtagagccattctttatatatcgtgcccgtacccctccgataattaacgcgagctatggcccattctccgtcgaaaagatcattcctcaagaattgctccttaccagcaccgcctttggaaacatggacaaatttccattcaactggaagctgaaatcccacatcctggacagcagtatctactccaatcgacctaaggtgcagacacttttttatgtcacggggatgggctgggatgactctgacctcaccgaggatctcccctgcgtgaagatgttcgcttttcctgaggctagagaggtcgctgcatcttgtaggttgcagggagctccaggcctgtgcgttgcagaactggagctattaccagagtggttttcttctgggctggacctggaacctgaggaggaaattcctgcactgttaggaggaaccaccatggagctcttcttcacattgtaccctgcagacaaggccggccagtgtcctttggaggaagagggcaaatgggaaaacaacatccactctgggctggagagcccccagcaagcattccctgcgagggaacgcatcggctctgtggtggtctatcccacacaggacgaccttaagtggtccctggtgagccttgatgaaaacgtggttatttctgtgcctttgaatctggtgcgcgagggcgacacagcgacattcctcgttagtctgacttcttctagcgtcgcggaccagttcaccttgcggatcaaagccgctgcaggagtcaagataacagctgtccgtgttagtagcgaggaccaatgggctgtgcaggaggagattgacaatggctccacccaaacgtcagcaactcttacctgcatgggtcacaggccagatacgcagtcaagagtaaacgggtcgttttatgagatactgcaagtggattttggaatcgacaatagcagcgaccttgccggggcacagcagatcacatggcaagttgagtatcccatcgaagattccatgtccgagctcgttgtatccgagattttcgtgtcccagacaaccttcgtcggaatcgtacccttagcaatggataccgaagtacttaataccgctattttgaccggcaaacctgtgtccgtccccgtgaaggtggtcggcgtccaagaagatgggtctgtcgtggatgtgtccgagagtgtcgaatgcaagtccgccgacgaggacgtgataaaagtgagtaacaactgcgactcgatattcgtgaatggaaaagaaatgaagtccaaggtggataccattgttaacttcacacaccagcacttcacttcacaatttgaggtgaccgtgtgggcaccccggcttccccttcagatcgagatatcagacacagaactgagtcagatcaagggctggcggatccccgttgccgctaaccgccggccaactcgtgaatccgatgacgaagacgacgaggagaaaaagggaaggggctgcagtctgcaataccagcacgcgacagtaagagttctaacacagtttgtggccgaaagtcctgatcttggccagttgacatacatgctggggccagactggcagtttgatattaccgacctcgtgactgaattcatgaaagtggaagagccgaaaatcgctcaacttcaggatggccgtacgctggccgggcgggaacccggcatcacgacagtgcaggtcctcagccccttaagtgactcgattctggccgagaaaacggttatcgtgttggacgatagagtgacgattgcagaattaggtgttcagctggtggccgggatgtccttgagcctgcaaccacaccgggccgataagcgtgccatagtgtccacagccgccgcactggacgttctgcaatccccacagcaagaggctattgtgtccagctggatcctgttctctgacgggagtgtcacacctctggacatctatgatcccaaggactattctgtcaccgtgagctctcttgatgaaatggtggtatccgtccaggctaatctggaatctaaatggcctattgtggtggctgagggcgaggggcagggcccgttgatcaagctggaaatgatgatatcagagccctgccaaaaaactaagagaaagtccgttctggctgttgggaagggcaacgtgaaagtaaaattcgaaccaagctccgatgaacatcagggcggcagcaatgatatcgagggcatcaaccgggagtacaaagaccatctatcgaattcaatcgagcgcgagggcaaccaggagcgggcagtccaagagtggttccatcggggcacccctgttggacaggaggaaagcaccaacaagagcaccacaccacagtctcccatggaagggaagaacaaactgcttaaatcgggcgggcctgatgctttcacaagcttccccacccagggcaaaagtccagacccgaataatccaagtgatctgaccgtgaccagccggggcctgactgatctggagattggtatgtatgctctcctgtgcgtgttctgtcttgccatacttgtgttccttatcaactgcgtggccttcgcatggaaatacaggcacaaaaggttcgctgtcagcgagcagggcaatataccccactctcacgactgggtctggttgggaaatgaggtcgagctgctcgagaacccagtcgatatcactttgccaagtgaggagtgcaccacgatgattgaccgggggctgcagttcgaggagcggaactttctgctcaacgggtcgagtcagaaaacttttcactcacagctgctgcggccctctgattacgtttatgagaaagagatcaaaaacgagccaatgaacagttctgggccaaagaggaagcgtgtgaaatttactagttataccacaattttgcctgaggacggaggcccctatactaacagcattctctttgacagcgatgataacataaaatgggtatgccaggatatgggattgggggactcgcaggattttcgggactacatggagagcctgcaggaccagatgtag

SEQ ID NO: 47176 - DNA, 3327 bp, Artificial Sequence
  Description of Artificial Sequence: Synthetic coding sequence
atgcggagcgagggcgccgcccccggccccgccgcccccctgtgcggcgcacttagcctcctgctgggcgccctgctgggcaaagtaattgaaggacacggggtaactgacaatatccagcgctttagctctctaccaccgtacctcccggtgtcctatcacattctccgggccgagactagtttttttctgaaagaggcgaatcaggatttgctgcgcaattcttcccttcaagcacgagtcgaaagcttctttacctataaaacccgacagcctcctgttctgaatgcctcatatggccctttctcagtggagaaggtggtgcctttggatctaatgctcacctctaattttttgggccccactaataagttctccttcgactggaagctcaaggcccacatcctgagggacaaggtgtacctcagcaggcccaaggtgcaagtactgtttcacatcatggggcgtgattgggacgaccacggagcaggggagaaactgccctgtcttcgggtcttcgccttcagagagactagagaagtcaggggctcttgtcgactaaagggagatctgggtctgtgtgttgccgagctcgagctcctgtcgagttggttcagtgctccaacagtcggggcaggcaggaaaaagtctatggaccagcctgagggtacaccggtggagctgtactataccgtgcatcccggaaatgaacgaggggattgcgctggaggtgatttccgaaaaggaaacgccatcaggcccggaaaggatgggctggaagagacaacttcacacttgcaacgcatcgggacagtcggactgtacagagcccaggactctgcacagctgtctgagttgaggctggacggaaacgtggtaatatggctaccatcccggcccgtgaagcaaggagaggtcgtaacagcctacgtcacaatcagctcaaactcttcagtagacttgtttatcttaagggcaaaagtgaagaagggtgttaatatactgagtgcccagacgcgggagccacgacagtggggggttaagcaggaggtgggaagtgggggcaaacatgtgaccgccactgttgcttgccaacgtctggggccttcacctaggaaccgatcaagcagcctgttcaacgaagtagtccaaatgaacttcgaaatcgcctcattttcttctctttccggcacacaaccaataacctggcaggtggagtacccgaggaagggcacaaccgacatagctgtgtctgagattttcgtatcccagaaggacctcgtgggtatcgtgccactggcaatggataccgaaatcctcaataccgctgtgctgacaggcaagaccgtggcgatgccaattaaggtcgtgtccgtggaggaaaattctgctgtcatggatattagcgaatctgtcgagtgcaagtcaactgacgaggatgtcatcaaagtatctgagcggtgcgactacatctttgtcaatggaaaggagataaagggtaaaatggacgctgtcgtgaacttcacatatcagtatctgtcagcgccgctgtgcgtgacagtgtgggtgcctaggctgccactgcagatagaggtctcggatacagaactgagtcagatcaagggttggcgggtccctattgtaaccaacaaaaggcccactagggaaagcgaagatgaagacgaggaggagcgccgcggtcgtggttgcgccctgcagtatcagcatgcaaccgtcagagttcttacacagttcgtctccgagggcgctgggccctggggccagccaaattacctcctgtctccgaactggcaatttgacatcacccacctggttgctgacttcatgaagctagaggaaccccatgttgctacgttgcaagattcacgagtgctcgtgggccgtgaggtaggcatgacaactatccaagtgctatccccactttctgatagtatccttgccgagaagacaatcaccgtcttagatgataaagtgtcggtcacagatctggccatccagctagtagccggcctctccgtcgcactctatccgaatgcagagaatagcaaggctgtcaccgctgtggtgacagccgaagaggtcttacgtactcccaaacaggaggctgtctttagcacctggctgcaattcagtgatggcagcgtcaccccactcgacatttacgacacaaaagatttctctctagctgccacttcacaagacgaagccgtggtgagcgtaccccagccaagaagtccaagatggcccgtggtagtggctgagggggaaggacagggtcctctgatcagagttgatatgacaattgccgaagcatgccaaaagagcaagcgcaaaagcattctggctgtcggcgtcggcaacgtgcgcgtcaaattcgggcagaacgacgctgatagtagcccggggggggactacgaagaggatgagattaagaatcatgcttctgaccggaggcagaagggccaacatcatgaaagaaccggacaggacggacatctgtacggctcatcccccgtcgagcgcgaagagggcgcattaagacgcgcaactaccacagcacgttcgctcctcgacaacaaagtcgtgaagaattcacgcgctgacggcggccgcctggctggcgagggccagctccagaacatccccatcgatttcacaaatttccccgcacatgttgatctgcccaaggcaggctctggtctcgaagaaaacgatcttgtgcagacgccccgtgggctgtcagatttggaaatcggtatgtacgcgttgctaggcgttttttgcctggcaatcctggtcttcctgattaactgtgccaccttcgctctaaagtaccggcacaaacaggtccctctggagggccaggcgtctatgacacacagccacgactgggtatggctcggtaacgaagctgagcttttggagtctatgggcgatgcccccccacctcaggacgaacacacaactatcatagaccgtggtccaggggcatgcgaagaatcaaatcacctcctgttaaacggtgggtctcacaagcacgtgcaaagccagatccaccggagcgccgactccggaggacgtcaagggcgtgagcagaaacaagaccccttgcatagcccgacttctaaacgcaagaaggtcaaatttacgaccttcactaccattccccccgacgacagttgccccactgttaattcaatcgtgtccagcaatgacgaggacataaagtgggtgtgtcaggacgttgctgttggtgccccgaaggaactccggaattacctcgaaaaactgaaggataaggcatag

SEQ ID NO: 47177 - DNA, 1914 bp, Artificial Sequence
  Description of Artificial Sequence: Synthetic coding sequence
atgcagcgggacgagagcagccccttcccccccctgttcagcctgacctcatcacaggtcagtgatcgatgcgattacgtcttcgtaaacgggaaggaaatgaagggtaaggttaacgttgttgtgaatttcacatatcagcatttaagttcccccctagagatgaccgtatgggttccccggctaccattgcagattgaagtgtctgatacagaattaaaccagatcaaaggctggagagtgcccattgtaagttcccgtcgcccagccggagacagtgaggaagaggaagatgacgaaagacggggccgagggtgtacactccagtaccagcacgctatggtcagagtgttgactcagtttgtagctgaggccgctggaccaggaggtcatctggctcacttgctgggatctgactggcaggttgacataaccgagctgattaacgattttatgcaggtggaggagccccgtattgccaagctgcagggaggccagatactaatgggtcaagagctgggaatgacaactatccagattttgagtccattgagtgataccattctggccgagaagacaatcactgtcctcgacgaaaaggtaacaatcaccgacctcggagtgcagctggttaccggcctctccctgagtctgcagctgtctcctggaagcaaccgggctatcttcgcaactgccgtagcccaagagttgctgcagcgccctaagcaagaggctgcaattagttgctgggtccagttcagcgatggtagcgtaacacctctcgacatctatgacggcaaggactttagcttgatggctacatcattggatgaaaaagttgtcagtattcaccaggaccccaagttcaaatggccaatcatagccgctgagaccgaaggccagggcacactggttaaggtcgagatggtgatatctgagtcctgtcagaagtctaagaggaaatcagtactagcagtgggcacggcaaacattaaggtgaagtttggccagaacgatgccaaccccaatactagcgatagcaggcataccggagccggtgtgcacatggaaaataatgtctcagatcgaagaccaaagaaaccaagtcaggaatggggctcacaggaaggtcaatactacggcagttcctctatgggcctgatggaggggagggggaccactacggacagatcgattcttcagaaaaagaaagggcaggagtccctgcttgatgacaactctcacctccaaaccattccatctgacctaacctcgttccctgcccaagtggatctgccgaggagcaatggagagatggacggcaatgatcttatgcaagccagcaagggactttctgatttggagattggtatgtatgcgctcctgggagtgttttgcctcgctatactggtgttcctgatcaattgtgtcacctttgccctgaagtacaggcataaacaggtaccttttgaggaacaggagggaatgtctcattcccacgattgggtcggcctttccaaccgcacagagcttttggaaaaccacatcaactttgctagtagccaggatgagcagattactgcaatcgacaggggcatggactttgaagaaagcaagtatctactaagcacgaatagccaaaaatccatcaacgggcagctcttcaagcctctgggccccatcatcatcgatgggaaggatcaaaagagcgaaccccctacctcccccacttctaaacggaagcgagtcaagtttactacattcaccgcggtgagctccgacgatgagtatcctacacgaaattcaattgtgatgtcctcagaggatgatattaagtgggtgtgccaggatttggatcctggcgattgtaaggaactccacaactacatggagcgccttcatgagaatgtctag

SEQ ID NO: 47178 - DNA, 3300 bp, Artificial Sequence
  Description of Artificial Sequence: Synthetic coding sequence
atgtgccccagcgagatgggcaccctgtggcaccactggagccccgtgctcatctccctggcagccctgttttctaaagttacggaaggccgcggtattttggaatcaattcagagattctcccttctgccaacctatctgcccgtgacgtaccacatcaacaacgctgacgtttctttctttctgaaagaagcaaaccaggatatcatgcggaacagttctttacagtcacgcgtggaatcgttcttgatttataaaagcagaaggttgcccgttctgaatgcatcatacgggcctttttctattgagcaagtggttccgcaagacctgatgctcccgagtaatccctttgggtttacaaacaagttctctctgaactggaagctcaaggcgcacattctgagggacaaagtttacctgagcagaccgaaggtgcaagtgcttttccacattatgggacgcgactgggacgaccgcagcgcaggcgagaagctcccctgcctgcgcgtgtttgcttttcgagagacccgcgaggtgcgcggaagctgccgacttcagggagacctgggcttatgtgtggcagagctagagctgctgagcagttggttttccccgcctaccgtagtggcaggccgccgaaaatctgtcgaccagcccgaggggacccccgtagagctgtactacacagtccacccaggaggagagagaggggactgcgtgcgtgaagatgctaggaggtctaacggaattcgaaccgggcacagtgacattgacgagtccggtccaccacttcagagaattgggtcaatcttcctgtaccagacccatcggaagccgtcactgagggaacttcgcttggataactcagttgcaatacactatatcccgaaaaccgtgcggaaaggagacgttcttacttttcctgtttcaattagcaggaactcaactgaggatcgatttactttgcgggcgaaggtcaaaaaaggtgttaacattataggtgttagggccagctctccttccatctgggatgtgaaagagagaacagattacacaggaaaatatgctcccgccgttattgtctgccaaaagaaagccgcaggtagcgaaaactcggccgatggagccagctatgaggtgatgcaaattgatgttgaagtggaggagcccggagacctgccagctactcagctggtgacctggcaggtagaatatcccggcgaaattacgagcgatctaggggtctcaaaaatctacgtgtcgccaaaggatctcattggcgtcgtaccactggcaatggaggccgagatcctgaatactgctatcctcaccgggaagacggtggcagtccctgtgaaagtcgtgtcagtggaagatgatggcacagttacagagctcctggaatcagtcgagtgtcgatccagcgacgaagacgtcattaaggtgagcgatcgttgcgactacgtgtttgttaacggcaaggagatgaagggaaaggttaacgtggtcgtcaatttcacataccagcatctgtcatctcctcttgagatgaccgtgtgggtacctagacttccgttacagatcgaagtcagtgacaccgaactcaatcagattaaagggtggcgggttccaattgtctcatctaggcggccggcaggcgactccgaggaggaagaagatgatgagcggcggggacgtggttgtaccctccaatatcagcacgccatggtgcgcgtgctgacacagttcgtagccgaggcagcaggtcccggcggacacctggctcacctgctaggaagcgactggcaggtagacatcaccgagctaattaatgacttcatgcaagttgaggagccaaggatcgctaaactgcagggcggccagattttaatgggacaggagctgggcatgacaaccattcagatcctttccccattgagtgacaccattctagccgaaaaaacaataacagtcttggatgaaaaggtgaccatcactgaccttggtgtgcagttagtgaccgggctgagcttgtccctgcagctgtcgccggggagcaatcgggctattttcgctacagcagtggcacaggaactcctccagcgtcccaaacaggaagcagctatctcttgttgggtgcagttcagcgatggttcagtgacacctcttgatatctacgacggtaaggactttagcttgatggctacttcactcgacgagaaagttgtgagtattcaccaggatcccaaattcaagtggcctataattgccgctgagacagaggggcagggaaccttggttaaggtcgagatggtgatttctgagagctgtcaaaaaagcaagcgaaaatctgtgttggcagtggggacagcaaatattaaggtgaaattcgggcaaaacgacgccaacccgaacacctcggacagtaggcataccggcgccggggtgcacatggaaaacaacgtgtccgaccgccgacccaagaaaccctctcaggagtggggtagccaggaggggcagtattacggctcttctagcatgggcctcatggaaggtcgcggcacaactactgaccgatctatcctccagaaaaagaagggacaagagtcactactcgacgataacagccacttacagaccatcccctccgatctgaccagctttccagcccaggtggatctgcccagatctaacggcgagatggacggaaacgaccttatgcaggcctccaaagggctgagtgatttagaaattggcatgtacgcactgcttggggtgttttgcctggccattctcgtcttcctcattaactgcgtcaccttcgctcttaagtatcgccacaagcaggtgccctttgaagagcaggagggcatgagccacagccacgattgggttgggctttcgaacaggactgagctgcttgagaatcatatcaatttcgccagtagtcaggatgaacagattacagcaattgatcggggtatggatttcgaagaatccaaatacctactctccaccaattctcagaagagcatcaatggacaactgtttaaaccattaggacccattataatcgatggtaaagatcagaagtcggagccccctacgagtcctacgtcaaagaggaaacgggtcaagttcactactttcaccgctgttagctcggatgacgaatatcccacccggaactctattgttatgtctagcgaggatgatattaagtgggtttgtcaagatctcgatcccggagactgcaaagaattgcacaactatatggaaaggttacacgagaacgtgtag

SEQ ID NO: 47179 - DNA, 2955 bp, Artificial Sequence
  Description of Artificial Sequence: Synthetic coding sequence
atggcccccggcatgagcggccggggcggcgccgccctgctgtgcttgtcggccttactcgcccacgctagcggcaggtcacacccggcgagtccctcaccccccggcccccaagcctcccccgtgcttccagtcagctaccgtctatcccacacccgcctagctttcttccttcgcgaagcccgtcctccttctccggcagttgctaactcttctctccaacggagcgaaccttttgtcgtatttcagactaaagagctaccggtcctgaacgtgtccctgggacccttttctacatctcaggtcgtggctcgcgagttattacagcctagctcgaccctggatatccccgaacgcctcaccgtgaactggaaggttcgggcattcatcgtccgaagccacgtgcccgcaagccagcccgtagtccaagttctcttttacgtggcaggccgagattgggatgatttcggcgtaaccgagcggttgccctgtgtgcggttacatgctttccgtgatgccagagagcatcctttactgaggatcggcagtatctcattgttcaggccaccccccaggcgtaccctccaggaacacagactcgattcaaatctgatgatccggctcccggaccggccgttaaaaccgggcgaagtcctcagtatactactgtatctggctccaaatagctcttccccaagttccccttccgtcgagcactttacattgcgggtaaaagccaaaaagggcgttacattgcttggaaccaagtcccggtccgggcagtggcatgtgaccagtgaattgctcaccggcgcaaagcacagtactgcaactgtcgacgtggcctgggcacagtccactccactgccaccccgcgaggggcagggacctctggaaattctgcagctggactttgaaatggagaactttacctcacagtccgtgaaacgacggataatgtggcatatcgactaccgcggccacggggctttgcccgatttagaaagagccgtgactgaacttacagttatccagagggacgttcaagctatacttcctcttgctatggacactgaaataattaacactgccatcctaacaggaagaaccgtggctattccagtgaaggtgattgcaatcgaagtgaacggtcttgtgttggacatcagcgctctggttgagtgcgagtctgacaacgaggatatcatcaaggtgtcatcatcatgcgattatgtgttcgtctcaggtaaggagagcagaggttcaatgaacgccagagtcacttttcgatacgacgtcctgaatgccccactggaaatgacagtgtgggtgcccaagctacctcttcacattgaactgagtgacgcccgtttgtcccaagtgaaaggatggagggttcctatcctccccgaccggcgctctgtaagagaatcagaggatgaggacgaagaggaggaagagaggcgccaaagcgccagtcgcggctgcactctgcagtaccagcatgctaccctgcaggtgttcacacaatttcataccacttctagcgagggaaccgaccaggtcgtgaccatgttggggcccgactggctagttgaagtaaccgatctggtcagcgatttcatgagggtgggtgatcctagggtggcacacatggtggattcctccaccctggccggcctggaacctggcactactccttttaaagtggtatcccccctgactgaggcagtgcttggcgagacactgctgaccgtgacagaagagaaagttagcatcacgcagctgcaggcccaagttgttgccagtctggccctctcactgcggccaagtccaggtagttcacacacaatcttggctacaaccgccgctcagcagaccctgtcattcttaaaacaggaagcattactgtctctgtggctctcgtattcagatgggaccactgcccctctgtctttgtattcaccgagagattatggtttgctggtatcttcattggacgagcacgtggccacggtgacgcaggacagagcttttcccctcgtcgtggctgaagcggagggttcaggggagcttctgagagccgaactgactattgctgagagctgtcagaaaaccaaaaggaagagcgtcctcgccaccacacccgttgggctgcgcgtgcattttgggagagacgaggaagaccccacttatgactatcctggtccaagccagcccgggccgggaggcggggaggacgaggcccggggagcggggcccccagggagcgccctgcccgctcctgaagccccagggccagggaccgcgagcccggtggtgccccccactgaggacttcctgcctttgcccactggattcctgcaggtcccccggggcctgaccgatctggagattggtatgtacgccttattgggagtattttgcctcgctattctggtatttcttatcaactgcatcgtctttgtgctgagatacagacacaagcgcattcctcctgaagggcagacttcgatggaccatagccatcattgggtttttctgggcaatggccagcccttacgtgtccagggcgaactgtcaccccccgcgggcaatcccctcgagacagttcccgccttttgtcacggagaccatcactccagcgggagctcccaaacgtccgtgcagtcacaggtccacgggcggggtgacggttcgtcaggaggatcggccagggatcaggccgaagacccagcttctagcccaacaagcaagcggaagcgcgtaaaattcaccaccttcactacacttccatccgaggagctcgcctacgatagtgtgcctgctggagaagaggacgaagaggaggaggaagaccttggctggggatgccccgacgtggctggaccaacacggcctactgcaccccccgatctgcataattatatgaggcgaatcaaggagatcgcctag

SEQ ID NO: 47180 - DNA, 390 bp, Artificial Sequence
  Description of Artificial Sequence: Synthetic coding sequence
atgaccagccaccactgcgtgggccccggcaaccacatcagctggtcgggccacgaaaaagaacacagactggattactgtccggaggttacattcccacttacaaagggattccctttgggttatacactactctttaatttcgctagttatccatttcttctgccctcaaagatcaaaactcttctccgaaacaaagacagcttcctcaacatactttgccctgcgtgcctgctcctgattcgccgttgtaatatcgagtatagttctaccggattgaacttcctgaatactttcacagtgagcctgattgtaaccgtcatacctctgctgcagaacgtgccggtgccgctgggaaacaacgttggcaaaatgcaggtgtatgaatag

SEQ ID NO: 47181 - DNA, 588 bp, Artificial Sequence
  Description of Artificial Sequence: Synthetic coding sequence
atgagcgccgcccggccccagttcagcatcgacgacgccttcgagctgtcactagaggatggcggaccaggtccggagagtagcggtgtggcgcggtttggcccccttcatttcgaacgccgggcgcggtttgaagtagccgatgaagataagcagagtcggcttcggtatcaaaatctcgaaaacgatgaggacggtgcccaggccagtcccgaacccgacggcggggtcggtaccagagacagctcgcgcactagcatcaggtccagccagtggtccttttcgacaatcagctcatccacacaaaggagttataacacctgctgcagttggacccagcaccccctcatacaaaaaaatagaagagtcgtgttggcgtcttttcttctacttctcctgggattggtgctgattctagtgggggtgggacttgaggccactcccagcccaggtgtgagctccgcaatcttcttcgtgcccggattcttattgctcgtgccaggtgtgtatcacgttatctttatctactgcgccgtgaaaggacatcgcgggtttcagtttttttacctgccctactttgagaaatag

SEQ ID NO: 47182 - DNA, 543 bp, Artificial Sequence
  Description of Artificial Sequence: Synthetic coding sequence
atgagcgccgcccggccccagttcagcatcgacgacgccttcgagctgtccttggaggatgggggccccggacctgagagctctggtgtcgcacggtttggcccgttgcattttgagcgaagagcaaggtttgaggtggcagacgaagataaacagagccgactcagatatcaaaatctggagaatgatgaagacggagcccaagcgagtcctgaaccagacggcggcgtcggtaccagagacagctctagaacctcaatacggtcttcacagtggtccttctctactattagctcatcaacccagcgcagctataatacttgctgctcgtggacacagcatccccttatccaaaagaatcggagagttgttctggcctcattcctcctcctgttgcttggccttggggtgtcctccgcgatatttttcgtgccaggtttcctgctgcttgtccccggcgtgtaccacgtaatctttatttattgtgctgtgaagggccatcgtgggtttcaatttttttatctgccatacttcgaaaaatag

SEQ ID NO: 47183 - DNA, 1377 bp, Artificial Sequence
  Description of Artificial Sequence: Synthetic coding sequence
atggccgccctgagcaagagcatcccccacaactgctacgagatcgggcatacctggcatccctcgtgtcgcgtttcctttctccagataaccggaggcgcactggaggagtcgctgaagatttatgcccccttgtacctcatcgccgccatcctgcgtaaaagaaagctggattactacctgcataaactgcttccagagatcttacagagcgccagcttcctcacggcaaacggagccctgtacatggccttcttctgcattctgagaaagattttgggaaaattttacagttggaccccgggattcggagctgctctgccagccagctacgtggctatccttatcgagagaaagtcccgccgcggccttcttacgatctatatggctaatctggcaaccgaaaccctgttccgcatgggggtggctcgtgggactatcaccacgttgaggaacggggaggtcttgttgttctgtatcaccgctgctatgtacatgtttttctttaggtgtaaagatggtctgaagggctttactttctctgccctccgtttcatcgtgggcaaggaggaaatccctacccactcatttagccctgaggccgcttatgccaaagtagaacagaaaagggagcagcacgaggaaaaaccaggccggatgaacatgattggactggtcagaaagttcgtggactcaatttgcaagcacggaccacgacatcgctgctgtaaacattacgaagacaattgcatctcttattgtattaagggtttcatacgcatgttctccgtggggtatctaatacagtgttgtctaaggatccctagtgccttccgccatcttttcacccaaccctcaagactgttgtccctgttttataataaagaaaacttccagctgggcgcctttctcggatcgttcgtctcaatttacaagggaacttcatgctttttaagatggatccgcaatctggacgacgaattgcacgctattatcgccggattcctcgctggaatatcaatgatgttttacaagtctaccacgatttcgatgtatctggcgagcaagctcgtggagactatgtactttaagggtatcgaggctgggaaggtgccttacttcccacatgccgataccattatctattctatcagcactgccatttgcttccaggcagccgtgatggaagtgcagacactacgcccgtcttactggaaattcctccttcgcctgaccaagggcaagtttgctgttatgaacaggaaggtactagatgtctttggaactggagccagcaaacacttccaggactttatacctagactggatcctcgctacactacagtcacaccagagctgcccaccgagttcagttag

SEQ ID NO: 47184 - DNA, 1311 bp, Artificial Sequence
  Description of Artificial Sequence: Synthetic coding sequence
atggccgccctgagcaagagcatcccccacaactgctacgagatcggccacacctggcaccccagctgccgagtgtcttttctgcagatcacaggaggcgctctggaagaatccctgaagatttatgctcccctgtatctgatcgccgctatcctgagaaagcgcaagctcgactattacctgcacaagttgctgcctgagatccttcagtcagcctcattccttaccgcaaacggggcgctgtacatggcctttttttgtatactgcgaaagatacttggtaagttctattcctggactccagggttcggcgctgccctcccggcatcttatgtcgctatacttattgagcggaagtctagacgcggtctgctgactatatacatggctaatctcgttcttctgttttgtatcactgcagccatgtacatgtttttcttccggtgcaaggatggcctgaaagggtttaccttcagtgcgctgaggtttatagtagggaaagaagagatacctacacacagcttctctccggaggccgcctacgccaaggtcgaacagaagagagaacaacatgaggaaaaacccggccgcatgaatatgataggcctagttcgtaagtttgtagactccatctgtaagcatggcccccggcatcggtgctgcaagcactacgaagataattgcatctcttattgcattaagggcttcattagaatgtttagcgtgggctacttaattcagtgttgcctgaggattcccagcgctttcaggcatctgttcacacagccgagcaggctcctttcactcttctataataaagagaactttcaactcggggcctttcttgggagcttcgtgagtatatacaagggaacatcctgtttcctacgctggatcagaaacctcgatgacgagctccacgccattatcgctggtttcctggccggcataagcatgatgttctacaaatccacaaccatttcaatgtacctggcatcaaagctcgtcgaaacaatgtatttcaaaggcatcgaagcaggcaaagtgccctacttccctcatgctgacaccatcatttattcaattagtacggctatatgcttccaagctgccgtgatggaggtacagactttaagaccatcctattggaaattcctactgcgcttgaccaagggcaaatttgccgtaatgaacagaaaggtgctggatgtctttggtactggagcttctaagcacttccaggactttattccccgtctggatccgcgatataccaccgttacaccagaattgcctacagaatttagttag

SEQ ID NO: 47185 - DNA, 483 bp, Artificial Sequence
  Description of Artificial Sequence: Synthetic coding sequence
atggccgccctgagcaagagcatcccccacaactgctacgagatcggccacacatggcacccctcctgtagagtatcttttcttcagattacagggggcgcactcgaggagagcctcaaaatctacgcccccctgtacctgatcgcggccattctgcggaaaaggaagctggactattatcttcataagctgctgcctgaaattctacagtcagcgtcttttttaaccgccaacggagcactgtacatggcttttttctgcatacttaggaaaatcctgggcaaattttacagctggacacctggatttggagctgcgcttccagccagctacgtggctattctaatcgaaaggaagagccggaggggcttgctaactatttatatggccaacctgatggaatcacactgcctgcctcaggcgggtgtcatttccgccccatgtagcctttgccttccaggttccagggactccccggcttag

SEQ ID NO: 47186 - DNA, 960 bp, Artificial Sequence
  Description of Artificial Sequence: Synthetic coding sequence
atgggcgtggcccggggcaccatcaccaccctgcggaacggcgaggtgctgctgttttgtataacagcggccatgtatatgtttttctttcgctgcaaagatggactgaaagggttcaccttttccgcgctgagattcatcgttggtaaggaggaaatccctacccacagtttttcgccggaggcggcatacgccaaggtagaacagaagcgcgagcagcacgaggagaagcccgggagaatgaacatgatcggcctcgtgaggaaattcgtggacagcatttgcaaacatggtccgcgccacagatgttgtaagcactacgaggacaactgtataagttactgcattaagggcttcattcggatgttctctgttggatacctaatccagtgctgcctacggattcctagcgccttccggcaccttttcacccagccaagtcgtctgctctccctgttttataacaaagagaactttcaactaggggcgttcctaggttccttcgtgagtatttataaaggaacatcatgcttccttcggtggatcagaaaccttgatgacgagttgcacgcgattatagctggttttttggccggaatcagcatgatgttctacaaatccactactatttcgatgtatctcgcatccaagttagtagaaaccatgtacttcaagggcattgaggctgggaaggtgccctatttcccacatgcagatacaatcatttactcaatctctaccgccatctgttttcaggcagcagtcatggaggttcaaactctccgaccatcctattggaagttcctgctccgcctgacgaaagggaagtttgccgttatgaaccggaaggtcctcgatgtgtttggaacaggtgcaagtaagcacttccaggattttataccccggctggaccctcggtacacaactgtgaccccggaactgcccactgagttttcctag

SEQ ID NO: 47187 - DNA, 888 bp, Artificial Sequence
  Description of Artificial Sequence: Synthetic coding sequence
atgtacatgttcttcttccggtgcaaggacggcctgaagggcttcacgttcagtgcactaagatttatcgtggggaaggaggaaatccctactcactcctttagtccggaagcagcatatgcgaaagtggagcagaagagggagcagcatgaagagaagcctggtcgcatgaacatgatcgggctggtcagaaaatttgtggacagcatctgcaagcacggcccacgacatcggtgctgcaaacactatgaggacaactgcatcagttactgtatcaagggattcattagaatgttctctgtgggttaccttattcagtgctgcttaaggatcccgtctgccttccggcatcttttcactcagccttccaggttgctttctcttttctataataaagagaactttcagctaggcgcatttctggggtcatttgtttccatttataagggaacttcctgctttctacggtggatccgtaatctggatgacgagttgcatgccattatcgctgggtttctagctggtattagtatgatgttttacaagagtacaaccattagtatgtatttggcaagtaagttggtcgagactatgtacttcaagggcatcgaggcagggaaggttccgtactttcctcacgccgacaccattatttattcaatcagcaccgccatatgtttccaagccgctgtgatggaagtgcagaccctgcgccccagttattggaaattcctcctgagattgacgaaagggaaatttgccgtgatgaaccgcaaagtcctggacgtcttcggtaccggggcttcgaagcactttcaggatttcataccgcggctcgatcctcgctatactaccgtgacccccgaactcccaactgagttctcgtag

SEQ ID NO: 47188 - DNA, 804 bp, Artificial Sequence
  Description of Artificial Sequence: Synthetic coding sequence
atgacccagtgctgcttcctgcgggtgcaccccctgttcttctggttttggtcctttcatcaccgcatggcgctcgcactttgtcttcaggtgctgtgttcactttgcgggtggctctccctctacattagtttctgccatctaaataaacatcgcagttacgagtggagctgtcgacttgtgacattcacacacggagtactgagtatcggcttgtcagcctatatcggatttatcgacggcccatggccttttacacaccccggtagccccaatacacccctccaggtgcacgtgttgtgcctcaccttaggatatttcatttttgacctggggtggtgtgtgtattttcaatctgaaggcgcacttatgctcgctcatcacacactcagtattttgggcattattatggcgctggtgttaggggagtctggtaccgaagtgaatgccgtcttgtttgggagcgaattaacaaatcctctgcttcagatgagatggtttctcagggaaacgggccactatcactccttcacaggggacgtcgtggactttctgtttgtcgccctgtttacaggcgtgcggataggagtgggcgcatgtctacttttctgcgaaatggtttctccgacccctaaatggttcgttaaagctggtggtgtcgccatgtatgccgtgtcctggtgcttcatgttcagtatttggcgattcgcgtggaggaagagtattaaaaagtatcacgcttggcgatcgcggcggtcagaagagcggcagctcaaacacaacggacacctcaagattcattag

SEQ ID NO: 47189 - DNA, 738 bp, Artificial Sequence
  Description of Artificial Sequence: Synthetic coding sequence
atggccctggccctgtgcctgcaggtgctgtgcagcctgtgcggctggctctcgctgtacatctccttctgccacctcaacaaacacagaagctacgagtggagttgccggctggtcacattcacacacggagtgctgtctatcggacttagtgcgtacatcggatttatagatgggccatggccgttcacacaccctggatccccgaatacacctctgcaggtgcacgtgctatgcctcacactgggctacttcatctttgacctgggatggtgtgtatacttccagtctgagggcgctctgatgttggcccatcacacccttagcatcctggggattattatggctctggtcctcggcgagagcggcaccgaggtgaacgccgtcttatttggcagcgagctaacgaaccctttactgcaaatgaggtggttcctgagggagactggccattatcacagctttacaggcgatgtcgtagatttcctcttcgtcgccctgttcacaggagtgcggatcggggtaggggcatgtctcttattttgtgagatggtgtctcccactcctaaatggtttgttaaggccggaggggtagcgatgtacgccgttagttggtgctttatgtttagcatatggcgctttgcatggcgcaagtccattaaaaagtatcatgcctggcggtctcgccggtcggaggagcgacaattgaagcataacgggcatctgaagatccactag

SEQ ID NO: 47190 - DNA, 447 bp, Artificial Sequence
  Description of Artificial Sequence: Synthetic coding sequence
atgacccagtgctgcttcctgcgggtgcaccccctgttcttctggttctggtcttttcaccaccgaatggccctggccttgtgcctgcaggtgctgtgctcactatgcggttggctgagtctgtacataagcttttgtcatctcaacaagcaccggtcctacgaatggtcctgtcgtttggtgacctttacacatggggtactgtcaatcggcctgtctgcatatatcggcttcatagatggaccgtggcccttcactcacccgggctcacccaatacccccctgcaggtgcatgtcctgtgcttgaccttaggatacttcattttcgacctggggtgtatttggcggttcgcctggcgtaaaagcatcaaaaagtatcatgcctggaggagtcgtcgttctgaggaaaggcagctgaaacacaatgggcacctcaaaatacactag

SEQ ID NO: 47191 - DNA, 651 bp, Artificial Sequence
  Description of Artificial Sequence: Synthetic coding sequence
atggtgcccatgcacctgctgggccggctggagaagcccctgctgctcctctgctgtgcctctttcttactgggcctggcactgctcggcattaagactgatattacgccagtcgcttatttcttcctgactctaggggggttcttcctgtttgcgtaccttctcgtccgctttctggagtggggcttacgttctcaactgcagtccatgcaaaccgagtccccgggaccaagtgggaacgcgagagacaacgaagcttttgaagtcccagtgtatgaggaagccgtcgtgggactggaaagccagtgtaggccgcaagaactcgatcagccccctccctacagcactgtcgtgatacctcccgcccctgaagaggagcagcccagccatcccgaaggcagcagaagggcaaagctggagcagaggcgcatggcgtcagaagggtccatggcgcaggagggcagtccgggccgcgctccaattaaccttcggctgaggggccccagggcagtgtccacggcgcccgatcttcagtcattggccgctgttcccacactggaacccttgactcctccccctgcatatgacgtatgtttcggccaccccgacgatgattctgtgttctacgaggacaattgggctcccccctag

SEQ ID NO: 47192 - DNA, 651 bp, Artificial Sequence
  Description of Artificial Sequence: Synthetic coding sequence
atggtgcccatgcacctgctgggccggctggagaagcccctgctgctgctgtgctgtgcatcctttctgttaggattggcacttctggggatcaagaccgacatcactcctgtggcttacttctttctcacccttggggggttcttcctctttgcatatttactagtgaggtttctggaatggggcctgagatctcagttgcagtccatgcagacggaatcccccggcccatccggcaatgccagggacaatgaagcttttgaagttccagtttatgaggaggccgtcgtgggcctcgagtctcagtgccgcccacaggagctggatcagccacccccgtacagtacagtggtgattccacccgcgccggaggaggagcagccaagtcacccagagggctcaaggcgggcgaagcttgaacaacggcgcatggcttccgagggttctatggcacaggagggctcccccggccgagctccaatcaacctcaggctgcgaggaccgagggcagtcagcaccgccccggacctgcagtctctggccgctgttccaactctagagccgctaactcctccaccagcctatgatgtgtgcttcggacatcctgacgatgattccgtgttttatgaggacaactgggcccctccatag

SEQ ID NO: 47193 - DNA, 651 bp, Artificial Sequence
  Description of Artificial Sequence: Synthetic coding sequence
atggtgcccatgcacctgctgggccggctggagaagcccctgctgcttttatgttgcgcatcttttttactgggtctggcgcttcttgggatcaaaaccgatatcacgccagtggcctacttctttttgacactcggagggttttttctttttgcctatttgcttgtcagatttttagaatggggcctccggtcccagttgcagtccatgcagaccgagagtccaggcccatctggtaatgcgagggataacgaagcattcgaggtgccagtttatgaagaggcggttgtcgggctggaaagtcaatgtcgaccgcaggaactggaccagccgccaccatactccacagtagtcattcccccggcccccgaggaggaacaacctagtcatcctgagggttcccggcgggctaagttggagcaaagaaggatggccagcgagggctctatggctcaggaaggcagccccggtagagcacccataaatctgcggctgagagggcctcgcgccgtttcaactgcacccgacttacaatccctggccgccgtccccacattggagccactgaccccaccgccggcatacgatgtatgtttcggacatcctgacgatgactcagtgttttatgaggataactgggctcccccgtag

SEQ ID NO: 47194 - DNA, 651 bp, Artificial Sequence
  Description of Artificial Sequence: Synthetic coding sequence
atggtgcccatgcacctgctgggccggctggagaagcccctgctgcttctgtgctgcgcgtcatttttactgggccttgccctactgggcatcaaaacggacataacgccagttgcttatttctttctgaccctggggggcttctttttattcgcttatctcctggtcaggtttctcgagtggggtttaaggagccaactgcagtccatgcagaccgaatctcccggcccttccggcaacgcacgggacaacgaggccttcgaggtgcccgtgtatgaggaggccgtcgtagggctcgaatcacaatgcagaccacaggagctggaccagccgcctccctactctacggtcgtgatcccacctgccccagaagaggagcagccgagccatcccgagggttcaagacgagcaaagttggaacaaaggcgcatggcctctgaaggctcgatggcccaagagggaagcccggggcgtgcccccatcaatctgagactgcgcggacctcgcgccgttagcacagccccggaccttcaatcactggctgcagttcccacattagaacccttaacacctcctcctgcctatgacgtctgcttcggacatcctgatgatgacagtgtcttctatgaggataattgggctcccccttag

SEQ ID NO: 47195 - DNA, 651 bp, Artificial Sequence
  Description of Artificial Sequence: Synthetic coding sequence
atggtgcccatgcacctgctgggccggctggagaagcccctgctgctcctgtgctgcgccagctttcttcttgggctcgccctactcggtatcaagacagacatcactcctgtagcgtattttttcctaactctgggagggttcttcctgttcgcttacctgctcgttcggttcttggaatggggcctgaggagccagctgcaaagtatgcagaccgagtcgccaggcccatctggaaacgccagagacaacgaggctttcgaagttcctgtatatgaggaggctgtagtgggcctggagtcccagtgccggcctcaggagctggaccagccacccccttacagcacggtggtcataccacccgcaccggaagaagaacagccaagtcaccctgaaggctcccgacgtgccaagctggagcagcgccgcatggcctctgaaggcagcatggcacaagagggatctccaggcagggcacccatcaacctgcggctacgaggcccgagggccgttagcaccgcccctgatcttcagtccctggctgcagtcccaacacttgagcccttgaccccacctccagcgtacgacgtgtgtttcggtcatcccgatgacgattcagtattctatgaagataactgggcccctccatag

SEQ ID NO: 47196 - DNA, 558 bp, Artificial Sequence
  Description of Artificial Sequence: Synthetic coding sequence
atggccggcccccggccccggtggcgggaccagctgctgttcatgtcaatcatcgtcctggttattgttgttatttgcctgatgttttacgccctcctttgggaagctggtaacttgaccgatctgcctaacctgcgtatcggattctacaacttttgcttgtggaacgaggatacgtccaccctccagtgccaccaatttccagagctcgaagctctgggtgtgcctcgggtcggcctcggcctagcccgtctgggcgtttacgggagcctggttttgactctcttcgctccccagcctctcttgctcgcacagtgcaactcagacgagcgagcttggagattggcggttggatttctggccgtgtccagtgtgctgctggctggaggcctgggcttgtttttgtcttatgtttggaaatgggtcagactgtctctgcccggtccaggatttctcgccctggggtcagcccaggcactgctgatacttctgctaatcgcaatggctgtattcccgctgcgggccgaaagggcagaaagtaagctcgagtcctgctag

SEQ ID NO: 47197 - DNA, 447 bp, Artificial Sequence
  Description of Artificial Sequence: Synthetic coding sequence
atggccggcccccggccccggtggcgggaccagctgctgttcatgtccatcatcgtactggtcattgtggttatttgtctgatgttttatgcccttctgtgggaagctggcaacctcacggacctgcccaatttacgtattggcttttataacttctgtctgtggaatgaggatacttccacattgcaatgtcaccagtttcccgagcttgaggccttgggggtaccgagagtcgggctcggacttgctcgactcggcgtttacggaagtctcgtgctcactctgtttttcctgtcctacgtgtggaagtgggtgcggctgagcctgccagggccaggatttctcgcactggggtcagcccaggcccttctgattttactgctgatagccatggcggtgttccccctcagagcggagcgagccgaaagtaagctggaaagttgctag

SEQ ID NO: 47198 - DNA, 327 bp, Artificial Sequence
  Description of Artificial Sequence: Synthetic coding sequence
atggtgaacctgggcctgagccgggtggacgacgccgtggccgccaagcacccagggctcggggaatacgctgcctgtcagtcccatgccttcatgaagggcgtgttcactttcgtgaccgggactggtatggccttcggcctgcagatgtttattcagcgcaaatttccctatccactacaatggtccctactcgtcgctgtagtagccggctccgtcgtgtcatatggagtgacgagggtggaatctgagaaatgcaataatctgtggttgttccttgagaccggacagctccccaaagataggtccaccgaccaaagatcatag

SEQ ID NO: 47199 - DNA, 1380 bp, Artificial Sequence
  Description of Artificial Sequence: Synthetic coding sequence
atgaccgtggagctgtggctgcggctgcggggcaagggcctggccatgttgcatgtgacaagaggggtgtgggggtcacgagtgcgtgtttggccactgcttccagccttgctggggcccccccgggctctgtcttctctggccgctaaaatgggggagtataggaagatgtggaatcccagggagcccagagattgggcacaacaatacagggaacgattcataccattcagcaaggagcaattactgcgcctactgatccaggagttccactctagccctgcggagaaagcagctctggaagcttttagcgcccatgtcgacttttgtacactgtttcactatcatcaaatcctggcacggcttcaggcactgtatgacccaatcaacccagatagggagacccttgatcagccatcgctgaccgatccccagagactatcgaacgagcaggaggtcctaagggcactggagccactgctggcgcaggcaaacttcagcccactctccgaagataccctggcatatgctttggtggtgcaccacccccaagacgaggtgcaggttaccgtgaatctggatcagtacgtgtatatccacttttgggctctgggacagcgggtcggacagatgccactcaagagctccgtggggagcaggcgcggattcttcacaaagctccctccagcagaacgccggtactttaaacgggttgtgctagctgcccgtactaagagaggacacctcgtgctcaaatcattcaaagacacgcccctcgaaggtttggaacagctcctgccagagctgaaggtacgcacaccaactctccagagagcactcctcaatctaatgttagtcgtcagcggagtcgctatttttgtgaacgtgggcatggtggtgctgacagacctgaaagtagcaaccagtctcttacttctcctctttgcaatatttatgggacttcgggccagcaaaatgttcggtcaaagaagaagtgcacaagcactcgaactggcacatatgctctattacagaagtaccagcaacaattccgagctgcttagcgccctcgcactccgtgcacaggacgagcacacaaaagaggccttgttagcccattcgtttctcgcccgacggccagggggtacgcaaggatcgcccgaagagacatcgagatggctgcggtcagaggtggagaactggctgcttgcaaaatccggatgcgaggtaacattcaatggaacgcgggcactcgcgcaccttcaagccctgactcctagtatgggtctgtacccgcctcccggattccccaagcttgaccccgtagctcccatcacaagcgagcccccccaagccactccctctagtaacattagctag

SEQ ID NO: 47200 - DNA, 1080 bp, Artificial Sequence
  Description of Artificial Sequence: Synthetic coding sequence
atgaccgtggagctgtggctgcggctgcggggcaagggcctggccatgcttcacgtgacgaggggtgtgtgggggagccgggtgcgggtgtggccattactcccagcccttttgggccctccccgggcgttgtcctcactggcagccaaaatgggcgagtatcgtaaaatgtggaatcctagggaaccaagggattgggcacagcagtaccgcgagagatttattcctttctctaaggaacagctgctgagattacttattcaagtgacggtgaaccttgatcagtacgtgtatatccacttctgggcgctgggtcagagagtgggacagatgccgctgaaaagtagtgtgggtagcaggcgtggcttctttacaaaattgcctcccgctgaacgaaggtactttaagagagtggtgctagcggcaagaactaagcgcggacacctggtcttgaaaagctttaaagatacacccctcgagggcttggagcagctgttgcccgagcttaaggtgaggacgcctactctgcagcgcgctctcttgaatcttatgctcgttgtgtccggagtcgccatcttcgtgaatgtcggaatggttgtgctcaccgacttgaaagtggcgacttccctgctcctgctcttgtttgctatattcatgggacttcgtgcctcaaaaatgttcgggcagcgtagaagcgcacaagccctggaacttgctcacatgctgtactatagaagtaccagtaacaattcggaactgctatcggccctcgctttgagagcccaggacgagcacactaaagaggctttgctcgcccacagtttcctcgcacgccggcccggcgggacacagggatccccggaggagaccagccggtggttgcggtctgaagtggagaactggttgcttgccaaaagtggttgcgaggtaactttcaacggcactagggcgctggcccaccttcaggcgttaaccccctccatgggcctgtacccccctcccggttttcctaaactggatcccgtggcaccgataactagtgagcctccacaggccacaccatcttctaacatttcttag

SEQ ID NO: 47201 - DNA, 1275 bp, Artificial Sequence
  Description of Artificial Sequence: Synthetic coding sequence
atgaccgtggagctgtggctgcggctgcggggcaagggcctggccatgttacacgtgactcgcggggtctggggttcccgcgttagggtttggcctctcctgcccgccctcctggggccacccagagccctcagtagcctggcggcaaagatgggtgaataccgaaagatgtggaatccgagagagccccgggattgggcacagcagtatcgggagagatttatcccctttagcaaggagcagctgctgagactcctgatccaggcgttgtacgaccctataaatccggacagagagacactggatcagccaagcctgaccgaccctcagagactctctaacgagcaggaagtgctgcgtgctctggagccacttctggcacaggctaatttctcaccactcagtgaggacactctggcatatgctctggtggtgcatcaccctcaggatgaagtccaagtgaccgtgaatcttgatcagtacgtgtacatccacttctgggcgttggggcagagagtcggacagatgcctctcaagtcctctgtgggtagcagacggggattttttactaaactgcctcctgcagagagaaggtatttcaaacgggtcgtacttgccgcgaggactaagagaggacacttggtcctaaagagcttcaaagatacgcccctcgaaggactggagcagctgctgccagagcttaaggtgcgtactccaacccttcagagggccctactgaacctcatgttggttgtttccggggtggcgatctttgtcaacgtagggatggtagtacttacagatctgaaggtcgcgacatctctgctccttctacttttcgctatcttcatgggcctgcgggcatctaagatgtttggccagagaagatccgctcaggctttggagctcgcccacatgctatattatcgtagcacgtctaataactccgaattgctgagcgccctggctctcagggcacaggacgagcataccaaagaggcacttttggctcactctttccttgccagaagacctggtggtacccaagggagccctgaggagacatctcgctggctacgaagtgaggtggaaaactggctactagccaaatcaggttgtgaagtgactttcaacggcactcgcgctttggcacacttgcaagcactcaccccgtctatgggattatacccaccaccagggttcccaaaactcgatccagtcgctcctataacaagtgagccaccacaggcgactccatcatctaacattagctag

SEQ ID NO: 47202 - DNA, 1185 bp, Artificial Sequence
  Description of Artificial Sequence: Synthetic coding sequence
atgaccgtggagctgtggctgcggctgcggggcaagggcctggccatgttacacgtgactcgaggcgtgtgggggagccgtgtgagagtgtggccactgcttcctgctctattgggccctccgagagcactcagcagcttggcagccaagatgggcgaatatagaaaaatgtggaaccccagggagcccagagattgggcccagcagtacagagagcggttcataccatttagcaaagagcaactactcaggctgttgattcaggaatttcattcgtccccagccgagaaggccgccctcgaggctttctccgcccacgtggatttctgcaccctgttccattaccaccaaattctcgcacgcttacaggttacagtgaatcttgatcagtacgtctatattcatttctgggcccttggacagcgggtggggcaaatgccccttaagagcagcgtaggatccaggcgcggtttcttcacaaaattaccacctgccgaaagaagatattttaagagagtggtactggcagctcgcacgaaaagggggcacctcgtactaaaatcctttaaagacacccctctggaaggattggaacaattgctgcctgagctaaaggtgcggacacctacgctgcagcgcgccttgctgaacctaatgctggtggtttctggtgtcgctatcttcgtgaacgtgggcatggttgtgctcaccgacctcaaagtagcgacctctctgctgctcctcctgttcgctattttcatggggctccgcgcatcaaaaatgtttggccagcggagaagcgcacaggccctcgaactggctcacatgctttactaccgaagcacctctaataactcagagctgttgagcgctttggctctgcgagcccaggatgaacatacaaaagaagccctgttagcccattcatttctggctcggagacccggtggcacacagggatctccagaggaaacgtcgcgttggttacggtctgaggtggagaactggctgttagcgaagagcggctgtgaggtgaccttcaatggcaccagagccttagctcacttacaggcactgaccccaagcatgggtctttacccaccccctggctttcccaagttggatccagtggccccgatcacgtctgaaccgcctcaggcaacgcccagcagtaatatttcctag

SEQ ID NO: 47203 - DNA, 1050 bp, Artificial Sequence
  Description of Artificial Sequence: Synthetic coding sequence
atgcggcggcggctgaacgacagccgggccctggccaaggccctgtacgatccaataaatccggatagagaaactctggatcagcctagtctcaccgacccgcagcggctgtccaatgagcaggaggttttaagggcgctcgaaccattactggcccaggctaatttcagtcccctgtcagaggatacgctcgcatatgccctagttgtgcaccatcctcaggatgaagtgcaggtgaccgtaaacctcgatcagtacgtctacatccatttttgggcattgggacaacgggtcggccagatgcccctgaaatcctctgtgggctctcgaaggggcttcttcaccaaactgccgccggctgaaaggagatactttaagagggtggtgctcgctgcccgcactaaaagggggcatttggttcttaaaagttttaaggatacacccctggagggactggaacaactccttcccgaactcaaagtcagaactccaactcttcaaagagctcttttgaatcttatgctggtcgtatcaggggtcgcgatctttgtgaatgtgggaatggttgtgctgactgatctgaaggtcgccacttctctcctgctgctgctcttcgcgatctttatgggtcttcgggcaagtaaaatgttcggtcagcgccgctcagcccaggctctcgagttggcacatatgttatactatagatccacttccaacaatagcgagctgctgtcggccttagccctgcgcgcacaggacgaacacaccaaagaagccctacttgcccactcattcctggcaaggcggcctggcggtacccagggatcacccgaggaaacaagcagatggttgcgctctgaggttgaaaactggcttctggccaaatctggctgtgaagtcacctttaatggaacgcgagcgctggctcatctgcaagccctgacccccagtatgggtctgtacccccccccaggatttcctaaactggatcccgtggctcccattacttcagagccccctcaggcaacaccgtctagtaatatttcttag

SEQ ID NO: 47204 - DNA, 1038 bp, Artificial Sequence
  Description of Artificial Sequence: Synthetic coding sequence
atgagcaacaacggcgccgacctgaccttcggctacatcagctgctttgtagcaatattgctcttcggttccaactttgtcccgctgaagaagtttgatacaggagacggtatgttcttgcagtgggtgctgtgtgcagccatttggttggtggccctggtggtgaatcttattctccactgcccaaagttctggcctttcgcaatgttagggggctgcatctgggccaccgggaatattgctgtcgtgccaataattaaaactatagggctgggattgggtattctgatatggggttccttcaacgctctcacggggtgggcttccagtcggtttggatggttcggcctggatgccgaagaagtgtctaaccctctgctgaattacatcggcgcgggactatccgtggtgagcgcattcatttttctcttcatcaagtccgaaattccgaacaacacatgcagtatggacaccacgcctctgattactgagcatgtcatcaataccacacaggacccttgtagttgggtggataaactctctactgtccaccaccgcattgtaggttgctccctggccgtgattagcggcgtcctctacgggtccacattcgtgccaattatatatattaaggaccattccaagaggaacgatagtatatatgctggggcttcgcagtacgatctcgattatgtatttgcccattttagtggtatcttcctgacatctacagtgtattttctggcgtattgcattgccatgaagaactctccaaagctgtatccagaggccgttctgccaggtttcctttcaggcgtgttatgggccatcgctacatgttgttggttcatcgcaaatcatagcctatctgctgtcgtgagctttcctatcataaccgctggaccaggtttcattgcagccatgtggggcatctttatgttcaaggaaatcaaaggcctgcaaaattatctgctgatgatcctcgctttctgcattatattgaccggggcgctatgcaccgccttcagtaagatttag

SEQ ID NO: 47205 - DNA, 234 bp, Artificial Sequence
  Description of Artificial Sequence: Synthetic coding sequence
atgagcaacaacggcgccgacctgaccttcggctacatcagctgctttgtcgcaatcctgctttttggctcgaatttcgtccctctcaagaaattcgacacaggcgacggaatgtttttgcagtgggtgctgtgtgctgccatctggcttgttgcattggtggttaatctgattctccactgccctaagttctggcctttcgctatgcttggtggatgcatctgggctacttag

SEQ ID NO: 47206 - DNA, 333 bp, Artificial Sequence
  Description of Artificial Sequence: Synthetic coding sequence
atgagcaacaacggcgccgacctgaccttcggctacatcagctgctttgtggctatccttctgtttgggagtaacttcgttccgctgaagaaattcgacactggtgacggcatgttcctacaatgggtgctgtgcgccgctatctggctcgttgcgcttgtggttaacctcattctgcattgccccaaattctggccttttgcgatgctggggggctgtatctgggccacaggcaatatcgcagtagtgcctatcatcaaaacgattgggctggggttgggtatcttaatttgggggagcttcaacgctctgactggttgggcaagcagttag

SEQ ID NO: 47207 - DNA, 414 bp, Artificial Sequence
  Description of Artificial Sequence: Synthetic coding sequence
atgagcaacaacggcgccgacctgaccttcggctacatcagctgctttgtcgccatcctgctgttcggatccaacttcgttccacttaagaaattcgatacgggcgacgggatgttcctgcagtgggtgctctgcgctgccatttggctggtcgctctcgtggtaaaccttattcttcactgtcccaagttctggccgttcgcgatgctgggtgggtgtatttgggctactggtaacatcgccgtagtcccgattatcaagacgatcgggctcgggcttggaatcctgatctggggttcatttaatgccctgacagggtgggctagttctcgctttggatggtttggactcgacgccgaggaagtgagcaatcctctgctgaactatattggcgccggtcttagcgtggtgtag

SEQ ID NO: 47208 - DNA, 234 bp, Artificial Sequence
  Description of Artificial Sequence: Synthetic coding sequence
atgagcaacaacggcgccgacctgaccttcggctacatcagctgcttcgtggcaattctcctgttcgggagcaatttcgtgccactcaagaaatttgacacaggagatggcatgttcctgcagtgggtactctgtgctgcgatctggctcgttgctctggttgtaaatcttattctccattgtccaaaattttggcccttcgcgatgttggggggatgcatttgggcaacttag

SEQ ID NO: 47209 - DNA, 264 bp, Artificial Sequence
  Description of Artificial Sequence: Synthetic coding sequence
atgagcaacaacggcgccgacctgaccttcggctacatcagctgctttgtcgcaatcctgctgttcggaagcaacttcgtaccgctgaaaaagtttgacactggagatggcatgttccttcaatgggttttgtgtgcagctatctggctggtagccctggtggtgaaccttattctgcactgtccaaaattttggcccttcgctatgttgggaggatgcatctgggctacaggaaacattgctgtagtgcccattatcaaatag

SEQ ID NO: 47210 - DNA, 504 bp, Artificial Sequence
  Description of Artificial Sequence: Synthetic coding sequence
atgagcaacaacggcgccgacctgaccttcggctacatcagctgctttgttgccattcttctgttcggttcgaacttcgtgcctctcaagaagttcgacacaggcgatggaatgtttctccagtgggtcctttgcgcagccatttggctggtggcattggtggtgaatttaatcctgcattgccctaagttttggccattcgccatgttaggtggatgtatttgggccactggcaatatcgctgtcgtccctattatcaaaactatcggtctgggactggggatactgatttggggctctttcaatgccctcaccgggtgggcgtctagccgttttgggtggttcggactggatgctgaagaggtgagcaacccccttttaaattatataggagccggattgtctgtggtctcagctttcatcttcctgttcatcaaaagcgagattccgaataatacatgtagtatggatacaacaccgttgattactgagcacgtgatctag

SEQ ID NO: 47211 - DNA, 33 bp, Artificial Sequence; identical to SEQ ID NO: 23247
  Description of Artificial Sequence: Synthetic coding sequence

SEQ ID NO: 47212 - DNA, 264 bp, Artificial Sequence
  Description of Artificial Sequence: Synthetic coding sequence
atgagcaacaacggcgccgacctgaccttcggctacatcagctgcttcgtcgccatactgctctttggttctaactttgtcccgcttaagaaattcgataccggtgatggtatgttccttcagtgggtgttgtgcgcagcaatttggctggtggcactggtggttaatcttatcttgcactgcccaaagttctggccattcgctatgctcgggggttgtatatgggccaccggtaatatcgctgtggtgcctatcatcaagtag

SEQ ID NO: 47213 - DNA, 510 bp, Artificial Sequence
  Description of Artificial Sequence: Synthetic coding sequence
atgagcaacaacggcgccgacctgaccttcggctacatcagctgctttgttgccatcctactgtttggatctaactttgtgcccttgaagaaattcgatacgggcgacgggatgttcctgcagtgggtactctgcgcagcaatttggttggtcgctctggtcgtcaatctcatcttgcactgtcctaaattttggccattcgccatgttgggggggtgtatttgggcaactggaaacatagccgtggtgcccattatcaagactatcgggctggggctgggcattctcatctggggttcattcaatgcactgaccggctgggcctcctctaggtttggctggttcgggctagacgcagaggaagtatccaaccccctgcttaactacataggcgcaggcctatcagtggtcagtgcgttcattttcctctttatcaaaagcgagatccccaacaatacgtgcagcatggatacgaccccattgataacagaacatgttagtattgtgtag

SEQ ID NO: 47214 - DNA, 276 bp, Artificial Sequence
  Description of Artificial Sequence: Synthetic coding sequence
atgagcaacaacggcgccgacctgaccttcggctacatcagctgctttgtcgcaatcctgctgtttggttccaacttcgtcccactcaaaaagttcgacacaggagacggcatgtttctgcagtgggtcctttgcgcagcaatctggctcgtcgccctggtggttaatctcattctacactgtcccaaattctggccattcgccatgttaggaggatgcatatgggctacaggcaatatcgctgtggtgcctatcattaagacaatcgggctatag

SEQ ID NO: 47215 - DNA, 1482 bp, Artificial Sequence
  Description of Artificial Sequence: Synthetic coding sequence
atggagcccctgcgggcccccgccctgcggcggctgctgccccccttgcttttgctcctcttatctctcccacctcgtgcacgggcaaagtatgtccggggaaatctcagcagcaaagaagattgggtgtttctcacgcggttttgtttcctatccgattatggccgcctggactttagattcaggtacccggaagcgaaatgctgtcagaatatactgctgtattttgatgatccttctcaatggccagccgtctataaagctggggataaagattgcctcgccaaagagagtgttataaggcctgaaaacaaccaggtgatcaatctcacaacacagtacgcctggagtggttgccaggtagtctcagaggaagggaccagatatctttcatgcagttctggtcgcagctttaggagtggggacggacttcagctggagtacgagatggtgctgactaacgggaagtccttctggacacggcatttttcagctgacgaatttggtattctggaaacggatgtcacatttctgcttatctttatccttatatttttcctttcttgctactttggctatctgttaaaaggcagacaattactgcacaccacctacaagatgttcatggcggcagctggggtagaagttttatctctgctttttttttgtatctattggggccagtatgccaccgacggaatagggaatgagagtgtgaagatactggccaagctgctcttcagctcatctttcttaattttcctcctgatgctgattttgctgggaaaggggttcaccgtgaccaggggcagaatttcacacgccggttcagttaagttgtctgtttatatgacattatacaccctgactcatgtcgttcttttgatatatgaggccgaattcttcgatccaggccaggtgttgtacacatacgagagccctgctggttacggcctgattggcctgcaggttgccgcatacgtgtggttctgttacgccgtcttagtgtccctgcggcacttcccagaaaaacagcctttctacgtaccttttttcgccgcctacaccctttggttttttgctgtgcctgtcatggctctgatcgcaaattttgggatccccaaatgggcccgagagaagatcgtcaatggcatccagttgggcattcatttatatgcccatggagtgttcctgattatgacaaggccctccgcggctaataagaacttcccttaccatgtgagaacttctcagattgcttcggcaggtgtccccgggcctggcggcagtcagtctgctgacaaggctttcccgcagcacgtatacgggaacgttacatttatcagcgattcagtgcctaacttcaccgagctgtttagtattccacccccagccacctcccccctgccgagggccgctccagattccggactgccactgtttcgtgatcttcggccacccggccctctgcgagatttgtag

SEQ ID NO: 47216 - DNA, 1404 bp, Artificial Sequence
  Description of Artificial Sequence: Synthetic coding sequence
cggctgcggcactgcacccccacctgggccaccgagcccgacagcgtaaaaaaaaaacgcaatagaaaacgtagcggagctgtcgctcacaactgtaatctgaagcacttcgggcggcctaggtgggaggaccatttgtgtccaggcatctgggatcaaagaggtaacatcatcgagttccttacgggcgagtttatctatcgcatgtatacgatcgacatgcactcacaactggagctgaccgcctcattaatcccccagcccgggaccagcctgataccactagtcatggtatccaatccccattccctgggtttccaggcgactttctacgaaaatgggtatacgtcagacgggaacacaaagtacaaacttgacattttccttaagcagcagcagcactggggcagaaccgacagcaacttcacaagctcccttaagaaagccactatgtcaacccttactgtcgacatagccaataaggaaatcagctgcgttgacattaaaccgctgtcgaccctcatttcggtgggttgcgatctggataagaagattgtgattcaaaacaaggtcagcgcttgttccatgggcatactcgatcccctgaccctgcaggataattacagtttcattatcgagaaggagttttacgatccgggattccagggccagcagagctccgaggaccttcacgtcttctactcctaccagcagctgggctgtcccttactggtgtattacgacacactttggaagcctgtggtggaattatggaggaaggactcttttcaggaggtcattgatgcggagtatgtcctactggaggtgaacggccaattctcctactcatattcactgactgcacagagtgctatgtgtacatcgcaacctcagaattggaccaccatgattaaggagtttgggggaccatttttttggaatcgggaaaattatgtgagttgccacgatccaaacaacaacgcgccactgcgatggcccgatgtgcagtatcagattctggggggacgtaccgctaatcagataatctttggccataacggattctatgtcttctacatctccattgtcgatccgtattattcctactgtcagctagagacaatcttcagtatctacgtgtatggtgctttccccgtgcaactggtgtcagcaggtgtcgtaatcctgttgattatttccagcatcctgggatctgtctggctggcgtataagacccccaaattgctccggaccgcacgcggccgtcgcattaagaaatgcgctacacagctttgccgcaggtgcaagactgtgtgtcagtttcgggcctccgcaacagctcgtgcgggaacagaaccccccgggcgtcacagaacccctcacgggggaagatcggatcattag

SEQ ID NO: 47217 - DNA, 1080 bp, Artificial Sequence
  Description of Artificial Sequence: Synthetic coding sequence
atgttccggagccccggcaccctggagatcctgacccccctgcgggataccgccttcccggctttcgattttcagaaatgtctggtgaacatccaggctctactcatggaccccgaactgcacgtgggtaagtgtaagatagagttcctcacgggcgagtttatatacaggatgtacaccattgacatgcacagccaattggaattgacagctagtctgatccctcaacccggtacctctctgatccctctggtcatggtgtccaacccacacagtctaggctttcaggccactttttatgagaatggctacacctctgatggcaacacgaaatacaaactcgacatttttctaaagcagcagcagcattggggcagaaccgactcaaatttcacctctagtctgaagaaagccactatgtcaacgcttaccgttgatatcgcgaacaaggaaattagctgtgtcgacattaaaccactctctactctaatcagtgtcggttgcgacctcgataagaaaatcgtaatacagaacaaagtgagcgcctgttcaatgggtatactggacccgctgactctccaggataactacagcttcattattgaaaaggagttctacgaccccggcttccagggtcagcaatcgagtgaagacctccacgtattctactcataccagcagcttgggtgtccgctgctcgtctattacgatacgctctggaaaccagtcgtggaactactggagtctagtggcatgaatacagtgcactgttctttgaatctgcccggctcctccggaccacccgcctctgccagtcaagtggcgggaaccgctgtagcctaccataatgcgcgtctgatcttctttttttttttttttttcttcttcttgaggcagagcctggctctgtctcctcgactcgagtgcagcggagtaatcctggctcatcgaaagttatgcctcccggggtccaggcatagtcccgcctcagcgagtagggtggccggaatcacgggagccagacactgtgcacggctcatattctttatattctcaagagaccgcgtgtccccatgctag

SEQ ID NO: 47218 - DNA, 2397 bp, Artificial Sequence
  Description of Artificial Sequence: Synthetic coding sequence
atgctgatgctgatgctggtggccgccgtgaccatgtggctgcggccccttgtgaccgctcagttgtgccggagccgcaccgttcgcacagggaaagtgttcaacctgatccaggatgttcaaggagatcgactgtactttcatcccacgactacccgactgattaaacacccctgtgagaagaacattgctctttatctggggaagcaggtgtttttcactatggacaacttcgagacctctcttctgccattcacaattcctacttctatgcaagtgggagtgcccgaagtaactagcgcgcacttcgcgggcagtttgctgctgcttgtggtggatcagaaggtgtacatctacgattacgagaacaactcctggagtatgtctcttggtatcaagcaccccgtaacccacgtgtcaggggacaactgctgttatactggttcactgttttgcgtccacgtgtctaaccttgtgttcgcgtacttccggggagatcagatctcacagacctacatttactattctaacaccggtggtttctctttctggaaataccattacgacagacaagcagaaatcatcgggagccttgggggcatattccattttttctcactgtcacaggtcgcaatgctcgtcgtgaaccagggaaagggcatgtttaaatatagcgaccatcccttaaatcgctcttttggtttgtccttcgactacaacggaactctggacatacttatcgcacccggacagagaggtattttacttctctggttcgagaatagccttctgttctcccacaatgcgggacagcttgtggacacagtccgcgttaaaaagggtgaccagaccctgttctcctcaatctttgaggctaaaatcacaattcataacatagccgtgaccgaaaatgagctggccgtcataacaagagaggataacctgtattacggaaacctcggcattgtcccttcgtccataatcaaatttgccgatcagtacatttggagcgaggacgtcgcccttatgtttcgtagtccaggcacactcgagattctcacccccttgagggatacagctttcccagctttcgatttccagaagtgtctcgttaatatccaggccttacttatggatcctgagctgcacgttgggaaatgcaagattgagttcctgaccggcgaattcatataccggatgtacaccatcgacatgcactcccagctcgagctaaccgcatccctgatcccccagccaggcacctctctgatcccgctggttatggtttcaaacccacattctctgggtttccaggcaaccttttacgaaaacgggtacacaagcgacggtaatactaagtacaagcttgatatctttttgaagcaacagcagcactgggggcggacggactccaatttcacatcttctctcaagaaagcaacaatgagtaccctgacagtcgatatcgctaataaagagatctcatgtgtggatatcaaacctctgagcaccttgatctccgttgggtgcgacctagataagaagatcgtcatccaaaataaggtctcagcttgtagcatgggcatcttggaccctctcactctgcaagacaactactcttttatcatagaaaaggagttctacgacccgggcttccagggccagcagtcgagcgaagatctgcacgtgttctatagctaccaacaactggggtgtccattgttagtgtattatgacaccctgtggaaacccgtggtcgaactgtggcgaaaagatagctttcaggaggtgatcgacgccgagtatgtgttgttggaggtgaacgggcagttcagctactcctattctctgaccgcccagagcgcaatgtgtacttcccaaccccagaattggacaacaatgataaaggagtttggaggcccatttttttggaatcgagagaattacgtgtcctgccatgatccaaataataacgctcccttaaggtggcctgacgtgcagtatcagattttagggggacgcactgccaaccagatcatcttcggccacaacgggttctatgtattctacatttcaatcgtcgatccatactattcatattgtcagttggaaacaatttttagtatatatgtgtacggagccttccccgtgcaactggttagtgccggcgtggttattctgctgattatatcttcaattctggggtccgtgtggctcgcgtacaagacgcccaagttgttaagaaccgcaaggggtaggcgaattaagaagtgcgcaactcagctgtgtcggaggtgtaagaccgtctgccagtttcgcgcaagcgccaccgctagagccgggacagaacctccaggccggcataggactccccacgggggacgctccgaccattag

SEQ ID NO: 47219 - DNA, 777 bp, Artificial Sequence
  Description of Artificial Sequence: Synthetic coding sequence
atggccagcgccgccgccgccgaggccgagaagggcagccccgtggttgttgggctgctggtggttggtaacattatcattctactttccggtttaagtctatttgcggaaacgatttgggtcactgccgaccaatacagagtataccctttgatgggcgtgagtggcaaggatgacgtgttcgcaggcgcctggatagccattttttgcggcttctcattcttcatggtcgcaagctttggagtcggggcggccttgtgccggaggcggagtatggttctcacatatctggttttgatgctgatcgtatatattttcgagtgcgcttcttgtattacgagctacacacacagagactatatggtttccaacccctccctgataaccaagcagatgcttactttctatagcgcggataccgatcagggccaagagctcacaagactctgggacagagtcatgatcgagcaagaatgttgcggcacgagcggccctatggactgggtcaatttcaccagcgcttttagagctgcaacacccgaagtggtattcccgtggcccccattatgctgcagaaggacaggaaactttattccgctgaacgaggagggatgtaggttaggtcacatggactacctttttacaaaggggtgtttcgaacatatagggcacgccatcgactcctacacatggggcatttcttggttcgggtttgccattctcatgtggaccttacctgtcatgttaattgcaatgtacttctatacaatgctctag

SEQ ID NO: 47220 - DNA, 528 bp, Artificial Sequence
  Description of Artificial Sequence: Synthetic coding sequence
atgctgttcctggccaccttcttccccacctgggagggcggcatctatgacttcatcggggaatttatgaaggcctccgtggacgttgcggatttgatcgggctgaatctcgtcatgagcagaaacgcagggaagggcgagtataaaatcatggtcgctgctctggggtgggccaccgccgagctgatcatgagccggtgcatcccactatgggttggtgcgcgggggatcgagtttgactggaagtacattcagatgtcaattgattcaaatatcagcctggttcactacatcgttgcttcagcccaggtgtggatgatcacgcggtacgacctttaccacactttccggcctgctgtactgttgttgatgttcctgtctgtgtacaaggcctttgtgatggaaacattcgtgcacctgtgctcgttagggtcctgggccgcactgctggcacgtgccgttgtgactggcctcctcgctttaagtacgctcgctttgtatgtggccgtggtgaacgtccattcatag

SEQ ID NO: 47221 - DNA, 555 bp, Artificial Sequence
  Description of Artificial Sequence: Synthetic coding sequence
atgaccctgttccacttcggcaactgcttcgccctggcctacttcccctattttattacctacaaatgcagtgggctctccgaatacaacgccttctggaagtgtgtgcaggcaggggttacttacctctttgttcagctgtgcaaaatgctgttcctggccacgttcttcccaacatgggagggcgggatctacgacttcattggggaattcatgaaagcctctgtagatgttgctgatctcataggactgaatctcgtgatgagtagaaacgcgggaaagggggaatacaagatcatggtcgcggctctcggctgggcaaccgctgaacttattatgtctaggtgtataccactttgggtgggtgcacggggaatagagttcgattggaagtacatccaaatgtccattgatagtaatatttcacttgtacattatattgtggcatcagcccaggtgtggatgatcaccagatacgatctctaccatacattccgcccggccgtcttgctgctcatgtttctaagcgtttacaaggcattcgtgatggagtag

SEQ ID NO: 47222 - DNA, 96 bp, Artificial Sequence
  Description of Artificial Sequence: Synthetic coding sequence
atgcggcccggctggagccacctgcccctgtgccccaccctgcaggatgcagttctggggcattttctttctcacttgggtaggagacacctctag

SEQ ID NO: 47223 - DNA, 1098 bp, Artificial Sequence
  Description of Artificial Sequence: Synthetic coding sequence
atgagcctgatccggaagaagggcttctacaagcaggacgtgaacaaaaccgcatgggagctgcccaagacgtacgtgagtcccacacatgtgggaagtggtgcgtatggttccgtatgctctgcaatcgacaagcggagcggtgagaaggttgctatcaagaagttatctcgtccattccaaagtgaaatctttgccaaacgggcatacagagagttactgctgctgaaacatatgcagcacgagaacgtcatcgggctgttggatgtattcacaccagctagtagccttagaaacttttatgatttctacttggtgatgccctttatgcagactgatcttcagaagattatgggcatggagtttagtgaagagaagatccagtatctggtttaccagatgctcaagggactgaagtatatacattctgcaggagtggtacaccgtgatctgaagcccgggaacctggccgtgaacgaagattgcgagctgaagattcttgatttcggcctggcacggcatgctgatgctgagatgaccggctatgtggtgactaggtggtatcgggcacccgaggtgatcttatcttggatgcactacaaccaaaccgtggatatatggagcgtcggatgtatcatggcagaaatgctcaccggcaagacacttttcaaggggaaagattacctggatcagctaacacagatcctgaaggtcactggcgtgcccggaactgagttcgtccagaaacttaacgacaaggcggccaaatcatacatccagtcccttccccaaactcccaggaaggactttactcaactgtttccgcgggcaagcccccaggctgccgacctgttagaaaaaatgcttgagttggatgtggacaagagacttacagccgctcaggctttgactcaccccttttttgaaccttttcgcgatccggaggaggagacagaagctcagcagccattcgatgatagcctggaacacgaaaagttgacagtcgacgagtggaagcagcatatctacaaggaaattgtcaactttagccccattgcccggaaggattcgagaaggcggtcagggatgaaactatag

SEQ ID NO: 47224 - DNA, 243 bp, Artificial Sequence
  Description of Artificial Sequence: Synthetic coding sequence
atggagaagcccctgttccccctggtgcccctgcactggttcggctttggctatactgcactggtcgtgtcaggcgggattgtgggatatgtgaagaccgcggcaacgagcgtgacttttgtgggggtgatgggaatgcggtcttattactatgggaagtttatgcccgtcggcctgatcgcgggagcctcgctcctgatggcagctaaagtcggggttcggatgttgatgacctctgattag

SEQ ID NO: 47225 - DNA, 345 bp, Artificial Sequence
  Description of Artificial Sequence: Synthetic coding sequence
atggagaagcccctgttccccctggtgcccctgcactggttcggctttggatatacagccctggttgtgagcgggggcatcgtcgggtatgtgaaaaccggctccgtgccctcgctggcagcaggcctcctttttggctcgctcgctgggctcggcgcctaccagctgtaccaggacccccggaatgtgtggggcttccttgcagccacatcagttaccttcgttggggtaatgggaatgcgaagctattactacggcaaatttatgcccgtcggtcttatcgccggggcgtcgttactgatggctgccaaggtgggcgtaaggatgctgatgacttccgattag

SEQ ID NO: 47226 - DNA, 345 bp, Artificial Sequence
  Description of Artificial Sequence: Synthetic coding sequence
atggagaagcccctgttccccctggtgcccctgcactggttcggcttcgggtatacagcccttgtggtgtcaggcggtatcgtaggctacgtgaagaccggcagtgtgccgagtttggcagcaggcttattattcggttcactggctggcctgggcgcttatcaactatatcaggacccacgaaacgtgtgggggttccttgcagcaactagtgtcacctttgtcggcgttatgggaatgcggtcttattactatggtaaattcatgcccgtcggcctgatcgctggtgctagtctgctcatggctgccaaggtgggggtgaggatgcttatgacctcagattag

SEQ ID NO: 47227 - DNA, 408 bp, Artificial Sequence
  Description of Artificial Sequence: Synthetic coding sequence
atggagaagcccctgttccccctggtgcccctgcactggttcggcttcggctatactgctctggtcgtttctggcgggattgtaggatatgttaagacagggtccgtgccctctctcgcagccggtttactgtttggttctttagccggtctgggtgcatatcagctgtaccaggatccccgaaatgtatggggctttctggccgcgacttcagtgacctttgtgggggtaatgggcatgcggagctattattacggtaagttcatgcccgtcgggctcattgcgggcgcgagatacttccacagtatcaccctgctgtaccatgtagagttttcactgctgccacgcattctgtacgctttcaagactctcctggtgagcgagtacctcatgctctgtataaattag

SEQ ID NO: 47228 - DNA, 2151 bp, Artificial Sequence
  Description of Artificial Sequence: Synthetic coding sequence
atggaggacagcaccagccccaagcaggagaaggagaaccaggaggagttgggagaaacccggcggccttgggaagggaaaaccgctgcctcaccccagtattccgagcctgagagctctgaacccttagaagccaagcagggccccgagacgggaagacaatcacgctcaagccgaccctggagtccccagtctcgagcaaagacccccctgggcggccccgcagggccggaaacatccagccccgcacccgtttccccgcgcgagccttcgagcagtcccagtcctctcgcccccgcgcgccaggacctggcagcccctcctcagtcggaccgaaccacatcagtgattcccgaggcaggaaccccataccccgaccccctggagcagtcttcggacaagagagaaagtacaccccaccacacctcccagagcgaaggcaacactttccagcagtcgcaacagcctaagccgcacttatgcggacggagagacgtgtcttacaacaacgccaaacagaaggaactccgctttgacgtattccaggaggaagatagcaactccgattatgatctccagcagccagcgcccggcgggtccgaagttgccccttccatgcttgagattaccattcaaaatgctaaagcttatctcctgaagacaagcagtaacagtgggtttaacctctacgaccacctgagcaacatgctgaccaaaatacttaatgagcgcccagaaaacgccgtggatatttttgagaatatttctcaggatgttaagatggcccactttagtaaaaaatttgatgcattgcagaacgagaacgaactgctgcccacatatgagatcgcagagaaacagaaggcactgtttcttcaggggcacctggagggcgtagatcaagagttagaggatgagatcgctgaaaatgctctgccaaacgtgatggaatccgctttctactttgagcaggcaggtgttggcctggggaccgatgagacctacagaatctttctagcccttaaacagttgactgacactcaccccatccagagatgccgcttctggggtaagatactgggccttgagatgaactatatcgtagcagaagtggaatttcgcgagggcgaagacgaggaggaggtcgaggaagaagatgtcgcagaggaaagggacaacggggaatctgaggcacacgaagacgaggaggacgaactgcccaagagcttctacaaggctccccaggccatcccaaaagaagaatctcgaacgggtgccaacaaatacgtgtattttgtttgtaatgagccgggcaggccctgggtgaagctcccgcccgtgataccggcccaaattgttatcgccaggaagattaaaaaattcttcaccggcaggctggatgctccaataatctcatatcctccattccctggaaacgaaagcaactatctacgggcccaaatcgcccgtattagtgccggcactcacgtcagtccacttgggttctatcagtttggcgaagaggaaggcgaagaggaggaggaagccgagggcgggcgtaatagtttcgaagaaaaccccgattttgagggcatacaggttattgatctcgtggagtcgctgtcgaattgggttcatcacgtgcagcacatcttgtcacagggcaggtgtaattggtttaacagcatccaaaagaatgaagaagaggaagaggaggaagacgaggagaaggacgacagtgactacatcgagcaagaggtcggactgccattgttgaccccgattagcgaagacctggagattcaaaacataccaccatggaccacccgcttgagctccaatctgatcccacagtacgctattgcagtgttacagagtaacttgtggcctggcgcctatgcatttagcaatggaaagaagttcgagaatttttatattggctggggtcacaaatattcacctgacaattatacacccccagtgccccctcccgtgtatcaggagtatcctagcggtccagagattacagagatggatgaccctagcgtcgaggaggagcaagcgttccgagctgcccaggaagcggtattactcgctgcggaaaatgaggaatccgaagaagatgaggacgaggaagatgactatgattag

SEQ ID NO: 47229 - DNA, 315 bp, Artificial Sequence
  Description of Artificial Sequence: Synthetic coding sequence
atgcaggacaccggcagcgtggtgcccctgcactggttcggcttcgggtatgccgctctggtggccagcgggggcatcatcggttatgtgaaggccggctctgtcccttctctcgccgccggcctcctgtttgggtcattggccggactgggagcatatcaggtgtccgggtccaaggagaggctggggtttccatcctatatatggtatctgggttggcactacgggaatgaggtcttgcctctgtggaaaatccacgcatgcagattcaactgtcggtgtcagtttgccgacgggcggcaatcttggagctag

SEQ ID NO: 47230 - DNA, 339 bp, Artificial Sequence
  Description of Artificial Sequence: Synthetic coding sequence
atgcaggacaccggcagcgtggtgcccctgcactggttcggcttcggctacgccgctctggtggcctctggtggcatcatcgggtacgttaaggccgggtcagtgccatctttggccgctggcctcctgttcgggtcattggccggcctgggagcataccagctttcccaagatcctcgaaacgtgtgggtgtttctggccactagtggcactctggccgggatcatggggatgagattttaccactctggcaaattcatgcctgccggcctgatcgccggcgcctccttgctgatggtggccaaggtgggagttagcatgttcaatcgaccccattag

SEQ ID NO: 47231 - DNA, 378 bp, Artificial Sequence
  Description of Artificial Sequence: Synthetic coding sequence
atgcagatggaccccggcccccaggtgcccctgtactggctgggctttgtctacgcagcgctggccgcactgggcggtatcagtggctatgccaaggtggggtccgtccagtcgccaagcgctggctttttcttttctgagttggcaggcctggatgctagtcagccatccagaaatcccaaggagcacctttctagtcccgtctatatctgggatctggcaaggtactatgccaataagatactcactttgtggaacatctacgcctgcggattttcttgccgctgtctgctgatagtcagcaagctggggagcatgtacggcgaacaaatcctgtcagtcgtggcgatgtcacaattagggctgatgaaaaattag

SEQ ID NO: 47232 - DNA, 657 bp, Artificial Sequence
  Description of Artificial Sequence: Synthetic coding sequence
atgtacgccctgtggcggaccggccccaccaccagccccgccctgttgaccctgttatctaagggcgtgccccgccccgcagctccctggaccatgtcaccttcgagcgtggctctcatctgcctgctccgatacggccagctcctagagcaatcccgccatagctgggtgaacacaacagctctcataaccgggtgcactaacgccgctggcctgttagttgtcggcaacttccaggtggatcatgcgagaagcctgcactacgtcggcgccggtgtggcttttcccgcgggcctgctgttcgtatgcctacattgcgccctcagctaccaaggcgcaacagcccctctcgatcttgccgttgcgtacctaaggtcagtgctggccgttatcgccttcatcacactcgtgttgtctggggtcttttttgtacacgagagttcacagctgcaacatggagcagcactatgcgagtgggtctgcgtgatcgatattcttatcttctacggcactttcagttacgaattcggggccgtatcctccgatactctcgttgccgcgctacaacccactcctggtcgcgcctgtaaaagctccggctccagcagtacctccacgcacctgaattgcgcccctgagtctattgctatgatctag

SEQ ID NO: 47233 - DNA, 816 bp, Artificial Sequence
  Description of Artificial Sequence: Synthetic coding sequence
atgaccgcctggatcctgctgcccgtgagcctgagcgccttcagcatcaccggaatctggaccgtctatgcgatggctgtcatgaatcaccacgtgtgccccgtagaaaattggagctataatgagtcctgccctcccgaccctgccgaacaggggggtcctaaaacctgctgcacactggatgacgtgcccttgataagcaaatgcggcagttacccacctgagagctgcctgttctctctgatcggcaatatgggagcctttatggtcgcgcttatctgtctgctgcgatatggccagctgttggagcagtctcggcattcctgggtcaacaccactgcgctgattacggggtgtaccaacgccgccggcctgttggtggttggtaattttcaagtggaccacgctcgatccctgcactatgtgggagcaggtgtggcatttccggccggattgctgtttgtgtgtctgcattgtgctctcagttatcagggggcaacagcccccctcgacttagcagtggcctatctcaggagtgtcctcgccgtgatagcatttatcacactcgtgctgtctggcgtgtttttcgtgcacgagtccagtcagctgcaacacggagctgccctatgcgagtgggtgtgcgtcattgacatattaatcttctatgggacgttcagctacgagtttggggctgtcagctcagataccttggtggcagccttacaacccacccctgggcgtgcttgcaaatcctccggttcgtcttccacgtctacccacttgaattgtgcacctgaatccatagctatgatttag

SEQ ID NO: 47234 - DNA, 816 bp, Artificial Sequence
  Description of Artificial Sequence: Synthetic coding sequence
atgaccgcctggatcctgctgcccgtgagcctgagcgccttcagcattacaggaatctggactgtttacgcaatggccgtgatgaaccaccatgtttgtccagtcgaaaattggagctacaacgagtcctgcccccccgatcctgctgagcaagggggcccaaagacttgttgtacactcgatgatgtgcctcttatctcaaagtgtgggagctaccctcccgagtcctgcttgttttccctgatcggaaatatgggggctttcatggtagcactaatttgtctgcttagatatggacaactcttggaacaatccagacattcctgggtgaataccacagctctaatcacgggctgcaccaatgcggccggactgctcgtcgtgggtaattttcaggtggatcacgcacggtcattgcattatgtgggcgccggagtcgcgttccctgccggcctgctattcgtgtgtctgcattgcgccctgtcataccaaggagcgaccgcccctctggatctggctgtggcatacctgcgatccgtgcttgccgtcatagcttttatcactctcgtgttgtctggagtcttcttcgttcacgaatccagtcagcttcagcatggggcagccctctgcgagtgggtgtgcgtcattgatatcctgatattttacggcacattcagctatgagttcggggccgtcagttccgacactctagtggcagcactccagcccacacctggaagagcatgtaaaagctcaggctcttcttcaaccagcacgcatctgaactgtgccccagaatccattgcaatgatctag

SEQ ID NO: 47235 - DNA, 204 bp, Artificial Sequence
  Description of Artificial Sequence: Synthetic coding sequence
atgtacgccctgtggcggaccggccccaccaccagccccgccctgctgaccctgctgtctaagggtgtgccacgtcccgcggccccatggacgatgtcgcctagcagtgtcgctcttatttgccttttacgttacggccaactgctcgaacaatctcgccacagctgggtgaatacaacagctctgatcacggggtgcacgtag

SEQ ID NO: 47236 - DNA, 702 bp, Artificial Sequence
  Description of Artificial Sequence: Synthetic coding sequence
atgtggggctacctgagcctgatgcccgtgttcctggccgtgtgggcaatctcgggcgtgtggattgtgttcgctatcgcagtcacaaaccgcaccgtggacttatcaaaaggcttcccgtatattagcatatgtggctccttccctccacagtcttgcatattttctcaggtcttgaatatgggtgcagccttggcggcatggatttgcattgtcaggtaccatcagttacgcgattggggggtcagaaggtggccaaaccaactcatcttgtggactggcctgctgtgcgcattggggacctcagtcgtgggaaattttcaagagaagaaccagcgcccaacccacctagcaggtgcttttctcgcttttatcctgggaaatgtttatttctggctgcagctgctattatggcggctgaagcgtttgcctcagcctggtgccgcttggatcggcccactgcgcctggggctgtgcagcgtctgtactatcctgatcgtcgccatgattgtcctacatgcctgtagtcttcggagcgttagcgccgcctgcgagtgggtggtggctatgcttctctttgctctgttcggactcctggccgttgacttctctgctctggaatcttgtacactttgcgtgcaaccgtggccaagcctgtcccctcccccagccagtcctatttcactacccgtacagctttag

SEQ ID NO: 47237 - DNA, 702 bp, Artificial Sequence
  Description of Artificial Sequence: Synthetic coding sequence
atgtggggctacctgagcctgatgcccgtgttcctggccgtgtgggctatatcaggagtgtggatagtgttcgccatcgcagttacaaatcgcacagttgacctgtctaagggattcccgtatatctctatttgtgggagcttccccccccagagttgcatattttcgcaggtgctcaatatgggcgccgccctcgctgcgtggatttgcatcgtgcgttaccaccagctgcgcgattggggcgttcggcgctggcccaatcagctgatcctgtggacagggctcctctgtgccctgggtacaagcgtagtcgggaacttccaggagaagaatcaaagacctactcacctggccggcgccttcttggcgtttattctgggaaacgtctatttctggctccaactgcttctgtggcgtctgaagcggctcccacagccaggtgccgcctggattggtcctttgaggttagggctgtgcagcgtgtgtactatcctcattgtggccatgattgtcctccatgcatgtagtctgcgcagcgtctcggccgcctgcgagtgggtggtggctatgctgctcttcgcactgtttggtctgctcgcagtggacttttcagcattggaaagttgcacgctgtgtgtacagccctggccttccctcagtcctcctcctgccagtcctatcagtctcccagtgcaattatag

SEQ ID NO: 47238 - DNA, 750 bp, Artificial Sequence
  Description of Artificial Sequence: Synthetic coding sequence
atggacggcaagaagtgcagcgtgtggatgttcctgcccctggtgtttacgctctttacttccgcaggactgtggatagtctattttattgccgtcgaggacgataagatcctgcccttaaatagtgcagagcggaaacctggagtcaaacatgctccttatatatccatcgcgggggacgatccccctgcctcatgcgttttttcgcaagtcatgaacatggccgcatttctcgccctggtagtggccgtgttacgattcatccagctgaagccaaaagtcctgaacccctggctcaatatatcaggactcgtggccttgtgcctggcaagtttcggcatgacattactggggaactttcaactcacaaacgacgaggaaattcataatgtgggaacgagcctgaccttcggcttcggtacgctcacttgctggattcaggccgctctaaccctcaaagtcaacatcaagaatgaaggcagacgggtagggataccgagggtgattctctctgcttcaatcactctgtgcgtggtgctgtacttcattctgatggcacagagcatccatatgtatgctgctcgtgtgcagtggggcctggtaatgtgctttctctcatactttggcacctttgcagtcgagttccgacattatagatacgagattgtatgcagtgagtatcaggaaaactttttgtccttttcagagagcttgtctgaagccagcgagtatcaaacagatcaggtatag

SEQ ID NO: 47239 - DNA, 204 bp, Artificial Sequence
  Description of Artificial Sequence: Synthetic coding sequence
atggacggcaagaagtgcagcgtgtggatgttcctgcccctggtgttcacactgtttaccagcgccgggctctggatagtgtattttattgcagtggaggacgataagatcctgccgcttaatagtgcggagaggaagcccggcgtcaagcatgccccgtacatctcaatcgccggcgacgatcctcccgcctcgtgcgtttag

SEQ ID NO: 47240 - DNA, 750 bp, Artificial Sequence
  Description of Artificial Sequence: Synthetic coding sequence
atggacggcaagaagtgcagcgtgtggatgttcctgcccctggtgtttactctgttcacatccgccgggttgtggatcgtgtacttcatagcagttgaagatgataagatcttgcccctcaactcagccgagaggaagccaggcgtgaagcacgccccctacatcagcatagccggtgatgacccaccagcatcctgtgtcttctcccaggtaatgaacatggccgcctttctcgcgctggtggttgcagtgctccgattcatccaattgaagccaaaggtgctcaacccttggcttaatatcagcggtttggtcgctttatgtctggcgagctttggcatgaccctattgggcaatttccagttgacgaatgacgaagaaattcataacgttggaacctcactgacattcgggtttggtactctcacctgctggattcaagcggccctgaccctcaaagtaaacatcaaaaatgaagggagacgtgtgggcattcctcgtgtgattctcagtgcgtccataactctatgtgtggtgctttattttatactcatggctcagtccattcacatgtatgcggctagagtgcaatggggcttggtcatgtgctttttgtcttactttggaacctttgcagtggagtttaggcattataggtatgaaatcgtctgcagtgagtatcaggagaacttcctatccttctcagagtcactgagtgaagcctctgagtatcagacggaccaggtgtag

SEQ ID NO: 47241 - DNA, 1407 bp, Artificial Sequence
  Description of Artificial Sequence: Synthetic coding sequence
atgcccgaggacggcgccggcgacggcggcgaggtgcccgccctgataccagacggcgagccgcttcgcgaagagcaacgcccactgaagcaatctctcggctcttctctatgtcgtgaaagccattggaaatgcttactgcttacgctgctgattcacgcgtgtggggcggtagtagcctggtgtagactcgccaccgtgccacgcttggtgctgggtcccgaggcggccttggctcgaggagctggcgggccaccccccacctatcccgcgtccccttgctctgacggatacctttatatacctctggcctttgtaagtctgctgtacctcctgtacctggctgaatgctggcattgccatgtgcgaagctgtcaggcccccagaaccgatgcacacacggtgctggctttgatccgtaggctgcaacaagcacctccttgtgtctggtggaaggccacctcatatcattatgttaggagaacacgtcagattacgcgttatcggaacggtgacgcttatacaactacacaagtgtatcatgaaagagcagactccagaaccgcccgaggcgaatttgactattctgctcatggcgtgcgcgatgtcagcaaagagctcgtggggctggccgaacacgccgctaccaggctacgtttcaccaagtgtttctcgttcggtagcgccgaggcggaagccagttacctaacacagagagcgaggttcttttctgcaaacgagggcctggatgactacctagaggccagagaggggatgcacctgaaagatgttgactttagggagagcctcatggtcttcgccgacccccgctcgccaccttggtatgctcgcgcctgggtattttggctcgtctccgctgctacactctcttggccgctgagggtggtggccgcctatggtaccgcccatgtgcactatcaggtggagaaactcttcggcgcctcctcacccccgccaggggccgtgcctagtggacccccgttatcacgagtggcgacagttgacttcaccgaattggaatggcatatctgcagtaacaggcagctcgtcccttcatactccgaagccgtggtgatgggcgcgggctctggagcatacctgcggggttgtcagagatgtagaaggtcagtgtcttccaattctctgcccccggcgcgaccctcggggcctcgattaccatttagccgatcgcgcctcagcctcggtgccggcggtcgggcgacccccggcgtctttaggagcctgtcaggggggcccctgggcaggcgcggcgaagataccgagcctttggaatcgcctccatgctacgaggatgccctttactttcccgtgctgatagtgcatggagatagcggctgccaaggggatggccagggagctctatag

SEQ ID NO: 47242 - DNA, 669 bp, Artificial Sequence
  Description of Artificial Sequence: Synthetic coding sequence
atgagcccccccggcagcgccgccggcgagagcgccgccggcggcggtgggggcggggggggccctggggttagtgaggaactgactgcagcggcagctgctgcggccgcagatgaagggccagcccgcgaggagcaacgtcctattcagccaagtttcacaaagtcactgtgcagggagtcccactggaagtgcttgctgctctcattgctgatgtatgggtgtctgggagcagtggcctggtgccatgttacgaccgtcactagactgacattcagctccgcctatcagggtaattcactaatgtaccacgatagtccctgctcgaatggctacgtttatatccccctggcttttctcctaatgctgtacgcagtttacctggtggagtgttggcactgtcaggcacggcatgagctccaacatagagtagatgtgtcttcggtgagggagcgggtagggagaatgcagcaggcaacaccttgcatttggtggaaagctataagctaccactacgtgcgcaggaccaggcaagtcacccgttatcggaatggagatgcctacaccacaacacaggtccctggctgtctggggtcacaggttgtccccctccggagcccctggcgaaacgcccaattagacgctggctctgacgaggaaccagcatag

SEQ ID NO: 47243 - DNA, 1701 bp, Artificial Sequence
  Description of Artificial Sequence: Synthetic coding sequence
atgagcccccccggcagcgccgccggcgagagcgccgccggcggcggtggtggagggggaggacctggtgttagcgaagagctgactgccgctgcggccgcagccgctgctgacgagggaccagcacgcgaggaacaacgcccgatacagccgtcatttacaaaaagtttatgtcgggaaagccactggaagtgtctgctcttgtccctgctaatgtacggctgcctgggagctgtcgcttggtgtcacgtgacaaccgttactcggttgacgttcagctctgcctatcagggaaattcccttatgtaccacgatagcccctgttccaacggctatgtgtacattccgttggccttcctgctgatgctgtacgccgtgtacttggtggagtgctggcactgtcaggcacggcatgaactgcagcacagagttgacgtgagctctgtgcgggagagggtcggaaggatgcagcaggcaactccatgcatatggtggaaagctatctcataccattatgtacggcggacccgacaggtgacgaggtaccgcaacggagatgcatacacaaccactcaggtgtaccacgagcgcgtgaacacccatgttgccgaggctgaatttgactatgctcgctgcggggtgagggatgtgtccaaaacactggtaggactggaaggcgcgcccgccacacgactgcgtttcactaagtgctttagttttgcttccgttgaagccgagaacgcctacctctgccaaagagcgcggttcttcgcagagaacgaggggctagatgattatatggaagcccgagagggcatgcacctgaaaaatgtcgacttccgagagtttatggtcgcatttcccgatccagccagaccaccctggtatgcctgctccagcgccttttgggcagctgcactgctgaccctgtcctggcctctgagggttctcgcagaatataggacggcctatgctcactatcacgtggagaagctctttggactggaaggcccaggctccgcctcttctgcaggaggcggtttgagccccagcgacgagctactgcctccattaacccatagactgccacgtgtgaatacagtggacagcacagagctggagtggcacatcagatcaaatcagcagctcgtgcccagctattctgaagcggtgctaatggatctcgctgggctaggcaccaggtgtgggggggccggtggcggctatgcaccctcctgccggtacggcggcgtcggcggtcccggcgccgctggggtggcaccctaccgtcgtagttgtgaacactgccagagggctgtaagcagctctagcatctttagtaggagtgcactgtctatttgtgcttctcccagggctggtcctgggcccggggggggggctgggtgcggaggatctaggttcagcctggggcgattgtatggaagcaggcgctcttgcctgtggagatcccggtcggggtctgtgaacgaggcatcatgcccaacggaacagaccaggctgtctagccaagctagcatgggcgatgatgaggatgacgatgaagaagaggcaggccctccgcccccctatcatgatgcactctactttcccgtccttatcgtgcacaggcaagaaggatgccttgggcacagccatcgtcccctgcatcgtcacgggtcctgtgttgaaacgtcactgtag

SEQ ID NO: 47244 - DNA, 552 bp, Artificial Sequence
  Description of Artificial Sequence: Synthetic coding sequence
atgcaggccccccgggccgccctggtgttcgccctggtgatcgccctggttcctgtggggagagggaactatgaagaattggagaactccggtgataccaccgtcgagtcagaaaggcctaacaaagtaactattccttccacgtttgccgcagtgaccatcaaagagacacttaatgctaatatcaactccacgaattttgcccctgacgagaatcagctggagttcatccttatggtgctgatccctcttatcctcctggtgctcctgttgctttctgtggtgtttcttgctacctactataaacgcaaacgaaccaagcaagaaccatctagccaaggctcccagagtgcattacagacatacgagctgggctccgagaatgtgaaggttccaatcttcgaggaggatacacccagcgttatggagatagagatggaggaattggataaatggatgaactctatgaatcgtaacgcagacttcgaatgcttgcctactctcaaggaagagaaggaatccaaccacaaccctagtgacagcgagtcttag

SEQ ID NO: 47245 - DNA, 378 bp, Artificial Sequence
  Description of Artificial Sequence: Synthetic coding sequence
atgcaggccccccgggccgccctggtgttcgccctggtgatcgccctggttcctgttggccgcggcaattacgaggaactagagaactccggagatacaaccgtcgaaagcgagagacctaataaagtaaccatcccaagcacattcgcagcggtgaccattaaagagactttaaacgcaaacatcaattcgacgaactttgccccagatgagaaccagctggagtttatcctgatggtcctcatccccctcattctgcttgttctgcttctgctgagcgtggtgttcttagccacctattacaagcgcaagagaacaaagcaggaaccaagctctcagggcagccaaagtgccctgcagacctatttactggtgtag

SEQ ID NO: 47246 - DNA, 891 bp, Artificial Sequence
  Description of Artificial Sequence: Synthetic coding sequence
atgaccaagaccgccctgctgaagctgttcgtggccatcgtgatcacatttatcctgatcctgcctgagtactttaagacccctaaggaacggactctggagctttcctgtctcgaggtgtgtctgcaatctaactttacgtattcgctgtcttccttgaacttttctttcgtcactttcctccagcctgtaagagaaactcaaataattatgagaatcttcctgaatcctagcaacttcagaaatttcacaaggacgtgtcaagacatcaccggggagtttaagatgtgtagttcctgcctggtctgcgaaagtaaagggaacatggattttatctctcaggagcagaccagcaaggtactgatccgccgaggaagcatggaagtgaaagctaatgacttccactctccttgtcagcattttaatttttcagtcgctccactggtggaccacttggaagagtataacaccacctgccacctgaaaaaccacaccgggcggagcacaatcatggaagacgagccttcaaaggaaaaatctataaattatacatgtcgaataatggagtaccctaatgactgtatccacattagtctacacttggaaatggatatcaagaacattacctgttccatgaagattacctggtacatcctggtgctgttggtttttatttttttgatcatccttacaattcgcaagatccttgaggggcagcggagggttcagaaatggcagagccaccgagataagccgacgtccgttctgttaaggggctctgacagtgaaaagctgcgtgctcttaacgtacaggtgttgtctgccgaaaccactcagcggctgcccttggatcaggtccaggaagtgctgcctccgatccccgaattgtag

SEQ ID NO: 47247 - DNA, 567 bp, Artificial Sequence
  Description of Artificial Sequence: Synthetic coding sequence
atgggcggcggctggtggtgggcccgggccgcccggctggcccggctgagattcaggagatcactgctgccaccacagagaccgagatcaggaggagcccgaggttcatttgccccaggccacggtcccagggcgggtgctagcccgcctccagtctccgagttggacagggcagatgcatggctgttgagaaaagcgcacgaaaccgccttcctttcatggtttagaaatggactgttagccagcgggatcggagtgatttctttcatgcagtcagatatgggcagagaggctgcttatggcttttttctgctaggtgggctttgtgtggtgtggggcagcgcctcatacgctgtcgggcttgcggccctgcggggcccgatgcagctgaccctcggaggtgctgccgtgggagcaggagccgtactagctgcctcactgctgtgggcgtgtgcagtgggcctgtatatggggcagctagagctggatgtggagctggtgcccgaggacgacgggactgcttccgctgagggcccagatgaggctggcagacctcccccggagtag

SEQ ID NO: 47248 - DNA, 1440 bp, Artificial Sequence
  Description of Artificial Sequence: Synthetic coding sequence
atggccgtgctgggcgtgcagctggtggtgaccctgctgaccgccacactgatgcatcgactcgctcctcactgcagtttcgcccgttggctgctgtgcaacggctcgcttttcagatataagcacccttcagaggaggaacttcgagctctcgctggaaagccgaggcccaggggcaggaaagaacggtgggccaacggcttgagtgaggaaaaaccattgagtgttccaagagacgccccttttcagttggagacgtgccccctgactacagtagatgccttggttctccggttttttctggagtaccagtggttcgtggactttgccgtgtactcaggcggagtgtatctgttcacggaagcctattattatatgctcggcccggctaaggagacaaacatagctgtgttctggtgcctgcttacagtcactttctcaatcaagatgtttttaacagtcactcgtctgtactttagcgcagaagaagggggggaacgaagtgtgtgcctgacattcgcctttctctttctgttgctggcgatgttagtacaggtggtgagagaagagaccttggagcttggactcgagcctgggttagcaagcatgacccagaacttggagcctctgcttaagaagcaaggctgggattgggctttacctgtcgcaaaactggccattagagtaggactggccgtagtaggttcggtgctcggagctttcctgactttccccggccttagactcgcacagacacatcgggacgccctgacaatgagtgaggaccgacctatgctgcagttcttgctacatacctccttcctgagccctctgttcattctctggttgtggaccaagcccattgcaagggatttcctgcaccaacctcctttcggcgaaacacgattctctcttctcagcgactccgcttttgattcagggagactttggcttctggtggtgctttgtctcctgaggctggcagttacacggccacatctgcaggcctatctttgtctcgcaaaagcccgtgttgaacaattgcgcagggaagccgggcggattgaagcccgagagatacagcaaagggtggtgcgcgtctactgctatgttacagtagtgagtctacagtatctcacccccctgatccttacgctgaactgtaccctcctgctaaaaacactgggaggctatagttggggcttaggaccggccccactgctgagccctgacccctcatcagcctcagccgccccaatcggctctggagaagatgaggttcaacaaactgctgctcgcatagcaggagctttgggcggacttctgacccccctgttcttgaggggggtgctggcctacttgatctggtggaccgccgcgtgccaactcctggcatctctgtttggactgtacttccatcagcacctggccggcagttag

SEQ ID NO: 47249 - DNA, 1131 bp, Artificial Sequence
  Description of Artificial Sequence: Synthetic coding sequence
atggccgtgctgggcgtgcagctggtggtgaccctgctgaccgccactctcatgcacagattagctccacactgctctttcgcaagatggctgctgtgtaacgggagcttgtttcgctacaagcatccatccgaggaagagctaagggctctcgctgggaagccccggcccaggggtaggaaagagcgctgggccaatggtctcagcgaggaaaaacccttaagcgtgcctcgagacgcccccttccagctggagacctgccccctcaccaccgtcgatgctctgggcctcgcctcgatgacacagaatttggagccacttctcaagaaacaaggatgggactgggccctccccgtggccaagttggcgataagagtggggttagctgttgtaggtagcgtcctcggggccttcctgaccttccctggcttacggcttgcacagacccatcgtgacgccttgacaatgagcgaggacaggcccatgctgcagttcctgcttcacacatcattcctcagtcctttgtttatcctctggctctggacaaaaccaatcgccagagactttctccatcagcccccattcggtgaaaccagattttccctgctcagtgattctgcatttgactccggccgattgtggctcctggtggtgttgtgtctgcttaggctggcagttacccgaccacacctacaagcgtatctgtgcctggccaaagcccgtgtagagcagttgagacgggaagccgggaggatagaggcaagggaaatacagcaacgcgtggtgagggtgtactgttacgtgactgtcgtttcccttcagtatctgacacccttgatactgactctaaattgcaccctgctgctgaaaactctcggggggtacagttggggcctcggccctgctcctctgctcagccccgatccatcatctgcatcagcagcccccatcgggtcaggcgaagacgaggtgcagcagacggccgcccgcattgcaggagccctcgggggtctgttgactcccctttttctcaggggggtcctggcgtacctgatatggtggactgctgcctgtcagctgctggcttcccttttcggcctgtatttccaccagcatctcgcaggttcttag

SEQ ID NO: 47250 - DNA, 1464 bp, Artificial Sequence
  Description of Artificial Sequence: Synthetic coding sequence
atgggcgtgatcggcatccagctggtggtgaccatggtgatggcctctgtcatgcagaagatcataccccattatagtctggctaggtggcttctgtgtaatgggtctcttcgatggtatcagcaccccaccgaggaagaacttcgcattcttgccggaaagcaacagaagggaaagactaagaaggaccggaagtacaacggacatatagagagtaagcccttgaccattcccaaagacattgacctacatctggagaccaagtctgtgactgaggtggacacactggccctgcattacttccccgaataccagtggttggtggacttcactgttgcagccactgtggtctatttggtgacagaagtatactacaatttcatgaagccaacacaagaaatgaacatctccctggtctggtgcctgcttgtgctatccttcgccatcaaagttttattttctttaactacacattatttcaaggtggaggatgggggcgagcgctccgtctgcgtaacattcggattcttctttttcgtcaaagcaatggcggtgctgattgtcaccgaaaactacttggagtttggactggagaccggtttcactaatttttctgattccgccatgcagtttctagaaaagcagggtcttgaatctcaaagcccagtgtccaaactcaccttcaagtttttccttgcgattttttgttccttcattggggcttttcttactttcccaggactcaggctggcacaaatgcatctcgatgctctaaatctagccaccgaaaagattacccaaacactgctgcacatcaactttctagcacctctgtttatggtccttctgtgggtgaaaccaataactaaggattacatcatgaatccaccgcttggtaaggagtcaataccactaatgaccgaggccaccttcgataccttaagactctggctgataatacttctgtgcgcactgagactcgccatgatgcgatcccatttgcaggcctatctgaatctggcccagaaatgcgtggatcagatgaagaaggaggccggaaggatcagcacggttgagctgcaaaagatggtggcacgtgtgttttattatctgtgtgtgatcgccctccaatacgtggcacctctggtaatgctgctgcatactactctcctactcaagaccctgggaaaccattcctggggcatttaccctgagtctatctccactctgcccgtggataactctctattgagcaatagtgtctattccgaactccctagtgccgagggaaagatgaaggttacggtgacgcagattactgtggcactttcaagtctgaaaaacatttttactcctctgctgttcagaggactcttgagcttcttgacctggtggattgctgcctgcctgttttcgacatccctctttggactgttttaccaccagtatctaactgtcgcatag

SEQ ID NO: 47251 - DNA, 924 bp, Artificial Sequence
  Description of Artificial Sequence: Synthetic coding sequence
atgggcgtgatcggcatccagctggtggtgaccatggtgatggcctctgtgatgcagaaaatcatccctcattacagcctagctagatggttactgtgcaatggcagccttcgatggtaccaacatcctaccgaagaggagctgcgcatcttggctggcaaacagcagaaagggaagactaagaaggacaggaagtataatggtcatatagaaagcaagccgctgacgattcctaaggacatcgacctccatttggagacaaagagcgtaaccgaagtggataccctggctcttcactattttccggagtatcagtggctggtcgattttacagtggcagccaccgtggtttacctggtcaccgaggtatattacaacttcatgaaaccaacccaggaaatgaatatttcactggtttggtgccttctcgtcctgtcatttgctataaaagtcctcttctctcttacaacgcactacttcaaggtggaagatggtggggaaaggtcagtgtgcgttactttcggattttttttcttcgtgaaagccatggcagtcctaatcgttactgagaactacttagagttcgggctcgaaactggattcaccaacttcagcgattccgcaatgcagtttctggaaaagcaggggctggaatctcagagccccgtgtccaagttgacctttaaattctttctggcaatcttttgttcgtttatcggcgctttcctgacattccctggcctccgactggcacagatgcatcttgatgccttgaacctggccaccgagaagatcacccagactcttctgcatattaatttcttggcgcccttatttatggtgctgctgtgggttaaaccaattacaaaggactatattatgaacccaccgctaggcaaagaaattagcccttccggcaggtag

SEQ ID NO: 47252 - DNA, 870 bp, Artificial Sequence
  Description of Artificial Sequence: Synthetic coding sequence
atggagcccgccgccggcatccagcggcggagcagccagggccccaccgtaccacccccacctagaggacatgctccgcccgcagcagcaccgggcccagccccgttgtcgtcacctgtgcgtgagcccccgcagctcgaggaggagcgtcaagttcgaatctctgagtctgggcaattcagtgatggattggaagaccggggtcttttggaaagtagtaccagactgaagccccacgaggcacagaactaccggaagaaggcactctgggtatcttggttctcaatcatcgttacactcgctctggccgtcgctgcatttactgtctctgtgatgcgctactctgcctctgcgttcggcttcgccttcgacgcgattcttgatgtgctctccagcgccatcgtgctatggagatactctaatgctgcggctgtccattcagcccaccgcgagtacatcgcctgtgtcatcctgggcgtgatatttcttctatcgagcatctgtattgtcgtgaaggccattcacgatctgtcaactaggctccttccggaggtggacgacttcctgtttagcgtatccatcctgagcgggatcctctgcagtatcttagcagtcctcaaattcatgttgggaaaggttttaacctctagggcacttatcaccgatggcttcaatagcctcgtaggcggggtgatggggttttctattctactcagtgccgaggtgtttaagcacgactcagccgtgtggtatctggatggaagcattggagtcttgatcggcttgaccatctttgcctatggagtcaaactgcttattgatatggttcccagggttaggcagacgaggcactacgaaatgttcgagtag

SEQ ID NO: 47253 - DNA, 279 bp, Artificial Sequence
  Description of Artificial Sequence: Synthetic coding sequence
tgcggcatgagccggagcggcctgctggagagcagcacccggctgaaacctcacgaggctcagaattatcggaagaaagctttgtgggtgagttggttcagcatcattgtcactctggcccttgcagtcgccgcttttacagtgagtgtgatgagatactccgcgtccgccttcgggttcgcgtttgacgccattctcgacgtgctgtccagcgctatcgttctatggcgatactcaaatgccgccgccgtgcacagcgcccaccgggaatacatgtag

SEQ ID NO: 47254 - DNA, 777 bp, Artificial Sequence
  Description of Artificial Sequence: Synthetic coding sequence
atgagccggtacagctaccagagcctgctggactggctgtacggcggcgtcgatcctagcttcgccggcaacgggggcccagactgcgccgcttttctttcttggcagcagaggctgctagagtcagtcgtcgtgctcaccctggcgctcctcgaaattctggtggctttgcgacacatactgaggcagacaaaagaagatggaaggggatcgcccggctctcagcctgaacaggtcacccaacggcccgaagaggggaaggagtccctcagtaagaacctgttattggtggccttgtgcctgacctttggtgtagaagtaggtttcaaattcgcaactaaaaccgttatttatctgctcaacccatgtcacctcgtgaccatgatgcacctccctttcgagctagagatttattatattcagcacgtgatgttgtacgtggtcccaatctacctcctttggaagggtggggcttatacccccgagcccctctcatcttttcgttgggcgctgctttctactggtctgatgtttttttatcatttcagcgttcttcaaatcctgggccttgtcacagaggtgaacttaaacaacatgctatgccctgcaatcagtgatcctttctatggcccatggtatagaatttgggcttctggccaccaaaccttgatgaccatgacgcatggcaagctagttattctgttctcatacatggccggccccctttgcaagtatctcttggacctcctcaggctgcccgccaaaaaaatcgattag

SEQ ID NO: 47255 - DNA, 894 bp, Artificial Sequence
  Description of Artificial Sequence: Synthetic coding sequence
atgagccggtacagctaccagagcctgctggactggctgtacggcggggtagaccccagcttcgcaggtaatgggggacccgattgcgctgcatttctttcatggcaacagaggctgttggagagtgtggttgtactgacactcgcattacttgagattctggtcgccctccgccacatcctgagacaaaccaaagaagatggccgcggctctccaggatcacagcctgagcaggtcactcagcggcctgaggaggggaaggaaagtctttccaaaaatttattgttggtggcactgtgtctaacattcggggtagaggtcggtttcaagtttgctaccaagactgtgatctacctgctgaatccatgtcatctcgtgacaatgatgcatatatttctgctagcatgtcccccttgtcgaggcgcgattgtggtattcaaactgcagatgcatatgctcaatggtgcccttctggctctcctctttcccgtggttaacaccagactactaccattcgagctggagatttattacatccagcatgtgatgctctatgtggtcccaatatatttattgtggaagggcggcgcttacacacctgagcccctcagctccttcagatgggccctcctaagcactgggcttatgttcttttaccatttctccgtgctgcaaatcctaggcctggtgacagaggtcaacctcaataatatgctctgtccagctatctccgaccctttctacgggccatggtataggatttgggcatcaggccatcagaccctgatgacaatgactcacggcaagctggtcatcctgttttcttatatggccgggcctctctgtaagtacttgctggaccttttgcggctgccagccaaaaaaatcgattag

SEQ ID NO: 47256 - DNA, 447 bp, Artificial Sequence
  Description of Artificial Sequence: Synthetic coding sequence
atgcacatgctgaacggcgccctgctggccctgctgttccccgtggttaacacgcgactgctgccttttgaactggaaatttattacatccagcacgtgatgctatacgtggtgccaatctacctcctctggaaaggaggcgcatacaccccagagcctctgtcttctttcaggtgggcacttttgtccacagggttgatgttcttttatcatttttcggtgctgcagatactggggctggtcacagaagtcaatttgaataatatgctgtgtcccgcaatctccgaccccttttatggtccctggtacaggatctgggcgtcaggccatcagacacttatgaccatgacacacggcaagttagtgattcttttcagttatatggctgggcctctctgtaagtatctgctggatctgctgcgtcttccagccaaaaagattgactag

SEQ ID NO: 47257 - DNA, 894 bp, Artificial Sequence
  Description of Artificial Sequence: Synthetic coding sequence
atgagccggtacagctaccagagcctgctggactggctgtacggcggagttgatcctagcttcgccggcaacggcgggccagactgcgccgcttttctctcctggcaacaaagattactcgagtccgtggtagttttgactctggcgctactcgagatcctagtagccctgaggcacatcctgagacagacaaaagaagacggaaggggctctcctggatctcagcctgagcaggtgacacaacgacccgaggaaggcaaagagtcactcagcaaaaacctgttgttagttgctttgtgcctgaccttcggcgtggaggtaggttttaagttcgcgaccaagactgtgatctatctcttgaatccctgccacctggtcaccatgatgcacatctttctgctggcctgtcctccctgcagaggggccatagttgtttttaagcttcaaatgcacatgctcaacggcgccctactggcactgttgttccccgtcgtgaacactcggcttctgccttttgaactggagatctactacatacaacacgtgatgctgtacgtcgttccaatttatttgctctggaagggaggagcctacacacccgaacctctgagcagtttccggtgggccctgctctcgacaggcttgatgtttttttaccatttcagcgtgctccagatacttggcctggttacagaagtaaatctgaataatatgttgtgccctgccattagcgacccattttatgggccctggtatcgtatctgggcttcagggcatcagacccttatgacaatgacccacggcaagcttgtgattttgttcagctacatggccggtcccctctgtaagtacttgcttgatctattgaggctgcccgccaaaaagattgattag

SEQ ID NO: 47258 - DNA, 777 bp, Artificial Sequence
  Description of Artificial Sequence: Synthetic coding sequence
atgagccggtacagctaccagagcctgctggactggctgtacggcggagtagacccatctttcgctggaaacggagggcctgactgtgctgctttcctgtcctggcagcagagacttctggagtctgtcgttgtgctcacgctggcccttctggaaatcctcgtcgccttaagacacattttgcggcagactaaagaggacggccgagggtcgcccggaagtcagccggagcaggtgacccagcgcccagaagaaggaaaggagtccttgagtaagaacctgcttctcgtggctctgtgcctcacctttggcgtagaggtcggattcaaatttgctacaaagacagtgatttatcttcttaacccgtgtcacctcgtgaccatgatgcacttgccctttgagctcgagatttactacatccagcacgtgatgctttatgttgtaccaatatacctgttatggaagggaggtgcctacactcccgagcctctgtcgtctttcaggtgggccctgctttctacggggcttatgtttttttatcacttctctgtcttacagattttgggactggttacggaggtgaatctgaacaatatgttgtgccccgccataagcgaccccttctatggaccatggtatcgcatttgggccagcggccatcagacactcatgaccatgacccatggaaaactggttatcctcttttcctatatggctggcccgctgtgtaagtacctgcttgacctgttgcggttgcccgcaaagaagattgattag

SEQ ID NO: 47259 - DNA, 975 bp, Artificial Sequence
  Description of Artificial Sequence: Synthetic coding sequence
atggccgccgccgcccccggcaacggccgggccagcgccccccggctgctcctgctgttcctggtacccttgttatgggcccccgctgctgtccgtgcgggccccgacgaagacctgagtcaccgaaataaggaaccccccgctccagctcagcagctacagcctcaaccagttgctgttcaggggccggaacctgcccgtgttgagaagatctttaccccagcagctcccgtccacacaaacaaagaggatcccgcgacccagacaaatctggggttcatccacgccttcgtggctgccatcagtgtgataattgttagcgagttgggtgacaaaactttctttatagcagccatcatggctatgcggtacaaccggttgaccgtgcttgcaggcgccatgctggccctgggtcttatgacctgcctgtccgtgctgttcggctacgcaaccactgtgataccccgcgtgtatacttactatgtgtccaccgttttgtttgctatctttggaatccgcatgctcagggagggcctgaagatgtcaccggatgaaggccaggaagaactggaggaggtgcaggccgagttaaagaagaaggacgaggaattccaacggacaaagctgctgaatggaccgggcgacgtggagactgggaccagcataacagtgcctcagaaaaagtggctgcactttatttcccctattttcgtccaggccctgacattgacttttcttgccgagtggggcgaccgttcccaactgaccacaatcgtcctggccgcccgcgaagacccttatggagtggctgtgggcggcacagtgggccactgcttgtgtaccggtctggcggtgatcggtggacgtatgattgcacaaaaaatcagtgtccgaaccgtgaccatcatcgggggaattgtattccttgccttcgcattctcagctctctttatatccccagatagcgggttttag

SEQ ID NO: 47260 - DNA, 786 bp, Artificial Sequence
  Description of Artificial Sequence: Synthetic coding sequence
atggagatccccatgcagaagatcttcacccccgccgcccccgtgcacaccaataaggaagatcctgccacacaaacaaacctcggcttcatccatgcttttgttgcagctattagcgtgataattgtgagcgagctgggagataaaacattttttatcgctgccatcatggccatgcgatacaaccggttgactgtgctggccggtgcaatgttggccctcggtttgatgacctgtctgagtgtgttattcggatatgctaccacagttatcccacgtgtttacacgtattacgtgtctactgtgctgtttgcaatatttggaattcgcatgcttcgagagggcctcaaaatgtcacctgacgaaggccaggaggaactggaggaggtccaagccgaactgaagaagaaagacgaggaattccagcggacaaaactgctgaatggtcctggcgatgtggagaccgggacaagtatcaccgtgcctcagaaaaaatggcttcacttcatatctccaatctttgtgcaggcattgacgctgaccttcctcgccgagtggggtgacagatctcagctcacaacaattgtcctggctgccagagaggatccctacggcgtggctgtggggggaacagttggccactgcctttgcacgggactggcagtgattgggggccgtatgatcgcccaaaagatctcagtccgtaccgtcaccattatcggaggcattgtttttctcgcctttgccttttcagccctgttcatatccccagacagcgggttctag

SEQ ID NO: 47261 - DNA, 219 bp, Artificial Sequence
  Description of Artificial Sequence: Synthetic coding sequence
atgagcgccatcttcaacttccagagcctgctgaccgtgatcctgctccttatctgcacttgtgcttatatccggtccctggccccttcactccttgataggaacaagactgggctgctgggaatcttctggaagtgtgcccgcatcggagaaagaaagagtccttatgttgcggtttgctgcatcgttatggccttttctatcttatttatccagtag

SEQ ID NO: 47262 - DNA, 225 bp, Artificial Sequence
  Description of Artificial Sequence: Synthetic coding sequence
atgaccaacgtgtacagcctggacggcatcctggtgttcggcctgctctttgtgtgtacctgcgcctatttcaaaaaggtgcctaggttgaagacatggcttctgagcgagaagaagggagtatggggtgtgttttataaggccgcggttattggcacccgcctgcacgctgccgtggcaatcgcctgcgtggtaatggccttttatgtcctgtttattaaatag

SEQ ID NO: 47263 - DNA, 2094 bp, Artificial Sequence
  Description of Artificial Sequence: Synthetic coding sequence
atgtgcaagagcctgcggtactgcttcagccactgcctgtacctggctatgactcgactggaagaggttaatcgtgaagtgaatatgcactcaagtgtgaggtacctgggttacctggcccgcatcaatctcctggttgcaatttgcctcggtctgtatgtccgatgggaaaagactgccaactcattgatacttgtgatatttatcttgggtttgtttgttcttggaatcgcttccattctttattattatttttcgatggaagctgcatctctgagtctgtcgaatctatggttcggatttttgctgggactcctttgtttcctggacaattcttcattcaaaaatgacgtgaaagaggagtccactaagtacctgctgctaaccagtatcgttctcaggattctgtgttctcttgtggagaggatctcagggtatgtgagacatcgcccgacactgcttacaaccgtggaatttctcgagttggtaggatttgccatagcaagcaccaccatgttggtagagaaatcgttgtctgttatcctcctcgtcgtggcacttgccatgctgattattgatcttaggatgaagtctttcctggcaatccccaacctcgtgatatttgccgttctgctcttcttctctagcttggagacccctaagaaccccatcgcgtttgcctgcttcttcatttgccttatcacagacccgttcctcgatatatacttcagcggtctgtccgtgacagaaagatggaagccttttctatacagaggaaggatctgccggcgattatccgtagtatttgcgggcatgattgaactgaccttttttatattgtccgccttcaagctgcgggacacacatctgtggtactttgtgatcccagggttttctatttttggaatcttctggatgatctgtcacatcatcttccttctgactttatggggtttccacaccaagctcaacgactgccacaaggtgtattttacccatcgcactgactacaattctctagaccggatcatggcttccaagggtatgcggcatttttgtctcatctccgagcagctcgtgtttttcagtctcctggcaactgcaattcttggcgccgtctcttggcagcccactaacggcatattcctgtctatgtttcttatcgtgctccctctcgagtcaatggcccacggactgtttcatgaactcggcaactgcctcgggggcacaagcgtgggatatgctatagtgatacccactaatttttgcagccccgatggtcagcccaccctgttaccacccgaacatgtgcaggaactcaacctacggtccactggcatgctcaacgccatccaacgcttcttcgcttaccacatgattgagacgtacggctgtgactatagtacttcagggctgtcctttgatacgctccatagcaagttaaaggccttcctcgaacttcgcaccgtggacggcccccgacacgatacctacatactgtactattcaggtcacacccacgggaccggagagtgggccctggccggaggtgatacactgcggctggatactctaatcgaatggtggcgtgaaaagaatggatccttttgctctcgcttgatcatcgtactagactccgaaaattcaacaccttgggttaaagaagtccggaagattaacgatcagtacatagcggtccagggagccgagctcatcaaaactgtggatatagaggaggctgatcccccacagttgggagactttactaaagactgggttgagtacaattgtaactcttctaacaacatttgctggactgagaagggccgaactgtgaaagccgtttacggagtgagcaaaaggtggtcagactatacgctccaccttcccacagggtctgatgtggccaagcattggatgctccattttcctcgtatcacttacccacttgtgcacctggctaactggctgtgcggtctgaacttgttctggatctgcaagacatgttttaggtgcctaaaacggctcaaaatgtcgtggttccttcccaccgttcttgatactggacagggattcaagttggtgaaaagctag

SEQ ID NO: 47264 - DNA, 942 bp, Artificial Sequence
  Description of Artificial Sequence: Synthetic coding sequence
atgttcctgatcgtgctgcccctggagagcatggcccacggcctgttccacgagctcggaaactgcctgggcggaactagcgtcggatacgctatagtgattcccacaaacttctgctctcccgacggacaacccactctactcccgcctgagcacgtgcaggagctgaacctgagaagcacaggcatgctaaatgcaatccagcgcttttttgcctaccatatgattgagacgtatgggtgtgactactctacctcaggccttagcttcgacaccttacactcaaagcttaaggcttttctggagctgaggacagtggacggcccgcgtcacgacacctacattttatattactccgggcatacgcatggcaccggtgagtgggcactggcaggcggtgataccttaaggcttgatacactgattgagtggtggagggaaaagaacggttcattttgctcgcggctgattatcgtcttggatagtgagaatagcacaccctgggttaaggaagtgcgcaagatcaatgaccagtacatcgcagtccagggcgccgagctgatcaagactgtggacattgaagaagcagatccaccacagttgggggattttaccaaggactgggtagagtacaactgcaattcttctaacaatatctgttggaccgaaaagggccgaaccgtgaaggcagtgtacggggtatctaaacggtggagtgactacacgcttcacctccccaccggttccgatgtggcaaaacattggatgctgcactttccccgcattacctaccccctcgttcacttggctaactggctctgtggcctgaacctgttctggatttgtaaaacatgctttagatgcctgaaacggcttaagatgtcgtggtttttgcccacagtgctcgacaccggtcagggtttcaaactggtcaagtcctag

SEQ ID NO: 47265 - DNA, 2094 bp, Artificial Sequence
  Description of Artificial Sequence: Synthetic coding sequence
atgtgcaagagcctgcggtactgcttcagccactgcctgtacctggcaatgacaaggctggaggaagtgaaccgagaggtgaatatgcactcttcagtgaggtatctgggttacctcgctcgcataaatttactggtagccatctgcctgggcttgtatgtgaggtgggaaaaaaccgctaattccctgatcctggtgatcttcattcttggtcttttcgttctgggcattgccagtatcctatactattatttttccatggaagccgcttctttaagtctaagtaacctttggttcggattcttgttaggactcctttgctttctcgacaattccagctttaaaaacgatgtgaaagaggagagtacaaagtatttgctgctgacgtctatcgtcctcagaattctctgctccttggtggagcgcatttctggatacgtccgccacagacctactttgctcactactgtcgaattcctcgaactggttgggtttgctattgcatcaactaccatgctggtggaaaaatcgttatcggttatcctgcttgtggtcgccctcgccatgctaataatcgatctgagaatgaaatccttcctagccatcccaaatttggtgattttcgccgtgctcttgttttttagtagcctggaaaccccaaaaaaccctatcgcctttgcgtgcttcttcatttgcctaattacagatcctttcctagatatctatttctccggcctttctgttaccgagcgatggaaacctttcctgtacaggggaaggatctgccggagattgtcggtggtcttcgccggtatgatcgagctaactttttttattctcagtgcattcaaactccgggacactcacctatggtacttcgtgatcccaggattttctattttcggaatattttggatgatatgtcacatcatctttcttctaacgctatggggtttccatactaagctgaatgattgccataaagtgtactttacccatagaacagactacaacagcctcgatagaattatggcatccaaggggatgcggcatttttgtctgatcagtgagcagctcgtatttttttccttgttggccacggccatcctcggcgccgtatcttggcagcctaccaatggaatattcttgagcatgttcctgatcgtgctgccgctggaatccatggcacatggcctgtttcatgagctcggaaattgtctgggcggcacaagtgtcggctacgcaatcgtgatccctaccaacttttgttcccctgatgggcaacctactttgctgccgccagaacacgtgcaggagctcaacttacgctcaactggcatgctgaatgccattcagagattctttgcatatcatatgatcgaaacatatggctgtgactactcaacatctgggctttcgtttgacacactgcactcaaaactgaaagctttccttgagcttcgaaccgtagatggcccgcgccacgacacatatatcttatactacagtggccacacccatggcaccggagagtgggcccttgcgggcggggataccctcaggctggatacactgattgaatggtggagagagaagaacggatctttctgcagtcgcctaattatcgtattagacagcgagaattccacaccatgggttaaggaggtcagaaagattaacgatcagtatatcgcggttcagggtgctgagttaattaagaccgttgatattgaggaggcggacccacctcagctgggtgatttcaccaaggactgggtggaatacaattgcaatagttcaaacaatatatgttggacagaaaaaggtcggaccgtcaaagccgtctacggcgtgagtaaaaggtggtccgactacaccctgcatctacctacaggaagcgatgtagccaagcactggatgctgcacttccccagaatcacttatcctctagtacacctcgctaactggctgtgcgggctgaacttgttttggatttgcaaaacgtgcttccgctgcctgaagcgccttaagatgagctggttcctgcccacagtccttgatacaggacagggcttcaaactagttaagtcctag

SEQ ID NO: 47266 - DNA, 894 bp, Artificial Sequence
  Description of Artificial Sequence: Synthetic coding sequence
atggaggagcccaccgccgtggagggccaggtgcagctgcccagcccgcatcaggggtctcttcgaaaggcggtagcggccgctttagccctggatggggaaagcacaatgggccacagaaaaaagaaaagaaaggaatctagaccagaaagtataatcatatatagatccgacaatgagaaaacggacgaagaacccggtgagtctgagggaggagaccagccgaaagaagaagagggagatgacttccttgactacccagtcgacgacgacatgtggaatctgccgcttgattcccgatacgtgacccttactggcaccattacgagagggaaaaaaaaaggccaaatggtggacattcatgttacgctgactgaaaaagagttacaagagttgaccaagcctaaagagtcttctcgcgaaactacacccgaagggaggatggcttgtcagatgggcgctgaccgcggcccccatgtagtgctgtggaccttaatctgtctgccggtagtattcatcctgagttttgtagtgtccttctattatggtacaatcacctggtataatatcttccttgtgtacaacgaggaacgtaccttttggcataagatcagttattgtccctgtttggtcctgttctatcccgtgctgattatggctatggcaagctccctggggttatatgcagccgtggttcagctgagttggtcctgggaggcttggtggcaggcagctagggatatggaaaagggtttttgcgggtggctatgtagcaaacttgggctggaggactgcagcccgtactcgatcgtggagcttcttgagagcgataacatttcctccaccctgagcaataaagatcctatccaggaagtggaaactagtactgtttag

SEQ ID NO: 47267 - DNA, 894 bp, Artificial Sequence
  Description of Artificial Sequence: Synthetic coding sequence
atggaggagcccaccgccgtggagggccaggtgcagctgcccagccctcatcagggcagcctgcgtaaagctgtggccgctgcactcgcactcgatggggaaagcactatggggcaccggaaaaagaagagaaaggagtcccgacccgagtccatcatcatctaccggtcggacaatgagaaaactgatgaagagcctggggaatctgaaggcggtgaccaacccaaagaagaagagggggatgacttcctggactaccctgtggatgacgatatgtggaacctgcctctggacagccgctacgtgacacttactgggaccatcacgcggggcaagaagaagggccagatggttgacatccacgtaacacttacggagaaggaactgcaggagttaaccaaaccaaaagagtcttctcgggagacaacaccggaaggtcggatggcatgccagatgggcgctgataggggaccgcacgtagtactctggaccctgatctgcttgccggttgttttcatcctgagtttcgtagtcagtttctactacgggaccattacctggtacaatatttttctcgtttataacgaggagagaacattctggcacaagatttcttattgtccatgcctggttttgttttaccccgtgttaataatggccatggccagttctctcggtctttatgcggctgtggtccaactttcttggtcctgggaagcctggtggcaggccgcacgcgacatggaaaagggattttgcggctggctctgcagcaagttaggtttggaagattgctccccttatagcattgtggaactgctggagagtgataatatctcctctacactttccaataaggaccctatacaggaagtcgaaacatccacagtatag

SEQ ID NO: 47268 - DNA, 351 bp, Artificial Sequence
  Description of Artificial Sequence: Synthetic coding sequence
atggaggagcccaccgccgtggagggccaggtgcagctgcccagccctcaccaggggtccttgcggaaagctgtggccgccgccctcgccctcgacggcgagagcaccatgggacaccgaaaaaagaagcggaaggagtcccgccctgaaagcataatcatctatcgtagtgacaacgagaaaaccgatgaagagccaggtgagtctgagggtggcgatcagccgaaggaggaggagggcgatgatttcttggactatccagtggatgatgacatgtggaacctcccactggactctagatatgtcacacttactgggactatcacgcgtggaaagaaaaagggccagtag

SEQ ID NO: 47269 - DNA, 894 bp, Artificial Sequence
  Description of Artificial Sequence: Synthetic coding sequence
atggaggagcccaccgccgtggagggccaggtgcagctgcccagccctcatcagggatccttgcgcaaggctgtagccgcagcacttgcactggacggagagagtacgatgggtcatcgcaagaaaaagagaaaagaaagtaggcctgagagcatcattatctaccggtccgataatgagaaaactgacgaggaaccaggggagagcgaaggaggtgatcaacccaaggaggaagagggtgatgatttcctcgattaccccgttgatgatgacatgtggaacctcccccttgacagtcgatacgtgacactcactggaacgattaccagggggaagaagaagggccagatggtggacattcacgtaacattaacagagaaagagttgcaggaactcaccaaacccaaagagagtagtagggagaccaccccagagggaaggatggcctgtcagatgggtgcagatcgcggaccccacgtagtgctctggaccctcatctgcttgcccgtggtgtttatactttctttcgtggtcagcttttactacggaaccatcacctggtacaacatctttctggtgtacaacgaagagcgcacattctggcataagatcagctattgtccgtgcttagtgctattctacccagtgctcattatggcaatggcctcctctctcggtttatacgcagcagtcgtgcaactctcttggtcctgggaagcatggtggcaggctgcaagggacatggagaagggcttctgcggatggttgtgctcaaagttgggattggaggactgctccccctatagcatagttgaactgctggagagcgataatatcagcagtacactgtcaaataaagacccaattcaggaagtagagacaagcacagtctag

SEQ ID NO: 47270 - DNA, 894 bp, Artificial Sequence
  Description of Artificial Sequence: Synthetic coding sequence
atggaggagcccaccgccgtggagggccaggtgcagctgcccagcccgcaccaaggatctctgagaaaggcggttgcggctgccctggcccttgacggagagtctaccatgggccacagaaagaaaaaaagaaaggaaagtagaccagaatctatcattatttatcggtcagataatgaaaagacagacgaggaacccggggagtccgagggaggagatcaacccaaagaagaagaaggagatgattttctggattatccggtcgacgacgacatgtggaatctaccgctggactcgcggtacgtcaccctaaccggtacaatcacccggggcaagaagaagggacagatggtagacattcatgtgacactgacagagaaggagctccaggagttaacgaagcccaaagaatcatcgagggagaccacgccagaagggcgtatggcctgtcagatgggagctgacaggggcccacatgtcgttctctggactctgatctgtctgcctgtggtcttcattctatcgtttgtggtaagcttctactatggaaccattacatggtataacatattcctggtctataatgaagaacgcaccttctggcacaagatatcatactgcccttgtctggttcttttttatcccgtgctcattatggcgatggctagcagtttagggttgtacgctgccgtcgtgcaactgagttggagctgggaagcctggtggcaagctgcccgtgacatggaaaaaggcttctgcggctggctctgttctaaactgggtctcgaagattgctctccctacagcatcgttgagttactggagagtgataatatttccagcactctgagtaacaaggacccgattcaggaagtggaaacaagcacagtgtag

SEQ ID NO: 47271 - DNA, 309 bp, Artificial Sequence
  Description of Artificial Sequence: Synthetic coding sequence
atggaggagcccaccgccgtggagggccaggtgcagctgcccagccctcaccagggaagcctccgtaaagccgtggcagccgcattagccttagatggtgagtcaaccatgggccataggaagaagaagcggaaggagtcgcggccagagagtatcattatttaccgcagtgacaatgagaagacagatgaggaacctggcgaatctgaggggggggatcagccgaaggaggaggagggcgacgacttcctagattacccagtcgatgacgatatgtggaacctacccctggattccaggtacgtgtag

SEQ ID NO: 47272 - DNA, 597 bp, Artificial Sequence
  Description of Artificial Sequence: Synthetic coding sequence
atggagctgcccgaccccgtgcggcagcggctgggcaacttcagccgcgcggtcttctcagatagtaatcgtacaggtcccgaatcaaatgaaggccccgaaaatgaaatggtgtcctccctagcactgcagatgagcctgtactttaacacctattactttccactgtggtgggtgtcctcaatcatgatgctgcatatgaagtactccattttgccggattattataagtttatagtcattaccgtgattatcctgattactctgatcgaagcaatcagactgtatctcgggtacgttggaaatctgcaagaaaaagtaccagaactggccgggttttggctgctgtccctcctgctacagctgcctctgatcctgttcctgctgtttaatgaagggcttactaatttgcctctggaaaaggctatccatatcatattcacgttgttcttggccttccaggtcgtcgccgccttccttactttgcggaaaatggtgaatcagttggcagtgcgattccatttacaggattttgatagactgagtgcaaatcgtggtgatatgcggcggatgcgcagctgcatagaggaaatctag

SEQ ID NO: 47273 - DNA, 435 bp, Artificial Sequence
  Description of Artificial Sequence: Synthetic coding sequence
atggagcgggagggcagcggcggcagcggcggcagcgccggcctgctccagcagattttgtccctgaaggtggtccctagagtgggaaacggaacgctgtgccccaacagcacatcactctgttcctttcccgagatgtggtatggggttttcctgtgggctctggtatctagtttgttttttcacgtgcctgccggactcttagctctgttcactttacgacaccacaagtacgggagattcatgtcagtgagtattttgcttatgggaatcgtgggaccgatcaccgcgggaattttaaccagcgctgctattgcaggtgtgtatagagctgccggtaaggaaatgattccctttgaggccctgacacttggcacaggccagaccttctgcgtgctcgtggtgagttttcttcggatcctggcaaccctttag

SEQ ID NO: 47274 - DNA, 435 bp, Artificial Sequence
  Description of Artificial Sequence: Synthetic coding sequence
atggagcgggagggcagcggcggcagcggcggcagcgccggcctgcttcagcagatactcagtttaaaagttgtccctagagtgggtaatgggaccctctgtcccaacagcacaagcctttgctcttttcctgagatgtggtacggtgtgtttctgtgggcactggtgagttcactgttcttccatgtccctgcagggctgctggccctgttcaccttgcgccatcataagtatgggcggtttatgagcgtgtcaatcctactcatgggcatcgttggaccaatcacagcaggcattctgacctctgcggctattgctggagtgtaccgagcggcaggaaaggagatgatccccttcgaggccttgacattgggcacaggtcagactttttgtgtattggtcgtctccttcctgaggattctagctaccctgtag

SEQ ID NO: 47275 - DNA, 399 bp, Artificial Sequence
  Description of Artificial Sequence: Synthetic coding sequence
atgaaggccgagggcggcgaccacagcatgatcaacctgagcgtgcaacaagtgttatcactgtgggctcatggcaccgtccttagaaatttaacagaaatgtggtactggatttttctgtgggcactctttagttctctgttcgttcatggagcagcgggggtcttgatgtttgtgatgctccagagacacagacagggcagagttatctcagtaatcgctgtgtcgattggttttctggcaagtgtaaccggtgcaatgatcacttctgccgctgtcgccgggatctaccgcgttgccggcaagaacatggccccactggaggccctggtgtggggtgtgggccagactgtgctcaccttgatcattagtttttcccgcatcctggcaacgctgtag

SEQ ID NO: 47276 - DNA, 399 bp, Artificial Sequence
  Description of Artificial Sequence: Synthetic coding sequence
atgaaggccgagggcggcgaccacagcatgatcaacctgagcgtgcagcaggtgctgtctctctgggcgcacggcacagtgcttcggaacctcaccgagatgtggtactggatatttctgtgggctctgttctcctctttgtttgtccacggggccgctggggttctgatgtttgtgatgttgcagcgacatagacaaggaagagttatctcagtcatcgccgtgtccatcggctttctcgcctccgtgacgggtgctatgataacttcagctgcggttgcgggaatttatagggttgccgggaaaaacatggcccccctggaagccctggtgtggggcgtcggtcaaactgtgctcacattaatcattagcttttcaagaatcctcgcaaccctctag

SEQ ID NO: 47277 - DNA, 972 bp, Artificial Sequence
  Description of Artificial Sequence: Synthetic coding sequence
atgagccccgccgccgccgccgagcccgacggcgaccagcaggacaggcatgtgagcaaactgattttctgttttttcgtgttcggagctgtgctgctgtgcgtgggggttttgttgtccatctttggtttccaggcttgtcagtacaaaccattgccggactgtccaatggtcctgaaggtcgcaggccccgcttgcgcagtggttggactgggggccgtgatattggcacgttctcgcgcccagctccagttacgagctggacttcaacgtgggcagcagatggaccctgatcgagcctttatctgtggggaatcccggcagtttgcacagtgcctcatctttggcttcctttttctgacaagcggcatgctgatttcggtcctgggtatctgggtgcctggttgcgggagcaactgggcccaagagccacttaacgaaactgatactggcgattcagaaccccgaatgtgtggattcctctcactccaaattatgggccccctgatcgtcctcgtgggcttatgttttttcgtcgtagctcatgtgaagaagaggaatactctaaacgcaggacaagacgcttccgagcgcgaagagggccagattcagattatggagccagtgcaggtcacagttggcgatagcgtgatcatattccccccccccccaccgccatacttcccagaatcctccgccagtgccgtagcagagagccccgggaccaattctctgttgcctaatgaaaatcctccttcatactactcaatctttaactatggtacaccaacctccgagggcgccgcctccgaacgtgactgcgagagcatatatacgatttctggaacgaacagcagctccgaagcttcccacactcctcaccttccatctgaactaccgccccggtacgaagagaaagaaaatgccgccgccaccttcctgccactctcaagtgaaccatctcccccctag

SEQ ID NO: 47278 - DNA, 975 bp, Artificial Sequence
  Description of Artificial Sequence: Synthetic coding sequence
atgagccccgccgccgccgccgagcccgacggcgaccagcaggacaggcacgtgagcaaactcatcttttgtttttttgttttcggggccgtgctgttatgtgttggagtgctgctgtcaatcttcgggttccaggcttgtcagtacaaaccgcttcctgattgtccaatggtccttaaggtggcaggccccgcttgcgcagttgtggggctcggggccgtcattctggcgcgttctagagcccaacttcagctgcgggctggccttcagcgaggccagcagatggaccccgatagagctttcatctgtggagagagccggcagttcgcccagtgtttgattttcggattcctttttcttacatccgggatgcttattagtgttttgggcatctgggtacccggctgtggctcgaactgggcccaagagcctctcaacgagaccgatactggagacagcgagccaaggatgtgcggtttcctgtcactgcagatcatggggcccctaatcgtcctggtgggactgtgcttcttcgtggtggcgcacgtgaagaagagaaacaccctcaatgctggccaggacgcaagcgagagggaggaagggcagatccagattatggagccggtccaggttaccgtgggcgacagcgtaattatctttcctccacctccaccaccatatttcccagaaagcagtgcgagcgccgtggccgaatcacctggtaccaactcgctgctgcctaacgagaatccacccagctattactccatttttaactacggacggacccctaccagcgagggagctgcttcagaacgcgattgcgagtccatttacaccatcagcggtactaactcgtcgagcgaagcatctcatacgccccacctgcccagtgagttacctccccggtacgaggagaaagaaaacgctgccgcgacatttctcccactttcctctgagccgtcgcctccttag

SEQ ID NO: 47279 - DNA, 732 bp, Artificial Sequence
  Description of Artificial Sequence: Synthetic coding sequence
atggagcagggcagcggccggctggaggacttccccgtgaacgtgttctctgtgactccgtacactccaagcactgccgatatccaggtgagtgacgacgacaaggctggcgccacactcctgttcagtggaatcttcttgggactggtggggatcacatttacagtcatgggatggatcaaataccagggcgtctctcacttcgagtggacccagttacttgggcccgttctcctctcagttggcgtgacgtttatacttatagctgtgtgtaaatttaagatgctctcctgccagctgtgcaaagagtcagaagagagggtacctgacagcgagcagaccccagggggcccttccttcgtgtttaccgggatcaaccagcccattactttccatggggctacggtagttcagtacatcccccctccctatgggtcacctgaaccgatgggaataaatacgagttatcttcagagtgtagtgtccccatgtgggcttatcactagtggaggggccgccgctgcaatgagttctcccccgcagtattacaccatttatccccaggacaactcggcttttgtggtcgatgagggatgcctctccttcaccgacggtggaaaccacaggcctaacccggatgtagatcagctggaggagacccagctcgaggaggaggcttgcgcctgcttcagcccacccccttacgaagaaatctatagcctaccccgatag

SEQ ID NO: 47280 - DNA, 1515 bp, Artificial Sequence
  Description of Artificial Sequence: Synthetic coding sequence
atgagccagccccggacccccgagcaggccctggacacccccggcgattgtccccccggaagacgcgacgaagatgcaggagagggaatccaatgcagtcagcggatgctgtccttttcagacgctctactttctattatcgccacagtgatgatccttcccgtgactcatacggaaatttctcccgaacagcagtttgaccgatctgtgcaaagattacttgcaacgcgcatcgcggtgtacctgatgacatttctcatagttactgttgcctgggccgcacacaccagactgttccaggtggtgggaaaaaccgacgacacactggctctcctgaatctggcctgcatgatgacaataacctttctcccatatactttttccctgatggtgaccttcccagatgtacccctggggatctttttattttgcgtgtgcgtgatcgcgatcggcgtggtgcaagccctcattgtcggttacgcctttcactttccacatctcctcagcccacaaattcagcgcagcgcgcatagggcactgtatcgccggcacgtgcttggaatagtgctccagggcccagccttatgctttgccgcagcaatctttagtctgtttttcgttccactctcctatctactaatggttaccgtgatccttctgccctatgtcagcaaggtgaccggctggtgcagggaccgactcctcggccaccgggagccctctgcccaccctgttgaggtcttttcatttgatctgcacgaaccccttagcaaggagcgagtggaagccttcagtgatggagtgtatgccatcgtcgctacactgctcattctagacatttgtgaggacaatgttcctgaccccaaagacgtgaaagaaagattctccggtagcctggttgccgcgctgagcgctactggtcccagattcttggcctacttcggctctttcgcaactgtggggttactttggtttgcacatcacagtttgttcctgcatgtgcgtaaagccacccgggccatgggattgttgaatacactgtcgcttgcgttcgtagggggcctgcctctcgcatatcagcagacaagtgcattcgcacgtcagccaagggacgagctggagagggtgagggtgtcttgcaccatcatttttctggcatccatctttcagttagctatgtggaccacagccctcctacaccaagctgaaaccctgcagccttccgtgtggtttggaggaagggaacacgtgctcatgttcgcaaagttggctttgtatccttgtgccagcttgctcgcgttcgcgtccacttgcctgctctcacgcttcagtgtcggcatcttccacctgatgcaaatcgctgtgccatgcgcattcttgctcttgcggcttctcgtaggccttgcactcgcaacacttagagtcctcaggggtctagcacgcccggaacatccaccgcctgcccctaccggccaggacgacccacagagccaactcctcccagccccttgttag

SEQ ID NO: 47281 - DNA, 798 bp, Artificial Sequence
  Description of Artificial Sequence: Synthetic coding sequence
atgaccttcctgatcgtgaccgtggcctgggccgcccacacccggctgtttcaggttgtaggaaagaccgacgataccctagctctgcttaatctggcctgtatgatgactattacgtttctcccgtatacattttccttgatggtgaccttccctgatgttccgctcgggatctttttattttgtgtctgcgtgatcgcaattggggttgtgcaggccctaattgtagggtatgcgtttcacttcccacatttgttgagccctcagattcagaggtccgcccaccgggcattgtatcggagacatgtcctggggatcgtgcttcaagggcccgccctgtgctttgccgccgccattttctcattgttctttgtgccgctttcctacctcctcatggtgacggttatcctgctgccttacgtttcaaaagtgacgggctggtgcagagaccgactactcggacacagggaaccttcagcccaccctgtggaggtatttagttttgacctacacgagccactgagcaaggaacgagtggaggccttcagtgacggagtttatgcaattgtggccactctcctcatactcgacatttgtgcaccgcacagattcgcggctccgcctgcccccttcggctggctgcttctgccatccagtgtttgctccagtgctgcaagttccgcctcttctagtgttagggcccgggtatcttcacagagctcccgattttggtttctttggggctttttcttctttttcctcaggcagtcgtgctgtgtggcccaagccggagtgtag

SEQ ID NO: 47282 - DNA, 405 bp, Artificial Sequence
  Description of Artificial Sequence: Synthetic coding sequence
atgagccagccccggacccccgagcaggccctggacacccccggcgactgcccccccggccggagggatgaagacgcgggggaggggatccaatgctcacagagaatgttatcattctcagacgccctgctgtctattattgcaactgtgatgatcttacctgttacgcacacggaaatctctccagagcagcagtttgaccgttccgtgcagagactactggccactcggatagccgtataccttatgacatttctgatcgtgactgttgcctgggctgcccacaccaggctgtttcaagtcgtgggtaaaactgacgacacgctggccttgctcaacctagcatgcatgatgacgataaccttcctgccatatacattttccctgatggtaacctttccatag

SEQ ID NO: 47283 - DNA, 1167 bp, Artificial Sequence
  Description of Artificial Sequence: Synthetic coding sequence
atgatgaccatcaccttcctgccctacaccttcagcctgatggtgactttccccgatgttccgctggggatttttctgttctgtgtgtgtgtgattgccattggggttgtgcaggctttgatcgtagggtacgcatttcatttcccacatctcctctccccccagattcaaagatctgctcatagggccctttaccggcgtcacgtcctaggaattgttctccaaggtcccgccctatgtttcgcagctgcaatcttcagcctgtttttcgtgccgctttcttacctcttaatggtaacagtgatcttgctcccgtacgtcagcaaagttaccggctggtgtagagaccgactgctggggcatcgggagcccagtgctcatccagtggaggtgttttcatttgacctacacgaacctctgtctaaagagagagtagaggcattctcggatggagtatatgccatcgtcgcaactcttctaatcttggatatatgcgaggacaacgtgcctgatcctaaggatgttaaagaaagatttagcggtagcctggtggccgcgttatcagccaccggcccaaggtttttggcctacttcggtagctttgctacagtaggcctgctgtggttcgcacatcatagtctgtttctacacgtgcgcaaagcaacccgggcaatgggcctcttaaacactctgtcacttgcgttcgtcgggggactacctcttgcttatcaacagacgtccgccttcgcaaggcagccaagggacgagctagagcgagtaagggtttcctgcactataatttttctggcctcaatcttccaactcgccatgtggactaccgcactcttacaccaggctgaaacacttcaaccttccgtgtggtttggcggccgtgaacatgtcttgatgtttgccaaattggctctatatccgtgtgcctctctgttagcatttgcttcgacctgcctgttgagcaggttttctgtgggaatcttccatcttatgcagattgccgtcccatgcgcatttttgctgctgaggctcctggtgggactggcgctggctaccttgcgagtcttgagaggactggcgaggcccgagcatccccccccagctcccaccggtcaggacgatcctcagtctcagctacttccagcaccctgttag

SEQ ID NO: 47284 - DNA, 708 bp, Artificial Sequence
  Description of Artificial Sequence: Synthetic coding sequence
atgggcaccgccgacagcgacgagatggcccccgaggccccccagcacacgcacattgacgtgcacattcatcaagagtctgccctcgcgaagctgctgcttacctgttgctcagcccttaggccacgtgcaactcaggcgcgtggatctagcaggctcctggttgcatcttgggtgatgcagattgtcctgggaattctctctgccgttctgggaggctttttctacattcgcgattacaccctgctggtaacttccggcgctgcaatttggacgggggctgtggcagtgctggctggcgcagccgccttcatctatgaaaagcggggagggacatattgggcactgctccggaccctgctgaccctggctgctttttcgaccgctatagccgctctgaaactctggaatgaagactttcgatatggatattcctactataactctgcatgtcgaataagctcaagctcagactggaacacgcctgctcccactcaaagccctgaggaagtgaggaggttacatttgtgtacatcctttatggacatgctaaaagccttgttccggactctgcaggctatgttgttgggcgtctggatcttgcttctactcgcatcacttacacccctatggttgtactgctggcgaatgttcccaactaagggcaaaagggaccagaaagaaatgctagaggtgagcggcatctag

SEQ ID NO: 47285 - DNA, 708 bp, Artificial Sequence
  Description of Artificial Sequence: Synthetic coding sequence
atgggcaccgccgacagcgacgagatggcccccgaggccccccagcacacccatatcgacgtgcacatccaccaggagtcagcacttgcgaagctcctgctcacctgctgttcagcactgcgaccacgggccacacaggccagaggctcgtctagactgctggtggcttcatgggtcatgcagatcgtcttgggcatcctttctgcagtgctcggaggcttcttctatattcgagattatactttgttagtaaccagtggggccgcaatatggaccggagctgtcgcggtactggctggggcagctgcctttatttacgagaaacggggcgggacctattgggcattgttgcgaaccctgctcaccttggctgcctttagcaccgccatcgccgctctgaagttgtggaacgaggatttccgatatggctacagttattataatagtgcctgtcggattagtagctcaagcgattggaatactccggctccaacccagagcccagaggaggtcaggcgactgcatttgtgtacatcctttatggacatgctgaaggctctgtttaggacgctgcaggccatgctcctcggcgtatggatactgttgttgttagcctcactgacccctctgtggctctactgttggagaatgttcccaaccaagggcaaaagggaccagaaggagatgctggaagtgtcagggatctag

SEQ ID NO: 47286 - DNA, 813 bp, Artificial Sequence
  Description of Artificial Sequence: Synthetic coding sequence
atgacccagaacaccgtgatcgtgaacggcgtggccatggccagcaggccatcacagcctacccacgtgaacgtgcatatccaccaggaatccgccctgacccagcttctgaaggctggcggatcgctgaagaagttcttgtttcatcctggcgatactgtgccatcaacggccagaataggttacgagcagctcgcgctcggagtcacacagattctgcttggcgtggtcagttgtgttctgggtgtctgcctatcactggggccctggacagtgctgagcgccagcggttgcgcgttttgggcaggatcagtagttatcgctgcaggagcgggtgcaattgttcacgagaagcatcctggaaaactcgccggctacatcagttctcttctgactctggctggatttgccaccgccatggctgcggtggtgctctgcgtcaattcctttatctggcaaacggagccatttctctacatcgatactgtttgcgacaggagcgaccccgtgttccccacgacggggtatcgatggatgcgtcgctcacaagagaatcagtggcagaaagaagaatgccgcgcatatatgcagatgctacggaagctgtttacagcgattagggccctgttccttgccgtgtgcgtcctcaaagttatcgtgagtttggtatctttaggggtgggcctgcgcaatctgtgcggacaatcttctcagcccctgaatgaagagggaagtgagaaacgcctgctgggggagaatagtgtcccaccctccccaagtcgggaacaaacgtccaccgcgatagttctctag

SEQ ID NO: 47287 - DNA, 813 bp, Artificial Sequence
  Description of Artificial Sequence: Synthetic coding sequence
atgacccagaacaccgtgatcgtgaacggcgtggccatggccagccgcccttcccagcctactcacgtgaatgtgcacattcaccaggagtccgccttaacccagttacttaaagccgggggatctctaaaaaagttcctgttccatcctggggacaccgtccctagcaccgcccgaattggatatgaacagcttgccctaggtgtgacccagattttactgggggtggtcagctgtgtgcttggggtctgcttgtccttagggccgtggaccgtcctgtccgcctccggttgcgctttttgggcagggagcgtggttatcgccgcgggcgccggagctatagttcatgagaaacaccccggcaagctcgccgggtatataagctctttgctcacattagccggcttcgctacggccatggctgccgtggtactgtgtgtcaactcctttatatggcagaccgaacctttcttgtatattgacaccgtgtgcgataggtccgaccccgtgttccccacaacagggtatagatggatgcggagaagccaagaaaaccagtggcagaaagaagagtgcagggcctacatgcagatgttaagaaagctgtttacggcgattagagccctgttccttgccgtgtgtgtgctcaaggtaatagtcagcttggtgtctctgggcgtggggctgaggaatctgtgtggacagagcagccagcctctgaacgaggaggggagcgaaaagcgattactgggggaaaattccgttcctccttctccctcacgggagcagacatcaacagcgattgtgctttag

SEQ ID NO: 47288 - DNA, 813 bp, Artificial Sequence
  Description of Artificial Sequence: Synthetic coding sequence
atgacccagaacaccgtgatcgtgaacggcgtggccatggccagccggcccagtcagccaacccatgtaaacgtgcacatccaccaggagtctgcacttacacagctgctgaaggctggagggagcctaaagaaattcctgtttcaccctggggacacagtcccgagcaccgcacggattggctatgagcaactcgctctcggagtgacacaaattctactgggcgtcgtgagttgtgttttaggcgtttgcttgagcctgggcccgtggacggtcctctcagcctcaggctgcgccttttgggctgggtccgtagtgattgctgctggtgctggcgcaattgtccacgagaaacatcctggcaaactggccgggtacattagcagcctgctcactctcgctggattcgcgactgctatggctgcggtggtgctgtgtgtgaactccttcatttggcagactgaaccattcctctatatcgatacagtgtgcgacaggtccgatcccgttttccccacaacagggtacagatggatgaggaggagtcaggaaaaccaatggcagaaggaggagtgcagagcctatatgcagatgctcaggaaactctttacagccatccgcgctcttttcctggctgtgtgcgtgctcaaagtgattgtatctctcgtgtctctgggtgtcggactgcgaaacctctgtggccagtcttcccagcccttgaatgaagagggcagcgagaaacggctgctgggcgagaattccgtgccgccctctcctagcagagaacagacttcaacggcaattgtgctgtag

SEQ ID NO: 47289 - DNA, 813 bp, Artificial Sequence
  Description of Artificial Sequence: Synthetic coding sequence
atgacccagaacaccgtgatcgtgaacggcgtggccatggccagccggccatctcagcctacccacgtcaacgttcacatccatcaggaatcggctcttacgcagcttcttaaggctggggggagtctcaaaaagttcctgttccatccaggggatacggtgccttctaccgctcggatcggctatgagcagttggccttgggcgtgacccagatcttattgggcgttgtttcatgtgtgctgggggtctgcctaagcctgggcccatggaccgtgctgtctgcctctggttgcgcattctgggccggatcagtcgtgatagcggctggcgctggagccatcgtgcacgaaaagcacccaggcaagctggccggctatatttcctcacttctaactctggcgggatttgccaccgccatggccgctgtcgtactgtgtgtcaactcatttatctggcagaccgagccatttctttacatcgataccgtttgcgataggtctgacccagtctttccgacaaccggataccgatggatgcgtcgtagccaggaaaatcagtggcaaaaagaagagtgccgagcctatatgcagatgctccggaaactatttaccgctattcgagccctgtttctggcagtgtgcgtgcttaaagtgatcgtgtcactggtaagcctgggggtgggactcaggaacctgtgtggacagtcttcacagcctcttaacgaagagggctccgagaagagactgttaggagagaatagtgtacccccgagcccttcgcgggagcagacatccactgcaatagttctctag

SEQ ID NO: 47290 - DNA, 702 bp, Artificial Sequence
  Description of Artificial Sequence: Synthetic coding sequence
atgacccagaacaccgtgatcgtgaacggcgtggccatggccagcaggccaagccaacccacacacgtgaacgtgcacatccatcaagagagcgcactgactcagcttctgaaggctgggggcagtctgaagaagttcctgtttcatcctggagatacggtaccgtcaacggcaagaataggatatgaacagctcgcacttggcgtgatcgcggccggggcaggcgctattgtgcatgagaagcacccaggcaagcttgctggctatataagctctctgctcacccttgcggggttcgccaccgccatggccgccgtggtgctctgtgtcaacagtttcatatggcagaccgagcccttcctatatatagatacagtgtgcgatagatcagacccggtatttccaaccacagggtacaggtggatgcgccgatctcaggaaaatcaatggcagaaagaggagtgccgcgcctacatgcagatgctgcgaaagctgttcacagctattcgggctctctttttggcagtgtgcgtgcttaaggtgattgtcagccttgtgtcactcggagttggtcttcggaatttgtgcgggcagtcaagccagccacttaatgaggaagggtcggagaaacggttgctgggggagaacagcgttccgccatctccaagtcgagagcagacgtcaacagcaattgtcctgtag

SEQ ID NO: 47291 - DNA, 813 bp, Artificial Sequence
  Description of Artificial Sequence: Synthetic coding sequence
atgacccagaacaccgtgatcgtgaacggcgtggccatggccagccggccatctcaacccacacacgtcaacgtccacatacaccaagaaagcgccttaacacagctgcttaaggccggcggatccttgaagaagttcctttttcacccaggtgacaccgtaccttctacggcgagaataggttacgagcagttagcccttggcgtcactcaaattctcttgggcgttgtatcttgtgtgcttggcgtctgccttagtcttggaccttggacggttctaagcgcaagcggatgtgccttttgggcggggtctgtggtgattgccgccggagccggggcaatcgtgcatgaaaaacatccaggcaaactggccggatacatcagcagcctactgactctagctggcttcgcaaccgcaatggccgccgtggttttgtgcgtgaactcatttatatggcagaccgagccatttctgtacatcgacacagtctgtgatcgctccgaccccgtgtttcctaccactggatacaggtggatgcgtcggtctcaagagaaccagtggcagaaggaagaatgtcgcgcctacatgcaaatgctgcgcaagcttttcaccgcaataagagccctgttcttggccgtgtgtgtcctgaaggtcatagtgtcactcgtgtcgcttggtgtcggcctccgtaatctttgtggccagagcagccaaccgctgaacgaggagggctccgagaagaggctgctgggcgagaactcggtccccccttctccctcccgcgagcaaaccagtacagccatcgtgctttag

SEQ ID NO: 47292 - DNA, 813 bp, Artificial Sequence
  Description of Artificial Sequence: Synthetic coding sequence
atgacccagaacaccgtgatcgtgaacggcgtggccatggccagcaggccaagtcagccaacacatgtgaacgtccacattcaccaagagagtgcgctaacccagttgttaaaggccggggggtcccttaaaaaattcctattccaccccggcgacaccgtgccaagcacagcccgtatcgggtatgaacagctggcactaggcgtgacccaaattcttctgggggtggtatcctgtgttctgggagtctgccttagtctgggcccctggactgtcctgagtgcatctggatgcgccttttgggcaggaagtgttgttatcgctgcaggagccggtgctatcgttcatgagaagcacccgggtaaactcgctggatatatcagctcgttattaaccctcgcaggcttcgcgaccgccatggcagccgtggtcctgtgtgtcaattcttttatctggcagactgaacccttcctgtacatcgatacagtttgtgaccgaagcgaccccgtgttccccacaacagggtatagatggatgcgtcgctctcaagaaaatcaatggcaaaaagaggagtgtagggcctacatgcaaatgctaagaaaactgttcactgctataagagcactctttttggcagtgtgcgtgttaaaggtgatcgtgagcctggtctccctcggggtcggcttgagaaacctatgcgggcagtcttcccagcctcttaatgaggagggttctgagaagaggctgctgggggagaactctgtccccccctctccttccagagagcaaacctcgaccgccatcgtgctttag

SEQ ID NO: 47293 - DNA, 936 bp, Artificial Sequence
  Description of Artificial Sequence: Synthetic coding sequence
atggccggccccctgtggcggaccgccgccttcgtgcagcggcacaggactggcctcctggttggctcatgtgccggtctgttcggagtgccgatttcttaccatctttttcctgaccccgtggtccagtggctgtaccagtactggccgcagggccaacctgctcccctgcctcctcagctccagtccctgttccaggaggtgttacaggatattggcgttccttccgggcactgctacaagccattcaccacgttcacttttcaacccgtgtctgcaggattccctcgcttaccagccggcgccgtggttggaattcctgcgtccttcttgggggatttggtcataaataccaatcacccagtggtgatccatggccatacagtggactggagaagtccggctggagctagactgagggcttcattaacgttgtccagggaggcccaaaaatttgccctcgcccgggaagttgtctatctggagagctcaacaacggccgtacacgcccttttggctcctgcttgtcttgctgggacttgggccttaggcgtgggcgcgaagtatacattaggcctccatgccggacccatgaaccttagagccgccttcagcttggtcgctgccgttgcgggattcgtggcatacgccttttctcaggatagccttacccacgccgtggagtcttggttggaccggcggactgcttcgctgtcagcagcatatgcttgcggcggagtggaattctatgagaaactgctctctgggaacctagccctgcggtccctgctaggcaaagatggagagaagttgtacacacccagcgggaatattgtgccccggcacctgttccgcatcaaacatttaccatataccacacggcgggacagcgtgctgcaaatgtggcggggcatgctgaatcctggcaggtcatag

SEQ ID NO: 47294 - DNA, 936 bp, Artificial Sequence
  Description of Artificial Sequence: Synthetic coding sequence
atggccggccccctgtggcggaccgccgccttcgtgcagcggcaccggactgggttactcgtcggctcctgcgccggcctgttcggtgttccgatttcataccatctgttcccagacccagtcgtccagtggttgtaccaatactggcctcaaggacaacccgcaccactgccacctcaactgcagagcctattccaggaggtgctgcaggatattggtgtgccttcagggcactgttacaagccttttacaacattcacgttccagcctgtaagcgccggattccctaggctgcctgccggagccgtcgtcggaattcccgcctccttcctgggcgacctggtgatcaataccaatcacccggttgtaatccacgggcatacggtggactggcgctctccggctggggcacgcctacgggcttctttgacgctcagccgtgaggctcagaaatttgcactggccagggaagttgtgtaccttgagtcttcgacaaccgccgtacatgcacttcttgctcctgcctgtcttgccgggacttgggcgctcggcgtcggggcaaaatacacacttggcctgcatgccggcccaatgaatttgcgagcggctttttccctggtcgcagcagtagccggttttgtcgcttacgcgttctctcaggattctcttacccatgctgtggaaagttggctagataggcggacggcctctctcagcgccgcttatgcatgtgggggagttgagttctacgaaaaactgctctcaggcaacctggccctgaggagtctgttaggtaaagatggtgaaaagctgtacacgcccagcgggaatattgtgcctagacatctgtttcgtattaagcacctcccttatacaacacgccgtgatagcgtcttacagatgtggcggggaatgctcaatccgggaagatcttag

SEQ ID NO: 47295 - DNA, 753 bp, Artificial Sequence
  Description of Artificial Sequence: Synthetic coding sequence
atggccggccccctgtggcggaccgccgccttcgtgcagcggcacaggactggacttctggtcggctcttgtgcaggcctgttcggcgtgccaataagctaccacttgtttcctgaccccgtggtgcagtggctttaccagtattggccccaggggcagcctgcccccttgcccccccagcttcaaagcctttttcaggaggttctacaagacatcggagtacccagcggtcattgttacaagcctttcaccactttcacctttcagcccgtgagcgcaggcttccctagattacccgcaggcgccgtggtcggtatcccagcttcctttctaggtgatctggtaattaatacaaaccacccagtggtcatacatggtcacactgtggactggcgctcacccgcgggcgcacgtctacgcgcctcattaactctatcgagagaagcacagaagtttgcacttgcccgcgaagtagtgtatctagaatcgtctacaacggccgtgcacgccctcttggcccctgcatgtctggccgggacctgggcgctgggtgtgggcgccaagtatacattgggtcttcacgccggcccgatgaacctacgcgcggcctccctgagcgctgcatatgcttgtggtggcgtggaattttacgagaagctgctaagtggtaacttggcactgcgatccctcctgggtaaagatggtgaaaagttgcagatgtggagggggatgctgaatcctggaagatcgtag

SEQ ID NO: 47296 - DNA, 936 bp, Artificial Sequence
  Description of Artificial Sequence: Synthetic coding sequence
atggccggccccctgtggcggaccgccgccttcgtgcagcggcaccggactggcctgctagtcggatcctgcgcaggcttatttggagtccctatttcatatcacttattccccgatcccgtggtgcagtggctgtatcagtactggccccaaggccagcctgcacccctcccgccccagcttcagagtttatttcaggaggtgctgcaggacattggagtcccatctggtcattgctacaaacctttcactacgtttaccttccaacccgtatctgccggattcccaaggcttccagccggggccgtcgtgggaatacctgcctcttttttgggtgaccttgtcatcaatactaatcatcccgtagtgatccacgggcatacggtggactggcggagcccggccggcgcacgactgcgggcctcactgactctgtcgcgagaggcgcagaagttcgccctggccagagaggttgtgtacctggagtcgagtacaacggctgtgcatgctctgttagctcccgcatgtttggcaggcacctgggctttgggcgtgggagcaaagtatactctcgggcttcacgccggacccatgaacctaagagccgcattctccctggtggctgccgtagccggattcgtcgcctacgcctttagccaggattcattgacccacgctgttgagagttggctggatcgccggactgcatctctgagcgccgcatatgcctgcggaggcgtcgagttctacgagaaactcctgagcgggaacctggccctgagatctcttctcgggaaggacggtgagaaactgtacactccatccggcaacatagtgcccagacacctctttcgaattaagcaccttccttacacgacaagaagagactccgttttgcagatgtggcggggaatgctgaatcccggtagaagctag

SEQ ID NO: 47297 - DNA, 345 bp, Artificial Sequence
  Description of Artificial Sequence: Synthetic coding sequence
atggccggccccctgtggcggaccgccgccttcgtgcagcggcacaggactggactgctggtagggagctgcgcagggctttttggcgtgcctatttcataccacctctttccagacccagtcgtgcaatggctttaccagtactggccgcagggtcagcctgcacctctcccgcctcaactgcagagtcttttccaggaggttctccaggacattggggtccctagcggccattgctacaagcctttcacaacgttcacatttcagcctgttagcgctggtttcccccgattgccggccggggctgtggtcggtatcccagcttcgtttctgggagatctgtag

SEQ ID NO: 47298 - DNA, 894 bp, Artificial Sequence
  Description of Artificial Sequence: Synthetic coding sequence
atggagccccgggccctggtgaccgccctgagcctgggcctgagcctgtgttccttaggcctcttagtgacggccatcttcaccgaccactggtatgagactgatccacggagacacaaggaatcttgcgagcggagccgggccggtgcagaccccccggatcagaagaaccgcctcatgcctctgagtcacctccctttaagagattcgccacccttggggaggcgtctcttaccgggtgggcccgggagagccgacccagaatcttggcgcagtctgcttgggctgggcggtctggacgccgagtgcggtcgccccttgtttgcaacctattcaggcctgtggcgcaaatgctattttctaggaatcgatagagacattgacacgctcattctgaagggcatcgcccaacgctgtactgctatcaaataccacttctcgcaaccaataagattaagaaatatcccattcaacctgaccaaaacaatccagcaggatgagtggcatctccttcatctacggcggatcacggccggatttttaggaatggctgtagctgttctgctgtgcgggtgcatcgtcgccaccgtttcgtttttttgggaagagagccttacccaacatgtagcgggcctgctgttcctaatgaccgggattttttgcacaatcagcttatgcacgtatgccgcctctatctcctatgacctcaatcggctgcccaagctgatatattcgctgcctgcggatgttgaacacggatacagttggagtatattctgtgcatggtgctccctggggtttatagtggctgccggcggcttgtgcattgcctatccattcatcagccggacaaagatcgctcagctaaagagcgggcgcgatagcactgtatag

SEQ ID NO: 47299 - DNA, 336 bp, Artificial Sequence
  Description of Artificial Sequence: Synthetic coding sequence
atggagccccgggccctggtgaccgccctgagcctgggcctgagcctgtgttcactgggactgctggttactgctatctttaccgaccattggtacgaaacggatcccagacgccataaggaaagctgtgaacggtcccgcgctggagccgacccccctgatcagaagaaccgcctgatgcccctcagccatcttcttggccccctagaagaggtactcctgcctggccaccgccccggacacaggcacccacacccagagaggtactgcgccgctatgcacgggcaccaagttcctctgttttcagctcatcccttagctaaacactcattctag

SEQ ID NO: 47300 - DNA, 594 bp, Artificial Sequence
  Description of Artificial Sequence: Synthetic coding sequence
atggccctgaacaacttcctgttcgcccagtgcgcctgctacttcctcgcattcctcttttcatttgtcgttgtggttcctttgtctgagaacgggcatgacttccgcggacgctgtctactttttaccgaaggtatgtggctgtccgctaatttgacagtccaggaacgagagcgttttaccgtacaggagtggggcccacccgcagcatgtcgcttctccctgttagctagtctgttaagcctccttttggctgctgctcatgcctggcggaccctattcttcttatgtaagggccatgaggggtcattcttttctgccttccttaacctgttggtgagcgccttcgtcgtttttcttgtgttcattgcgagcacgatcgttagtgtggggtttaccatgtggtgcgataccatcaccgaaaaaggcaccgtgccccactcctgtgaagagctgcaggacattgacctggagctgggtgtcgataattcggccttttatgaccagttcgctatcgcacaggtgggcgggtccggccaagagggaaggctggccatgcttgggggcgggcacctgttgcttgatatctgctag

SEQ ID NO: 47301 - DNA, 702 bp, Artificial Sequence
  Description of Artificial Sequence: Synthetic coding sequence
atggccctgaacaacttcctgttcgcccagtgcgcctgctacttcctggcattcctgttcagcttcgttgttgtggtccctctgtctgagaacggccatgacttcaggggacggtgtctcttgtttacagaaggcatgtggctgagcgctaatctcaccgtgcaggaaagggaacggttcaccgtccaagaatggggtccccccgcagcctgcaggttctcattactcgcttcgctgctgagtttattgctcgctgcggctcacgcctggcgcactctcttttttctttgtaagggccatgagggatcgttcttttcagcgtttttgaacttgctggtttcagccttcgtggtgttcctggtgtttatcgcaagcaccattgtttccgtcggattcaccatgtggtgcgacacaatcaccgagaaaggcacggtgcctcactcctgcgaggagctccaggacatcgacctggaattaggggttgataatagcgccttttacgatcaattcgccatcgcccagtttggcctgtgggcgtcttggctggcatggctggccatcacaaccctagctttccttaaagtctatcataactacaggcaggaggacctgctggatagcctcatccacgagaaggaattgctgctggccagaccctctccaaggactagcttccaggaagaaaagtcggccgtcatctag

SEQ ID NO: 47302 - DNA, 660 bp, Artificial Sequence
  Description of Artificial Sequence: Synthetic coding sequence
atggccctgagctggctgcagcgggtggagctggccctgttcgccgcggcattcttatgtggagccgtggcggctgcagccatgacgcgtacccaaggaagcttctccgggaggtgcccactctatggtgtcgcgacgttgaatggctcgtctctggccctgtctcggcccagtgctccatccctgtgctacttcgtagctggcgcctcagggcttttggctctatactgcttgctcctgcttcttttctggatctattcttcttgcattgaggattcacatcgcggggcgatcgggctccgaatcgccctcgcgattagtgctatagccgtcttcctggtcctggtctctgcatgcatactgcggttcggcactagaagtttgtgcaattccatcatatccctgaacacaactatcagttgctccgaagcacagaagatcccgtggacgccgcccggtaccgccctgcagttctactccaatcttcacaatgccgagacatcttcatgggtgaatctggtgctgtggtgcgtagtgttagtattgcaggtggtgcaatggaagtctgaagccaccccatataggcctctcgaacgcggggacccagaatggagcagcgagactgatgctctggtgggtagtcggctgtcacactcatag

SEQ ID NO: 47303 - DNA, 1554 bp, Artificial Sequence
  Description of Artificial Sequence: Synthetic coding sequence
atgggcctgggccagccccaggcctggctgctgggcctgcccaccgccgtggtttatggttctctggctctctttaccaccattctgcataacgttttcctcctctattacgtcgatacatttgtcagcgtttataagattaacaagatggccttctgggtcggcgaaactgtgttcctcttgtggaattccctgaatgatccactgtttggctggctgtcagatcggcagttcctgtcttcccagccccgtagtggcgcaggtctctcaagccgtgccgttgtcctggcaagggtgcaagcattgggttggcacggtccccttctggccctgtctttcctggcattttgggtcccatgggctcccgctggcctgcaatttctactctgcttgtgcctctacgatggtttcctgaccttggtcgacctgcatcaccatgccctgctcgctgatctcgccctgtctgcccatgataggactcacttgaacttctactgtagtcttttcagcgccgccggctccctgagcgtttttgctagttatgccttctggaacaaagaagatttttcctcctttcgggctttctgcgtcacactcgcagtcagttcaggattaggcttcctgggcgcgacacagcttctgaggcggagagtggaagctgcccgtaaggacccaggatgcagcggtctcgtcgtcgattctggtctgtgcggcgaggagctgctggtagggtccgaagaagctgactctataaccttgggtcgctaccttcgtcagcttgcaaggcaccgcaacttcctttggtttgtgtcaatggatctggttcaagtgttccactgccacttcaactccaatttctttcctctattcctcgaacacttgttatcggatcacatttccctctctactgggtctattctgctcggccttagctacgtggccccacatctgaacaatctctacttcctttctttgtgtaggcgttggggagtctatgccgttgtgagagggctgtttctactgaagctgggactatccctcctcatgttgctcgccggacccgaccacctctcgctactctgcctatttattgcgtcgaaccgggtgttcacagaagggacctgcaagcttctgactctggtggtcaccgatctcgtggatgaagacctagtattaaatcaccgtaagcaagcagctagtgccctactgttcggcatggtggctctggtaaccaagcccggtcaaacgtttgctccccttttgggtacttggctgctctgcttctacacagggcacgacctgttccaacagagcctgattacacccgtggggagcgcccatccatggcctgaacctcctgcaccagccccagcccaggccccaaccctaagacaagggtgcttttaccttctggttctggtgcccattacatgcgccttacttcaattgtttacatggagccagtttacactgcacggccggaggctgcacatggttaaagcccagcggcagaatctctctcaggcacagaccctggatgttaaaatggtctag

SEQ ID NO: 47304 - DNA, 741 bp, Artificial Sequence
  Description of Artificial Sequence: Synthetic coding sequence
atggacctggtgcaggtgttccactgccacttcaacagcaacttcttcccactttttttggagcatctgctgtccgaccatattagcctgagcacaggcagcattctgctcggcctgtcatatgtagctccccacctgaataatttgtactttctctccctctgccggaggtggggtgtgtacgctgtggtgcggggacttttccttctcaagcttggcctttccctattgatgcttctagctggccccgaccacctgagtcttctatgtctgtttatcgcttcgaaccgcgtgtttactgagggtacatgtaaactgttgaccctggttgtgacggacttagtggatgaagacctggtgctaaaccatcgcaagcaggctgcgtccgccctgctgtttggtatggtcgccctggtgacaaaaccaggacagacatttgcacctctattaggaacgtggctgctgtgtttttataccggacacgacctatttcagcagtctctcatcacgcccgtcggatccgcccacccttggcctgagccccccgccccggcgcctgctcaggctcctacgcttcggcagggttgtttttaccttctcgtcttagtgcccattacttgcgccctgctgcagctgtttacgtggtcccagtttaccctgcatggcaggagactccatatggtaaaggcccagcgacaaaatcttagtcaggctcagactttggacgttaagatggtgtag

SEQ ID NO: 47305 - DNA, 741 bp, Artificial Sequence
  Description of Artificial Sequence: Synthetic coding sequence
atggacctggtgcaggtgttccactgccacttcaacagcaacttcttccctctgttcctggagcatctgctgagcgaccatatctcacttagtaccggaagcatcctgctgggcctgagctatgtggcccctcaccttaataacttgtatttcttaagcctgtgccgtcgctggggcgtttacgccgtggtgcggggcctgtttctgctgaagctcggactctccttgctcatgcttctggccggccctgatcaccttagcctgctatgcttgttcattgctagtaaccgggtgttcactgaaggcacctgtaagcttcttacactcgtggtgacagacctcgttgatgaagatctggttctgaatcatcggaaacaggcggcatcagccctgctctttggtatggtggctcttgttacgaagccaggacagaccttcgcccctctcctggggacatggctgttgtgcttctatactggtcacgacttattccagcagagtctcatcacacccgtcggttctgcccatccttggcctgagccacccgcccccgcccctgctcaggcacccacattgcgccagggttgcttttatctcctcgtgctggtgccgattacatgtgcattgctccagctcttcacatggtcccagtttaccctgcacgggagacgactccatatggtaaaggctcaacgtcagaacctcagccaggcccagactctggacgtgaagatggtatag

SEQ ID NO: 47306 - DNA, 462 bp, Artificial Sequence
  Description of Artificial Sequence: Synthetic coding sequence
atgggcctgggccagccccaggcctggctgctgggcctgcccaccgccgtagtctacggatcccttgctttatttactactatactgcacaacgtcttccttctctattatgttgatacgttcgttagcgtctataagatcaacaaaatggcgttttgggtcggcgaaactgtttttttgctgtggaatagtcttaacgaccccttgttcggatggctcagtgatcggcagttcctcagctctcagccaaggctttgtggcgaggaattactggtggggtccgaagaggccgattcaattactctggggcggtatctccggcagctcgctaggcataggaatttcctctggtttgtgagcatggacctcgtccaagtacagtggcttactccagtcattcccgcactcagggatgctaaggtggaacgccccctggagccgcggtcgtctcggctgcagtag

SEQ ID NO: 47307 - DNA, 948 bp, Artificial Sequence
  Description of Artificial Sequence: Synthetic coding sequence
atgggcctgggccagccccaggcctggctgctgggcctgcccaccgctgtcgtttacggcagtctggcactcttcaccactattctgcacaatgtgttcctgctctactacgttgacaccttcgtgagtgtgtataagattaataaaatggcattctgggtcggggaaactgtattcctcctctggaacagcctgaatgaccctctctttggttggttgtccgacaggcaatttctctcaagccagcctagactgtgcggggaggaactgttggtgggtagtgaggaggcagactcaatcactctgggtcgatacctccgtcaattggcaagacaccggaacttcttgtggttcgtgtccatggacctggttcaggtgttccattgccactttaatagtaacttctttcctctgttcctggaacatctgctaagtgatcatatcagtctgtctaccggatcaatcttactggggttgagctatgtggcgccgcatctaaataatctgtactttcttagcctgtgcaggcgatggggcgtatatgctgtggtgaggggcctgttcctccttaagctggggctgagtctacttatgcttctggccgggccagaccacctgagtctgctctgcttgttcatagctagcaaccgcgtcttcactgaagggacctgcaagctcctgacgctagtggtgactgacttagtggacgaggacttagtgttgaatcaccgcaaacaggcagcatcagcactgttgtttggaatggtggcgcttgtcacaaagcccgggcagactttcgctcccttgctaggcacatggctgctgtgcttttacacagggtgggatctgggctatgcactggcacactcgctccttaaccaggctggaccccgctctcgcatggcacaggatcagccacgtggcggactaccaactagtactacctag

SEQ ID NO: 47308 - DNA, 402 bp, Artificial Sequence
  Description of Artificial Sequence: Synthetic coding sequence
atgcggggcgagcacaacagcaccagctacgacagcgccgtgatctaccgtggcttctgggccgtgttaatgttgcttggtgtggtcgcagttgtcattgcttcctttctgatcatttgtgccgctccatttgccagccactttttatacaaggcggggggcggatcctatatcgccgccggaattctgttttctttggtggtaatgctgtacgtgatttgggtccaggccgtggccgacatggaaagttaccggaacatgaagatgaaggattgcctcgacttcactccctccgtcctgtatgggtggagcttcttcctggcccctgcagggatctttttttctctcctcgctgggcttttgttcctggtggttggctggcacatacagatccaccactag

SEQ ID NO: 47309 - DNA, 690 bp, Artificial Sequence
  Description of Artificial Sequence: Synthetic coding sequence
atgcggctgaacatcgccatcttcttcggcgccctgttcggcgccttaggagtgttgctcttcttagtggccttcggatccgactattggctcctagccacagaggtagggcggtgctcgggcgaaaaaaatatcgagaacgtaacattccaccacgaggggtttttctggaggtgctggttcaatggaatagtcgaggaaaatgactcaaatatttggaagttttggtacacaaatcagccaccctctaaaaattgtactcacgcttacctgagtccttatcctttcatgcggggggagcataattctacttcatatgactctgccgttatttatcggggcttctgggcagtcctgatgctactaggggtggttgctgtggttatcgcctctttcttgataatttgtgccgcccccttcgccagccacttcctatacaaagcgggaggcggaagctatatcgcagccggcatcttgttttctctggttgtgatgctttacgtaatctgggttcaggctgtcgccgatatggagagctaccgtaatatgaagatgaaagactgtctggattttaccccatctgttctttatgggtggtcgtttttcctcgcgccagccggaatttttttctcgctgctggcgggcctcttgttcttagtggttggctggcacattcagatccaccattag

SEQ ID NO: 47310 - DNA, 1131 bp, Artificial Sequence
  Description of Artificial Sequence: Synthetic coding sequence
atggcccggggccccggccccctgggccggccccggcccgacaccgtcgctatgccaaagcggggaaaacgcctgaagttccgcgctcacgatgcctgctcgggtcgggttacggtggcagattatgctaattcagacccggcagtggtgcgctcaggccgcgtcaaaaaggccgtggctaatgcagtgcagcaggaagtgaagagcctgtgtggattggaagcatctcaggtccctgccgaggaagcgctatctggcgccggcgagccatgtgatattatcgatagcagcgatgaaatggacgcacaggaggaaagcatccacgaacggacggtgtccaggaagaagaagagtaaacgacataaggaagaactcgatggagcaggaggcgaagagtatccgatggatatatggctgctgctggcaagttatatccgtcctgaggacatcgtcaatttttcactgatttgtaagaatgcttggacggtgacgtgcacagctgccttttggacccgcttgtaccgacgacactacacattggatgcaagtctgcccctgcggctacggcctgagtctatggaaaaactgcgatgcttgcgcgcgtgcgtgataaggtccctgtatcatatgtatgagcctttcgcagctcggatttccaaaaaccccgcgatcccagagtcaacaccaagtacgctaaaaaactcaaagtgcctcctgttctggtgcaggaagatagtcggtaataggcaggagcccatgtgggaatttaattttaagttcaagaagcagagcccaagattgaagtctaagtgcaccggaggcctacagcctcccgtgcagtatgaggatgtacatactaatcccgaccaggactgctgccttctccaggtgactaccctcaattttatttttatcccaatagtcatggggatgattttcaccctgtttactatcaatgtgagcaccgatatgagacaccaccgagtgcgtcttgtgtttcaagatagccccgtgcacggcggaaggaaattaaggagcgaacagggagtgcaggttatcttggaccctgtccacagcgtgagacttttcgattggtggcatccacagtacccatttagcctccgcgcatag

SEQ ID NO: 47311 - DNA, 1242 bp, Artificial Sequence
  Description of Artificial Sequence: Synthetic coding sequence
atgagcaacgtgagcggcatcctggagaccgccggcgtgcccctggtgagcgccaactggccacagccctcccccccccccgctgtcccagccggaccacagatggaccacatgggaaattctagtcaaggagccccatggttgttccttacatctgctcttgccagaggggttagcggaatctttgtatggacagccctggtacttacttgccaccagatctacttgcacttaagatcttacactgttcctcaggaacagaggtatattatcagactcttacttatcgtgcccatttatgcttttgacagttggctgtcactgttattgctaggcgaccatcagtactacgtttatttcgactctgtgagggattgttatgaggcttttgttatctactcctttctctccctttgttttcagtatctggggggcgagggcgccattatggctgagatccgaggcaagccgattaagtcctcctgtctctatggtacatgttgtctcaggggaatgacgtactccattggattcctgcggttttgtaagcaggccacgttgcagttctgcttggtaaagccagtgatggctgtgactaccatcattctgcaggctttcggaaaataccacgatggtgactttaacgtacgctccgggtacctctatgtgacacttatctacaacgccagcgtgtctctagccttgtatgccctcttcctgttttacttcactaccagagaactgcttagaccgttccagccagttctcaagttcctcacaattaaagcagtaatcttcctttctttctggcagggtttgctcctggctattctggaaaggtgcggagtgatcccggaagtcgaaacatccggcgggaacaaattgggcgcaggaacactggccgctggataccagaattttattatctgcgtggagatgctctttgcttctgtggcactccgatatgcatttccgtgccaggtgtacgccgaaaaaaaagaaaacagccccgcccccccagctcctatgcagtctatctcttccggcataagggaaacagttagtccacaggatatcgttcaggacgcaatacataacttttcacccgcttatcagcattacacacagcaggcgacgcacgaagccccacgcccaggaacccacccttccggtggaagtggcggctccagaaagtccagaagtctagagaagcgaatgctgataccctccgaggatctctag

SEQ ID NO: 47312 - DNA, 528 bp, Artificial Sequence
  Description of Artificial Sequence: Synthetic coding sequence
atgagcaacgtgagcggcatcctggagaccgccggcgtgcccctggtctctgccaactggccgcaaccaagcccccctcctgcagtacccgccggaccgcagatggaccacatggggaactccagtcagggggcgccctggttgttcttgacgtccgcgcttgcaagaggcgtttcgggcatcttcgtttggacagctttggtcttgacttgccaccagatctacctacacctgcggagctacaccgtcccccaagagcagaggtacatcatacggctgctgcttatcgttcctatttacgctttcgatagctggctttccctgctgctgcttggtgaccaccagtactacgtgtatttcgattctgttcgggactgttatgaggctttcgtgatctactcgttcctctctctgtgttttcagtacctgggcggggaaggtgctatcatggccgagatcagaggtaagccaatcaagtcctcgtgtctctatggaacctgttgtcttagggggatgacctactcatag

SEQ ID NO: 47313 - DNA, 420 bp, Artificial Sequence
  Description of Artificial Sequence: Synthetic coding sequence
atgagcaacgtgagcggcatcctggagaccgccggcgtgcccctggtgagcgctaattggccgcaaccatccccacctcccgctgtgccagccggcccacagatggaccacatgggaaactctagccagggcgcaccctggctgtttttaacatcagccctggcacggggggtttcagggatctttgtttggactgccctggtgctgacgtgtcaccagatttaccttcacctccgcagctacaccgtcccccaagagcagaggtatataatccgccttctcctgatagtccccatctatgcgtttgacagttggctgtccttattattgctcggggatcaccagtattatgtgtatttcgattcagtcagggactgttacgaggcgttcgtgatctatagcttcctgagcctgtgctag

SEQ ID NO: 47314 - DNA, 477 bp, Artificial Sequence
  Description of Artificial Sequence: Synthetic coding sequence
atgagcaacgtgagcggcatcctggagaccgccggcgtgcccctggtcagtgcaaattggccccagcccagtcccccaccagctgtgcctgccggccctcagatggatcatatgggtaacagttctcagggggcaccatggctgttcctcaccagcgctctggcaaggggcgtgagtggaattttcgtatggacagctttggtgctcacctgtcaccaaatctaccttcaccttagatcctacacagtccctcaggaacagcgatatatcattcgcctgctgctgatagtgcctatttacgcctttgattcctggctctccctgctgttgttgggagatcaccaatactacgtgtattttgactccgtgagagattgctacgaagcatttgttatctattcctttctctccttgtgctttcaatatctcggaggagaaggagcgattatggctgagatccgcggcaagcccatatag

SEQ ID NO: 47315 - DNA, 1224 bp, Artificial Sequence
  Description of Artificial Sequence: Synthetic coding sequence
atgaccgtgcggggcgacgtgctggcccccgaccccgccagccccactacggcagccgcaagccccagcgtttcagtcatccccgaggggtcccccactgccatggaacaaccagtgtttctaatgactaccgccgcacaggccattagtggcttctttgtatggacggccctcttaatcacttgtcaccagatttacatgcacctcagatgttactcatgtccaaacgagcagaggtatatcgtaagaatcttattcatcgtgcccatctacgctttcgacagctggctgtctctgctctttttcacaaacgatcagtattacgtgtattttggaaccgtgcgggattgttatgaggcactggtgatctacaacttcctttcactgtgttatgaataccttggcggggagtcaagtataatgtccgagatccggggcaaacctattgagagcagttgcatgtacggtacatgttgtctttggggcaaaacttactctatcggctttctacggttctgtaagcaagcaactctacagttctgcgtggtgaaacctctgatggccgtgagtaccgtggtccttcaagcatttggaaagtacagagacggagattttgatgtgaccagcggctatctgtatgtgactatcatatacaatattagcgtgtctctggccctgtatgctctttttttattctatttcgctacacgggagcttctctcaccctacagcccggtgctgaaattttttatggtcaagtctgtgattttcctctctttttggcaaggcatgctcctggccatccttgagaaatgcggggctatccccaagatccattcagctcgcgttagtgtaggcgagggaaccgttgcagctggttaccaggatttcattatctgcgttgaaatgttctttgccgctctggctcttagacacgccttcacctataaggtctacgccgacaagcgactcgatgcccagggacggtgcgcgcccatgaagtccatcagttcatccctgaaagaaaccatgaatccccacgacattgtgcaggacgcaattcacaatttttcccccgcataccagcaatacacccaacagagcacactcgaacctggccccacctggaggggtggggcccatgggctgtcccggagccactctctcagcggcgccagagacaacgagaaaaccttactgctaagtagcgacgacgagttctag

SEQ ID NO: 47316 - DNA, 1224 bp, Artificial Sequence
  Description of Artificial Sequence: Synthetic coding sequence
atgaccgtgcggggcgacgtgctggcccccgaccccgccagccccacaacagctgccgctagtcctagcgtgagcgtgatcccagagggcagccccacagctatggagcagccagtgtttcttatgactacagccgcccaggcaatctcaggcttcttcgtctggactgcactgcttatcacgtgccaccagatctatatgcacctgcgttgctactcttgtccaaatgaacagaggtatatagtgagaattcttttcattgtacctatttacgctttcgattcttggctctcactgctattcttcactaacgaccagtactacgtgtactttgggacagttcgggactgctacgaagcactggtgatctacaacttcttgtctctctgttacgagtatctgggcggcgaaagcagtataatgagtgagatacgaggaaaaccaatagagagctcatgcatgtatggtacatgctgcctgtggggtaaaacatattctattggcttcttacggttctgcaaacaggccacgctccaattttgtgtggtgaaacctcttatggccgtctccactgtcgtcctacaagctttcggcaaatatcgtgatggtgattttgacgtgacctccggctatttatatgtgactatcatctataatatttcagtctcattagccctgtatgctctgtttctgttctattttgccacgcgggagttgctgtccccatactccccagtgctaaaatttttcatggttaagtccgtaatttttctgagcttttggcagggcatgctgctggccatcctggagaagtgcggcgctattccgaaaattcactccgcacgggtaagcgtcggagagggcactgtagccgccgggtaccaggactttattatttgcgtggaaatgtttttcgctgctctggccctacggcacgccttcacttataaagtttacgccgacaaacgcctagatgcacagggaagatgcgcaccaatgaagagcatcagctccagtctgaaggagaccatgaacccgcatgatattgttcaagacgccatccacaacttcagtccagcctaccagcagtacacccaacagagcacattagagcctggacccacttggcggggcggagctcacgggctgtcccgatcccactccctgtctggagcgagggataatgaaaagactctcctcctcagctctgatgatgaattctag

SEQ ID NO: 47317 - DNA, 420 bp, Artificial Sequence
  Description of Artificial Sequence: Synthetic coding sequence
atgcacctgcggtgctacagctgccccaacgagcagcggtacatcgttcgaatactgttcattgttccaatttatgcctttgattcatggctgagcctcttatttttcactaacgatcagtactacgtgtacttcggtacagttcgggattgctacgaggctctggtgatatataatttcctcagtctctgttacgagtatttgggaggcgaatcttcaatcatgagcgagatccggggaaagcccatcgagtcttcctgtatgtacggcacttgctgcctgtggggcaagacctattcaatcgggttcctgcgcttctgtaagcaagccacactgcagttctgtgtcgtgaagcctctcatggcagttagcaccgttgtgttacaggcatttggcaagtaccgcgatggtgacttttag

SEQ ID NO: 47318 - DNA, 219 bp, Artificial Sequence
  Description of Artificial Sequence: Synthetic coding sequence
atgaccgtgcggggcgacgtgctggcccccgaccccgccagccccacaactgccgcggcatccccttccgtgagtgtcatcccagaaggttccccaacagctatggaacagccggtcttcctcatgaccaccgccgcacaggctatttcaggcttttttgtatggaccgccctcttgattacttgtcaccaaccccgggctcgactaggtcaagtatag

SEQ ID NO: 47319 - DNA, 1053 bp, Artificial Sequence
  Description of Artificial Sequence: Synthetic coding sequence
atgaacccccggggcctgttccaggacttcaaccccagcaagttcctcatctacacgtgtttgctgctttttagcgtgctattgcctctcaggcttgatggtattatacagtggagctattgggctgtctttgccccaatatggttgtggaagctgctagtcgtggcaggggcaagcgtcggtgcgggtgtgtgggctcggaacccccgttaccggaccgagggagaagcttgtgttgagtttaaagctatgctcatcgccgtcggcattcatctcctcctgctgatgttcgaggtgctggtgtgcgaccgagttgagaggggcacccacttctggctcctggtctttatgcctctcttctttgtgtcccctgtatcagtagccgcctgtgtttggggcttcaggcacgacaggagtcttgagctggaaattctgtgttctgtgaatattctccagtttatcttcatagcactcaaactcgatcggatcattcactggccctggctggtcgtctttgttccattatggatccttatgagctttctttgtctggtggtgctgtactacatagtttggtcactgctcttcctgcgatctttggacgttgtggccgaacaacgacgtacccacgtgaccatggctatctcttggatcactattgtggtccctctcctaacatttgaagttttgttggtgcatcggctggacgggcataacacgttttcctacgtgagtatcttcgtgccgctttggctttcattgctgaccttaatggccaccacctttcggaggaagggcgggaatcattggtggttcgggattagaagagatttctgccaatttctgctcgaaattttcccctttctgcgggagtacgggaacatctcatatgatttacaccatgaggactccgaggatgctgaggaaacatccgtgcccgaggcccctaagatagcacctatatttggcaaaaaggccagagtcgtgatcacccaatctccaggcaaatacgtccctcctcctcccaaattaaacatagacatgcctgactag

SEQ ID NO: 47320 - DNA, 642 bp, Artificial Sequence
  Description of Artificial Sequence: Synthetic coding sequence
atggccgccctgctgcgggccgtgcggcggttccggggcaaggccgtctgggagaggccactccacggactctggtgctgttctggccaggaggatcccaagagatgggtcggttctagctcacctattagtaaagaaaaactgccaaacgccgaaacggaaaagttctggatgttctacagatttgacgctatcagaacctttgggtttctctcccggctcaagctcgcccaaacggccctgaccgtggtcgcccttccaccaggctactacctatactcgcagggcttattaacacttaacactgtttgtttaatgtcaggaatctctggctttgcattgaccatgctgtgctggatgtcttatttcttacgccgactggtggggatcctgtatctaaatgagtccggcactatgcttcgcgtcgcgcatctcaacttctgggggtggcgacaggacacatattgtcctatggctgatgtcattcctttgactgaaaccaaggatcgtcctcaagaaatgttcgtgcgtatccaacgatacagcggcaagcagaccttctacgtcaccctgcgatacggccggatcctagacagggagaggtttactcaggtgtttggtgttcaccaaatgttgaaatag

SEQ ID NO: 47321 - DNA, 786 bp, Artificial Sequence
  Description of Artificial Sequence: Synthetic coding sequence
atgaaccccgagtggggccaggccttcgtgcacgtggccgtggccgggggcctctgtgcagttgcagtgttcacgggtattttcgacagcgtgtcggtgcaggttgggtatgagcactatgctgaggcaccagttgccgggctgcccgcattcctggcaatgccttttaattctctggtgaatatggcctataccctgcttggcctcagttggctgcaccggggcggggcgatgggcctcggccctcggtacctgaaagatgtgttcgctgccatggccttgctgtatggtcctgtacagtggctccgtctctggacccagtggcggcgggccgccgtacttgaccagtggctgactctgcctatcttcgcttggcccgtggcatggtgtttgtatttggatcgtggatggcggccttggctgttcctgagtctcgagtgtgtgtcccttgctagctatggcctggccctcttgcatccacaggggtttgaagtggcactgggcgctcatgtggtcgctgcagtgggacaggccctgaggacacatcggcactacggttctaccacttcggctacttacctggcgctgggcgtgctcagctgccttgggtttgtcgttctcaagctgtgcgatcatcagctggcccggtggcgactgttccagtgtctgacaggacacttctggtcaaaggtgtgcgatgtgttgcagttccattttgcttttctgtttctaacccatttcaatactcatccccgattccaccccagtggcgggaagacccgctag

SEQ ID NO: 47322 - DNA, 201 bp, Artificial Sequence
  Description of Artificial Sequence: Synthetic coding sequence
atgaaccccgagtggggccaggccttcgtgcacgtggccgtggccggtggcctttgtgccgttgctgtgtttacagggatattcgacagcgtctccgtgcaggtcggctacgagcactatgcagaagcccccgtggccgggctgcctgccttcctggctatgcctttcaacagcctcgtgaacatggcatatactttgtag

SEQ ID NO: 47323 - DNA, 102 bp, Artificial Sequence
  Description of Artificial Sequence: Synthetic coding sequence
atgaaccccgagtggggccaggccttcgtgcacgtggccgtggccggcggtctgtgtgccgtggccgtgttcacaggaatattcgattccgtcagtgtttag

SEQ ID NO: 47324 - DNA, 144 bp, Artificial Sequence
  Description of Artificial Sequence: Synthetic coding sequence
atgaacagcctggagcaggccgaggacctgaaggccttcgagcggcgcctaaccgaatacattcactgcctccagcctgctacaggccgctggcggtccgtcctgctgcacatcatcatggaaagtccgattttccatcattag

SEQ ID NO: 47325 - DNA, 378 bp, Artificial Sequence
  Description of Artificial Sequence: Synthetic coding sequence
atgaacagcctggagcaggccgaggacctgaaggccttcgagcggcgtcttacagagtacatacattgcttgcaacctgctaccgggaggtggcggatgttgctcatcgtagtctcagtttgcacggcgacaggcgcttggaactggctgatcgatccagaaacccagaaggtcagcttcttcacctctttatggaaccatccgttcttcacaatttcatgtattacccttataggactcttcttcgccggaatacataaaagagttgtcgctccttcaatcatcgccgcacgttgccgcacagtactggccgaatacaacatgtcatgtgatgatacaggaaaattaattctgaagcctcggccccatgtgcagtag

SEQ ID NO: 47326 - DNA, 429 bp, Artificial Sequence
  Description of Artificial Sequence: Synthetic coding sequence
atgaacagcctggagcaggccgaggccccccgggtggtgagcctgatcccggccgtggtgagcgggaattgccaggatctgaaggctttcgaacgccgactgactgaatacatacattgcctgcaacctgctaccggccgctggagaatgcttctgatcgtggtgtctgtttgtacagccaccggagcttggaactggttgattgacccagagacacagaaggtgtcattctttacatctctgtggaaccacccgtttttcaccatatcgtgtattacattgatcggactgttctttgccggcattcacaaaagagtagtcgctccctccattatagccgcccgttgtcgaactgtgctggcagagtataacatgtcatgtgacgataccggtaaacttattctgaagccccgacctcacgtgcagtag

SEQ ID NO: 47327 - DNA, 804 bp, Artificial Sequence
  Description of Artificial Sequence: Synthetic coding sequence
atggccggcgccgagaactggcccggccagcagctggagctggacgaggatgaggcgtcttgctgccggtggggtgcacagcatgctggcgcccgagaactcgcagctctctactctcctggaaaaagattgcaggagtggtgcagtgtcattctttgtttctctctgattgctcacaatctggtgcacttgttattgcttgctcgctgggaggacacacccctggtgatcctgggggttgtggctggggctctgattgctgacttcctttccggtctggtgcattggggagccgatacctgggggtccgtagaactgcccatcgctttcatccgaccttttcgcgagcatcacatagaccccactgcaattacgcgccacgactttatcgagaccaacggagacaactgtttagtgacactgttacccctgctgaacatggcctataaattcagaacacactcccccgaggcactggaacaactctatccttgggaatgttttgttttttgtttaatcatatttggcacgttcaccaatcagatccacaagtggtctcacacctattttggcctgccccgctgggtgacacttctgcaggactggcacgtaatattaccccgcaagcatcatcgaatccaccacgtgagccctcatgaaacgtatttctgtattaccactggctggctaaactatccactcgaaaaaatcgggttttggagaagactcgaagacttgatccaggggctgaccggagagaagccccgggctgacgatatgaaatgggcacagaagataaagtag

SEQ ID NO: 47328 - DNA, 813 bp, Artificial Sequence
  Description of Artificial Sequence: Synthetic coding sequence
atggccggcgccgagaactggcccggccagcagctggagctggacgaagatgaggcttcctgctgccggtggggtgctcagcacgcgggggccagggagctggctgctctgtattcccccggcaaaagactgcaggaatggtgttcggtcatcctctgtttctctcttatagctcacaacctggtgcacctgctgctgcttgcccggtgggaagacacccccttggtaatcctgggtgttgtggctggcgcactgattgccgacttcctgagcggcctggtgcattggggcgccgatacatggggctccgtagaactgcctatcgtcgggaaggcttttatccggcctttccgtgaacaccacatcgatcccacagccataaccagacacgattttatagagacaaatggcgacaactgtctggtcacactcctgcccctcctcaacatggcttataagtttcgcactcactccccagaagcccttgaacagctgtacccgtgggaatgctttgtgttctgtctgataatttttggaacctttaccaatcagatccacaagtggagccatacctactttggccttccccgctgggtcaccctcctccaagactggcacgtgattctgccccggaagcatcatcgaatccaccacgtctctccacacgaaacatacttttgcattaccactggatggctgaattatcccctagagaagatcggcttctggagacgacttgaagacctgattcagggtttgactggcgagaaaccacgagcagatgacatgaaatgggcacaaaaaatcaagtag

SEQ ID NO: 47329 - DNA, 588 bp, Artificial Sequence
  Description of Artificial Sequence: Synthetic coding sequence
atgaacgagcgggccatcgccggcgccctgatcgccgacttcctgtctggcctagttcactggggtgctgatacatggggtagtgtggaactgccgatcgtgggcaaggcgttcatccgccctttcagagagcaccatattgatcctactgctatcacacgccacgattttatcgagactaacggcgacaattgcttggtaacccttctccccctgctcaatatggcgtataagttcaggacacacagccccgaggctctagagcagctgtacccatgggagtgctttgtcttttgcttgatcatcttcggcacatttacaaaccagatccataaatggtctcacacctactttggcctgcccaggtgggtcactctgttacaagattggcacgtcatacttcctcgcaagcatcataggattcatcatgtgtctccccatgaaacatatttttgcattaccacagggtggttgaattaccctcttgaaaagatcggattctggcgccgcctcgaggatctgatccaaggactcacgggcgagaagccccgcgccgacgacatgaagtgggcccagaagattaaatag

SEQ ID NO: 47330 - DNA, 1113 bp, Artificial Sequence
  Description of Artificial Sequence: Synthetic coding sequence
atggccggcgccgagaactggcccggccagcagctggagctggacgaggacgaggcatcttgttgtagatggggagcccaacatgctggcgcaagggaactggccgccctgtactctcctggcaaacgcctgcaagagtggtgttccgtaattctgtgcttctcactcatcgcacataatctagtgcacttgttgctgctcgccaggtgggaggacactcctctggtaatcttgggcgttgttgcaggcgccctcattgccgatttcctgtcgggtctggtccactggggagctgacacgtggggaagtgtcgaattgcctatagtgggcaaggccttcattcgcccattcagagagcaccatatcgaccctaccgccatcactcgacatgattttatcgaaacaaacggcgataactgtctggtaaccctgctgccactgcttaacatggcgtacaagttccggacccacagccccgaggccttggagcagttgtacccatgggagtgctttgtgttctgcctaatcatatttggcacatttactaatcagatccataaatggtcgcacacttactttggactccccagatgggttacattactccaagattggcatgtcatcctgccacggaagcaccacaggatccaccatgtaagcccccatgagacatacttctgcattacgaccggggtgaaggtgccgagaaacttcagactgctagaagaattagaagaaggacagaagggagttggcgatggaacagttagctggggactagaggacgacgaagacatgactctgacgagatggacaggcatgattataggacctccccggacaatttatgaaaatagaatttactctctgaaaatagaatgtgggcctaagtaccccgaagcacctccctttgtacgctttgtaacaaaaatcaacatgaacggtgtcaactcctccaacggagttgtggacccaagggccatctctgttctggccaaatggcagaactcatattcgatcaaggtggttctccaggagctgcgcaggttgatgatgagcaaggagaatatgaaactgccgcagcctccagaagggcaatgttactcgaactag

SEQ ID NO: 47331 - DNA, 1011 bp, Artificial Sequence
  Description of Artificial Sequence: Synthetic coding sequence
atgaccgacctgaacgacaacatctgcaagcggtacatcaagatgataactaacatcgttattctgtccttaattatttgcatttctctcgcattctggattattagcatgactgcgtccacatactacgggaatctgcgtcctatctctccttggagatggctgttcagcgtggtcgtgccggtgttaattgtcagtaacggattgaaaaagaaatcacttgatcattctggagcattgggtggactggtggtgggatttattctgaccattgccaacttcagctttttcacctccttgctcatgttcttcctgtcgagttctaagctgaccaaatggaaaggtgaagtgaaaaagaggctcgactctgagtataaagagggcggccagaggaattgggtccaggtattctgtaacggcgcggttcctactgaactggcattactgtatatgatcgagaacggccctggagagatacctgtggacttcagcaaacagtactccgccagctggatgtgtttatccttgcttgccgccctggcatgtagtgcaggcgatacatgggctagcgaagttggcccagtgctgtcaaagtcaagtccacggctgataactacatgggagaaggtgccagtgggcaccaacgggggggtgaccgtcgtgggcctggtgtcgagcctgctcggaggaaccttcgtgggaatagcctatttcctcacacagcttatcttcgtgaatgatctggacatttcagccccgcagtggccgatcattgcttttgggggactggcaggtctgctcggctcaattgtcgatagctatctgggtgcgactatgcagtatacagggcttgacgagtccaccgggatggtcgtgaattcaccgaccaataaagcacgtcatattgccggcaagcccattctggataacaacgcagtaaacctgttttccagtgttctcattgcactgctactgccgaccgcggcttggggattttggcctcgcgggtag

SEQ ID NO: 47332 - DNA, 1011 bp, Artificial Sequence
  Description of Artificial Sequence: Synthetic coding sequence
atgaccgacctgaacgacaacatctgcaagcggtacatcaagatgatcacaaatattgtgatcctgagcctgattatctgtatctccctggcattctggattattagtatgaccgcatccacctactatggtaacctccgtcccatttccccttggagatggctgttctccgtggtcgtgcccgtcttaatagtgagcaacgggctaaaaaagaagtcgctcgaccactccggagcgctggggggcttggtcgttgggttcattctcactattgccaacttcagcttttttacatccttactgatgttctttctgtcaagcagtaagttgacgaagtggaagggcgaagtgaaaaagagacttgattctgagtataaggagggcggacagaggaattgggtccaggtgttctgcaacggtgccgtgcctactgaacttgcactgctgtatatgattgagaacgggccaggcgaaattcctgtggacttctccaagcaatattcggcatcctggatgtgtttaagccttcttgcagcacttgcttgtagcgctggcgacacgtgggcctcagaagtgggtccagttctcagcaaatcatccccacggctgatcacaacctgggaaaaggtgccagttggaactaacggcggggtgaccgtagtcggtctggtttcttctttgctgggaggcaccttcgttggcatcgcctactttttgacacaactcatttttgtcaacgatctggacatcagcgctccccaatggcctattattgctttcggcggccttgcaggactgctgggctccatagttgattcctatttgggagccacaatgcaatatacaggcttggacgagagtacaggcatggtggtcaactccccaaccaataaagcccgccatattgccggaaagccaatcctggacaataacgccgttaatctgttcagcagcgtcctcatcgcgctgttgctgcctacagccgcatggggcttttggccccgcggatag

SEQ ID NO: 47333 - DNA, 897 bp, Artificial Sequence
  Description of Artificial Sequence: Synthetic coding sequence
atgaccgacctgaacgacaacatctgcaagcggtacatcaagatgatcacgaatattgtcatcctctctctgataatctgcatttctctggccttttggattatttccatgactgcctccacatactatggcaatcttaggccaatttccccctggcggtggctgttttcagttgtagtccccgtgttgatcgtgagcaatgggctgaagaagaaatctttagatcactccggtgctttaggcggtttggttgtgggattcattcttacgatcgctaacttctccttctttactagcctactgatgttctttttgagttcgtcaaagctaaccaagtggaaaggggaggtgaaaaaaaggcttgacagcgagtataaggaagggggacagaggaactgggtccaggttttttgcaacggcgcagtgccaacagagctggccctcctgtacatgatcgagaacggacctggggagatacctgtggactttagtaagcagtattcagcctcctggatgtgcttgagcctgctggcagcactggcttgcagtgccggcgacacatgggcgagcgaagttggaccagtactctccaaatcctcccccaggttgatcactacttgggagaaggtgccggtgggaaccaacgggggggtcaccgtagtcggcctggtgagcagtctgctgggggggacgtttgttggaattgcttatttcctcacccaactgatcttcgttaacgaccttgatatttcagctccgcaatggccaattatagcattcgggggccttgctggcctactgggcagtattgtggactcctacctaggcgccacgatgcaatatactggcaagaacatcccatctttccttcagttgatagggatgctgaaaaagtag

SEQ ID NO: 47334 - DNA, 513 bp, Artificial Sequence
  Description of Artificial Sequence: Synthetic coding sequence
atgaccgacctgaacgacaacatctgcaagcggtacatcaagatgatcaccaacattgtgattctttcgctgatcatctgtatcagcctggcgttttggatcatctctatgacagccagcacatattacggaaaccttaggcctatctcaccctggcggtggctgttctccgtggttgtccccgtgctcattgtttcaaacggcctgaagaagaaaagtctggatcactcgggagccctcggcgggctcgtggtcggattcatattgaccatcgcaaatttctcgttttttacgagccttctaatgttcttcctctcgtcaagcaagctgacaaagtggaagggcgaggttaagaagagactggactcggagtacaaggagggggggcagcgcaactgggtccaagtgttctgcaatggcgccgtgccaacagagctcgcattgttgtacatgattgagaacggacccggagagattccagtcgatttctcaaaacagtattcagcttcttag

SEQ ID NO: 47335 - DNA, 459 bp, Artificial Sequence
  Description of Artificial Sequence: Synthetic coding sequence
tgagacacctgggccagcgaggtgggccccgtgctgagcaagagctctccccggctgataactacctgggaaaaggttcccgtcggaaccaacgggggagtgaccgtggttggcctggtgtctagcttactgggcgggactttcgttggtatcgcctacttcctgacgcaactgatcttcgttaacgatttagatatttcagcaccgcaatggcccattatcgcattcggcggtttggccgggctcctaggcagtatcgtggacagttatttaggcgccaccatgcagtatacaggcttggacgaaagtactggcatggtggtgaattcaccgactaataaggcccgccacatagccggcaaacccatacttgataacaacgccgttaaccttttctcttccgtccttattgcattacttctgcctaccgccgcatgggggttctggccccgcggttag

SEQ ID NO: 47336 - DNA, 534 bp, Artificial Sequence
  Description of Artificial Sequence: Synthetic coding sequence
atgctgggctgcggcatccccgccctgggcctgctgctgctgctgcagggctctgccgatggcaatggaatacaagggtttttctacccctggagttgcgagggtgacatctgggaccgggaatcttgtggaggccaggccgctattgatagccccaacctctgcctgaggctgagatgctgttatcgcaatggcgtatgctaccaccaacggcctgacgaaaatgtcaggcgcaaacacatgtgggctctggtgtggacgtgttcaggactcctactgctgtcatgttctatctgtctgttctggtgggcgaagcgcagagacgtgctgcacatgcctggctttctcgccggcccgtgcgacatgtctaagtccgtctctctgcttagtaagcacagaggaactaaaaagacacctagtacgggaagcgtcccagtggcattgagcaaggaatctagggatgtcgagggcgggacagaaggggagggcactgaggagggcgaggagacagaaggagaggaggaagaggattag

SEQ ID NO: 47337 - DNA, 816 bp, Artificial Sequence
  Description of Artificial Sequence: Synthetic coding sequence
atggccgccggcggccggatggaggacggcagcctggacatcacccagagcatcgaagacgatccactcctggatgctcagttacttccccaccactctctgcaggctcacttccgtcctcgtttccatccattgcccactgtgattatagtgaacttgctgtggttcatacacctggtatttgtggtgctggcttttctcaccggagtcctgtgctcttacccgaatccgaatgaggataagtgtcctggaaattacactaacccgttaaaagtgcagactgtgattattctcggaaaagtaatcttgtggatccttcatctgctactcgaatgctacatccagtatcatcacagtaagatcaggaaccgcggctacaacctcatttaccgctctacccgccacctcaagaggctcgcactgatgattcagagctccggtaacaccgtgctattgcttatcctctgcatgcagcattcgtttccagagcctggaagactatacctggacctaatcttagcaattctagctctggaactcatctgctccctgatctgtcttctgatctacaccgtcaaaattagacgctttaacaaagccaagcctgagcccgatatcttggaagaggagaaaatatacgcctaccctagtaacattacttcagaaactggattcagaaccatctcaagtctggaagagatcgtagaaaagcaaggtgataccatagaatatctgaaacggcataacgcactgctcagcaagcgcctgttggccctgacttctagcgacctcggttgccagccaagccgaacctag

SEQ ID NO: 47338 - DNA, 804 bp, Artificial Sequence
  Description of Artificial Sequence: Synthetic coding sequence
atgaacaaggccaccggcagcctggacatcacccagagcatcgaggacgaccccctcctagatgctcaactcttgccccaccactccctccaagctcactttcgacccagatttcacccgttacctaccgtgataatcgtaaatctcctctggtttattcatctcgtatttgttgtacttgcatttctgacaggtgtcttgtgtagttacccgaatcccaacgaggacaagtgcccagggaattataccaatcctctaaaggttcaaaccgtgatcatactcgggaaagtgatactgtggatcctgcacttgttgctggaatgttatattcagtatcaccacagcaagattcgaaatagggggtataatctcatataccgtagcactcgccatcttaaacgactcgctttgatgatccagagttccgggaatactgtgttattgcttatattgtgtatgcagcattcttttcctgaaccgggtcgtctgtatcttgacctaattctggctatcctggccctggaactcatatgtagtcttatttgtctgttgatttataccgtcaaaatacgccgtttcaataaggccaagccagaaccagacatcctcgaagaggagaaaatctacgcgtatccgtcaaacataacttctgagaccgggttccgaactatttctagtctggaagaaatcgtggagaaacagggcgataccatcgagtatcttaaacgacacaatgccctgttgtctaagcggctactcgctctgacctctagtgatctggggtgccagcctagcaggacttag

SEQ ID NO: 47339 - DNA, 1335 bp, Artificial Sequence
  Description of Artificial Sequence: Synthetic coding sequence
atggccggcggcatgaaggtggccgtgagccccgccgtgggccccggaccatggggatcaggagtgggaggcggcggtaccgtaaggttactgctgatccttagtgggtgtctggtgtatgggaccgctgagactgacgtcaatgttgttatgcttcaggaatcacaggtgtgcgaaaagcgggcctcccagcaattttgctacacaaacgtactcattccaaagtggcacgatatttggacacggatccaaatccgggttaacagcagccggctcgtgcgggtgactcaagtagagaatgaggagaaattaaaggagctggaacagttctctatttggaacttcttttcatcttttttgaaagagaagttgaacgatacctacgtgaatgtgggactgtactcaacaaagacgtgcctcaaggttgagatcatcgagaaagatacaaaatactcggtcatagtgattaggaggttcgatcctaagctttttttagtgttcctgcttggactaatgctgtttttttgtggcgacttgttgtcccgcagtcaaattttttattactcgactggcatgaccgtgggcatcgttgcctctctactcatcattatctttatcctgtcgaagtttatgcccaagaagagcccaatttacgttatccttgtgggcggttggtccttttcactttatctgatacagctggttttcaagaatctacaggaaatttggagatgctactggcagtaccttctgtcttatgtacttaccgtgggctttatgagctttgccgtctgctacaagtacggtccactggaaaacgaacgcagtattaatttactgacttggacactgcagctaatggggctctgtttcatgtacagcgggatccagatcccgcacatagccctcgcaataatcatcatcgcgttgtgtactaaaaatttggagcaccctatccagtggctatacatcacatgcagaaaggtttgtaagggagccgaaaagccagtccccccgcgcttgttgactgaggaggagtatcgcattcagggcgaggtggagacccggaaagctctggaggaactacgagaattctgtaactccccggactgttccgcttggaaaaccgtctcccggatacagtcacctaaacgattcgctgacttcgtggaagggtccagccatctgacaccaaacgaggtgagcgtccatgagcaagaatatgggctgggtagtattatcgcacaagacgaaatatatgaggaggcctcctcagaggaagaggatagctatagtaggtgcccagctatcacgcagaataattttcttacctag

SEQ ID NO: 47340 - DNA, 1116 bp, Artificial Sequence
  Description of Artificial Sequence: Synthetic coding sequence
atggccggcggcatgaaggtggccgtgagccccgccgtgggccccgggccgtggggttcaggcgttggagggggaggaacggtaaggctgcttcttattctgagtgggtgtttggtctatggtacggccgagacagacgttaacgtggtaatgctgcaggagtctcaggtatgtgagaagagagctagtcagcagttttgctatacgaacgttctgataccgaaatggcacgacatctggaccagaatccaaatccgagtgaactcctctcgtctagtcagagtaacccaagtggagaacgaggaaaaactcaaggaactcgagcaatcccagatcttctactactctacaggaatgaccgttggcattgtcgcctccttgctcatcattatctttatactgtccaagttcatgcctaaaaaatcccccatctatgtgatactggttgggggctggtccttctccctgtacctcatccaactcgttttcaaaaatctgcaagagatctggagatgctactggcagtacttattgtcatacgtgctgaccgttggctttatgagtttcgccgtctgttataaatacggcccactagagaatgagcgttctataaacctgctgacatggaccctgcaattgatggggctatgcttcatgtattccgggattcaaatcccccatatcgctttagcgattataattatagcactgtgtaccaagaatttggagcatcctattcaatggctctatattacgtgtcggaaagtttgtaaaggggccgagaagccggttccacctagactattgacagaggaggagtacaggatccagggcgaggtcgagaccaggaaggctcttgaagagctccgggaattctgcaattctccggattgttctgcctggaaaacagtttccaggatacagagcccaaaaaggttcgctgacttcgtcgagggttcctctcatctgacccccaacgaggtctctgtgcatgagcaggaatacggccttggaagtatcattgcccaggatgaaatatatgaggaggcgagctcggaagaggaagactcctacagccgatgtccggccattacacagaacaacttcctcacctag

SEQ ID NO: 47341 - DNA, 519 bp, Artificial Sequence
  Description of Artificial Sequence: Synthetic coding sequence
atgtgcaccagcggccagatcatcggcagcctgctggtgctgagcgtactggagataggattaggcgtatcttcggtggctgtgggcgcagtgtcattctcgctggcattgagagagcataagccccagctgggggattctagtccctttctactttgtggcatatgcggcatcctgtgcgctaagaagaagtctggcctggtgatgatacttttcagcgcatgttgcatatgcggcctaatcggcggcatactcaactttcagttcctgcgagccgtgacaaagaagacaagctcactgtatcctctgcaccttgcgagcatgtcacttgcctgcatcgggatcgggggatgtacgctgtcttcatggctgacatgtaggctggcctcttacgaacaacggcgaatgttttctgaacgagaacactctcttcaccatagtcacgaaatggcagagaaggagattaccgacaacatgagtaatggagggccacagctgatatttaacggcagggtgtag

SEQ ID NO: 47342 - DNA, 270 bp, Artificial Sequence
  Description of Artificial Sequence: Synthetic coding sequence
atgatcctgttcagcgcctgctgcatctgcggcctgatcggcggcattctcaattttcaatttctcagagcagttactaagaagacttccagcctgtaccctctccacttggcctcgatgtctctggcgtgtatcggcattgggggctgcaccttgagcagctggctgacatgtcggctggccagttatgagcagagaagaatgttttccgagcgcgagcattctctgcaccacagccatgagatggccgaaaagatagaggggtactag

SEQ ID NO: 47343 - DNA, 1083 bp, Artificial Sequence
  Description of Artificial Sequence: Synthetic coding sequence
atgcccggcaccgtggccaccctgcggttccagctgctgccccccgagccggatgacgcattctggggcgcaccatgcgaacagccattggagagaagatatcaggcactgcccgcactggtgtgtatcatgtgctgtctgtttggagtggtctactgtttcttcggatacaggtgctttaaggctgtgcttttcctgacaggcctcctctttggctccgtcgttatttttttgttgtgttatcgggaacgtgtgctagaaacgcagctttcagccggcgcgtctgccggcatcgcccttgggattgggcttctgtgtggtctagtcgcaatgctggttcgttccgtcgggctcttcctggtgggccttctgcttgggcttctgctggccgccgccgcattgcttggaagcgctccctattatcagcctggatctgtctgggggccactggggttgctgctaggcggcggcctgctgtgcgctctcttgaccttaaggtggccaagacccctcactactttggccacagcagtgactggagctgctcttattgcaaccgcggctgactactttgccgagctgttgttgttaggccgctatgtggtcgaacgtctgcgggccgcgcccgtgccacccctttgctggcggagctgggctctgctggcgttatggccactgctgtcccttatgggggtcctcgtacagtggagagtcacagcggagggtgactcccacactgaagtcgtgatctcacgccagaggcgacgggtgcaactgatgcgtatcagacaacaggaggataggaaggaaaagcgacgtaaaaaacgccctccgcgagcacctctgaggggaccaagggcccctccgaggccggggccaccagatccagcctaccggcgtagacccgtgccaataaaacggtttaacggggatgtcctaagcccctcctatattcaatctttccgtgataggcaaaccggaagctcgttgtcttcttttatggcatcccccaccgatgccgattacgagtatggcagtagaggacctctcaccgcatgctccggcccccccgtgcgcgtttag

SEQ ID NO: 47344 - DNA, 1083 bp, Artificial Sequence
  Description of Artificial Sequence: Synthetic coding sequence
atgcccggcaccgtggccaccctgcggttccagctgctgccccccgaacctgatgatgccttttggggcgcgccatgtgagcagcctcttgagcggcgctaccaggcgctgccggccctggtctgcatcatgtgttgtctctttggagtagtgtactgttttttcggataccgctgtttcaaggcagtgctctttttgactgggctgctgtttggctccgtggtcattttcttactctgctacagggagcgtgtgctcgaaactcaattgtccgccggtgcttccgctggcatcgctctcggcattgggctattatgtggtctcgtggctatgttggtgaggtccgtgggcctgttcctcgtgggccttcttttggggctgctgcttgccgcagcagctctcttggggagtgccccctactatcagccaggtagtgtctgggggccactgggactgttgttgggcggtggcctcctgtgcgccttgttaacgctgaggtggccgaggccgctcacaaccctcgcgaccgccgtgaccggggcagccttgatcgcaactgccgccgattattttgctgagttactcctcctaggccgttacgtggttgaacgcttacgtgcggctccggtgccacctttatgttggcgctcttgggccctgttagcactgtggccccttctctctttgatgggtgtcctggttcagtggcgagttacagcagagggggattctcatacagaagtggtcatctcacgccagcgccggcgagtgcagcttatgcgaattagacagcaggaagataggaaggaaaagcgcagaaaaaagaggccacccagggcacccctccgaggtccgagggcacccccaagacctggaccccccgatcccgcctatcgccggcgtccggtgcccataaaacgcttcaacggcgacgtgctatctccttcttatatacaatcatttcgtgaccgacagacggggtccagtttgagcagtttcatggcctcaccgactgatgcggactacgagtacggctcacgcggccccttaacggcatgttccggaccaccagtgagagtgtag

SEQ ID NO: 47345 - DNA, 684 bp, Artificial Sequence
  Description of Artificial Sequence: Synthetic coding sequence
atgcccggcaccgtggccaccctgcggttccagctgctgccccccgaacccgacgacgcattctggggggccccatgcgaacagccgcttgagagaaggtaccaggcgcttccggccctggtgtgtattatgtgttgtctgtttggagtggtgtactgtttttttggctaccgatgcttcaaagctgttctgtttctcaccggcctcctgtttgggagcgtcgtgatttttctgctttgctatcgagagcgcgtgctggagacacaactgtcagccggggcatcagccggcatagccttaggaatcggccttttgtgtggactggtggcaatgctggtgcggtctgtaggactgtttctggttggcctattactagggctgttgttggcagcagccgcgctgttggggtccgccccctactaccagccagggtcggtctggggacccctgggactccttctgggaggaggcctcctgtgtgccctgttaaccttacggtggccaaggcctctgacaactctggctacggcagtgaccggagctgctctgatcgcaacggcagctgactatttcgcagagctccttctgctgggccgctacgtggtggaacgattgcgggccgcccctgttcctccactgtgttggagatcctgggccctgttagctctgtggccattactgtag

SEQ ID NO: 47346 - DNA, 627 bp, Artificial Sequence
  Description of Artificial Sequence: Synthetic coding sequence
atggccagcagcctgctggccggcgagcggctggtgcgggccctgggacccggaggcgaactcgagcctgagagactcccgcgcaagttgcgagccgagctggaagcagccttgggaaagaagcacaagggtggtgacagctcgagcgggccccagaggttggtgtctttccgcctgatacgggacctgcaccagcacttaagggagagggattctaagctgtacttgcatgaactgctcgagggttctgaaatctacctacccgaggtagtgaagccccccagaaatcccgagttagttgcccgacttgagaagattaaaatccagttggccaatgaggagtacaaacgcatcactaggaacgtcacctgccaggatactcgccacggtggaactttgtccgatctcggaaagcaagtgagaagtctaaaggccctggtgatcaccatctttaacttcatcgttaccgtggtggcagcctttgtgtgtacatacctggggtcccagtatatcttcactgagatggcgtccagggtgcttgctgcactcatagtagcctctgttgttgggctagccgaactctacgtaatggtaagggcaatggagggggagctcggcgagctgtag

SEQ ID NO: 47347 - DNA, 900 bp, Artificial Sequence
  Description of Artificial Sequence: Synthetic coding sequence
atggccagcagcctgctggccggcgagcggctggtgcgggccctgggacctgggggtgagctggaaccagagcggctgcctcggaagctgagagctgagctggaagcggctctgggcaagaaacacaagggcggtgacagcagcagcggtccccaacggctggtgtcatttcggctcattcgggacctgcatcaacatcttcgggagagggattcaaaactttatttacacgaactcctggaggggagtgagatctatcttcccgaagtggtgaaaccacctcgaaatccagagttggtagccaggctggaaaaaatcaagatccagttggcaaacgaggagtataaaagaataactcggaacgtgacctgccaggacacgagacacggaggcaccttgtccgatctgggaaagcaagttcggtctcttaaggccctagtaattacaatctttaattttattgtgaccgttgtcgccgcttttgtatgtacttatctggggtcgcagtatatatttactgagatggcctcgcggcctaggggagcccattgggccggcagggatcccgagcctggcgaaggaacccgcacccgacgggccggcgccgagtgggtgagacatctgggggcgcacgtgcaggcgtttggaggcgatatgccggaggccggcggcggacgacgtcccggacgaggggctgtgctggtgccaccccacggccctcgtgcagctgcccctctgagggccggcgccggtcagctaagagccgccaggggccctggcggagccgccacacacggccgcgaggcccgcagcagggtcgccctcccggctcgcttattacagggcgggagggccgcctttgcagctaggctcccacggagctcaggagttggcgactag

SEQ ID NO: 47348 - DNA, 1476 bp, Artificial Sequence
  Description of Artificial Sequence: Synthetic coding sequence
atgatcgccaccggcggcgtgatcaccggcctggccgccctgaagcgccaagattccgcaaggtcccagcaacatgtcaacttgagcccatcacctgccactcaggaaaagaaacctataaggaggagacccagagcagacgtggtggtcgtgagaggcaaaattcgcctgtactcaccttccggctttttccttattctcggcgtacttatttcgattattgggatagctatggcggtcctcgggtattggccccaaaaagaacattttatcgacgccgaaaccacgttatccactaacgagacccaagttatccgaaacgaaggaggtgtcgtggtaagatttttcgagcagcatttgcactcagataagatgaagatgctgggcccattcaccatgggaatcggcattttcatcttcatttgcgcaaatgcaatactccacgagaaccgggacaaggaaactaagattatccacatgagagatatttactctaccgtgatcgacattcataccctcagaatcaaagaacagcggcaaatgaacgggatgtacaccggtctgatgggcgagaccgaggtcaaacaaaacgggtcatcttgcgcctctagattggccgcaaatacaatcgccagtttttccggattcagaagttcctttagaatggacagctctgttgaagaagacgagctgatgctcaatgagggcaagtcctccggtcatctgatgccacctcttctctctgattcatctgtgtccgtctttggcctgtacccaccgccctcaaagacgacagatgataaaactagcggctccaagaagtgtgaaactaagtcaattgtgtcatctagtatttcagcattcacactgcccgtaatcaaactgaacaattgcgtcatcgatgaaccctcaatcgataatattactgaggacgccgataatctgaaaagccgtagtcgcaacttgagcatggactctctggttgtccctctaccaaatacaagcgaatcctttcagcccgtgtccaccgtgttaccacggaataatagtataggggagtcgctctcctcccagtataaaagttccatggccctgggtcctggcgccggccagctgttatctcccggggctgctagaaggcagttcggctccaatacctctctccatctgctgagctctcactccaaatctctggatctggatcgagggcccagcacgctaactgttcaggccgagcagcggaagcatccgtcgtggccacgcctcgacaggaacaactccaaggggtatatgaagctggagaataaagaggaccctatggacagattgcttgtgccccaggtcgctataaaaaaggattttaccaacaaagaaaaattgctgatgatttctaggtctcacaacaacctctcttttgaacatgatgagtttctgtccaataacctcaagcgggggacgagcgaaaccaggttttag

SEQ ID NO: 47349 - DNA, 1476 bp, Artificial Sequence
  Description of Artificial Sequence: Synthetic coding sequence
atgatcgccaccggcggcgtgatcaccggcctggccgccctgaagcgccaggattccgctcgatcccaacaacacgttaacttgtcccctagcccagcaacccaggaaaaaaagccaataagaagacgccccagggcagacgtcgtcgtggtgagaggaaagattcggctttactcaccaagcgggtttttcttgatcttgggggtccttatctcgattatcggaattgccatggctgttctaggttattggccacagaaagagcacttcatcgatgccgaaacaacgttgtccaccaacgagacacaggtgattcggaatgaggggggggttgtagtcagattttttgagcagcatctccactcagacaagatgaagatgttggggccgttcaccatgggcattgggatttttattttcatctgcgccaacgccatcctgcacgaaaacagggacaaggaaaccaaaataatccatatgcgagacatctacagcacagtgatcgacattcatactctgaggatcaaggaacagcggcagatgaacggcatgtataccggcctcatgggcgaaaccgaggttaagcagaatggatcatcgtgtgcgagtaggcttgctgctaataccatcgcaagtttttctggctttagaagcagcttccggatggactcatccgtggaggaagacgagctcatgcttaatgaagggaaaagctctggtcatctcatgccaccacttttatccgactcatctgtttctgttttcggactgtacccccccccttctaaaactacggatgataaaacctctgggtccaaaaagtgcgagacaaagtccatcgtgtcctcaagcatttcagcctttactctgcccgtcatcaagctcaacaattgcgttatcgatgaaccttctattgacaatatcactgaggacgcagacaatctgaaatccaggtctaggaatctatctatggattcgttagtggtgcctctgcccaacacaagcgagtcattccagccggtttccacagtcctaccccggaataacagcattggggagtccctgagtagtcaatacaagtcctcaatggctttaggacctggcgcgggacagctccttagcccaggggcagctaggcgacagtttggaagtaacactagcctgcacctgctcagttcacactccaagtcccttgatctcgataggggcccctctaccttgactgtacaggcagaacagcgcaaacacccaagctggccgaggctggaccgcaataactccaagggttatatgaaactcgaaaataaggaggaccccatggatcggttacttgttccacaggtcgctatcaagaaagattttactaacaaagagaagctacttatgattagccgctcccacaacaatctgtctttcgagcacgacgaatttctgtccaacaatctgaaaaggggcacctcagagactagattttag

SEQ ID NO: 47350 - DNA, 1476 bp, Artificial Sequence
  Description of Artificial Sequence: Synthetic coding sequence
atgatcgccaccggcggcgtgatcaccggcctggccgccctgaagagacaggactctgcccggtcccagcaacacgttaacttatccccctcacccgcaacccaggagaagaagcccattcgtagacgaccccgcgccgatgttgtagtggtcagaggtaaaatcaggttgtactccccatctggcttctttcttattctcggcgtgttgatctcaattatcggaattgcaatggccgtcctcgggtattggccgcagaaggagcacttcattgatgccgagacgactttgtccaccaatgagacacaggtaattagaaacgaaggtggcgtggtggtaagattttttgaacagcatctgcacagcgataaaatgaagatgttggggccattcaccatgggcatcgggatcttcatattcatctgtgcaaatgccatcctacacgagaatcgagataaagaaaccaagatcatccacatgagggatatttactctacggtcatcgacattcataccctgcgtattaaagagcagcgccagatgaacgggatgtacacggggctgatgggcgaaacagaggtcaaacagaacgggtctagctgtgcctccagactagcagccaatactatagcaagttttagtggatttcgttcctccttccgcatggatagctcagtggaggaggatgagctgatgctcaatgagggcaagtcaagcggccatcttatgccgccactcctttccgactcctccgtgtctgtctttggtttgtacccaccaccatcgaagaccacagatgacaaaacatcgggcagcaaaaagtgtgaaactaaaagcatagtctcctcgagtatcagcgcttttactctgccagtgatcaagctaaataactgtgtgatcgatgagccttccattgataacattactgaggacgccgacaacttgaagtctaggagcaggaacctctctatggactccctggtggtgccgctgccgaatacctcagagagcttccagcctgtcagtacagtactcccgagaaacaatagcattggcgagagcctgtccagtcagtacaaaagctccatggcccttggccccggagcaggccagctgctgtctcccggcgccgcccgaaggcagttcgggagcaatacgagcctgcatctccttagttcgcatagtaagtccctcgacctggaccgtgggcctagtacgcttacagtccaagccgaacagaggaagcatccatcttggcctcgactagatcggaataattcaaaagggtatatgaaattagaaaataaagaagatccaatggatagactactcgtcccccaggtcgcaatcaaaaaggattttaccaacaaggagaagctgttaatgatctcccgctcgcacaacaatttgagtttcgaacacgatgagttcctgagcaataatcttaaaaggggaacaagcgagacacgtttctag

SEQ ID NO: 47351 - DNA, 924 bp, Artificial Sequence
  Description of Artificial Sequence: Synthetic coding sequence
atgaccgccggcagccccgaggagtgcggcgaggtgcggcggagccccgagggaagagtcagccgactaggaaggcgactggggcggagaagacgccctagatcccccccagaacctctcagggttcgtgctcgcctgcgtctgcgctcaccctcaggagcctttgcagccctgggggctttggtggtcctcgtaggcatgggtattgctgtggccggctactggccacacagagctggtgcaccggggagccgtgcagctaacgctagctcaccacaaatgtctgagctgcgaagagagggcagaggaggcggacgcgcccacggaccccacgaaaggctaaggctcttgggccccgttatcatgggagttggtctcttcgtgttcatttgcgccaataccctcctgtacgagaatcgggatctggagaccaggaggctcagacagggagttctgcgggctcaggcactacggcctccagacggacctggttgggactgcgcactcctgccatcacctgggccacggtctcctagggccgtggggtgtgccgagccagaaatctgggatcccagcccaagaaggggcacctcgccggtgccatctgtgaggtctctgagatctgagcctgcaaaccccaggctgggactgcctgccctgctaaattcctatccccttaaaggccccggactgccccccccttgggggcccaggacccagactggtcacgtcatcatcacagtgcagccctccggctcctgcattgaacattctaagtcattggacctgggcctgggagagctcctcctgggcgcacccgccgctagagactgcgctcataggtcctggcctcgcctagatcggctgagcctcggtggctatgcgaagctcggggggggaggagatcttggagcccgcgtctag

SEQ ID NO: 47352 - DNA, 924 bp, Artificial Sequence
  Description of Artificial Sequence: Synthetic coding sequence
atgaccgccggcagccccgaggagtgcggcgaggtgcggcggagccccgaaggcagagttagtagactgggcaggcggcttggcagacgccggaggcctcgtagcccccccgagcctttacgagtgagagctaggttacgcctgaggagtccttcaggagccttcgcagccctcggcgcccttgtcgtgctcgtggggatggggatcgcagtcgccggatattggccccatcgagcgggtgcacctggctcacgcgctgccaacgctagtagtccacagatgtccgagttgagaagggaggggaggggaggtggcagggcgcatggcccgcatgaaagactgaggcttcttggcccggtgattatgggggttggactcttcgtgtttatctgtgcaaacactcttctgtacgaaaatagagacctcgaaacccggagactgcgccaaggagttcttagggctcaagccttgaggccacctgatggcccgggctgggattgcgcactacttccgtctcccgggcccaggtcacccagagcagtcggttgtgccgaacctgaaatctgggatcctagtccccggcgcggaacctctccggtaccctccgtcagaagcttgcgcagcgagccagccaatcctagactcggtctccccgcactcttaaactcttacccactgaaaggccctgggcttccccctccttggggccctcggacgcagaccggacatgtaatcatcaccgtccagccaagcggaagttgtattgagcacagcaagagcctggatctggggcttggagagctcctgttgggtgcaccagccgcacgcgactgtgctcatcggtcatggcctaggctcgatcgcctgtccctgggtgggtacgcaaagctgggcggaggtggagatctcggggcccgcgtatag

SEQ ID NO: 47353 - DNA, 1866 bp, Artificial Sequence
  Description of Artificial Sequence: Synthetic coding sequence
atgatcgccaccggcggcctgctgcggatcagcgcccggaagcaggacccactcagaccgccaagtcagatcccaaagcgcaagaggaaagcaaagaagcgccgcaaaaacgacgttgtggtagtgaagggaaagctcaagctttgctccatatcagggttaatcgcattgtgcggaatcctcgtcctgttggtgggcatcgctatggccgtagtcggctattggccaaaggcgactgggactaaccgcgagggggggaaacagctgccgccagctggatcctctcacagagtgcccacaaccgctaattcttctagtagtggctctaaaaaccgctccaggtctcaccccagggcgcctgggggagtgaactcttcctctgcgggcgcacctcgcagcactccccccgccagagccgcttccccttccagtagctctacaagcgtgggctttttttttagaatttttagcggataccttcacagtgacaaactcaaggtgttcggccccctcatcatggggatcggtattttcctattcatctgtgccaatgctgtcctccatgagaaccgcgacaagaagacaaaaataataaacctccgtgacctgtatagtaccgtgatagatgttcactcactacgagccaaggacctggcggcagcggccgctgctgccgctgccgctgccgcctctagctcctcatcagccccggctgcggcacctccgggagcgattcccctgaatggctttttaagttatgtgcaaagtcgcggtctggagctcaaacccggtggctgcggaggcagtggggacgctttcggggctgctgctatgctcgcaaaagggagctggccgccgcatcccgctgctccaagcgggggccgcccacgtggggccgcgagcccccctgacttggcctcaagccctagatgtccccgggagccccccagcttagcggaggctgtgtacagcgtttacagagaacgtagtggagtcgccggctctcggcgcgccgcggcagcaaccgccgcagctgcagcgagctcgtgctcaagcccagctccttgttccccaccagaaagctggggacgccagagcaccgcaagctcattcgtggattcctccttgtcagctttcgctctcctgccgttacagggtggaagggacaggggcggcgatgctgagggcgctagctgtagctggcaaagaccgccgggcgaacgcggatctcaggagattccccgcggagagctagacttaagtatgaccaacctgaggggcgcggaaggatccatgaggggagcccggcgcgaaccagaagaacctgagggggcagtcgccgcacgcgccgccagaggccagggaggccgcttaccaagaactgggaggtacgctgcacttagaaggagaagcacatccggtctgcccgactacagagcccccccttccccagaacctcctcccagccccggcagtgctgatccagactcctcgcctctggctaaggctgcatccccaagtccccccctccgtcttgaggggtccccccccacccgcagggatagcggatctagccagtcagacgatccgagttcctctaataagggatacactccacttcgtgaggctggcaccagcacagaaagtgtgcttgacgctgtggcagggcagactcgtgattcggccgtggctgccccagtgttaggcgccgagcagtcgagcccagagggagccagccaggagccgcccactgccgaacagccccagccagtgcagcgccagttcacgaataaagagaagctcatcatgatctcaagatctcatgcaatcggagtggaagaggagctcgaatccacgggcatctag

SEQ ID NO: 47354 - DNA, 1866 bp, Artificial Sequence
  Description of Artificial Sequence: Synthetic coding sequence
atgatcgccaccggcggcctgctgcggatcagcgcccggaagcaggacccactgcgtcctccttctcagatccctaaaagaaagaggaaggcaaaaaagcggagaaaaaacgatgtggttgtggtaaaggggaagttgaaactatgttccatatccggactgatcgccctgtgtgggatcctcgttttactggtcgggattgcaatggccgtcgtgggatattggcccaaagcaacaggcacaaaccgtgagggtggcaagcaactaccacctgcgggatcatcacaccgcgtccctaccaccgcgaatagttccagctccggctcaaaaaaccggtctcgatcacaccccagggcacctggtggggtgaactcaagcagtgcgggagcacctaggtctacgccacccgccagagcagccagccccagttcatccagcacaagcgtggggttcttcttccgaattttctctgggtacctgcacagcgataaacttaaggtgttcggcccactcattatgggaataggtatatttttgttcatctgcgctaatgcagtcctgcatgaaaatagggacaagaagactaagattattaatcttagagatctgtactcaacagtcatcgatgtacacagtttgagagccaaggatctggccgctgcagctgccgctgctgccgcagctgcagcctcaagctcctcatcggcgcccgccgcggctccaccgggagcaatcccccttaacggctttttatcgtacgtacagagtagaggtctcgagctaaaacctggcggttgtggcggctctggagacgcatttggggctgctgcaatgctggcaaaaggctcctggccacctcaccccgccgctccatccggcggacggccaaggggggcggccagcccgcctgaccttgcttcttcccctaggtgcccccgagaacccccaagcctcgccgaggcggtgtacagcgtctatcgcgagcggagtggtgtggcaggttccagaagagccgccgcagcgactgcggccgccgccgctagctcgtgttctagtccagccccctgttcccccccagagtcctggggtcgtcagagtacggcatcaagcttcgtggatagctccctgtcggcgttcgctttactccccttgcagggtgggagagatcgcggaggggatgccgagggagctagttgttcttggcagcgcccccccggagagcggggttctcaggagatccccagaggcgagctggacctgtctatgaccaatttgcgcggcgccgagggctcgatgcgcggagcgagacgagagccagaggaaccagaaggcgcagtggccgcacgggccgccaggggccagggcgggcgcctccccagaacaggcagatatgctgctttacgcaggaggtctacgagcggcctcccagactaccgggctcctcctagccctgagccaccgcctagccctggctcagctgatccagacagtagtcctctcgctaaggccgcgagtccttccccgcctctcaggctggaaggaagtcccccaacaaggcgggatagtggctctagccagagcgacgacccttcctcatccaacaagggatatacccctctccgagaggccggtaccagcactgaaagcgtgctggatgccgtggcagggcagacaagagattccgctgtggccgcacccgtcttgggtgctgaacagagcagtccagagggcgcaagtcaggagcctccgaccgcagaacagccccagcccgtccaacggcagttcaccaacaaagagaaactgataatgatctcacgttcacacgcaataggggtggaggaagagctcgaatctacagggatttag

SEQ ID NO: 47355 - DNA, 1179 bp, Artificial Sequence
  Description of Artificial Sequence: Synthetic coding sequence
atggagggcgtgagcgccctgctggcccggtgccccaccgccggcttggcgggtggcctaggagtcaccgcctgtgcagcagctggcgtcctcctctatcggatcgctcgaaggatgaagcccacccacactatggtgaattgctggttttgtaatcaggacactctcgtgccatatggtaatcgaaattgttgggattgccctcattgtgagcaatataacggtttccaagaaaacggagattacaacaaaccaatccccgcacagtacctcgagcatctcaatcacgtggtctcgagtgccccatcactgcgcgacccatcacagcctcagcagtgggtgtcttctcaggtgctgttatgcaaacggtgcaatcatcaccagaccaccaaaatcaagcagttggcagctttcgcgccacgagaggagggtagatacgatgaagaggtggaagtgtatcggcaccatttagagcagatgtacaaattatgtcggccttgccaggcggccgtggaatactatattaagcaccaaaatagacagcttagagccctgctgctgtcccatcaattcaagcgacgggaggcagaccagactcacgctcagaacttttcttctgccgtgaaaagtcccgtccaagttattttgctaagggctctggcttttctggcttgtgcttttcttctgaccaccgcgctatacggggcttctggacactttgcccctggcaccaccgtgcctctagccctgcccccgggcgggaacgggagcgctacacctgacaacgggaccactcctggagccgaggggtggaggcagctgcttgggctgttgcctgaacacatggccgagaagttgtgcgaagcctgggcatttgggcagtcccatcagactggggtggtcgcattgggtctgctgacctgcctgcttgcgatgctgctcgcaggccgaatccggctgaggagaatcgacgcattttgcacctgcctctgggctctgcttctaggactgcacctggcagagcaacacctacaggcagcctccccatcctggctggataccttgaagttcagcacaacatccttgtgctgcctggttggatttaccgcggcagtggctacaagaaaagctactgggcctcggcggttccgcccgcggagaagcgaaaaacagccctag

SEQ ID NO: 47356 - DNA, 2001 bp, Artificial Sequence
  Description of Artificial Sequence: Synthetic coding sequence
atggagggcgtgagcgccctgctggcccggtgccccaccgccggcttggccgggggactcggagttaccgcctgtgccgcagccggagttttgttatatcgaatcgccagaagaatgaagccaacccatacaatggtgaactgctggttttgcaatcaggatactctggtgccctatggcaaccggaactgctgggattgcccacactgcgaacagtacaacgggtttcaagaaaatggagactacaataagcccatcccggcccagtatctagagcacctcaaccacgtggtgagttccgctccaagcctgcgagatcccagtcagccacagcagtgggtctcaagccaagtgctgctctgcaaaaggtgcaaccaccatcagaccaccaagatcaagcagctcgcggccttcgcacctcgggaggaaggacgttacgacgaagaagtggaggtgtaccgccaccatctcgagcagatgtacaaactatgccggccctgtcaggctgcggtggagtactacatcaaacaccagaacaggcaactaagagctttgttactgtctcatcagtttaagagacgagaggcagaccagacacacgcgcaaaatttttcttcagccgtgaagagccctgtgcaggtgatcttattacgagctcttgcctttctggcctgtgctttcctcctcacaactgcactttacggggcctccggacattttgctcccggcacgaccgttcccctcgccctgcctccaggcggcaatggttccgccacccctgataatggcaccactcccggagcggaagggtggaggcagctattgggactccttcctgaacacatggctgaaaaattgtgtgaggcgtgggccttcggccagtcacaccaaaccggggtggtcgccttaggcctactgacctgtttgctggccatgctgctggccggccggattagacttagaaggattgacgccttttgcacctgcctgtgggcactgttgttaggcctgcacctggccgagcagcacctgcaggccgcctcgccaagctggctcgacacactgaagttctctacaacatccttatgttgcctggtgggctttacagccgcagtcgctacaagaaaagctacaggtccccggcggtttcggccccggcgattctttcccggcgacagtgctggcctgtttcccacgagccccagtctggcaataccacacccttctgtcggtggatcccccgccagtctcttcatcccaagtcctccgtcatttctcccgctggctaaccaacagctgtttaggagtccccgccggacttccccatcctctctgcctgggaggctttccagagctctctcccttggtacaattccgagcctgacgagagcggactccggttacttattttccggctccaggcctccatcacaggttagtaggtcgggggagttccctgtgtctgattactttagtctgttgagtggcagctgtccttcctcgccactgccaagccctgccccctcggtggcagggagtgtcgcctctagttcaggctctctgcggcatcgtcgccccctgattagcccagcgagactgaacctcaagggacagaagctgctcctgttcccttccccgccaggagaagcgccgactacaccaagcagttccgatgaacatagcccccataacggcagcctgtttaccatggaaccacctcatgtcccccgcaagccaccacttcaggacgtcaaacatgcgttagacctgaggtctaagttagagaggggcagcgcatgctcaaatagaagcattaaaaaggaggatgactcatctcagagctccacctgcgtcgtagacacgactacccggggatgcagcgaggaggcagccacttggcgtgggcgatttggtccctctcttgtgaggggactgctggctgtcagccttgcagctaacgccctcttcacaagcgtgtttctgtatcagagcctcaggtag

SEQ ID NO: 47357 - DNA, 1929 bp, Artificial Sequence
  Description of Artificial Sequence: Synthetic coding sequence
atggagggcgtgagcgccctgctggcccggtgccccaccgccggcctagccggtgggctgggggtgaccgcctgcgccgccgccggcgtactcctgtacagaattgctaggcggatgaagccaacacacactatggtgaactgctggttctgcaaccaggacacccttgtgccatatggcaaccggaattgctgggactgtccacactgtgagcagtataacgggttccaggagaatggggattataacaaaccaatacctgcccaatatctcgaacatctcaaccacgtggtgtcgtcagctccctccctccgcgacccctcccagccacagcagtgggtgtccagccaggtgctgctttgcaaacgttgtaaccatcaccagacaacgaagatcaaacagttagccgcttttgcgccacgtgaagagggcagatacgacgaggaggttgaggtataccgccatcatctggaacaaatgtataaactctgcagaccttgtcaagcagccgttgaatactatattaagcatcagaatcgccagctccgagcgctcctgctgagccatcagtttaagagacgggaagcagaccagacccacgcccagaacttcagctccgctgtcaagtcacccgtgcaggtcattttgctgagagccctggcattcttggcttgcgcatttcttctgactacggccttgtacggagcttcaggccacttcgcccccggaacaaccgtgcctttggctctcccccccggcggcaacggatctgccacaccggataacggaacaacacctggtgccgaaggctggagacagttgcttgggttattgcctgaacatatggcggagaaactctgtgaagcctgggcatttggccagtcccaccagaccggagtggtggcactgggtttactgacttgtctccttgcgatgctgctggctggcaggatccgcctgcgcagaatagacgccttttgtacctgtttgtgggcactactcctggggcttcacctggccgagcaacaccttcaggccgccagtccatcctggctggatacactcaaattctcaaccaccagcctgtgttgcttagtggggtttaccgccgctgtggcgaccagaaaggctactgggcccagacgcttcagacctcgcaggttcttcccgggcgacagcgcaggactttttcctacttccccaagtctagctattccacaccccagcgtcggcgggagcccggcctctttgttcatccctagcccaccctcttttcttccactggccaatcagcaactgtttagaagccctcgacggaccagtcccagttctctacccggccggctctcaagggctttatctttaggcactatcccctctcttacaagagctgactactttagccttctgtccggctcatgccccagttctcctctcccttcgccggccccgtctgtggccggcagcgtcgcctccagcagcggatctttgcgccacagaagacctctcatctcaccggcaaggctaaacctgaagggccagaagctgcttctcttcccttccccccccggtgaagcgccgacaaccccttcgagtagcgatgaacactccccccacaatggcagtctgttcactatggagcctcctcacgttccccgcaaacccccgcttcaggacgtaaagcatgctctggacttacgatccaaacttgagcgggggagtgcatgcagtaataggagtatcaagaaagaggatgactccagtcagagcagtacatgcgtcgtagacaccaccacccgaggttgcagtgaagaggccgcaacttggcgggggcgcttcggacctagtctggtgcgtggtctattggctgtatctcttgctgctaacgcacttttcacctctgtttttctgtatcaaagccttcggtag

SEQ ID NO: 47358 - DNA, 411 bp, Artificial Sequence
  Description of Artificial Sequence: Synthetic coding sequence
atgctgttcagcctgcgggagctggtgcagtggctgggcttcgccacatttgaaatttttgtgcatctacttgccttgctcgtgttcagcgtgttgcttgccctgcgtgtggatgggctcgtccctggcttgagctggtggaacgtgttcgtgccattttttgccgcagacggcctatccacgtatttcacaacaatagtctccgtcagactgttccaggacggcgagaaaagactggcagtactacggctgttttgggtgcttacagttctgagtttgaagttcgtttttgaaatgctgttgtgtcagaagttggctgagcaaacacgcgaactgtggttcggattgatcacctcacctctgttcattctcttgcagctcctgatgattcgagcgtgcagggttaattag

SEQ ID NO: 47359 - DNA, 411 bp, Artificial Sequence
  Description of Artificial Sequence: Synthetic coding sequence
atgctgttcagcctgcgggagctggtgcagtggctgggcttcgccaccttcgagatcttcgtgcacctgttggctttactcgtgttctcagtcctgctcgccctccgagtggacggtctcgtgcctgggcttagttggtggaatgttttcgttcctttcttcgctgccgacggactgtccacatatttcacaacaatcgtgtccgttagattgtttcaggatggtgagaagagactcgctgtcctgcgcctgttctgggtcctcacagtgctcagcctgaagttcgtcttcgaaatgctgctctgccaaaagcttgccgagcagactcgcgagttatggttcgggctgatcaccagtccactcttcattttactccagttgcttatgatccgggcgtgtagagtgaactag

SEQ ID NO: 47360 - DNA, 681 bp, Artificial Sequence
  Description of Artificial Sequence: Synthetic coding sequence
atgaccgtgcagcggctggtggccgccgccgtgctggtggccctggtctcgctgatcctcaataatgtcgcagctttcacatctaattgggtctgtcagacgctagaggacgggagacggaggagcgtcggactgtggcgatcctgctggctggtcgatagaaccaggggagggccaagtcctggggctcgcgccggacaggtcgatgcccacgattgcgaggcgctgggttggggcagcgaggctgctgggtttcaagaaagtaggggcaccgtcaagctgcagtttgatatgatgcgggcatgtaacctggtggccaccgcggctcttacggctggccagttaactttcttgctgggactcgtagggttgcccctgctttcgccagacgctccttgctgggaagaagctatggccgccgcgtttcagttagcctcctttgtcctggtcatcggcctggtcaccttctataggatcggaccctacaccaacctgagttggtcttgttatctgaatattggtgcctgtcttctggccacattggctgctgctatgttgatttggaatattctccataagagagaagactgcatggccccgcgagtgatcgtgattagccgctcacttaccgcccgcttcagacggggattggacaatgactatgtcgagtccccttgttag

SEQ ID NO: 47361 - DNA, 681 bp, Artificial Sequence
  Description of Artificial Sequence: Synthetic coding sequence
atgaccgtgcagcggctggtggccgccgccgtgctggtggccctggtgtcattgatcctgaacaacgtggctgcattcacctctaactgggtgtgccagaccttggaggatggcagaagacggtccgtgggtttatggcgctcatgttggctggtggaccgaactcgcggaggcccctcccccggtgcgcgcgccgggcaggtagacgctcatgactgtgaagctctgggctgggggagtgaggcggctggctttcaggagtcacgcggcacagtgaaattacagttcgatatgatgcgggcttgcaacctagtagctacggcggccttgaccgccggtcagctgacctttctccttggactggtcggactgcccctacttagcccagatgccccctgctgggaagaagcgatggccgccgcctttcagctggcgagtttcgtgcttgtcatcgggctggttaccttctatcgcattgggccttataccaatttgtcttggtcatgctacctgaatattggggcatgccttttggctaccctggctgctgccatgctcatttggaacatcctgcacaagcgcgaggactgcatggcacctagagtgatagtgatctcccggtccctaacggcaaggttccgccgcggcctcgataatgattatgtggaaagtccatgctag

SEQ ID NO: 47362 - DNA, 1053 bp, Artificial Sequence
  Description of Artificial Sequence: Synthetic coding sequence
atgatccggcaggagcggagcaccagctaccaggagctgagcgaggagctggtccaggtagtcgaaaacagtgagttggctgacgaacaggataaagaaacggtcagggtacagggcccgggcatcctgccaggactggactctgagagcgcgagctcttccatcagatttagtaaagcctgcctgaagaacgttttttccgtcctcctcatcttcatctacctgctgctgatggccgtcgcagtctttctggtgtataggacaattacggattttcgggagaagttgaagcatccggttatgtccgtaagctataaggaagtggatagatatgatgcccccgggatagctctgtacccgggacaggctcaactcctgtcctgcaagcaccactatgaagtgatccctccgttaacctctccaggccaacctggggatatgaattgtactactcagcgcattaattatactgatcccttctctaatcagacggttaaatccgcgctgattgtgcaggggcctcgggaggtaaaaaagcgcgaactggtctttttacaatttagactcaacaaaagttccgaggatttcagcgccattgactatctcctgttttccagctttcaggaatttctgcagagccccaatagagtaggctttatgcaggcttgtgagtcagcctatagttcatggaagttctcaggcggatttcggacgtgggtgaagatgtcgctggtgaaaacgaaggaagaagatggcagagaggctgttgagtttcgtcaggaaaccagcgtagtgaattacatagaccagagaccagcggccaagaagagtgcgcagcttttcttcgttgtctttgagtggaaagacccgttcattcagaaggtccaagatatagtgactgccaacccctggaataccattgcgttgttgtgcggcgccttcctcgccctgttcaaggccgccgaattcgccaagctgtcaattaaatggatgatcaaaatccggaagagatatctgaaaaggcggggccaggcaacatcccatatcagctag

SEQ ID NO: 47363 - DNA, 1236 bp, Artificial Sequence
  Description of Artificial Sequence: Synthetic coding sequence
atgatccggcaggagcggagcaccagctaccaggaggccgtgcggcccgctctgccgagttccaagccctgtctgcttactagtcctgctgtcctcgtcaaactactttcgagctcagcgtctacttctaggccacccaatctcggccatctctggcagccaagttccagcgtgcccctccacagggctgcatcccttgcgaaggttcgccagttccagctttcagaagagctcgttcaggtcgtcgagaatagtgagctcgccgacgaacaggacaaagaaactgtgcgcgtccaaggtcccggcatcttacccggcctagactctgaatccgctagctcgtctatcaggttttctaaggcttgtctaaagaatgtcttttcagtgttactgatctttatttatcttttgctgatggcagttgctgtgtttctggtgtaccgaaccatcacagattttagagagaaactcaaacaccctgtgatgtctgtgtcttataaagaggtggatcgttacgatgcaccggggatcgctctgtatcccggtcaggcacagctcctgtcctgcaaacaccattacgaagtcattcctccgctgacgagccctgggcagccaggcgacatgaattgcacaactcagagaattaactatactgaccctttttctaaccagacggtcaagagtgcactgatcgttcaagggccaagggaagtcaaaaaacgcgagctggtgttcttgcagttcaggctcaacaagtcaagtgaggactttagtgcgatagactacctgttattcagctccttccaggaattcctgcagtcacccaatagggtcgggttcatgcaggcttgtgaaagtgcctactctagctggaagtttagcggcgggttccggacctgggtcaagatgtctctggttaagaccaaggaagaggatgggcgtgaggctgtagaattccgccaggaaacatccgttgtgaattatatcgatcagagacctgctgccaagaaatcagcccagcttttttttgtagtattcgagtggaaggatccatttatccagaaagtgcaggatatagtcacagctaacccttggaacacgatagcacttctctgtggtgcttttctggcattgttcaaagccgcagagtttgcgaaactgtcgatcaagtggatgattaaaatacgcaaaagatacctcaagcgtagaggacaggccacatcccatatttcttag

SEQ ID NO: 47364 - DNA, 441 bp, Artificial Sequence
  Description of Artificial Sequence: Synthetic coding sequence
atgagccggagccggctgttcagcgtgaccagcgccatcagcaccatcggaattctgtgtctacccctgttccagctggtgttaagtgacctaccctgcgaggaggacgaaatgtgtgttaactacaacgaccagcatccaaatggctggtatatctggatcctcctgcttctcgtcctggtcgcagcactcctgtgtggggccgtcgttctgtgcctgcagtgctggttgcgacgacctagaatcgactcacacagacggactatggcggtattcgcagtgggagacctcgattcgatctacggaacggaggccgctgtgagccccacggtgggtattcatctgcagacccagactcctgacctctaccccgtacctgccccttgctttggtcccctcgggagtccaccaccgtacgaggagatcgtcaaaactacatag

SEQ ID NO: 47365 - DNA, 522 bp, Artificial Sequence
  Description of Artificial Sequence: Synthetic coding sequence
atggcccccaagggcaaggtgggcacccggggcaagaagcagatcttcgaagagaatcgcgagaccctcaaattctatctgcgtattatattaggcgcaaatgccatatactgcctcgttactctggttttcttctattcttctgcttcattttgggcatggctggctcttggtttctctttggcggtgtacggggccagttaccactccatgagcagcatggccagagccgccttcagcgaagacggggcactgatggatggcggaatggacctaaacatggaacaaggaatggcagagcatcttaaggacgtaattcttttgacagcaattgtgcaggtgcttagttgtttcagcctttatgtttggtctttctggctcttggccccaggcagggccttgtatctgctctgggtgaatgtactagggccgtggtttaccgcggactcaggcacccctgcgcccgaacacaatgaaaaaaggcagaggagacaggaaagaagacaaatgaaaaggctctag

SEQ ID NO: 47366 - DNA, 1557 bp, Artificial Sequence
  Description of Artificial Sequence: Synthetic coding sequence
atgcagggcgaggcccaccccagcgccagcctgatcgaccggaccattaagatgcgcaaagaaacggaggctcggaaagtggtgctagcctggggcttacttaacgtctccatggccggaatgatttacaccgagatgacaggcaagcttatttcatcgtactataatgtcacatactggcctttatggtacattgagctagctttggctagccttttttcactaaatgctcttttcgatttttggaggtactttaaatacaccgtcgcccctacatcactggtcgtgtcccccggtcagcagaccctcctggggcttaaaaccgccgtggtgcagaccacacccccacatgaccttgcagcaacacaaattccaccagcacccccttcccccagcatccagggacagagtgtgttgagttactcacccagcaggagtccttctacgtcccccaagtttacaacatcttgcatgactggctatagtccacagttacagggccttagctcaggcggttctggatcttatagccccggggttacctatagcccagtgtcaggatataataaactggccagtttctccccatccccacccagcccataccccacaacagtagggcccgtggagagtagtgggctacggtcccggtacaggagttcccccacagtgtataacagcccgacagacaaggaggactacatgacagaccttaggactctcgatacttttcttcgcagtgaggaggagaagcaacaccgggtgaagttgggatctcccgatagcaccagcccatcatccagccctactttctggaattatagcaggtcgatgggggactatgctcagacactcaaaaagttccagtaccagctcgcctgccgaagccaggcaccctgtgccaataaggatgaggcagacctcagcagtaagcaggctgctgaagaagtctgggcccgagttgcaatgaaccgccagctgttggatcatatggatagctggactgctaaattccggaattggataaatgagacgatcttggtgcctctggtgcaggagattgagtcggtgtctactcagatgagacgcatgggctgccctgagttacagatcggggagctcagtcaagggggatgcatgtccagctttagatggaatagggggggggatttcaagggtcgaaaatgggacaccgacctgcctaccgacagtgccataattatgcacgtgttttgtacctatcttgacagccggcttcctccccaccctaaatatcccgacggaaagacgttcacatcacagcactttgtgcagactcctaataagcctgacgtgaccaacgaaaacgtcttctgtatctaccagtccgccatcaaccctcctcattacgaattaatctatcagagacacgtttacaaccttcccaagggcagaaacaacatgttccacactttactcatgttcctgtacatcatcaagactaaagaatccggaatgctcgggcgtgtcaaccttggtctctctggagtgaatatactctggatattcggtgagtag

SEQ ID NO: 47367 - DNA, 1686 bp, Artificial Sequence
  Description of Artificial Sequence: Synthetic coding sequence
atgatgcagggcgaggcccaccccagcgccagcctgatcgaccggacgattaagatgcggaaagaaacggaagccagaaaagtcgttctcgcttgggggctgctgaatgtgtccatggctggtatgatctacacggagatgacaggcaaattaatttcttcttactacaacgtgacctactggccgctttggtacatcgagctggctcttgcttcgctgttcagtctgaacgccctgttcgacttttggagatactttaagtacactgtcgctcccacatcactggtggtgtcacctggccagcagactctcctcggcctgaaaacagcggtcgtgcaaaccaccccgccacacgatcttgctgccacccagatccccccagctccaccctcgccatctatccagggacagtctgttctgagctacagcccatccagaagccctagcacttccccaaagttcaccacctcttgcatgaccggctactctccacaactgcagggactgtcatccgggggatctggcagttatagccctggcgtcacatactcccccgtgtcagggtacaataaattggccagtttctctccatctccaccctccccgtaccctacaacagtaggaccagtggagagctccggcctccggagtaggtatcgttctagtcctactgtctacaattctcctactgataaggaggactacatgacagacctgaggactcttgatacttttctacggagtgaggaagagaaacagcacagggtaaagcttgggagccctgacagtaccagcccgagttcctcaccaaccttttggaattatagtcgaagtatgggcgactatgcccaaactcttaagaagttccagtaccaacttgcgtgtcgaagccaggccccatgtgctaacaaagacgaggccgacctgtcttcaaaacaggccgccgaggaagtttgggcccgggttgccatgaaccgacagttactggatcacatggacagttggacagccaagttccggaactggatcaatgaaacaattctcgtgcctttggttcaggaaattgaatctgtctctactcagatgagaagaatgggctgccctgagctccagatcggcgaggcctcaataaccagcctcaagcaggccgctctggtcaaagcgccactgattcccactcttaatactattgtgcagtacttggacctgaccccaaaccaggaatatcttttcgagagaatcaaagaattatcccagggcggatgtatgagctcctttcggtggaaccgcggaggcgattttaaggggcggaagtgggacactgacctacctaccgattcggctattattatgcacgtattttgcacatatttggattcaagacttcccccccacccaaagtaccccgacgggaaaacatttacatcacagcacttcgtgcagaccccgaacaaacctgatgttactaatgagaacgtgttttgtatttatcagtctgctattaatcccccccattacgaactgatttatcagcggcacgtatataacctaccaaagggccgcaataatatgttccataccctgctaatgtttctgtatatcatcaagacaaaagagagtggaatgcttgggcgggtaaacctcgggctgagtggtgtgaacatcctgtggatatttggcgagtag

SEQ ID NO: 47368 - DNA, 1683 bp, Artificial Sequence
  Description of Artificial Sequence: Synthetic coding sequence
atgcagggcgaggcccaccccagcgccagcctgatcgaccggaccattaagatgcgaaaggagaccgaggcgcggaaagttgtgctggcttggggtctcttaaatgtgtccatggcaggtatgatctataccgaaatgaccggaaagttgataagcagctactataatgtcacttattggcccctgtggtatattgagctagctctggcatcactgttctctcttaacgcactgttcgacttctggcgatattttaagtacaccgtcgcacccacaagcctggtggtatctccaggccagcagactctcctgggattgaaaactgccgtagttcagaccactcctccccacgatctggccgctacgcaaatccccccagcaccaccatccccaagcatccaaggccagtctgtgctaagttactccccctctagatctccatccacctcccccaaattcaccacaagctgcatgactggctacagcccgcagctccagggtctgagttccggcggatctgggtcgtactccccaggggtgacttacagccccgtctccgggtataacaaactggcctccttttcaccatccccgccatccccgtaccccacgaccgtcggacctgtcgagagttccggactgagatccagatatagaagctctcccactgtttataatagcccgaccgacaaggaggattacatgaccgatcttaggacgctggatactttcctgagaagtgaggaggagaaacaacacagggtcaaattgggctcaccggactcgacctctccgtcttccagtcccacattttggaattactcccggagcatgggtgattacgcccaaacactgaaaaaatttcagtaccagctggcctgtagatctcaggcgccctgtgccaataaagacgaagccgatctgtcaagtaagcaggcggcggaagaagtatgggcaagagtcgccatgaatcgccagctgctcgatcatatggatagttggaccgctaaatttaggaattggatcaacgagaccattctggtaccactggttcaagaaattgagagcgtgtcaacacagatgcgccggatggggtgccccgagctccagatcggggaagccagcatcactagtcttaagcaggctgcgctcgtgaaagccccacttatccctactctgaatacgattgtgcagtatttagatttaacaccgaaccaggaataccttttcgaaagaatcaaggagctctctcagggaggctgcatgtcatcattcagatggaatagggggggagatttcaaaggccgtaaatgggacaccgacctgccgacagactccgcaataatcatgcatgtgttttgtacctatctcgattctagacttcctcctcatcccaagtaccccgacggcaaaacattcacatcccaacactttgttcagaccccgaataaacctgatgtgaccaacgagaacgtattctgtatttaccagtctgcaatcaatccaccccactatgaattgatctatcagaggcatgtctataatctgcctaaggggaggaacaatatgtttcacactcttctgatgttcctgtacataatcaaaaccaaggagtccgggatgctagggcgggtgaatctcggcctgtccggagtgaacatcctgtggatctttggagaatag

SEQ ID NO: 47369 - DNA, 171 bp, Artificial Sequence
  Description of Artificial Sequence: Synthetic coding sequence
atgcagggcgaggcccaccccagcgccagcctgatcgaccggaccattaaaatgagaaaagaaacagaggccaggaaggtggtgctggcgtggggactccttaacgtgagtatggcagggatgatttatactgagatgactgggaagctgataagctcctactacaattag

SEQ ID NO: 47370 - DNA, 1560 bp, Artificial Sequence
  Description of Artificial Sequence: Synthetic coding sequence
atgatgcagggcgaggcccaccccagcgccagcctgatcgaccggacgatcaaaatgcgaaaggagacagaggcccgaaaagtggtcctggcctggggcctactgaacgtctccatggccggcatgatctacacggagatgaccgggaagttgatctcatcatattataacgtgacctattggccactgtggtatatcgagctggcactggcaagcctcttctcacttaacgcactcttcgatttttggcgctactttaagtataccgtagccccaacctccctggttgtatccccaggtcaacagacgctgctggggttgaagaccgctgtcgtgcagaccacccccccccatgatttggctgcaacacagattccacccgctcccccttcaccctctatccaaggccagtctgtcttatcatatagcccttcaagatccccatccacttcgccaaagtttactacctcctgcatgacagggtattcccctcagttacagggtcttagctcagggggctccggttcttattcccccggtgtgacatactcccctgtcagtggctataataaactcgctagcttcagtccctctcccccaagcccttatccgaccactgtgggaccagtagagtcatctggtcttagatcaaggtacagatcttctccaacagtctataattcgcccacggacaaggaggattatatgacagatttgcgcactctagacacattcctccgctctgaagaggaaaaacaacaccgggtgaaacttggatcccctgatagcacctcaccctctagtagtcctacattctggaactacagtaggagtatgggcgactacgctcagaccctcaagaagtttcagtaccagctggcctgtcggagccaggcaccctgtgccaacaaagatgaggccgacctgtccagcaagcaggccgccgaggaggtttgggccagagtggccatgaatcggcagctcctggaccatatggactcctggaccgctaaattccgaaactggattaatgagactattctggtgccactggtgcaggagattgaatccgtctccacccagatgagaaggatggggtgccccgaattgcaaatcggagagctgtctcaaggcgggtgcatgtcttcttttaggtggaaccgcggtggggactttaaagggaggaaatgggacaccgacttgcctactgactccgctatcattatgcacgtgttctgtacgtaccttgacagtagacttcccccccatccaaagtaccccgacggaaagacatttacaagccagcactttgtacagacaccaaataaacccgatgttaccaatgagaacgttttctgtatctatcagtccgctataaatccgcctcactatgagcttatttatcagcgtcatgtatacaaccttccgaaagggcgcaacaatatgttccacacattgttaatgttcctatatatcatcaagacaaaggagagtgggatgctgggaagggtgaacctgggacttagcggcgtgaatatcctttggatattcggggaatag

SEQ ID NO: 47371 - DNA, 612 bp, Artificial Sequence
  Description of Artificial Sequence: Synthetic coding sequence
atgatgcagggcgaggcccaccccagcgccagcctgatcgaccggactatcaagatgaggaaagaaactgaagctcggaaggtggtgctcgcatggggcctgctgaatgtttcaatggccgggatgatttatactgagatgacagggaagctcatctcatcttattataacgtcacatactggcctttgtggtacattgagctcgccctggcctctctgttttctctcaatgcacttttcgacttctggcgatattttaagtatacggtcgctcccacgtccctggtggtgtcgccagggcagcagaccctgttgggactgaagaccgcggtagtccagactacacctcctcatgacttggccgccacccagatcccacccgcaccgcctagcccaagtattcagggacagagcgtcttgtcatattccccttctcgctccccctccacatcacccaaattcacaacaagctgtatgactggctattctccacagctgcagggtctgtcgagcggaggctccgggtcttatagtcccggagtgacctatagcccggtgagcggatataataaagtgatgaccctgttcagctgcctggtcacattgttctag

SEQ ID NO: 47372 - DNA, 390 bp, Artificial Sequence
  Description of Artificial Sequence: Synthetic coding sequence
atgctgctgggcggctggctgctgctggccttcaacgccatcttcctgctgagctgggctgtagcacctaaagggctgtgtccacggcggagttccgtacctatgcctggggtgcaggcagtggccgccacagccatgatcgtgggactcctgattttccctatcggactcgcctcaccgtttatcaaagaggtgtgcgaggcgtcttccatgtattacggcggtaagtgtcgccttgggtggggatatatgaccgctatcctcaatgcagtgctggcaagcctgttgcccatcatttcttggccacataccactaaggtacagggtcgtaccattatcttttcatccgccaccgaaagaattattttcgtcccagagatgaataaatag

SEQ ID NO: 47373 - DNA, 390 bp, Artificial Sequence
  Description of Artificial Sequence: Synthetic coding sequence
atgctgctgggcggctggctgctgctggccttcaacgccatcttcctcctgagctgggccgttgcccccaaaggactttgccctaggcgttcatccgtgcccatgcctggggtgcaggcggtggctgctactgctatgatcgtgggcctcctgatctttcctatcggattggcaagcccttttatcaaagaagtgtgcgaagcctccagtatgtattatggcggaaagtgccgtctggggtgggggtatatgacagcgattcttaacgctgtgctggccagcctgctgcccattatttcatggcctcatacaacgaaggtacaggggaggactattatcttttcttccgccacggagagaatcatatttgtgccggagatgaataaatag

SEQ ID NO: 47374 - DNA, 603 bp, Artificial Sequence
  Description of Artificial Sequence: Synthetic coding sequence
atgctgagcagcgtgtgggtggccctgggcctgagcctgacctgcacctccgccttctcgctgattagccctgcatggttccagacgcctacctttagcttcggaattttgacatactgctcctggccacaaggaaatagctggaatcagagctgcgtgacgttctcctcgttagaggatattccagactttgcatggaaagtgagtgccgtaatgctgctgggcggatggcttctactggctttcaacgctatcttcctgctgagttgggcagtggctccgaaaggactttgtcctaggcggagttctgttcctatgccaggagttcaggccgtggcagccaccgccatgatcgtaggactcctcattttcccaataggtcttgcgagtccgttcatcaaggaggtctgcgaggcgagcagcatgtattacgggggcaaatgtcggctggggtggggctacatgaccgcaattctcaatgcagtgttggcaagtttgctgcccataatcagctggccacatacgaccaaggtgcaagggaggaccatcatcttctcttcagccaccgagcgcattatctttgtgccggagatgaataagtag

SEQ ID NO: 47375 - DNA, 474 bp, Artificial Sequence
  Description of Artificial Sequence: Synthetic coding sequence
atggtgttcccccccaacacccagcacaagttcaccagcggccgggtggcttttcaactcttacaggttggcgttgactctcctgcagcaggtacacgccataactcagctggacccgctcaccttcaccgggctttgagcaccgctagttccatgcagagattgcctgccgcaacgcgggccacccttatcctatcactggcgtttgcaagcttgcactccgcatgctctgcggcgagctccagcaactcctcatctctgaccgcccaccatcccgatcctgggacactagagcaatgtctcaacgtcgacttttgccctcaggcagcccggtgttgtagaactggggtggatgaatatggatggatagcggcggctgtggggtggtccctttggtttctcaccttgatcctcctctgtgtggacaagttaatgaaacttacacccgatgaacccaaagacttgcaagcttag

SEQ ID NO: 47376 - DNA, 324 bp, Artificial Sequence
  Description of Artificial Sequence: Synthetic coding sequence
atgcagcggctgcccgccgccacccgggccaccctgatcctgagcttagccttcgcatcgctacactctgcctgcagtgccgaggcctcgtccagtaactcctcaagtttaaccgcgcaccatccggaccccggaacgctggagcagtgtctgaacgttgacttctgccctcaagcagccaggtgctgtcgtacaggagtagacgaatacggatggatcgccgccgcggtgggatggagtctctggttcctcacactaatacttctgtgcgttgacaagctgatgaaactcacacccgatgaacccaaggatctgcaggcttag

SEQ ID NO: 47377 - DNA, 2070 bp, Artificial Sequence
  Description of Artificial Sequence: Synthetic coding sequence
atggccaccaagaccgccggcgtgggccggtgggaggtggtgaagaaagggagacgtccaggtgtgggagctggagctggcggaagaggaggcggacggaataggagggccctgggcgaggcgaatggagtttggaagtacgacctcactcccgccatacagacaacctcaactctgtatgaacgcgggttcgaaaatattatgaaaaggcagaataaggaacaggtgccaccacccgcagtggaaccaaagaagcctgggaacaagaagcagcccaaaaaggtggcaaccccacctaaccaaaaccaaaagcaagggagattccgctctctcgaggaagccttgaaagctttggacgtggcagacctgcagaaggaactcgataagagtcagtccgtctttagcggtaatccaagcatttggctcaaagacttggcctcctatctgaattacaaactacaggctcctctcagcgaaccaaccctctcacagcacacccacgactacccctacagtctagtgtccagagaattgcgcggcatcatccgcgggctgttggccaaagccgccggttccttagagttgttctttgaccactgtctctttacaatgctgcaggaattagataagaccccaggggaatctctccatgggtaccggatatgcattcaggcaattctgcaggataagcctaaaatagcaacagccaacttaggaaagtttcttgaactgctgaggtctcatcagagtagacctgctaaatgcctaacaattatgtgggccctaggccaggccggctttgccaacttgaccgagggtctcaaagtgtggttgggaattatgctcccagtgctaggcattaaatctctgtctccgtttgctatcacttatcttgatagactgctgctaatgcatcccaatttgaccaaaggattcggaatgattggccccaaggatttttttccactgcttgattttgcctatatgccaaacaactctctgactccaagtcttcaggaacaactgtgccaactctaccccaggctgaaagtgttggctttcggggcaaagccagactccacacttcacacctacttccccagctttctttccagagccactccctcttgtcctcccgaaatgaagaaagaattgctttccagcctgaccgagtgccttacagtggacccactgtccgcaagcgtgtggagacagctgtatcctaaacaccttagccagtcaagtctccttctggagcacctcctcagcagctgggagcagatccccaagaaggtccagaagtccctgcaggaaaccatccagtctctcaaactcacaaatcaggagctgctgaggaagggatcatctaacaaccaggacgtggtcacctgtgacatggcgtgtaaaggactgctccagcaggtgcagggaccaaggttaccctggactagacttttgctgctgctgctggtgtttgcagtgggcttcctatgccacgacttgagatcccacagtagctttcaagcctctctgactgggcgcctcctgcgctcctcaggttttctgccagcttcacagcaagcttgtgcgaagttatactcctattccctgcagggctatagctggctgggagagaccctgccgctctggggatcacatctgctcaccgtggtgcgtccatccttgcagctggcctgggcacacactaacgctaccgtgagcttcctgagtgctcactgtgctagccacctggcctggttcggagatagtcttacatctctcagccagagactgcagatccagctacccgactccgtgaaccagctgcttcgctacttgcgcgaactgcccctgctgttccaccagaacgtgttacttccgctttggcatctcttactggaggctctggcatgggcccaggagcactgtcacgaggcatgccgtggagaagttacatgggattgcatgaagacacagctcagcgaggcggtgcattggacgtggctttgtttgcaggatatcacggtggctttcctggactgggcactggcactgattagtcagcagtag

SEQ ID NO: 47378 - DNA, 2070 bp, Artificial Sequence
  Description of Artificial Sequence: Synthetic coding sequence
atggccaccaagaccgccggcgtgggccggtgggaggtggtgaagaaagggagacggccaggcgtcggtgccggcgctggtgggcgcggtggtgggcgtaatcggagggcgctcggggaggccaacggcgtctggaagtatgacctcacccccgctatccagaccacaagtacactttacgaacgaggttttgaaaacataatgaagcgacaaaataaggagcaggtgcccccccccgcagtggaacctaaaaagcctggtaataagaagcagccaaagaaagttgcaactccccccaaccaaaatcaaaagcaggggagatttcggagtctagaggaagctttaaaagccctggacgttgcagacctgcagaaggagcttgataagagccagtctgtgttttccggcaacccaagcatttggctgaaagacctggccagttacctcaactacaagctgcaggcccccctgtccgagccaaccctctcccagcacacacacgactacccttattccttggtgtctagagagctgaggggaataatcagagggttactggctaaggcagccgggtccttggagctgttcttcgatcattgccttttcaccatgctgcaggagctggacaaaacacccggggaaagcctgcacggttacaggatttgcatacaggcaatcctccaagacaaaccaaagatcgccacagcaaatctcggcaaattcctcgagctgctccgctcccaccagagccgccccgctaaatgcttaacgataatgtgggctttggggcaggcgggatttgcgaatttaaccgaggggctcaaggtctggctaggaattatgttaccggtgcttggaataaagagcctgagcccgttcgccattacttacctcgatagactcctcctgatgcacccaaacctcaccaagggcttcggtatgatcggacccaaggacttcttccctctgctggactttgcttatatgcccaacaattccctaactcccagcctgcaggaacaactgtgccagctttacccacgcctgaaggtcttggcatttggagcgaagccagactctaccctccatacatacttcccttcgtttctcagccgtgccactccttcctgtccacctgagatgaaaaaagagctactgtccagcctcaccgagtgcctgactgtcgatcccctgtcggctagcgtatggaggcagctttaccccaagcacctatctcaatcaagcctgttactggagcacctgctgagcagttgggaacagattcccaagaaggtgcagaagtctctgcaggagacgatccagtcgctgaaactgactaaccaggaattgctcagaaaaggcagttccaacaatcaggacgtcgtgacttgtgacatggcctgcaagggactcctgcagcaggttcagggcccacggctgccctggacccgcctcctcctgttacttcttgttttcgccgtcggcttcctatgtcacgatctgcgatcacacagttcttttcaggccagtttgacaggccgcctgctgagatcaagtgggttcctgcctgcaagccagcaggcctgcgcgaagctctatagttactctttgcaggggtacagttggctgggggagaccctgccgctgtggggatctcacctgctaaccgtggttagaccatctctgcaactcgcgtgggcccacactaatgccacagtttctttcctctcggcacattgtgcatcacatctggcctggttcggagactcactgactagtctttcgcaaagattacagattcagctgcccgactcagtcaatcaactgctgcgatacctccgcgagcttccccttctcttccatcagaacgtcctactccctttatggcacctcctattggaggctctagcatgggcccaagagcactgccatgaggcatgcaggggcgaggttacttgggactgtatgaaaacacaactgtctgaggcagtgcactggacctggctttgcctccaggacattactgtagccttcttggattgggcactggcccttatctcccagcaatag

SEQ ID NO: 47379 - DNA, 1935 bp, Artificial Sequence
  Description of Artificial Sequence: Synthetic coding sequence
atggccaccaagaccgccggcgtgggccggtgggaggtggtgaagaaaggccgtaggcccggcgtcggggcgggggctgggggacggggcggcggtaggaaccgcagagctcttggcgaagccaacggagtatggaagtatgacctgaccccggccatccaaaccacctctactctgtatgagcgcggcttcgaaaatataatgaagaggcagaataaagaacaggtgccaccaccagccgtggagccgaaaaagccaggaaacaaaaagcaacccaagaaagttgccaccccgcccaaccagaatcagaagcagggcagattccgcagcctggaggaagctctgaaagccctcgatgtggctgatctgcagaaggaacttgacaagtcacaatcggtattcagcggcaaccctagcatttggctgaaagatctcgcctcttacctgaattataaacttcaggccccactgtctgagcccacactaagtcagcatacccacggcgagagtctgcacgggtaccgaatctgtatacaggccattctgcaggacaagcctaaaatcgccactgccaatctgggtaagttcctggaactcctcaggagtcatcagagtcggccagccaaatgccttacgataatgtgggcccttggccaagccggattcgccaatctgacagagggtctgaaagtttggctaggcataatgctgccagtgctggggattaagagcctctctccgttcgcaattacctaccttgaccggcttttactcatgcatcccaacctgacgaaaggctttggaatgattggtccaaaagatttctttccactcctcgatttcgcttacatgccgaataacagcctaaccccttctctacaggagcagctttgccagttgtacccacggctgaaggtgttggctttcggtgcaaaacctgactctacactccacacatattttccctcctttttaagccgcgctactccaagctgcccacccgaaatgaaaaaggagctcctgtcttcccttactgagtgcttgacagtagaccctctctccgcttcagtctggcgtcaactgtatcctaagcacctcagccagtcatctctgctccttgaacatttgctctcttcctgggagcagatacctaaaaaggtgcagaagagcctgcaagaaaccattcagtctctgaaactgactaatcaagaactactcaggaaaggctcatccaataaccaagacgtcgtgacctgtgacatggcctgtaaaggtctgctgcagcaggtgcaggggccccgcctcccatggacccgcttgctcctgctgttattggtgtttgccgtcggctttctgtgccatgaccttcgatcccattcctcttttcaagccagtctgacaggcaggctcctgcgcagtagcggctttctccctgctagccagcaagcatgtgccaaactgtacagctacagcttacaaggatattcttggctcggagagaccttgcctctttgggggtcacacttgctcacagttgtgaggccctccctccagttagcgtgggctcacaccaatgccacggtgagtttcttgagcgcccactgcgccagccaccttgcctggttcggcgattcccttaccagtctaagccagcggctgcagatacagctccccgacagcgttaatcaacttttgcgataccttagggagctgcccctcctgttccatcagaacgtcctgttgcctctttggcacctgctgctcgaggctctcgcctgggctcaggagcattgccacgaagcatgccgcggagaggtgacctgggattgcatgaaaacacagttgtccgaggccgtgcactggacttggttgtgcctccaggacattacagtggcttttctggactgggccctggctctcatctcccaacagtag

SEQ ID NO: 47380 - DNA, 483 bp, Artificial Sequence
  Description of Artificial Sequence: Synthetic coding sequence
atggccaccaagaccgccggcgtgggccggtgggaggtggtgaagaagggtcgtcgccctggagttggtgcaggcgccgggggccgggggggcgggaggaatcgtcgggccttgggagaggctaatggggtctggaagtatgatctgacccccgccattcaaaccacctccaccctatatgaaagaggatttgagaacattatgaagagacagaacaaagaacaggtgcccccccctgctgtggaacctaagaaaccagggaataagaaacagcctaaaaaagtggcgacaccaccaaaccagaaccaaaaacagggtaggttccggtcgcttgaggaggctctgaaagctctggatgtcgctgacctccaaaaggagcttgacaagtcacagtcagtcttttccggaaacccgagtatttggttgaaagaccttgctagctatttgaactacaaactccaggccccagagcagcccgattag

SEQ ID NO: 47381 - DNA, 1290 bp, Artificial Sequence
  Description of Artificial Sequence: Synthetic coding sequence
atgtgggccctgggccaggccggcttcgccaacctgaccgagggcctgaaggtatggctcggtattatgctgcccgtcctggggatcaagtccctttcgccgttcgcaattacgtacctggatcgactgctcctgatgcatccaaacctcacaggactgagacacgactggccgcaggggttgcttcctacttctggcctgtgtttgtacgcagagcagctgccagatactcagcccgctggcgcctgtcagctgtatcctcgtctgaaggtgcttgcattcggagccaaacccgacagtactttgcatacatatttcccctcctttctgtcaagagccacgccgagttgcccacctgaaatgaagaaggaactattgtcaagcctgactgagtgcctgacggtggacccgttgtcagcaagcgtctggcgacagctgtaccccaagcatctgagccagtcctctcttctgctcgaacacctactctctagctgggagcagattcccaaaaaggtgcagaagtcattacaagaaaccatccagtcgcttaagctaactaaccaagagctcctgagaaaaggctcaagcaacaaccaggacgtcgtaacgtgtgatatggcctgtaaaggtcttctgcagcaggtgcaagggcctcgactcccctggacacgcttacttctgcttcttcttgtgtttgcagtaggattcttatgtcacgacctgcggtctcactccagctttcaggcaagcttaacaggcaggctcctgagaagtagtgggttcctccctgcatctcagcaagcttgcgcaaaactgtattcctatagcctgcaggggtatagctggttgggcgaaactttgcctctatggggctctcacctgctgaccgtagtacggccatcactgcagctcgcttgggctcatacaaatgcaaccgtttcttttctgtcagcccactgtgcgtcgcacctggcatggtttggagattctctgacgtccctgagccagaggctgcagattcagttgcccgattctgtgaatcagttgttaaggtacctccgagagctgccattactctttcatcagaacgttctattaccattgtggcacctgctgctggaggcattggcctgggctcaggaacattgccacgaagcctgtagaggggaggtcacctgggattgtatgaaaactcagctgagcgaagcggtacattggacctggctctgcctacaggacattacggtcgcgttcctggattgggcactcgcactgattagtcagcagtag

SEQ ID NO: 47382 - DNA, 708 bp, Artificial Sequence
  Description of Artificial Sequence: Synthetic coding sequence
atgcggcccgacgacatcaacccccggaccggcctggtggtggccctggtttctgtattcctggtcttcggattcatgttcactgtgtcaggcatgaaaggggaaactctggggaacatcccactcttagccattggtcccgcaatttgcctcccaggcattgcagcgattgctcttgccaggaagaccgagggatgcaccaagtggcctgaaaatgagctgttatgggttcggaagctgccgtgctttaggaagcccaaggacaaagaagtagtggaacttctgcgaactccgagtgatctagaatctgggaaggggtcctcagatgagctggccaaaaaggcggggctgaggggcaaaccaccccctcagagccagggggaggtttctgtagccagcagtattaatagcccaacccctacggaggagggtgaatgccaaagcttggttcagaacggccaccaggaggaaacttctagatatctcgatgggtactgccccagtggctcgagtctgacctacagtgcactggatgtcaaatgttccgctagagaccgcagcgaatgtcccgagccagaagactcaatcttttttgtccctcaggactcaatcatcgtctgttcatataagcagaatagcccatacgataggtattgctgctacatcaatcagatccagggtcgatgggaccacgaaacgatcgtttag

SEQ ID NO: 47383 - DNA, 690 bp, Artificial Sequence
  Description of Artificial Sequence: Synthetic coding sequence
atgaagcagcagcagtggtgcggcatgaccgccaagatgggcaccgtcttgtccggggtcttcacgattatggctgtggacatgtatttaatttttgagcagaaacacctggggaatgggagttgtactgagataacgccgaagtatcgtggcgcgtccaacatcattaacaattttataatctgttggtccttcaagatcgtacttttcttgagttttattaccatcttgatatcatgcttcctcttatactcagtgtatgctcagatctttagggggctggtaatttacattgtgtggatcttcttttatgaaaccgccaacgtcgttattcagatcctcacaaataacgatttcgacattaaggaggtgagaatcatgcgatggttcggtctggtgtctagaacggtgatgcactgtttctggatgttctttgttattaattacgcacatataacttataagaaccgcagtcagggtaatattatctcatacaaaaggagaatatcgacagcagagattttacattctcgcaacaaacgtctcagcatatcttcggggtttagcgggtctcacctggaatcccagtacttcgaacgacaaagttttcacacctcaatattcacttgcttgagcccagttccctcatctgctcctagcacttgccgctatacaatagatgtttgctag

SEQ ID NO: 47384 - DNA, 636 bp, Artificial Sequence
  Description of Artificial Sequence: Synthetic coding sequence
atgaagcagcagcagtggtgcggcatgaccgccaagatgggcaccgtgctcagcggtgtcttcaccatcatggccgttgacatgtatctgatttttgaacagaagcacctggggaatgggagttgtactgagatcaccccgaagtatcggggggctagcaatattattaacaacttcatcatctgttggtcgttcaagatcgtcttattcctgtcctttattaccatccttattagctgtttcctcctatattctgtgtatgctcaaatcttccgggggcttgtgatttacatcgtctggatcttcttttacgagaccgccaacgttgtgatacaaatccttactaacaacgattttgatattaaggaggtgcggatcatgaggtggttcggtctggtctccagaacagtgatgcactgtttctggatgttttttgttatcaactatgcccatataacatataaaaatagatcacaaggcaacattattagttataaaaggcggatatccacagcagagatccttcactcccggaataagaggctgtccatcagcagcgggttttccggcagccatttggagtcccagtatttcgaacgccaaaggcgctgctctggcaagacatccatcaagtag

SEQ ID NO: 47385 - DNA, 348 bp, Artificial Sequence
  Description of Artificial Sequence: Synthetic coding sequence
atggccggcaccgtgctgggcgtgggcgccggcgtgttcatcctggccctcttatgggttgccgtcctcttgttgtgtgttctcctctccagggcgagcggcgcagctcggttctcggtaatctttctctttttcggagccgtaataattacttcagtcctcttgctgttccccagagctggggagttccccgctcccgaggtcgaagtgaagatcgtggatgatttttttattgggcgatatgtgctgctggcttttctaagtgccatattcctggggggcctatttctggttttaatccattatgtgctggaaccaatctatgccaagcccctgcactcttactag

SEQ ID NO: 47386 - DNA, 348 bp, Artificial Sequence
  Description of Artificial Sequence: Synthetic coding sequence
atggccggcaccgtgctgggcgtgggcgccggcgtgttcatcctggctcttctttgggttgccgttctgctgctctgcgtgttgctctccagggcctcgggcgccgcacgttttagtgttatcttcctgttcttcggtgcagtcattattacctctgttctgctgctctttccaagggccggtgaatttcccgccccagaagtcgaggtgaagatcgttgacgacttctttattgggcggtacgtgctgctcgcctttttgagcgccatcttcctcgggggactgtttctggtacttattcattatgttctcgagccgatctacgctaagccactacactcttattag

SEQ ID NO: 47387 - DNA, 348 bp, Artificial Sequence
  Description of Artificial Sequence: Synthetic coding sequence
atggccggcaccgtgctgggcgtgggcgccggcgtgttcatcctggcactactgtgggttgctgtcctgctgctgtgcgttttgctgtctcgggcttccggcgcagcccggttctctgtgatttttctgtttttcggagctgtgataattacttctgtgctactcctgttcccccgcgccggagagttccccgccccggaagtggaggtaaaaattgtggatgattttttcataggacgctacgtgctcctagctttcttatcagccatcttcttgggcggtctttttctggtgctgattcactacgtcttggaaccgatatacgcaaaaccgctgcatagttattag

SEQ ID NO: 47388 - DNA, 348 bp, Artificial Sequence
  Description of Artificial Sequence: Synthetic coding sequence
atggccggcaccgtgctgggcgtgggcgccggcgtgttcatcctggccctgctttgggtggccgtactgctcctctgtgtgctcctgagtcgggctagcggggctgctcgtttctccgttatcttcttgttctttggagctgtgattattacgtctgtgctgctgctgtttccacgggccggcgaattccctgctcctgaagtggaagtgaagattgttgacgacttcttcatcggtagatatgtcctccttgctttcttatcagccatttttctcggcgggctgtttctcgtgctgatccactacgtacttgaacctatctatgcaaagcccctgcacagctactag

SEQ ID NO: 47389 - DNA, 348 bp, Artificial Sequence
  Description of Artificial Sequence: Synthetic coding sequence
atggccggcaccgtgctgggcgtgggcgccggcgtgttcatcctggctttactgtgggtagccgtgctactgctctgtgtgctgctgtcacgcgcttctggcgcagctcgtttcagtgtgatctttctgttcttcggagcagtcattattaccagcgtactgctgctgtttccaagagcgggggagttccctgcaccggaggtggaggtgaagatcgtcgatgatttctttattggccgctatgttctactggcattcctatccgctatattcctaggaggactgttcttggtactgatccactacgtgctcgaacctatctatgcaaagccacttcactcttattag

SEQ ID NO: 47390 - DNA, 348 bp, Artificial Sequence
  Description of Artificial Sequence: Synthetic coding sequence
atggccggcaccgtgctgggcgtgggcgccggcgtgttcatcctggccttgctgtgggtcgccgtgctgttgctttgtgtgctgttatctcgggcctccggggctgcacggtttagcgtaattttcctctttttcggcgctgtaattattacttccgttctgttgctgtttccacgcgccggagaatttccggcccctgaggtggaagtgaaaattgtggacgactttttcataggccgctacgtcctactggccttcttatccgcaattttcctgggaggcttgttcttggtgcttattcattacgttttggagccaatttacgccaaaccgctgcattcttattag

SEQ ID NO: 47391 - DNA, 348 bp, Artificial Sequence
  Description of Artificial Sequence: Synthetic coding sequence
atggccggcaccgtgctgggcgtgggcgccggcgtgttcatcctggcccttctgtgggttgcagtgcttctgctctgtgtactgttgtcaagggctagcggagccgctcgattttctgtgatctttctgttttttggtgccgtaattataaccagcgttctgctgttattcccaagagccggcgagttccctgctccagaggtcgaagtaaaaatcgtggacgactttttcatcggcaggtatgtactgcttgcttttctgtctgccatcttccttggcgggctgttcctcgtactcattcactatgtcctggagcctatctatgccaaacctttgcatagctattag

SEQ ID NO: 47392 - DNA, 348 bp, Artificial Sequence
  Description of Artificial Sequence: Synthetic coding sequence
atggccggcaccgtgctgggcgtgggcgccggcgtgttcatcctggccctgctctgggtggcggtacttctgctgtgcgtcctgctatcacgtgcgagcggcgctgcccgattttctgtaatctttctattcttcggcgctgttataattacctcggtactgctcctgttcccgcgcgccggtgaatttcctgctcccgaggtggaggtgaagatcgtagatgattttttcatcgggcgctatgtgctcctggccttcctgtctgccatctttctggggggcctgtttctagttcttatccattacgtcctggaaccaatctacgctaaaccgctgcatagctactag

SEQ ID NO: 47393 - DNA, 723 bp, Artificial Sequence
  Description of Artificial Sequence: Synthetic coding sequence
atgggcaactgccaggccggccacaacctgcacctgtgcctggcccatcaccccccgttggtgtgtgccactttgatattgctgcttctaggacttagtggcctgggcctcggatcttttctgctaactcaccggaccgggctgcggtcccccgacattcctcaggattgggttagttttcttcggtcatttggccaactcaccctgtgcccccggaacggcacggtcacggggaagtggcgggggtcgcacgtggtggggctgctgaccaccctgaattttggtgatgggccagaccgcaataagacaagaacattccaggccactgtgctaggctcgcagatggggctcaagggttctagcgcggggcaacttgttctcatcaccgcccgggtcactaccgagagaacagccggaacctgcctctacttctctgccgtgcctggtatcctcccatccagccagccccccatcagttgttccgaggagggcgcgggcaatgcaacactgagccccagaatgggggaggaatgcgtgtcggtgtggagtcacgagggtctcgtgcttacaaaactgctaacttctgaggagctagcattgtgcgggagccggttgctggtcctgggaagcttcctactgctgttttgtggcctgctttgttgtgtaactgctatgtgcttccatcctcggagagagagccactggtcccgcaccaggctgtag

SEQ ID NO: 47394 - DNA, 723 bp, Artificial Sequence
  Description of Artificial Sequence: Synthetic coding sequence
atgggcaactgccaggccggccacaacctgcacctgtgcctggcccatcatccacccctcgtctgcgctacactgatcctgctcctacttggcttatccggcttagggttgggcagctttttgctcacccaccggaccgggctccgctccccagacatcccccaggactgggtttcctttttgcggtcgttcggacagctcacactgtgcccaaggaacggaaccgttactggaaagtggcgggggagccatgtggtgggccttctcaccacgctgaactttggcgatggccctgatcgcaataagacacggacatttcaggccactgttctgggctctcaaatggggctgaaaggtagttcagcaggacagctggtactcatcacagcgcgagtgacaaccgagaggacggcaggaacttgtctctacttcagcgctgttcccggtattctgccatcctctcaacctcctatatcgtgctccgaggagggcgccggcaatgctaccctgagccccaggatgggcgaggaatgtgtgtcagtgtggtcacacgagggactagttcttaccaagctgttaacttcagaggagctcgccctctgcgggagccgtctgctagtcctgggcagcttcttgttacttttctgtgggctgctatgttgtgtgaccgctatgtgcttccacccacggcgcgaatcccactggtctagaaccagactatag

SEQ ID NO: 47395 - DNA, 1239 bp, Artificial Sequence
  Description of Artificial Sequence: Synthetic coding sequence
atggacaccagccccagccggaagtaccccgtgaagaagcgggtgaagatccacccaaataccgttatggtgaaatatacctcacactatccacaacccggtgacgacggatacgaggaaattaatgaggggtacggcaacttcatggaagagaatcccaagaagggactcctgagtgaaatgaagaagaaagggagagcgtttttcggaactatggacacacttcctccacccacagaagaccctatgataaatgaaattggccagttccagtctttcgccgaaaagaacatatttcaatccagaaagatgtggattgtcctgtttggctctgctcttgcccatggctgtgtcgcccttataacacgactcgtgtctgaccgtagcaaagtgccatctctggagttaatttttattagatctgtgtttcaggtgctctccgtcctagtggtgtgctactatcaagaggctccttttggcccatctggttataggcttaggcttttcttctatggtgtctgcaacgtgatctcaattacctgtgcctacacctctttttctatagtgccgccgagcaacggaacaaccatgtggagggccacaacaaccgtattcagcgcgatccttgccttccttttagtcgacgagaagatggcttatgtggatatggctacggtggtctgttctatcttgggcgtatgtttggtgatgatccccaatatcgtcgatgaagataattcattgcttaacgcctggaaggaggcctttggatacacaatgactgtaatggctgggcttacaaccgcactgagcatgatcgtgtacaggtctataaaagagaagattagtatgtggaccgcgctcttcacttttgggtggacaggaaccatctggggcatcagcacaatgttcatcctccaggagcccatcattccacttgatggagagacctggtcgtacctcattgctatctgcgtgtgctcgactgctgcttttctcggtgtgtactatgccctggacaaattccatccggctctcgtgtccactgtccagcacttggagatagtggtggctatggttttgcagttgctagtgctgcatatctttccgtctatttacgatgtttttgggggagtgattattatgatttcagtgtttgtgttggctggttacaagctgtactggagaaacctgagaaagcaggattaccaggagatcctcgattccccgatcaaatag

SEQ ID NO: 47396 - DNA, 1239 bp, Artificial Sequence
  Description of Artificial Sequence: Synthetic coding sequence
atggacaccagccccagccggaagtaccccgtgaagaagcgggtgaaaattcaccccaataccgttatggtcaagtataccagccattaccctcagcctggagacgatggctacgaggagattaacgaaggttatggcaatttcatggaggagaaccccaagaaaggccttctgagtgaaatgaaaaaaaaggggagggccttttttggaacgatggatactcttccaccgcctaccgaggatccgatgattaacgagataggacaatttcaatccttcgccgagaagaacattttccagtctaggaagatgtggatcgtcctttttggatctgctctagcccatgggtgtgttgccctgattacgagactcgtatccgataggtctaaagttcccagccttgaactgatttttattcggtccgtgtttcaggtgctcagtgtgctcgtggtgtgctattaccaggaggcccccttcggacccagtggctataggctgagattattcttttacggagtgtgtaatgtgatcagcattacttgcgcttacacctctttttcaatcgtgccccccagtaatggcacaaccatgtggcgcgctacaaccacagtgttcagcgctatcctggccttcctcctggttgatgaaaagatggcatacgtggatatggccacagttgtctgtagtatcctgggcgtttgtctggtaatgattcccaatatcgttgacgaagacaacagcctcctcaatgcttggaaggaagctttcggctatactatgactgtgatggctggtctgactactgccctgtccatgattgtttaccggagtattaaagaaaagatctccatgtggaccgcactttttacctttggctggacaggcacaatttgggggattagtactatgttcatcctccaggagcctattatccccttggacggtgagacgtggtcatacctgatagcaatctgtgtgtgcagcaccgccgccttcctgggcgtgtactacgccctagacaagtttcacccagccctcgtctcgaccgtgcaacatctggaaatagtggtcgccatggtcctacagttgctggttctgcatattttcccatccatctatgacgtcttcggcggcgtgataataatgattagcgtgtttgtgttggccggttataagctgtactggcggaacctgaggaagcaggactaccaggagatactcgacagtcccatcaagtag

SEQ ID NO: 47397 - DNA, 483 bp, Artificial Sequence
  Description of Artificial Sequence: Synthetic coding sequence
atggcccccgccctgtggcgggcctgcaacggcctgatggccgccttttttgctctggcagctctagttcaagtgaacgaccctgacgcagaagtgtgggtagttgtgtacactatacctgctgtattgactctgctggtaggactcaaccccgaagtcaccggtaatgtgatctggaaatccatctcggccattcacatactgttttgtaccgtgtgggcagtggggcttgcgtcttacctgcttcatcgaacccaacagaatatcttacacgaagaagaagggcgcgagctgagcggcctcgttattattaccgcctggataattctgtgtcacagctcatcaaagaatcccgtaggcggcagaattcaactcgctatcgccattgtcattactttgtttccgttcattagctgggtttacatttacataaataaagaaatgcgctccagctggcccacccactgcaagacggtcatttag

SEQ ID NO: 47398 - DNA, 453 bp, Artificial Sequence
  Description of Artificial Sequence: Synthetic coding sequence
atggcccccgccctgtggcgggcctgcaacggcctgatggccgccttctttgccttggctgcattggtgcaggtggtgtacacaattcctgctgtgttgaccctcctggttgggctcaaccctgaagttaccggtaatgttatctggaaatccataagtgctattcatatcctgttctgcaccgtgtgggcagttggcctggcatcatatctgctgcatagaacgcagcagaacatcctccacgaagaagaagggcgcgagctgtcaggcctggtgataatcactgcttggataatactgtgtcactcatcatcgaaaaacccagtgggcggcagaatccagctcgcaatcgctatcgtgatcacgctgttcccttttatttcttgggtgtacatttacataaacaaagaaatgcgttccagctggcccactcattgtaagactgtcatatag

SEQ ID NO: 47399 - DNA, 603 bp, Artificial Sequence
  Description of Artificial Sequence: Synthetic coding sequence
atgaagcagtaccagggcagcggcggcgtggccatggacgtggagcggtcaagatttccatattgcgtcgtgtggacacccattccagtgctgacatggttcttcccgataatcgggcatatggggatctgcacctcaactggggtcattcgtgacttcgcaggtccctatttcgtgtccgaagataacatggccttcgggaagccagcgaagtgccatctgcaagaagctttctcacaccccatcctcgttaggagcgggtgccacaataagatttcatctatagggtattggaagctcgatccggcacaagtgtacgcctccggacccaacgcctgggacactgctgtgcatgatgcaagcgaggaatacaagcaccgcatgcataacctttgttgcgacaactgtcatagccatgtggctctggccctgaatcttatgaggtacaacaactcgactaattggaacatggttacactgtgctttttctgcctcctgtacggcaagtacgtctctgttggggcattcgtcaagacatggctgcctttcatcctgttactgggtatcatcctcaccgtttccttagtattcaacctgcgctag

SEQ ID NO: 47400 - DNA, 627 bp, Artificial Sequence
  Description of Artificial Sequence: Synthetic coding sequence
atggccgaggccgagggcagcagcctgctgctgctgccccccccccccccacctccccgaatggcagaagtggaagcaccaaccgctgcggaaacagatatgaaacagtatcaagggagcggtggggtggctatggatgtggagaggagccggtttccctattgcgtggtgtggactcctattcctgtcctgacatggttctttcccatcattggtcacatgggaatctgcacgtccacaggtgtgattagagacttcgccggtccctacttcgtcagtgaggacaatatggctttcggcaaacccgcaaagtattggaaactcgatcctgcccaggtgtacgcctccggccccaacgcatgggacaccgcagtacatgatgcatcagaagaatataagcatcggatgcataacctttgctgtgacaattgccactcacatgtggcactcgccctgaacttgatgcgctacaacaattctacaaactggaacatggtaaccctctgctttttctgcctgttgtatggtaaatatgtatcagtcggagccttcgtaaaaacatggctgccattcatcttgctcctggggatcattttgaccgtttcactggtgttcaacttaaggtag

SEQ ID NO: 47401 - DNA, 609 bp, Artificial Sequence
  Description of Artificial Sequence: Synthetic coding sequence
atggccgccccctggcggcggtggcccaccggcctgctggccgtgctgcggccactcctgacctgtcggcctctgcaaggcactacgttacagagagacgtactgctgttcgagcacgacagggggaggtttttcacgatactgggtctgttctgtgctgggcagggggttttttgggccagcatggcggtcgcagctgttagcaggccccccgtcccagtgcagcctctggatgccgaagtgcccaaccgtggaccatttgatttgcggagtgcactctggagatatgggctagccgtgggatgcggagcaatcggtgctctggtcttaggggccggactgctatttagcctgcggagcgttcgctcagtcgttctaagggccggcggacaacaggtaacacttacaacccacgcgccctttgggctgggggcccacttcactgttcctttgaagcaggtgtcctgcatggcccatcgaggcgaagtgcctgccatgctgccacttaaggtcaaagggcgcagattttatttcctactggacaagactggacatttccctaacactaaactgttcgacaacactgtgggggcatatcgctctctctag

SEQ ID NO: 47402 - DNA, 678 bp, Artificial Sequence
  Description of Artificial Sequence: Synthetic coding sequence
atggtgcacgtgagcaaccggagcatccagggcatgaacatcctgttctccagctgggccgtggtcctcatggtgatgggcatcaccttggataagtgggttgagttgatttcagaggatgaacgggccaagatgaaccactccccatggatgatgtgttgcccagctttgtggcctgaggatgaccttaaggtagtccgcatcatgatgacgtcatctcttggcctgtccttcctgctgaaccttattttgggaatgaaatttacctacttgatccctcagaacaaatacattcagctgttcactactattcttagcttcttctctgggatcagcttactatgggcacttatcctgtatcataacaagctcaagcaaggccagtcaatgcacttttccaactaccgaattacatggatcatgtatacggcttatctgaatgttttcttcctctctgtttgtggggtactctcactgttggagtgcaagctttccacttccagctgcacttgcctcaacatccataaatcggacaatgagtgcaaggagtccgaaaacagtatcgaagatatatcgctgccagaatgcaccgccatgccaagatcgattgtgcgggcgcacacagtgaattcactgaacaagaaagtacaaacaaggcacgtcacctgggcgttgtag

SEQ ID NO: 47403 - DNA, 1143 bp, Artificial Sequence
  Description of Artificial Sequence: Synthetic coding sequence
atggccggcagcgacgtggacagcgagggccccgcccggcggggcggcgccgccaggcggcccggtgcacccggaggtccaggtagtgaagccgccgctgggtgcccagagccgctttctacggcagaggccccggcggagtctgcaactctgcccgcgtggatgagactctatttctacggcatgcatggaatcactctcgatgtcctggttagctccgcaaggcggttcgccagaagccccgatctgcgcatgttaggattctctagcccgtaccggtgtttattacacagccttacacatttcgctctggagaaggtgtatctgcaacagcgacgttgtcccaacgctttcgtctttaacttcctcctctatccatcagcacatgtgggactccagacgcttgctggtcaagccctgctcctgtccttgggagggggtgccggagtggctgtggccccaggggcactggatctggccctccagtacgtgttggcgctgtaccactgtcaggtgtttctcaagcgattcctgcggctaagatatggccggcagcgcaggaggcaacagcaacagcagcaacaacaacaacaacagcagcggagaggtgctcttcccgtccccccaggtgccagggtcccaaccgcggccggagccaggcggcgtcggcccaggggccctcggggagctggcggggctccttctcaaggtttgcctgacctgcctaggtttctattctttggaatgcacggtttcctcgacgagatattctttacattctttttcaacgtactggggcagggcgatggcaccaccagcggtcatacttcactgtggtcattctttatgtatgggagctgctcctttgtggtggaaaagttgtatttccatcttcactattctcggggttggggcacctggaagcgagtacccatatatgtgattttcatctacgtgtgggaactctcctggggtctaggcttaagaacctgcggcgcttgctcttgggattattcacactatccacttaacttcatgggtttgatcacgctgatgtacttgcccggctggatcttcctctccgtttatcaggatctgattagcaatgtcctttggcgggtgcagtacgttcccgccaactag

SEQ ID NO: 47404 - DNA, 504 bp, Artificial Sequence
  Description of Artificial Sequence: Synthetic coding sequence
atggccagcgccgagcccctgaccgccctgagccggtggtacctgtacgccatccacggatatttttgcgaggttatgtttactgccgcctgggagtttgtggttaacttgaattggaagtttcctggggtgacttctgtctgggccctttttatctatgggaccagtatccttatcgtagaaaggatgtacctccgactgagaggccggtgtcctctattgctccggtgcctgatatataccctttggacttacctgtgggagttcaccaccggcttcatcctgagacagttcaacgcctgcccatgggactatagtcagtttgattttgattttatgggtctaatcacactggaatacgcagtgccatggttctgcggggctcttattatggagcagttcataataaggaatactctccgcctgagattcgacaaggacgctgagccaggggagcccagcggcgccctggccctggccaatggtcacgtcaaaactgattag

SEQ ID NO: 47405 - DNA, 405 bp, Artificial Sequence
  Description of Artificial Sequence: Synthetic coding sequence
atggccagcgccgagcccctgaccgccctgagccggtggtacctgtatgccatacatgggtacttttgtgaagtgatgttcactgctgcctgggagttcgttgtgaatctgaactggaagtttcccggcgtaacttctgtgtgggccctgttcatctacggcacttccatactgatcgtcgaaaggatgtatctccggttgagagggagatgcccccttttgttacggtgcctgatttacactttgtggacatacctttgggagttcacaacaggattcatcttaaggcagttcaatgcatgcccgtgggactactcacagttcgatttcgacttcatggggttaatcacactcgagtacgcagttccatggttttgcggtgctctgatcatggagcagttttag

SEQ ID NO: 47406 - DNA, 240 bp, Artificial Sequence
  Description of Artificial Sequence: Synthetic coding sequence
atggccagcgccgagcccctgaccgccctgagccggtggtacctgtatgcaatccacggatacttttgtgaggtgatgttcactgctgcttgggaatttgttgtgaatctcaattggaagtttccaggcgttacgagtgtgtgggccctcttcatctacggcacgagcattctgatcgtggagaggatgtatttgcggctgcggggaaggtgtcccctgctcctaaggtgtctaatttag

SEQ ID NO: 47407 - DNA, 504 bp, Artificial Sequence
  Description of Artificial Sequence: Synthetic coding sequence
atggccagcgccgagcccctgaccgccctgagccggtggtacctgtacgcaattcacggatacttttgtgaggtaatgttcaccgctgcttgggagtttgtagtaaacttgaactggaaatttcctggggttacctctgtctgggccctgttcatctacgggaccagcattctcattgtggaacggatgtaccttagactgaggggccgctgccctctgttgctccgctgtttgatctacacactgtggacctatctctgggaatttacgaccgggttcatcctgcgtcagttcaacgcatgcccgtgggattacagccagttcgatttcgacttcatggggctcattaccctggaatacgctgtgccttggttctgtggggccctcatcatggagcagtttatcatacggaacaccttacgtcttaggtttgacaaagacgcagaacctggggagcccagtggagcactggcattggcgaacggacacgtgaaaaccgattag

SEQ ID NO: 47408 - DNA, 171 bp, Artificial Sequence
  Description of Artificial Sequence: Synthetic coding sequence
atggccagcgccgagcccctgaccgccctgagccggtggtacctgtacgctatccacggatatttttgcgaagttatgtttacagcagcttgggagtttgtcgtaaaccttaattggaaattccctggggtgacaagtgtctgggccctatttatctacggtacttcgtag

SEQ ID NO: 47409 - DNA, 504 bp, Artificial Sequence
  Description of Artificial Sequence: Synthetic coding sequence
atggccagcgccgagcccctgaccgccctgagccggtggtacctgtacgccattcacggatatttttgtgaagtgatgttcactgccgcatgggaatttgtggtgaacctgaactggaaatttcccggggtcaccagcgtgtgggcactgtttatttatggaacctccatcctgatcgtcgagcggatgtatttgcggctgcgcggccgttgccctctgctcctaagatgtctgatatacactctctggacctatctgtgggaatttaccactgggttcatccttcgacagttcaacgcttgtccgtgggattactcacagttcgacttcgacttcatggggcttatcactttagagtacgccgttccatggttctgtggtgctttaattatggagcagtttatcattcgcaataccttgcgcctccgcttcgataaagacgctgagcctggcgaacctagtggtgcactcgcacttgcaaatgggcacgtcaaaacagactag

SEQ ID NO: 47410 - DNA, 168 bp, Artificial Sequence
  Description of Artificial Sequence: Synthetic coding sequence
atggccagcgccgagcccctgaccgccctgagccggtggtacctgtacgctattcacggctacttttgcgaggtcatgttcacagccgcctgggaattcgtggtgaatctgaactggaaattccccggtgtgactagcgtttgggcgctcttcatttatgggacttag

SEQ ID NO: 47411 - DNA, 951 bp, Artificial Sequence
  Description of Artificial Sequence: Synthetic coding sequence
atggccctgtacgagctgttcagccaccccgtggagcggagctaccgggccggactctgttccaaggctgcccttttcctgctcctcgccgctgccctcacctacattcctccactccttgtagcattccggtcccacggcttttggctcaaacggtcatcatacgaggagcagccgactgtacgttttcaacaccaggtactgctcgttgccctgttgggaccagaatctgacggatttctggcatggtcgacattccccgcctttaaccgtcttcaaggcgacagactgagagttcccctggtgtcaacacgggaagaggaccggaaccaagatggtaagacagacatgctccattttaagctcgaattgccactgcagtcaactgaacacgtactcggggttcagctgattctgacattctcatacagactccacaggatggctacactggtgatgcagagcatggcttttcttcagtcatcttttccagtcccaggatctcagctatacgttaacggcgacctgagactgcaacagaaacaacccttaagctgcggcggtctggacgccagatataatatttccgtcattaatggcacatccccattcgcgtacgattacgatctgactcacatcgtggctgcctaccaggagaggaatgtcacaactgtgctcaatgatcccaatcccatatggcttgtgggccgcgccgcggatgctccctttgtgattaatgccataattcggtatccagtggaggtgatcagctatcagcctggattctgggagatggtgaagttcgcctgggtccagtacgtctccattttgttgatcttcctttgggttttcgaaaggattaagatattcgtatttcagaaccaggtagttacaacaattccggtcactgtcactccacgcggagacctatgtaaagaacacttgtcctag

SEQ ID NO: 47412 - DNA, 1038 bp, Artificial Sequence
  Description of Artificial Sequence: Synthetic coding sequence
atgagcagcagcctgacccggagcagcgccgtgaccgcccggggcagtgcacccaaaccaagatgctcatgttgttggccattgagatctagaacgtctcggcgctgttggtggccaagcggagccactgtgagtttgcctcggcctctctgtcacgaggcacctcgtgcccgatcagcgcgagccgggcttcccaataggctgcctactgctttatttaactccggcttttggctcaagcgctccagttatgaggaacaacccaccgtgcgctttcaacatcaggtactgctggtagccctgctgggacccgagagcgatggctttcttgcttggagcacttttccggcatttaacagattgcagggggacaggcttcgggtgccgttggtttcaacacgagaagaggaccgcaatcaggatggaaagactgacatgctccactttaaattggagctgccactgcagagcactgaacacgttctgggggtgcagctcatcctgaccttcagttaccgtcttcatagaatggcgacgctagtgatgcaatcaatggcttttctgcaatcctcattcccagtccccggctctcagctgtatgtgaatggagaccttagactccaacagaagcaaccgctgtcctgtggcggtctggatgctcgctacaatatctctgtaattaatggaacaagtccattcgcctacgactatgacctgacgcatattgttgcggcttatcaggagcgcaatgttacaaccgtgttgaatgacccaaaccccatctggctggtgggcagagcagccgacgcaccctttgttatcaacgccatcatccgctatcctgtggaagttatttcttaccagcctggattctgggaaatggtcaaatttgcttgggtgcagtacgtttctattctcctgatcttcctgtgggtcttcgaacgcataaagatatttgtctttcagaaccaggtcgtgaccacgatacccgtgacggtgacccctcgcggggacttgtgcaaagaacatttgagctag

SEQ ID NO: 47413 - DNA, 1521 bp, Artificial Sequence
  Description of Artificial Sequence: Synthetic coding sequence
atgaacatgcccgtgaacaagagccccatgatcaacacctgcggcggtatctcttcaccgtaccacgaggagctgtggaaactcaactttcaacatttatcaggggagcggggtcataaatcaaggccaaccttttcaataacaaaggaatttatccttcgatttaatcagacccagaattctaaggaaaaggaagagctgttggagctggcaaggaaaattatcttgcggtgcaaacggaaactcgggctcaaaaccctgggcagcggcagacatgtgcacctcccagcagcttggacagaggtgatatatctcgctcagtgcaagggagaaatccaggacgagagcctcaatatgttgtacgcctccctggaccacgcaagtttcgattacgatcacctccccgcactgttcttcgtcgcagagagcgttctttaccgcttgtgttgtgacgcctcactcaaaacttacctatacagtgtagaaatcaagctggcaaaaattgggtatcttgtgttcctgagactgttcatcttctttctccatggtcacctagagagctttaagcagcacctgctcagactgcagccgtatctgtatgcattgtcatttagtggggcttcttaccataagtatcctaatattttttcaaacgttcagttcatcctgaaggcttctgagatcatcggcaaacgcgagttacggtcagagtcaattttccgccccgtagaagacaagaagaggtacgaaaataccgattctgatatgggggggtatgaaataaatcacctgctctggcactgcgtggccgcatggagctgcgtgcagaacaattccccacaactcaacaacgtgctagagcatctggtgtttcacaaaacacagctccagaagaagtgttggcttgactctgtgctggccctgctcgtactgggcgaggcagctaagctcaacatggcttgtctgaaggctctcatggatgtggtgagggatttcgttagtagtattatgtcagtgcagaatcaagaggagtcttgcaaagtcgatgatttctcatgggcttggaacgtcgtgtacatatataccgtcatcttagccgaaatctgcctatacgccgcgacttcagacttgagaaaaaccgccctgataggtttctgccactgcaagagttcgcaaaaaaatattctgtaccttgataagtctgtcccgccagagctgaaagagaccagcatcttgtccctcctggagtacttcagctccaagatgtccgagaattgtgaccaggtggtttggaccggttactatgggctcgtatacaacctggtgaagatcagctgggagctgcagggggacgaggagcaggacggactgaggaatatgatttggcagactttgcagaaaaccaaagactatgaggaggacgtgcgcatccagaatgctataaatatcgcccagggtacttccttttgcatccggaacagtcatgtcagcatctccagattccttcatcagggcaggtag

SEQ ID NO: 47414 - DNA, 1974 bp, Artificial Sequence
  Description of Artificial Sequence: Synthetic coding sequence
atgaacatgcccgtgaacaagagccccatgatcaacacctgcggcggcattagcagcccataccacgaagagctgtggaaactgaactttcagcatttgtccggagaacggggccacaaaagtcgccctacgtttagtatcacaaaagaatttatattgagattcaaccagactcaaaatagtaaggagaaggaggagctgctcgagctcgcccgcaagattattctgcgctgcaagagaaagttgggccttaagaccctgggatcaggtagacatgttcacctgcccgccgcatggaccgaggtaatatatctggcacagtgcaagggagagattcaggacgaaagcctgaatatgctgtacgcctccctggaccacgcatcattcgactatgaccacttaccagcgctgttttttgtggccgagtccgtcctgtatcgcttgtgctgcgatgctagcctcaagacctatctctatagcgtggagatcaaactggccaaaatcggttacctagtcttcctgcgactttttatatttttcctccacggacatctggagtcgttcaaacagcacctactgcgactgcagccgtacctctatgccctgagctttagtggagcctcatatcataagtatccaaacatcttctcaaatgtgcagttcatcctgaaagctagtgagatcattggaaaacgagagctccggtcagagagtattttcagacccgtcgaggataagaagaggtacgaaaacactgacagcgacatgggcggatatgagatcaatcatttactgtggcattgcgttgccgcatggtcttgcgtgcagaacaactcaccacagctgaataatgttctggaacacctggtctttcataagacccagctgcagaagaagtgttggctagatagcgtgcttgctctgcttgtactcggcgaggctgctaaactgaatatggcttgcctcaaggctctgatggatgtagtgagggattttgttagtagcatcatgagtgtgcaaaaccaggaggagagctgtaaagtggacgatttctcgtgggcatggaacgtagtctatatctatacagttattttggccgaaatatgtctgtatgccgcaactagcgacttacgaaaaaccgctctgatagggttctgtcactgtaagtctagccaaaagaacatcctgtacctggacaagagcgtgccccccgaacttaaggagactagtatcctttccctccttgaatatttcagctctaaaatgtccgaaaattgcgatcaagtggtctggaccggctattacgggcttgtctacaatcttgtgaaaatctcatgggagcttcagggcgacgaggaacaggacggattacgaaatatgatttggcagacactccagaaaaccaaggactacgaagaggacgtacgcattcaaaacgctattaacatagcccaggctgaactgaatgatcctacagacccattcactcgctactccacaaacatttcatccaacgtgggcgaagaggttttctccaaatatatcggctggcgcatagctaataccctgtcaaagctgttcttccctccgattgaggctcactttcttcccctcaaaaagccctctattaaaaaggatcagactaaatatcccaacaagaaacttgagtcagtaaaaaagcaagtgttgcattttactgtgcgggaacatccgagcgtgagcgagatcccaatgttcccatatcctgactttttcaccaaggcggacaaggagctggcaaagattatcgatcaccattggcaggaggagctaaaaataagagaaaaggaggacgccatctgtaaggcccaggagctcaaggataagaaactcgctgagaagaaccatttccaggaagtgatgaaaaaacgtgaagaaaaattacacaagcagactaaaccttatgaactcccatatagaaaggaggtcatatag

SEQ ID NO: 47415 - DNA, 330 bp, Artificial Sequence
  Description of Artificial Sequence: Synthetic coding sequence
atgagccagtacgcccccagccccgacttcaagcgggccctggacagtagccccgaagctaataccgaagatgacaagacagaggaagatgtccctatgccgaaaaattacctgtggctgacaatagtgtcctgcttctgccctgcctaccccattaatatcgtggcattggttttttcaattatgtcacttaactcctataacgatggcgattatgagggcgctcggcggctaggccgtaacgccaagtgggtcgccattgccagcattatcatcgggctgctgattatcggcatatcttgcgccgtgcatttcactagaaatgcttag

SEQ ID NO: 47416 - DNA, 423 bp, Artificial Sequence
  Description of Artificial Sequence: Synthetic coding sequence
atggccgccagcctgggccaggtgctggccctggtgctggtggccgccctttgggggggaactcagccattacttaaacgggcgagcgctgggctccaacgagtccacgaaccgacctgggcgcagcagctactgcaggagatgaagaccctatttttaaacacagagtacctgatgccttttttgcttaatcagtgtggctccctcctttactatctaaccttagctagcacggacctgaccttggccgtacctatctgtaactcattggccataatttttactttaattgtaggcaaagctcttggcgaagacataggtggaaaacgcgccgttgcaggtatggttcttactgtcataggcatttccctctgtatcacgtcatctgtgagcaaaacacagggtcagcagtccacactctag

SEQ ID NO: 47417 - DNA, 495 bp, Artificial Sequence
  Description of Artificial Sequence: Synthetic coding sequence
atggccgccagcctgggccaggtgctggccctggtgctggtggccgccctgtggggcggcacccaaccactgcttaaacgtgcttcagcgggtctgcagagagtgcacgagcctacctgggctcaacagctgcttcaggaaatgaagactctgtttctgaacaccgagtaccttatgcccttcctgttgaatcagtgtgggtcccttttgtattatctgactctagcatctactgacctgactcttgccgtaccaatttgtaattcactggcaatcattttcacgcttatcgtcggtaaagctctgggggaagatatcgggggcaagagggccgtcgccggcatggtgctaaccgtgatcgggatttcactttgcatcactagttccgtcccatggactgcagaactacagctgcacggaaagggtcagctccagacactcagccaaaagtgcaaacgcgaggcaagtggcacgcagagtgagcgattcggttag

SEQ ID NO: 47418 - DNA, 495 bp, Artificial Sequence
  Description of Artificial Sequence: Synthetic coding sequence
atggccgccagcctgggccaggtgctggccctggtgctggtggccgccctgtggggtggcacacagccgctgttaaaacgagcctcagccggattacagcgcgttcacgagcctacgtgggctcaacagctgctccaggagatgaaaaccctgttcctgaacactgagtatttaatgcctttcctgctgaaccagtgtggatccttgctgtattatctcactctggcatcgacagaccttacactcgcggtccctatttgtaacagccttgccatcatttttaccctgattgtggggaaggcgctcggagaggacatcggaggcaagagagctgtggctgggatggtgctcactgtgatcggcatctcactgtgcataacatcatctgtgccgtggaccgctgaactccagttgcacgggaagggccaacttcagacactgagccagaagtgtaaacgggaagcctccggcacacagtctgaacgctttgggtag

SEQ ID NO: 47419 - DNA, 495 bp, Artificial Sequence
  Description of Artificial Sequence: Synthetic coding sequence
atggccgccagcctgggccaggtgctggccctggtgctggtggccgcgttgtggggcggcacacagccactcctcaagcgggccagtgctggtctccagcgggtgcatgagccaacttgggctcaacagcttttgcaggaaatgaaaacacttttcttaaatactgagtatctaatgccgtttctgctgaatcagtgcggtagtctgctctactacctcacactggcatctactgacctcaccttggcagtgcccatttgtaattccctggccattatttttactctaattgtgggtaaggccctgggagaagacataggaggaaagcgtgcagttgccggcatggtgttgaccgtcataggaatttcactctgtattacatccagcgtgccttggacagccgagctccaactgcatggtaagggacaactgcagaccctgtcacagaagtgtaaacgcgaagcctctggcacccagtccgaaagattcggctag

SEQ ID NO: 47420 - DNA, 495 bp, Artificial Sequence
  Description of Artificial Sequence: Synthetic coding sequence
atggccgccagcctgggccaggtgctggccctggtgctggtggccgctttatggggtggtacccaaccgttgctgaagagggccagtgcgggactccaacgtgtgcacgagcccacttgggcccagcagctgttgcaggagatgaagacattgttcctgaacaccgaatatctgatgccatttctactgaaccagtgcggcagtctgctctattatttaacgctggcctcaaccgatctaacactggctgtacctatctgcaatagcctagctatcatctttactctcattgtcgggaaagctctaggagaagacataggtggtaaaagggccgtggcaggcatggtgttaaccgtgataggtatttccctgtgcatcaccagcagcgttccctggaccgctgaactgcagctgcacggaaagggacagctgcagactctgagtcagaaatgtaagcgagaggcctctggaacacagtctgagaggttcggttag

SEQ ID NO: 47421 - DNA, 486 bp, Artificial Sequence
  Description of Artificial Sequence: Synthetic coding sequence
atggccgccagcctgggccaggtgctggccctggtgctggtggccgccctgtggggcggcacacagcccctcctcaagcgtgcttcagccggcctgcaacgagtccacgaaccaacttgggctcagcagttgctccaggagatgaagacgctatttctgaacaccgagtatctcatgccttttttgctcaaccagtgtggcagcttattgtactatttaacccttgcttctacagacctcacgctcgccgtccctatttgtaattccctggcaatcatttttactctgattgttggcaaagcactaggcgaagacatcggaggcaagccggtcctcctgccatgtgggcaccagagttctctccccttggactcactggagaaggataggggctggggcctggggcttaaaacgcgaccccacctttccccttcttcatcgccagtgcctgctcccacaggcatggcagaattgcgaccttcatag

SEQ ID NO: 47422 - DNA, 591 bp, Artificial Sequence
  Description of Artificial Sequence: Synthetic coding sequence
atggcccggctgggcgccctgctgctggccgccgccctgggcgccttgttatctttcgctctgctggctgcagctgtggcttcagattattggtacatcctagaggttgccgatgctggcaacggatcagcatggccgggtcgggcggagctgctgagttcccatagtggcctatggagaatttgtgaagtgctccaccgcgccgtgattgtcgtcctgcctttgagcttagtactgttggtgtgcggctggatttgcggccttctcagcagtctggcacaatccgtgagtctcctgctcttcaccggatgctatttcctgctgggctcagtattaaccttggctggagtttctatctacatctcgtactcacacttggcctttgcagagacagtccaacagtacggaccacaacatatgcagggggtgagagtgtccttcggctggtctatggccttggcatggggaagttgcgccctcgaggccttctcaggcacactgttactgagcgccgcgtggaccctgagcttgagtccgccgatatgcgggcatctgtccccccaacaagtcggcgggagaggcggggattag

SEQ ID NO: 47423 - DNA, 1185 bp, Artificial Sequence
  Description of Artificial Sequence: Synthetic coding sequence
atgcccagcggctggagcagcggcctgatccagacccggacccccggccctgccagagcacgacttctgtgcttccaagagcacggatgggtcgtcctgttaccgggtcggccatctagctgggggcggtctcttgcagatcctccaagctcttcccaagctctgcattcccccgcgaggcaagtgcacctggtctggctccttcggagccgaggtttcagggagattaaagaaagggcacagggccccggtgcatcaccatggggaaggtgggactggtcacctagcccgaggttcgccgcaaggctgtctactagctcccccttcccacagggcagggctcagagaccacagagaggcggcgtggacctgcccgccactcctggaggcccacgcggtcagtgcgctggtcgttcgggagacgtcctgagaagagcagggcggcgacgggccagaccaccacccgtcccaagattgcccgcaccacgggcgccaagacggcctaggggaccagccacccccgatccctcccctccagctggacgaccccacggcccagccggtcgtgcggcacccggcagacgtccaggctgcacagcccagctgagggcacccggccgacggggaagacaacgattactggtccacccaggcgggggaggccgcagacagtggcagagactggcccgggctcggagagcagcgctgctggctcttggtgccctggcccacctgcgcaggtgtccagacactggcgggggacagcatttacaccagctgctagcccctggactgtgcggtgacggggctgctgtttggcccgctgcacatgctggccggcccaggcagttgcggctcgtgcacgggcctgggctcgggttgctgtgtttgggtgggatccagaggaacccgcccgccctttcctgcttagacccgcaaccagagcccccaaacctgtggtctagtgagtcaccagccggcggtcgcgagcgtggccgcctgagaccaagggccgccgagggtcccacccagatcgcatggcggcagagggatgcagtgtctggtcagggacttcctggattgtgcagcgtgcactctcctcgtcgagccggtctggtcgaaaaacggttgatgcggggccctgagtcccctagcgatctgcaaggttggggggcacgcagctag

SEQ ID NO: 47424 - DNA, 453 bp, Artificial Sequence
  Description of Artificial Sequence: Synthetic coding sequence
atggcccggctgggcgccctgctgctggccgccgccctgggcgcccttctgtcattcgccctccttgctgccgccgtcgcatcagactactggtacatcttggaagtcgcggatgccggcaatggctcagcgtggcccgggcgggcggaactgctgtcttctcacagtgggctgtggcgcatatgcgagggtgtgcttaccctggctggggtgagcatatacatcagctatagccacttggctttcgcagagacggtccagcagtacggacctcagcatatgcagggagttagagtgagtttcggatggtcaatggcactcgcttgggggtcttgtgctctggaggctttttccgggactcttttgctttctgctgcttggaccttgagcctgtcgccacccatttgcgggcacttgtcaccccagcaggtaggcggcagaggcggggactag

SEQ ID NO: 47425 - DNA, 591 bp, Artificial Sequence
  Description of Artificial Sequence: Synthetic coding sequence
atggcccggctgggcgccctgctgctggccgccgccctgggcgccctactgagcttcgctctgctcgccgccgccgtggcatctgattattggtacatactggaggtggccgatgcgggaaacggctctgcctggcctggccgggcggagctcctgtcctcacatagcgggctatggcgtatctgcgaggtcctgcacagagctgtgatcgtcgtccttccgctgagtctcgttctgctcgtctgtggctggatctgtggcttgctatcgtctctggcacagagcgtgtcgcttctgttgtttaccggatgttactttctgttgggatctgttctgaccctagctggggtgtccatttatataagttattctcacctcgcattcgccgaaacggtgcagcaatacggaccacagcatatgcagggagtacgcgtcagttttggttggtctatggcacttgcctggggttcgtgtgccctcgaagccttctccgggaccctgcttctgtccgccgcctggacactgagcctctcaccacccatctgtggtcacctaagcccccagcaagttggtggccgagggggtgattag

SEQ ID NO: 47426 - DNA, 672 bp, Artificial Sequence
  Description of Artificial Sequence: Synthetic coding sequence
atggcccggctgggcgccctgctgctggccgccgccctgggcgccttgctctcgttcgccttgttggctgcagcagtggcaagcgactactggtatattctggaggtggccgatgctgggaatggctccgcttggccgggcagggctgagctgctttcttcccactccggtctctggcgcatttgcgaaggacaaaacggttgcattccactggtagaccctttcgcgagtgagagtctcgacgtctcaacctctgttcagcatttgatcctgttacaccgtgctgtgatagtggtgctgcctctctccctggtgctgttggtatgcggctggatctgcggtctactcagctctttggcacagtccgtttccctgctgctctttaccggctgttacttcctgctcggctccgtgctaacgctggctggggtgtctatttatatatcctatagtcatctcgcctttgccgaaaccgtccagcaatacggaccacagcacatgcagggtgtaagggtttcattcggctggtccatggcgcttgcatggggcagctgcgcgctggaagcctttagcggcacactgcttctttcagctgcttggacactctccctctccccaccaatctgcggccatctgtccccccaacaggtgggcggaaggggcggagactag

SEQ ID NO: 47427 - DNA, 453 bp, Artificial Sequence
  Description of Artificial Sequence: Synthetic coding sequence
atggcccggctgggcgccctgctgctggccgccgccctgggcgccttactgtcattcgcacttttggctgcagcagtggcttccgattactggtatattctggaggtggccgatgctgggaatggctctgcgtggcccgggagagcagagctgctgtccagtcattccggactttggcgtatctgcgaaggggtgttgaccctggccggtgtgtccatatatatctcctactctcatctggctttcgcagagacagtgcagcagtatggtccacagcacatgcagggggtccgggtgagcttcggatggtctatggcccttgcatgggggtcatgtgccctagaggctttctcaggaactctactattgagtgccgcctggaccctgtctctgtcgcctccaatatgcggacacctgagtcctcagcaggtcgggggtagagggggggattag

SEQ ID NO: 47428 - DNA, 1056 bp, Artificial Sequence
  Description of Artificial Sequence: Synthetic coding sequence
atggccagcggccggctgatcaagttcgtggtgttcgagctgctggagttcgccgcattctccatccccacacttgtgatcactgagcagtttgccacagcctaccaagggacccgggctcgtagtgacaacacacattattggctgatcattagttgtagcatcgcttacgttgccctggtgaccctcctgatctgggtgccggtgaaggtgatactgcacaagaagcgctacatttacaggaagattaagggttggcgtcctgttctgatgatgtgtgtagttctgaccacattaccgtgcctcacgtttagcatagctgtgactgaggttcagaagtctataaatgggagcgcagatgtgttgcccgatatgctacctgatctaccagtaagcctggtgctgctctcactgatcatggtcgatatcatcgagaaactgcgcatataccccctccggggaagccagaaatcttcggagaacggccatatacacagcacaagtctacagcacatcaaaacagtaacggagcaggtccgccagtcccctgagaatgcagcctcaccccaggcaaccaactctacccaggtgtctcagccttcgggtgccatgacgcgaagccaggaaagcgtctttatggggccacaagaaccatcctgtgacagcggcattctcagaatgatgagccggagagatgttcgcgccgagttgttcttgtggagctttctgctgtggtccgacacgattgagatggtaagggtcgctggacaccctaacgtatacaaatcctcctggctgtacccggtttacatcttttctttcatcagccttttgcggataacatttaccccccagaatccactgctgaattccctgagcgtcctgcttcaagacctgccctttgtgttcgttaggcttggactcattatagcgctggggacgataactcccgtgttgggcctgtgtaaaaatattctcgtgactctgagctacatctactttaactatctgacaaggatccgcatattcagcgcatttgagatgtcccctttttag

SEQ ID NO: 47429 - DNA, 1056 bp, Artificial Sequence
  Description of Artificial Sequence: Synthetic coding sequence
atggccagcggccggctgatcaagttcgtggtgttcgagctgctggaattcgccgccttctcaattccaacactggttattacagagcagtttgcaacagcctatcaagggactagggccagatcagataacacccattactggctgattatctcttgtagtatcgcttacgtggcgctggtgactctgctcatctgggtacctgtgaaagtcattctgcacaaaaagagatatatctaccgaaagataaaaggctggcgccccgttcttatgatgtgtgtcgtgctaaccacattgccttgtcttacatttagcatagctgtgacagaggtgcagaagtccattaacggaagcgccgatgtgctaccagacatgctgcccgacctccctgttagcctggttctgcttagcttgatcatggttgatattattgagaaactcagaatatatcctctgaggggcagtcaaaaatcttctgagaatgggcatatacattctacctcactgcaacacataaagactgttacagagcaggtcaggcagtcccctgagaacgcagccagtccccaagctacaaactccacacaggtctcccagcctagcggcgccatgacacgctctcaggagtctgtgttcatgggcccacaggagccttcctgcgatagcggaatcttgagaatgatgtctaggcgcgacgttcgagcagaactgttcttgtggagctttctcctttggtcagacactatcgagatggtgagagtcgctggacacccgaatgtgtacaagtcatcctggctttacccagtgtatatcttttcattcatctctctgctgcgaattacattcacaccccaaaatccactcctcaattctctatcagtattattgcaggatctgcccttcgtgttcgtgcgacttgggctgatcattgccctgggcacaatcacaccagtacttggactctgcaaaaacatcttagttaccctgtcgtacatatacttcaattatttgaccaggattcgaatttttagcgcattcgagatgtcccctttctag

SEQ ID NO: 47430 - DNA, 1056 bp, Artificial Sequence
  Description of Artificial Sequence: Synthetic coding sequence
atggccagcggccggctgatcaagttcgtggtgttcgagctgctggagttcgcagccttctctatccctacattggttattacggagcagtttgctaccgcataccagggcacccgtgctcgatcagacaacacacattattggctaattatttcttgcagcatcgcctacgtggctctggtcaccctgctgatctgggtacccgtcaaagttattctgcacaagaagcggtacatatacagaaagataaaggggtggaggcccgtgctgatgatgtgcgtggtgttgactactctgccttgcctaacattctccatcgccgtgacagaagtgcagaagagcatcaatgggagcgccgatgttctgccagacatgctccctgacctgcctgtgagtctagtgttactgtccctgattatggtcgacatcattgagaaactcaggatttacccccttcgagggagccaaaagtcctctgagaatgggcatattcacagtacctccctgcagcacataaagacagtgaccgagcaggtccggcagagtcctgaaaatgcagcttccccccaggctacgaattcaacccaggtcagccagccatcaggagcaatgactagatcacaggagtcagtattcatggggccccaggaacccagttgcgattcaggtatcttgcggatgatgagccgtagggacgtccgcgccgaattgtttctctggtcctttctactttggagcgacacaattgaaatggttcgagttgccggacatccaaatgtgtacaagtctagctggctgtacccagtctacatttttagttttatttcactcctcagaattacttttacgccccagaaccctcttctcaactcattgagtgttttgctgcaagacctaccatttgtctttgtgagactgggcctgatcatagccctaggtactattacaccagtcctcggcctgtgtaagaacatcctggtgactctttcatatatctacttcaattaccttactagaattagaattttctctgcgttcgaaatgagtcctttttag

SEQ ID NO: 47431 - DNA, 1056 bp, Artificial Sequence
  Description of Artificial Sequence: Synthetic coding sequence
atggccagcggccggctgatcaagttcgtggtgttcgagctgctggagttcgctgcattctccattcctacactggtgatcaccgagcagtttgcaacagcatatcagggtacccgcgcgcgatctgacaacacacactactggctgatcatatcatgttctatcgcatacgtggcattggttacattgctgatatgggtgcctgtaaaggttatcttacacaagaaacgctacatataccgtaaaatcaagggatggcgccctgtactgatgatgtgtgtggttctgactactctgccgtgcttgacattctcgattgccgtgacagaggtgcagaagtctatcaacggctccgcagatgtcctacctgacatgctgccagatctgcccgtatctctcgtcctgctgtcactcataatggtggatatcattgagaagctccgcatctatccattgcgcggttcccagaaaagtagcgaaaatgggcacatacacagcaccagcttacagcacatcaaaaccgtgaccgaacaggtcagacagtcgccggagaatgcggcatcacctcaggcgacaaattccacccaggtttctcaaccaagcggggccatgacccgctctcaggagtcggtgtttatgggtccacaggagcccagctgcgactcaggtatcttacgcatgatgagccggcgagacgtcagagcagaactgtttctgtggagttttttgctgtggtctgatactattgagatggttagggtagccggacatccgaacgtgtataagtcctcatggttataccccgtgtatatattctctttcatttccctgttgcgaattacgttcacgccccagaacccactcctaaattccttatccgtgttgctgcaggacttacccttcgtgttcgtacgacttggattaatcatagcactaggcaccatcaccccggtgctaggactctgtaagaacatattagttactctgagttatatctatttcaattaccttacaagaattcggattttctccgcattcgagatgtcaccgttttag

SEQ ID NO: 47432 - DNA, 522 bp, Artificial Sequence
  Description of Artificial Sequence: Synthetic coding sequence
atgagcatgagcgccaacaccatgatcttcatgatcctgggcgcctccgttgttatggccattgcctgcctgatggacatgaacgccctgttggatcggttccataattatatacttccccatctgcgcggggaggatcgtgtctgccactgcaactgcggccgacaccatatccactatgtaataccttacgacggggaccagtctgtggtggacgccagcgagaactacttcgtaacggactccgtgacgaagcaggaaatcgaccttatgcttgggctgttactgggtttttgtatcagctggttcctggtgtggatggatggcgtgttacactgcgctgttcgggcatggcgcgcagggagaagatacgacgggtcttggacgtggctgccaaaactctgctccttgcgcgagttaggcagacggcctcataggccatttgaagaagccgccggaaatatggtacatgtgaagcagaagctctatcacaatggacatcccagccccagacacttatag

SEQ ID NO: 47433 - DNA, 522 bp, Artificial Sequence
  Description of Artificial Sequence: Synthetic coding sequence
atgagcatgagcgccaacaccatgatcttcatgatcctgggcgccagcgttgttatggccatagcgtgcctgatggacatgaatgctcttttggaccggttccataactatatcttgccccatctaaggggcgaggacagggtgtgtcattgtaattgcgggaggcatcacatccattacgtcataccttatgatggagatcagagtgttgtggacgcttccgaaaactatttcgtgactgactccgtcacgaagcaggaaattgatttgatgctcgggcttctgctaggcttctgtatctcttggttcctcgtttggatggacggcgtcctccactgtgccgtgagggcctggagagcagggcgcagatatgacgggagctggacttggctgcctaaactgtgcagtctgagagagttggggcgtcggccacaccgaccgtttgaggaggcagccggtaatatggtccacgtaaagcagaaattgtatcataatgggcaccccagcccgagacacctgtag

SEQ ID NO: 47434 - DNA, 891 bp, Artificial Sequence
  Description of Artificial Sequence: Synthetic coding sequence
atgtgcgtgcggcggagcctggtgggcctgaccttctgcacctgctacctggcttcatacctcacaaataaatacgtactcagtgtgctgaagtttacttaccctacactattccagggatggcaaacattgataggcggcctcctgctgcatgtctcgtggaaactggggtgggttgagattaattctagttcacgaagtcatgttctagtgtggttgcccgccagcgtcctgtttgtgggcatcatatacgccggctccagggcgctctcccggttagcaataccagtattcctgacactgcacaacgtggccgaagtcattatctgtgggtaccagaagtgcttccagaaggagaaaacatcgcccgcgaagatatgctctgcactcttactgctcgccgctgccggctgtcttccctttaacgactcacagtttaatcccgacggttatttttgggctattatccatcttctgtgcgtcggggcgtacaagatactccagaagtctcagaagccgtcagctctgtctgacattgatcagcaatacctgaattacatcttctctgttgtactccttgcattcgcctcccacccaaccggggatctcttctctgtgctagactttccatttttgtatttctatcgttttcatggtagctgttgtgcatctggcttcttgggatttttcctgatgttctccacggttaaactgaaaaatttacttgcgcctggtcagtgtgcagcgtggatattcttcgccaagattatcaccgccgggctgtcaatcctgctatttgacgctatacttacttcggccacgaccggttgtttgctcctgggcgctctaggagaagcgctgttagtctttagcgagaggaagagttcatag

SEQ ID NO: 47435 - DNA, 372 bp, Artificial Sequence
  Description of Artificial Sequence: Synthetic coding sequence
atgtgcgtgcggcggagcctggtgggcctgaccttctgcacctgctacttagctagttatctgacaaacaaatatgtacttagcgtacttaagttcacctaccctacgctgtttcaaggcagtcatgtcctagtatggcttccggcttccgttctgtttgtgggcattatttatgcaggcagccgcgctctgtcaagactggccatccccgtgttcctcaccctacataacgtagcagaagtgatcatctgcggctaccaaaaatgtttccagaaagagaaaacatctcctgcaaaaatatgtcgtctccaccttgaacgaacccgccagaatcagacctcacgtttaagcagttgtttaaagggggactag

SEQ ID NO: 47436 - DNA, 468 bp, Artificial Sequence
  Description of Artificial Sequence: Synthetic coding sequence
atgatccccgacgtgatcagcgccctgctgctgctggccgccgccggatgtttgccattcaacgatagccaatttaacccagatggatatttttgggctatcatccatctgctgtgcgtgggcgcctacaagatcttgcaaaagtcacagaagccttcggcactatcggacatagatcagcagtacctcaattatatattcagcgtagttctgttggcattcgcttcccaccctaccggagacctgttctcggtgctagatttcccctttctgtatttttataggttccatggctcctgctgcgctagtggtttcctcgggttctttcttatgttctccactgtgaaattaaagaaccttttggctcccggtcagtgcgccgcttggatcttttttgccaagattattacagccggactgtccatcctattattcgacgccattctaacttctgctacaaccggatag

SEQ ID NO: 47437 - DNA, 507 bp, Artificial Sequence
  Description of Artificial Sequence: Synthetic coding sequence
atgtgcgtgcggcggagcctggtgggcctgaccttctgcacctgctatctggcctcttatctcactaacaaatatgtgttgtccgtgttgaagttcacgtaccccacactgtttcagggctggcagaccctcattgggggcctgcttctgcacgtttcttggaaactcggatgggtggagattaactcgtctagccgcagccatgtcttagtgtggctgcctgcttctgtgttgttcgtgggaatcatctacgctggatctcgggccctttctcggctggccatccccgtgtttctgacattgcacaacgtagccgaggtgataatttgcggatatcaaaagtgcttccagaaggagaagaccagtcccgccaagatctgttctgcccttcttctcctggccgctgctgggtgcctgccattcaacgacagtcaatttaacccggacggctatttctgggcaatcattcacttactctgcgtggtgaccttgacatctaacacatag

SEQ ID NO: 47438 - DNA, 387 bp, Artificial Sequence
  Description of Artificial Sequence: Synthetic coding sequence
atggagaccgccggcgccgccaccggccagcccgccagcggcctggaggccccgggcagcacaaatgaccggctctttttggtaaaaggaggcatattcctcggcaccgtggcagccgcgggcatgctcgcaggctttataaccacacttagcttggcaaaaaagaagtctcccgaatggttcaacaagggatctatggcaacagcagctctgcctgaatccgggtcatcattggccctccgggcccttggttggggttccctttacgcttggtgcggcgtgggggtgatttcatttgccgtctggaaggccttgggggtgcacagcgtatccaattattgtctggtccctggcatctatatgttcatactccttactgtgttttag

SEQ ID NO: 47439 - DNA, 426 bp, Artificial Sequence
  Description of Artificial Sequence: Synthetic coding sequence
atggagaccgccggcgccgccaccggccagcccgccagcggcctggaggcccctggcagcacaaatgatcggttattcctggttaaaggtggaatcttcctgggtaccgtagcggctgccggaatgctagccggattcattaccacgctatctctggccaaaaaaaaaagtccagagtggttcaataagggctccatggcgacggcagccctgccagagtccggatccagtctggcattgcgcgcgctaggatggggcagcctttacgcctggtgcggagtgggcgttatcagtttcgcggtgtggaaagctctcggtgtgcatagtatgaacgactttaggtccaaaatgcagtctatcttccccactattcctaagaactcggagtctgcagtggagtgggaagagacactcaagtccaaatag

SEQ ID NO: 47440 - DNA, 651 bp, Artificial Sequence
  Description of Artificial Sequence: Synthetic coding sequence
atgcccaagggccgggccggcagcctgcccaccaccagcatcggctggcggtttcagctgtggtttctgggcctgacatgccctgaaaggcatctcgctaggagactcaagaataactccttctacccatttgtgcaacaggagcccaacggcgctgaggccagagacttagggcttccccgcgtgcggcggggccgtgggccagtggccagggatctcgttgcggcggccgcaccaccaggtgcggaaccccatgcgcggcgcgtgcctcttctgcatcctggcccccacagagtccccggacccctggcctccgggcttagagctccaggtgcccaacttcgatgtcctcgtaaggtacttctgcctcccgggccaagaaggccccaggtgggcgcacccggcgccggcgcggccgtgggtgctcttagggccaatgggattctaggaccacttcaccgcccagagacgcaacatcagctgctgcggctgcccggtcatctgctccctgcaaggggatcacctctggctacgccttggaggtggcactgtgatgggcaggagcctcatgggtctcaggcccagctcttgagtgtgcagccaggaggagtgaccttgagggcctctccgacctctggcctgtgtagctag

SEQ ID NO: 47441 - DNA, 672 bp, Artificial Sequence
  Description of Artificial Sequence: Synthetic coding sequence
atggagggcctggtgttcctgaacgccctggccacccggctgctgtttttgctgcattccctggtcggcgtgtggcgggtgactgaggtgaagaaggaacctcgctactggctcctggccctgctgaacctgcttctgtttctcgagaccgcactgaccctcaaattcaagcgaggcagaggctataaatggttctccccagctatattcctttatttgatttctatcgtccccagtttatggcttctggagctccaccatgaaacacaatattgcagtatccaggctgagggtacctctcagaacacttcaaggaaggaagattttaatcagacactgaccagtaatgagcagacgtctcgtgcagacgacctgattgagactgccaaggtgttcgtgaacaacctctccactgtgtgcgagaaggtctggaccctaggactgcaccagacatttttgctgatgttgatcatcggacggtggcttctacctatcggaggcgggatcacacgagaccagttgtcacagcttctgttgatgttcgtgggaacggctgccgacatattagaatttaccagcgaaacactcgaagaacaaaacgtgaggctatgttggaagaatagcacaaaccggaggcacacaaacccaaaatggcagttagtgctgttctag

SEQ ID NO: 47442 - DNA, 1107 bp, Artificial Sequence
  Description of Artificial Sequence: Synthetic coding sequence
atggagggcctggtgttcctgaacgccctggccacccggctgctgtttctgctgcactcactggtcggagtctggagggttactgaggtcaagaaagaaccccggtactggttactggcgttactaaacctattgcttttcttggaaacagccctgaccctcaaattcaagcgcggccggggatataaatggtttagtccagctatcttcctctacctgataagcatcgtgccgagcctgtggctgctcgagctccatcacgaaactcaatactgctccatccaggcagaaggtactagccagaataccagtaggaaggaggacttcaatcagactctaacatccaacgagcagacaagccgcgccgacgatttaatcgagaccgctaaagtgttcgtcaacaatttaagcacggtctgtgagaaagtatggacccttggtctgcatcaaacctttttactgatgttaatcattggtaggtggctgctacctataggcgggggtataactcgggaccagctcagccagttgctgctgatgttcgtcgggactgccgccgatatcttagagtttactagcgagaccctggaggagcagaacgtgcgaaactcacctgccctggtgtatgccatcctggtgatctggacctggtcaatgctgcagtttcctctagacctggctgtccagaacgttgtgtgtcccgtcagtgtgaccgagagaggctttcctagcctattcttctgccagtattctgccgacctgtggaacattggaatcagcgtctttattcaggatggtccctttctggtggtcagacttattctcatgacttattttaaagtgattaaccagatgcttgtgtttttcgcagccaagaactttcttgtggtggtccttcagctctataggctggtcgtcttggccctggcagttagagccagtctgaggtctcagagtgagggccttaaaggcgaacacggctgtcgagctcaaacctccgagtccggaccatcacagagagactggcagaatgagagcaaggaaggactcgcaatccctctgcgggggtcgcctgtaacgtccgacgattctcatcataccccatag

SEQ ID NO: 47443 - DNA, 1107 bp, Artificial Sequence
  Description of Artificial Sequence: Synthetic coding sequence
atggagggcctggtgttcctgaacgccctggccacccggctgctgttcctgctgcacagcctcgtgggcgtctggagggttacagaagtaaagaaggagcctagatattggctcttggccctactaaaccttctgctgttcttggagacagctctgacactcaagtttaagcgcggaaggggctacaaatggtttagcccagccatctttctgtacctgatatccatcgttccttcactctggctgctggagctacaccacgagacccaatactgctcaattcaagccgaaggaactagccagaatacttcaaggaaagaggattttaaccaaacactaacatccaacgagcagactagccgggcagacgatctgattgagaccgctaaagtgttcgtgaacaacctctcgaccgtatgcgagaaagtctggactctcggcctgcaccagactttcctgctcatgcttattatagggcgttggcttctgccaataggcggcggaatcacccgggatcagttaagtcagctcctgttaatgtttgtgggtactgccgccgatatcttggagttcacaagcgaaacacttgaggaacaaaacgtgaggaactcacctgccctggtctacgccattctcgtaatttggacgtggtctatgctgcagttcccgctagacctggcagtgcagaatgttgtatgcccagtgtcggtgactgaaagagggttcccaagcctgttcttctgccagtacagtgccgacttatggaacattggaatctcggtgtttatccaagatgggccatttttggtcgtgcggcttatcctgatgacttatttcaaagtgatcaaccaaatgctggtgttctttgcagccaagaatttcttagttgtggtcctccagttatatcgattagtggtcctcgctctggccgtgcgggcttctttaagatcccagtcagagggactcaagggggaacacggctgtcgcgctcagacttccgaatctgggcccagtcaaagggattggcagaatgagtctaaggagggtctagcaatacctctgcgaggatctccggtgactagcgatgacagccatcacaccccctag

SEQ ID NO: 47444 - DNA, 507 bp, Artificial Sequence
  Description of Artificial Sequence: Synthetic coding sequence
atgcggctgaccgagaagagcgagggcgagcagcagctgaagcccaacaacagcaacgcgccgaacgaggaccaagaggaggagatccagcagagcgaacagcatacaccggcccgccagaggactcagcgggccgacacccagcctagccggtgcagacttcctagccgcagaacccctaccacatccagcgacaggactatcaatctcctggaggtgctgccttggcctaccgagtggatctttaatccttaccgcctgccggcccttttcgaattatatcccgagtttcttctggtgttcaaagaggcttttcacgacatcagccattgcctgaaggctcagatggagaagattggcttgcccattattctgcatctgttcgccctttccacgctgtacttctataaattcttcctgcctaccatcctcagtctctccttcttcatccttcttgttcttctgctcctcctgttcatcatcgtgtttatcttgatattcttctag

SEQ ID NO: 47445 - DNA, 744 bp, Artificial Sequence
  Description of Artificial Sequence: Synthetic coding sequence
atggccgacaccacccccaacggcccccagggcgccggcgccgtgcaattcatgatgactaacaagctggatacagccatgtggctcagcaggctgtttacagtatactgttccgccttattcgtcttgcctctgctcggcctccacgaagctgcctctttttaccagcgggcactcctggctaatgctcttacctcggctctccgactccatcagcggcttcctcacttccagttgtctagggcctttctggctcaggccctgctagaggactcgtgccactacctgttgtactccctcatcttcgtgaattcatatccagttacaatgagcatctttcctgtgctcctgtttagtttgctccatgctgcgacatacacaaagaaggtcctggacgctcgaggttctaattccttgccattgctgcggagtgtcctggacaagctcagtgctaatcagcaaaacatactcaagtttatcgcgtgcaacgagatctttctcatgcccgccacagttttcatgcttttcagtggtcaagggagcctgttgcagcccttcatatactacaggttcctgactttgcgctatagttcgaggcgcaatccatattgccggaccctctttaacgaactgaggattgtggtcgagcacataatcatgaaacctgcttgtccgctgttcgtgaggcgcctgtgtctgcagagtatcgcgttcatcagcaggctcgcaccgacagtgccttag

SEQ ID NO: 47446 - DNA, 744 bp, Artificial Sequence
  Description of Artificial Sequence: Synthetic coding sequence
atggccgacaccacccccaacggcccccagggcgccggcgccgtgcagttcatgatgacaaataagttagacacagcaatgtggcttagcagactcttcacagtctactgcagcgccttattcgttctcccactcctcggtttgcacgaggccgcgagcttctaccaacgggcactcctggccaacgcactgacctccgccctcagattacaccaacgtctcccccactttcaactatcacgcgcctttctagcacaggccttactcgaggacagttgccattatctgctctacagcctcatattcgtgaatagctacccagtgactatgagcattttccctgtcctgctcttttccctgttgcacgctgccacttatacgaagaaagtccttgatgctcgtggatccaacagtctgccactcctcagaagcgtcctagataagctgagtgccaaccagcagaacatactgaaattcatagcttgtaacgagattttcttgatgcccgccaccgtgtttatgttgttctccggacagggcagcctcctccagccatttatctactatcgtttcttgaccctacgctacagttctcgcagaaacccgtactgcagaactctgtttaatgagctccggattgttgttgagcacataataatgaagccagcgtgtcccctgttcgtaaggaggctgtgtctgcagtctattgcatttattagcaggctcgcacctacggtaccctag

SEQ ID NO: 47447 - DNA, 669 bp, Artificial Sequence
  Description of Artificial Sequence: Synthetic coding sequence
atggccgacaccacccccaacggcccccagggcgccggcgccgtgcagtttatgatgacaaacaagctggacacagctatgtggttaagtcggctgttcaccgtgtattgcagcgctttattcgtgcttcccctgttgggcttgcacgaggccgcctctttctaccagcgggcactacttgcaaatgccctgacttccgcactgaggcttcatcagcgcctccctcacttccagcttagtagggctttcctggcacaagctctgctggaagatagttgccactatttactatacagcctgatttttgtgaactcttaccccgtcaccatgtctattttcccagtgctgctattctctctgttgcatgccgccacatataccaaaaaggtgcttgacgcccgagggagtaatagcctgccactgcttcgcagtgtgctggacaagctttctgctaatcaacaaaacatcctgaagtttatcgcttgcaacgaaatttttttgatgcctgcaaccgtgtttatgctgtttagtgggcagggcagtctgctgcagccattcatatattaccgttttctcacactccgctacagttcaagaagaaatccctactgccggacactgtttaatgaactgcggatcgtggttgaacacattattatgaaaccgtag

SEQ ID NO: 47448 - DNA, 744 bp, Artificial Sequence
  Description of Artificial Sequence: Synthetic coding sequence
atggccgacaccacccccaacggcccccagggcgccggcgccgtgcagtttatgatgaccaacaaactcgacaccgcaatgtggctgagccgactcttcacagtgtactgtagtgcgctgtttgtcttacctctgctgggcctgcacgaggccgccagcttctaccagcgggctctgcttgctaatgccctgacctcagcactgcgcctgcaccaacgccttccgcatttccaactgtctagggcattcctcgcgcaggcgctcctagaggatagctgccattaccttctatacagcctgatctttgttaattcatatccagttactatgtctattttccccgttctgctgttcagtctcctgcacgcagcgacttatacaaagaaggttcttgacgcgaggggttccaacagcttgcccctgctcagatcagtactggataaactgagcgctaaccaacagaatattctgaagttcattgcgtgcaacgagattttcttaatgccggctacggtctttatgctcttttctggccaggggtctcttctgcagccgttcatctattaccggtttctgaccttaagatactcctcgaggcgcaacccatattgtcggaccttattcaatgaactcaggatcgtagtagagcatatcattatgaagccagcttgtcccctcttcgtgcggcggttgtgcctgcagagcatcgcttttatttcccggctggcccccactgtgccttag

SEQ ID NO: 47449 - DNA, 504 bp, Artificial Sequence
  Description of Artificial Sequence: Synthetic coding sequence
atggccagcccccggaccgtgaccatcgtggccctgagcgtggccttgggactgttttttgtttttatgggaaccattaaactcaccccacgcttaagcaaagatgcatatagcgagatgaagcgagcctataagagctatgttcgcgccctgccattgctgaagaaaatgggaatcaactcaatcctcctgcggaagtccattggagctttagaagtggcctgtggaatcgtgatgaccctggttcctggtcgtcctaaggatgtggcaaatttttttttactactcctggttctcgcggtcttgttctttcaccagcttgtgggagaccccctgaaacgatatgcccacgcccttgtgttcggtatcctcctgacctgtcggctgctaatcgctcggaagccagaggatcgctcctccgagaaaaagcctcttccgggaaatgctgaagagcaaccgtctctgtacgaaaaggctccacaggggaaagttaaggtgtcatag

SEQ ID NO: 47450 - DNA, 381 bp, Artificial Sequence
  Description of Artificial Sequence: Synthetic coding sequence
atggccagcccccggaccgtgaccatcgtggccctgagcgtggcccttggactcttcttcgtttttatgggcaccatcaagcttacccctagactcagtaaggacgcttactccgaaatgaagcgcgcatacaaatcgtatgtgcgagcgctcccgttgcttaaaaagatgggaatcaattcaattttgcatcagctggtcggcgaccctctcaagcgctacgcacacgcgctcgttttcgggatactactgacatgcagactgctcattgcccgaaagccagaagaccggagcagtgagaaaaaaccactcccaggtaatgcggaagaacagccatcactgtatgaaaaagccccccaggggaaggtgaaagtgtcctag

SEQ ID NO: 47451 - DNA, 573 bp, Artificial Sequence
  Description of Artificial Sequence: Synthetic coding sequence
atgaccgccgtgggcgtgcaggcccagcggcccctgggccagcggcagccaaggagatcgttttttgaatccttcatcaggacactcatcatcacatgtgttgccctcgcagtggtcttgagttccgtgagtatctgcgacggacattggctgctcgccgaggataggctgttcgggctgtggcacttctgcactacaacaaatcaaactatctgcttcagggacctgggacaggcccatgttccaggcctggcagtgggtatggggcttgtcaggtccgtgggtgccctggcggtggtggctgccatattcgggcttgagtttttgatggtgagtcagctttgcgaggataagcatagtcagtgcaaatgggtaatgggctcgattctactgttggtgtcttttgtgcttagcagcggcggactgctagggtttgtgattcttctgagaaatcaggtgaccttgataggatttacactaatgttttggtgcgaattcacagcatccttcctgttgtttcttaacgccatcagtggcctgcatatcaatagcatcacgcacccttgggagtag

SEQ ID NO: 47452 - DNA, 900 bp, Artificial Sequence
  Description of Artificial Sequence: Synthetic coding sequence
atggagctgctgagcgccctgagcctgggcgagctggccctgagcttctccagagtccctctattcccagtgtttgacttatcttactttatcgtgtccatcctttacctgaaatacgaacctggcgctgtggagctttcacgccgacatccgattgcgtcctggttgtgtgccatgctgcattgcttcgggtcatatatccttgcagacctgctcctgggggagcctcttatagattacttctctaacaacagttcaatactgctggcatccgccgtgtggtacctcatattcttctgtcctcttgatttgttctataagtgtgtgtgttttctcccggttaagctgatctttgtcgcaatgaaggaagtggtcagggtgaggaagatcgcagtggggattcaccacgcacaccaccactatcatcatggttggtttgtcatgatcgctactgggtgggtcaagggctccggagtggctctaatgagcaacttcgagcaactgctgaggggggtctggaaacccgagaccaacgagatcctccacatgagctttcctacaaaagcctcgttatacggagctattttgtttacacttcagcagactcgatggctcccagtctctaaggcctcgctgatttttatctttactctgttcatggtgagctgtaaggtttttctgaccgccacacactcgcacagttcaccgttcgatgcgctagaagggtatatttgtcccgtcttatttggttctgcttgcggaggggaccatcatcacgacaaccacgggggtagccactcaggcggcggacctggcgctcagcacagcgctatgccagccaaatctaaggaggagctgtctgagggatctcggaagaagaaagctaagaaagccgattag

SEQ ID NO: 47453 - DNA, 714 bp, Artificial Sequence
  Description of Artificial Sequence: Synthetic coding sequence
atgctgcactgcttcggcggcggcatcctgagctgcctgctgctggccgaacctcctttgaaatttctggcgaatcatactaacatccttctggcttctagtatttggtacatcacgtttttttgccctcatgatctcgtgtctcagggatatagctacttgcctgtccagctgcttgccagcggcatgaaggaggttacacgtacttggaagattgtgggaggcgtgacccacgctaacagttactacaagaatggatggattgtaatgattgccatcggctgggctaggggggctggcggaaccatcatcactaacttcgagaggctcgtgaagggcgactggaaacctgaaggggatgagtggttgaagatgtcttatcctgccaaagtaactttgttgggatcagtcatctttacttttcaacacacacaacatctggccatatccaaacacaatctgatgtttctttataccatcttcatcgtggccactaagatcaccatgatgacaacacagaccagtacaatgaccttcgcacccttcgaggatacattgagctggatgctcttcggatggcaacaacccttcagcagttgtgagaagaaatccgaagctaaaagtccttccaatggcgtcggcagcttagcatccaaaccagtagacgtggcttctgacaacgtcaagaagaaacatactaagaagaacgaatag

SEQ ID NO: 47454 - DNA, 876 bp, Artificial Sequence
  Description of Artificial Sequence: Synthetic coding sequence
atggacagcccctgggacgagctggccctggccttcagccggacctcaatgttccccttctttgatatagctcactatctggtcagcgtcatggcagtgaagaggcagccaggagccgctgctctagcatggaaaaatcccatctcttcttggtttacggccatgctgcattgttttggtggcggtattttgagctgtcttttattggcagagccccctctcaagtttctggcaaatcataccaatatacttctggcctcaagtatatggtacatcaccttcttttgcccccacgatctagtatcccagggatattcgtatctgccggtgcaactcctggcgtccggaatgaaagaagtgactaggacctggaaaatcgttgggggggtaactcatgcaaactcctactacaagaatggttggatcgtgatgatcgctataggctgggcaagaggggcaggtggaactataatcaccaattttgaaagattggtgaaaggggactggaaaccagagggcgatgagtggctgaaaatgtcctatcccgccaaggtaaccctcctgggatcagtaatttttacatttcaacacacgcagcatctggctatttcaaaacataaccttatgttcttgtacacaatcttcatcgtagctaccaaaatcacaatgatgactactcaaacatctacaatgacattcgctccctttgaagacactctgtcttggatgctctttggttggcagcagcccttctcctcttgcgaaaaaaagagtgaagccaagtcgccaagcaatggtgttggatctcttgcctccaaaccagtggacgttgccagcgataacgttaaaaaaaagcacaccaaaaaaaacgaatag

SEQ ID NO: 47455 - DNA, 108 bp, Artificial Sequence
  Description of Artificial Sequence: Synthetic coding sequence
atgctgcactgcttcggcggcggcatcctgagctgcctgctgctggcggagccccctctgaagttcttggcaaaccacactaacattctactagccagcagcatttag

SEQ ID NO: 47456 - DNA, 489 bp, Artificial Sequence
  Description of Artificial Sequence: Synthetic coding sequence
tgaagctgcctgctgctggccgagccccccctgaagttcctggccaaccacaccaatatcctgctcgcaagttcaatctggtatataacttttttctgcccccacgacctggtttcccaaggctactcatatcttcctgttcagctgctagcttcagggatgaaagaggttactcgaacctggaagatcgtggggggagttacccatgccaattcatactataagaacggctggatcgtcatgattgctataggctgggccagaggcgccgggggtactatcataaccaactttgagagactcgtgaagggcgattggaaacctgagggagatgagtggctgaagatgagctatcccgccaaagtaactttgcttggcagcgtgatttttacgtttcaacatacacagcacttagctatctctaagcataacttaatgtttttgtacactatttttatcgttgccactaagtccctgaactggcgttag

SEQ ID NO: 47457 - DNA, 246 bp, Artificial Sequence
  Description of Artificial Sequence: Synthetic coding sequence
tgatggatcgtgatgatcgccatcggctgggcccggggcgccggcggaacaataatcaccaattttgagcgcctggtgaaaggagattggaagccagaaggagacgaatggctcaaaatgtcttacccagccaaggtgacattattaggcagcgttattttcaccttccaacacacacaacatctggccatctccaaacacaatttgatgttcctgtacacgatttttattgtggccactaaatag

SEQ ID NO: 47458 - DNA, 1467 bp, Artificial Sequence
  Description of Artificial Sequence: Synthetic coding sequence
atgcccggcggccggcggggccccagccggcagcagctgagccggtctgcgcttccctccttacagacactggttggtggcgggtgtgggaacggaacgggcttacggaatcgcaatggctctgctatcggattgccagttccccctatcacagccctaataacgcccgggcctgttcgccattgtcagatcccagacttgccagtggacggaagcctcctgttcgagtttttgttttttatatacctcctcgtcgctctgttcatacagtatattaacatttataaaacggtgtggtggtatccatacaatcaccctgcttcatgtacctccctgaactttcaccttattgattaccatttggccgctttcatcaccgtgatgctggcaaggcggctggtttgggcactcatctctgaggccactaaggctggtgccgctagcatgattcactacatggttttgatttcagctcgcctggtcctgttgaccctttgcggatgggttctgtgttggacgttggtaaacctgttccggagccactccgtcctgaatctgttgttcctcggatacccctttggggtgtacgtcccgctttgttgtttccatcaggacagtcgcgcgcacctcctgctgactgactacaactatgtggtgcagcacgaagccgtcgaagaatcagccagcacagttgggggattagccaaatctaaagatttcctgagtctgcttcttgagagcttaaaggaacaatttaacaacgcgactccgatccccactcattcctgtcctctaagcccagatctaattcggaacgaagttgagtgtctaaaagccgacttcaaccatagaattaaagaggtgctgttcaactccctgtttagtgcgtattacgtcgcattcctgccgttatgtttcgtgaagtcaacccaatactacgatatgaggtggagctgtgagcaccttattatggtctggatcaatgcctttgttatgctcactacgcagttgctgccctccaagtactgcgatctgctgcacaaatcagcagcccatttaggaaagtggcagaaactggagcatggtagttattcgaatgctccacagcatatttggtccgaaaacacaatctggcctcaaggagtgctggtcaggcatagcagatgcctatatcgggccatgggaccttacaacgtagcagtaccgagcgacgtgtcacatgcccgtttttattttctgtttcatcggcccctgagactcctaaacctgttgattctcatcgaaggttccgtggtcttttatcagctctatagcttacttcggagcgagaaatggaatcacacattgagtatggcccttattctcttttgcaattattacgtactttttaagttgctgcgagatcgcatagtgctgggtcgggcctacagctaccccttaaactcctatgagctcaaagcgaactag

SEQ ID NO: 47459 - DNA, 339 bp, Artificial Sequence
  Description of Artificial Sequence: Synthetic coding sequence
atgcccggcggccggcggggccccagccggcagcagctgagccggagcgccctgccatctctgcagacactggttggtggcgggtgtggtaatggcaccgggctgagaaatcggaatggctcggctatcggcctgcctgtacccccaattacagctttgattactcctggaccagttcgtcattgccagattcctgatctgcctgttgacgggtctttgttatttgagttcctgttctttatttacttgttagtcgcactgtttattcagtacataaacatatacaagacggtgtggtggtacccgtataatcatcctgcttcctgtacgtcattgtag

SEQ ID NO: 47460 - DNA, 579 bp, Artificial Sequence
  Description of Artificial Sequence: Synthetic coding sequence
atgcccggcggccggcggggccccagccggcagcagctgagccggtcagctttgccatctttgcagacccttgttgggggcggctgcggtaatgggaccgggttgcgcaatagaaacggctcggctatcggtttaccagtgccccctataaccgcgctgataacccctgggcctgtgaggcattgccagatccctgatttgccagtggacggcagcctgttattcgagtttttattttttatttacttgctggtcgctctgtttatccaatatataaacatttataaaacagtctggtggtatccctataatcacccggcctcgtgcacttcccttaacttccatctcatagactatcacttagctgctttcataaccgttatgttagcaagaaggttagtgtgggcactgattagcgaagcgacgaaggcgggtgcggcttcaatgattcactacatggtcctgatctccgctcggttggtcctcttaacgctttgcggatgggtactttgttggacgctggtcaacctcttccgctcccactcggttctgaatctgctctttttgggttatccatag

SEQ ID NO: 47461 - DNA, 423 bp, Artificial Sequence
  Description of Artificial Sequence: Synthetic coding sequence
atgcccggcggccggcggggccccagccggcagcagctgagccggagtgccctcccttccttacagaccctagttggtgggggctgcgggaatggaaccggtttaagaaaccgtaatggatcggccatcggcctgccggtgcctccaatcaccgctttaattacacccggacctgtacgccactgccagatcccggatttgcctgtcgacggcagtctcctgttcgaatttcttttcttcatctacctcctcgtggctctctttattcaatatataaatatatataagacagtgtggtggtacccttataatcacccagcaagttgcacatcactgaattttcatctgattgactatcacctcgcggcattcataacagtaatgctcgccaggagactcgtctgggcgttgattagtgagtag

SEQ ID NO: 47462 - DNA, 1479 bp, Artificial Sequence
  Description of Artificial Sequence: Synthetic coding sequence
atgggcggccggcggggccccaaccggaccagctactgccggaacccgctctgcgagccaggcagctccggcgggtcgtccgggtcgcacaccagtagtgctagcgtgacttcagttcggagtcggacaagaagcagctccgggacaggtctgagtagccctcctttggcgacacagaccgtggtacccctgcaacactgtaaaattcctgagctgccagtccaagcgagtatactcttcgagctccagttgtttttctgccagctgattgctctgttcgtgcattatattaacatatataagaccgtctggtggtacccgccctcacatccacccagccacacaagtctgaatttccatctgattgactttaatctgctgatggtcactacaatcgtgttaggcaggagattcattggaagcatcgttaaggaggccagtcagcggggcaaggtgagccttttcaggagcatcctgttgttcttgaccagattcaccgtgctgaccgctacaggctggtcgctgtgccggagtctcattcatctgttccgcacctactcattcttaaacctgctgtttctctgttatcctttcgggatgtacataccctttctgcagctgaactgcgacctgagaaaaaccagcctgtttaatcacatggcttccatggggcctcgtgaggccgtgagcggcttagcaaagtctcgcgactatctgctgacacttagggagacatggaagcagcatactcggcagctttatgggcctgacgccatgcccacgcacgcttgctgcttatctccgtccctgatccgaagtgaagttgaattccttaaaatggacttcaattggcggatgaaggaggttttggtctcttcaatgctgtctgcttactatgttgcattcgtgccagtatggttcgtaaaaaatacacattactatgataaacgctggagctgtgagctattcctactggtttccatcagcaccagtgttattttgatgcagcacttgctccccgctagctactgcgacctgctgcataaagcagctgctcatttgggatgttggcaaaaagttgacccagcactgtgctcgaacgtgttgcagcacccatggaccgaggagtgtatgtggcctcagggtgtgctcgtgaaacattccaaaaacgtctataaggcggtgggacattataatgtcgccattccatctgatgtgtcacatttccggtttcattttttcttctctaagccccttagaatcctcaacattctgctgcttttagagggcgccgtcatcgtctaccaactatactctttgatgtcaagcgagaaatggcaccaaaccatatctctggctctgatcttgtttagtaattattacgccttttttaagctgctgagagaccgcctcgtacttgggaaggcctactcctattccgctagtccacagagggacctggaccaccggttttcctag

SEQ ID NO: 47463 - DNA, 579 bp, Artificial Sequence
  Description of Artificial Sequence: Synthetic coding sequence
atgggcggccggcggggccccaaccggaccagctactgccggaaccccctctgtgagcctgggtcatcagggggaagctccggctctcataccagcagcgcctctgtgacgagtgtgcgttcgcgcacgcgcagttcttcagggacggggctatcttcacccccgcttgctactcagactgtggtgccgctgcaacattgtaaaatcccagaactccctgtgcaggccagtattttgtttgagctgcagctgttcttttgtcagctgattgccctgtttgtgcattacattaacatctacaagactgtctggtggtacccgccatcacaccccccatctcataccagtctcgcatctcagcgcggcaaggtgtctctgttcagatctattcttctgtttctcacccggttcaccgtgctgacagccaccgggtggtctctgtgcaggtcattgattcacctgttcagaacttacagcttcctcaatctactgtttttatgttatccttttggcatgtacattccattcctccagctgaattgcgatttgcggaagacatccttgtttaatcatatgtag

SEQ ID NO: 47464 - DNA, 882 bp, Artificial Sequence
  Description of Artificial Sequence: Synthetic coding sequence
atgtacatccccttcctgcagctgaactgcgacctgcggaagaccagcttattcaatcacatggcgtccatgggaccaagagaggcagtatctgggctggcaaagtctcgtgattacctactaacattgcgcgagacttggaaacaacacactcgccagctgtacgggcctgatgccatgccaacccacgcctgctgcctcagtcccagccttatacggagcgaggtggagttcctcaagatggattttaattggcggatgaaggaggtgctggtgtcatccatgctttcggcctattacgtggctttcgtgcccgtttggttcgtcaagaatactcattactacgataagcgctggtcatgcgagctcttcctgttagtgagcatttctaccagtgtcatcctaatgcagcatttgcttcctgccagttactgcgacctgctgcacaaggccgccgctcaccttggatgctggcagaaagttgatccagctctttgctccaatgtccttcaacatccctggacagaggagtgcatgtggcctcagggcgtgctggtcaagcacagtaaaaatgtttacaaagcagtcggccactataatgttgcgatcccaagcgacgtaagccactttaggttccactttttttttagtaaacccttacgcatcctgaatattctcttgctcctcgagggcgcagtgatcgtgtatcaactatattcactaatgtctagcgagaagtggcatcagactatttcgttggcccttattctgttctccaactactacgcgtttttcaaactgctgcgggaccgccttgttctgggcaaagcttatagctactccgccagccctcaacgggacctggatcaccgcttttcttag

SEQ ID NO: 47465 - DNA, 1029 bp, Artificial Sequence
  Description of Artificial Sequence: Synthetic coding sequence
atgaagaacttccacctgatcgacttcaacctgctgatggtgaccacaatcgtcctcggtagacgatttataggaagcatcgtgaaggaggcttcacagcgcggaaaggtctccctcttccgcagtattttgctttttctgacacgatttactgtattgacggcaacaggctggtccctgtgccggtctctgattcacctctttagaacgtatagtttcctgaatttactcttcctgtgttaccccttcggcatgtacatacccttcctccaactcaactgcgacctgaggaagacctcccttttcaatcacatggcatctatggggcctcgggaggccgtgtcaggactcgcaaagtctagagactatctgctgaccctacgggaaacttggaagcagcatactcgtcagctttatggccctgatgccatgcctacacacgcctgctgcctcagcccctcactcattcgctctgaagtggagtttctgaagatggacttcaattggcgtatgaaggaagtgctagtgtcttccatgttgtctgcctactacgtggcattcgtgccggtgtggttcgtcaaaaacacacactactacgacaaacgctggtcatgtgagctctttttgctggtgtccatctctactagtgtcattcttatgcagcatctcctccctgccagctattgcgacctactacataaggccgccgcccatctagggtgttggcaaaaagtggatccggctctgtgcagcaacgttttgcagcatccatggaccgaggagtgtatgtggccacagggagttctcgtcaaacatagtaaaaatgtctacaaggctgtcggccactataacgtggctataccttcagacgtcagccacttcagatttcatgtgagtctgctaccgggcgaggggggtttaggacccgagagggtgggtggatccgccggacaggagtgcgatgtcatcgcgagagaaagctactttcagtacttccccaatcctaaagaagactccgctcacatgtag

SEQ ID NO: 47466 - DNA, 579 bp, Artificial Sequence
  Description of Artificial Sequence: Synthetic coding sequence
atgggcggccggcggggccccaaccggaccagctactgccggaaccctctttgcgagcctgggtcaagtgggggcagctccggctcgcacacatcctccgcatcggtgacgtctgtaaggagccggacgcgtagtagttccgggactggtctgtcatctccacctctggcaacccagaccgtggtgccacttcaacactgtaaaatccctgagctacccgtacaagccagtatactgttcgagctgcagctcttcttctgccaactgattgcactgttcgttcactatattaacatttataagacagtctggtggtatcccccctcacatcccccaagtcatacttccctggcttcgcagcgtgggaaagtcagtctgttcaggagcatcctccttttcctgacacgctttaccgttcttacggcaaccggctggtccctgtgtcgcagcctgattcacctgtttcggacttacagtttcctcaatctcctatttctctgctacccatttggcatgtacatccccttcttacagctcaactgtgatctccggaaaacctccctattcaaccacatgtag

SEQ ID NO: 47467 - DNA, 666 bp, Artificial Sequence
  Description of Artificial Sequence: Synthetic coding sequence
atgggcggccggcggggccccaaccggaccagctactgccggaaccctttatgcgagcctggatcctctgggggctcctccggatcccacacatcctccgctagtgtcacgtccgtgcggtcccgtactaggtctagctctggtactggtttgtcatcccctcccttggctactcaaactgttgtgcccctccaacactgcaaaattcccgagctccctgtacaggcctccattcttttcgaattgcagctgttcttctgtcagctgatcgccctgtttgtgcattacatcaatatctataagacagtgtggtggtaccctccgagccatccgccctcccacacttccttgaactttcacttaatcgactttaatctcctgatggtaaccaccatagtcctgggcagacgtttcattggatctattgtaaaggaagtctgggatgtccactctgtgccagctgcggaactgcgacccccccaggacaagcccttgcagccacatggtcttcatggggctccaggaggcggacagtggcccggtaaagagcctggtctcccaccggatacagctggggacgtggaggccgcacacaaaaccgcggtatggcccggccgtcacgctcatccctgtctgctgccagtcacccaaccacatcctcagtag

SEQ ID NO: 47468 - DNA, 702 bp, Artificial Sequence
  Description of Artificial Sequence: Synthetic coding sequence
atggagaccagcgccagcagcagccagccccaggacaacagccaggtgcatcgagagacagaagacgtggactacggggagaccgacttccataagcaagacgggaaggctggacttttttctcaggaacaatacgagagaaacaagagcagtagttcttcatcgtcttcaagcagctcttcctcgagctcttccagctccagctcttccgaaagcaacgatgaggatcagcagccgagggcgaccgggaaacacaggaggtctcttggcgcggggtacccccatgggaatggatccccaggcccaggacacggggaaccagatgtcctcaaagatgagcttcaactgtacggtgacgctcctggcgaggttgtaccgagtggcgaatcagggctgcgccgtaggggctccgaccctgcctccggtgaagtcgaagcgtcacagctgagaagattgaatatcaaaaaagatgatgagttttttcattttgtgcttctatgctttgcaattggtgccctgctggtctgttatcactattatgcggattggttcatgtctctcggagtcggattgttaaccttcgcttctctggagactgtgggaatatatttcggcctggtttatagaatccactccgtgctgcagggattcatacccttgttccagaagttccgcttgaccggattcagaaaaaccgattag

SEQ ID NO: 47469 - DNA, 702 bp, Artificial Sequence
  Description of Artificial Sequence: Synthetic coding sequence
atggagaccagcgccagcagcagccagccccaggacaacagccaggtccaccgtgagaccgaggatgtcgactacggtgagacagacttccacaaacaagatggaaaggccggtctgttctcccaagagcagtatgagagaaataagagttccagctcctcctcctcgagcagctctagctcctcttcttcatccagctcaagctcttctgagagtaacgatgaagaccagcaaccacgggccaccgggaagcaccggaggtctcttggagcagggtaccctcatggaaacggctcgccaggccctggacatggggaacccgatgtcctgaaggatgagctccaactctatggagatgctcctggtgaggtggttccttccggagaaagcgggcttcgccgaagggggtcagatcctgcgagcggtgaagttgaggcatcacagctccgacgcctgaacatcaagaaggacgacgagttttttcactttgtcctgttgtgcttcgctatcggagcccttctggtttgctaccattattatgccgattggtttatgtcactcggtgtgggcctgctcactttcgcctcactggaaacagttgggatatacttcggattggtttaccggatccattccgttctgcagggatttattccactctttcagaagttccggctaacagggttcagaaaaacagactag

SEQ ID NO: 47470 - DNA, 750 bp, Artificial Sequence
  Description of Artificial Sequence: Synthetic coding sequence
atggccgaggccggcgccggcagcctgagcctgcccggcggcaaggcaatggaaacctccgcctcttcctcacagcctcaggataactcgcaggtgcaccgcgaaaccgaggatgtggattacggcgagacagatttccacaagcaagacggaaaggctggactcttttcacaggagcaatacgagcggaataaaagttctagtagcagctcttcctcctcgagctcctcatcctccagctcctcatcttcaagtagcgagtctaatgacgaggatcaacagcccagagccactggtaagcacagacgatccctgggcgccggttatcctcacggcaacggatctccagggcctggccacggcgaaccagacgtgttgaaagacgagctccagctatatggcgatgctccaggcgaggttgtgccttccggagagagcgggctgcgaagaaggggcagcgatcccgcatccggggaggtagaggcgagccaactacgaaggctgaatatcaaaaaagatgacgagttttttcacttcgtgttgctgtgcttcgccatcggagcgctgctggtctgttatcactattacgcggattggtttatgagcttaggggttgggctacttaccttcgctagcttagaaacagtcggcatctactttggactggtgtatcggatccactcggtcctgcaaggctttattcccctgttccagaagtttcggctgactggattccgtaagaccgactag

SEQ ID NO: 47471 - DNA, 612 bp, Artificial Sequence
  Description of Artificial Sequence: Synthetic coding sequence
atggagaccagcgccagcagcagccagccccaggacaacagccaggtacatagagagactgaagacgttgattacggggagaccgatttccacaagcaggatggcaaggcaggactcttttcgcaggagcagtatgaacggaataaatcctcctccagcagctcatcctcctctagcagtagctccagtagcagctcttcatcctcaagcggcccaggacatggcgaacctgacgtccttaaagacgagctgcagctgtacggcgacgctccaggcgaggttgtccctagcggcgagagtgggctccggcggcgcggcagcgaccctgcaagtggcgaagtggaggcttcccagctgcgacgcctcaacataaagaaggatgacgagttctttcattttgtgctcctgtgctttgctataggtgcccttctggtgtgctaccattactacgccgattggttcatgagcctcggcgtcggactgctaacgttcgcctctctcgagacagtaggaatttacttcggtcttgtataccgtatacacagcgttttgcaaggctttatcccactctttcagaagtttcgtctgaccggtttccgtaagaccgattag

SEQ ID NO: 47472 - DNA, 474 bp, Artificial Sequence
  Description of Artificial Sequence: Synthetic coding sequence
atggagaccagcgccagcagcagccagccccaggacaacagccaggtacaccgcgaaacagaggacgtggactgtcctggccatggggaacccgatgtgctaaaggacgagctccaattgtatggggacgctcccggcgaggtcgtcccttctggcgagagtgggctgaggcgcaggggtagtgatccggccagcggggaggtcgaggcctcacagttgagaagactcaatatcaagaaggacgatgaatttttccactttgtgttactgtgctttgcgataggggctctgctggtgtgttatcattattatgccgactggttcatgtctctcggagtgggtctccttaccttcgcctcactggagaccgtgggtatttacttcgggcttgtctatcgtattcacagcgtgctccaggggttcattcctctgttccagaaattccgcctcacagggttcagaaaaacagactag

SEQ ID NO: 47473 - DNA, 795 bp, Artificial Sequence
  Description of Artificial Sequence: Synthetic coding sequence
atgcggcccctgctgggcctgctgctggtgttcgccggctgcaccttcgcactgtatcttctgtctactcggctgcccagaggccggcgactgggctctaccgaagaagctggtggtagaagcctttggtttccatcagatctggccgaacttcgggagctgtctgaagtgctcagggagtaccggaaagaacatcaggcttacgtcttccttctgttttgcggcgcctatctgtacaagcaggggttcgcaatccccggatcaagctttctgaacgttctagcaggggccttatttggcccatggctcggactgttgctgtgttgcgtactgaccagtgtcggggcgacgtgttgctacctcctgtcaagtatcttcggtaaacagcttgtagtcagctatttccccgacaaggtcgcgctcctgcaacgcaaggtggaggagaaccgcaatagtctttttttctttctcttattcctgaggcttttcccaatgactccaaattggttcctcaatctatctgccccgattttgaacattccgatcgtgcaattcttcttttctgttctaatagggttgattccctacaactttatctgtgtgcagaccggatcaattctgagcactctcacctcactggatgccctcttcagttgggacaccgtgtttaagctcttagctatcgccatggttgctttgatccctggcactctgatcaaaaagttttctcaaaagcatctacagcttaatgagacctcaacggccaatcacatacattctaggaaagacacttag

SEQ ID NO: 47474 - DNA, 876 bp, Artificial Sequence
  Description of Artificial Sequence: Synthetic coding sequence
atggccaagggccgggtggccgagcggagccagctgggcgcccaccatactacccccgttggggatggtgccgctggcaccaggggtctggcggcacccggatctcgcgaccaccagaaagagaagtcctgggtggaagccggctcggcaaggatgtcactgcttatcctggtgagcatattcttgagcgccgcttttgtgatgtttctagtttacaagaactttccccagctatctgaagaggagcgcgttaacatgaaagtgccaagagacatggatgacgccaaggctttgggtaaggtgctgtctaagtacaaggataccttctacgttcaggtactggtcgcttactttgctacctatatctttttacagacatttgcaatccccggctccatctttctctccatcctgtctggatttctgtacccatttcctctggctctctttctggtgtgtctgtgttcaggtcttggagccagcttttgttacatgctgagttacctcgttgggcgtccggtggtttataaatacttgacggagaaggcagttaagtggagccagcaagttgagcgccatcgggaacacttgataaactatattattttcttgcgcatcaccccctttttgcctaactggtttattaatataacaagtcccgtcattaatgttccactgaaggtctttttcataggaacattcctgggggtggcacctcctagtttcgttgcaatcaaggcaggcaccacattgtaccaactaacgacagctggagaagctgtgagctggaatagcatcttcatcctgatgattctggccgtgctgagtatcttgcccgctatttttcagaaaaagctgaagcaaaaattcgaatag

SEQ ID NO: 47475 - DNA, 876 bp, Artificial Sequence
  Description of Artificial Sequence: Synthetic coding sequence
atggccaagggccgggtggccgagcggagccagctgggcgcccaccataccacacctgtcggagacggagcagcagggacccgtggactcgctgccccaggcagtcgggaccaccaaaaggagaagtcttgggtcgaggcagggagcgcgcgtatgtcactgctgattctggtcagcattttcctctccgccgctttcgttatgttcctcgtatacaagaatttcccgcagttaagcgaggaggagcgagtcaacatgaaagtgcctcgcgatatggatgatgctaaggcccttggcaaagtcctgtcgaaatataaagatacgttctacgtgcaagtgttggtggcttattttgccacctacatctttcttcaaaccttcgccatccccggaagcatcttcctatctattctctcaggatttctatatccatttccactggctctgttcctggtttgcctgtgctctggactgggcgccagcttttgctatatgctaagttatttggtcggccgccccgtggtctataagtatctgacagagaaggctgtgaagtggagccagcaggtggaacggcatcgggagcatttaatcaattacatcatctttctacgtatcacccctttcctcccaaactggttcatcaacatcacttctccagtgattaatgtgccactaaaagtgttttttattggaaccttcttgggtgtggcccccccttcctttgtcgcaatcaaggccggtaccaccctttaccagctgactaccgcaggggaagcagtctcctggaactcaattttcattctaatgatcttggctgtgctatcaatcctacctgcaatttttcaaaagaagctaaaacagaagtttgaatag

SEQ ID NO: 47476 - DNA, 384 bp, Artificial Sequence
  Description of Artificial Sequence: Synthetic coding sequence
atggccaagggccgggtggccgagcggagccagctgggcgcccaccacacaacacctgtgggggacggcgcagctggtacccggggcctggcggcacctgggtctcgagatcaccagaaagaaaaatcatgggtcgaggccggaagtgcgagaatgagtctcctgatacttgtttcgatcttcctgagtgccgctttcgtgatgttccttgtgtacaagaattttcctcagctgagcgaggaggagcgcgttaacatgaaggttccaagggatatggatgatgccaaagccctgggtaaagttttatcaaagtataaggacactttttatgtgcaggtgctggttgcgtacttcgcaacctacatcctgtacccattcaattag

SEQ ID NO: 47477 - DNA, 480 bp, Artificial Sequence
  Description of Artificial Sequence: Synthetic coding sequence
atggccgagcggcccggcccccccggcggcgccgtgagcgccaccgcatatcccgacacaccggccgagtttcccccccacctgcaggcaggggccatgcggaggcgattttggggtgtgtttaactgcctgtgtgctggcgcgttcggagccctagctgcagcttcagccaagctcgccttcggatccgaagtttctatgggcttatgcgtactcggcatcatcgtgatggcctccaccaattcccttatgtggactttctttagtaggggcctaagcttttctatgagcagtgctatagcttctgtgacagtcaccttctccaacatcttgtcctccgcatttctgggctatgtgctgtatggggaatgccaagaggtcttgtggtggggcggcgtgttcctgattttgtgcgggcttacgttgatccacaggaaactacccccaacctggaagcctttaccccataaacagcagtag

SEQ ID NO: 47478 - DNA, 828 bp, Artificial Sequence
  Description of Artificial Sequence: Synthetic coding sequence
atgggcaacttccggggccacgccctgcccggcaccttcttcttcattatcgggctttggtggtgtacaaaaagcatacttaagtacatctgtaagaaacagaagagaacttgttacttgggttccaagacactcttttacagactggagatcctcgagggcatcaccattgtggggatggccttgacgggtatggccggggaacagttcatcccagggggtccccacctgatgctctatgactataaacaggggcattggaaccagcttctggggtggcaccacttcaccatgtacttcttcttcggattgctgggagttgcagatatactctgtttcacaatctcgtcattacctgtgagtcttacaaaactgatgctatcgaatgccctgttcgttgaagctttcatattctataaccatacacacggccgggaaatgctagatatattcgtgcatcagctgctcgtgcttgtggttttcctgacagggttagtggcatttttagagttcctggtgcggaataacgtgctcctggaactgttgcgctcatctcttatcctgttgcagggaagctggtttttccagattggattcgtgttatatccccccagcggaggacccgcctgggacctgatggaccacgagaacatccttttcctcacaatttgtttttgctggcattatgctgttaccatcgtgatcgtggggatgaactacgcttttataacgtggctggtaaagtcaagattgaagcgactgtgttcctcagaagtgggactcctgaaaaacgccgaaagagaacaggagtctgaggaggaaatgtag

SEQ ID NO: 47479 - DNA, 876 bp, Artificial Sequence
  Description of Artificial Sequence: Synthetic coding sequence
atgaccaacgacagcgagggcaagatgggcttcaagcaccccaagatcatgggaaactttagaggacatgccctgcctggaacgttttttttcataatcgggctgtggtggtgcacgaaaagcatcctgaagtacatctgcaaaaaacaaaaacgcacctgttacctcggttccaagacactgttttatcggctggagatactagaaggtataaccatcgttggtatggccctgacaggaatggctggtgaacagttcatccctggaggaccccaccttatgctttacgattacaagcaaggtcactggaaccagttgctcggctggcaccactttactatgtatttcttctttgggctgctgggagtggcagacatcctgtgcttcacaatcagcagtctgcccgtgagcctcaccaaactcatgctgtccaatgccctgtttgtggaagcttttatcttctataatcatacacacgggagggaaatgcttgacatcttcgtgcatcagctactggttcttgtggtgttcctgaccggtctggtggcttttctggagttcctggtgcggaacaacgtgctgctcgagcttttgcgcagcagcctaatattgttgcagggcagctggttttttcagatcgggttcgtcctgtatccaccgtcaggtgggccagcgtgggacctgatggatcatgaaaatatcctcttcctgactatctgcttctgttggcattacgccgtcacaatcgtgattgtgggaatgaactatgcgttcatcacctggctggtcaagagccgactgaaacgcctgtgttccagtgaggtgggactgctgaaaaatgcggaaagggaacaggagagcgaagaagagatgtag

SEQ ID NO: 47480 - DNA, 828 bp, Artificial Sequence
  Description of Artificial Sequence: Synthetic coding sequence
atggccaacttcaagggccacgccctgcccggcagcttcttcctgattatcggcctttgctggtccgtcaagtatcctctcaaatattttagtcacacgaggaagaacagcccactgcactattatcagcggttggaaatcgttgaggctgccattcgtaccctcttcagcgtgacaggaatcctggccgagcaatttgtacccgatgggccacacttgcacctctaccatgagaaccactggatcaagttgatgaattggcagcactcaaccatgtaccttttctttgccgtctctggtatcgtagacatgctgacttacctggtctcacatgtcccactgggggttgaccgcctggtgatggccgtggcagtcttcatggaagggttcctattctactatcacgtgcacaaccggccccccctcgatcagcacattcattcactgctgctttatgcactttttgggggatgcgtctccatttcccttgaggtcatcttcagggaccacatagtcctggagctctttcggacttccctgattatcctgcagggaacctggttctggcaaataggattcgtcctgtttccacccttcgggacaccagagtgggatcagaaagacgacgccaacctcatgtttattaccatgtgcttctgctggcattacttagcggctcttagcattgttgctgtgaactattccctggtctattgtctgcttacgcgaatgaaaaggcacgggcgaggcgagataattgggatacagaagctgaacagtgatgatacctaccagacggctctgctcagcggttccgacgaggaatag

SEQ ID NO: 47481 - DNA, 828 bp, Artificial Sequence
  Description of Artificial Sequence: Synthetic coding sequence
atggccaacttcaagggccacgccctgcccggcagcttcttcctgattatcggcctttgttggagtgtgaagtatccgcttaagtatttcagtcacacaaggaagaattctcccctacactattaccagcgcctggagatcgtcgaagccgcgattcgcacccttttttccgtcaccggcatcctggcagaacagttcgtgcccgatgggcctcatctgcacctttaccacgagaaccattggattaagctgatgaactggcagcatagtaccatgtatctgtttttcgctgtttctggtatcgttgacatgctgacttatctggtctcccatgtgccactgggtgtagataggctggtaatggcagtggccgttttcatggaaggtttccttttctactaccacgtgcacaaccggcctccactcgaccagcatattcattccctactgctgtatgccctcttcggaggctgcgtgagtatctctctggaggttatattcagagaccacattgtcttagagctcttccgcacgtcacttatcatcctgcagggcacctggttttggcagatcggtttcgttctatttcccccattcggaacaccagagtgggatcagaaagacgatgccaatctgatgtttattactatgtgtttttgctggcactaccttgctgcactgagcatcgtggctgtgaactattccctcgtctactgccttctgacacgcatgaaaagacacggcaggggtgagatcatcgggatccagaagctgaactcagatgatacctaccaaaccgccctccttagtgggagtgacgaagagtag

SEQ ID NO: 47482 - DNA, 474 bp, Artificial Sequence
  Description of Artificial Sequence: Synthetic coding sequence
atgagcggcttcctggagggcctgcggtgcagcgagtgcatcgactggggggaaaaacgaaacacgattgcgagtattgccgcaggcgtgctcttctttaccggatggtggatcattatcgacgctgcggtgatctatcccactatgaaagactttaaccactcttatcacgcgtgtggcgtcatcgcaaccattgcctttcttatgattaacgctgtctctaatggacaggtacgcggggattcttatagtgaggggtgccttggccagactggcgccaggatctggcttttcgtaggtttcatgctcgcctttggcagtcttattgccagcatgtggatcctttttggaggctatgtcgccaaggagaaggatatcgtgtacccagggattgccgtgttttttcaaaatgctttcattttttttgggggacttgtcttcaaatttggacgaacagaagacttatggcagtag

SEQ ID NO: 47483 - DNA, 477 bp, Artificial Sequence
  Description of Artificial Sequence: Synthetic coding sequence
atggccggcttcctggacaacttccggtggcccgagtgcgagtgcatcgactggtccgagcgcagaaacgccgtggcctccgtggtagcgggcattctcttcttcaccggttggtggataatgattgatgcggccgtggtgtatcccaagcctgagcagctcaatcacgcatttcacacatgcggagtttttagcacacttgccttctttatgatcaatgcagtgagtaacgctcaggtgcggggagatagctatgaatccggatgcttgggtcgaaccggggcccgggtgtggttatttatcggattcatgcttatgtttggcagtcttatagccagtatgtggatcctttttggggcgtacgttacccagaatactgatgtgtatcccggccttgctgtgtttttccagaatgctctaatttttttttcaacattgatctataagtttggccgaaccgaagagctgtggacatag

SEQ ID NO: 47484 - DNA, 246 bp, Artificial Sequence
  Description of Artificial Sequence: Synthetic coding sequence
atggccggcttcctggacaacttccggtggcccgagtgcgagtgcatcgactggagtgagaggcggaatgcagtggcttccgttgtagcagggattctttttttcaccgggtggtggattatgattgacgccgccgtcgtctatcctaagcctgagcaactgaaccacgcatttcatacttgcggcgtattttccaccttagcgttttttatgataaatgcagtatctaacgcgcaggttagatag

SEQ ID NO: 47485 - DNA, 189 bp, Artificial Sequence
  Description of Artificial Sequence: Synthetic coding sequence
atggccggcttcctggacaacttccggtggcccgagtgcgagtgcatagattggtccgagagacggaatgccgtggcatctgtggtggctggaatactctttttcactgggtggtggatcatgatcgatgcggcagtggtctatcctaaaccagagcagctcaaccatgctttccacacctgtgggtag

SEQ ID NO: 47486 - DNA, 381 bp, Artificial Sequence
  Description of Artificial Sequence: Synthetic coding sequence
atggccggcttcctggacaacttccggtggcccgagtgcgagtgcatcgactggagcgagaggagaaatgcggttgcgagtgttgtagcaggaattctgttctttactggctggtggataatgatcgatgctgctgtcgtttatcccaagccggagcaacttaaccacgccttccatacttgtggagtgttctccactctcgcgttttttatgattaatgccgttagtaatgcacaggttcgcggggacagttatgagtctggctgtttaggccgcactggcgccagggtttggctgtttattggcttcatgttgatgttcggctctttgattgctagcatgtggattctgtttggtgcctatgtaacccagaacctctag

SEQ ID NO: 47487 - DNA, 477 bp, Artificial Sequence
  Description of Artificial Sequence: Synthetic coding sequence
atggccggcttcctggacaacttccggtggcccgagtgcgagtgcatcgactggtcggagcggcggaatgcagtagccagtgtcgtggctggtatcctcttctttactggctggtggatcatgatcgacgccgccgtcgtctaccccaagcccgaacaactgaatcatgcttttcacacatgtggagtgttttccaccctggccttcttcatgataaacgccgtctctaatgctcaggtgagaggggattcatacgagagtggctgtcttggtcggaccggggctagggtgtggctgttcatcgggtttatgctgatgtttggcagcctaattgctagtatgtggatcttattcggtgcttatgtaacacagaataccgacgtgtacccggggctcgccgtttttttccagaatgccttgatctttttctcaacactgatttacaagttcggaagaaccgaggaattatggacatag

SEQ ID NO: 47488 - DNA, 762 bp, Artificial Sequence
  Description of Artificial Sequence: Synthetic coding sequence
atgatggcccagagcaaggccaacggcagccactacgccctgaccgcaatcggcctgggcatgttggtcctcggcgtcattatggctatgtggaatttggtccctggtttctctgccgccgagaaaccgaccgcgcagggatcaaacaaaactgaggtcggcggcgggattctaaagagcaagacattcagcgtcgcctacgtcctagttggcgccggggtgatgctgctactcctgagcatttgcttgagcatccgcgacaagcgtaagcaaaggcaaggggaagatttggcccacgtgcagcaccccacgggtgcaggaccccacgctcaggaagaggacagccaggaagaagaagaggaggacgaagaagcagcctcaaggtactacgtgccgagctatgaggaggtgatgaacacaaactactccgaagcgcgtggtgaggaacagaatccacgtctatcaatttcccttccaagctacgaatccctcactggcctggacgaaacgacccctacgtcaactcgcgccgatgtggaagcgagccccggaaacccacccgatagacaaaattccaaattagctaagcgactgaaacccctcaaggtgagacgcattaagtcagagaagctgcatctgaaagactttagaattaacctgccagataagaacgttccccctcctagcatcgaaccactgacacccccacctcagtacgacgaagtgcaggaaaaagcgcctgacacaaggcctcccgactag

SEQ ID NO: 47489 - DNA, 762 bp, Artificial Sequence
  Description of Artificial Sequence: Synthetic coding sequence
atgatggcccagagcaaggccaacggcagccactacgccctgaccgctattggcctgggaatgctggtgttgggtgtgatcatggccatgtggaacttggtacctggctttagtgctgcggagaaaccgacagctcaggggtcgaataagaccgaagtgggtggaggaatcctgaagtctaagacattttctgtggcctacgttctggttggggccggagtgatgctgttgctgctgtccatctgtcttagcatcagagacaaaaggaaacagcggcagggagaagatcttgctcacgttcaacaccccacaggggctggcccgcatgctcaggaagaggacagtcaggaggaggaagaagaagacgaagaggccgcctctcgctattatgtgccttcttatgaggaagtgatgaataccaattattccgaagcccgtggcgaggaacaaaaccctcgactgtcaatttctctgcctagttatgaatcactaacgggcctcgatgagactacacccacctccaccagggccgatgtggaagcaagccccggtaaccctccagacaggcagaactcaaagctggccaaacgcctgaagcctctgaaggttcgtagaatcaagtcggaaaaactgcacctgaaggattttagaatcaacctgccagataaaaacgtaccaccccctagcattgagccacttacacctccaccgcagtacgacgaggtccaggaaaaagctcctgatacaagaccgcccgattag

SEQ ID NO: 47490 - DNA, 762 bp, Artificial Sequence
  Description of Artificial Sequence: Synthetic coding sequence
atgatggcccagagcaaggccaacggcagccactacgccctgaccgcaataggcctcgggatgctagtgcttggggttatcatggctatgtggaatctagttcccgggtttagtgccgcagaaaagcccactgcccaggggagcaacaaaaccgaagtggggggtggtatcctcaagagtaagactttcagcgtggcttacgtcttagtgggcgcgggagtgatgctgctgctgctttccatttgcctgtccattagagacaaacgcaagcagcggcagggggaagacctggcccatgtccagcaccccactggggctggaccacacgctcaagaagaggactcccaggaggaggaagaggaggatgaagaggctgcatcacgctactacgtgccttcttacgaggaagtgatgaatacaaattactccgaggccagaggcgaagaacagaacccccgcctgtctatatctttgccaagctatgagtctttaaccggtttggacgaaacgacacctacctccacacgcgcggacgtggaagcctcgcccggcaatccaccagacaggcagaatagcaaactagccaaaagactgaaacccctgaaggtccggcgaattaagtccgagaaacttcacttgaaggattttcgaattaaccttcccgataaaaatgtccctccacctagcatcgagcctctgacaccaccgcctcagtatgatgaggtacaggagaaggcccctgacacaaggcccccagactag

SEQ ID NO: 47491 - DNA, 762 bp, Artificial Sequence
  Description of Artificial Sequence: Synthetic coding sequence
atgatggcccagagcaaggccaacggcagccactacgccctgaccgcaataggactcggcatgctggttttgggcgttatcatggctatgtggaatctcgttcctggattctctgcagctgaaaagcccaccgcgcaaggctccaacaagaccgaggttgggggaggcatcctcaaaagtaagacttttagcgtggcatacgtcttggttggggcaggcgtgatgctccttctgttgagcatctgtctgagtattcgtgacaaacgtaaacaacggcagggcgaagacctggcacacgttcaacatccgactggggcgggaccccatgcgcaggaggaggacagtcaggaggaagaagaagaagacgaagaagctgcatccaggtattatgtgccctcatacgaagaggtcatgaacaccaactactctgaggcccgtggcgaggagcagaacccaaggctcagcatcagccttccctcatacgaatctctgaccggactggatgagaccacccccaccagtacgagggccgacgtcgaggccagtcccggtaacccaccggacagacaaaactcgaagttagccaagaggctgaaaccgcttaaggtgagacggatcaaaagcgaaaagctccacctcaaagactttcgaatcaatctcccagacaagaacgtgccgcctcccagcattgaacctctcaccccgcccccccagtatgacgaagtgcaggaaaaagctcccgatacacgtccacctgattag

SEQ ID NO: 47492 - DNA, 762 bp, Artificial Sequence
  Description of Artificial Sequence: Synthetic coding sequence
atgatggcccagagcaaggccaacggcagccactacgccctgaccgctatcgggctgggtatgttggtgctaggagtgattatggctatgtggaatctggtgccaggcttctccgcagcggagaagcccaccgctcagggatcaaacaagaccgaagtaggtggcggcatcctgaagagcaaaaccttctccgttgcctacgttcttgttggtgctggggtcatgctcttgctgctatctatctgtctgagcatccgagataaacggaaacagcgccagggtgaagatcttgcacatgttcagcaccccacgggggccgggcctcacgcgcaagaggaggatagccaagaagaagaggaggaggacgaagaggcagcgagtcgttattatgtgccgagttacgaggaagttatgaatacaaattacagcgaagccagaggcgaggaacagaacccgaggctgtctatctccctgccaagttacgagtccttaaccggcctggatgaaaccactcctaccagtacgcgagctgatgtggaagcctcacccggcaatcctcccgataggcagaatagtaagctcgcaaagaggttaaaacccctgaaggtaaggagaatcaaatcagaaaaactgcatctcaaggatttcagaataaatctgcctgataagaatgtgccccccccaagcatcgagcccctgacaccccctccgcagtacgacgaagtgcaggaaaaggctccggatactagaccacctgactag

SEQ ID NO: 47493 - DNA, 762 bp, Artificial Sequence
  Description of Artificial Sequence: Synthetic coding sequence
atgatggcccagagcaaggccaacggcagccactacgccctgaccgctattggcttagggatgctggtactgggtgttatcatggctatgtggaatctcgtcccgggtttttcggcagccgaaaagcctacagcgcagggcagcaacaagaccgaggttggtgggggtattctcaagtcaaagaccttctctgtggcctatgtgctggtcggcgcaggggtcatgctgttgttactctcaatttgtctgtcaattcgggacaaaaggaaacagcggcaaggtgaggatctagcacacgtgcagcacccaaccggagctggtcctcatgcacaggaagaagatagtcaggaagaagaggaggaagacgaggaggccgcatcccggtattatgtccctagctacgaagaagtcatgaatacaaactactctgaagcacgtggagaggaacagaacccccgcctgtcaatcagcctcccatcttacgaatctttgaccggactggatgaaacaacgccaacttctacacgcgcggacgtagaggcctcacccgggaatcctccagatagacagaacagtaagttagcaaagcggctgaaaccacttaaagtccgtcgaattaagagcgagaaactacacttaaaagattttcgcatcaatctgccagataagaacgttccgcccccctcaattgagcctctcacacccccccctcagtacgatgaggtgcaggaaaaagctcctgacactcggccccccgactag

SEQ ID NO: 47494 - DNA, 528 bp, Artificial Sequence
  Description of Artificial Sequence: Synthetic coding sequence
atgatggcccagagcaaggccaacggcagccactacgccctgaccgctattgggctgggcatgctggtgctgggggtcatcatggccatgtggaacttggtgccaggctttagcgccgccgaaaaaccaacggcacaggggtccaacaagacagaggtaggcgggggtatcctgaagtccaaaactttctcagtggcctatgttcttgttggagccggagtaatgctcctcttattatctatatgtttgtctatccgtgataagcgaaagcagcgccaaggagaagaccttgcccacgtgcagcatcccaccggggccggcccccatgcccaggaggaagactcccaggaggaagaggaagaggacgaggaggcggcttccaggtattacgttccttcttatgaagaagtgatgaatacaaattactcggaggccagaggtgaggagcaaaatccccgccttagcatttctctgccgtcttacgaatccctgacgggcctggacgaaacaacccccaccagcacttag

SEQ ID NO: 47495 - DNA, 630 bp, Artificial Sequence
  Description of Artificial Sequence: Synthetic coding sequence
atggcccggggccccctggccgcccggggcctgcggctgctgctgcctcttcttccacttctcccattactccccctgccgcaggtggcattaggcttcgctgatggtagctgcgatcccagtgaccagtgcccgcctcaggcacgctggagcagtctctggcacgttggtctgatactccttgccgtcctcctcctgcttctgtgcggtgtcacggctggatgtgtacggttttgctgcctgcggaagcaggcgcaggctcaaccccacttgccccccgcaaggcagccatgcgatgttgccgttattcctatggactccgattctccggttcacagcaccgtgacgtcttatagttccgtccagtacccattgggcatgaggctcccactgcccttcggggagctggatctagattcaatggccccacccgcctactctctgtatacgcccgagccccctcccagttacgatgaagcggtcaagatggccaagccgagagaggagggaccggcgctgtcacagaagccatcacctctgctcggggccagtggcctcgaaacaactccagttcctcaggagtcggggcctaatacacagcttccgccttgttcccccggggcaccatag

SEQ ID NO: 47496 - DNA, 375 bp, Artificial Sequence
  Description of Artificial Sequence: Synthetic coding sequence
ggcggccggtggccccccgccgactgcggctgctgctgccggagctgtcgcagttgccgcagctgccggtgcaggaggtgggttggaaggcgcagcttgtccgtccgccctcccagaggcgggtccctgctgggaccaaggccaagtcgggcccacccatgtccacacaggtggcggtgggcctccaggactgccgcggcaaccccaagaacgtctgctcgaccacggccagctggagccgcctgtgggacctgggcatgcacaccaaggagccttcaccctcccactatgaagttgagtcgttggcccagtccggagagaaaagaccagcactcaccacgcaacccggccctctctctgggtccccgcgcctag

SEQ ID NO: 47497 - DNA, 585 bp, Artificial Sequence
  Description of Artificial Sequence: Synthetic coding sequence
atggagcggcactgcctgctgttcatcctgctgacctgcctgcggtggctgtgtcatgacatccctcagggtgcaggagccaggtggcccagggtgtctccagtagtggagccatgttcacctcggctgattctgttggctgtgctgctgcttcttctgtgcggcgtcaccgccggttgcgtccggttctgctgccttcgcaagcaggcccaggctcaaccccacctgccgcctgcaagacagccctgcgacgtagctgtgataccaatggattctgactctccagtccatagcacagtgacttcatattcctcggtacagtacccactgggcatgcggctgcccctgccctttggcgaacttgatctcgactccatggccccacccgcttatagcctgtacacaccggagccgcctccttcttatgatgaagccgttaaaatggcaaagccgcgggaggaaggaccagctctatcccagaagcccagcccgctgttaggtgccagtggcctcgagactaccccagtgcctcaggagtcgggtcccaatactcagctgcctccatgttcacccggcgctccttag

SEQ ID NO: 47498 - DNA, 312 bp, Artificial Sequence
  Description of Artificial Sequence: Synthetic coding sequence
atggcccggggccccctggccgcccggggcctgcggctgctgctgccactgctgccactgttacccctgctccctctgcctcaggttggcagagcggccttctccctgggatccgccaccgctggcagagttcccgccagaactacccccttgccaggcagccctctgtcaccacaggttgcgctgggcttcgctgacggcagttgcgacccttcagatcaatgccctcctcaggcaaggtggtcatcactgtggcatgtcggactgatactcttagccgtgttactgttactactgtgcggggtgacttag

SEQ ID NO: 47499 - DNA, 744 bp, Artificial Sequence
  Description of Artificial Sequence: Synthetic coding sequence
atggccagcgccgagctggactacaccatcgagatccccgaccagccctgctggtcccagaagaactcgccttcaccaggtggtaaagaggccgaaacgcgccagccagtggttatcttgctcggctgggggggttgtaaggataagaatctcgctaagtatagcgcaatttatcataagaggaagttgctggaactgctctttgactacgaaattgaaaaggagcccctgctgttccatgtcttcagcaatgggggggttatgctgtacagatacgttctcgaacttctacagaccaggcgattctgccgactgcgggtggtgggtaccatcttcgactccgcgcccggagactccaacttggtgggcgccctgcgcgcactggcagccattttggagcgacgagccgccatgcttcgtttgctgttgttagtggctttcgccctcgtagtggtgttatttcacgtgctgctagcgccaatcactgcactgttccacacacacttctatgacaggctgcaggatgcggggtcacggtggcctgagctgtacctctatagcagagcggatgaagttgtcctagcccgggatatagagcgcatggtggaggcacggctcgctcggagagtgctggctcggagcgtggatttcgttagttcagcccacgttagccacctacgagattaccctacatactacaccagtctttgcgtggactttatgagaaattgtgttcgctgttag

SEQ ID NO: 47500 - DNA, 834 bp, Artificial Sequence
  Description of Artificial Sequence: Synthetic coding sequence
atggccagcgccgagctggactacaccatcgagatccccgaccagccctgttggagccagaaaaatagtccaagccccggcggaaaggaggcagaaacccgccaacctgtggtaatactgctgggctggggcggctgcaaagacaagaatctggctaaatactcagccatctaccataaacgggggtgcatagtcatacggtatacagcaccctggcacatggttttcttctccgagtccttaggcattccttctctgcgggttctggctcaaaaactcctggagctgctgttcgactatgagattgagaaggaaccactgttgttccacgttttctcaaatggaggcgtgatgctttatagatacgtgttggagttactccagacacgacgtttctgcaggctaagggtagttggtactatcttcgactctgccccaggagactctaacctggtcggcgcactgagggccctggccgccattctggagagacgtgctgccatgttgcggttactcctcctagtagcattcgcactcgtggtggtgctctttcacgtgctgctggcccctattacagcattgtttcacacacatttctatgatagactgcaggacgcgggaagtcgatggccagagttgtacctgtactcacgggcggacgaggtcgttcttgccagggacatagaaagaatggtggaagcaaggctggccagacgtgttctggcacgctccgttgattttgtcagcagtgctcacgtgagccacctgagggactacccaacctactacacttcactgtgcgtcgattttatgcgaaattgcgtgcgctgctag

SEQ ID NO: 47501 - DNA, 606 bp, Artificial Sequence
  Description of Artificial Sequence: Synthetic coding sequence
atggccagcgccgagctggactacaccatcgagatccccgaccagccctgctggtctcagaagaactcaccctcgccaggcggaaaggaggcggaaacccgacagcccgtagtgatactactgggatggggcggatgtaaagacaaaaacctagctaaatacagtgcaatataccataagagggggtgcattgtgatcagatacacggccccctggcacatggtctttttctctgaatccttgggtattccttccctgcgggtattggctcagaagctgctcgagctgcttttcgattacgaaatagagaaggagcctctgctgtttcatgtctttagtaatggtggcgtgatgttgtatagatatgtactagaattgttgcagaccagaaggttctgcagactccgagtggtaggcaccattttcgacagcgccccgggcgactccaacttagttttttgtatggcatcctgtctgctgctcagccccctcttggtcgatggtataagcgctggcactgagggccagctgacattgagaccagattgggctgcacaggttctgacacggttgggctgtcatctgcagtgcatcactaggtcatag

SEQ ID NO: 47502 - DNA, 336 bp, Artificial Sequence
  Description of Artificial Sequence: Synthetic coding sequence
atggccagcgccgagctggactacaccatcgagatccccgaccagccatgctggtctcagaagaattccccatcccctggcggtaaagaagcggagacacgccagccggtggtgatcctcctgggctgggggggatgtaaggataagaatttagctaagtatagcgcaatctatcataagcgagtgttctgtatggccagttgcctgcttctctctccccttctcgtcgatggtatctccgctggcaccgagggacaacttacactacgccctgattgggccgctcaggtgttaacccgactgggctgccatttgcagtgcattacacggagctag

SEQ ID NO: 47503 - DNA, 237 bp, Artificial Sequence
  Description of Artificial Sequence: Synthetic coding sequence
atggccagcgccgagctggactacaccatcgagatccccgaccagccctgctggtctcagtccctactgcacggactgttgcttgctgcgttcactatcgcgggcggctggcatctgtgctgggatcgtggtgcaacccacacgccagccagactgggaagcacaggagccaacgccgcctggctgagcccttcgatgcatcaccctaaactgcgcgcacccctgagacactcgtag

SEQ ID NO: 47504 - DNA, 408 bp, Artificial Sequence
  Description of Artificial Sequence: Synthetic coding sequence
atggccagcgccgagctggactacaccatcgagatccccgaccagccatgctggagccagaaaaactctcccagccccggaggcaaggaggcagaaacaaggcagcccgtggtaatccttctgggatgggggggatgcaaggacaaaaacttggcgaaatacagtgctatctatcataaacgcctgctggagctgcttttcgattacgagatcgagaaggaacctctgctgttccacgttttctcaaacggaggagtcatgctgtacaggtacgtgcttgaactcctccagacacgccggttctgtcgcctccgcgtcgtgggtaccatatttgattctgccccaggagactcaaatctcgtcggagctctgagagccctagcagccatactcgagcgtcgagcatag

SEQ ID NO: 47505 - DNA, 510 bp, Artificial Sequence
  Description of Artificial Sequence: Synthetic coding sequence
atgtgcctgcggctgggcggcctgagcgtgggcgacttccggaaggttctgatgaaaacgggattggtcctcgtagttctgggacacgtcagcttcatcacggccgcactctttcatggcactgtactgagatacgtcggaacaccccaggatgcggtggcccttcaatactgtgtagtgaacatcctcagcgtgacatctgccatcgtcggaaaggctctcctggccgcctgtacttttggctccagtgagctgctggccctggcgccagactgccccttcgaccctactcgcatttactcttcgagtctttgtctctggggtattgccctagtcttgtgtgtggccgaaaatgtgtttgcggtgcgctgcgctcagttgacacatcagcttctcgaactacgcccatggtggggcaagtcttcgcatcatatgatgcgcgaaaatcctgaactcgtcgaggggagggatctgctgagctgcacctcttccgagcccttgaccttgtag

SEQ ID NO: 47506 - DNA, 669 bp, Artificial Sequence
  Description of Artificial Sequence: Synthetic coding sequence
atgtgcctgcggctgggcggcctgagcgtgggcgacttccggaaggtgttaatgaaaactggtctcgttctggtggtcctcggccacgtttcgttcattactgctgccctcttccacggcacagttctacgatatgtggggaccccacaggatgccgtggcgcttcagtactgtgtggtgaatattctgagcgtcacatctgctattgtagtgattacatcagggattgccgcaattgttcttagtcggtacctgccatctaccccgctgaggtggactgtcttcagctcaagtgtcgcttgcgccctgctatccctgacttgtgcactgggcttgctcgcctcaatcgctatgacatttgcaacccaggggaaggcgctgttggccgcttgcacctttggatccagtgagctgctggctttagcccccgactgtccctttgatcctacgcggatttatagcagttccctgtgcctctggggtattgctttggtgctttgtgttgcagagaacgttttcgctgtgagatgcgcacaactcacccaccaactgctggaattgcgcccttggtggggaaaatcttcccaccatatgatgcgcgagaacccagagctcgttgaagggcgagacctgctgagttgcacaagtagtgagcccttaaccctgtag

SEQ ID NO: 47507 - DNA, 834 bp, Artificial Sequence
  Description of Artificial Sequence: Synthetic coding sequence
atggccgccgacggcgagcggagccccctgctgagcgagcccatcgatggaggggctggcgggaacggattggtgggccctggagggtctggcgccggtccaggcggcggcttgactccttccgcacctccatacggcgctgcattcccaccatttcccgagggccatcccgccgtactgcctggagaagacccacctccctactcacccctcacatcccccgactcaggctccgcacccatgatcacttgtcgggtttgtcaaagtctcatcaacgtagagggaaagatgcaccagcatgtcgtcaagtgcggagtatgcaacgaggcaacacccattaagaacgccccccccgggaaaaaatacgtcaggtgcccctgtaattgtctccttatatgcaaagtgacctcccagaggattgcctgtcctcgtccctactgcaaacggattattaatctgggtcctgtccacccaggccccctgagcccggagccccagccgatgggagtccgggtaatctgtgggcactgtaaaaatacctttctgtggacggagtttacagatcggaccttggcccgttgtccccactgcaggaaggtatctagtattggcagaaggtatccgcgcaagcgctgtatctgctgcttcttattggggctcctgctggcggtgaccgcgacaggtctcgcttttggaacctggaagcacgctaggaggtatgggggcatttacgcggcctgggcgttcgtcattctgcttgcggtgctgtgtctcggacgagctctttattgggcttgcatgaaagtttcccaccccgtccaaaatttctcttag

SEQ ID NO: 47508 - DNA, 855 bp, Artificial Sequence
  Description of Artificial Sequence: Synthetic coding sequence
atggccgccgacggcgagcggagccccctgctgagcgagcccatcgatggaggcgctggagggaacggcttagttgggccaggtggctctggcgcagggccaggcggagggttaacacccagtgctccaccctatggcgctggcaagcacgctcctcctcaggcattccctccctttcccgaaggtcatcccgccgtgcttccaggcgaggacccgccgccctattcgcccctcacaagcccagattcagggagcgctccgatgatcacctgccgcgtgtgccagtccctgattaacgtggagggtaaaatgcaccaacatgtggttaagtgtggagtttgtaacgaagccacacccattaagaatgctccgcccggcaagaaatacgtgaggtgcccttgtaattgtctcctcatttgtaaagtgaccagtcagagaatcgcgtgcccacgaccatattgcaaaaggatcataaacctcggtcccgtgcacccgggccctctcagtcctgagccgcagcccatgggggtgagagtcatctgcggccattgtaaaaacacattcttgtggaccgaatttaccgatcggaccttggcccgctgtcctcactgccggaaggtgtcatcaatcggccgaagatacccccggaaaagatgtatttgttgttttctcctggggcttctgctggctgtcaccgctactggcttagcattcgggacatggaagcacgcaagacggtatggcgggatctatgctgcatgggcgtttgtgatcttattggcagtcctgtgtctcggcagagccctatactgggcgtgcatgaaggtcagtcacccagtccagaatttttcgtag

SEQ ID NO: 47509 - DNA, 792 bp, Artificial Sequence
  Description of Artificial Sequence: Synthetic coding sequence
atggagatcaacaccaagctgctgatcagcgtgacctgcatcagcttctttacatttcagttgctattctattttgtgtcttactggttctcagctaaagtgtcccctgggttcaactcgcttagtttcaaaaagaagattgaatggaacagccgtgtagtgtccacttgtcatagcctcgtcgtgggtatcttcggattgtatatttttttgttcgacgaagctacgaaagctgaccctctgtggggtggaccttccctcgccaacgtgaatattgccatcgcctcaggctacctgattagtgatctgtctattatcatcctgtactggaaagttatcggtgacaagttcttcataatgcaccactgcgccagcctctacgcgtattacttagtcctcaaaaacggtgtgctagcctatattgggaactttaggctgcttgctgagctgagttctccatttgttaaccagagatggttcttcgaggctctcaaatatccgaagttcagtaaagctatagtgattaacggtattcttatgacagtcgtctttttcattgtccgtatcgctagcatgctcccgcactacggcttcatgtactctgtgtacggcaccgagccttacatccggctgggcgtgctgatccagctgtcttgggtgattagctgcgtggtcctggatgtcatgaacgtcatgtggatgatcaagattagcaaaggttgcatcaaggtgatctcccacattcgtcaggaaaaagccaagaacagcctgcagaacggtaagctggattag

SEQ ID NO: 47510 - DNA, 432 bp, Artificial Sequence
  Description of Artificial Sequence: Synthetic coding sequence
atggagatcaacaccaagctgctgatcagcgtgacctgcatcagcttctttacattccagctgctgttttatttcgtgtcctactggttctccgcaaaggttagcccgggatttaactccctgagcttcaagaaaaaaatcgaatggaatagtcgggttgttagcacatgccactccctggtcgtaggaatctttgggttatatatcttcttgtttgatgaggctacaaaggcggaccccctgtggggcggtccgagtctcgccaatgtgaacatagctattgcgagcggttacttgatcagtgacctttcaattatcatcctatactggaaagtgatcggagacaagttttttattatgcaccactgcgcatccctctatgcctactatcttgtattaaagaatggggtccttgcctacattgggaactag

SEQ ID NO: 47511 - DNA, 465 bp, Artificial Sequence
  Description of Artificial Sequence: Synthetic coding sequence
atggagatcaacaccaagctgctgatcagcgtgacctgcatcagcttttttacgtttcagttgttattttactttgtatcctactggttcagtgcgaaagtgagtcccggatttaacagcttgagcttcaagaagaaaatcgagtggaactcgcgggtcgtcagtacttgtcactccctggtggtaggcatttttggtctgtatattttcctgttcgatgaggcaacgaaggccgaccctctctgggggggacccagcctggccaacgtaaatatcgcaatcgcaagcgggtacttaatctctgacttgtccattattatactttactggaaagttattggcgataaattttttatcatgcatcactgtgcatcattatatgcctactatctggtgcttaagaatggcgtcttggcctatatcggtaacttcaggttactggccgagttatctagtcccttttag

SEQ ID NO: 47512 - DNA, 1995 bp, Artificial Sequence
  Description of Artificial Sequence: Synthetic coding sequence
atgaagcggcggaacgccgactgcagcaagctgcggcggcccctgaaaaggaaccgaatcaccgaagggatttacggcagcaccttcctgtatctcaagtttctagtcgtgtgggctcttgttctcctggccgatttcgtcctcgaatttcgattcgagtacctctggcccttctggctgttcatccgaagcgtgtacgattcattccggtatcagggtctggccttcagcgtgtttttcgtttgtgtcgctttcacatctaatatcatttgtcttctcttcattcctatccaatggctgttttttgcagcgtctacttatgtgtgggtccaatatgtctggcataccgaaagaggggtgtgtctgccaacagtgagcctgtggattttatttgtctatatagaggctgcgattcggtttaaagacctgaaaaacttccacgttgacctgtgcaggcctttcgcagctcactgtattgggtatccggtcgtcacgctgggattcgggtttaagtcctacgtgagttacaaaatgcgactccggaaacagaaagaggtacaaaaggagaacgaattttacatgcagcttctccaacaggccctgccccctgaacagcagatgctccaaaagcaggagaaagaggcagaagaggcagccaaaggactgcccgacatggattccagcattctgattcaccataatgggggtattcccgcgaacaaaaaactgtcaaccacattaccagaaattgaatatcgcgagaaggggaaagaaaaggacaaggacgccaagaaacacaatcttggtattaataacaacaacatccttcaacccgtcgactccaagatccaggagatcgagtacatggaaaaccacatcaactctaaacgcctcaataatgacctggttggcagcacagagaacctgctgaaggaggacagctgcactgcctctagcaaaaactacaagaatgcttccggcgtcgtgaacagttcgccacggtcccattccgccaccaacggctctatcccgtcgtcatcatcaaaaaatgagaaaaaacaaaaatgcacgtcaaaaagcccctctacacacaaggacttaatggagaattgcatccctaacaatcagcttagtaagcctgatgctctggtcagactcgagcaggacattaagaagctgaaagcagatctacaagcgtctcggcaggtggagcaggagctgcggagccagatttcctctctaagctctacagagcggggtatcaggagcgagatggggcagctgcggcaggaaaatgagctattgcaaaataaactccacaatgcagtgcaaatgaagcaaaaggacaagcagaacatatcccagctcgagaaaaagcttaaggccgaacaggaggcacggtcattcgtggaaaagcagctaatggaggagaaaaagaggaaaaagctcgaagaggccacagcggccagggcggtggctttcgctgctgcaagtagaggcgaatgcacggagacgctccgcaacagaattagagagctcgaggctgagggtaaaaaactgaccatggatatgaaggtgaaggaggatcagatcagagagctggaactgaaagtccaggaactgagaaaatataaggagaacgaaaaggataccgaggtcctgatgtcagctctctctgccatgcaggataagacgcaacatctggagaatagcctgtccgccgaaacgagaattaagctcgacctattctcagccctgggcgatgcaaaacgccagctcgagattgctcagggccaaatcttacagaaagatcaggagatcaaagatcttaaacagaaaatcgccgaagtgatggctgttatgccgtcaattacctactctgccgcaactagtccactctcacctgtctcccctcattattcaagcaagttcgtggaaacaagcccatccggcttggaccctaatgcatctgtgtaccagcccttaaagaaatag

SEQ ID NO: 47513 - DNA, 921 bp, Artificial Sequence
  Description of Artificial Sequence: Synthetic coding sequence
atgaagcggcggaacgccgactgcagcaagctgcggcggcccctgaaacgaaacaggattaccgaaggtatttacggacggttggaacaagatatcaagaagctgaaagccgacctgcaggcaagccgtcaggtcgagcaggagttaaggagtcaaatctcttccctttcttccacagaacggggcattaggagcgagatgggtcaactcaggcaggaaaacgagcttctgcaaaacaaacttcacaatgccgtacagatgaaacaaaaggataaacaaaatatcagccagttggagaaaaagttgaaggccgagcaagaagcccgatccttcgtcgagaagcagctgatggaagaaaaaaaacgcaagaaactagaggaggcaacggccgctcgggcagtcgccttcgccgctgctagtcgcggggaatgtaccgagaccttgcgtaaccgtatccgggagctggaagccgaagggaagaagcttaccatggacatgaaagtcaaggaagatcagattcgcgagctagagttgaaggtccaggaattgagaaagtacaaagagaacgaaaaagacacagaggtgttgatgtcagcactgtctgccatgcaggacaagactcaacatctggagaacagcctgtcagccgaaaccagaatcaaactggatctcttctccgccctcggtgacgctaagaggcagctggaaatagcccagggccaaatcctgcagaaggaccaggagatcaaagatcttaagcagaaaattgccgaagtgatggccgtgatgccaagcatcacatactctgccgctacttccccgctctcacccgtgtcccctcattattcgtctaaatttgtcgagacctcacccagcggactcgacccaaatgcttcggtctatcagcctctgaagaagtag

SEQ ID NO: 47514 - DNA, 1314 bp, Artificial Sequence
  Description of Artificial Sequence: Synthetic coding sequence
atgaagcggcggaacgccgactgcagcaagctgcggcggcccctgaaaaggaataggataacagaaggcatctatggctccacttttctttatctaaagttccttgtagtgtgggccctcgtgcttctggctgatttcgtcctagagttccgattcgaatacctctggcctttctggctgttcatcagatcggtctacgatagctttagatatcaggggctggccttctcggtattctttgtctgcgtggcatttacctccaatattatctgcctgctgtttatccccatccagtggctgttctttgctgcgtccacctacgtgtgggtgcagtacgtgtggcacactgagagaggagtctgcctgccgaccgtttctctctggattcttttcgtctacatcgaggctgcaatccggttcaaggatcttaaaaattttcacgtcgatttgtgtagaccctttgccgcacattggctagaacaggacatcaagaagctgaaagccgacctacaagcctcccggcaggtggagcaggagctgcgttcgcaaattagcagcctatctagtaccgagcgcgggattagatccgaaatgggccaactccgacaggaaaatgagcttcttcaaaataagctccacaatgctgtgcagatgaagcagaaagataagcaaaatatcagccaattggagaagaaattaaaggcagaacaagaggccaggagtttcgtggagaaacagctgatggaggagaaaaaacgcaagaaattggaagaggctaccgcggctcgcgccgttgcctttgctgccgcatcgcgaggtgaatgtacggaaaccctgcggaatcgcattagggaattagaggccgaaggaaagaaactgactatggatatgaaagtgaaggaagaccaaatcagagaattggaactgaaagtgcaggaactccgcaaatacaaagaaaatgagaaagataccgaggttctgatgtctgccttatccgctatgcaggataagactcaacatctggaaaactccctttcagcggagaccaggattaagctggatctgttcagcgctttgggcgacgccaagcgacagctcgaaatcgcacagggtcaaatcctacagaaggatcaggaaattaaagaccttaagcagaagattgccgaggtaatggcagtgatgccaagcatcacctactctgctgcaacctcccctctcagcccagtgtcgccacactactcgagcaagttcgtggaaacctcgccctctggactggatcctaacgccagcgtgtaccaaccactgaagaagtag

SEQ ID NO: 47515 - DNA, 627 bp, Artificial Sequence
  Description of Artificial Sequence: Synthetic coding sequence
atggacaagttcgtgatccggaccccccggatccagaacagcccccaaaagaaggattcaggtggtaaggtgtacaaacaagccactatcgagagtctgaagagggtggttgtggttgaggacatcaaacggtggaaaacaatgcttgagttgcctgatcagacgaaagagaatcttgttgaggccctccaggaattgaaaaagaagatcccatccagagaggtgttgaagtccactaggatcggacatacagtcaataagatgcgaaagcattccgactcggaagtagcttcattggctagggaagtgtacactgagtggaagactttcaccgaaaagcacagtaaccgcccatctattgaggtgagatccgacccaaaaaccgagtcactcaggaagaatgcacagaagttgcttagcgaggcactcgaattaaaaatggaccatctgctcgtggaaaacatagaacgtgagaccttccacttgtgtagtcgtcttatcaacggcccatatcggagaaccgtcagagccctcgtctttaccctcaaacacagagctgagattcgagcccaggtcaaatccggctcactacccgtgggcacctttgtgcagacgcataagaagtag

SEQ ID NO: 47516 - DNA, 438 bp, Artificial Sequence
  Description of Artificial Sequence: Synthetic coding sequence
atggccgcccccaagggcagcctgtgggtgcggacccagctgggcctcccacctctgctgctgctaactatggctcttgcaggcggatctgggaccgccagcgctgaagcgttcgactctgtcctgggagacactgcatcatgccatagggcctgccagctgacttaccctttgcatacataccccaaggaagaagaactgtatgcctgtcagcgcggatgccgcttattctcgatttgccagtttgttgatgacggaatcgacctgaatcggacaaaactcgaatgtgagtctgcttgcacagaggcatatagccagagtgatgagcagtatgcttgtcatctgggctgtcagaaccaactgccattcgctgagctgcgacaggaacaggtacggaacaatactgcattccagacatccctgctgcgatggcattag

SEQ ID NO: 47517 - DNA, 852 bp, Artificial Sequence
  Description of Artificial Sequence: Synthetic coding sequence
atggccgcccccaagggcagcctgtgggtgcggacccagctgggcctgccgcccctgcttcttctcactatggctctcgccgggggatccggaacagcaagcgcggaggcatttgacagcgtcctgggtgatacagcatcttgtcaccgggcttgccagctgacatacccattgcacacgtaccccaaggtgagcgcctcgctctacactgttgaccacatagaagaagaactctacgcgtgccaacgcggatgcaggcttttttctatatgccagttcgtggatgatggcattgacctgaatcgtaccaaactggaatgcgaatcagcttgcaccgaagcttattcacagtcagatgagcaatacgcctgccatttagggtgccagaatcaacttccattcgctgagttgagacaggaacaactaatgtctctgatgcctaaaatgcacctactgttcccgctcactctcgtgcggtccttctggtctgatatgatggattcagcccaaagctttattacttccagttggaccttttatctacaggccgatgacggaaagattgttatattccagagcaaaccagaaatccaatatgcacctcacctcgagcaagagcctaccaatctgcgggaatcttctctgtctaagatgagctatctccaaatgagaaatagccaggcccatagaaactttttggaggacggcgagagcgacggctttcttcgctgcctctctctgaacagtggctggattttgacgactactttagtgttgtccgtgatggtcctgttgtggatttgctgcgctacagtagccaccgccgtggagcaatatgtcccttcggaatag

SEQ ID NO: 47518 - DNA, 579 bp, Artificial Sequence
  Description of Artificial Sequence: Synthetic coding sequence
atgagcctgatgcccaagatgcacctgctgttccccctgaccctggtgcgttccttttggagcgacatgatggactctgctcaaagcttcatcacctcatcatggaccttttatttgcaggccgacgatggcaaaattgtgatttttcagtcgaagcctgagatccaatacgccccccacctggagcaagaaccaacgaacctgagggaatcttccctgtcaaaaatgagttacctgcagatgagaaacagtcaggcacacagaaattttctggaggatggagaatccgacggattcctcagatgcctgtcccttaattctggttggatcctcaccacaaccttggtgctctccgtgatggtgctgctctggatttgctgcgctaccgtggcgacagctgtggaacagtacgttccatctgagaaactgtctatctatggcgaccttgagttcatgaatgaacagaagctcaatcggtacccagctagttccctggtggtggtgcgctctaagaccgaggaccacgaggaggcaggccccctcccaacaaaagtaaacttagcccactcagagatttag

SEQ ID NO: 47519 - DNA, 579 bp, Artificial Sequence
  Description of Artificial Sequence: Synthetic coding sequence
atgagcctgatgcccaagatgcacctgctgttccccctgaccctggttcggagtttctggtccgacatgatggattctgcccaatcctttatcacgtcttcatggactttttaccttcaggccgatgatggcaagatcgtaatattccaaagcaagcccgagattcagtacgctccccacctggagcaggagccaacaaacctgagggagtcaagcctcagtaagatgtcttacctgcagatgaggaatagtcaggcacaccggaacttcctagaagacggtgaatctgacgggttccttcggtgcctctctctcaattccggctggatcctgaccacgaccttggtgttatccgtgatggtactgctgtggatctgttgcgccactgtcgctaccgctgtggaacagtacgtaccatctgagaagttgagcatttacggggatctcgagttcatgaatgaacagaaactcaataggtatccagcatcaagtctggtcgtggtgaggagcaagactgaagaccacgaggaggcgggccctttgccgaccaaagtcaacctagcgcactctgagatttag

SEQ ID NO: 47520 - DNA, 579 bp, Artificial Sequence
  Description of Artificial Sequence: Synthetic coding sequence
atgagcctgatgcccaagatgcacctgctgttccccctgaccctggtcaggagtttctggagcgatatgatggattcagctcaaagtttcattacttcttcttggacattctatctgcaagcagacgatggaaaaattgtgatattccaatccaagcctgaaatccagtatgcccctcacttagaacaggagccaactaacctgagagagtcttccctcagcaaaatgagttacttgcaaatgagaaactcccaggcgcatcgcaacttcctggaagacggagagagcgacgggtttctgcggtgcctgagccttaactctggttggatcctcacaacgaccctggtcctgagcgtcatggtgctgttgtggatatgttgcgctacagtcgccaccgccgtggagcagtacgtgcccagcgaaaaattgagtatttacggtgaccttgagtttatgaacgaacagaagttgaataggtatccggcatccagcctggtcgtggtacgaagtaaaactgaggaccatgaagaggcaggtcctctgcctacaaaagtcaatctcgcccatagtgagatatag

SEQ ID NO: 47521 - DNA, 435 bp, Artificial Sequence
  Description of Artificial Sequence: Synthetic coding sequence
atgagcctgatgcccaagatgcacctgctgttccccctgaccctggttcgctctttttggtctgatatgatggactctgcccaatcgtttatcacgtccagttggaccttttatctgcaggcagatgacgggaaaatcgtgatttttcagagcaagccagaaattcagtacgccccccacctagaacaagagcctacgaatttgcgtgagtcctcacttagcaaaatgtcatacttgcagatgagaaactcgcaggcccaccgtaactttttagaagacggcgagtctgacggtttcctgaggtgcctgtcgttaaattccggatggattttaaccacaacactggttctgagtgtcatggtgctgttatggatttgctgtgccacagtcgccactgctgttgagcaatatgttccaagcgaagtgaatctttag

SEQ ID NO: 47522 - DNA, 435 bp, Artificial Sequence
  Description of Artificial Sequence: Synthetic coding sequence
atgagcctgatgcccaagatgcacctgctgttccccctgaccctggtcagatccttttggagcgacatgatggactccgctcaaagctttattacatcttcctggactttctatctgcaagctgacgatggcaagattgtgatttttcaaagtaagccagaaattcaatacgcgccccatctggaacaggagcccaccaatttgagggaatcctctctgagtaagatgtcctatcttcaaatgaggaactctcaggcccaccggaattttctggaggatggggagtccgatggtttcctgcgctgtttgtcactcaactcgggctggatcctgacaacaaccctggtattgtccgtgatggtactgctttggatctgttgcgcgaccgtcgcaaccgccgtcgaacagtatgtgccaagcgaagtcaatctctag

SEQ ID NO: 47523 - DNA, 858 bp, Artificial Sequence
  Description of Artificial Sequence: Synthetic coding sequence
atggccgcccccaagggcagcctgtgggtgcggacccagctgggcctgcctccactgctactactgacaatggcccttgccggcggtagcggcaccgcctctgccgaggctttcgacagcgtcctgggggataccgcttcttgccatagagcatgtcaactgacttaccccctgcatacatatccaaaagtgtccgcttctctatataccgtcgatcacatcgaggaggaactgtacgcttgtcagcgaggctgtcggctatttagcatttgtcagtttgtagacgacggtattgacttgaatcgcacgaagctggaatgcgagtcagcatgcacagaagcttatagccagtccgatgagcagtatgcctgccacttgggctgtcaaaaccagctacctttcgctgaactgcgtcaggagcagttaatgagtcttatgccaaagatgcaccttctgttcccactgaccctggttagatcattctggtcggacatgatggacagtgcacagtctttcattaccagcagctggacgttctatctgcaggctgacgatgggaaaatcgttattttccaaagcaagccggagatccaatatgcgccgcacttggagcaggagcctacgaacctgagagagtcatctctgtcaaaaatgtcttatctgcagatgagaaacagtcaagcccatcgcaacttcctggaggatggcgagagcgacggctttctgagatgcctctccttaaattccggttggatcttaacaaccaccttggtgctgagcgtaatggttttgctctggatatgctgtgcaaccgtggcaacggcggttgaacagtacgtgccgtctgaggtgaactag

SEQ ID NO: 47524 - DNA, 1029 bp, Artificial Sequence
  Description of Artificial Sequence: Synthetic coding sequence
atggccgccgtggccctgatgcccccccccctgctgctgctgctgcttttggctagcccacctgccgcctccgcaccatcagccagagatccgttcgcccctcagctcggagatacccaaaattgccagctgcgatgccgcgatagggatctcggtccccagcctagccaggcaggtctggagggcgcctccgagagtccatacgaccgggctgtgctgattagcgcctgcgagaggggatgccggcttttctccatctgtagatttgtggcccggtccagcaaacccaacgccacgcagacagaatgcgaggctgcatgtgtggaggcttacgtgaaagaggccgagcagcaggcgtgtagtcatggctgttggtcccagccggccgagcctgagcctgagcaaaaaagaaaggttctagaagcaccgtccggagcactgtccctgctggacctgttctctacactgtgcaatgacctggtcaactcagcccagggattcgtttcttctacctggacgtactacttgcagacagacaacggcaaggtggtggtgttccagacgcaacctatcgtggaatcattgggcttccaaggcggccgcttgcagcgggtggaggtgacctggcgcgggagtcatccagaagctttagaagttcatgtcgacccagtgggtccgcttgataaggtacgcaaagcaaagatcagagtgaaaacctccagcaaagccaaagtcgaatctgaagagccgcaggacaacgatttcctaagttgcatgtccaggagaagtgggctgcctcgctggatcctggcatgctgcctgtttttgagtgtgctggtcatgctgtggttgagctgctccaccctggtaaccgcccccggtcagcatttaaagttccagcccttaactctggaacagcataagggctttatgatggagcccgactggcccctgtatccccccccatcccacgcctgcgaggacagcctcccaccttacaagctgaaattggacctgacgaagctatag

SEQ ID NO: 47525 - DNA, 1029 bp, Artificial Sequence
  Description of Artificial Sequence: Synthetic coding sequence
atggccgccgtggccctgatgcccccccccctgctgctgctgctgttgcttgcttcgcccccagctgcatccgctccaagcgctcgggatccttttgctccacagctgggtgatacccagaattgtcagctccggtgtagagatagggatctcgggccccaaccgtcacaggccggactcgagggagcctctgaatcgccttacgatagagccgtcctgattagtgcgtgtgaaagggggtgccggcttttctccatttgcagatttgtcgctcggagctccaagcctaacgctacgcagaccgaatgcgaggcagcctgcgtagaagcttatgtgaaagaagcggagcagcaggcctgtagccatgggtgttggagtcagccagcggaaccggaaccggagcagaagcggaaagtgctagaggcaccatctggcgccttatctctcctagacctgttttctaccctgtgtaatgatttggtcaactcagcacaagggttcgtgagctcgacctggacatactatttacagaccgataacgggaaggtcgtcgttttccagacccaaccaattgtggagtccctagggtttcagggtggcagactccagcgggtcgaagtgacctggcgcgggtctcatccagaggccctagaagtccacgtcgaccctgtcgggccactcgataaggttcggaaagccaagatccgagtgaaaaccagctctaaggccaaagtggaatcagaggaaccccaggacaacgactttctgagctgcatgtcccgcaggagcggcctgcctagatggattcttgcatgctgcctctttcttagcgttctcgttatgttgtggctctcctgctcaacgctagtgactgcccccggacagcatctgaagttccagcctctcaccctcgaacaacataagggcttcatgatggagcccgactggcctctatatccccctccaagtcacgcttgcgaggactctctgcctccctacaaattgaagctggatcttaccaaactgtag

SEQ ID NO: 47526 - DNA, 402 bp, Artificial Sequence
  Description of Artificial Sequence: Synthetic coding sequence
atgcggatgagcctggcccagcgggtgctgctgacctggctgttcaccctcctgtttctgattatgctggtactgaagctcgacgagaaagccccctggaactggttcctcatattcatacctgtgtggatcttcgataccatattactggtgttgctgatcgtgaaaatggccggtagatgcaaatctgggttcgaccccagacatggtagccacaatatcaaaaagaaagcctggtacctgattgcaatgctgctaaagctggccttctgtctagccctttgcgctaagctggaacagttcacaaccatgaacctgtcctatgtattcatcccactctgggccctgttggctggtgcattaacggaactgggatataatgttttttttgtaagggactag

SEQ ID NO: 47527 - DNA, 633 bp, Artificial Sequence
  Description of Artificial Sequence: Synthetic coding sequence
atggccctgccccagatgtgcgacggcagccacctggccagcaccctcagatactgtatgacggtgtctggcacagtagtccttgtcgccggcaccttgtgcttcgcctggtggagcgaaggagatgccactgcccagcctgggcagctcgcaccccctacagagtaccccgttcctgaagggccctcgccgctgctgagatccgtctcctttgtctgctgcggcgctggggggctgctgttgctgattggtcttctctggagcgttaaagcaagtataccaggtcctccaaggtgggacccttatcacttgtcccgagatctgtactacttgaccgtggagtcctccgagaaagagagctgcagaacaccaaaggtggtggacattcccacttacgaggaggctgtcagtttccctgtagccgaaggccccccaacaccccccgcttatcctaccgaggaagcacttgaaccttccggcagtcgcgacgctctcctttccactcagccagcctggcccccccctagctacgaaagtatcagtctggccctcgacgccgtgtccgccgagacaacaccgtcagcgactcgaagctgctcgggtttagtacagaccgcacggggaggcagctag

SEQ ID NO: 47528 - DNA, 1932 bp, Artificial Sequence
  Description of Artificial Sequence: Synthetic coding sequence
atggccgccgtgctggccctgcgggtggtggccggcctggccgccgcagcgctcgtcgcgatgttgctggaacactacggcctagccgggcagccatcaccactacctcgccccgcgccccctagacggcctcaccctgctcccggtccaggcgattccaacattttctggggcttacagatctctgacatccacctctctagattcagggacccgggcagggccgtggacctagagaagttctgttccgagaccatcgacatcatccagcccgcgcttgttctcgccaccggcgaccttactgatgccaagaccaaagagcaactcggctcccgccagcacgaggtagagtggcagacataccagggaatcttgaagaagacgagggtcatggagaaaaccaaatggttagatatcaagggtaatcatgatgcattcaacatcccaagcctggatagcataaagaattattatagaaagtactcagccgtccgccgagacggtagcttccattacgtacactcgaccccttttgggaattactcttttatctgcgtggatgccacagttaatcccggcccaaaacgaccatataatttctttggcatactggataagaaaaaaatggaggagctgctgctgctagccaaggaatcatcccggtccaaccatactatatggttcggccactttacaacatcaacaattctttcgccgtcccccggcattaggtctatcatgagttcggcaatagcctatctgtgtggacacctgcacacactgggtggactcatgccagtgctacacactcgtcactttcaggggaccctggagttggaggtcggggactggaaggacaataggaggtaccgtatctttgctttcgaccacgatttgttctcctttgccgacctgatatttgggaaatggccagtggtgttgattacgaatcccaagtctctcctctattcctgcggcgaacatgagcccctggagaggctcttgcactcaactcatattcgagttctagccttctctctttcttctattacttcggtgacagtgaagatcgacggcgtgcaccttgggcaggcggtccatgttagcggacctatcttcgtgttgaaatggaatccgaggaattattcttccgggacacacaacattgaggtgattgttcaggactctgcgggcagatcaaaatcagtgcatcacatattcagcgtacaggagaataaccacctctccttcgaccctctggcatcctttatccttcgaaccgaccactatattatggccagggtcctttttgtcctgatcgttttgtcccagttaacaatactcatcatttttagatatcggggatacccagagctgaaagagcccagcggatttattaatctgacttccttttccctgcacgttctcagcaagataaacatattttactattctgtccttctcctgactctttacacagtattgggcccctggtttttcggcgagataattgatggaaagtttgggtgttgcttcagttttggaatttttgttaacgggcattttctgcagggtagcataaccttcattattggtattctgcagctcgcatttttcaacatccctcttatggcatacatgtgttggagcctactccaacggtgtttcggacacaactttcggagtcacctccatcagcgcaagtacctcaagatcatgcctgttcacttgctcatgttattgttgtatatttggcaggtctattcatgctatttcttgtacgccacctatgggacactggccttccttttctccccactcagaacgtggttaactcttttgacacccgttcttatccgatacgtttggaccctaaattccacgaaattcggaatcttcatggtgcaattgaaatcacacctctcatcttag

SEQ ID NO: 47529 - DNA, 2424 bp, Artificial Sequence
  Description of Artificial Sequence: Synthetic coding sequence
atgatggacagccccttcctggagctgtggcagagcaaggccgtgtcaattcgggagcaactggggcttggcgacagaccaaatgacagctactgttataattctgccaagaacagcacagtcctgcaaggagtgacttttggcggcattccaaccgtgctgttgattgacgtgtcttgctttctcttcctaattctggtgttctccataatacgacgccggttttgggattacggcagaattgctctcgtttcagaggccgattccgaaagccgttttcagagactgtcctctactagtagctctggccagcaggacttcgaaaacgaactagggtgttgtccatggctgacagcgatttttcgtctacacgacgaccagatactggagtggtgcggggaagacgctattcactatctcagttttcagcgccacattattttcctactcgtggtcgtgagtttcctgtccctgtgtgtgatcttgccagtgaacctgtccggcgatctgcttgataaagacccgtattcctttggcaggaccaccattgcaaatctccaaactgataacgatttgctgtggcttcatactatattcgccgtgatctatttgttccttacagtcggttttatgagacaccacacacagagtatcaaatataaagaggagaatcttgtgagaagaacgctttttattaccgggctgccccgggatgcacgcaaggagactgtagagtcacatttccgagacgcatatcctacgtgtgaggtggtcgacgtgcagttatgttataacgtagcaaaactaatttacctgtgcaaggaaaagaaaaaaaccgagaaatctctgacttattacacaaatctccaggtgaaaactggtcagagaacattgatcaaccctaaaccctgcggacaattctgctgctgtgaggttctaggctgtgagtgggaagatgccatatcctattacactcggatgaaagacaggctgctggagcgaattacagaggaagagcgccacgtgcaggatcagcctctcggcatggcattcgtaacattccaggaaaagagtatggctacctacattctcaaggatttcaatgcctgtaaatgtcagtcactgcagtgcaaaggggagccgcagccctcttcgcattctagggagctttatacaagcaaatggactgtcacctttgccgccgatcctgaggacatttgctggaaaaatctgtctattcaaggactgaggtggtggcttcagtggctgggaattaacttcactctcttcctcggactctttttcctgacaacccctagtattattctctctacaatggataagttcaacgtcaccaagcccatccacgcccttaataaccccataatttctcagtttttcccgactctccttctctggtccttctccgcgcttctaccatctatcgtctactactccacgcttctcgagtcacactggacgaaatctggtgaaaaccagattatgatgaccaaggtctatatcttcctcattttcatggtgctgatcctgcccagtctgggactgacaagtttggactttttcttcagatggctgtttgacaagacctcatcagaggcaagtatccggctggagtgcgtgttcttgcctgaccagggtgccttcttcgttaattacgttattgcatctgcctttataggcaatggcatggaactcctgagattgcctggcctgatcctgtacactttccggatgatcatggcgaagacagctgctgataggaggaacgtgaagcagaatcaggcctttcagtacgaattcggcgcaatgtacgcctggatgctatgtgtgttcactgtgatcgtcgcgtatagcataacctgtcccattatagccccgttcggtttgatttacatcctcctgaagcacatggtcgacaggcataacttgtactttgtatacctgcccgcaaaacttgaaaagggtatacacttcgcggctgtgaatcaggcactcgcagcgcccattttgtgcctgttctggttgtatttcttctctttcctaaggctagggatgaaagcacctgccactctattcaccttcctggttcttttgttgaccatccttgtgtgtttagcccatacgtgttttggatgcttcaaacatttatctcctttgaattataagacagaagagccagcttccgataagggatcggaggctgaagctcacatgcctccaccctttactccctacgttccacggatactcaatggactggcctctgagcggaccgccctctcgccccagcagcagcagcagcagacctatggggcaattcacaacatctccggaacgatacctggccagtgtctggctcagagtgccaccggcagcgtcgccgccgccccacaagaagcctag

SEQ ID NO: 47530 - DNA, 357 bp, Artificial Sequence
  Description of Artificial Sequence: Synthetic coding sequence
atgatggacagccccttcctggagctgtggcagagcaaggccgtgtctattcgtgaacagttaggactgggggaccggcctaacgatagttactgttacaacagcgccaaaaactctaccgtgcttcagggcgtgacgttcggcgggatccctactgttctgttgattgatgtgagttgctttttattcttaatattggtcttctcaattattagacgcaggttttgggactacgggcgcatcgctctcgtcagtgaggccgatagtgagtctagatttcagagactttcgtccactagttcgtccggccagcaggacttcgagaatgaactgggatgctgcccttggcttacgtag

SEQ ID NO: 47531 - DNA, 249 bp, Artificial Sequence
  Description of Artificial Sequence: Synthetic coding sequence
atgaaggaccggctgctggagcggatcaccgaggaggagcggcacgtgcaagaccagcctttgggcatggctttcgtaacctttcaggaaaagtccatggctacatatatcctaaaagattttaacgcttgtaaatgtcaaagtctgcagtgcaaaggggagccccagccgtcatcccactccagggagctgtacaccagtaagtggaccgtcacttttgcagccgatcccgaggacatctgttggtag

SEQ ID NO: 47532 - DNA, 2499 bp, Artificial Sequence
  Description of Artificial Sequence: Synthetic coding sequence
atgctgcccttcctgctggccaccctgggcaccaccgccctgaacaatagcaatcccaaggactactgctattcagcaaggatcagaagcactgttttacagggtcttccgttcgggggcgtacctactgtgctggccttagatttcatgtgctttttggccctgctgttccttttctctattctacgcaaagtagcatgggattatggtcgacttgcgctcgtgacggacgctgatcggctgcgacgccaggaacgcgatcgggtggagcaggaatacgtggcttcagccatgcatggcgactctcacgaccgctatgagcgcttaacaagcgtgtcatccagcgtcgatttcgaccaaagagataacggattttgttcttggctgactgcgatcttccgaatcaaggatgacgaaataagggacaaatgcgggggcgatgccgtccactatctgagctttcagcgccatatcattgggttgctggtggttgtgggcgtccttagcgttggcatagttctgcctgtgaactttagcggagatctgcttgagaataacgcctattccttcggtcggaccactattgccaacttgaaatctgggaataatctgctgtggttacacacatcatttgccttcctttacctcctcctgaccgtgtactcaatgaggcgccacacctcgaaaatgcggtataaagaggacgacttagtgaagaggaccctcttcataaatggaatttcaaaatatgccgagagcgagaagataaaaaagcactttgaggaggcatacccaaattgcaccgttctggaagctcggccttgctacaacgtagctcgtctgatgttcctcgatgctgaacgcaagaaggccgaaagggggaaactctactttaccaatttacagagcaaggaaaacgtcccgaccatgatcaatcccaagccctgtgggcatctgtgctgctgtgtggttagaggatgcgagcaggttgaggctattgaatattataccaagctcgagcagaaattgaaggaggactacaaaagggaaaaggagaaggtgaacgagaaacctttgggcatggctttcgtcactttccacaatgaaacaatcacagcgatcattctcaaagactttaatgtctgtaagtgtcagggatgcacctgtaggggtgagccccggccatcatcttgctctgaatctctgcatattagcaactggacggttagctatgcccccgaccctcagaatatatactgggagcacctgagcattaggggttttatctggtggctgagatgtctggttatcaatgtggtgttgttcatcctgctcttcttcctgacaaccccagccatcataataactacaatggacaagtttaacgtgacaaagcctgtcgagtatttgaacaatcccattattactcagtttttccctactcttctgctgtggtgtttttcagcactactcccaaccatcgtttactatagtgcattcttcgaggctcattggaccagatctggggaaaacagaacaacaatgcataagtgctacacatttctcatctttatggtgcttttgctgccctcacttggtttgagtagcctggatttgttctttagatggctcttcgataaaaagtttctcgctgaggcggcaatacgattcgagtgcgtcttcttaccagataatggcgccttcttcgtcaactacgttattgcctccgccttcatcgggaacgctatggatctgctcaggattcccggtctacttatgtatatgatcaggttatgtctggccaggagcgccgctgaaaggcgcaatgtaaagcgccaccaggcttacgagttccagttcggggccgcatatgcctggatgatgtgtgtgtttaccgtggtgatgacctattctattacatgccccatcatcgtgccattcgggctcatgtacatgctgctgaagcacctagtggataggtacaacctctattacgcctacctacccgctaagctggataagaaaattcattcaggcgcggttaatcaggtggtcgccgccccgatcctgtgccttttttggctcctatttttctctacaatgcgcaccgggtttctcgctcctaccagcatgttcacctttgtagtgctagttattacaatcgtaatctgcctctgtcacgtgtgttttggccattttaaatatctatccgcccacaattacaaaattgaacacaccgaaaccgataccgttgatccccgaagcaatggacggccgccaacagccgccgctgtacctaagtcagccaagtacatagcgcaggtactccaagattctgaggtggacggagacggggacggcgctcccggcagctccggcgacgaaccgccctcctcttctagccaggacgaggaactattgatgccaccagacgctttgaccgacactgactttcagtcttgcgaggacagcctgatagaaaatgaaatccatcagtag

SEQ ID NO: 47533 - DNA, 2499 bp, Artificial Sequence
  Description of Artificial Sequence: Synthetic coding sequence
atgctgcccttcctgctggccaccctgggcaccaccgccctgaacaacagcaaccctaaagactattgctatagtgcccgaattcgtagcaccgtgcttcagggcctaccttttgggggagtcccaacagtgctagccctggacttcatgtgctttctcgcacttctattcctattctctattttgcgcaaagtggcatgggattatggccgacttgctctcgtgacggatgccgatcgtctgcggaggcaggagcgagatcgggtagaacaagagtacgttgcttctgccatgcacggtgacagtcacgaccgatatgaaaggctgacctctgtttcttcttcggtcgacttcgatcagcgtgacaacgggttctgctcctggctgactgctatttttagaattaaagacgacgaaattcgagataagtgcggcggcgatgctgtccactacctctcgtttcagcgtcacattatcggactactcgttgtcgtaggagtgctgtcggtcggcattgtgttaccggtgaatttcagtggagatttgttggagaacaatgcttacagctttggcaggaccaccatcgcgaacttgaaatccggaaataacctcctctggctgcacacgagtttcgccttcttatacctgctgctcaccgtctacagtatgcgtaggcacacctctaagatgcgatataaggaagatgacttggtgaagaggactctgttcatcaatggtatttccaagtacgctgagtcggagaagattaagaagcacttcgaggaggcctatcccaactgcaccgtgcttgaggcacgcccctgctataatgttgcccgcctgatgttcttagacgcagaaagaaaaaaggctgaacgagggaaattgtattttactaacttgcagagtaaagagaacgttcccactatgatcaatcctaagccttgcggtcatctgtgctgttgtgtagttcgcggatgtgaacaggtggaggccattgagtattacactaaactggaacagaaactcaaggaggattacaagcgcgaaaaggagaaagtaaacgaaaaaccactagggatggcattcgtgacattccataacgaaaccatcacggccatcatactaaaagatttcaacgtctgcaagtgtcaagggtgtacttgcagaggagaacctagaccttcaagctgctccgagagcctccacatctccaattggacagtgtcctatgctcctgatcctcagaatatatactgggagcacctttctatccgcgggttcatatggtggctgcgatgcctagttattaacgtagtgcttttcatactgttgtttttcctaacaacgcctgcaatcatcatcaccaccatggacaagttcaatgtaaccaagccggtggaatacctgaataacccgatcataacacaattctttccgactttactgctatggtgtttcagcgccctgctgccaactatcgtgtattactctgctttcttcgaagcccactggacacggtcaggcgagaacaggacaacaatgcacaaatgctatacctttctcatcttcatggttttgctgctgccctcgctcgggcttagttctttggaccttttttttagatggctgttcgataagaaattcctcgcggaggctgcgatccggttcgagtgcgtgttcctgcctgacaacggggcatttttcgtcaattacgtcatagcgagcgcttttatcggtaatgcgatggacctactgcggatccccggacttttaatgtacatgattcggctttgcctggcaagaagcgcggcagagagaagaaatgtgaagcgtcaccaggcctacgagtttcagtttggcgccgcctatgcatggatgatgtgtgtttttaccgtggtcatgacttactctatcacttgccctattattgtgccatttggcctcatgtatatgcttctaaaacatctggtggaccgctacaacctttactacgcttatcttccggccaaacttgataagaaaatacattccggggcagtaaatcaagtcgtggctgcgcctattctgtgcctgttttggctccttttcttctctaccatgagaaccggctttctggcccccacatctatgttcacatttgtagtactggttataaccattgtcatctgcttatgccacgtgtgtttcggacacttcaaatacctctctgcgcacaactataaaatcgaacacacggagaccgatactgtcgacccaaggagcaacggacgcccccccacggcagccgcggtgcctaagagcgccaagtatatcgcccaggtgctgcaagacagcgaagtcgatggtgatggtgatggcgctcctgggagttcaggcgacgaaccaccatctagttcatcacaggacgaggagctgctaatgcctccagatgccctgacagatacagacttccagagctgcgaggattcccttattgagaatgagattcaccagtag

SEQ ID NO: 47534 - DNA, 681 bp, Artificial Sequence
  Description of Artificial Sequence: Synthetic coding sequence
atgctgcccttcctgctggccaccctgggcaccaccgccctgaacaactccaacccaaaagactactgctacagcgcaagaatccgttccaccgtcctgcaggggctgccctttggcggtgtgccaacggttcttgctctggatttcatgtgttttctagcgttgctattcctgttcagcattcttcgcaaggtggcttgggattacggtaggttagcactggtcacagatgccgaccggctccgacgccaggagcgcgacagagtggagcaggaatacgtcgcctccgctatgcacggggacagccacgatcggtatgaacgtctgacctctgtatctagttccgtggacttcgatcagagagacaacggcttctgttcctggctcactgccatatttcgaatcaaagatgacgagattagagacaagtgtgggggagatgcggtccactatctttctttccagcgtcatataattggactacttgtcgtcgtcggcgtcttgtcagtaggcatagtacttcccgtcaatttctctggggatctgcttgaaaacaacgcctactcattcgggcgcactacaatagctaacctgaaatctggcaacaacctgctatggttacacacctccttcgctttcctgtatctccttctgactgtatattcaatgcgccgccactag

SEQ ID NO: 47535 - DNA, 2421 bp, Artificial Sequence
  Description of Artificial Sequence: Synthetic coding sequence
atgagcgccagccccgacgacctgagcaccggcggccggctgcagaacatgaccgttgacgagtgcttccagtcgaggaatacagtcttacaggggcagccttttggcggcgtaccgactgtcctgtgccttaatatcgccctctgggtgctggtcctcgtggtgtatagcttcctcaggaaggccgcttgggattacggccggctggcactactaattcacaatgattcgctgacgtccctgatctatggtgagcagagcgaaaagacctctccatccgaaacgagcctggaaatggaacgccgggataaggggttctgcagctggttctttaactctatcaccatgaaggatgaggacttgataaacaaatgcggagacgacgctaggatctacattgtgttccaataccacctcattatctttgtgctcatcatctgtattccctcactgggcattatcctgccgattaactatactggttcggtgttggattggagctcccacttcgctcgcactacaatcgtgaacgttagcaccgaatcaaagttactgtggctccattccctgctgagcttcttttatttcattaccaacttcatgttcatggcccatcactgcttgggatttgcacctagaaacagccaaaaagtcacccggacactcatgataacttacgttccaaaggatatcgaggaccctgaattgatcatcaagcacttccatgaagcttaccccggaagtgtggtcactcgtgtgcatttctgctacgacgtgcgtaacttaatcgacctcgacgatcagaggcgccatgcaatgagagggcgactgttttacactgccaaggccaagaaaaccggcaaggttatgatccgcattcatccttgtgccagactatgtttttgtaaatgctggacctgttttaaggaagtggatgcggaacaatactacagtgagctggaggagcagctaacggacgaatttaatgccgagcttaatagagttccgcttaagcgtctggatcttatatttgtaactttccaggacagccgaatggcgaagcgggtgaggaaagactacaagtatgtacagtgcggagtgcagcctcaacagtcaagcgtcactaccattgtaaaatcctactactggcgtgtcaccatggcgccacatcctaaggacataatctggaagcacctcagtgtgaggcgattcttctggtgggccaggttcatcgctattaacactttcctatttttcttgttctttttcctaacaacgcctgctattatcatgaatactattgacatgtacaatgtgaccaggccaatcgagaaactccagaaccccatagtgacccagtttttcccctcggtgatgttgtggggttttactgtcatcctgccactgatcgtttatttttcagcatttctggaggcccattggacgaggagttctcagaacctcgtaatggtgcacaagtgttacatattcctcgttttcatggtggtgatcctgcctagcatgggactgaccagtctggatgttttccttcgatggttatttgacatttattacctggaacaagcgagcatcaggttccaatgtgtcttccttcctgataatggagcttttttcgtaaactatgtcattacagctgccctgctcggaacgggtatggagcttttgagattgggttctctcttctgctactccacaagactgttttttagtaggtccgaacccgagcgggtgaacatccggaaaaatcaagccattgattttcagtttggacgcgaatatgcctggatgatgaacgtgttctcggtggtgatggcttatagcataacttgtcctattatcgttcccttcggtctcctgtatttatgtatgaaacacttaactgacagatataacatgtactactcttttgcccctacaaaactgaacgaacaaatacacatggcggcagtgagccaggccatttttgcgccactactgggtctgttctggatgctcttcttcagtatcctccggcttggctcccttcatgccattaccattttttcccttagtactctacttattgccatggttatcgctttcgttggcatcttcctgggcaagctcaggatggtcgcagattatgagccagaggaggaagagatccagactgtgttcgacatggaaccttcctcaacgtctagcactcctacttcgctgctgtatgtggcgacggtcttacaggagccggaactcaatctcactccagcttcctcccccgctcggcatacgtatggaaccatgaataaccaaccggaggaaggagaagaggagtctggtcttcggggctttgctcgcgagctggactccgcacagttccaagagggactggagctggaggggcagaatcagtatcactag

SEQ ID NO: 47536 - DNA, 1131 bp, Artificial Sequence
  Description of Artificial Sequence: Synthetic coding sequence
atgaacaccatcgacatgtacaacgtgacccggcccatcgagaagcttcagaaccctatcgtcactcagtttttcccatctgtgatgttgtggggtttcacggtgatcctgcctttaattgtgtacttttcggcctttctggaagctcactggacccgcagcagccagaacctcgtcatggtgcacaagtgctacatcttcctggtgtttatggtggtcattcttccatccatgggactgactagtttggatgtcttccttcggtggcttttcgatatatattatctggaacaggcgagcattcgtttccagtgcgtatttttgcccgacaacggcgctttttttgtgaactacgtgatcacagccgctctgctggggaccggaatggagctcctcaggctcggcagcctcttctgctattctacaagactcttttttagtagaagtgagcccgagcgggtaaacatccgtaaaaatcaggccattgatttccaattcggaagagagtacgcctggatgatgaacgtcttttctgtagttatggcgtatagcatcacgtgcccaataatcgtcccatttggtctactgtacctatgtatgaagcatctaaccgaccgatacaatatgtactatagctttgctccaacaaaactgaacgagcagatccatatggccgccgtttcccaagccatattcgcccctctgctgggactgttttggatgctgttcttcagcatccttcgcctagggagcctgcacgcgatcaccattttctccctctctaccctgttaatagcaatggtcatcgcctttgtcggcatcttcctcggaaagttgcgaatggtggccgactacgagcccgaagaggaggagatccagaccgtgtttgacatggagcccagtagtacaagtagtacaccgacctcactactgtacgtggctactgtgctgcaagagccagagctgaatctcacccccgcctcctcccccgcccgacacacctacggtaccatgaacaaccagccagaagagggggaggaagagagcggcctccgcggcttcgcacgcgaattggatagcgcgcagttccaggaaggcctggagctcgaaggccagaatcaataccattag

SEQ ID NO: 47537 - DNA, 153 bp, Artificial Sequence
  Description of Artificial Sequence: Synthetic coding sequence
atgagcgccagccccgacgacctgagcaccggcggccggctgcagaacatgaccgttgatgaatgtttccagtcacgcaatacagtcctgcaggggcagcctttcggaggggtccccaccgtactctgcctgaatattgccctctgggtttag

SEQ ID NO: 47538 - DNA, 495 bp, Artificial Sequence
  Description of Artificial Sequence: Synthetic coding sequence
atgagcgccagccccgacgacctgagcaccggcggccggctgcagaacatgaccgttgacgaatgcttccaaagccgtaacacagtccttcagggtcagcccttcggaggggtccctaccgtcttatgcctgaacattgcactctgggtgctggtgctggtggtgtactcttttctcaggaaagccgcatgggactacggccggctcgccttgttaatccataacgactctctgaccagcctgatatatggcgagcagtctgaaaagacctcgccctctgagacttctttggagatggaaagacgagataagggcttctgcagctggttttttaacagcatcaccatgaaagatgaggatctgatcaataagtgtggtgatgacgcgaggatatatattgtttttcaatatcatctaattatctttgtgctgattatatgtatcccttctctgggcattattctgcctatcaattatacagggtccgttttatag

SEQ ID NO: 47539 - DNA, 156 bp, Artificial Sequence
  Description of Artificial Sequence: Synthetic coding sequence
atgagcgccagccccgacgacctgagcaccggcggccggctgcagaacatgacagtcgacgaatgtttccagtcacgcaacactgtactccaaggacagcccttcggtggggtgccgaccgttctctgcctgaacatagcactctgggtgttatag

SEQ ID NO: 47540 - DNA, 111 bp, Artificial Sequence
  Description of Artificial Sequence: Synthetic coding sequence
atgagcgccagccccgacgacctgagcaccggcggccggctgcagaatatgaccgtagacgagtgctttcagtcaagaaacaccgtcttgcaagggcagccatttggctag

SEQ ID NO: 47541 - DNA, 72 bp, Artificial Sequence
  Description of Artificial Sequence: Synthetic coding sequence
atgagcgccagccccgacgacctgagcaccggcggccggctgcagaatatgacggtggacgaatgcttttag

SEQ ID NO: 47542 - DNA, 987 bp, Artificial Sequence
  Description of Artificial Sequence: Synthetic coding sequence
atgcggagccccggcggcatcctgctgcaggccctgccccggctgttgcagcacgccgccctacccgggctcgccgaactccctgctcgctgggctctgcctagaggagccggaggcgacggccccgctgatcgcctaccccgcggtgggggcgcgtccgctgccgctgccgccgctgctgcgtccggagcactgctgggtgcctacctggaacgtcatggaccacccgaggcaagtgagctgcctgagcccgggggggccttggctggcgggccggggagtggaggcggcggtgttgtcgtaggggtggctgaggtgaggaactggcgctgttgttgcctcgggagcacatgttggtgcagatctctggtcctggtctgtgtgctggctgccctttgcttcgcttccctggctctggtgcggagatatctgcatcacctactgctgtgggtagaatcgctcgacagtctcttgggtgtgcttttgttcgtcgtgggtttcatcgtggtcagcttcccttgtggatggggttatatcgtactgaacgtggcggccggttacctctatggctttgtgcttggcatggggctgatgatggtgggtgtgctgattgggacttttatcgcacatgtggtctgtaagaggctgctgaccgcatgggtcgcggccagaatacaatccagcgaaaaactcagtgcagtcattagggtcgttgaaggcggctccgggttgaaagtggtggcactggctcggcttaccccgatccccttcggcctccagaacgcagttttttctataatcataagtattggcctgatgttttacgtggttcacagagctcaagttgagctgaatgccgctattgtggcgtgcgaaatggaactgaagtctagcctggtgaaaggtaaccagccaaacactagcggttccagtttctataataagcgcacactgaccttcagtgggggaggtatcaacgtggtgtag

SEQ ID NO: 47543 - DNA, 1143 bp, Artificial Sequence
  Description of Artificial Sequence: Synthetic coding sequence
atgcggagccccggcggcatcctgctgcaggccctgccccggctgctacagcacgccgcattaccagggctggctgagctgccagcccggtgggcacttccgcgcggcgccgggggtgacggacccgctgacagactgcccagaggtggcggcgcctccgccgccgccgccgctgcggccgcaagcggggctttgctgggcgcctacctggaacggcatggtcccccagaggcctctgagctccctgaacccggtggcgcattggccggaggcccaggcagtggtggcgggggagtagtggtgggcgtcgctgaggtcagaaactggaggtgctgttgcttaggcagcacatgctggtgtagatctttggttctcgtgtgcgtcctcgctgcactgtgctttgctagtcttgccttagtgagacgctatctgcaccacctgttgttatgggtggaaagcctcgatagcttattgggggtgctcctgttcgttgtgggatttattgtcgtctctttcccatgtggctgggggtacatcgtgttgaacgtggcggccggatacttgtatggttttgttctgggaatgggcctgatgatggtgggagtgttgattggaactttcatcgcgcacgtcgtgtgcaagcggctgttgacagcttgggttgccgctaggatccagtcatccgaaaaactttccgccgtcattcgagtcgtggaaggcggatccggactgaaggtggtggctctcgcccgactgaccccaataccttttgggcttcaaaatgctgtgtttagcattactgacctcagcctgccaaattacttgatggcaagtagcgttggcctgctccctacccagctgctgaactcctatctgggaaccacgttgcggacaatggaagacgtgatcgctgagcagagcgtgtccggctactttgtcttctgtctgcaaatcatcattagtatcggacttatgttttatgtcgtccaccgagcccaggtggagctgaatgctgctattgtggcatgcgagatggaactcaagagttcccttgttaaggggaaccagccaaacacaagtgggtctagcttttacaataagcggacacttaccttttccggaggcggcataaacgtggtgtag

SEQ ID NO: 47544 - DNA, 360 bp, Artificial Sequence
  Description of Artificial Sequence: Synthetic coding sequence
atgcccccccggatcaccgacctgagcctgcccaactacctgatggccagttccgtcggtctcttacctacccagctccttaacagctacctcgggacaacactgcgaaccatggaggacgtgattgcggagcagagtgtctcaggttattttgtcttttgccttcagatcatcatctcaatcggactcatgttttatgttgtgcatcgcgctcaggtggagttgaatgctgcaatcgtggcttgcgaaatggagctgaagtcttcgctggtcaagggcaatcagccaaataccagcggctccagtttttacaataagagaaccctgactttcagtggcgggggaatcaatgttgtgtag

SEQ ID NO: 47545 - DNA, 156 bp, Artificial Sequence
  Description of Artificial Sequence: Synthetic coding sequence
atgcccccccggatcaccgacctgagcctgcccaactacctgatggcatccagcgtgggcctgttgcccacccagttactcaactcttatctgggcactactctgaggactatggaagatgtgattgcagagcagtccgtgagtggttatttttag

SEQ ID NO: 47546 - DNA, 723 bp, Artificial Sequence
  Description of Artificial Sequence: Synthetic coding sequence
atgagccggctgctgcccctgctgcggagccggaccgcccggagcctcagacctggtcctgccgcagccgcagccccgcgtccgccgtcctggtgctgctgcgggcgggggctgctcgccttagctccccctggcgggcttcccggcgggcctcgtcgtctcggcactcatccgaagaaggaaccaatggaggccctaaacactgctcagggggctagagacttcatctactccttgcactccaccgaaaggagctgcctgttgaaggaactgcaccgcttcgaatccattgccatcgcccaagaaaagcttgaggcgccacctcccacccctgggcaacttcgctacgtgttcattcacaatgcaatacctttcattggttttggatttctggataacgcaattatgatcgtggctggaacacatatcgagatgtctataggtatcattctaggcatcagcacgatggccgctgctgcactgggcaacttggtgagcgatttggctggcctgggcctcgccgggtatgttgaagctctggcgagcagattggggctgagcatccccgatctcacaccaaaacaggttgacatgtggcaaacccggctgagcacccatctggggaaagccgtaggagtgaccattggttgcatcttgggtatgttccctctaatattctttggaggcggagaagaggacgaaaagcttgaaactaagagctag

SEQ ID NO: 47547 - DNA, 1020 bp, Artificial Sequence
  Description of Artificial Sequence: Synthetic coding sequence
atggccgccgcctgcggccccggcgccgccggctactgcctgctgctgggacttcacctattcttacttaccgccgggcctgctctgggctggaacgaccccgaccgcatgctgctgcgggacgtgaaggctctgacactgcattatgatcggtatacaacttctaggagactggaccccattccacagctgaagtgtgtaggagggacggccggttgcgactcatatacgcccaaagttatccagtgccagaataaaggttgggatggctacgacgtccagtgggaatgtaagactgacctggatattgcctataaatttggtaagactgtagtttcctgcgaggggtacgagtctagcgaggaccaatacgtcctgaggggaagctgcggcctggagtacaatctggattacaccgagttgggcctccagaagctgaaggaatccggaaagcagcacggcttcgccagcttttctgactactattataagtggagctctgcggattcttgcaatatgtccggactcatcaccatcgtagttctcctgggcatcgcgttcgtggtgtataaacttttcttatccgacggccagtattctccccccccctactcggagtacccacccttcagtcatagataccagcgctttaccaacagcgcaggccctccaccgcctggcttcaaaagtgagttcactgggcctcagaacaccggccatggagccacttcaggatttggttctgcctttacaggacaacagggctacgagaacagtggcccaggattttggaccggtctcggcaccgggggtatcctgggttacttattcggtagtaaccgcgccgctacgcccttttccgatagctggtactatccatcatacccaccatcctatccgggaacctggaatcgggcctatagtcctctgcatggcggcagcggatcatacagtgtttgctcgaattctgacactaagacgcgaacagccagcggatacggcggtacacggcgccggtag

SEQ ID NO: 47548 - DNA, 504 bp, Artificial Sequence
  Description of Artificial Sequence: Synthetic coding sequence
atgagcggcctgatcaccatcgtggtgctgctgggcatcgccttcgtcgtgtataaactgttcttgtctgatggccagtatagcccgccaccctactcggagtaccctccgttctcccaccgctaccaacgctttaccaactccgctgggcctcccccgccaggcttcaaatcagagtttaccggacctcagaacacaggccatggtgccactagtggattcggttcagcctttaccggacagcagggatatgagaattctggacctggcttctggactgggctggggacaggcgggattctgggctacctgtttgggtctaatcgcgccgcaaccccattctctgacagctggtattaccctagctatcctcctagctaccccggtacttggaatcgtgcctatagcccattacacgggggatctggatcgtactccgtctgcagcaattcagacacaaaaacgagaactgcttcaggttacggcggcacccgcaggcgctag

SEQ ID NO: 47549 - DNA, 912 bp, Artificial Sequence
  Description of Artificial Sequence: Synthetic coding sequence
atgctgctgcgggacgtgaaggccctgaccctgcactacgaccggtataccaccagcagaagattggacccaatcccccagcttaagtgcgtgggcggaacagccgggtgtgactcctatacccccaaagtcatccagtgccagaacaagggatgggacggctatgatgtgcagtgggagtgcaagacggacctcgatattgcttataagtttgggaagacagtcgtaagttgcgaaggatacgagagctccgaagaccagtacgtcctacggggcagttgtggtctcgagtacaatctggattatacagaactcggcctgcagaagctgaaggagagcggtaaacagcatggctttgcgtccttttccgattactactataaatggtcatccgccgactcgtgtaatatgtcaggactcattacaattgttgtactgctgggcatcgcctttgtcgtttacaaactgttcctctcggacgggcagtacagtcctccgccatactctgaatatcctcctttctctcacaggtatcagagatttacaaattctgccggaccccctccccccggctttaaaagtgagttcactgggccccagaacacaggacatggcgccactagcgggttcggaagcgcctttacgggccagcagggctacgagaacagcggtcccgggttctggactggtctgggcaccgggggtatacttggatacctgttcggtagtaatcgcgcagctacgccgttctccgatagctggtattatccttcttatcctccgtcttaccctggcacctggaatagagcctactcacccctgcacgggggtagtggatcatacagcgtgtgcagtaactccgacactaaaacaagaacagcctctggctatggcggcacacgcaggagatag

SEQ ID NO: 47550 - DNA, 504 bp, Artificial Sequence
  Description of Artificial Sequence: Synthetic coding sequence
atgagcggcctgatcaccatcgtggtgctgctgggcatcgccttcgttgtgtataaattgttcctttctgacggacaatactcccccccaccttatagtgagtaccccccattctcacaccgctaccagaggtttacaaactccgctggaccaccgcctcctgggtttaagagcgagtttactggacctcaaaacactgggcacggcgcaacttcagggtttggttcggccttcactggtcagcaggggtatgaaaattctggacctggcttctggaccggacttggcaccggagggatcctggggtacctttttggatcgaacagggctgccacaccattctccgatagttggtattatccgtcctaccccccgtcttacccaggcacgtggaaccgggcctatagcccactgcacggcggaagcgggagttacagtgtgtgtagcaattccgataccaagactcgaacagccagtggttacggcggcaccagacggagatag

SEQ ID NO: 47551 - DNA, 774 bp, Artificial Sequence
  Description of Artificial Sequence: Synthetic coding sequence
atgatcgacaagaaccagacctgcggcgtgggccaggacagcgtgccctacatgatctgtctgatccatattctggaagaatggtttggcgtggagcagttggaagactatcttaactttgcaaactatctgttatgggttttcaccccccttattctgctgattctgccctattttaccatctttctgctgtacctgaccattatctttctgcacatctacaaaagaaagaatgtgctgaaggaagcttactcccataatctttgggacggggcgcgtaaaaccgtggccactttgtgggacggccatgctgccgtatggcacggttacgaggtgcatggaatggaaaaaatccctgaggacggccctgcactgataatcttctatcatggagccattccaattgatttttactattttatggctaagattttcattcacaaaggtagaacctgtagggtggttgcagaccatttcgtgttcaagatacccggtttctcattattgctggacgtattttgcgcactgcatggccctcgggaaaaatgcgtggaaatcttgcgctctggtcacttgctggcaatcagcccaggcggcgtgagagaggctctgatatcggacgagacctacaatatcgtgtggggccaccgcagagggttcgcccaggtagcaattgatgccaaagtcactaagaatgctgtacaagctttgatcgacaagcaccagcggattcccggaaacattatgagtgctctgcttgaacgcttccactag

SEQ ID NO: 47552 - DNA, 975 bp, Artificial Sequence
  Description of Artificial Sequence: Synthetic coding sequence
atgatcgacaagaaccagacctgcggcgtgggccaggacagcgtgccctatatgatttgtctcatacatatactcgaagagtggtttggagtcgagcaattggaggactatctcaattttgccaactacctgctctgggtgtttactcccctcatactgttgatcctcccatatttcacaatcttcctgctgtaccttacaatcatttttctgcacatttacaagcgaaagaacgtgctgaaggaagcatatagccataatttatgggatggcgcacgaaagactgtggctaccctgtgggatggtcatgccgcagtgtggcacggctacgaggtacacggcatggagaaaatccctgaagatggccccgcactgatcattttctatcacggcgctatacctattgacttctactacttcatggccaagatctttattcacaagggcagaacatgtcgagtggttgcagaccatttcgttttcaagatccccggcttctcattgcttctggacgtgttttgtgcactgcacggaccacgggagaagtgtgtagaaattctgcgttcaggtcatttactggccatttcccctggaggcgtgagagaagcattaatcagtgacgaaacgtacaacatcgtctggggccacaggaggggttttgcccaagtggcaatcgacgcgaaggttcctattattccaatgttcacgcagaatatccgtgaagggtttcggtctttgggcggaacccgtctgtttcggtggctgtatgagaagttccggtacccttttgcccctatgtatggtgggttcccagtgaagctgagaacctacctgggggatccaatcccttatgacccgcagatcaccgctgaagagctggcagaaaagacaaagaatgctgtgcaggccttaatcgataagcatcagaggatccctggaaacattatgtcggcgttactggaacgcttccactag

SEQ ID NO: 47553 - DNA, 381 bp, Artificial Sequence
  Description of Artificial Sequence: Synthetic coding sequence
atgatcgacaagaaccagacctgcggcgtgggccaggacagcgtgccctacatgatatgtctaattcatatcctcgaagaatggttcggtgtggaacaactggaggactacctcaacttcgccaactacctgctgtgggtgttcactccactcatcttgctgatcctgccttactttaccatctttctgctgtacttaaccatcattttcctgcatatttataagaggaagaatgttctcaaagaggcttatagtcataacttgtgggatggcgcccggaaaacagttgcaactctgtgggacggccacgccgccgtctggcacggctatgaagtacacggaatggagaagatcccagaggatggcccggccctcatttag

SEQ ID NO: 47554 - DNA, 408 bp, Artificial Sequence
  Description of Artificial Sequence: Synthetic coding sequence
atgatcgacaagaaccagacctgcggcgtgggccaggacagcgtgccttatatgatttgcctgattcacatcctggaagagtggtttggggtggaacaacttgaggattacctgaactttgccaactacctgctgtgggtcttcactcctctcattcttctcattctcccttactttaccatcttcctgctgtaccttaccatcattttcttgcatatttacaaacgaaaaaatgtcttgaaggaagcctactcccacaacctatgggatggggccaggaaaaccgtcgccaccctctgggatggacacgctgcagtctggcacggcaagcaggggtacttccatctctgcgtcgcaattcacgtatgttgcatcggaaccgtgcttcccttccattttatcgactag

SEQ ID NO: 47555 - DNA, 732 bp, Artificial Sequence
  Description of Artificial Sequence: Synthetic coding sequence
atgatcgacaagaaccagacctgcggcgtgggccaggacagcgtgccctacatgatctgtctcatccatattcttgaggaatggttcggtgtggagcagctagaagactacctgaatttcgcgaactatttgctgtgggtgttcacaccattgatcctgctcattctgccttatttcacaatctttcttctgtacctcacgatcatcttcctgcacatctacaaaaggaagaatgtgttgaaggaggcttactcacacaatttgtgggatggagctcgcaagacggtagcaaccctgtgggacgggcacgccgctgtctggcacggctacgaggtgcacggaatggagaagattcctgaagatgggcctgctctaattattttttaccacggggctattcccatcgacttttactattttatggcgaagatcttcattcacaaaggacgaacctgcagggtcgtcgccgaccatttcgtgtttaagataccaggctttagcctcctgctggatgtgttttgcgcactgcacgggccaagagagaaatgcgtggagatcctccggtcagggcaccttttggctatcagtccagggggtgtgcgggaggcactgatctccgatgagacttacaacatcgtgtggggacatcgcagagggtttgctcaggtggctatcgacgctaaagttcccattataccaatgtttactcagaacattagagaaggcttctag

SEQ ID NO: 47556 - DNA, 408 bp, Artificial Sequence
  Description of Artificial Sequence: Synthetic coding sequence
atgatcgacaagaaccagacctgcggcgtgggccaggacagcgtgccctatatgatctgcttgattcatattcttgaagagtggttcggcgtcgagcaactagaagactacttaaactttgccaactacctgctttgggtgtttactcctctaattctcctgattctgccgtacttcacaatctttcttctgtatctaacaatcatttttctccatatctacaaacggaaaaatgtcctgaaagaagcatacagtcataatttgtgggatggtgccaggaagacagtggccaccttgtgggatgggcatgccgcagtgtggcatgggaaacagggctacttccatttgtgcgtggcaatccatgtgtgctgcatcggaacagtacttccttttcattttattgactag

SEQ ID NO: 47557 - DNA, 9 bp, Artificial Sequence
  Description of Artificial Sequence: Synthetic coding sequence
atgatctag

SEQ ID NO: 47558 - DNA, 495 bp, Artificial Sequence
  Description of Artificial Sequence: Synthetic coding sequence
atgatcgacaagaaccagacctgcggcgtgggccaggacagcgtgccctatatgatctgcctgatccacattcttgaagaatggtttggggtagaacaactcgaggattatctcaactttgcaaactacctgttgtgggtgtttacccctttaatcttgctaatcctgccatacttcacgatcttcctcctgtatttaaccataatttttctgcacatttataagaggaagaacgttctgaaagaggcctattcacacaacttatgggacggagctcggaagaccgtggcgaccctctgggacgggcacgcagcagtgtggcacgggtacgaagtccatgggatggaaaagattcctgaggatggaccagcactcataattttctaccatggtgctatccccatagatttttactatttcatggctaaaattttcattcacaaggggaggacctgccgagtggtggctgatcatttcgtcttcaagatcccttag

SEQ ID NO: 47559 - DNA, 276 bp, Artificial Sequence
  Description of Artificial Sequence: Synthetic coding sequence
atgttcacccagaacatccgggagggcttccggagcctgggcggcacacggctttttcggtggctgtatgaaaagttcaggtatccatttgcccccatgtatggtggctttccggtgaagctgagaacatatctgggagacccaatcccttacgaccctcagatcacagccgaggaactggcggagaaaacaaagaatgcagtgcaggctctcattgacaaacatcagcgcattcctggtaacattatgtctgccttattggagcggtttcattag

SEQ ID NO: 47560 - DNA, 744 bp, Artificial Sequence
  Description of Artificial Sequence: Synthetic coding sequence
atgctgcggttcatccagaagttcagccaggccagcagcaagatcctgaagtactcttttcccgtgggcctccgcacctccaggacggacatcttatccctgaagatgagcttgcaacagaacttttctccatgtccaaggccctggctgtcatcctctttcccggcctatatgagtaagacacagtgctatcatacctccccttgttctttcaaaaagcaacagaagcaagctcttcttgcaagaccgagcagcaccatcacctacctgacagatagtccaaaacctgccctctgtgtgacccttgccggattaattcctttcgtagctccacctctggtcatgcttatgaccaagacatacatccctatacttgccttcacgcagatggcttacggcgcctccttcctctctttcctggggggtatccgctggggcttcgctctcccagagggttctcctgccaaacccgactatcttaacttagcgtccagtgccgccccacttttcttttcatggtttgcattccttatcagcgaacggctgagtgaggcgatcgtgaccgttatcatgggaatgggggtcgccttccacctggaattatttctgctgccccattacccaaattggtttaaggcactgcgtattgttgtgacgttgctcgccacgttctccttcatcatcacgttagtagttaagtccagctttcctgagaaaggtcacaagagacctggacaggtgtag

SEQ ID NO: 47561 - DNA, 828 bp, Artificial Sequence
  Description of Artificial Sequence: Synthetic coding sequence
atgcagctgcaggtgttctggaccggcctggagtacacctgccggttacttggaatcacgaccgccgccgttctgatcggagtgggcaccgaaacgttccttcaaggccaattcaagtcgttggccttttatcttctttttactggagcagccgtgtctatttgcgaaggggcatattttgtggcacaacttctcgccatatgttttcagtgccaaccagggtcccttgccgatcgggtgagagaaaaagcccactggctgggttgtttccagaagttcctggcatacctgctcctatctgtggcttgctttctgcatccagtcttagtgtggcatgtgacgatccctgggtctatgctaattatcaccggcctggcctacttcttactgtcgaaacggaaaaaaagaaaggcggccccagaagtgctcgctagcccggagcagtatacagacccaagttcctcagctgtgtccactactggctcaggagacaccgaacagacctatactttccacggtgctctgaaagagggcccctccagccttttcatccacatgaagtcaatcctgaaaggaaccaagaaaccaagcgccctgcagccgccgaatacactcatggaacttagcctcgaacccgccgactccctggccaagaagaagcaggtgcatttcgaagataatctggtgagaatcgtgcccagtcttgctgaaggcctcgacgatggcgactcagaacctgaggaaacgacaagcgacacaactcctatcatccctcctccccaggcccctctattcctttccagccttaccgcaactgggctattttag

SEQ ID NO: 47562 - DNA, 474 bp, Artificial Sequence
  Description of Artificial Sequence: Synthetic coding sequence
atgctgatcatcaccggcctggcctacttcctgctgagcaagcggaagaagaggaaggcagcccccgaggtgttggcctctcccgaacagtacactgacccttcaagcagcgccgtctcgactacaggctccggcgacacagaacaaacgtacacatttcatggtgctctcaaagaagggcctagcagcctttttatccacatgaagtccatacttaaggggacgaagaaaccaagtgctctccagccgcctaacaccctgatggagctgtcactggaacctgctgactcgctggctaaaaagaagcaagtgcatttcgaagacaacctcgttcgcattgtcccaagtttggcggaaggcctcgacgacggggactccgaaccagaggaaactactagtgacaccacgcccattatccccccaccacaggccccactgtttttgagcagtctgaccgctaccggcttattctag

SEQ ID NO: 47563 - DNA, 771 bp, Artificial Sequence
  Description of Artificial Sequence: Synthetic coding sequence
atgccccccgcccagggctacgagttcgccgccgccaagggccccagggacgagctcggccctagtttcccgatggcaagccccccagggctagaactgaaaacactctcaaacggcccccaggcgcctagaagatcagcacccctgggtcctgtggctcccacacgcgaaggagtagagaatgcatgtttttcatccgaggagcatgagacacactttcagaatcctgggaatacaaggttagggagcagcccatctccacccggcggcgtctcttccctgccacggtcccagagggatgatctttcgcttcattccgaggaaggccctgctcttgagcctgtatctcgtccggtcgactatggcttcgtaagcgcactcgtgttcttggttagcggcatactgctcgttgtgacggcctacgctatccctcgagaggctagagtgaaccccgataccgttactgcacgggaaatggaacggcttgagatgtattatgcccgcctaggttctcacctagataggtgtatcattgctggcttaggcttgctgacggtggggggtatgctgctcagcgttttgctgatggtgtccctctgcaaaggtgagttgtaccgaagacgtaccttcgtgcctggcaagggaagtcggaaaacctatggctccatcaacttgaggatgagacaacttaacggggatgggggtcaagcacttgtagagaacgaagtcgtgcaggtgtctgagaccagccataccttgcagagaagctag

SEQ ID NO: 47564 - DNA, 465 bp, Artificial Sequence
  Description of Artificial Sequence: Synthetic coding sequence
atgccccccgcccagggctacgagttcgccgccgccaagggccccagggatgagcttggacctagttttcctatggctagtccccccggtctcgagctgaagaccctctcaaacggaccccaagcccccagaagatctgcgcctctcggccctgtagcccctactcgggaaggagttgaaaacgcctgtttctcgtctgaagagcacgaaacacatttccagaaccccggtaatactaggctcggatcctcccccagcccacccggcggggtctcctccctcccccgatcccaaagggatgacctgtcactccactctgaggaagggccagctctagaacccgtttctaggcctgtggactatggatttgttagcgcactagttttcttagtgagtggcatcttactggtagtgactgcatatgccattccccgggaggcaagggtgaaccccgacactgtttag

SEQ ID NO: 47565 - DNA, 417 bp, Artificial Sequence
  Description of Artificial Sequence: Synthetic coding sequence
atgcggcccaccgccgacagcttccggctgaagaagggcaacgtgtttcctaactttgatccatgcgcgcaagccctccagaagagctgtcacttcgctctcagcttcctcatcgggaagatgggcatcatcattttgagtgtttgtctgatctgcacaaggttgcttcaggagggcatcgcacagtccaagtgcctcatcaacgtttcttttagtctctacagttgttttatcgtgttcgtgaccatcagccaagatagcgagaccctgtctctcgactgtgaccatcggctgttcttttcgctgcctttcacagatccagcatcggggggccagtctcagcattcttggccctgccctgagagaagtaaaaacctcccccaggtatccaagcagctgaggaatagagctggatag

SEQ ID NO: 47566 - DNA, 411 bp, Artificial Sequence
  Description of Artificial Sequence: Synthetic coding sequence
atgtggctggacacccggaacctgggcatcgtgatcagctgctggaagggggtctgcgtcccccaaacaacaacactcgaaatgttttataacgataatgatagggttgaggagagtagcaactcttatcagatcagaagagaattcctcctccccgcttgccttccggccttccttagcttcagtactagtttttctttcttcctctcatttttgccactgtctttgtcactgttcttgccattttttccgtctttttttctgagtctgtctctgtcacccagcttcctgcctagctttttacggcaggggctcgcgttgtctccccgactggaatgcgatggggcaattatgatacactgtagtctgaacattcccggctcatctgatcccccaacgtccgccagctag

SEQ ID NO: 47567 - DNA, 1185 bp, Artificial Sequence
  Description of Artificial Sequence: Synthetic coding sequence
atgaccgagcaggagaccctggccctgctggaggtgaagcggagcgacagtcctgagaagtcttctccacaggcactggttcccaacggacgacagccagagggggaaggaggcgctgagtcccccggggccgagagccttagggtgggatcctcagccggatcacccacagctatagagggggccgaagatggtctagattctaccgtgtcggaggccgccactcttccttggggcacaggacctcagccttccgctccctttccagatcccccaggctggcgggatatcgagcccgaaccaccggaatcagaacccctgactaagctggaggagttgccagaggatgatgccaatttacttcctgagaaggcggccagggcatttgttcccattgacctccaatgtatcgagcgacagccccaagaagatttgatcgtgcggtgtgaagctggggaaggcgagtgcagaaccttcatgccaccacgagtcacgcacccagatcctacagagagaaaatgggccgaagcagtggtccgccccccaggttgcagttgtggtggctgtggatcttgcggggatcgcgaatggctgcgcgccgttgccagtgtcggcgctgcacttatactctttccatgcctgctttacggcgcgtatgccttcttgccgttcgacgttcctcgcctgcctacaatgtcctcgaggctgatatatactctccggtgcggcgtttttgccacttttccgatcgtcttggggatcctggtgtacggactaagtctactgtgtttcagcgctctacgtccctttggagagcccaggagagaggttgagatacatcggcgatacgtggcccaaagcgtacagctttttatactctactttttcaatctcgccgttctttctacatacctgcctcaagataccctgaagctgctacctctgttaaccggactctttgccgtgagccgattgatctactggctgaccttcgcggtcggccgctcgttcagagggttcgggtatggtctgacttttctgcctctgctgagtatgcttatgtggaatctgtactacatgtttgttgttgagcctgaacgcatgctgacagccacggagagcaggctggattatcccgaccatgcaaggtccgctagcgactataggcctaggccctggggctag

SEQ ID NO: 47568 - DNA, 528 bp, Artificial Sequence
  Description of Artificial Sequence: Synthetic coding sequence
atgaccgagcaggagaccctggccctgctggaggtgaagcgggaccccggtgtaagagctgagccggtgatgctgttctgccccagcgcactgtggggagcaacagctggtggaggggatccccccgcaatttgcggacctgtgggacccgccctgtacagcctgttgctgcagccaggccgagcgtttcacctgcccgctcctgggtacccccagacagcccctagtgcgcattggtccctgtgcaggctccctgccgacctgctcgccgacctgtgcaggggtccactgctacctcgcttgagactgcgtcccgatgtgtccgctacagccgtggacgctgacgtagagcccttactgcatgtgagaggtggagctggggctcatgctcactgccaccgggagcctcccggccttccgggtcctcgcccactgggcttacggctacaggccccgcctcttggcttgtctttgtccgctctcgccctgggcgtgggcgggagtgggctcgggctcacccacctttag

SEQ ID NO: 47569 - DNA, 1185 bp, Artificial Sequence
  Description of Artificial Sequence: Synthetic coding sequence
atgaccgagcaggagaccctggccctgctggaggtgaagcggagcgatagtcctgaaaagagctcaccccaagcgctggtgcccaacggacgccaacctgaaggtgagggcggcgcagaatcccctggagctgagagtctccgggtgggcagctctgccgggagcccaacagctatagagggcgccgaagacggcttggattccactgtcagtgaagccgccactctgccatggggtaccggccctcaaccctccgcaccattccccgatcccccaggttggcgggatatcgaacctgaaccccccgaaagcgagccactcacgaagttagaggaacttcccgaggatgatgctaacctgctgccagagaaagccgctcgcgccttcgtgcccattgatctgcagtgtattgaacgacagcctcaggaggacctcattgtgaggtgtgaggctggtgaaggggaatgtaggacatttatgcctcctcgggtcacccacccagaccccacggagcggaagtgggcagaagcagtggtgcgccctcctggctgttcatgtggtgggtgtggctcctgcggtgatcgtgagtggctgcgcgcggttgcatcggtgggagcagcactgatcttgtttccatgcttgctctacggcgcttatgcctttttacccttcgacgtgcctcgcctgccaactatgtcctccagattgatttacacgctgcgatgcggggtgtttgctaccttccccatcgtgctaggcattctggtgtacgggctgtccctcctctgttttagcgcactgagacccttcggcgagcctcggcgagaagtggaaatacaccggcggtacgtcgcccagtccgtgcagctgttcatcctatatttcttcaatcttgctgtgctgtctacatacctgcctcaagataccctgaaattgttgccactgcttactggactgtttgccgtgtcgcgactgatctattggttgacatttgccgtggggaggagcttcagagggttcggttacggtctgacctttctacctctgctgtctatgctcatgtggaatctgtattatatgtttgtagtcgaacctgaaagaatgctgaccgctacagagtcccgtctggattatccggaccatgccaggtcggcttcggactacagaccccgcccatggggatag

SEQ ID NO: 47570 - DNA, 399 bp, Artificial Sequence
  Description of Artificial Sequence: Synthetic coding sequence
atgaccgagcaggagaccctggccctgctggaggtgaagcgggacccaggggtccgagcagagcccgtgatgcttttctgcccgtccgccttatggggcgccactgccggaggcggagacccaccagccatttgtggtccagtgggtccggccttgtactcgcttcttctgcaacccggcagagcctttcacttacccgcccctgggtacccccagacagcacctagtgcccactggagcctctgtaggttgccggctgacttgcttgccgatctgtgtaggggtccccttctgccgagactgcggcttcgacccgatgtgtctgctacagcagtagacgcggacgtggagccattacttcacgtccgggggggcgcaggcgctcacgcacactgttag

SEQ ID NO: 47571 - DNA, 507 bp, Artificial Sequence
  Description of Artificial Sequence: Synthetic coding sequence
atggccgagggcgcccgggcccggggcccccggggctgccgggaccgagatggcccagcaggtggcgcgggcaaaatggctgcacctcgccggggacgcgggtcatctacggtgctgtcctcagttccactccagatgctcttttatctgtcgggcacctactatgcactgtactttctggccactctgctgatgatcacttacaaaagccaggtgtttagctatccccaccgttacttggtgctggatctggctttgttgtttttgatggggatcctggaggctgttcgtctttatctcggaacgagggggaacttgacagaggctgaacggcctttggctgctagcctcgcgctcacagctgggacggcgcttctttccgcccacttccttctgtggcaggccctggtgctttgggccgattgggccttatcagcaaccctgttagcgttgcacggccttgaggcagtccttcaggtggtggctatcgccgctttcacccggtag

SEQ ID NO: 47572 - DNA, 483 bp, Artificial Sequence
  Description of Artificial Sequence: Synthetic coding sequence
atggccgagggcgcccgggcccggggcccccggggctgccgggaccgtgacgggccggccggcggggctggacgtggcagttctactgttctaagttcagttcccttacagatgctgttttacctctccggtacgtactacgcactatactttctggccacgttactaatgattacttacaaatctcaggtgttcagctatccacacaggtaccttgtgctggacctcgctttgctgttccttatgggcatcttggaagccgtccggctctatttgggcaccagaggcaacttgacagaggccgagaggcccttggcagctagcctcgccctcactgcaggtaccgctctcctgagcgctcattttctcctgtggcaggccctggtcctgtgggccgactgggcactgagcgcaactctgctcgcgctacacgggctagaggcagtgctccaggtcgtagccatagcggccttcaccaggtag

SEQ ID NO: 47573 - DNA, 768 bp, Artificial Sequence
  Description of Artificial Sequence: Synthetic coding sequence
atgaaggtgctggccaccagcttcgtgctgggcagcctgggcctggccttctatctccctctggttgtgactacccccaagacgttggctatacctgagaaacttcaggaggcggtgggcaaggtgattatcaacgccacaacctgcaccgtcacctgcggcctgggctacaaagaggagacagtgtgcgaagttgggccagacggtgtgcgccgaaaatgccaaactcgacgacttgagtgcttgacgaactggatctgcggaatgctgcatttcacgatcctcattggtaaagagttcgagctctcctgtttgtctagcgatattctcgaatttgggcaagaagccttcagattcacttggcggttagcaaggggagtgatttccaccgatgacgaagtttttaagccttttcaggccaattcgcattttgtgaagttcaagtacgctcaggagtatgattctggaacctacaggtgtgatgtgcagttggtgaagaaccttcgcctagtaaaaaggttgtacttcggtctgcgcgttctgcctccaaatttagtgaacctcaattttcaccaatctttgactgaggatcagaaactcatcgacgaaggcttggaggtgaacctggattcttattcgaagcctcaccatcccaaatggaagaaaaaagttgcaagcgcccttgggatcggcatcgctatcggcgtcgttggcggagttctggtgcgcattgtcttgtgtgctttaagagggggtctgcagcagtag

SEQ ID NO: 47574 - DNA, 1032 bp, Artificial Sequence
  Description of Artificial Sequence: Synthetic coding sequence
atgttcagcctgcccagcctgcccagctggctgcccggcctgcccagcctcgagtggggcagctcgctattagacagtctgctacaggggctcattggtgccctcggggtgctggtgctgaactccctgttgaaggtctacttttttgtgggctgcgctaatgaccctcagagacgccctgagaaagaaagactgcgagcccagtgggcttcgctggagacggtccatctggcaggtctggcgctgttcctcacagtcgtggggtccagggtcgcagcattggtagtgctggagttctcactgcgcgccgtgagtaccctgttatctctgggcaaagggtcccagggcgctgccgaacggctgcagttatatctcctttgccaatacagcctcggctgcggactcacgtgtgggctctcctttctccaggagggggcccctcaccgtacattgaaccttctgctgtcattgggtctggccacactcctcgggctgggggctagaagactgcatcggcatgtgtgcaggctgtacgaacttcactccagccagcgctattgtggtgtgtgcctgggtctgttggcacatgctcacgggctaccacagctcctggggagggctcttgcaatcgcatttgccgtgggcgatctggcggctgtggcattgatcaatcaggattttttgacaactagtgaagcgatgagattttggacccctcttacaatttgctatactttactggtgatctatatgcaggaggagcaacgacagcatccaggactgcagtctcaggttcagactgtcctcgtgaggatgggcggtctgtttgtactcctgctgaccgtgggacgctggctggaccttctgggcattctggtgagcctgctgggagagctctggtgccttgtgggtgtacggactctgttagatctctgccagatccaggactttccctcacagagaccacctgtgtcaactccatcacagcccctgcccagcgcaccgcagagccaatccagtgctccttcctag

SEQ ID NO: 47575 - DNA, 450 bp, Artificial Sequence
  Description of Artificial Sequence: Synthetic coding sequence
atgaccgcccagggcggcctggtggccaaccggggccggcggttcaaatgggccatcgagctaagtggccccgggggagggtcacggggccgtagtgacaggggaagcgggcagggcgacagcctgtaccccgtcggatatctggataagcaggtgcctgacacttccgtgcaggagaccgatagaatcctggttgagaaaaggtgctgggatatcgctttaggaccgctgaaacaaatcccgatgaatctctttattatgtacatggccgggaacacgatctcgatatttcctacgatgatggtctgcatgatggcttggagaccgatccaggccctcatggccatcagtgccaaaaatggagtgcagtggtggaggaccgccttcgttaatatgaggaagcaaagactggttccaatgtatctggggctgatctacatcctcctgtag

SEQ ID NO: 47576 - DNA, 552 bp, Artificial Sequence
  Description of Artificial Sequence: Synthetic coding sequence
atgaccgcccagggcggcctggtggccaaccggggccggcggttcaaatgggccatagagttgagtgggcccggaggcggctctcgcggcagatcagatcgaggctcaggccagggcgacagcctgtatccggttggatatctagataagcaggtgcctgataccagtgtccaggagaccgatagaattctggtagagaaacgctgctgggatatagctctcggcccactgaagcagattccaatgaatctgttcatcatgtacatggccggaaataccattagtatctttcctacaatgatggtgtgtatgatggcttggcgccccatccaggccctgatggctatttcggccaccttcaagatgctggagagttcctcacaaaaattcttgcagggcctggtatatcttatcggaaacctcatgggcctggccctggcagtctataagtgtcagtcaatgggcctccttccgacacatgctagtgactggctggcttttattgaaccccctgagagaatggagttcagcggaggcggactcctgctctag

SEQ ID NO: 47577 - DNA, 723 bp, Artificial Sequence
  Description of Artificial Sequence: Synthetic coding sequence
atggtgagccccgtgaccgtggtgaagagcgagggccccaagctggtgccattctttaaggctacgtgtgtgtacttcgtgctctggctcccatcctccagccctagctgggttagcaccctgataaaatgcctgcccattttttgcttatggttgttcctcctggcacacggcctgggcttcctcctagcacacccctctgccactcgaattttcgtcggactggttttctccgccgtcggcgacgctttcctgatatggcaagatcaaggatatttcgtgcatgggctgctcatgtttgccgtcacacacatgttctacgcctctgcatttggaatgcagcccctcgcactgcgcactggcttagtgatggctgccttgtcaggactgtgttatgctctgctgtatccatgcctgtctggcgcgtttacctaccttgtcggggtgtacgtagcactcatcggtttcatgggatggcgtgcgatggcaggcctgcggttggcaggagccgactggcgttggaccgagctggcagctgggagtggggccctctttttcattatttccgatctgacaatagctttaaacaagttctgcttcccagtcccctactcaagagctctcatcatgagcacgtattacgtagcccagatgctggttgctctctcagcggtcgagagcagggagcctgtggaacattaccggttgacgaaggcaaattag

SEQ ID NO: 47578 - DNA, 723 bp, Artificial Sequence
  Description of Artificial Sequence: Synthetic coding sequence
atggtgagccccgtgaccgtggtgaagagcgagggccccaagctggtgcccttctttaaagccacgtgcgtgtacttcgtgctgtggttaccaagctcaagtcctagttgggtcagcacactgataaaatgcttacccattttttgcctgtggctgtttttactcgcgcatggactggggttcttgctggctcacccctctgccacgaggatctttgtgggactcgtcttctcagctgtaggtgatgcgttcctgatctggcaggaccaaggctacttcgtacacggtctgctgatgttcgcggtaacacatatgttctacgcttccgccttcgggatgcagcccctggccctaagaaccggtctagtaatggcagctttgtccgggctgtgttatgcccttctgtatccatgccttagcggcgcttttacgtacctggttggcgtctacgttgcattaatcgggtttatgggctggagagcgatggctggactgcgcctggccggcgctgactggagatggaccgagttggctgccggcagcggggctttgtttttcatcataagtgacttgaccatcgccctgaacaaattttgctttccagtcccgtactcccgcgctctgattatgagtacatactatgttgcacaaatgctggtcgctcttagtgctgtggagagccgtgaaccagtcgaacactaccgactgaccaaggctaactag

SEQ ID NO: 47579 - DNA, 681 bp, Artificial Sequence
  Description of Artificial Sequence: Synthetic coding sequence
atggacgccggcaaggccggccagaccctgaagacccactgcagcgctcagcgccccgacgtttgccggtggctcagccctttcattctcagttgctgcgtgtatttctgcttatggattcccgaggaccagctgtcttggttcgcagccctcgtgaaatgcttacccgttctatgccttgctgggttcctgtgggtgatgtccccgtccggcggatacactcagctactgcagggagctcttgtgtgctccgctgtgggcgacgcctgtctgatttggccggcagcttttgttcccggcatggccgctttcgccacagctcatctcttatacgtatgggcctttggctttagccccctgcagcccggccttctactcttgattatacttgctcctggaccctacctcagcctggtgctgcagcatctcgagccagatatggtgcttcccgtggctgcctacgggctgatcctcatggccatgctgtggaggggcctcgcccaggggggatctgcaggctggggggcccttttatttacactctctgacggcgtgcttgcatgggacacattcgcccagcccttgccccatgcgcaccttgtcattatgacaacatactacgctgctcagctgctgatcactctgtctgctctgcgttctcctgtgcctaagacagattag

SEQ ID NO: 47580 - DNA, 546 bp, Artificial Sequence
  Description of Artificial Sequence: Synthetic coding sequence
atggccgccgccgcctggctgcaggtgctgcccgtgatcctgctgctgctgggcgctcatccttcaccgctgtcgtttttttccgcaggccccgccacagtggcggctgcagacaggtcaaagtggcacattcccattcccagcgggaagaactatttcagctttggtaagatccttttcagaaacaccactatcttcctgaaatttgacggcgaaccctgcgacctttccctgaatattacttggtatctcaagtctgctgactgttacaatgagatttataactttaaggcagaagaggtggaattatacctcgaaaaacttaaagaaaagagaggactgtcaggcaagtaccagaccagttccaaactgttccagaattgcagcgagctcttcaaaactcagacattctcaggtgatttcatgcacagactgcccctcctgggagaaaagcaggaggcgaaggaaaacggaacgaacctcacattcattggagataagactatccaaatgccattcttgaaaaagcactttctggattgctag

SEQ ID NO: 47581 - DNA, 1668 bp, Artificial Sequence
  Description of Artificial Sequence: Synthetic coding sequence
atggccgccgccgcctggctgcaggtgctgcccgtgatcctgctgttacttggcgcccatccaagtcctctgtcattctttagtgctgggcccgccacagtggccgctgcagataggtccaagtggcacataccgattcccagcggtaaaaactacttctccttcggaaagatactatttaggaacaccaccatttttttgaaatttgacggagagccatgcgaccttagcctaaatatcacatggtacctgaaaagcgccgactgttataacgagatctacaatttcaaggccgaggaggtcgaactctatctcgagaagctcaaagagaaaagagggctgagcgggaaatatcaaacatcctcgaagctttttcaaaactgcagcgaactgtttaaaacccaaacttttagtggagactttatgcatcgcctcccacttttgggagaaaagcaggaagcgaaggagaatggaaccaatctgacctttatcggcgacaaaaccgccatgcacgagccacttcagacttggcaagacgcaccatacatttttattgtgcatatagggatttcgtcatccaaggaaagcagtaaggagaactccctttcaaacctcttcacaatgaccgtcgaggtgaaaggaccctacgagtatctgacacttgaggactaccccctaatgatcttctttatggtgatgtgcatcgtctacgtgctgttcggtgtgctgtggttagcgtggagcgcatgctactggagagatttgctgcggattcagttctggataggcgccgtcatcttcctgggcatgcttgaaaaggccgtgttctacgccgaatttcagaatatccgctacaagggggagtcggttcaaggagctcttattttagccgagcttttgtccgctgttaagcgctccctggctcgaacactcgtgatcattgtgtccctgggctacggaatagttaaaccaaggctcggagtgactttgcacaaagtcgtcgtagctggagcactgtacttgctgttttcaggcatggagggtgtcctccgggttacaggagcacaaaccgatctggcctctctcgcttttattccattggcctttttggacacagctttgtgctggtggatcttcatctcactcactcagactatgaaactgctaaagttgaggcgtaatatagtgaaactgtccttgtatcgccatttcacaaacacattgattctggctgtggccgcaagcatagtttttattatatggacgactatgaaatttagaattgtaacctgtcagtctgactggagggagctgtgggtcgatgacgcgatttggagactcctcttttccatgatcctattcgtaataatggtactgtggagacccagtgctaataaccagcgcttcgcattttctccattgagtgaagaagaagaggaggacgaacagaaagagccaatgctgaaagagtccttcgagggcatgaagatgagatcaacaaaacaagaacctaatggcaattcaaaggtgaacaaagcccaggaggacgatctgaaatgggtggaggagaatgttccgtcaagtgtcacggacgtggcactgccggcgctcctcgactcagacgaagagagaatgattacacattttgaaaggtctaagatggagtag

SEQ ID NO: 47582 - DNA, 1485 bp, Artificial Sequence
  Description of Artificial Sequence: Synthetic coding sequence
atggcccacagcgacaccgtggtggacggcgagccctgcgacctgtccctgaatattacatggtaccttaaaagtgccgattgctacaatgagatttacaattttaaagctgaggaggtagaactgtatctggaaaagctgaaagagaagagggggctttctggcaaatatcagacaagctctaagctgtttcagaattgcagtgagctattcaaaacgcaaaccttttcaggagactttatgcatcgtctcccactcctcggcgagaagcaggaagcaaaggagaacgggacgaatctaacttttattggcgacaaaacagcaatgcatgaacctttacaaacatggcaggatgccccttacatctttatcgtgcatataggcatcagtagctccaaagaatcttcgaaagagaatagcctgagcaatcttttcactatgaccgttgaagtgaaaggaccctatgaatatctgactcttgaggactaccccttgatgattttctttatggtgatgtgcatcgtttatgtgctcttcggtgtgctttggcttgcctggagcgcgtgctattggagagatctcctccgaatccagttctggattggtgccgtgattttcctgggcatgcttgaaaaagctgtattctacgctgaattccaaaacataaggtataaaggagagagtgtgcaaggggcactgatacttgccgaactgctgtctgctgtaaagcgttctctcgcccgcactctggtcattattgttagcctgggatacggtatagtgaaaccacggttgggcgtgacgctacacaaggtcgtcgtagcgggagcactgtaccttttgttctcaggaatggaaggcgtgctccgagtgaccggggctcagactgacctcgcctcactggcttttatcccactggcattcctggatacagcactgtgctggtggatatttattagcttgactcaaaccatgaagctgcttaaattgcggcgtaacatcgtgaagctttccctatatcggcattttactaatacgctcattctggccgttgcagcttctattgtctttattatctggaccaccatgaagtttcggatcgtgacctgtcagtctgactggagagagctctgggtggacgatgccatttggaggctgctttttagcatgatccttttcgtcattatggtcctttggagaccctctgccaataatcagaggttcgcctttagtcctctcagcgaagaggaggaagaggacgagcagaaggagcctatgctcaaagagagtttcgaaggtatgaagatgcggtctactaaacaagagcctaatggcaattctaaagtgaacaaggcccaggaggatgacctgaaatgggtcgaggagaacgttccaagcagcgtcaccgatgttgccctgcccgccctgctcgactctgacgaggagcggatgatcacccatttcgagcgttctaagatggaatag

SEQ ID NO: 47583 - DNA, 1596 bp, Artificial Sequence
  Description of Artificial Sequence: Synthetic coding sequence
atgtacaagcggcgggtggtgtacctgagcgacgtgagccagaacccagtgtcacctggctggattcgcaaaggcaagaactacttcagtttcggcaagatcctttttcgcaacaccactatcttcctgaagtttgacggcgaaccctgtgacctgagtcttaacatcacctggtatctgaagagcgccgactgctataatgaaatttataatttcaaggccgaagaggtagaactttacctagagaaacttaaagaaaagaggggcctttccggaaaatatcagaccagctctaaactattccagaattgctcagagctgtttaagacacagaccttcagcggagatttcatgcaccgccttcctctcctgggagagaagcaggaagctaaggagaacgggactaacctgacattcattggggacaagaccgctatgcatgagccgctgcagacgtggcaagatgcaccgtatattttcattgtgcacataggaatatccagcagcaaagagagttccaaggagaactctctgagtaatctttttactatgactgtggaggtgaagggaccctatgagtatctgactttggaggattatccattaatgatcttttttatggtgatgtgtattgtctacgtcctgttcggggttctgtggctggcatggagcgcgtgttactggcgggatcttctgcgaatccaattctggatcggcgccgtgatattcctcggtatgttagagaaagctgtattctatgcagagtttcaaaacattcgttacaagggcgagtccgttcaaggggccctgatactagcagagctgctgtccgcagtcaaacgctccctggcgaggacattggtgatcatcgtctccctgggctatggcatcgtaaagccccgcctcggcgtcaccctgcacaaggtggtggtggccggggctttatacctgctgtttagtgggatggagggagtgctacgcgtgacaggggcacagacggacctggcatctttggcatttattcccctagcgtttttggacacagccttgtgctggtggatcttcatttccttgacccagacaatgaaacttctgaagctgcgccggaacatcgtgaagctttcgctttatagacactttactaataccctaatcctggcagtcgccgcctccatcgtgtttatcatctggaccactatgaaatttaggatcgttacctgtcagagcgattggagggaactgtgggttgacgatgcgatctggcggctcctattttccatgatcctcttcgtgatcatggtgctgtggcggccctccgctaataaccagcgttttgccttttcccctctgtctgaggaagaggaggaggatgaacagaaggagcccatgctcaaagagtcttttgaaggcatgaagatgcgttctacaaaacaggagcccaacggcaactccaaggtgaacaaggcccaagaggacgatctgaagtgggtggaagagaatgtgccctctagtgtaacagatgtggcccttccagcactgctcgacagtgatgaggagcggatgataacccacttcgagagaagcaaaatggagtag

SEQ ID NO: 47584 - DNA, 1668 bp, Artificial Sequence
  Description of Artificial Sequence: Synthetic coding sequence
atggtggccgcctgccggagcgtggccggcctgctgccccggcggagaaggtgttttcctgcgagggcccctctcctgagggtggccctgtgccttctatgttggacgccagcagccgtgcgcgccgtaccagaactcggcctgtggttggagacagttaatgataagtcaggacctctgattttcagaaaaaccatgtttaactcgacagacataaagctgtctgttaaatcttttcattgttccggaccagtgaagttcacgatagtatggcatctcaaataccacacttgtcacaacgaacactcaaacctagaagaactcttccaaaagcacaaactctcagtagacgaagatttctgtcattatttgaaaaatgacaactgctggaccacaaagaacgagaacctggactgtaatagcgacagtcaggtttttccatctctgaacaacaaggaactgatcaacatacgcaacgtgagcaatcaggaacggagcatggatgtcgtggctagaacacagaaagatggtttccatatattcatcgtttccatcaagaccgagaataccgacgcatcttggaatttaaatgttagcctgagtatgatcggcccgcacggttacatatctgcctctgactggccattaatgattttttacatggtcatgtgcattgtttatatcctgtatggaattttgtggttgacttggagcgcgtgttactggaaagacatcctaaggatccagttttggatcgctgcagttatcttcctcggaatgctggaaaaggcggtgttttactcagaataccagaatatcagtaatacaggcctgtcaacccagggactgctcatctttgcagaattaattagtgccattaagcgcaccttggccagattgctagtaattattgttagtcttggatacggcattgttaaaccacgactcggcacagtgatgcacagagttattggattgggactcctctatctcatctttgccgccgtggagggcgtgatgagagtcatcgggggaagcaaccacctcgctgtggtgctggatgatataatcctcgccgttatcgattcaatctttgtctggtttatatttattagcctagcccagacgatgaaaacactacgtctgcgtaaaaatacggtgaaatttagcctctaccggcactttaaaaacacacttattttcgctgtgctggctagcatcgtctttatggggtggaccactaagacattccggatcgccaagtgccagtcggattggatggagcgatgggttgatgatgcattctggtccttccttttctccctgatcctcattgtgattatgtttctgtggcggccatccgcaaacaaccagagatacgcattcatgccgctgattgacgactctgacgatgaaatcgaagaattcatggtaactagcgaaaatctgacagaaggaatcaagttgagggcgtccaagtctgtgtctaatggtacggccaaacccgcaacatccgagaatttcgacgaggatcttaaatgggtggaggaaaatatacccagcagcttcacagatgtggcacttcccgtgcttgtagacagtgatgaggagattatgaccaggtcggagatggctgagaaaatgttttcttcagagaagattatgtag

SEQ ID NO: 47585 - DNA, 480 bp, Artificial Sequence
  Description of Artificial Sequence: Synthetic coding sequence
atggccgacgtgcccggcgcccagcgggccgtgcccggcgacggccctgagccgcgcgatccgctagactgttgggcctgtgccgtgctggttactgcccagaacttgctggtggccgcctttaacctcttattgctggtcctggtcctaggaactatcctgcttcccgcagtgaccatgctcggatttgggtttctgtgccacagtcaattcttacgttctcaggctcccccttgcacagcgcacctccgagaccctgggttcacagccctcctggtaacaggatttttactgctcgtaccactgttggtgttggctctcgccagttatcgccgactgtgtctgaggttaaggctggcagattgtctggtaccttattcccgcgccctgtaccgaaggcgaagggctccgcaacctagacagattcgggcgagccctggcagtcaggctgttcccacaagcggcaaggtgtgggtgtag

SEQ ID NO: 47586 - DNA, 480 bp, Artificial Sequence
  Description of Artificial Sequence: Synthetic coding sequence
atgctgcacgtgctggccagcctgcccctgctgctgctgctggtgacatccgcgtctacgcacgcctggagccgtcccctgtggtaccaagttggcttagatctgcaaccatggggatgtcagcccaagtctgtggaaggttgtaggggcggactgagctgtcccggctactggcttgggcccggagctagtcgcatctaccccgttgcagctgtcatgataaccaccacaatgctgatgatctgccgcaaaattttacaggggaggagaaggtctcaggccactaagggagagcacccccaagtgaccaccgagccatgcgggccttggaagagaagagctcccatctcagatcataccttactaagaggggttctgcacatgttggacgctttactagtgcacatcgagggccacttgcgccaccttgcgactcaacggcaaatacagataaagggcacctcaacccagtcaggctag

SEQ ID NO: 47587 - DNA, 780 bp, Artificial Sequence
  Description of Artificial Sequence: Synthetic coding sequence
atgtgccccgagaacgccgaggactgcgagcaggccgtggtgcacgtggagacaactctgtacctggttccctgtctgaacgactgcggaccatacggtcagtgccttttgctgagaaggcattcctacctatatgcaagctgtagctgtaaagccggctggaggggctggtcgtgtacagacaattctacggcgcagaccgtcgcacaacagagagccgccaccctgttactgacgctgtccaatctcatgtttctggccccaatcgccgtctccgtgagacgctttttcttggtcgaggcatctgtgtacgcttataccatgtttttctccaccttttatcacgcatgtgaccagcccggagaggcggtcctgtgtatactcagctacgataccctgcaatattgtgatttcctcgggagcggtgcggccatttgggtcactattctttgcatggcccggctaaagacagttcttaaatacgcgtatcgctgcggccaccgccggcaatgttaccctacctcctggcagcggtgggcattctatttgctccctggcgtgagcatggcatctgtcgggattgcgatctacacttcgatgatgacatctgacaattactactatacccactccatctggcatatccttctggctggctcggccgccctgctcctgcctccacccgatcagccagcggagccttgggcctgttcacaaaagtttccgtgtcactaccagatctgtaaaaatgaccgcgaggagctgtatgccgtcacatag

SEQ ID NO: 47588 - DNA, 2316 bp, Artificial Sequence
  Description of Artificial Sequence: Synthetic coding sequence
atgggccgggccggcaccggcaccggcggcgaggccgtggccgccgtcgtggctggacccctcctgctgctattgcttgcaagaccccccccggccagtgctggttactcggggaaatccgaggtaggactcgtgagcgagcactttagccaggccccccaacgcctatcattctatagttggtatggcagcgccaggttgttccgattcagggtgcctccagacgccgtcctactgcgctggctacttcaggtgtcccgggagagtggagccgcttgcactgatgcagagatcactgtgcattttaggtctggagccccgcccgtgatcaatcctctggggacgagtttcccggacgacacagctgttcagccatcgttccaagtcggggttccactttccaccactccccgcagtaacgccagcgtaaacgtctctcaccctgctccgggggactggttcgtcgctgcccacctgcctccaagctctcaaaagatagaactcaaggggttggctcccacgtgcgcttacgttttccagcccgagttactggtgacccgtgtagtggaaatcagtatcatggagcccgacgtcccactgccccaaaccctgttaagccacccctcctatcttaaagtgttcgttcccgattatacccgcgagctcttattagaactgagagactgcgtgtccaacgggtcactcgggtgtccagtgcggcttactgtgggccctgtgaccctgcccagtaacttccagaaggttctcacctgcacgggagcaccctggccctgccggctgctgctgcccagtccgccttgggacagatggctacaggtcactgccgagtcgctggtgggacctctcggcacagtggcattctcagctgttgctgctctgaccgcatgtagaccacgcagcgttacgattcagcctttactccagtctagtcagaatcagtcgttcaatgcgtccagtggtctcctgagcccctctccagatcaccaggacctgggacgaagcgggagagtggaccgcagccccttttgtctcaccaactatccagtcacacgcgaggatatggatgttgttagcgtgcactttcaacctctggatagggtgtcagttcgtgtctgtagtgacacaccatcggtgatgcgtctgagactaaacacagggatggactccggtgggtcactgacaatctctcttcgggcaaataagactgagatgagaaacgagaccgtagtggtggcctgtgttaacgctgccagtcctttcctaggattcaatacaagtttgaattgcactaccgctttcttccaaggctatccgctgagtttgtcggcctggagccgacgcgcaaacctcattataccttaccctgagactgataactggtacctcagtctccaactcatgtgtccggaaaatgccgaagactgtgaacaggctgtcgtgcacgtagagacaacactataccttgtcccatgtctgaatgactgtgggccatatgggcaatgtctactactaagaaggcatagttatctgtacgcatcatgtagctgtaaagcagggtggcgggggtggagctgtactgataacagcaccgcccaaacagtcgcgcaacaacgggcagcaaccctcctccttaccctgtcaaacctaatgttccttgcccccattgccgtgagcgttagaagattctttctcgtggaggcatccgtgtacgcctacacaatgttttttagcactttttaccacgcgtgcgaccaacccggcgaggccgttctctgcatattgagctacgacacattgcaatactgcgactttctgggaagcggggctgccatttgggtcaccattctgtgtatggcgaggctcaagactgttctaaagtatgtgctctttctgctggggacactggtcatagccatgtccctgcagcttgaccgaaggggcatgtggaacatgctgggtccgtgcctgttcgctttcgtcattatggccagcatgtgggcctacaggtgcggccacaggcgacagtgttaccccacctcttggcagaggtgggcattctacctcctgcccggcgtctcaatggcctctgttggtattgcaatttacacttccatgatgacctctgataattattactacacccacagcatttggcatatcctgctcgccgggagtgctgctttgcttctgccacctcccgatcagccagctgagccctgggcctgcagccagaaatttccttgccactaccagatctgtaaaaatgaccgggaagagctgtatgccgtaacttag

SEQ ID NO: 47589 - DNA, 1419 bp, Artificial Sequence
  Description of Artificial Sequence: Synthetic coding sequence
atgaacatgccccagagcctgggcaaccagcccctgccccccgagccaccaagcctgggcaccccagccgaggggcccggcactacgtccccccctgaacattgctggcccgtgcgccccactctccgtaacgagttagacacgttcagcgtgcatttctacattttttttggcccctctgtcgccctcccaccggaacgccccgcggtctttgctatgcggcttctccccgttttggattcaggcggggttctctcccttgagttgcagctcaacgcatcctctgtgaggcaggaaaacgtgacagtttttggatgtttgacacatgaagtgccactcagcctaggtgatgctgccgtaacttgcagtaaggaatcactggccgggttcctgctatccgtgtctgccacaacacgcgtcgcccgcctgcgcatcccgtttccccaaacagggacgtggtttctggcgcttaggagtctgtgcggcgttgggccccggttcgtgaggtgccgcaatgcaaccgcagaagtgaggatgcgaacttttctttctccttgcgtggatgattgcgggccttatggccagtgcaaattattgcggacacataactatctgtacgccgcctgtgaatgcaaggccgggtggagggggtgggggtgcacagatagcgccgacgcgctaacttacgggtttcaactgctctccactctattgctgtgcttgtcgaacctgatgttcctgcctcctgtggtactagctatcaggtctaggtatgtcctagaggccgcagtctatacctttactatgtttttttccacgttttaccacgcgtgtgaccagcccggcatcgtggtgttttgtataatggattacgacgttttacagttctgcgattttctcgggtcactgatgagtgtgtgggtgactgtgattgcaatggcccggctgcagcctgttgtgaagcaggttctatacctcctgggcgcaatgcttttgagcatggcactccagttggaccgccacgggctgtggaatctcctgggtccctcgctattcgcactgggaattctggctaccgcctggaccgtacgcagtgtccggagacgccattgttacccacccacatggcgtcggtggttgttctacctgtgccctgggagcttgatcgcagggtcagccgttttactctatgcctttgtggagacccgagacaactacttttacatacacagtatatggcacatgttgatagctggatctgtgggcttcctgttgccacctagagccaagacagatcacggcgtccccagcggagcaagggcacgcggctgtggctaccagctttgcataaatgagcaggaagaattgggcttggtggggcctggaggcgccaccgtctctagcatctgcgccagctag

SEQ ID NO: 47590 - DNA, 1419 bp, Artificial Sequence
  Description of Artificial Sequence: Synthetic coding sequence
atgaacatgccccagagcctgggcaaccagcccctgccccccgagccccccagtctcggcacgccagccgagggccctggcacaacgtccccaccagagcactgctggcctgttaggcccaccttgcgcaacgagttggataccttttccgtgcacttttacatcttcttcggccctagtgtggctcttccccccgaacggcccgctgtgttcgctatgcggctcttgccagtgctggacagcgggggggtgctgtccctcgagctgcaactgaacgcgagttcagttaggcaggagaatgtgacagtttttggctgtctaacgcatgaggtacctctgagtctgggggacgctgcagtgacttgttccaaagagtcgctggcaggattcttgctgagcgtctccgcaacgactagagttgcaagacttcggattcctttcccacaaactggcacttggttcctggcactccgctccttgtgcggtgtggggccccgcttcgttaggtgtcggaacgccacagctgaggtgaggatgagaacttttctgtccccatgtgttgatgactgcggcccatatggccagtgcaaactgctgcgcacacacaactacctttacgccgcttgcgagtgcaaggcaggatggcgcgggtggggctgcactgactctgccgacgctctgacatacggattccagcttcttagtaccctccttctgtgcctatctaatttgatgtttctgccaccggtggtattagccatcagatcaaggtacgtgctggaagcagcggtgtatacatttaccatgttcttcagtactttttaccacgcctgcgatcagccaggcatcgttgtcttctgtatcatggattatgacgtgttgcagttttgcgattttctgggttccttgatgagtgtatgggtgaccgtcatagctatggcaagacttcagcccgtcgtgaaacaggttctgtacctgctgggagccatgctcctgtcgatggcattgcagctggaccggcacggactttggaatttgctgggcccaagtctgttcgccttaggcatcttggcgaccgcttggacggtcagaagtgtgcgccgccgccattgctacccccccacttggaggcgttggcttttctacttgtgtccagggagtctgatagctggaagcgcggtgttgctgtacgccttcgttgagactcgagataattatttctatattcattcaatatggcatatgctgatcgccggctccgtcgggtttctcttaccgccgagagcaaagaccgatcatggtgttccgtccggagccagggctcgggggtgcggataccagctgtgcataaatgaacaggaagagttggggttggttggtccaggaggcgcgaccgtgagttcaatatgtgccagttag

SEQ ID NO: 47591 - DNA, 1017 bp, Artificial Sequence
  Description of Artificial Sequence: Synthetic coding sequence
atgaacatgccccagagcctgggcaaccagcccctgccccccgagccacccagcctgggcacacccgcggagggaccagggacaacttcacctccagaacattgttggccagttcgtccaacgctccggaatgagttggacacattctctgtgcacttctacatcttctttggacctagtgtggcgttgcctccagaacggccagcggtgttcgctatgagattgctgcccgttctagactcaggcggggttttgagcctggaactacaactgaacgcttcaagcgtgaggcaggagaatgtcacagtgttcggatgcctgactcatgaggtaccactctcattgggagacgcggctgtgacttgctctaaagagagcctcgctgggttcctgttgtctgtaagcgccacgacccgagtagctagattgaggatcccattcccccagaccggtacgtggtttttggccctacgtagtctctgcggggtgggcccaagattcgttcgctgtagaaatgccacagctgaggtgcgaatgagaaccttcttgtctccgtgcgtggacgattgcggcccttatgggcaatgtaaactcctgcgaacccacaattatctctatgctgcctgtgaatgtaaagccggatggcgtggctgggggtgcactgacagcgcagatgcactgacctacggatttcagctcttgtccactttactcttgtgtctatccaaccttatgttcctgccaccagtagttctggctatcaggtctcggtatgtgctggaggcagctgtgtacacattcactatgtttttcagcaccgtgtgcgggggcgtctgcattctctctttaggcgcctgcgcttggtggtgggtgacagtctgtatttccactacctttagcgaaggcctgggcatgagcgttccatccctgtgtctcctccagacagagaccgctgtgctgccaaagctctcatgtatagataatggacatttttgcaagacccattggtctaagtag

SEQ ID NO: 47592 - DNA, 1017 bp, Artificial Sequence
  Description of Artificial Sequence: Synthetic coding sequence
atgaacatgccccagagcctgggcaaccagcccctgccccccgagcccccttctcttgggacacccgctgaaggcccgggcacaacctcaccaccagaacattgttggcctgtccgtcccacccttcgcaatgaattagataccttttccgtccatttttacattttctttggaccgtccgtagcacttcccccagaaaggcccgctgtattcgcaatgcggcttctcccagtgctcgatagcggcggcgtgctgtccctggagcttcagctcaatgctagttccgtcagacaagagaatgtgacagtcttcggatgcctaacgcacgaagtccctctgtcactgggggacgctgccgtaacgtgttccaaagagagcttggctggatttctgttgtccgtatctgctactacccgggtcgctcgcttaagaattcctttccctcagacaggtacttggttcttggccctccgatcgttatgcggcgtcggtccacgattcgtgcggtgtcgtaacgccacggccgaggttcgcatgaggacctttctgtcaccatgtgtcgatgactgtggaccctatggtcagtgcaagttgctgcgcactcataattacctctatgccgcgtgcgagtgtaaagccggctggaggggctggggctgtaccgactccgccgacgcgttgacctatggttttcagctacttagcacattattactttgcctgtctaatttaatgttcttgcctcccgtggttcttgcaattcgatctcggtatgtactcgaggctgcagtctacacctttacaatgttcttttccacagtgtgtggaggcgtttgtatcctgtcactcggtgcctgtgcttggtggtgggtgaccgtctgtatttctacaaccttctctgaggggctcggaatgtctgttccgtctctgtgcctccttcagaccgagactgctgtgttgcctaagctcagctgcatcgacaacggtcacttttgtaagacgcattggtccaagtag

SEQ ID NO: 47593 - DNA, 552 bp, Artificial Sequence
  Description of Artificial Sequence: Synthetic coding sequence
atgaagctgctgagcctggtggccgtggtgggctgcctgctggtgcctcctgccgaagctaacaagtcaagtgaagacattagatgtaaatgcatctgtccaccatatagaaacatcagtggtcacatctacaaccagaacgtttctcagaaagactgtaattgcctacacgtggtcgaaccaatgcctgtgccaggccacgacgtcgaggcctattgcctactctgtgaatgcagatacgaggagcgctctactactacaattaaagtgattatcgtcatctatctgtcagttgtgggcgccctcttgttgtatatggcgttccttatgctcgtggaccccttgattaggaagcccgatgcgtataccgaacaactgcacaatgaggaggagaacgaggatgcccggtcaatggcggcagccgccgctagcctggggggtcctagagcaaacaccgtgctggaacgcgtggaaggcgcgcaacagcgctggaagctacaggtgcaggagcagaggaaaaccgtgtttgaccggcataaaatgctgagttag

SEQ ID NO: 47594 - DNA, 552 bp, Artificial Sequence
  Description of Artificial Sequence: Synthetic coding sequence
atgaagctgctgagcctggtggccgtggtgggctgcctgctggtgccacccgccgaggccaataaatcttcggaagacattaggtgtaagtgtatatgtcccccctaccgcaatatcagtggtcatatatataatcagaatgtctctcaaaaggattgcaactgtcttcacgtggtggaacccatgccggtccctggccacgacgtggaggcctactgtctgctctgcgagtgcaggtatgaggagcggtccactacaactatcaaggtgatcattgttatctatttaagtgtagtgggcgcattgctgttgtatatggccttcctcatgttggttgacccactgatccggaaacccgacgcctatactgaacaactgcataatgaggaagaaaatgaagacgctagatctatggcagctgccgctgcttcgttaggtgggcctcgggcaaacactgtgctggagcgggtggagggagctcagcagagatggaagcttcaggtgcaagagcaaaggaaaaccgtgtttgatagacacaagatgctatcttag

SEQ ID NO: 47595 - DNA, 561 bp, Artificial Sequence
  Description of Artificial Sequence: Synthetic coding sequence
atgaagctgctgagcctggtggccgtggtgggctgcctgctggtgcctcccgctgaggcaaacaaagttcgggaaagctcggaagatatacgctgcaaatgtatctgcccaccgtaccgtaacatctctgggcacatttacaaccagaatgtaagtcaaaaggattgcaactgcttgcacgtggtggaaccgatgccagttcccggtcatgacgtggaggcctattgccttctttgtgaatgccgctatgaagagagatctaccactactataaaagtcatcatcgtgatttacctaagcgtggtgggcgccctgctgttgtacatggcttttttaatgttggttgatcccctgatccgcaagcctgatgcctataccgagcagcttcacaatgaagaggagaatgaggatgcacgttcaatggctgcggccgcagcctctctcgggggtccccgagccaacacagttctggagcgcgtggagggtgcccagcagagatggaaactgcaggtgcaggaacagagaaaaactgtctttgaccgccataagatgctgagctag

SEQ ID NO: 47596 - DNA, 561 bp, Artificial Sequence
  Description of Artificial Sequence: Synthetic coding sequence
atgaagctgctgagcctggtggccgtggtgggctgcctgctggtgcctcccgcagaggccaacaaggtccgcgaaagctccgaagatattcggtgcaaatgtatttgcccaccctaccggaacattagcggacacatatataaccagaatgtgagtcagaaggattgtaattgtctccacgtggtagaaccaatgcccgttccagggcacgatgtcgaagcctactgccttctgtgcgaatgccgttacgaagagagaagtaccacaaccatcaaagtgattatagttatttacttgagcgttgtcggcgctctgctcctttacatggctttcttaatgctggtggaccctttaatacgaaagccagatgcatatacagagcagctccacaacgaagaagagaacgaagatgctcgttccatggctgcggctgccgcctctctgggcggtcccagggccaacactgtgttggagcgtgtcgaaggtgcccagcaaaggtggaaattgcaggttcaagagcagaggaaaacggtttttgatagacacaaaatgctcagctag

SEQ ID NO: 47597 - DNA, 552 bp, Artificial Sequence
  Description of Artificial Sequence: Synthetic coding sequence
atgaagctgctgagcctggtggccgtggtgggctgcctgctggtgcctcccgcagaagccaataagagctccgaagacatcaggtgcaagtgcatctgccccccatacagaaacatatcagggcacatatacaaccaaaacgtgtcccagaaagattgtaactgcttgcacgtggtagagcctatgcctgtgccaggccatgatgttgaggcctactgtcttctgtgcgagtgtagatacgaggaaagaagtactacaaccatcaaggtaatcatagttatttacctgtctgttgtcggagcacttctgctgtacatggcattcttgatgctggtcgaccccctgattcggaagcctgacgcgtatactgagcagctgcataatgaagaggagaacgaagacgcgcgttccatggcagctgccgcagcaagcctgggagggcctagggccaacaccgttttggagagggtggagggcgcccagcagcgctggaaattacaggtgcaagagcaacgcaaaacagtgtttgacagacacaaaatgctgagctag

SEQ ID NO: 47598 - DNA, 345 bp, Artificial Sequence
  Description of Artificial Sequence: Synthetic coding sequence
atgaagctgctgagcctggtggccgtggtgggctgcctgctggtgccgcccgccgaagctaacaaggtgagagaggtgtcattgcagcatctggtcaccactacagtgcacggtcatccagtctatcgggctgactccgaatcttcagaggatatcaggtgcaagtgcatttgccccccatacaggaacatctccggccacatctataatcagaacgtgtcgcagaaggactgtaattgtctgcatgtggttgaaccaatgcccgtgcccggccacgatgtggaggcctactgtcttctgtgtgaatgtcggtatgaagaacggtccacaaccactatcaaatag

SEQ ID NO: 47599 - DNA, 417 bp, Artificial Sequence
  Description of Artificial Sequence: Synthetic coding sequence
atgaagctgctgagcctggtggccgtggtgggctgcctgctggtgccaccagcagaagctaataagagctcagaagacataaggtgtaagtgcatatgtcctccttacagaaatatcagcggccatatatataaccagaatgtgtcccagaaggattgcaactgcctccatgtagtggagcccatgcccgtgccgggacatgatgtggaagcgtattgcctgttgtgcgaatgtcggtacgaggaacggtctactactacaattaaggtgattatcgtgatatacctgtccgtcgtgggggctctcctgctgtacatggcctttctgatgttggtggaccctctaataagaaaacctgatgcctatacagagcagctgcacaacgaggaggaaaacgaggacgccagaagcatgtag

SEQ ID NO: 47600 - DNA, 456 bp, Artificial Sequence
  Description of Artificial Sequence: Synthetic coding sequence
atgaagctgctgagcctggtggccgtggtgggctgcctgctggtgccacccgcggaagctaataaaagctctgaagatatacgctgtaagtgcatatgtccgccctacaggaatatatccggacacatctataatcagaatgtgtctcagaaggactgcccagtaagtttgtgctgtagcaactgcttacacgtggtggagcccatgccagtgccaggacatgatgtggaggcgtactgtctgctgtgcgaatgcagatacgaggaaaggagcactacaacaattaaggtaattatcgtcatttacctgtccgtggtgggagcactgctcttgtacatggctttcctgatgctcgttgatcctttgattagaaagcccgacgcttacaccgaacaactacataacgaggaggaaaatgaggacgcccgcagcatggccgccgctgccgcctcgtag

SEQ ID NO: 47601 - DNA, 369 bp, Artificial Sequence
  Description of Artificial Sequence: Synthetic coding sequence
atggacagccccagcctgcgggagctgcagcagcccctgctggaggggaccgagtgtgaaacccccgcccagaagcccgggaggcatgaactagggtcaccattgcgtgaaatcgcgtttgctgagtctctgcgcgggcttcagtttctctcgccccctctaccttccgtgagcgctggtctgggggagccccggcccccagatgtggaagatatgtcctcttctgactccgactccgactgggacggtgggtcacgcttaagccctttcctgccacatgaccacctggggcttgctgtcttctccatgctttgttgtttctggcccgtgggcatagcggcattctgtttagcacagaagactaactag

SEQ ID NO: 47602 - DNA, 420 bp, Artificial Sequence
  Description of Artificial Sequence: Synthetic coding sequence
atggacagccccagcctgcgggagctgcagcagcccctgctggagggcacagaatgtgagacccctgcccaaaaacccggtcgtcacgagcttgggagtccactccgagagatcgcatttgccgaatctttacgcggactgcagttcctcagccctcccctgccctctgtgtccgccggactcggagaaccccgacctccagatgtcgaggacatgtcctcgtccgatagcgattccgattgggacggcgggtcccggctgtcacccttcctaccacacgaccacctgggtttggccgtgttttctatgttatgctgcttttggccagtcgggatcgccgcgttttgcctcgcacagaaacatcctcagtgtctcacgtactcacgctgctacgtgagcgcctttggaatacacgcatag

SEQ ID NO: 47603 - DNA, 519 bp, Artificial Sequence
  Description of Artificial Sequence: Synthetic coding sequence
atggacagccccagcctgcgggagctgcagcagcccctgctggagggcactgaatgcgagacccccgcccagaagcctggcaggcacgaactgggatcgccactgagagagatcgcctttgccgagagccttagagggcttcagtttctgagcccccccctgcccagcgtctcagccggattgggtgaaccgagacctcccgacgtggaggacatgtctagtagtgatagtgactccgattgggacggcggatcacgcctgtctcctttccttcctcatgatcatctgggtctcgcggtgttctccatgctgtgctgcttctggccagtcgggatcgctgcattctgcctggcacagaaaacgaataaagcttgggcaaagggggacattcaaggcgcgggcgcggcctccaggcgggcttttctgttgggggtgttggcggtggggctgggcgtgtgcacttacgccgctgctttggtgacccttgcagcatacctcgcctcacgcgatcccccctag

SEQ ID NO: 47604 - DNA, 402 bp, Artificial Sequence
  Description of Artificial Sequence: Synthetic coding sequence
atggacagccccagcctgcgggagctgcagcagcccctgctggagggcacggaatgcgagacacctgcacagaagccagggaggcacgaactggggtctcctctcagagaaatagctttcgccgagtcactccgtgggctacaatttttatcccctccattgcctagtgtttcggctggcctgggggaacccagacctccagacgtcgaggacatgtcatctagcgacagcgatagcgattgggacggaggatcccgcttaagcccattcctgcctcatgatcatctgggactggccgtgttctctatgttgtgttgcttttggcctgtgggaattgccgctttctgcctcgcccagaagacccgaccatcatgtccatactcgcctcattgcgaaccctag

SEQ ID NO: 47605 - DNA, 372 bp, Artificial Sequence
  Description of Artificial Sequence: Synthetic coding sequence
atggacagccccagcctgcgggagctgcagcagcccctgctggagggaaccgaatgtgaaactccggcccagaagcccggccggcacgaactgggcagccctctgcgagagatcgcgttcgccgaatctctgcgcggccttcagttcctgagccccccactgccttctgtgagcgcagggctgggggagcctcgtcctcccgacgtagaggatatgtcatcttcagattccgactccgattgggatggcgggagtcgtctatccccgttcttgccccacgatcatctgggactggccgtcttctcgatgctatgctgtttttggcccgtgggaatcgccgcgttttgtctcgcccagaaaccctcactgtag

SEQ ID NO: 47606 - DNA, 384 bp, Artificial Sequence
  Description of Artificial Sequence: Synthetic coding sequence
atggacagccccagcctgcgggagctgcagcagcccctgctggaggggaccgagtgtgaaacacctgcccaaaagccagggcggcacgagcttggttctccgctgcgtgagatcgccttcgccgaatccttgcgggggctgcagtttctgtcacctccactaccctcggtatctgcaggactcggggagcctaggcctccagatgtagaagacatgtctagctcggatagcgacagcgattgggacggcgggagccgtttatcaccctttctaccccatgatcacttggggctcgccgtcttttccatgctctgctgtttctggcctgtcgggatagctgcattctgtttagctcaaaagctcccgctgcaaccctctctctag

SEQ ID NO: 47607 - DNA, 183 bp, Artificial Sequence
  Description of Artificial Sequence: Synthetic coding sequence
tgatgggacggcggcagccggctgagccccttcctgccccacgaccacctgggtctagctgtttttagtatgctatgctgcttctggcctgtgggcatcgcggcgttttgcctagctcagaaacacccgcagtgtctaacgtactcaagatgttacgtgtccgcattcggtattcatgcctag

SEQ ID NO: 47608 - DNA, 345 bp, Artificial Sequence
  Description of Artificial Sequence: Synthetic coding sequence
atggacagccccagcctgcgggagctgcagcagcccctgctggagggcacggagtgcgagaccccagctcagaaaccaggtcgacacgagctgggctcccctctgagggaaatcgcctttgccgagtctctgcgaggattacagttcttgtcgccacccctcccctctgttagcgctggactaggtgagcccaggcccccggatgtggaggacatgtcctcaagcgattccgacagcgactgggacggaggatcccggttgtcgccctttctacctcacgatcacttggggctggctgtgttctctatgctctgctgcttttggccagtgggcatcgctgcatag

SEQ ID NO: 47609 - DNA, 402 bp, Artificial Sequence
  Description of Artificial Sequence: Synthetic coding sequence
atggacagccccagcctgcgggagctgcagcagcccctgctggagggcaccgaatgtgagaccccagctcaaaagcctggcagacacgagctgggctccccactgagggagatagcttttgcagagtcccttcgtggtctccagtttctgtccccacctctccccagtgtctccgcaggtcttggcgagcctaggccaccagatgtggaagacatgagctccagtgatagcgattccgattgggacggagggtcacgtctgtcgcctttcctccctcacgaccacctgggattagctgtttttagcatgctctgttgtttttggccggtggggatcgctgcattctgtctggcccagaagactcgaccaagttgcccgtactccccccactgtgagccatag

SEQ ID NO: 47610 - DNA, 264 bp, Artificial Sequence
  Description of Artificial Sequence: Synthetic coding sequence
tgactgcccagcgtgagcgccggcctgggcgagccccggccccccgatgtggaggatatgtcttcttccgattctgattcagactgggacggggggagtcggctttcaccctttttgccccatgatcatctagggttagctgtatttagcatgctgtgttgcttctggcccgttggcatcgctgccttctgcctcgctcagaagcatccccaatgccttacctatagcagatgctatgtttcggcgttcggcatccacgcctag

SEQ ID NO: 47611 - DNA, 480 bp, Artificial Sequence
  Description of Artificial Sequence: Synthetic coding sequence
atgagccaggcctgggtgcccggcctggcccccaccctgctgttcagcctgctggcaggccctcaaaagatagcagccaaatgtgggttaattctcgcatgtcctaaggggtttaagtgttgcggggactcctgttgtcaggagaatgagctgtttcctggcccggttcgcatctttgtgattatcttcctcgtcattctgtctgtgttctgcatatgcggactggccaaatgcttttgtagaaactgccgggaacctgagcccgatagtccagttgattgccggggaccactggagctgccgagtatcatccctccagaacgggtaagggtatcactgtccgcaccacctcccccttacagtgaggtaattctgaaaccaagcctgggccccactccgaccgagcctccgcctccttattccttccggcccgaggagtacacaggcgatcagagagggatagacaaccctgcattttag

SEQ ID NO: 47612 - DNA, 480 bp, Artificial Sequence
  Description of Artificial Sequence: Synthetic coding sequence
atgagccaggcctgggtgcccggcctggcccccaccctgctgttctcactgctggctggacctcagaagatcgccgctaagtgcggtctcatcttggcatgtcctaagggtttcaaatgttgcggagattcctgttgtcaagagaatgaactgtttcccggacctgttcgtatttttgtgatcatctttctggtgattctgtccgtgttctgtatttgcggcctcgctaagtgcttttgcaggaactgtagggaacccgagccagattcacctgtggactgtcgcggtcccttggagctgccttcaatcatccctccagagcgggtacgggtgtctcttagtgcccccccgccaccatattcggaagtcatccttaagccctcactgggacccacaccgactgaaccaccacccccatactcattccgccccgaggagtataccggagatcagcgtgggattgacaacccagcattctag

SEQ ID NO: 47613 - DNA, 333 bp, Artificial Sequence
  Description of Artificial Sequence: Synthetic coding sequence
atggccgccgtggtggccaagcgggagggcccccccttcatcagcgaggcggccgtaagagggaatgctgctgtgctggactactgtcgcacatctgtctccgccctgtcgggtgcaacggctgggattttggggctaacagggctctatgggttcatcttttatctcctggcgagcgttctgctgtcactccttctgattctgaaagccggcagacgctggaataagtacttcaaatccaggcgcccactctttacgggggggctgattggcggcctctttacctacgtactgttttggacgtttctgtacggaatggttcacgtgtactag

SEQ ID NO: 47614 - DNA, 333 bp, Artificial Sequence
  Description of Artificial Sequence: Synthetic coding sequence
atggccgccgtggtggccaagcgggagggcccccccttcatcagcgaggctgcagtgagaggaaatgccgccgttctggactattgcagaacctccgtgagcgctctgagtggcgctacagccgggatcctgggtctaaccggcctctacgggttcatcttctacttattggcgtcggtactgctctctctgctcctgatcctgaaggccggacggaggtggaacaaatattttaagagtaggcgcccgctgttcactggaggcctaattgggggcctgtttacttatgtccttttctggaccttcctttatggaatggtgcacgtttattag

SEQ ID NO: 47615 - DNA, 681 bp, Artificial Sequence
  Description of Artificial Sequence: Synthetic coding sequence
atggagaccgtggtgatcgtggccatcggcgtgctggccaccatctttctggcctccttcgcagcattggtgctcgtgtgcagacagcgttattgccgaccccgtgacttattacagcgctacgactcaaagccaatagtggatctcattggggccatggaaactcagagcgagccctctgagctggagctcgacgatgttgttattacaaacccccacatcgaagccattttggaaaatgaagattggattgaagacgcatccggcctcatgtctcactgcattgctatactgaagatctgtcacactctcactgaaaagctagttgccatgaccatgggctcgggagctaagatgaagacctccgcttcagtctcggatattatcgtagtcgccaaacggatctccccaagagtagacgacgttgtgaaatctatgtaccctcccctagaccccaagctgctggacgcacgcactaccgcattgctgttatctgtttcacacttggtcctggtgacaaggaacgcctgccacttgaccgggggtctggattggatcgatcagtcgctcagcgcagcagaagagcacctcgaagtgctgagggaggctgcccttgctagcgagcccgataagggcctgcccggacctgaggggtttctgcaggagcagtccgccatctag

SEQ ID NO: 47616 - DNA, 681 bp, Artificial Sequence
  Description of Artificial Sequence: Synthetic coding sequence
atggagaccgtggtgatcgtggccatcggcgtgctggccaccatctttcttgcaagttttgccgcactagtcctcgtgtgcagacaaaggtattgccgaccacgtgatctccttcagagatacgatagtaaacctattgtcgacctgatcggggctatggaaactcagagcgagcccagtgagctcgaattggatgatgtggtcattaccaacccacacatcgaagctattctcgaaaatgaagattggatcgaggacgcttctggccttatgagccactgcatagcaattctgaagatctgccacaccctgacagagaagctcgtggcaatgacaatggggtcaggagccaagatgaaaacatccgcatcggtatccgacataattgttgtggccaagagaattagccctcgtgttgacgatgtcgtgaaatctatgtatccgcccctggatcccaagctcctggatgctagaactaccgcgctcctgctgtctgtgtcccacctagttctggttactcgtaatgcctgccacctaacaggggggctcgattggattgaccagagtctgtctgctgctgaggagcatctggaagtgttaagagaagccgccctggcatcagagccggacaaaggattacccggtcctgaaggtttcttgcaggagcaatcggctatttag

SEQ ID NO: 47617 - DNA, 414 bp, Artificial Sequence
  Description of Artificial Sequence: Synthetic coding sequence
atggagaccgtggtgatcgtggccatcggcgtgctggccaccatcttcctagcgtctttcgccgctctggtgctagtttgccgtcagcgctattgtcgccctagggacctactccaaagatacgacagtaaacccattgtggacctcattggcgcaatggagactcagagcgaaccctcagagttggaattggatgatgtcgtaattaccaatcctcatatcgaggctattctagagaacgaagactggatagaggacgcttccggcctgatgtcccattgcatcgctatactcaaaatctgtcacaccttaacggaaaagcttgttgcgatgacaatgggatccggcgctaagatgaaaacgtccgcttcagtgtccgacataatagtggtggccaaacggatctcaccttag

SEQ ID NO: 47618 - DNA, 669 bp, Artificial Sequence
  Description of Artificial Sequence: Synthetic coding sequence
atggagaccgtggtgatcgtggccatcggcgtgctggccaccatcttccttgcgagctttgccgctcttgtgcttgtttgtaggcagaggtattgcagacctcgggatttgttgcagcgatatgattccaagcccatcgttgatctgatcggagccatggagacacagtccgaacctagtgaactcgaattggacgacgtggtcattacgaatccacacattgaggccatactggaaaacgaggactggatcgaggacgcgtccggcctgatgagtcactgtattgctatactgaagatttgtcatacactcaccgaaaaactggtggcaatgacaatggggagcggggccaagatgaaaacctctgcgtccgtatcagatatcatcgtcgttgctaagcggatttcgccaagagtggacgatgttgtcaagagcatgtaccctcccctggatcccaagctacttgatgcgagaactactgccctgctcttgtcggtgtctcacctcgtgcttgtgacgcgcaacgcatgccatctcacaggaggattagattggattgaccagagtttgtccgctgctgaagagcacctcgaggtgctgagagaggccgcgctggctagcgagcccgataagggcttaccgggacccgagggctttctccaagagtag

SEQ ID NO: 47619 - DNA, 681 bp, Artificial Sequence
  Description of Artificial Sequence: Synthetic coding sequence
atggagaccgtggtgatcgtggccatcggcgtgctggccaccatctttttggcttccttcgctgcactggtcctcgtctgccggcagagatactgccgccccagagacctgctgcagaggtacgacagcaaacctatcgtcgatctcatcggggccatggaaacccagtcagaaccttccgagctcgaactggacgacgtagtgatcactaaccctcatatcgaggctattttggagaacgaagactggattgaagacgctagtggcctcatgagccattgtatagcgatactcaaaatctgccacacactgaccgagaagctggtcgctatgaccatgggtagtggagccaagatgaagacgtcagcctctgtcagtgatattattgtggtggccaagagaataagtccaagagtggatgacgtggttaagagtatgtacccccccttagatcctaagctgctggatgctaggacaacagccctcttattgtcagtttcgcacttggttctcgtcacccggaacgcctgccacttaactggcggcctcgactggatcgatcagtccctcagtgctgctgaggaacacctcgaagtactgcgcgaggcggcactcgccagtgagcctgataagggccttccaggccccgagggatttttgcaagaacagagcgccatatag

SEQ ID NO: 47620 - DNA, 777 bp, Artificial Sequence
  Description of Artificial Sequence: Synthetic coding sequence
atggtgggcatcctgcccctgtgctgcagcggctgcgtgcccagcctgtgctgctcctcttacgtcccctctgttgctcctactgctgcccacagcgtgcgtgttcctcactcggccggacactgcgggcagagagtgctggcatgctcccttcctcaagtgtttctaaagccctggatattcgtagagcactttagttcctggctttcactggagttgttctccttcttgcgctatctcggcaccctcctgtgtgcttgcggccatagactgagggaaggcctgctgcttccttgtctgctcggcgtcggatcctggttactgttcaacaactggacaggcggcagctggtttagtctacatctgcagcaggtgtctctttcccagggctcccacgtcgccgccttcttgcctgaggctatcggccccggagtccccgtgccagtctccggcgaatcgactagcgctcagcagtctcatgctgggtggcaactgtctgccgaggccgatgcctgtccgtccgtgctttacagcgaggttctggaatggaacaagaatatcaatacctatacatcttttcatgacttttgcttgattctcggaatatttctattttgtttcgtgctggctgtgataggcctgccttacattaagccagggctctcactaagcgtggcgttgctgtggcagtcattgatcctgttatcttccctggtgcagcaagactcccaggttcatacctggggttgtttgtttagtacttttacctcgacatag

SEQ ID NO: 47621 - DNA, 570 bp, Artificial Sequence
  Description of Artificial Sequence: Synthetic coding sequence
atggtgggcatcctgcccctgtgctgcagcggctgcgtgcccagcctgtgctgcagcagttacgttccctcggtagctcctactgcagctcacagtgtgagggtcccacattccgccggccactgcggacagagggtgctcgcttgcagcctgccacaggtcttcctgaagccttggatcttcgtggaacattttagttcctggctgtcactggaactctttagcttcctgcgctacctagggacgctcttatgtgcttgtggccaccgactgagggaaggtctcttattaccttgcctcctgggtgtaggaagttggctcctctttaacaattggactggtggttcctggttcagtctgcaccttcagcaggtcagcttatctcaaggaagccacgtcgccgcattcctgccagaggcaatcggcccaggcgtgccggtgccagtgtcgggggagtcgacatcagcccagcagagtcacgccggctggcagctgtccgctgaagctgatgcctgtccaagcgtgctttacagcgaggtgcttgagtggaacaagaacatcaacacctag

SEQ ID NO: 47622 - DNA, 507 bp, Artificial Sequence
  Description of Artificial Sequence: Synthetic coding sequence
atgcccaagggctggggcgtgcggagcagcaccttcctgcccctgtggttgccggtcaagatcgaactgcatcaagtccagttccatagctccagtcagatgattttttctacgctgcgaagtgaactttacaagcttctggccctgtgccagcacgctgtcgtgcctatggggaagtttctcggaaagaccaaaactcagtcacaggggcaggtcgtcatcttctccgagaagggtaaagccattatttatttgtcactcccccggacagtgcccatctacacctgtattttctctcaatcagttggctgtctgtttatcctgctgataatatctctgaacttcctgttgttcatttactttattgagactgacctgattatgctgccaagagtcatattagacttactggcaagtagtgatcctccaaccctggttagccaaagtgccggtatcaccgatgtgaattaccatacccagtctacttgccgcagattctccgtttag

SEQ ID NO: 47623 - DNA, 1362 bp, Artificial Sequence
  Description of Artificial Sequence: Synthetic coding sequence
atggccatcttccggcagctgagcctgggcgccaaggccaccctggctgccgtgactgtgtttgtgagcatgatagcttctcggtcctacttggctgaatctctcgaactgcgggcctggcgctggctgctccgccttcagttggcactgtttgtgaattccttgctgttgatcggttcgttgtacatttggagatctaccgtctcaaatctctgccacagccccgcagcggaaagcacctgttttcagctgtggaaagtggtagttctggcattcctggcccttgcgcacagctcattcttcactatgtttttccttgttgccgaggaaccctacctcttcagcctggccgcgtatagctgcctaggcgcctatattatcatgctcttctttctgtttatactgtctggcatggagcaagcttaccagcttttagcctggcgttctgggagagtagttggatctctcgaaaagactcgcaaactagttttaaggccagccctcgccgtcggggtcaccgctgtgttgtctgtggctggcattttaaacgcagcccagcctccggctgtgaaaacagttgaagtgccgattcatcagctccctgcatctatgaataacctgaaaattgtcctcttgagcgatattcatttgggccctactgtggggagaacgaagatggaaatgttcgtgaggatggttaacgtgttggagcccgatataacagtgatcgtcggtgatctgtccgattcggaggcatccgtactgcgaaccgctgtcgctccacttggccaactgcattcacacctgggagcgtattttgtaacaggcaaccatgagtattatacctcagacgtatccaattggtttgccttgcttgagagtctgcacgttcagcctctgcataacgagaatgtcaagatcagtgctacgcgggcacagaggggaggcgggggctcagggtccgggtccgaagatgaagactggatctgtctcgcgggggtcgacgatattgaggctgacattttgcactactctggccacggcatggatctcgataaagccctggagggctgttcacctgatcacacgatcattttactggcgcatcaacctttagccgctaagcgcgctcttcaggcgagaccagatattaatttaatcctttccgggcacacccatgcgggacagatcttcccattaaacgttgccgcttatctcctgaatccttttttcgctgggttataccaagtggcccaagccactttcgtgtacgtgagcccgggcaccgcatactacggaatccccatgcggctgggctcccgcgcagagattaccgaacttattctgcaacggagtccctag

SEQ ID NO: 47624 - DNA, 951 bp, Artificial Sequence
  Description of Artificial Sequence: Synthetic coding sequence
atggagcaggcctaccagctgctggcctggcggagcggccgggtggtgggaagccttgagaagacaaggaagctggtccttcgtcccgctttggccgtcggggtgacagccgtcctgagcgtggccggtatcctgaacgccgcccaaccgcccgctgtcaaaacggttgaggtcccaatccaccagctcccagcttccatgaacaacttgaaaatcgtacttctttccgatatccacttaggccctaccgtcggacggacaaagatggagatgttcgttcgcatggtgaacgtgttagaacctgacatcactgtgattgttggcgatctcagtgacagcgaagcctctgttctgagaactgcagtcgcccctttaggccagctccatagtcatctgggggcatattttgtaactggcaaccacgagtattacacatcagatgtgagcaactggttcgcattgctcgaaagtctgcacgtacagccactgcacaatgagaacgtgaaaatctctgccaccagggctcaacgtgggggcggcgggtctggaagtgggtcagaagacgaggactggatctgcctcgcgggcgtcgatgacatcgaagccgatatcctacactactccggtcacggcatggaccttgataaagctttggagggttgctctcccgaccatactattatactgttggcccatcagccactggccgccaaacgggcgctccaggcgcggcctgatattaatcttattctaagcggacacacgcatgctggccagatcttcccgcttaatgtagccgcatatctgttgaatcccttctttgcaggcctttatcaagtggcacaagccaccttcgtgtatgtcagtcccgggaccgcatattatggcataccaatgcggttaggatccagagcagagatcaccgagttaatcttgcagcggagtccatag

SEQ ID NO: 47625 - DNA, 882 bp, Artificial Sequence
  Description of Artificial Sequence: Synthetic coding sequence
atggacaccctggaggaggtgacctgggccaacggcagcaccgccctgccccccccactggcacctaacatatctgtgcctcatagatgcttgttgctgctgtacgaggacatcggaactagccgtgttagatattgggacttgcttttgttgattccgaacgtactttttctgatcttcttgctgtggaaactgccttctgccagagctaagataaggattacatccagtccaattttcatcaccttctatatcctggttttcgtggtggctttagtcgggattgccagggcggtcgtgagcatgacggtctctacatccaacgccgctaccgtggcggataaaatcctatgggaaatcacccgctttttccttctcgcaattgagctgagtgtcataattcttgggcttgccttcggacacctggagagtaaaagttccattaagagggtgctcgcaatcacaactgtgctgtcactggcctatagtgtgactcaaggtaccctagagatcctgtatccagatgctcacctctcagccgaggacttcaatatctacggacatggcgggagacagttttggttggttagcagctgttttttcttcctgctctgcaggtgccacaatctgcctgttctgcaattacttcgaagcgcccacctgagggggtttccccctggactgcttaggctgggggctcaggacccactccttctgcaaatgccaagcggccgtgacaggggggccaggtgcacgccaacacccgctctcaggtgcggcccagccgggggtccgggcgggtgccgagggtgctgggggttgtcgtgtcagctacttgagcacgcagtgcggctttgccggagaggcggcctgcccggctag

SEQ ID NO: 47626 - DNA, 1122 bp, Artificial Sequence
  Description of Artificial Sequence: Synthetic coding sequence
atggacaccctggaggaggtgacctgggccaacggcagcaccgcccttcccccacccctggctcccaatatcagtgtaccccatcgttgcctgcttttgctttacgaggacattgggacgtcaagagttagatattgggacttgctcctgctgatacccaacgttctttttctaatattcctgctgtggaagttgccttccgcccgagcaaagatccggataacgtcctcccctatttttataacattttatattctcgtttttgtggtggcactggtgggtatcgctagggctgttgtatcaatgactgtgagtactagcaatgccgcaactgtcgccgacaagatcctttgggaaattacacgattcttcctgctggctatcgagctttccgtaatcattctcggtctcgcctttggacacctcgaatcaaagtcttcaattaagcgcgtactcgctattacaaccgtgctaagtcttgcatactccgttacgcagggtactttagaaatcctgtatcctgacgcgcatctttccgcggaggatttcaatatatacggccacggcggacggcagttttggcttgtctctagctgtttcttttttcttgtatatagcctcgtggttatcttgccaaagactcccctgaaagagagaatttcactccccagcagaaggagcttttacgtttacgccgggattcttgcgcttttaaacctcctccagggtctaggcagtgtcctgctgtgctttgacatcatcgaagggctatgctgcgtggacgccacgacattcctgtactttagctttttcgccccattgatatatgtggcattcctacgcgggttcttcggctcagagcctaaaatcctgtttagttataaatgccaggtggacgagacagaggaacccgacgtacacttgccgcagccctacgccgtggcccgcagagagggcctggaggcggccggcgctgccggagcttctgcagcctcgtattctagcacacagtttgacagtgccggaggggtcgcatacctggatgatattgctagtatgccctgccacacagggagcatcaactcaaccgacagcgaaagatggaaagccataaatgcctag

SEQ ID NO: 47627 - DNA, 1122 bp, Artificial Sequence
  Description of Artificial Sequence: Synthetic coding sequence
atggacaccctggaggaggtgacctgggccaacggcagcaccgccctcccccctccgctcgcgcccaacatatctgtgcctcaccgctgcctgctcctgctgtacgaggatataggcacgtccagggtccgctactgggatcttcttctcttaataccgaacgttctctttctgatttttttgctgtggaagctgccctctgcaagagcaaagattcgaattacaagctcgcccatatttattacattctacattctggtctttgttgtagcacttgtgggaattgctagggccgtggtgtctatgacggtatccacaagtaacgccgcaaccgtcgccgataagatactgtgggagatcacacggttctttctgttggcaatcgaactgagtgtgataatcctgggattggccttcgggcatctcgaaagtaaaagcagtattaagcgagtacttgctatcacaacagtccttagcctggcctacagtgtgacgcagggaaccctggaaatcctttatcctgacgcgcatctctctgcagaggattttaacatctatggtcacggggggcgtcagttttggttggtgagcagctgtttcttctttttggtctacagcttagtagtgattctgccaaagacgcctttaaaggagaggatcagcctgccatcacgcagaagtttttatgtctacgccggcattcttgcccttttgaacctgctgcagggtctcggcagcgtattgttatgtttcgacattattgagggtctgtgttgtgtagacgcaactacctttctgtattttagcttctttgctccgttgatctatgtggctttcctgcgggggttcttcggcagtgaacccaagatcctgttctcatacaaatgtcaggtggatgagactgaagaacccgacgtgcacttgccccagccatatgccgtggcaagacgcgagggattggaggctgccggagccgctggagccagcgctgctagctattccagtacccagttcgacagcgccggaggggttgcgtatctcgacgacatcgcctctatgccatgtcacactgggtccatcaactctactgactccgagaggtggaaggctattaacgcctag

SEQ ID NO: 47628 - DNA, 126 bp, Artificial Sequence
  Description of Artificial Sequence: Synthetic coding sequence
atggacaccctggaggaggtgacctgggccaacggcagcaccgccctgccccctcccttggcacctaatattagtgtgccccacagatgtctgctgctgctgtatgaggacattggcacctcctag

SEQ ID NO: 47629 - DNA, 612 bp, Artificial Sequence
  Description of Artificial Sequence: Synthetic coding sequence
atggacaccctggaggaggtgacctgggccaacggcagcaccgccctgcccccccctctcgcaccaaatatttctgtgccgcataggtgccttttgcttctgtacgaggacattggtacttctagagtgcgatattgggacttgctgctgttgattcccaatgttctcttcctgatattcctactctggaaactgccttccgcccgtgcgaagatcaggatcaccagcagccccatcttcatcaccttttatatcctagtgttcgtcgttgctctggtgggaatcgcaagggcggtcgtgagcatgaccgtgagcacatcaaacgccgcaaccgtggccgacaaaatcctctgggaaatcaccagatttttcctacttgctatcgagctgtctgtgatcattttgggtctggccttcggccatctggaaagcaaaagttccataaagcgcgtcctcgccataactactgttctgtcactcgcgtactccgtaacacagggcacactggagatattgtaccccgatgcccatctcagcgccgaggacttcaatatatacggacatgggggtagacagttttggctggtctcttcatgcttctttttcctgtag

SEQ ID NO: 47630 - DNA, 1122 bp, Artificial Sequence
  Description of Artificial Sequence: Synthetic coding sequence
atggacaccctggaggaggtgacctgggccaacggcagcaccgccctgccaccacccctggccccgaatatatctgtcccacacaggtgcttactgctgctctatgaagatatcggaacctctagagttcgttattgggacctcctactccttatacccaacgtgctgtttctgatctttctgctttggaagcttcccagcgctagggccaagatccgcatcacctcgagtccaattttcatcactttttacatcctcgtatttgtggtcgcccttgtcggtatcgcacgagccgtggtgagtatgactgtcagcacgagcaacgccgccaccgtcgcagataagatcctgtgggagatcactcggttcttcttactggcaatcgagcttagtgtaatcatacttgggctggcctttggtcatctcgagtctaaatcatctatcaagcgcgttctcgcgatcaccactgtgctctctctagcctactccgttactcagggaacacttgaaatactttatccagacgctcacttaagcgccgaagactttaacatctatggacacggtggtagacagttttggctggtgtcttcttgctttttctttctcgtctactctctggtagtgatcctccccaaaactccgctgaaggaacgcatttctctcccctctcgtcgcagcttctacgtctatgcgggaatcctggcactgttaaacttgctgcagggcctcggaagtgtgctcctgtgcttcgatatcatcgagggtttgtgttgtgtcgacgccactacttttttgtatttttctttcttcgctccgcttatctacgtagcatttctcagaggatttttcggctctgagcccaaaattctttttagttacaaatgccaggtggatgagaccgaagaacccgatgttcatctcccgcagccgtatgcggtggccagaagagagggcctggaggccgccggcgctgccggggctagtgcagcttcatactccagcacccagttcgattctgcgggaggcgttgcctatctggatgacattgcctccatgccttgtcacactggctccatcaactccacagactccgagcggtggaaagccatcaacgcttag

SEQ ID NO: 47631 - DNA, 615 bp, Artificial Sequence
  Description of Artificial Sequence: Synthetic coding sequence
atggacaccctggaggaggtgacctgggccaacggcagcaccgccctaccccctccgctggccccgaacatatcagtacctcatagatgtctgctcctactttacgaggacataggcacatctagagtgcgttactgggacttgttgctgttgataccaaacgtactcttcctcatctttctgctttggaaactgccctcggcacgcgctaagatccgaatcaccagcagtcccatcttcattaccttttacattttggtgtttgtagtggcgctagtcggtatagctagggcagtcgtgtccatgaccgtctctacgagcaatgctgctacggtcgcagacaagattctctgggagattacgagattctttctgttggctattgagttgtccgttattattctggggttagccttcggacatctggagtcgaagtccagcattaagcgggttctggcaatcacaacggttctgtctctggcctactccgtgacccaggggactttggaaatcttgtatccggacgcacacctgtccgccgaggactttaatatttacggtcatgggggaaggcaattctggctggttagctcctgtttcttttttttagtgtag

SEQ ID NO: 47632 - DNA, 501 bp, Artificial Sequence
  Description of Artificial Sequence: Synthetic coding sequence
atggacaccctggaggaggtgacctgggccaacggcagcaccgcccttccgcctcctctggcaccaaacatatctgtcccccaccgctgtctcctgttactctacgaggacataggaacgagccgggtgaggtactgggaccttcttctactgatacctaatgttctgttcttaatctttttattgtggaagctgcctagtgctagagccaagatacgtattacctcctcgcctatcttcatcaccttttatattctggtgttcgtggtggctctcgtgggcattgcccgggcggtagtgtctatgactgttagcacatctaatgctgccacggttgccgacaagatactctgggaaatcacaagattctttctgctagccatcgaactgagcgtgatcattctgggtttagcgtttgggcatcttgagagcaaatcatcgatcaaaagggtgttggcaattactacagtcttatcgttggcatattccgttacccaatag

SEQ ID NO: 47633 - DNA, 390 bp, Artificial Sequence
  Description of Artificial Sequence: Synthetic coding sequence
tgaagcgaggtgcccctgccccccggcgccctggccaccctgagctcgagctgttcgctgggcgtcgcgctgcatcgaagttccccagccagccggggcccaggcgagtctagtctgcccgctttctcaggcgttgcgctgctgccccccgcgtgtaaagcagggcttccttacaacctttctaggcaggaggggcatttaacgtgtctgagcatcccagacattaaaacagctttcagcgattgcacttccaagatcgggcggcgggattgtctgacacaagcatgctccgccctgacaggcaagggcgttagggaaggcatcgagtggatggtcaagtgtgtggtgcgcaatgtccatcgtccacctaggcagagggacatcacctag

SEQ ID NO: 47634 - DNA, 1158 bp, Artificial Sequence
  Description of Artificial Sequence: Synthetic coding sequence
atggtgctgatgcacctggccgtgaagaacaaccggatgagcgccaacaacgatcattttctgacaccgacttggcaacagatgcgtgcaactccgctggccgcgccagccggtagcctgtctagaaaaaagcggttggagctagacgacaacttagacactgagcgccccgttcagaagcgcgcacgatccggaccccagccacgactcccaccatgtcttctgcctctctctcctccgaccgctccagacagagcaaccgcggtggctactgcatctagacttggaccttacgtcctcctggagcctgaagagggggggagagcctaccaggcactgcactgtccaacaggaacagagtacacttgcaaagtgtaccccgtgcaagaggcccttgcagtgctcgagccttatgcaagacttccccctcacaagcatgtggccaggcccaccgaggtactcgctggcacccagctgctgtatgctttcttcacaaggacccatggggatatgcactcactggtgcgttcccgccatagaatcccggagcctgaggctgctgtcctcttccgccagatggctactgcgttggctcactgtcaccagcatggacttgtgcttagagaccttaaactgtgccgttttgttttcgctgaccgcgagagaaagaagcttgttctggagaatctcgaggactcttgtgtgttgacaggcccggacgactccctgtgggacaaacacgcgtgtcctgcttatgttggccccgaaatcctatcttcccgcgccagctacagtggcaaggctgcagatgtgtggagccttggcgttgcactgttcaccatgctggcagggcactacccttttcaagacagcgaaccagttttactgttcgggaagatcaggcgtggagcttacgccctgcctgccggtcttagcgcgcctgcgcgctgtttagtcaggtgcctgctgagacgggaacctgcagagcgtttgaccgctactgggattcttctgcatccatggctgagacaggacccgatgcctcttgcacccacacgctcccacctctgggaggctgctcaggtggtcccggacggactgggtctcgacgaagcccgggaggaagaaggggaccgcgaagtagtgctgtacggctag

SEQ ID NO: 47635 - DNA, 816 bp, Artificial Sequence
  Description of Artificial Sequence: Synthetic coding sequence
atgcgggccacccccctggccgcccccgccggcagcctgagccggaagaagaggctagagctggatgataaccttgacacagaacgacccgtccaaaagcgggcaagatccggtccccaaccgagattaccaccctgtcttctgccgttgtcaccgcctaccgctcccgatcgagcaaccgctgtggcaacagcttccagactcggtccctatgtcttgttagagcctgaagaggggggccgtgcctaccaagcattgcattgccctacgggcaccgagtatacttgcaaagtctatccagttcaggaagctctcgcagtcctcgagccctatgcccggctgcccccccacaagcatgtcgcccgtccaacagaggttttggctggaacacagttgctctatgctttcttcactaggacccatggagatatgcacagtttagtgagatcccgtcacaggattccagagcccgaagcagccgtgctgttcaggcaaatggccactgcattggcccactgccaccagcatggccttgtattaagggacttaaagctttgccggtttgtgttcgccgaccgggaaaggaaaaagctagtgctggaaaatctcgaggattcttgtgtgcttacagggccggacgatagcctgtgggacaaacatgcatgcccagcctatgtgggcccagaaattcttagcagccgggcctcatattcaggaaaagccgccgacgtgtggtcccttggcgtggctctgttcaccatgctggccggccattatcccttccaggattctgagccagttctcctgtttggctag

SEQ ID NO: 47636 - DNA, 1188 bp, Artificial Sequence
  Description of Artificial Sequence: Synthetic coding sequence
atggccagcgccgccagcgtgaccagcctggccgacgaggtgaactgtcctatctgccagggcaccttgagagaaccagttacaattgactgcggacacaacttctgcagagcctgtttgacaagatactgtgagatccctgggcccgatctagaagaaagccccacttgtcccctgtgcaaggagccattcagacccggcagttttcggcccaactggcaattggccaatgtcgtggaaaatatcgagcgcctgcagctagtgagtacgctcggtctcggcgaggaagacgtatgtcaggagcatggggaaaagatttattttttttgcgaggatgatgaaatgcagctgtgcgtggtctgtagagaggccggagaacacgctacacataccatgagatttctggaggatgcggctgccccatacagagaacagatccataagtgcctcaaatgtctgcggaaggagcgtgaagagatacaggaaatccagagcagagagaataaaaggatgcaggtgttgctgacccaggtcagcacaaaacgccagcaggttatcagcgaattcgcccatcttcgcaagtttctcgaggagcaacagtccatcctgctggcccagttggagtcgcaggacggcgacattctcaggcaacgggacgaattcgatctgctcgtggctggagaaatttgtagatttagtgcacttattgaggagttggaagagaagaatgagcgcccggcgagagagctgctaaccgacattcggagcacactcattaggtgcgagactcgcaagtgtcgaaagcctgtggctgtgtcacctgaactgggccagaggattagagattttccacagcaggctttgcctcttcaacgcgagatgaagatgtttctagaaaaactgtgtttcgagttggactacgaacctgctcacatctcattggacccacagaccagccaccccaagcttctcctttcggaggaccatcagagagctcagttctcctacaagtggcaaaactcacctgacaatccacagcggttcgacagggccacgtgtgtacttgcgcacactggcatcactggggggaggcatacctgggtctggatggcgagagtcccaggagactctggttgctgccagttctgtagcccaccttcagtgctggggaccgaagtggccgcatag

SEQ ID NO: 47637 - DNA, 1446 bp, Artificial Sequence
  Description of Artificial Sequence: Synthetic coding sequence
atggccagcgccgccagcgtgaccagcctggccgacgaggtgaactgccctatttgccagggcactctgagagaacccgtcaccatcgactgcgggcataatttctgtcgcgcatgcctcaccaggtattgtgagatccctggtccggatctcgaagaatcccccacctgcccactgtgcaaggagccttttcggccggggtcctttcgtcctaattggcaactcgccaatgtcgtcgaaaacatcgaacgtttgcagcttgtgagcacactggggctaggggaagaagatgtttgccaggaacatggagagaaaatctatttcttctgcgaggacgatgagatgcagctttgcgttgtatgcagggaagccggcgagcatgcgacacatactatgcggtttctggaagatgccgctgccccctatagagagcagattcacaaatgcctgaaatgtctacgaaaggaaagagaggaaattcaggaaattcaaagtcgcgagaacaagaggatgcaagtgttgctcacccaggtttctaccaagcgccagcaggtcatctccgagtttgcccacttgaggaaatttctcgaagagcagcagagcattttgctggctcaacttgagagccaggacggtgacatcctgcgccagcgggacgaatttgacctccttgtcgcaggtgagatctgcaggttcagtgctctgattgaggagttagaggagaagaacgagagacccgcccgcgaactgctgaccgacattagaagtaccctgataaggtgtgagacccgtaagtgcaggaagcccgtggcggtgtcaccagaactggggcaaagaattagagatttcccccagcaggcgctcccactccagcgggagatgaaaatgtttttggagaagctgtgttttgaactggattacgaaccagcccacatcagcctggacccacagacctctcaccctaagctgctgctcagcgaggatcatcagagggcgcagttttcgtacaaatggcagaattctccagataacccacaaagattcgaccgggctacctgtgtgcttgctcacactggcatcacaggtggaagacatacctgggttgtaagcatcgacctggcacacggtggctcatgtacagttggcgtcgtatcagaggacgttcagcgaaagggagaattgcgtttgcgccccgaggagggtgtttgggccgtgagattagcctggggctttgtctcagctctgggtagttttcctactcgcctgactttaaaagaacaaccacgccaagtcagagtatcccttgactatgaagtcggctgggtcaccttcactaatgccgtcacgcgcgagccaatatacaccttcacagcttctttcaccagaaaagttatcccattcttcggcctttggggcagagggtcctccttctccctgtccagttag

SEQ ID NO: 47638 - DNA, 1446 bp, Artificial Sequence
  Description of Artificial Sequence: Synthetic coding sequence
atggccagcgccgccagcgtgaccagcctggccgacgaggtgaactgccccatttgccaaggcacacttcgcgagccggtgacgattgattgcggacacaatttttgccgggcatgccttacaagatactgcgaaatccctggccctgatctggaagaaagccccacatgccctctctgcaaagaaccctttcgccccggctccttccgcccaaattggcagctggctaacgtcgtggaaaacatagagaggctgcagctggtctctaccctcggtctcggcgaagaagatgtctgtcaggagcacggcgagaagatttactttttctgcgaggatgacgagatgcagctttgcgttgtatgcagagaagctggggagcatgcaactcacacaatgaggttcttagaagatgccgccgccccctatcgggagcagattcataagtgcttaaagtgccttcggaaggagagggaggaaatacaagaaatccagtctcgcgaaaacaagcgaatgcaggttctccttacccaggtgtccacgaagcgacaacaagtgatctcggagtttgcccatttacgcaagttccttgaggaacagcagagcatcctattggcccagctggaatctcaggatggcgatatcctgagacaacgcgacgagttcgatctgctggtcgccggcgaaatatgccgcttttccgcactgatagaagagctggaggagaagaacgagagacctgctagggaattgctgaccgatataagaagtacacttatccgctgtgagaccaggaaatgtcgcaagcccgtggccgtgtcaccagaattgggtcagagaatccgggacttccctcaacaggccctgccattacagcgggagatgaagatgttcttagaaaatctgccaaaccacctagtcattcctacggcgcacatttcgctggatccccagaccagccatccaaaactgctcttgtccgaggaccatcagcgggctcaattctcttacaaatggcaaaacagtccagataacccccagcgattcgatcgggcaacctgcgttcttgcacacactgggatcaccggtggccgccacacatgggtggtgagcatagacctcgcccacgggggatcctgcaccgttggggtggtaagcgaggatgtgcaacggaagggggaactgaggctccgacctgaagagggcgtgtgggcagtccggctcgcctgggggtttgtctcagcactgggaagcttcccaacaagattgactctgaaggaacagccacgtcaagtgcgcgtgtcacttgattatgaggttggatgggtgacatttaccaacgccgttacgcgagaacctatctatacgttcactgcgtcattcacacgcaaagtgatccctttttttgggctatggggaaggggatcatcattcagcctgagctcgtag

SEQ ID NO: 47639 - DNA, 1695 bp, Artificial Sequence
  Description of Artificial Sequence: Synthetic coding sequence
atggccgagctggacctgatggcccccggccccctgccccgggccactgctcaaccacccgctcccttgtcgcccgactctgggagcccaagtccagatagtggttctgccagtccagtcgaggaagaagacgttgggtcatccgagaagctaggacgcgagactgaggagcaggattcagacagcgcagaacagggcgacccagcaggcgagggcaaggaggtactctgcgacttctgtctggacgatacaagacgggtcaaagctgtgaaatcatgccttacctgtatggttaattactgtgaggagcatttacaaccccatcaggtgaacatcaagttgcaaagccatctcctgaccgaacccgtcaaggatcacaactggagatactgccctgctcaccactccccactgagcgctttttgctgccctgatcagcagtgtatttgtcaggactgctgtcaggaacattccgggcataccatcgtgagccttgatgccgccagacgggataaagaggcagaactgcagtgtacacagcttgacctcgagcgtaaactgaaactgaacgagaacgctataagtcgcctgcaagcaaaccagaaaagcgtgcttgtctctgtgtccgaagttaaagctgtagctgagatgcagttcggggaattgctggccgccgtcagaaaagcgcaggcaaatgtgatgctgttcctggaggaaaaggagcaggccgccctcagccaggctaatgggatcaaggcccatctggaatatcggtctgccgagatggagaaaagcaagcaggaactggaaaggatggcagctatcagtaacactgtccaatttctcgaggagtactgtaaattcaagaacacggaagacataactttcccctctgtatacgtgggcctgaaagataagctgtctggcatccggaaggtgatcactgaatctactgtgcatctcattcaactgctggagaattataagaaaaagctccaggaattctctaaagaggaggagtatgatattaggacacaagttagtgccgtggtgcaaagaaaatattggacctctaagcccgaaccaagtacaagagagcagttcctccaatacgcctatgatattaccttcgacccagacaccgcacataagtacctgcgattgcaggaagagaaccgtaaagtgactaacaccaccccttgggaacacccttacccggatctgcctagccgcttccttcactggcgccaagttctcagtcagcagagcctctacctgcacaggtactacttcgaagttgagatttttggggccggaacttatgtcgggttaacctgtaagggtattgatcgaaagggtgaggagaggaattcctgcattagtggaaataatttcagctggtcactgcagtggaatggtaaggagtttaccgcctggtacagtgacatggaaaccccgctgaaggctgggccgttcagaagactgggagtctacattgacttccccggcggcatcctgtcgttctacggcgtcgaatacgacactatgactcttgttcacaaatttgcctgcaaattctccgagcctgtctatgccgccttctggctctcaaagaaggaaaatgcgatccggatagtggacttgggggaggaacctgagaagccggctccaagcttagttgggaccgctccttag

SEQ ID NO: 47640 - DNA, 1695 bp, Artificial Sequence
  Description of Artificial Sequence: Synthetic coding sequence
atggccgagctggacctgatggcccccggccccctgccccgggccaccgcgcagccacccgccccactgtccccggatagcggttctccctctcctgattccggttccgcttcacctgtggaagaggaagatgtgggcagctcagagaagctagggagagaaacagaggagcaagacagtgactctgcagagcagggggaccctgctggcgaaggaaaggaggtcctgtgcgatttttgtctggacgatacgcgccgcgtcaaggcagtcaaatcgtgccttacctgtatggtgaattattgcgaggagcatctccagccacaccaagttaatatcaagctgcagtcgcacctgctgaccgaacccgtgaaggaccacaattggagatattgtccagctcaccactccccattgtccgcattctgctgtccggaccagcaatgcatctgtcaggattgctgtcaggagcattcggggcacaccatcgtttcactcgacgccgcccgccgcgacaaggaggcggagctccagtgcacacagctggacctggagcgcaagctcaagttgaacgagaacgccatctcgcggctccaagccaatcagaaatccgtgctcgtctctgtgagtgaggtgaaagcagtggccgaaatgcagtttggcgagcttttggcagccgtgaggaaagcccaggcaaatgtgatgctatttttggaagaaaaagaacaagccgcattaagtcaggccaatggcatcaaagctcaccttgagtacaggagtgcagagatggaaaaatccaaacaggagctggagcggatggccgcaatttccaacacagtgcagtttcttgaggagtactgtaaatttaagaataccgaagacattacttttccatctgtgtacgtggggttgaaagataagctgtctggaattcgcaaggtcattaccgaatcgactgtgcatcttattcagctactggaaaactataaaaaaaagttacaggagttttccaaggaggaagagtatgacattcgtacgcaggtgtctgcggtggtccagcgtaaatactggaccagcaaacctgaacctagcacgagagagcagttcctccagtacgcctacgatatcacatttgatcctgacactgcccataaatatttacgactgcaggaagaaaataggaaggtgacaaacactacaccctgggagcacccataccccgatctgccgtccagatttcttcactggcggcaggtgttgtcccaacagtcactttacctgcatagatactatttcgaagtggaaatcttcggggcaggcacctacgtggggctgacatgcaagggtatagatagaaagggtgaggaaagaaacagctgcatcagcgggaacaattttagctggtcacttcagtggaacggaaaggaattcactgcctggtatagcgacatggagacgccactcaaggctggcccctttagacgtttgggagtctacattgacttccctgggggcatcctttcattttatggtgtggagtatgacacaatgaccctggtgcataagtttgcttgcaagttctccgagcccgtctatgcggccttctggctttcaaagaaggagaatgcaatacgcatagtggaccttggggaagagccagagaaacccgcaccgtcactggtaggcacagctccctag

SEQ ID NO: 47641 - DNA, 1425 bp, Artificial Sequence
  Description of Artificial Sequence: Synthetic coding sequence
atggaggccgaggacatccaggaggagctgacctgccccatctgcttagactactttcaggatcctgtgagcatagaatgcggccataatttctgtcgcgggtgtctgcataggaattgggctcccggcggcgggccatttccttgtcctgagtgccgccatccctcagccccggccgctctgcggcccaactgggctctagcgcgattaactgagaaaacccagagacgccgtctgggtcctgtgccccccggcctttgcgggcgccactgggagccgctaaggcttttctgtgaggacgaccagcggcccgtctgcttggtgtgcagggaatcccaagaacaccaaacacatgcgatggctcctatcgacgaagccttcgaaagctatagggaaaaactattgaaatctcaacgcaacctggtggcaaaaatgaaaaaggttatgcatctgcaggacgttgaggtaaaaaacgcgactcagtggaaagacaagatcaaatctcagcggatgaggatttccaccgaattttctaagctgcacaatttccttgtcgaggaagaggatctcttcctccagcgactcaacaaggaggaggaggagaccaagaaaaagctgaatgagaacactttaaaattgaaccaaactattgcttccttaaaaaagctgattctggaagtcggcgagaaaagtcaggctccaacattagagctgctgcagaacccaaaagaggtcctgacacgcagtgagattcaggacgtcaactactccctggaggctgtgaaagtaaagaccgtttgccaaatcccactgatgaaggaaatgttgaagagatttcaggtggcagtcaacctcgctgaagacactgcccatcccaaactggtcttttcacaggagggacggtacgtgaagaacaccgcgtccgcctctagttggcccgttttctccagcgcatggaattatttcgcaggctggcgcaatccgcagaagacagcatttgtggagcgcttccagcatctgccatgcgtcttgggaaaaaacgtctttacctcgggaaagcattattgggaggttgaaagccgcgattccctagaagttgcagtcggggtttgtagagaagatgtgatgggaataactgacagatccaagatgagtcccgacgttgggatatgggccatatactggagcgcagctgggtactggcccctgattggtttccccgggactcccactcagcaggagccagcattgcacagagtgggcgtgtatctagacagggggactggtaacgtgagcttttattccgcagtggacggagtacacctgcacacatttagctgctcatccgtatctcgtctaaggccctttttttggctgtcccccttggcatctctggtaattccccctgtgacagatcgaaagtag

SEQ ID NO: 47642 - DNA, 885 bp, Artificial Sequence
  Description of Artificial Sequence: Synthetic coding sequence
atggaggccgaggacatccaggaggagctgacctgccccatctgcttggattacttccaagacccagtgagcatcgagtgcgggcacaacttttgtcgcggatgcttgcaccggaactgggcaccaggtgggggtccattcccatgtccagagtgccggcatccttcagctcccgctgctttgcgtcctaattgggctttggccaggttgaccgaaaagacccaacgccggcgactcgggccggtgcctccaggtttgtgcgggcgccactgggaaccgttgcgcctgttttgcgaggacgatcagcggcccgtttgcctagtttgtagggagtctcaagagcatcagacacacgccatggctccaatagatgaagctttcgaaagctatcgtgagaagctgctgaagagccagcggaaccttgtcgccaagatgaaaaaagtgatgcacctgcaggatgtggaagttaaaaacgctacacaatggaaggacaaaattaagtcccagaggatgagaatctccactgagttctcaaagttgcataacttcctggtagaagaggaggacctgttcctgcagcgactgaacaaagaagaagaggaaactaagaaaaaactgaatgaaaacacactgaaacttaaccagacaatcgcttctctcaaaaaactgatcttggaggtaggcgaaaaaagtcaggcccctacgctggagttattgcagaacccaaaggaagttctgactaggagtgaaattcaggatgttaactacagcctggaagccgtcaaggtgaaaacggtctgccaaattccccttatgaaagaaatgctaaagcggtttcaagccacaaagataaagacgcaaaaacaaaatagacacaatatgtag

SEQ ID NO: 47643 - DNA, 1503 bp, Artificial Sequence
  Description of Artificial Sequence: Synthetic coding sequence
atggaggccgaggacatccaggaggagctgacctgccccatctgcctggactattttcaggaccccgtctccatagaatgcggccataacttctgccggggttgtctgcatagaaactgggcccccggcggggggccatttccctgccccgagtgtcggcaccccagcgcacctgctgccctgcggccgaattgggccctggcaagattaaccgagaagacacagcgccggaggctgggacccgttccaccagggctatgcggcagacactgggagccattgaggttgttttgcgaggatgatcagagaccagtgtgtctcgtgtgccgtgaaagccaagagcaccagacgcatgcaatggctccaatcgacgaggcctttgaaagctatcgcaccgggaattttgacattcatgtggacgagtggaagaggagactgatccgcctgcttctgtatcatttcaaacaggaagaaaaactgcttaagagccagcgcaatctggtcgccaaaatgaaaaaggtgatgcatctgcaggatgtggaggtgaagaacgctacccagtggaaagataaaattaaaagccagaggatgcgtatcagcacggaatttagtaaattacataacttcctagtggaggaagaggacctttttctccagcgcctgaacaaggaagaggaggaaacgaagaagaaactgaacgaaaacactctcaagcttaatcaaacgatcgcctctctcaagaagcttatccttgaggtaggggaaaagtcgcaggcaccaactctggagctcttgcagaatccgaaggaagtattaactcggagcgagatacaggacgtcaattattctcttgaagcagtgaaggtcaagactgtatgtcaaattccgctaatgaaggagatgctgaagagattccaggtggcggtcaacttggcagaggacaccgctcatcctaagttggttttctctcaggagggccggtacgttaagaataccgcgtcggcatcttcctggccagtgttcagtagcgcatggaactacttcgcgggctggcgaaatccccagaagaccgcattcgtggaaagattccagcacctgccgtgtgtcctgggaaagaatgtgtttacctccggaaaacattactgggaggtggagtctcgcgatagtctcgaggttgctgttggggtttgccgcgaggacgtcatgggtatcaccgatcgctccaaaatgagtccagatgttggaatctgggccatctactggtccgccgcagggtattggccactgataggatttccggggacacctacacagcaggaaccagccctccaccgagtgggggtatacctggatcgtgggactggaaacgttagcttctacagcgctgttgatggtgttcacctgcacaccttcagttgtagctcagtgagcagactgcgcccatttttttggttgagcccactggctagcctggttatcccacctgttacagataggaagtag

SEQ ID NO: 47644 - DNA, 993 bp, Artificial Sequence
  Description of Artificial Sequence: Synthetic coding sequence
atgaagaaggtgatgcacctgcaggacgtggaggtgaagaacgccacccagtggaaagacaagatcaagtcccagcgcatgcgcatatctaccgaatttagcaaactgcataactttctggtcgaagaggaagacctctttctacaacggttaaataaggaggaggaagagacaaaaaaaaaactgaatgaaaatacactgaaactcaatcaaactatcgcctccttaaagaagctgatactagaggttggggagaagtcccaggcccctactttggagctgcttcagaatcccaaggaggtcttgacccggtcggaaatacaggacgtaaactatagcctggaagctgtgaaagtaaagaccgtgtgccaaattcccctaatgaaggagatgcttaagcggtttcaagtggccgtgaatctcgctgaggacactgcccaccctaaacttgtgtttagccaggaaggtcgatatgtgaaaaatacagcctcggcatcttcatggcctgtgtttagctcagcttggaattacttcgctggatggcgcaacccccagaaaactgctttcgtagagcggttccagcatctgccatgtgtccttggaaaaaacgtattcacgagtggaaagcattactgggaagtggaaagccgggacagccttgaggtcgctgtcggggtctgcagggaagacgtgatgggcatcacggataggtctaagatgagtcctgatgttgggatttgggctatctactggagtgcggccggttattggcccctgattggttttcctggaacccctactcagcaggaacccgctctgcacagggtgggggtgtatttggaccggggaaccggcaatgtatccttttatagtgctgtggatggcgtacatctacacactttttcttgctctagcgtaagccggctccgacccttcttctggctgtccccattggcctccctggtcattcctcctgtcaccgataggaaatag

SEQ ID NO: 47645 - DNA, 1212 bp, Artificial Sequence
  Description of Artificial Sequence: Synthetic coding sequence
atgcacaacttcgaggaggagctgacctgccccatctgctacagcattttcgaggatccaagggtgctgccctgtagtcatacattctgcagaaactgcctggagaacatactgcaggctagcgggaacttctacatttggcggccactgcgaattccactaaagtgcccaaactgcagaagcattactgagatcgctcccaccggcattgagagcctccccgtcaattttgctctgagggcaattattgagaagtatcagcaggaggaccatcccgatattgtaacttgcccagaacactataggcagcctctcaatgtttattgcctccttgataagaaactagtttgtggccattgcctcacaattgggcaacaccacggccacccaatcgatgacctgcagtccgcttacctgaaggagaaagacacgccccaaaagcttctggagcaattgaccgatacacactggacagacttgactcacctgatcgagaaactgaaagagcagaagtcacacagcgagaaaatgatccaaggggacaaggaagctgtgctgcagtattttaaagagcttaacgacacccttgagcagaagaagaagtctttcctgaccgccctgtgcgatgtgggaaatctcattaaccaggaatatactccccaaattgagcggatgaaggagatcagggagcagcagctcgaactgatggcactcacaatttcactacaggaggagagcccactgaagttcttggagaaggtcgacgacgtgcgtcagcatgttcaaattcttaagcagaggccactccccgaagtccagccagtcgagatttatccccgggtgtctaaaatccttaaggaggagtggagtcgtaccgaaatagggcaaatcaaaaacgtactgatccctaaaatgaagatctcgcccaaacgaatgagctgcagctggcctggtaaggacgagaaagaggttgagttccttaagatcctcaatattgttgtcgtcaccctaatctcagtgatattgatgagcatactgttctttaaccaacacattataactttcctctctgaaattaccctcatctggttttccgaggctagtttgtctgtctaccagtccctatctaacagcctacataaagtgaagaatatactgtgccacatcttttacctgttgaaggagttcgtttggaagatcgttagtcactag

SEQ ID NO: 47646 - DNA, 345 bp, Artificial Sequence
  Description of Artificial Sequence: Synthetic coding sequence
atgcacaacttcgaggaggagctgacctgccccatctgctacagcatatttgaagatcctagagtgttaccctgttcacacaccttctgccgcaactgtctggaaaacatactccaggctagtgggaacttttacatctggcgaccactgcgaataccgctcaaatgtccgaactgtcgtagcattactgagatcgcaccgaccggaatcgagagtctgcctgtgaatttcgccttgcgagccataattgaaaaatatcagcaggaggatcaccccgatatcgtgacatgccccgaacactataggcagcctctaaacgtttactgcctgctggataaaaagtag

SEQ ID NO: 47647 - DNA, 468 bp, Artificial Sequence
  Description of Artificial Sequence: Synthetic coding sequence
atgcacaacttcgaggaggagctgacctgccccatctgctacagcatctttgaggatcccagggtcctgccatgctcccacactttctgtcgaaactgtctggaaaacatcctgcaggccagcggcaatttctacatctggaggcccttacgaatccccctcaagtgccccaattgtcggagcattactgagatcgcgccaaccggcatcgagagcctgccagtgaacttcgccctccgcgccatcatcgagaagtaccaacaggaggatcaccctgacatcgtaacgtgtccagaacattaccgtcagcctctaaacgtctattgcctgctcgacaaaaaactcgtatgtgggcattgcctgacaatcggccaacaccatggtcatcctatcgatgacttgcagtctgcctatcttaaggagaaggatacccctcagaagctcttggagcagctaacagatacatag

SEQ ID NO: 47648 - DNA, 534 bp, Artificial Sequence
  Description of Artificial Sequence: Synthetic coding sequence
atgcacaacttcgaggaggagctgacctgccccatctgctacagcatctttgaggacccgcgcgtgctgccatgtagccacacattctgtcggaattgtttagaaaacatcctgcaggcttccggcaacttctacatctggaggccactgcggattccactgaaatgccccaattgtcggtccataacagagatcgccccgacaggcattgagagtctgccagtgaactttgccttgcgagcgatcatagaaaaatatcaacaggaggaccacccagacattgtgacttgcccagagcactacagacaacccttgaacgtgtactgcctgctggacaaaaaactggtttgtgggcactgtctcacaattggtcagcaccacggccacccaatagacgatctacagagtgcataccttaaagagaaagatacccctcagaagcttctggagcagctgactgacacccactggacggatcttacccaccttatcgaaaagctcaaggaacagaagtctcacagcgagaaaatgtag

SEQ ID NO: 47649 - DNA, 336 bp, Artificial Sequence
  Description of Artificial Sequence: Synthetic coding sequence
atgcacaacttcgaggaggagctgacctgccccatctgctacagcattttcgaggatccacgcgtgttgccttgctctcataccttctgccggaattgcctcgagaacatcctgcaagcgtccggaaacttctatatttggcgtccgctgcggataccgttgaagtgccctaattgccggtctattaccgaaatagcccccacagggatagagtctttgcctgtgaatttcgcactgagagcaattattgagaagtaccagcaggaagatcatcctgacattgtcacatgccctgaacattaccgtcagcctctgaacgtttactgcctcctgtag

SEQ ID NO: 47650 - DNA, 972 bp, Artificial Sequence
  Description of Artificial Sequence: Synthetic coding sequence
atgcacaacttcgaggaggagctgacctgccccatctgctacagcatattcgaggatccccgggtgctgccttgctcccacaccttttgtaggaattgcttggagaacattctccaagcgtccggaaatttctacatttggaggcctcttaggatcccacttaagtgtcctaactgtaggtcgatcacagagattgctccaaccgggattgaaagcttgcccgttaatttcgccctgagagcgataattgagaaatatcagcaggaggatcatcctgacatcgtgacctgccccgagcactacagacagccattgaatgtttattgtcttcttgacaagaaactcgtctgtgggcactgtctgacaattgggcagcatcatggtcatcccatcgatgatctgcagagcgcctacctaaaagagaaggatacgccccagaaattactggaacaattaacagacactcattggactgacctcacccatctgatcgaaaaactaaaagaacagaagagccactccgaaaagatgattcagggagataaggaggccgtcctccaatactttaaggagctcaacgacacgctggagcagaagaaaaaaagctttttgaccgcactttgcgacgtgggaaatctcattaaccaggaatatactccgcagatagaacggatgaaagaaattcgggagcagcagctggagctgatggctctgactatcagtttacaggaagagtccccgttaaagttcctcgagaaagtagatgatgttagacagcatgtgcaaattctaaagcagagacccctgccagaggtccagcctgtagagatataccccagggtgtcgaagatactcaaagaagagtggagtcgtactgagattggtcagattaagaacgtgctgatcccaaagatgaaaataagcccaaagcgtatgtcttgctcatggcctgacgaaggaactgataaatag

SEQ ID NO: 47651 - DNA, 1380 bp, Artificial Sequence
  Description of Artificial Sequence: Synthetic coding sequence
atggccggcctgaagcggcgggtgcccctgcacagcctgcggtactttatatccatggtgggcctcttctctaagccaggcctcctgccttggtatgcccgaaatcctcccggttggtcacagctgtttctaggaacagtctgtaagggtgactttactcgggtgatagccacaaaatgtcaaaagggacaaaagtcacagaagaaacctagccacctgggaccattggacggatcatggcaggagagactagccgacgtggtgacacccttatggagactgtcctatgaggagcagctgaagcccgtgatcaatgggtatcggaacaagagcaccttctccgttaacagaggccccgatgggaaccccaagaccgtcggtttctacctgggaacctggcgtgacggcaatgtggtatgtgttcagagcaaccatctgaagaacatccccgaaaagcatagccaggtcgcccagtactatgaggtcttccttaggcagagccctctggagccatgtttggtgttccacgagggcgggtactggcgtgaactcacagtgcgcacaaactcacaagggcatacgatggcaatcattacgtttcacccacaaaaactgtcccaagaggaactgcacgttcagaaggagatcgtcaaggagtttttcattagggggcctggggctgcctgcggactcacgtccctctacttccaggagtccaccatgacacggtgcagtcaccagcaatctccataccagctcctattcggggaaccctacatatttgaggagttgctttcacttaagatcaggatctctccagacgcgttcttccaaatcaacacagccggagccgaaatgctgtacagaacagtgggtgaactgaccggcgtgaactcagatactatcttgcttgacatctgctgcgggactggggtcattggactgagtctcgcgcagcacacttctcgtgtgcttggaatagagctgctggaacaggccgtagaggatgccaggtggaccgccgcctttaatggtatcaccaatagtgaatttcacacaggccaggctgagaagatcctgccggggctgctcaaatccaaggaagacggccagtctatcgtggccgtcgtaaacccggctagggccggactccactacaaagtgatacaagctatccgcaactttcgcgcaatccacactttagtattcgtgagctgcaagctgcatggcgaaagtacccgcaacgtgatcgagctttgctgcccccctgaccctgcaaagaaactgctgggcgagccctttgtgttgcagcaggccgtcccagtggatcttttcccacataccccccattgcgagctcgtgctgctgttcacgcggtag

SEQ ID NO: 47652 - DNA, 1485 bp, Artificial Sequence
  Description of Artificial Sequence: Synthetic coding sequence
atggccggcctgaagcggcgggtgcccctgcacagcctgcggtacttcatatctatggtggggctgttctccaagccaggcctgctaccttggtacgccaggaatcctccagggtggagccagctgtttcttggtacagtctgtaagggagactttacacgggtgatcgctactaagtgtcagaagggtcagaaatcccagaagaaacctagccaccttggaccccttgatggttcatggcaagaaaggctggccgacgtcgttacccctctgtggaggctgtcctatgaagagcagcttaaggttaagtttgccgcccaaaagaagatcctgcagcggctcgagtcttacatccaaatgctcaacggggtttcagttacgacagcggtgcctaagagtgaaaggctgagttgtctgctccaccctataataccctctcctgtcataaatggctaccgaaataagtccacgttcagcgtgaacagaggtcctgatggtaatcctaaaacagtgggcttttatctcggcacttggcgtgatggcaacgtggtatgcgtacagagtaaccatctcaagaatataccggaaaaacattcccaggtagcacagtattacgaagtgtttctgagacagtctccgctggagccttgcttagtcttccatgaaggcggttactggcgcgagctgacagtgaggaccaacagtcaggggcatactatggcgattattacttttcatccccagaagctcagccaagaagagctgcatgtgcagaaagagattgtaaaagaattcttcattcgcgggcctggggctgcatgtggtttgacgtctctatacttccaggaatccacgatgacaagatgctcccaccaacaatccccttatcagctgctgttcggtgagccctacatcttcgaagagctcctcagcctcaagatcagaatttctcccgacgcgttttttcagattaacactgccggcgccgaaatgttatatcgtactgttggggaactgaccggcgtgaactccgatacgattctcctggatatatgctgcgggaccggtgtgattggactgtcactcgcacaacacacaagtcgggtcttggggattgagttgctcgagcaagcggtcgaagacgcccgctggacagccgcgtttaatggcattactaactctgaatttcacaccggacaggccgaaaaaatcctccctggattgctcaaaagcaaggaggacggacagtcgattgtcgccgtagtgaaccccgcccgcgcagggttacactataaggtcatccaggctatcagaaatttcagagccatacacaccttagtgttcgtcagctgcaaactgcacggtgagtctacccggaatgtcatcgagaggagcctcatcttgcttgagtgctcaggaatggtgagcgcacactacagtttacaccttccaggttcgtcagactctcctgcctctgcgtcatag

SEQ ID NO: 47653 - DNA, 1515 bp, Artificial Sequence
  Description of Artificial Sequence: Synthetic coding sequence
atggccggcctgaagcggcgggtgcccctgcacagcctgcggtactttatttcaatggtgggccttttctctaaacccggcctgctgccgtggtacgccaggaatccacccggctggagtcagcttttcttaggtaccgtgtgcaaaggcgacttcaccagggtcatcgcaactaaatgtcagaagggtcagaagagccagaagaagccttcccatctgggccccctggacggctcttggcaagagcgcctcgcagatgttgtaactcccctatggcggctgtcgtatgaagagcaactcaaggtgaaattcgccgcgcagaagaaaatattgcagcggctggagagctatatccaaatgcttaacggagttagcgttaccacagccgtgccaaagtccgagagactgtcatgcctactgcatcctatcatccccagtccagtaattaacggatacagaaataagtcgacttttagcgttaataggggtcctgatgggaaccccaaaaccgttgggttctacttgggcacttggcgggacggcaacgtggtgtgcgtccagagcaatcacttaaagaacattcccgaaaagcattctcaggtagcacaatactatgaggtttttctgcgccagagtcctctggagccatgtctcgtgtttcacgagggcgggtattggagagaactgacggttcggacaaatagccagggtcataccatggccatcatcaccttccatccacagaaactctcgcaggaggaactgcatgtgcaaaaagaaatcgtgaaagaattttttatccggggacctggggccgcttgtggactcacatctctgtattttcaggaaagtacaatgactcgatgtagtcatcaacagagcccataccagctactgtttggggaaccctacattttcgaggaactcctgagtctaaagattcgcatatctcccgatgcctttttccagattaacactgctggggcagagatgctctatcgcaccgtgggagaactcaccggcgtcaacagtgatactattctgctcgacatatgctgtggtactggcgtgataggattatctctggcccagcatacctccagggtcctgggtatcgagctccttgagcaagcagtcgaggatgctcgttggacagccgcttttaacgggatcacaaactccgaattccatacaggccaggcggaaaagatcctgcctgggcttcttaaaagtaaggaggacggtcagtccatcgtggccgtggttaatcctgcaagggcgggtctacattacaaggtaatccaggccattagaaattttcgggctatacacactctggtgtttgtgagctgtaaactgcatggagagtcaacgcgaaatgtcatcgagctatgctgccctcccgaccctgccaaaaaattgttaggggaaccatttgtccttcagcaggcggtccctgtagacctttttcctcacacgccccactgtgagttggtgcttttattcacccgatag

SEQ ID NO: 47654 - DNA, 1515 bp, Artificial Sequence
  Description of Artificial Sequence: Synthetic coding sequence
atggccggcctgaagcggcgggtgcccctgcacagcctgcggtacttcatctcaatggtgggcctattctccaaacccggcttgctaccatggtacgcccggaaccctcccgggtggtcccagttattcctcggaactgtctgtaaaggggattttacgagagtcatagccaccaagtgccaaaagggccaaaagagtcagaagaaaccaagccaccttggccccctggacggctcttggcaggagcgactcgcagatgttgtcacccccctgtggcggttgagctacgaagagcagctcaaggtgaaattcgcagcccagaagaagatattgcagcgactggagagttacatccagatgctgaacggagttagtgtgacgactgcagtgcctaagagtgaacgattgtcttgcctccttcatccaattatcccaagtcctgtgattaatgggtaccggaacaaatcgactttctcagtgaatcggggccccgatgggaaccctaagacagtgggattttacttaggtacctggcgggatgggaacgtcgtgtgcgtgcagtcaaatcacctgaagaacatccccgagaagcacagtcaggtggcacagtattacgaggtgttcctgcgacaaagtcctctcgaaccttgcctggtgtttcatgagggggggtactggcgggagctgacggtgcgaaccaattcacaggggcacacaatggccattatcacattccacccacagaaactgtctcaggaggagctgcacgtacagaaggaaatcgtcaaagaattctttatcaggggacctggcgctgcctgcggactgaccagtctttattttcaggaaagcacgatgacacgttgtagtcatcaacagtctccatatcagctattgttcggcgagccttacatcttcgaggagctgctcagtctgaagattcgaatttcacctgatgcgttttttcagatcaacactgctggtgctgagatgctgtatcggaccgtaggagagctcactggggtcaatagcgatacaatcctgttagacatttgctgtggcacaggcgtcattgggctcagcctagcccagcacactagccgcgtcctgggcatcgagttgctggagcaggccgttgaggacgcgaggtggaccgccgctttcaatggcatcaccaattctgaattccataccggccaagcagaaaaaattctcccaggcttgctgaaaagcaaggaggatggacagtccattgtggccgtggtgaatccagcacgggccggtctgcactacaaagttatccaggctattcgtaactttcgagctattcacactctggtatttgtcagctgcaagctgcacggtgaaagcactagaaacgtcattgagttgtgttgtccccccgacccggccaaaaaactgctgggagagcccttcgtcttacagcaggcagttcctgtagacttatttccacacacccctcactgtgagctggtgttgcttttcacacggtag

SEQ ID NO: 47655 - DNA, 1380 bp, Artificial Sequence
  Description of Artificial Sequence: Synthetic coding sequence
atggccggcctgaagcggcgggtgcccctgcacagcctgcggtacttcatttctatggttggcttgttcagtaagcccggactgctcccctggtatgctcgcaaccctcctggttggtcccagctatttctgggcaccgtatgcaaaggtgatttcacaagagtcattgcaaccaaatgccagaaagggcagaaatcccagaagaagcccagccacctaggccccctggacggttcctggcaggaaaggcttgcggatgtggtgacaccactatggcgactgagttacgaggaacagctgaagcccgttatcaatggttatcgtaacaaaagcacattctctgtcaatagaggacccgatggaaacccaaagacagtgggattctacctgggaacctggcgcgacggcaacgtagtctgtgtgcaatctaatcacttgaaaaatatccctgaaaagcacagtcaggtcgctcaatactacgaggtcttcctccgccagtcccccctcgaaccttgcttggtcttccatgaaggtggctattggcgcgaactgaccgttcggacaaatagccaaggccatactatggcaatcattactttccatccgcagaaactgagccaggaggagctacatgtgcaaaaagagattgtgaaggagtttttcattcggggacccggggccgcctgtgggttgacatctctgtattttcaggagtcaacaatgacccgctgtagtcatcagcagtcgccctaccagctgctgtttggcgagccctacatatttgaggagctgctctcccttaagatccgaatcagcccggatgcattcttccagattaatacagcgggggccgaaatgctgtatcggacggttggggaattgaccggggtaaactccgatacaatcctgcttgacatttgctgcggaacgggcgtcatcggcctctcgcttgctcaacatacatcccgcgtgcttggaattgaactgttggaacaggctgtggaggacgccagatggaccgccgcattcaatggcattacaaatagtgaattccacactgggcaggccgaaaaaatattgccaggtctgctcaagtccaaggaagacggacagagcattgtagccgtagttaatcccgcccgggctggcctgcattataaagtcatacaagctatccggaactttcgagcaatccataccttggtattcgtgagctgtaaactgcacggagagagcacacggaatgttattgaactgtgctgtccacctgatcccgccaagaaactgctcggcgagcccttcgtcctgcagcaagccgtccccgttgacctgttcccccacacccctcactgtgagttggttctcctgtttacaaggtag

SEQ ID NO: 47656 - DNA, 1515 bp, Artificial Sequence
  Description of Artificial Sequence: Synthetic coding sequence
atggccggcctgaagcggcgggtgcccctgcacagcctgcggtactttatcagcatggtcgggttgttctcgaagcccggcctgttgccatggtacgctcggaaccctcccggctggagtcagctgttcctgggcaccgtctgcaagggagacttcacaagagtgatcgccactaagtgccagaaagggcagaagagtcaaaagaaacctagccatctgggccccctcgacggcagttggcaagaaaggcttgccgatgtcgttacacccttgtggagactgagctatgaagagcagctcaaagtgaagttcgctgcccagaaaaagattctccagcgactcgaaagttacattcaaatgttgaacggtgtgtcagtcactacagccgtgcccaaatctgagcgcctgagctgcctgctgcatccaatcattccttctccagtcatcaacggataccgcaataaatcaacattctctgttaacaggggtcctgatgggaatcccaagaccgtgggcttctacctaggaacttggcgtgacggcaacgttgtctgcgttcagtctaatcatctcaaaaatattccagaaaagcatagccaggtggcacagtactatgaagtttttctgcgccagtcacccctggaaccctgcctcgtatttcatgagggaggttactggagggagttgacagtccgcaccaactcccagggtcacacgatggccattattacgttccaccctcagaaattgtctcaggaggagcttcatgtccagaaagaaattgtgaaagaattctttatacggggccccggagccgcctgtgggctgacaagcctgtacttccaagagagcaccatgactagatgcagccaccagcagtcaccctaccagcttctttttggcgaaccatacattttcgaggagctgctgtcactgaaaattagaattagtccagatgcattcttccagattaacaccgctggagccgagatgttgtatcgtactgtaggagaattaactggcgtgaatagtgacacaatactgcttgatatttgttgcggcaccggggtcattggactttccttagcccagcacacaagccgtgttttgggaatcgagctgttggagcaggcggtcgaggacgctagatggaccgccgctttcaacggtataaccaactcagaatttcatacaggacaggcagagaagattctgccaggcctgctcaaatctaaagaggacggacagtccattgtggccgtggtgaacccagcccgagctgggctgcactacaaggtgatccaggctattcgcaactttcgggctatacatactctggtgttcgtctcttgtaagctgcacggtgagtccaccagaaatgtgatcgagctgtgttgtcctcccgacccagccaaaaagctactgggtgagcctttcgttctgcagcaggcggttccagtggacctgtttcctcacactccccattgcgagctcgtactactgttcacaagatag

SEQ ID NO: 47657 - DNA, 1542 bp, Artificial Sequence
  Description of Artificial Sequence: Synthetic coding sequence
atgagctacggcagcatcgcccggggcggcggcctgggcagccggggcccgtttggcgggccctcacgccagggctgccagccgcttgagtgcgctcggtgctggaccgaatatggaatacgccatttcccatgccccagccccgagtcaaaactccaaaatcggtgtgttggcaaagatggagagggtgaccttggccctgccggcacacccattgtccctcgtgcccgaaaaagaggcccaggagtcgcccctgaaggctctagaatgcccgaaccaacttcatcacccacaatcgggcctaggaaggacagcgccgcaggaccccacgggcgaatggctggcccctctactactcgtgccaaaaaacgcaagcccaatttctgtcctcaggaaacagaggtcctcgtttctaaggtaagcaagcatcaccaacttctgttcggtacaggtctgctgaaggccgagccgactcgcaggtatagagtgtggagtcgcattctccaggccgtcaatgcactgggatattgccgaagagatgttgtggatctgaagcataagtggagggacctgcgcgccgtggtgcgacggaaattaggtgacctccgaaaagccgcacacggaccatcccccgggtctggaaagccgcaagccttggcactgactccagttgagcaggtcgtggctaaaacgtttagttgtcaagctctgcccagtgaaggtttctctcttgagcccccgcgagccactcaggtggatccatgcaacctacaggagctttttcaagagatgtccgctaatgttttccgcataaactcatcagtcacctctctggagagaagccttcaaagtcttggaactcctagcgatacacaggagctgcgggattctttacacactgcccagcaggagactaataaaaccatcgcagcgagtgcatcaagtgttaaacagatggccgagttactccgaagctcctgcccccaggaaaggctccaacaggagcgccctcaacttgataggttgaagactcagctgagtgatgccattcagtgctatggagttgtacaaaagaagatagctgagaaatcccgcgccctattgccaatggcccagagagggtctaaacaatccccacaggcaccatttgccgagctcgctgatgacgaaaaggtgttcaacggctctgataacatgtggcaagggcaggaacaggctctgttgccagacataaccgaggaagatctggaggctatccggttaagggaagaagccattcttcaaatggaatcaaatctcctggacgtgaaccagattatcaaagatttggcctcaatggtgagcgagcaaggagaggcggtggactccatcgaggcaagtctggaggccgcttcaagccacgccgaggccgctaggcaacttttagccggagcgtctaggcatcagctccagagacataagattaaatgctgctttctgtcagcaggagtaaccgccctcctggttattataattattattgccacctccgttaggaagtag

SEQ ID NO: 47658 - DNA, 834 bp, Artificial Sequence
  Description of Artificial Sequence: Synthetic coding sequence
atgagctacggcagcatcgcccggggcggcggcctgggcagccggggacccttcggtgggccaagccgccaggggtgccagcctctggcaacccaggtggacccgtgcaatctgcaggaactgtttcaggaaatgagtgcaaacgtctttaggatcaactcctctgttaccagcctcgagcggtccctgcagtcactgggaactcctagcgatactcaggagctgcgagactcgctgcataccgctcagcaggagacaaataagactattgccgccagcgcctcttcggttaaacagatggccgaactgctccggtcttcctgcccagagagactccagcaggaaaggccacagctggatcgcctcaaaactcaattgtcagacgcaatccaatgttacggggtggttcagaaaaagatcgctgaaaagtctcgggcccttctcccaatggcacagcggggttccaagcaacagtcccctcaggctcccttcgcagagctagcagatgatgaaaaagtgtttaacggatccgacaacatgtggcaaggccaggaacaagcactgttgcccgatatcaccgaggaagacctcgaggccattagactgagggaagaggccattcttcagatggagtcgaatctgttggatgtcaatcagatcatcaaagacctggccagcatggtttctgaacagggcgaggcagtggatagcattgaagcctctctggaagctgcatcctcacacgcggaggccgctaggcagctactcgccggcgcttcaagacatcagctcatgagacggacgcgaccccccgccgcctgtggatgcccttag

SEQ ID NO: 47659 - DNA, 1542 bp, Artificial Sequence
  Description of Artificial Sequence: Synthetic coding sequence
atgagctacggcagcatcgcccggggcggcggcctgggcagccggggaccatttggaggaccttctcgccaggggtgtcagcccctggagtgcgcccgatgctggacagagtatggaattcgccactttccctgccccagtccagagtctaagctgcagaatcggtgtgtagggaaagacggagagggtgatctcggtccagcagggacaccaatcgtgccacgcgctaggaagcgtgggcctggggtcgcccccgaggggagccgcatgccagaacctacctcctcccccaccatcggtccaaggaaggactccgccgcgggtccgcatggccgaatggcaggcccgagcactacacgcgccaagaaaagaaagcccaatttttgcccccaggaaaccgaggtcctcgtgtctaaagtctccaagcatcatcagttactctttggcacagggctgctgaaggctgagcccacacggcggtaccgggtgtggagccggatcctgcaagccgtcaatgcactgggatactgtcgacgtgacgtggtcgacctcaagcataagtggcgagacctcagagccgttgtgaggagaaagctgggggacctccgcaaggccgcacacggcccgagtccggggagtggcaaaccccaagccttggcactgactcctgtggaacaggttgtggctaagacattttcttgtcaggctttgcctagcgaagggtttagtctggagcccccacgtgccacccaagtggacccttgtaatcttcaggagctgttccaggagatgagcgctaacgtgtttcgtataaattcttctgttacaagtctagagcgttccttacagtccctgggcactccttctgatacgcaggagctaagagacagcctccacactgcacagcaagagactaacaaaaccatagctgcaagtgcatcgtccgtgaagcagatggctgagctgctacggtcaagctgcccagagaggctgcagcaggaacggccacaacttgaccgccttaagacacagttgtcggacgccattcagtgttatggcgtagtacaaaagaaaatcgctgagaaatcccgcgccttactcccaatggcgcaaagaggcagcaaacagcagtcccctcaggctccatttgccgaactagctgatgacgaaaaggtgttcaacggatcggacaacatgtggcagggacaggagcaggccctattgcctgatatcactgaagaggatctggaggccatcaggttgcgtgaggaggcgatcctgcaaatggagagtaatctgctcgatgtcaaccagattatcaaggacctggcctccatggtgtcagagcagggtgaagccgtggactccatagaagcctcactggaagcagcatcgtctcacgctgaggccgctcgccagctgctggccggggcaagccggcatcaactgcagagacacaaaattaaatgttgctttctgtccgcaggtgtcactgcattgctggtcattatcatcatcattgcaacctctgtgcgcaagtag

SEQ ID NO: 47660 - DNA, 453 bp, Artificial Sequence
  Description of Artificial Sequence: Synthetic coding sequence
atgagctacggcagcatcgcccggggcggcggcctgggcagccggggaccgttcggtggccctagccggcaagggtgccagccactggaatgcgctcggtgttggacagagtatggaatccgccactttccttgtccttctccagagagtaaactccagaatcggtgcgtgggcaaggatggggagggtgacctgggccctgcaggaactcctatcgtgcccagggcccgcaagagaggacccggggtcgccccggaaggatcccgcatgcctgagcccacgtcctcccccaccatcggacccagaaaagacagcgctgctggaccacacggccgaatggccggaccaagtacgacccgcgcaaagaagcggaagcccaatttttgtccccaagaaaccgaggtgctggtctccaaggtgtctaagcatcatcaactactcttcggaacatag

SEQ ID NO: 47661 - DNA, 1539 bp, Artificial Sequence
  Description of Artificial Sequence: Synthetic coding sequence
atgagctacggcagcatcgcccggggcggcggcctgggcagccggggacctttcggcgggccaagtagacagggctgccagcctcttgaatgcgctagatgctggaccgagtacgggatccgccacttcccgtgtccttcacccgaatcgaaactccagaacaggtgtgttggaaaagatggagaaggagatcttggccctgccgggacccctatcgtaccccgggcccgaaagcggggcccgggagtagcccccgaaggatctcgtatgcccgagcccacttcttcaccgactattggtcctcggaaggatagtgccgctgggcctcatggaaggatggccggcccttcgaccacacgggccaagaaaagaaaaccgaatttttgtccacaagagaccgaggtcctggtaagtaaggtaagtaagcatcatcagctgttattcggaactggattgcttaaggcagagcctactagaagatacagggtgtggagccgaatcctgcaggcagtcaacgcactcgggtactgccgacgggatgtggtcgacttaaaacataaatggagggacctgagggcagtcgtacggaggaagctaggagacttgcgaaaggccgcacacggtccttcacctggatcgggaaagccgcaggccttggccttgactcctgttgagcaagtagtggcaaagacattcagttgccaggccctgccaagcgaaggttttagcctcgagcctccaagggcgacgcaagtggacccatgtaacctacaggagctgttccaggagatgtccgccaatgtgttcaggattaactccagcgtaacctcactggaacgatcactgcagtcccttggaacccccagcgatacgcaagagttacgggactctctgcacactgctcagcaggaaaccaataagactatagcagccagtgctagctcagtgaagcagatggcagaattattgagaagctcttgccccgaaaggttgcagcaagagaggccacagcttgacagactaaagacccaactttccgacgccatccaatgctatggagttgtgcagaagaaaatcgctgaaaagtccagagctctcctgccaatggcccagcgcggatcaaaacagtcaccccaggctccctttgccgagttggctgacgacgaaaaagtgttcaatggctccgataacatgtggcagggacaagagcaggccctgcttcccgacattaccgaggaagatctcgaggccatacgtctgcgggaggaagcaatcctgcagatggaatccaacctgctggacgtgaaccagataatcaaagacctcgcctctatggtttccgaacaaggcgaggccgtagactcgatcgaggccagcttagaagccgctagtagccatgcagaggctgcccgccagttgttagccggggcatccaggcaccaactgcaacgacacaaaataaaatgctgctttctgtccgctggtgtcacggcactgctggttatcatcatcatcatcgccactagcgtgcgtaaatag

SEQ ID NO: 47662 - DNA, 1686 bp, Artificial Sequence
  Description of Artificial Sequence: Synthetic coding sequence
atgagcaccgagcggaccagctggaccagcctgagcaccatccagaaaattgcgctgggtctgggcattcctgcttcagccactgtcgcgtatatcctgtataggagatacagggagagcagagaggagcggctcacctttgttggagaggatgatattgagatagagatgagagtgccgcaggaagccgttaagctgatcatcggacgccagggtgctaatattaaacaactgcggaaacagaccggcgcccgcatcgatgttgatactgaagacgtgggcgacgagagggtccttctgatcagcggattccccgtgcaggtttgtaaagctaaggctgcaattcatcagattctcacagaaaacaccccggtgtctgaacagctgtctgtgcctcagcgctccgtgggacgcatcatcggaaggggtggagagaccatcagatccatctgtaaagcatcgggcgccaagattacatgcgacaaggagtccgaggggacgctgctgctgtctaggttaataaagatcagcggtactcagaaggaagtggctgccgccaagcatcttattctggaaaaagtctccgaggacgaggagctccgaaagagaattgctcactccgctgaaacacgcgttccaaggaagcagccaatctcggtcaggcgcgaagacatgactgagccaggaggtgctggcgaacccgccctatggaaaaacaccagctcttccatggagccaaccgcccctctggtgacgcctcctcccaaaggcggtggcgacatggctgtggttgtgtcgaaagaggggtcctgggagaagcccagcgatgacagctttcagaagtccgaagcccaggctattcctgaaatgcccatgttcgaaatcccatccccagacttttcttttcacgcagacgagtacctggaggtatatgtctctgcttccgagcaccccaatcacttctggatccagattgtcggatctcggtcactgcaactggataagctggtgaatgaaatgactcagcactacgagaactctgtacccgaggatttaaccgtccatgtcggggacatagtggctgctccgctccctaccaatgggagttggtacagggcccgcgtgctcggaacgttagagaatgggaatctcgatctttactttgttgatttcggtgacaacggagattgccccctgaaagacctgcgtgccctgcggtctgacttcctgtctcttccgttccaagctatcgagtgctccttggccaggatcgccccaagcggcgatcagtgggaagaggaggctctggacgagttcgacagacttacccactgtgctgattggaagcctctggtggcaaagatcagctcctacgtgcagaccgggatctcgacctggcccaagatttatctgtacgatacctcaaatggaaagaagttggacatcggcctcgaactagtccacaaaggatacgcaatagagcttccggaggacatcgaagagaatcgagcggtgccagacatgctaaaagacatggccaccgaaactgacgcatccctgtctacattgctgactgagaccaagaaatctagtggggaaataacccatacccttagttgcctttctctgtctgaggctgcctctatgtcaggggacgacaacctggaggacgattatctgctgtag

SEQ ID NO: 47663 - DNA, 1674 bp, Artificial Sequence
  Description of Artificial Sequence: Synthetic coding sequence
atgagcaccgagcggaccagctggaccagcctgagcaccatccagaaaatcgccctggggctggggattcctgcctcagcgactgtggcatatatactctaccggagatatcgcgaaagccgggaagagaggctgacatttgttggcgaggatgacattgagatcgaaatgcgcgttccgcaggaagcagtgaagcttataatcgggagacagggagctaacatcaagcaaacaggcgcaaggattgatgtcgatactgaagacgtgggcgatgaacgagtcctcttgatctcagggttccccgtgcaggtgtgtaaagctaaggccgccatacatcagatccttactgagaacacgccggtcagcgagcagctgagcgtgccacagcgatccgtaggcaggatcatcggtcgggggggtgaaacaattcggagcatttgcaaggcttctggtgcaaagattacctgcgataaagagagcgaaggtacactcctgctttcacgcctgattaagataagcgggacgcagaaagaggttgctgctgcaaaacacttgattctggagaaggtgtccgaggacgaagagctacgaaaacgcatagcccacagcgctgagacaagagtgccccgcaaacagccaatctcggtgagaagggaggatatgacggagcccggtggggcgggagaaccagcactgtggaagaatacttcaagtagcatggagccaaccgcaccgctggtgactcctcctccaaagggtggaggagatatggcagtggtggtgtccaaggaagggagttgggagaagcccagcgatgactcttttcaaaagtcggaagcccaggctatcccagagatgccaatgtttgagattccaagccccgatttcagtttccacgccgatgagtatctggaggtgtatgtctccgcttctgaacaccctaaccacttttggatacagattgtggggtctagatccctgcagttggacaaactcgtgaatgagatgactcagcattatgaaaatagcgtcccggaagacttgacagtgcacgttggtgatattgttgccgccccattgcctaccaatgggagctggtatcgagcccgcgtcttaggtactcttgaaaacggcaaccttgacctttactttgtggactttggtgataatggcgactgcccactcaaggacttgcgtgccctgaggtccgacttcctaagtctccccttccaggcaatcgagtgttctctcgcaagaatcgctccgtcgggtgaccagtgggaggaagaggccctggatgagtttgacagactgacccactgcgccgactggaaacccctggtcgccaaaatctcctcctacgtccagacgggaattagcacctggccaaaaatatatctgtatgacacttccaatggaaagaaactggatataggacttgagctggttcacaaggggtatgctatcgagcttcccgaagacatcgaagagaaccgggcagtgcccgatatgctcaaagacatggccactgagaccgatgcaagtctgtctactctgctaaccgagactaagaagtcgtcaggtgaaattacgcacaccctctcctgtctttctctcagcgaagctgcctcaatgtctggagatgacaacctggaggatgattacctgctctag

SEQ ID NO: 47664 - DNA, 1686 bp, Artificial Sequence
  Description of Artificial Sequence: Synthetic coding sequence
atgagcaccgagcggaccagctggaccagcctgagcaccatccagaagatcgcccttggtcttggcatacctgcttccgccacagtagcctatatcctttaccggcggtatagagagtcacgcgaggaacggcttaccttcgtgggcgaggacgacatcgagatcgagatgcgtgttcctcaggaggctgtaaaactaattatcgggcggcagggggcgaatataaagcagctgcgaaaacaaactggagcccggattgacgtggatactgaggatgtgggagatgagagagtcctacttatctccggattcccagtgcaggtctgtaaggcgaaagccgccattcatcagattctaactgagaatacccccgtgtctgagcagctgagcgtaccgcagcgtagcgtgggccgaatcattggaagggggggtgaaaccatccgttccatctgcaaggcctctggcgccaaaataacctgcgacaaagagtcagaaggcactctcctcctgtcacgcctgattaagatctcaggaactcagaaagaagttgccgccgccaagcacctcatcttggagaaggtgtccgaagacgaagagctgcgaaagcggatcgcacactccgcagaaaccagagtgccacggaaacagcctatcagtgtcagacgcgaggatatgactgaaccgggcggcgccggggaaccagccctgtggaagaatacttctagctcaatggaacccacagctccattggttacaccaccaccaaaaggcgggggcgatatggcggtcgtggtgtctaaagaggggtcctgggagaagcccagtgatgacagcttccagaaaagtgaggctcaggctatccctgagatgccaatgtttgaaattcccagccccgactttagcttccatgccgacgagtacttggaagtgtatgtcagtgcttccgagcatcccaatcacttttggattcaaatcgtcgggtccagatcccttcagctcgataaattagtcaacgagatgacacagcattacgagaacagcgtgccagaagaccttaccgttcatgttggagatatcgttgcagcacccctgcccacgaacgggtcatggtaccgggcacgagtcctggggacactcgagaacggtaatctggatctgtattttgtggacttcggggacaacggagattgtcccttaaaggacctgcgggccctgcgatctgactttctgtccctcccttttcaggcgattgagtgcagcctggcccggattgcaccaagcggtgaccagtgggaggaggaggcccttgacgagtttgacagactaacacactgcgccgattggaagcccttggtggccaagatttctagctacgtccagaccggtatctccacctggcccaagatttatctatatgacactagcaacggcaagaaactcgatatcggactcgagctagtccacaaagggtatgctatagaattgcctgaggacattgaggaaaacagagcagtgccggatatgttgaaagacatggcaacagagacggacgcttcactgagtacgttgctgaccgaaaccaaaaaaagttctggcgaaatcacccataccctcagctgtctctccctctctgaagcggcaagcatgagcggggacgataatctggaagatgactacttactctag

SEQ ID NO: 47665 - DNA, 1551 bp, Artificial Sequence
  Description of Artificial Sequence: Synthetic coding sequence
atgagcaccgagcggaccagctggaccagcctgagcaccatccagaagattgctctcggcctaggcattccagcctctgcaacagtggcctatattctgtatagacgttaccgggaatccagagaagagagattaaccttcgtcggtgaagatgacatcgagattgaaatgcgagtgcctcaggaagcagtcaaactgattatcgggagacaaggcgccaacatcaaacaattaagaaagcaaacgggagctcgcatcgatgtagacacagaagacgtgggcgacgaaagggtccttttaatttccggattccccgttcaggcttccggagctaaaatcacatgtgataaagaaagtgaaggcacccttctcctgtctcggctgattaagataagcggcactcagaaagaggttgctgcggctaagcacctcatcctcgagaaagttagtgaggacgaagagcttcggaagagaatcgctcactcggctgagacaagggtgcccagaaagcaaccaatatcagttcgccgtgaggacatgactgagcccggaggagctggtgaaccagcactgtggaagaacacgtcctcctccatggaacctaccgcccccctcgttacccctcccccaaaaggggggggagatatggccgtcgtggtgagcaaggagggctcatgggaaaagccaagcgatgattccttccagaaatctgaggcccaagctatacccgaaatgcccatgttcgagataccgtcccccgacttcagtttccacgccgatgaatacctcgaagtttatgtgtcagcatcggagcatcctaaccatttctggatccagatcgtgggatctagaagcctgcagttggataaactggtcaacgaaatgactcagcattatgaaaatagcgttccagaagatctgaccgttcacgtgggtgatattgtcgctgctccactgcccacaaatggctcttggtacagggcgcgggtgctgggcacactggagaacgggaatttggacctgtactttgtggactttggagacaacggagattgtcccctgaaggacctacgtgcactaaggagcgactttctctcattacccttccaggccatagaatgcagcctggcgcggatcgcacctagcggcgatcagtgggaggaagaggccttagatgagttcgatagactgacgcactgcgctgattggaaacctttagtggcaaagatcagctcttacgttcaaactggcatttctacctggcccaagatctacctgtatgacacctccaatggaaagaaattagatattgggcttgagctcgtacacaaagggtacgctatcgaactgccggaggacatcgaggagaaccgtgccgttccagatatgttgaaggatatggccacagagactgatgcctcactgagcaccctgctcacagagaccaagaaaagttccggagagatcacacacacgctgtcttgtctgtccctgtccgaagccgcctctatgtctggtgatgataacttggaagacgactacctgctctag

SEQ ID NO: 47666 - DNA, 1686 bp, Artificial Sequence
  Description of Artificial Sequence: Synthetic coding sequence
atgagcaccgagcggaccagctggaccagcctgagcaccatccagaaaatagcccttggtctgggtattccagcctcagctactgtagcttatattctatacagaagatatcgcgagtcccgagaggaaagattgacattcgttggggaggatgacatagagatcgagatgcgcgtcccccaggaggccgtaaagcttatcatcggccgacagggcgccaatatcaaacagctccgcaagcagacaggggctaggatcgacgtagacaccgaagatgtcggcgacgagagagttctgctgatatcaggatttccagttcaggtgtgcaaagctaaagccgccatccaccagatccttacagaaaatacacccgtatcagagcagctatctgtgccccagcgatccgtcggcaggatcattggccgcggtggggaaactattcgctcaatttgcaaggcatccggagcgaagataacatgcgacaaagaatcagagggcactttgttgttaagtcggctgattaagatctcgggaacgcagaaagaagtggctgcggccaaacatcttattttggagaaggtttcagaggacgaagaattgcgaaaaagaatcgcacactccgcggagactcgcgtgccaagaaagcagcctatttctgtgagacgcgaagatatgaccgaaccagggggcgctggcgagcctgctctgtggaagaacacgtcgtccagcatggagccaactgcacctctggtgactcccccgccaaaaggagggggagacatggctgtcgtcgtaagtaaggaaggtagttgggagaaacccagcgacgattcgtttcaaaagagtgaagctcaggctattcccgaaatgcctatgtttgagataccctctccagacttctcattccatgccgacgagtatctggaggtgtacgtgagtgctagcgaacatccaaatcacttctggatccaaatcgtgggatctcgctcattacaactggataagttggtgaatgagatgacccaacattatgaaaatagcgtgcccgaggacctcaccgttcacgtgggggacattgtcgccgcccccctaccaactaatgggtcctggtaccgggcccgagttctcggaactcttgagaatggtaatctcgacctgtattttgtcgatttcggcgataacggcgattgcccgctgaaggatcttcgggccctcagatcagattttctgagtctccccttccaagccattgagtgttctttggctaggattgcaccatctggggaccagtgggaggaagaagcgctggatgagttcgaccgactgactcactgcgccgattggaaacctctggtggccaagatctccagctatgtgcaaaccggcatctccacctggcccaagatttatttgtatgatacaagcaatggaaagaagttggacataggtttagagcttgttcacaagggttatgctatcgaactccccgaggatattgaggagaaccgagcagtgccggatatgttgaaagatatggctacggagaccgatgcatccctgagcaccctgttgacggaaacaaaaaaatcgagtggcgaaattacccacactctcagttgcctcagcctcagcgaagcagcttccatgtccggcgacgataaccttgaggacgactacctgctctag

SEQ ID NO: 47667 - DNA, 1014 bp, Artificial Sequence
  Description of Artificial Sequence: Synthetic coding sequence
atgaccgagcccggcggcgccggcgagcccgccctgtggaagaacacatcaagctctatggagccaactgcccccctcgtaactcctcctcctaagggtggcggcgacatggccgtggttgtgtcgaaggaaggaagctgggagaagccatctgacgacagtttccagaagagcgaagcacaggctattcctgagatgcctatgttcgaaataccgtcacctgatttctcctttcatgctgacgaatatctggaggtgtatgtgagtgcatcagagcaccccaaccacttttggatccagatcgtcggatctaggagcttacagctcgacaagttagttaacgaaatgacgcagcactatgagaacagcgtgcccgaggatctgacggtccatgtaggcgacatcgtggccgccccactgcctacgaacggctcgtggtatcgggctagggtcctgggaactctcgaaaatggtaatctggatctttattttgtggactttggagacaatggtgattgtccactgaaggatctgcgagccctgaggtctgattttctgagtctaccatttcaagccatcgagtgttctctggctcgaatagccccctcaggagaccagtgggaggaggaggccctggacgaattcgaccgactcacccattgcgccgactggaagcccctcgtggcgaagattagttcctatgttcagaccgggatttcaacttggccgaagatttatctgtacgacacctcaaacgggaagaaactggacattggcctcgagctggtacacaaagggtatgctattgagcttccagaagatatcgaagagaacagggctgtccccgacatgctgaaggatatggccactgaaaccgacgcctctctgagcaccctccttaccgaaaccaaaaagtcgtcaggagagatcactcacactttgagttgtctgagcctgtccgaggccgcctcgatgagtggggacgacaacctcgaagacgattacctgctctag

SEQ ID NO: 47668 - DNA, 1686 bp, Artificial Sequence
  Description of Artificial Sequence: Synthetic coding sequence
atgagcaccgagcggaccagctggaccagcctgagcaccatccagaaaatcgctctggggctgggcatccccgcgagtgccactgtggcctatatcctgtatcgcagataccgggagagtagggaggagagactcaccttcgtcggagaggacgatatagagatcgagatgagagtacctcaggaagccgtaaaactaatcatcggccgacagggtgccaacatcaaacaactgcgtaaacagactggggcgagaatcgatgtggatacagaagacgttggcgacgagagggtgctcctgatctctgggttcccagtgcaggtatgtaaagcaaaggctgccatccatcagatactcacagaaaatactcctgtctctgagcagctgtccgtgcctcagaggtccgtgggcagaatcattggcaggggcggggagacaatccgaagcatctgcaaggcatcgggtgccaaaattacttgtgacaaagagtcggagggcaccctgctgctgtcgaggctgatcaagatctctgggacacagaaggaggtcgcagcagccaaacatctcatacttgagaaagtgagcgaggatgaggaactgaggaaacgcatagctcattcggccgagacacgggtgcctcgaaaacagcctataagcgtgcgccgggaggatatgacggaaccgggtggagctggggagcccgctctttggaaaaacactagcagcagcatggagcctacagcccctctggttacacctccccccaagggagggggggacatggcggtcgtagtcagtaaggaaggttcctgggaaaaaccgtctgacgatagctttcagaagagcgaggcccaagctattccagaaatgcccatgttcgagatcccatctcccgacttttcttttcatgcggatgagtatttggaggtatatgtctctgccagcgaacatcctaaccacttctggatccagatcgtgggtagtagaagcctccagcttgacaaactggtaaatgagatgacccagcattacgaaaattctgtgcccgaggatctgaccgtgcacgttggagatattgtcgcagcccccctgccaacaaatgggagctggtaccgggcccgggtcctggggacactcgagaacggtaacctagacctgtatttcgtagacttcggcgataacggggactgccctctaaaagacttgcgcgctctgcgcagtgacttcttgtccctgccttttcaggcaattgagtgctcgctggccaggatcgccccttccggagatcagtgggaagaggaagctttagacgagttcgatcgactgacgcattgtgccgactggaagcccctcgtggccaaaatttcttcctacgtacaaacaggcatctctacatggccgaaaatctatctttatgatacatcaaatgggaagaaactcgatataggactggagttggttcacaagggttacgctatcgagttgccggaagatattgaggagaaccgggctgtgccggacatgctcaaggatatggccacagaaactgacgcgtccttatctactctcttgactgaaaccaaaaagtcttctggcgagattacacacaccctttcctgcctttccctaagtgaagcagcaagcatgagcggcgatgacaaccttgaggatgattatctgctgtag

SEQ ID NO: 47669 - DNA, 396 bp, Artificial Sequence
  Description of Artificial Sequence: Synthetic coding sequence
atgagcaccgagcggaccagctggaccagcctgagcaccatccagaagattgccctgggcctgggcatccccgccagcgccactgtagcatacattctgtaccggaggtacagagagtcacgcgaggaaaggctcaccttcgttggggaagacgatatcgaaattgaaatgagggtgcctcaggaggctgtcaaattgatcatcgggagacagggggctaacatcaaacagctcagaaagcagactggcgccagaatcgatgtggacaccgaagacgtcggtgacgagagagtattgctgatctccggattccccgtgcaggtatgtaaggctaaggccgccattcaccagatcttaacagaaaatacccctgtgtcagaacaactctcagtctag

SEQ ID NO: 47670 - DNA, 1254 bp, Artificial Sequence
  Description of Artificial Sequence: Synthetic coding sequence
atggccctgaaggtgctgctggagcaggagaagaccttcttcaccctactggtcctcctcggatatctctcctgcaaggttacgtgtgagagtggagattgtcgccagcaggagtttagagatcgtagcggcaattgtgtaccgtgtaatcagtgcggtccaggcatggagttgagtaaggagtgcggattcggctatggtgaagatgcccagtgcgttacgtgccgcctgcaccgctttaaggaagattggggattccagaagtgtaagccctgtctcgactgtgccgttgtgaaccgattccagaaggctaattgtagtgccacgagcgacgccatctgtggcgattgtttgcccggattctaccggaagaccaagttggtggggtttcaggatatggagtgtgtcccttgtggcgacccacctcctccctatgagccccactgcgcttcgaaagtgaacctcgtgaagatcgccagtactgccagttccccacgggatacggccttggccgcagtgatttgtagcgctctcgccaccgtgcttctcgccctccttattctgtgtgtgatttactgtaagagacagtttatggaaaagaagccctcatggagtctccgaagccaggacattcagtataatgggtccgagttgagttgctttgatcgcccacagcttcacgaatatgcacacagagcatgttgccagtgtcggcgcgattcagttcaaacttgtgggccagttcgcctccttccctcgatgtgttgcgaagaagcttgctcccctaatcccgcaacattaggctgcggggttcacagtgctgcaagtctccaggctcgaaatgcggggccagctggcgagatggtgcccactttttttggaagcctgacgcagagtatctgcggcgagtttagtgacgcttggccactgatgcagaaccccatgggcggcgacaatatctccttttgtgacagctatcccgaactgacaggggaagatatccatagcctgaacccagaactagaaagttccaccagtctcgacagcaacagcagccaggatctggtcggcggcgccgtacccgttcagagccacagcgagaactttaccgccgcaaccgacctttctcgttataacaacacactggttgaatcagcctcaacacaggatgctctgacaatgcggtcccagttggatcaggaaagcggggcggtgatccaccccgcaactcagacctccctgcaagaggcatag

SEQ ID NO: 47671 - DNA, 1272 bp, Artificial Sequence
  Description of Artificial Sequence: Synthetic coding sequence
atggccctgaaggtgctgctggagcaggagaagaccttcttcaccctcctggttctgctgggctatctgtcctgcaaggtgacctgcgaaagtggggattgcagacagcaagaattccgggacaggtcaggtaactgcgtgccgtgtaaccagtgtggaccggggatggaacttagcaaagaatgcggttttgggtatggagaggatgcccagtgcgtaacttgccgcctacaccgcttcaaagaggactggggttttcagaaatgcaaaccttgtctggattgtgccgtggtgaacagatttcagaaggccaattgttctgcgacttctgatgccatctgcggtgattgtctaccgggcttttatagaaaaacaaagctggtgggattccaggacatggagtgcgttccctgtggggatcctccccccccctatgagcctcactgcgcctcaaaggtgaacctcgtgaagattgccagtactgctagttcacctcgggatactgccctcgctgccgtgatatgcagtgcactggctaccgtcctcctggccctgttgattctctgtgttatatactgtaagcggcaatttatggagaagaagccttcatggtctctgagatcccaggacatccagtataacggttcggaattgtcatgcttcgacagacctcagttgcacgagtacgcacatagggcatgttgtcagtgtaggcgggatagtgttcaaacctgtggccccgtaaggctccttccaagcatgtgttgtgaggaggcgtgtagcccaaaccctgctacgctgggatgcggagtgcatagtgcggcgagcttgcaagcgcggaacgccgggccggcaggcgaaatggtgcccacgttcttcgggtccctcacccagagtatttgcggcgagttttcagacgcttggcctctgatgcagaaccctatggggggggacaacatctctttttgtgatagctatcctgagctcactggcgaggacatccacagcctgaacccagagctggaatcttcgacttccctggatagcaatagttcccaggacctagtcggaggcgccgtccctgtgcagtctcactccgagaattttaccgccgccacagatctatcacgttataacaacacactggttgagtcagcatccacccaggacgccctgactatgaggtcccagcttgatcaagagtccggtgcagtaatacaccctgccacccagacgagcctacaagttcgccagaggctcgggtccctgtag

SEQ ID NO: 47672 - DNA, 1254 bp, Artificial Sequence
  Description of Artificial Sequence: Synthetic coding sequence
atggccctgaaggtgctgctggagcaggagaagaccttcttcaccttgctggtgttactggggtatctgagctgcaaggtcacatgcgagtccggcgactgccggcaacaggagtttagagaccgcagtggcaactgcgtaccttgcaatcagtgcggcccaggcatggagttgtcaaaggagtgcggctttggctacggagaagatgcccagtgcgttacatgtagacttcaccggtttaaggaggactggggcttccaaaagtgtaagccctgtttggattgcgcagttgtaaaccgattccagaaggccaattgttcagccacaagtgatgccatctgcggggactgcctgcctggattttataggaaaaccaaactcgttggctttcaagatatggaatgtgtaccttgtggtgatcctcctccaccttatgaaccacattgcgcctctaaagtaaacctggtgaaaattgcttctactgccagctccccacgcgataccgcacttgccgccgtgatttgttcggcactggcaacggtgctgctggcactcctgatcttgtgtgtcatctactgtaagcggcagttcatggaaaaaaagccctcatggtctctacggtcccaggatattcaatacaacggctccgagctatcctgcttcgataggcctcagctccacgagtacgcacacagggcctgctgtcagtgccgtagggattctgtgcagacctgcggccccgtccgcctgttacctagtatgtgttgcgaagaggcatgctctcctaacccagccacactcggatgcggcgtgcactcagccgcaagtcttcaagcgaggaacgctggcccggctggagaaatggttcccaccttttttggttccctaacgcagtcaatctgtggcgaattcagcgatgcctggcctctgatgcagaaccccatgggcggggacaacatatccttctgcgatagttacccggaacttaccggggaggacatccactccctgaacccagaactggagtccagcactagtctggactccaactctagccaggacctggttgggggggccgtgcccgtgcagagccatagtgaaaacttcacggcagctacagatctgtctcgatacaataacaccctggtcgaatccgcttcaacacaggacgctctgaccatgagatcacagcttgaccaagaatctggcgctgttatccatccagccacacagacttcattacaggaggcttag

SEQ ID NO: 47673 - DNA, 858 bp, Artificial Sequence
  Description of Artificial Sequence: Synthetic coding sequence
atggagtgcgtgccctgcggcgaccccccccccccctacgagccccactgtgctagcaaggtaaacttggtgaagatcgcttcaaccgcaagtagtccaagagacaccgcattggcggcagttatctgtagtgcccttgcaacagttctcctggcccttctgatactatgtgtgatctactgtaaaaggcaattcatggagaagaagccttcgtggtcgctgcgctcccaagatattcagtataatggcagtgagctcagctgcttcgatcgacctcagctccatgaatatgcacatcgcgcctgctgtcaatgccgcagagacagcgttcagacctgtggacccgttaggctgctgcccagtatgtgttgcgaggaggcttgttcacctaaccctgccacactgggatgtggagtgcatagtgccgcttctcttcaggcccgcaatgctggacctgctggcgagatggtgccaaccttctttggatctctgacccagtccatttgtggtgaattctccgacgcctggcctcttatgcagaacccaatgggaggggataacatcagcttttgcgatagttatcccgaactgacgggtgaggatatacattcccttaatccagaactggaatcatcgacatcactcgatagtaacagtagccaggacctagttggaggcgctgtacctgtgcagtcacactctgagaacttcacagctgctaccgacctgtcaaggtataataacactctggttgagtccgctagcacacaagacgctctgaccatgcggtcccagttggatcaggagtccggggctgtgatccaccctgccactcaaacatccttgcaggaggcctag

SEQ ID NO: 47674 - DNA, 570 bp, Artificial Sequence
  Description of Artificial Sequence: Synthetic coding sequence
atggccgccaagcagcccccccccctgatgaagaagcacagccagaccgacctggtcagtaggctcaagacaagaaagatcctgggcgttggtggcgaggatgacgacggagaagtccataggagcaaaatcagccaggtgctggggaacgaaattaaattcaccattagggaacctttaggactgagggtgtggcagttcgtgtccgccgttttgttctctggaatcgcgattatggcgttagcattcccagaccagctgtacgatgctgtctttgatggagcacaggtgaccagcaagacacctataaggttgtatggcggggcactgttgagcatcagccttataatgtggaacgcattgtataccgccgagaaggtcattatcagatggacactgctcaccgaggcctgttatttcggcgtccagtttttggtcgtgactgctacgctggctgagactggtctgatgagcctgggcattctcctgcttctggtctccagactgctgtttgtggtcatttcgatatattactactatcaggttggacgcaggcctaagaaagcatag

SEQ ID NO: 47675 - DNA, 411 bp, Artificial Sequence
  Description of Artificial Sequence: Synthetic coding sequence
atgaccaccggccggtgcatcgccccccgggtgtggcagttcgtgtctgcagtgctgttctctgggattgccattatggccctcgctttcccagaccagctgtacgacgcggtgtttgacggcgcccaggtgacttccaagactccgatccggctctatggcggagccctgctgagcatctcacttatcatgtggaacgccttatacactgcggaaaaggttataatccgctggacattgcttacggaggcttgctacttcggcgtacagtttcttgtcgtcaccgctacgctcgccgagaccggtctcatgagccttggcattctactgctgctggtcagcaggttgctatttgtggttattagcatctattattattatcaggttggtcgacggccaaagaaggcgtag

SEQ ID NO: 47676 - DNA, 570 bp, Artificial Sequence
  Description of Artificial Sequence: Synthetic coding sequence
atggccgccaagcagcccccccccctgatgaagaagcacagccagactgatcttgtttcgaggctaaagacgagaaagatattaggtgttgggggagaagacgatgacggtgaagtgcacaggagtaagatctcccaggtgctcgggaatgagatcaagttcacgattagggagcctctcggccttcgagtctggcagtttgttagcgccgtgctattcagcggcatcgcaatcatggccctggccttccctgaccagttatatgacgccgtgtttgacggagcacaagttaccagcaagacaccaattaggctctatggaggtgccctgctgtctatcagtttgatcatgtggaacgccctgtatactgccgaaaaggtgataatacggtggaccttactgaccgaagcgtgctacttcggagtacaatttcttgtggttactgcaacgctggcagagacaggcctgatgagcctgggcattctccttctgctggtgagtcgtctcctttttgtagttatctccatttactactattaccaggtgggcagaaggccaaaaaaagcttag

SEQ ID NO: 47677 - DNA, 570 bp, Artificial Sequence
  Description of Artificial Sequence: Synthetic coding sequence
atggccgccaagcagcccccccccctgatgaagaagcacagccagactgacttggtgtcccgtctgaagaccagaaagatactaggggtgggcggtgaggacgatgatggtgaggtgcaccggtccaagatcagccaagtgctcggaaacgagatcaaattcaccataagggagccacttggactgcgcgtgtggcaattcgtgtccgcagtgttgtttagtggaattgcaataatggctctggcttttccagaccaattatatgacgccgtcttcgacggtgcacaagttacaagtaagactccaatccgtctctacggcggagccctcttatccatttccctgattatgtggaatgccttgtatacggccgagaaagtgattatccgatggacactgctgactgaggcgtgctattttggagtccaattcctggtagttaccgctacactggccgagactggactaatgagcctagggattctccttctattggtatcccgacttttgttcgtggtaatctccatttactattactatcaggtaggtcgacgaccaaagaaggcttag

SEQ ID NO: 47678 - DNA, 297 bp, Artificial Sequence
  Description of Artificial Sequence: Synthetic coding sequence
atggccgccaagcagcccccccccctgatgaagaagcacagccagaccgatctcgtcagcagactgaagacccgcaagatcctgggcgtgggcggcgaggatgatgacggcgaggtgcataggagcaaaatttcacaagtcctggggaatgaaattaaatttaccattcgcgagccactgggattgcgggtgtggcagtttgtgagcgcagtgttgttttccggcattgccattatggcactagccttcccggatcagctgtacgatgctgtattcgatggcgcccaggtaacatag

SEQ ID NO: 47679 - DNA, 222 bp, Artificial Sequence
  Description of Artificial Sequence: Synthetic coding sequence
atggccgccaagcagcccccccccctgatgaagaagcacagccagaccgatctggtctctagactgaagacacggaaaattctgggggtgggcggcgaggatgatgacggggaagttcacagatcaaagattagccaagtgctcggcaacgaaatcaaattcactatcagagagcccctcggactgcgggtgtggcagttcgtctccgcagtgctgttttag

SEQ ID NO: 47680 - DNA, 477 bp, Artificial Sequence
  Description of Artificial Sequence: Synthetic coding sequence
atggccgccaagcagcccccccccctgatgaagaagcacagccagactgacctcgttagcaggctgaagacaagaaaaattctgggcgttggaggcgaggacgatgacggcgaggtgcataggagtaagatcagccaggtgctcggtaatgagattaaattcactataagggagccattgggcctgcgggtctggcagttcgtgagcgctgtattatttagcggcatcgccattatggcgttggcgttccctgatcagctctatgacgccgtcttcgacggggcacaggtgacatccaaaacccccattaggctatatggtggggccctcctgagcattagcctgatcatgtggaacgccctgtacacagccgagaaggtgatcattcgctggaccctgttaacagaggcttgttactttggagtgcagtttctggtggtgaccgccaccttagcagagaccggactaatgtcatag

SEQ ID NO: 47681 - DNA, 240 bp, Artificial Sequence
  Description of Artificial Sequence: Synthetic coding sequence
atggccgccaagcagcccccccccctgatgaagaagcacagccagaccgacctggttagtcgcctaaaaacccgaaaaatcctgggagtcggtggcgaggacgacgatggcgaagtacacaggtcgaaaatctcacaggtactaggaaacgaaatcaagttcacaatccgggagcctctcggactgcgcgtatggcaatttgtatcagccgtgctcttcagcgggatcgccattatgtag

SEQ ID NO: 47682 - DNA, 282 bp, Artificial Sequence
  Description of Artificial Sequence: Synthetic coding sequence
atggccgccaagcagcccccccccctgatgaagaagcacagccagacagaccttgtgagccgactgaaaacaaggaaaatattgggtgtagggggggaagacgatgatggagaggttcaccgcagcaagatttcacaggttcttggtaatgaaattaagttcacaattcgtgaaccactgggactccgagtttggcagtttgtgtcagctgtgcttttctccggtattgcgatcatggcactggcctttccagatcaattatacgacgccgtgtttgactag

SEQ ID NO: 47683 - DNA, 189 bp, Artificial Sequence
  Description of Artificial Sequence: Synthetic coding sequence
atggccgccaagcagcccccccccctgatgaagaagcacagccagactgacctggtctcccgtttaaagacgagaaaaatcctgggcgttggcggagaggatgacgacggagaagtgcaccggtccaagatctcacaagtcctcggcaatgagattaaattcaccatcagagagcccctcgggctgtag

SEQ ID NO: 47684 - DNA, 570 bp, Artificial Sequence
  Description of Artificial Sequence: Synthetic coding sequence
atggccgccaagcagcccccccccctgatgaagaagcacagccagaccgacttagtgagtaggctgaagacgcgaaaaattctgggagtcgggggggaggatgacgatggcgaggtgcatcgttccaaaatcagtcaggtcctgggcaacgagatcaagttcaccattcgggaaccactgggcctgagagtgtggcagttcgtctctgccgtactgttctcaggtattgctatcatggccctcgctttccccgaccagctttacgacgccgtgtttgacggagcccaggtcacatccaagacacctatcaggctgtacgggggcgcccttttatcgattagtttgattatgtggaacgccctgtataccgccgaaaaagtaataattcggtggaccttgctgaccgaggcgtgttatttcggcgtgcaatttttggtcgtcacagccactctcgcagaaacaggactaatgtcgttagggattctgctgcttcttgtatcaaggctgctgttcgtcgtgatctccatttattattactatcaagttgggcgaagaccgaaaaaagcttag

SEQ ID NO: 47685 - DNA, 1182 bp, Artificial Sequence
  Description of Artificial Sequence: Synthetic coding sequence
atggccccccccccccccagcccccagctgctgctgctggccgcccttgcacgtcttctcgggcctagcgaggtgatggcgggacctgcagaagaagcaggagcacactgtccagaatctctgtggcccctgccccctcaggtctcccctagagtgacgtacaccagggtgtctccgggccaagcggaggatgtgacctttctctaccatccttgcgcccacccatggctcaagctgcagctggcgctgctcgcatacgcctgtatggccaaccctagtctgacacccgatttttcattgacgcaagatagaccattagtactcaccgcttggggcctggctctggagatggcctgggtagaaccggcatgggccgctcattggcttatgagacgaagaagacgcaaacaaaggaaaaagaaggcatggatttattgcgagtccctgagtgggccagcccccagcgagccaactcctggtcgcgggcgtctgtgccgtaggggctgcgttcaggccctggccttagcatttgcactaagatcttggagacctccgggaactgaggttacctcccagggcccgcggcagccatccagctccggagccaagcgtcgaaggctcagagccgcattaggtccacagccaactagaagcgccctgaggttcccctccgcatctcctggatcccttaaagctaagcagtctatggctggcatccctggtcgagaaagcaatgccccctctgttcctacggtcagcctcctccctggggccccgggaggtaatgctagctcacgaactgaggcccaagtcccaaacggacagggctcccccgggggctgcgtttgctctagccaggcgtcacccgcccctagggcagcagccccacccagggccgcacggggccctacaccccgaaccgaggaggccgcctgggccgctatggctcttacgtttctgctggtgctgctgacactggccacactgtgcacgcgtctccacagaaacttccgacggggagagtctatctactggggcccaacagcagactcgcaggacacagttgccgcagtgttgaagcgacgacttttgcagccctcgcgacgggtgaaaagatccagaagaaggcctctgctcccgcccacacccgacagtggcccagagggcgagagctctgagtag

SEQ ID NO: 47686 - DNA, 414 bp, Artificial Sequence
  Description of Artificial Sequence: Synthetic coding sequence
gccaagcagagcatggccggcatccccggccgggagagcaacgccccgtctgtcccgactgtgagcctgctgcccggtgccccaggcggcaacgcaagtagcaggacggaggcacaggtgccaaacggccaggggccaagaggcctgtgtcttttcaagtctggctttccaggcccaagtagaagcagtccccgcgctgcaagaggccccaccccgcgcaccgaagaagccgcatgggctgccatggccttgacatttctgctagttcttctcactctggcaacactttgcacccgccttcacagaaattttcgcagaggtgagagcatatactgggggcccactgccgattctcaagatacaactccaccgcccgcccatgattccgggcccgagggcgagtccagcgagtag

SEQ ID NO: 47687 - DNA, 1605 bp, Artificial Sequence
  Description of Artificial Sequence: Synthetic coding sequence
atgcaggccgcccgggtggactacatcgccccctggtgggtggtgtggttgcatagtgtgccccacgtgggcctccgcctacaacccgtcaattcaacgttcagtcctggggatgagagctaccaagagtcactgctgttcctcggactggtcgccgcagtctgcctgggactgaacctgatattcctggtggcatatctggtgtgcgcttgccactgtcgccgcgatgacgcggtgcaaacaaagcaacaccattcgtgctgcataacgtggaccgcagtggttgctgggttgatctgctgcgctgccgtcggtgtgggtttctacggcaattctgaaactaacgatggcgcataccagctgatgtactcacttgacgacgccaaccataccttcagtggaattgacgcgctggtcagtggaactacccagaagatgaaagtagacttggaacaacacctggcaagactgagtgagatctttgccgcgaggggtgactaccttcagaccctgaagttcattcagcagatggctggatcagtcgtagttcagctctccgggcttcctgtctggcgtgaagtcacgatggaacttacgaagctgagcgaccagaccggctacgttgaatactatagatggcttagttacttgctgctattcattctagacttggtgatctgcctaatagcctgcctggggcttgcaaaacggagtaaatgtctactagcaagcatgctctgctgcggcgctttgtccctcctgttgtcttgggcgtcactcgctgctgacgggagtgcggcagtggcaacatctgatttttgcgtcgcgccggatacattcatactgaacgtgactgagggacaaatcagtactgaggtgacgcgctactatttgtactgctctcaatcaggctcttctcctttccagcagacactcacaacattccagcgggccctcaccaccatgcagatccaggtggccggcctacttcaatttgccgtacctttgttttcaactgccgaggaggatctcctggccatccagctgctgctaaatagcagcgagagttccctacaccagctgactgccatggttgattgtcgcgggctccacaaggactatctggatgctctcgctggtatctgctacgacggattacagggtctcctgtatctgggcttattcagttttttggcggcccttgcgttttcaacaatgatttgcgcaggacctagagcatggaaacactttacaaccagaaatcgcgattacgacgacattgatgacgacgatccattcaatcctcaggcgtggcgcatggccgcgcacagtccacccagaggtcagctacatagcttctgctcttactcatccgggcttggatcccaaacttccctgcagccaccagcccagacaatttccaatgcccccgtgtcagagtacatgaaccaggcaatgctgttcggtcgcaacccacggtatgagaatgttccactgattggccgggcctcccctccccctacatattctcctagcatgcgggctacttacctgtccgtagccgacgaacacctccgccactatggcaaccagttccctgcctag

SEQ ID NO: 47688 - DNA, 642 bp, Artificial Sequence
  Description of Artificial Sequence: Synthetic coding sequence
atgcagatccaggtggccggcctgctgcagttcgccgtgcccctgttttctaccgcagaggaggatctcctggcaattcagttattactgaactcttcggaatcaagtctgcatcagctcacagccatggtggattgtagaggactgcacaaggactacctggacgcgctggctggcatttgttacgacggtctccagggcctgctgtacttggggttgttcagctttctggcagccctcgcgttttcaactatgatttgcgccgggccacgagcctggaaacactttaccaccaggaatagggactacgacgacatcgacgatgatgatccgtttaaccctcaggcttggcggatggctgcccactcccctccgcggggccagttgcactctttctgttcctactcaagcggactgggcagccagacgtcccttcagcccccagcacagacgatttcaaacgccccggtctccgagtacatgaatcaggctatgctgttcggtcgtaacccccggtacgagaatgtgcctctgatcggtcgcgcatcccctcccccaacctactcaccttctatgcgggccacgtatcttagcgtcgctgacgagcatttgcggcactacggaaaccagttccccgcatag

SEQ ID NO: 47689 - DNA, 1572 bp, Artificial Sequence
  Description of Artificial Sequence: Synthetic coding sequence
atggccggcgtgagctacgccgccccctggtgggtgagcctgctgcatcgcctgccgcactttgatctgtcatgggaagccacctcaagccagttccgaccagaggatacagactatcagcaggctcttctccttttgggggcagccgccctggcatgtctcgccctggatctgttgttccttttattctactccttctggctgtgttgccgtagacgaaaatccgaggagcatttagatgctgactgctgctgcacagcctggtgcgtcattatcgccactttggtgtgtagcgcaggtatcgccgttggattctacggaaacggcgagactagtgacggtatacaccgcgcaacatacagcctgagacacgcgaatcgtacggtggctggggttcaggaccgggtgtgggatactgcggtagggctgaaccatacggctgagccatccttgcagacgctggagcgccaactcgctggaaggcccgagcctctcagagcggtgcagcgcctccaagggctgctggagacccttctggggtatacagctgccattccgttctggcggaacactgccgtaagcctggaggtgcttgccgaacaagtggacctctacgattggtatcgatggctggggtatctgggcctgcttctgcttgatgtcatcatctgtctgcttgtcctggtgggactgatacgctctagcaaagggatcctagtaggcgtgtgcctcctgggggttctcgccctggtgattagctggggggctttgggactggagctagctgtttctgtgggaagtagcgatttttgcgtcgatccagacgcttatgtcactaagatggtggaagaatattctgtcctgagcggagatattctacagtactatctggcatgcagccctagagcagccaacccttttcaacagaaacttagtggctcacacaaagcacttgtggaaatgcaggatgttgtcgccgagctgctcaggaccgtgccttgggagcagcctgcaacaaaggatcccttattacgggtgcaagaggttctgaacggaaccgaggtcaatctccagcacctgactgccctggttgattgtcgatccctgcatcttgattatgtgcaggcgctgaccgggttctgctacgacggggtggagggattgatctacctcgcactgttttctttcgtgaccgccttaatgttcagtagcatcgtatgttctgtgccccacacctggcaacaaaagcggggccccgacgaagacggcgaagaagaagcggctcctggacctagacaagctcacgacagcctttaccgagttcacatgcctagtttgtatagttgtggatcttcttatggatcagagactagcatcccagctgctgctcataccgtgagtaacgcccctgtgaccgaatatatgtctcagaacgcgaatttccaaaaccccaggtgtgagaataccccattgattgggagagagtcgccgccccccagttacactagctcaatgagagccaagtatctggcaaccagccagcctagacccgattcaagcggctcccactag

SEQ ID NO: 47690 - DNA, 1059 bp, Artificial Sequence
  Description of Artificial Sequence: Synthetic coding sequence
atgcccagcggcgtgcccggctgctggccccagctgcccctgaagggaccatggaggcctacccccaggccacgagtgcccgtgccatggcgaacccccagattcgcctgtcggtggctgggatacctgggcttgttgttgcttgatgtcattatctgtctccttgtgctggtgggcctcatccggagttctaaggggatcctggtgggtgtctgcctgctcggtgttcttgctcttgtgatttcctggggcgctctgggcctcgagttagcggtgtcggttggctcctctgacttctgcgtggatccggacgcgtacgtgaccaagatggtggaagagtactctgttctttctggcgatatcctgcagtactatctggcatgtagcccgcgtgccgctaatccgttccaacaaaagctgagcggaagccataaggctttggtggagatgcaggatgtcgtagctgaactgctcaggaccgtgccttgggagcagcctgccacaaaggacccactcttgcgtgtgcaggaagtcttaaatggcactgaagttaaccttcagcacttgacagccctggttgactgccgatctcttcacctggactatgttcaggccctcaccgggttttgctacgacggagtagaagggctcatctacctggccttgtttagctttgttaccgccctgatgttctctagcatcgtctgctccgtcccccacacatggcagcagaaacgcgggcccgatgaggatggtgaggaggaagctgctcccgggccgaggcaggcgcatgatagcctttaccgggttcacatgcctagtctatacagctgcggatcatcatatggttccgaaacctccataccggctgccgcccacacagtctcgaatgcccccgtcaccgaatatatgtcgcagaatgctaatttccagaaccccagatgtgaaaacacaccccttatcggcagggagtctcctcctccatcatacacctcctccatgcgtgccaagtacttagccacctctcagccaagaccagacagctcgggttcccactag

SEQ ID NO: 47691 - DNA, 1476 bp, Artificial Sequence
  Description of Artificial Sequence: Synthetic coding sequence
atggccggcgtgagctacgccgccccctggtgggtgagcctgctgcaccggctgcctcattttgatttatcttgggaagcaacttcaagccaatttaggcctgaagacacagattaccagcaggctctactgctactgggggcagcagccctggcttgcttggcactggatttactgtttcttcttttttatagcttttggctctgctgtcgtaggagaaagagtgaggaacatttagacgctgactgctgctgcactgcctggtgtgtgatcattgccactctggtttgcagtgccgggattgctgtcgggttttatggaaacggagaaacctctgatggcatccaccgagctacctattcactccggcacgccaatcgcacagttgccggagtccaggacagagtgtgggacactgcagtggggctaaaccatacggctgagcctagcttgcaaacgttggaaaggcagctggcaggccgtcccgaacctctccgtgcggtgcagcgactacagggcttacttgagaccttgctgggttataccgccgctatccccttttggcgcaacacagctgtcagcctggaggtgctggccgagcaggttgacctgtacgattggtaccgagtctgtttgcttggcgtcctcgctttggtcataagttggggtgctcttggattagagctcgcagtgtctgtcggctcttcggacttctgtgtggaccccgatgcgtatgttacaaagatggtggaggagtatagcgtgctctctggcgacattctccaatattacctggcctgtagccctcgcgccgctaatcccttccagcagaaattgtccgggagtcacaaggctctcgtggaaatgcaggatgtggtggccgagcttctgcgaactgtcccatgggaacagcctgctaccaaagacccgcttctgcgcgttcaggaggtgctgaacggcaccgaagtgaatctgcaacacctcactgccttagtggactgtcgctctctgcacctcgattacgtgcaagctctcacaggtttctgttacgacggcgtggaaggtctcatttatttagctctgttcagcttcgttaccgccctgatgttttcctccatagtgtgttctgtcccgcacacttggcagcaaaaacggggccccgatgaggacggggaggaagaagcggctcctggaccccgtcaggcccacgatagtctctatcgagtccacatgccaagtctctacagctgtgggtccagctacgggagcgaaacctctattccagccgctgcacacactgttagcaacgcacctgtgacagaatatatgtcccagaatgccaattttcagaatccccgctgcgagaatacacctctaatcggccgggaaagtcctccaccaagttacacctccagtatgcgcgctaaatacctggcaacctcccagcccagaccagatagctcagggagccactag

SEQ ID NO: 47692 - DNA, 609 bp, Artificial Sequence
  Description of Artificial Sequence: Synthetic coding sequence
atggccgagtacctggccagcatcttcggcaccgagaaggacaaggtcaactgttccttctactttaaaattggggtttgccgccatggcgacaggtgctcaagactccataacaagccgacattttcgcaggaggtattcactgagctccaagagaaatacggcgagattgaagagatgaatgtgtgtgacaacctgggcgaccatcttgtagggaatgtgtacgtcaagttcagacgggaagaggacggagagcgcgcagtcgctgaactgtccaataggtggttcaatggacaggccgtgcacggcaatgttcccgaggttgcctcggccacctcatgtatctgtggcccttttcccaggacctctcggggttcctcaatgggcggtgatccgggtgccggacacccaagaggtagcatactggcaaccatacccgagagagggacgattggcgtgccactcattacaggcatggccgcaagtgaagctctcgccccgctgccatttacgcctaacagggacaggtgtagttggcaggatttaagttccaaaccaccatcactttcttgccctatactgcctcggctcccaggctctatcatgtag

SEQ ID NO: 47693 - DNA, 546 bp, Artificial Sequence
  Description of Artificial Sequence: Synthetic coding sequence
atggccgagtacctggccagcatcttcggcaccgagaaggacaaggtgaactgttcgttctacttcaaaattggggtctgcagacacggcgatagatgtagccggctgcacaacaaacccacattttcccaggaggtgtttactgagctgcaggagaagtatggagagattgaggaaatgaatgtgtgcgataatctgggggatcatctagtaggcaacgtgtacgtgaagtttagacgtgaggaagatggggagcgagcagtggcagaattatccaataggtggttcaatggacaggcagtccacggggagctctcgcctgtgaccgatttcagagaatcatgttgtagacagtatgagatgggtgagtgcaccaggggaggattctgcaacttcatgcatctccgtcctatatctcaaaatctgcagcgtcaactttatggccgtgggccacgcagacggagtcctccgcggttccacactgggcatcatccccgcgagcggaaccaccgatgttctcctgatcactggcacggacgattttag

SEQ ID NO: 47694 - DNA, 552 bp, Artificial Sequence
  Description of Artificial Sequence: Synthetic coding sequence
atgtgcgccaccaccctgggcaccaccagctgggccaccagcatgtccagttctggcgggcgtaggatggaaagcggcccctggttaaattctgttaccgccgggtccactggacgactgtgtaccgggatgtatccaagatggctgttgcagctgcacgcgagcgccgcccacttccctgagcccccagaggctgccctctgggccggcacacaggcccaggtgccacaggatcaacccgcaatgtccccccacgtgctgagacccctctacccgcagatgtcacttacattgagcccaagcaatcacgtacccaaaaacttcttctttttcttctttttcgagatggagccccactcagtggcacaggccggggtgcattggcaccacctgggaagctggcagctgccccctccaggatttaagcagttcagcgcatccgcatctcaaatcgcaggaatcactggcacttgccatcacgcgagacttattttcgtattcctggtggaaatgggctttcaccacctggggcaggccggcttaaactcctag

SEQ ID NO: 47695 - DNA, 663 bp, Artificial Sequence
  Description of Artificial Sequence: Synthetic coding sequence
atggccgagtacctggccagcatcttcggcaccgagaaggacaaggtcaactgtagtttctatttcaaaattggtgtgtgtcgacacggtgacagatgctctcgcctccataacaagccaaccttcagccagaccattgtgctcttgaacctctatcgtaatccacagaacaccgcccagactgctgatgggtctcattgtcacgtgtctgatgtcgaggtgcaggagcactacgacagcttcttcgaggaggtattcacagagctccaggagaagtatggggagatcgaggaaatgaatgtgtgtgataacctcggagaccacttagtgggcaatgtttatgtgaaattcagacgcgaggaggacggagagagagctgtggcagagttgtccaatcgctggtttaatggacaggctgtgcatggcgaactgtccccagtgacagattttcgagagagttgttgtcgtcaatacgagatgggggaatgcacacgcgggggattctgcaatttcatgcacctgcggcccatttcacaaaacctccagagacagctttacggcagaggcccgcggaggcgttctcctcctcggttccataccggtcatcaccctcgtgagaggaaccatcgctgcagtccagaccactggcacggcaggttctag

SEQ ID NO: 47696 - DNA, 930 bp, Artificial Sequence
  Description of Artificial Sequence: Synthetic coding sequence
atgtgcttcttcttcagcctgcaggaggagttcctggacaagcacaccctcatgcgagtgctgagctcaggcggcaagctgggcagccgcggagagggagctcaactgtgttgctggatgctgctgttttcctggagagtctcaggaggtcagcaaacacgtaggctgtgcagaagagcattctgttggagccccgtgccgtcgccttcgtgttctcccagctcctgcctgaccgctcgcagcagcctttgtatgacattcacacagagccgtacaaccagctctctggccccagtcttcgcgttgttcgtccctttttactgttctattcctcgagtgcaagtagcacagattctcggacctctctccattaccaacaagactctgatctacatcctgggcctacagctcttcacctccgggtcgtacatttggatcgtcgccatttcaggactgatgagtggcctgtgttatgattctaagatgttccaggttcaccaagtgctgtgtattccctcttggatggccaagttcttctcatggacgctggaacccatcttttcctcttcagaacctacaagtgaggccagaataggaatgggagccaccctggatatccagcgtcaacagcgtatggagctcctggatcggcagctcatgttctcccagtttgctcagggacgccgacaacgtcaacagcagggtgggatgattaattggaatcggttgttccctccgctgcgccagagacagaatgttaactaccaaggcggaaggcagtctgagccagcggcccctcctttagaggtcagcgaggagcaggtggcaagactcatggagatgggcttctcaagaggcgacgccctggaggcactgcgcgcctctaataacgacctcaatgtggccactaatttccttctgcaacactag

SEQ ID NO: 47697 - DNA, 1035 bp, Artificial Sequence
  Description of Artificial Sequence: Synthetic coding sequence
atgttcaccagcaccggcagcagcggcctgtacaaggcccccctgtcaaagtctttgctactggtgccttccgctctgtctttgttgcttgccctgctgctgcctcattgccagaagctctttgtgtatgatctgcatgccgttaaaaacgattttcagatctggagactcatatgtgggagaatcatctgtttagatctgaaagataccttttgcagctctctgctaatctacaacttccgcatctttgagcgtcgatacgggtctcgtaagttcgcctctttccttctgggaagctgggttttgtctgcattgttcgatttcctgttaatcgaggcgatgcagtatttctttgggatcacggcagcctctaatctcccatccggatttttggctcccgtgttcgccttatttgtacccttttactgctcaataccacgggtgcaggtggctcagatcttaggtcccctctctattaccaacaaaactctcatctatatactcggcctgcaactttttacttctggctcttacatctggatcgtcgctatttccggtctcatgtcaggcctttgttacgattcgaaaatgttccaagtgcatcaggtgctctgcatcccctcttggatggcgaagtttttttcatggactctcgagcctatcttttcgtcctctgaacccacgtccgaagcccgcattggaatgggcgccactctggacatacagcgtcagcagaggatggagctattggaccgacagctgatgttctcccaatttgcccagggaagacgccagcgacaacagcaggggggaatgattaattggaatcgtttgtttcctcccctgcggcagcgccagaatgtgaactaccagggcggccgtcagagcgagcctgctgcgccgcccctcgaggtgtccgaggagcaggtcgcacgactgatggagatgggcttctcccgaggcgacgcacttgaagctctgcgggcctctaataacgaccttaacgttgccacgaactttctactccagcactag

SEQ ID NO: 47698 - DNA, 192 bp, Artificial Sequence
  Description of Artificial Sequence: Synthetic coding sequence
atggccgccgccaccctgaccagcaagctgtacagcctgctgttccggcgaacatctacctttgcgcttacgatcattgtcggcgtgatgtttttcgaacgagctttcgaccagggtgctgacgccatatatgaccacattaacgagggaaagctctggaaacacatcaagcacaaatacgaaaataagtag

SEQ ID NO: 47699 - DNA, 399 bp, Artificial Sequence
  Description of Artificial Sequence: Synthetic coding sequence
atggccgccgccaccctgaccagcaagctgtacagcctgctgttcaggcgtccacccccaagtccgtcaccctcatcatgggcaagctgcagttcatctgccccttcaatcaaggcaaggaccctgtccaccacaacatccacccgggggagctgtggcaacactagcagcacttctatgcgcacatcctcatcactcgaggcccccatccaggcaaggcgtactcgcagcacccagcagttatttgcccaaagctggagcctgtctctcaagatgatgcttaaggtgctctttatggaccaccatagtctgctggcacgtaacgggtttacatataagaccgattccttgccgtctgcggtctttgaagtgtgtttggtgagtatgctcagaaagtag

SEQ ID NO: 47700 - DNA, 189 bp, Artificial Sequence
  Description of Artificial Sequence: Synthetic coding sequence
atggccgccgccaccctgaccagcaagctgtacagcctgctgttcaggcgtactagcacttttgcactgaccattatcgtgggagttatgttttttgaacgggcttttgaccaaggcgcggatgcaatttatgatcacatcaacgagggcgtgagagcttgcgccattccggatttgggccctgcttag

SEQ ID NO: 47701 - DNA, 249 bp, Artificial Sequence
  Description of Artificial Sequence: Synthetic coding sequence
atggccgccgccaccctgaccagcaagctgtacagcctgctgttcagacggacaagtacatttgcccttacaattatcgtcggtgttatgttctttgagagggcgtttgaccagggagctgacgccatttacgatcatattaatgagggcgtgagagcatgcgccatcccgccctggacgcgactccgaggtgactccggagtagagaagctctggaaacacattaaacataagtacgaaaataaatag

SEQ ID NO: 47702 - DNA, 171 bp, Artificial Sequence
  Description of Artificial Sequence: Synthetic coding sequence
atggtgacccggttcctgggcccccggtaccgggagctggtgaagaattgggtgccgaccgcgtatacctggggtgccgtcggcgctgtcggtttggtgtgggccacagactggaggctgatcctggattgggtgccatatatcaacggcaaatttaagaaagataactag

SEQ ID NO: 47703 - DNA, 15531 bp, Artificial Sequence
  Description of Artificial Sequence: Synthetic coding sequence
atggccaccagcggcggcgaggaggccgccgccgccgcccccgcccccggcactcccgccaccggcgcagacacaacacccggatgggaagttgcagtccgccccctgctgagcgcctcttattccgcatttgaaatgaaagagttgcctcagttggttgcctctgttatagaaagtgagtctgagattcttcatcacgaaaaacagtacgagcctttttactcgagctttgtggcactgagtacccactatataaccaccgtgtgttcactcattccacgaaaccaactgcagagtgtcgccgccgcatgtaaggtcttgatcgagttttctctcctccgactagaaaaccccgatgaggcgtgcgccgtgtcgcagaagcacctgatcttactgatcaagggtctgtgtacaggatgttctagactggaccggaccgagatcattaccttcactgcaatgatgaaatcagcaaaactgccccaaaccgtgaaaactttgtcagacgttgaggaccagaaggagctggcgtcacctgtgtcaccagagttgagacaaaaggaagttcagatgaattttctgaaccagcttacatcagtgtttaaccctcgaaccgtggctagccagcctatctcgacacagaccctggtcgagggtgagaacgacgagcagagctccaccgaccaggcctctgctattaagacaaagaacgtattcatagctcagaatgtggcttctctacaagagctcggcggttcagagaagctcctgagagtctgtcttaacttgccatattttttacgctacattaatcggttccaagatgcagtgctcgcaaactcatttttcattatgcctgccaccgtcgccgatgccaccgccgtaaggaatggatttcattctctcgtgatcgatgtcacaatggcgctggacactctgtccctgcctgttctggaacccttaaacccttctcgcctgcaagacgtcactgtcttgtcgttgtcctgcctgtatgcaggcgtcagtgtcgccacttgtatggccattctgcacgtgggttcagcccaacaggtgcgaaccggttccactagttcaaaggaagacgattatgagtctgatgccgctacaattgtccagaagtgtctagagatctatgatatgattgggcaggcaatttctagttcccgacgggccggaggagagcattatcaaaatttccagttactgggcgcatggtgcctcctcaacagcctgtttttgatcctaaatttatcaccgacagccctcgccgataagggcaaagagaaggaccctctggccgctctgcgtgtgcgggacattcttagtagaaccaaagaaggggtcgggtcccctaagttggggcctggaaaaggtcatcagggcttcggagtcttgtctgttattctggctaaccacgccatcaagctcctgacaagcttgtttcaagacctgcaagtagaggccctgcacaaagggtgggagacagacggccctcctgccgctcttagcataatggcacagtccactagcatccaacgtatccagagactgatagactctgtgcccctaatgaaccttttgctgacccttctctcaacttcgtataggaaagcctgcgtcctgcaacgccagagaaaaggtagtatgagtagcgacgccagcgcatctaccgattccaacacatactacgaggatgactttagctcaaccgaagaggatagcagtcaggacgatgactcggagccaattctcggacagtggtttgaggagactatttctccatcaaaagaaaaggctgcccccccacctccacctccgccgccgccactggagtcctcaccgagggtgaagagcccatcgaaacaggctccaggcgaaaaggggaacatcctggcaagccgcaaggatcctgagttgttcttaggcttggccagcaacatattaaactttatcacatctagtatgctcaacagccgtaataactttattaggaattacttatccgtgagtctctccgagcaccatatggctacactggctagcatcattaaggaggttgataaggatgggttaaagggatcaagtgatgaagaatttgccgctgccttgtatcattttaatcactcgttggtgacctcagatcttcagtcaccaaatctccagaataccctgctgcagcaacttggagttgctcccttttccgagggcccttggccactgtatattcaccctcagagtcttagcgtactgtcaagacttcttctgatctggcagcataaagcatccgcccagggcgaccccgatgtccctgagtgtctgaaggtgtgggacagattcctgagcactatgaagcaaaacgctttgcaaggtgtcgttccttcagagacggaggatctgaatgtcgagcatctccagatgcttctacttatattccataacttcaccgaaactggccgtagggccatactaagcctgtttgtgcagattatccaggagttaagcgtcaatatggacgctcaaatgcgctttgtgcctctgatactggctagactgcttctgatcttcgactatctgctacaccagtatagtaaggccccagtttacctctttgagcaagtccagcataatctgctgagcccaccctttggatgggcaagcggttctcaggacagtaacagtcgcagggccaccactcctctataccacggattcaaggaggttgaggaaaactggtccaaacacttcagcagcgacgccgtcccacacccgagattttattgcgtactgtctccggaagcctctgaggacgatttgaatcggctcgactcagttgcgtgcgacgtgctgttttcaaaacttgtgaagtatgatgaactttacgctgctctgacagctctgctggctgccggatcacaattggacacagtgcgccgtaaagagaacaagaatgttacagccttggaagcctgtgccttacaatactactttttgatcctgtggcggattctcggtatccttcccccatcaaaaacatacatcaatcagctcagcatgaactccccggagatgtcggaatgcgatattctgcacacgctaagatggagctctcggcttagaatttccagttatgtgaactggataaaggaccacctcattaagcaaggtatgaaggcagaacatgcgagttctctattagagctggcctcgactactaagtgtagcagcgttaaatatgatgtcgagatcgtggaggagtacttcgccagacagatctcgagtttctgtagcatcgactgcacaaccatcctccaactccatgaaattccgagtctgcagtccatttataccctggacgctgcaatctcaaaagttcaggtctcattggacgaacacttctctaagatggctgcagaaaccgacccacacaaaagctccgagatcacaaaaaaccttctgcccgccactctgcagcttattgatacatatgcgtcattcactagggcgtacttgctgcaaaacttcaatgaggaggggaccaccgaaaaaccatctaaggagaaacttcaagggttcgcagcagtgctagcgataggcagttccagatgtaaggctaacactctcgggcccaccttggttcaaaacctgccatcttcagtgcagacggtttgtgaaagctggaataacattaacaccaacgagttcccaaacatcggctcttggcggaatgccttcgcgaacgatactatcccatccgagtcctatataagtgccgtgcaggctgctcatctcggcacactttgcagccagagcctacctttggcagcttcacttaaacataccctgttgagcctagttcgcctgaccggggatttgattgtctggtctgatgaaatgaacccgccccaggtgatacggacacttctaccgttacttttggagagtagtacggaatctgtggcggagatctctagcaatagcctggaaagaattctggggcctgcggagtctgacgagtttctggcccgtgtttatgagaaactgattaccggctgttacaatatcctggccaatcacgccgaccctaactccggcctcgacgagtccatactggaggagtgtctgcagtacctggagaaacagctggaaagttcccaggctcggaaagctatggaggagtttttctccgactcaggcgagcttgtgcagatcatgatggcaactgccaatgagaatctctctgccaagttctgcaatagggtcctcaagttctttacaaaactcttccaactgactgaaaaaagccccaaccccagtctactccatctttgcggcagcttggctcaacttgcctgtgtggaaccagtccgtttgcaggcctggctcacacgtatgactaccagcccgccaaaagacagcgaccaactggacgttatccaggaaaaccggcaattgctacagctgctcactacatatattgtgagagaaaattcccaggtgggagagggagtgtgtgcagtactactgggaaccttaacccccatggccactgagatgttggccaacggagacggcaccggttttccagagctgatggtggtcatggctaccctggcatccgccggccaaggcgccgggcacctgcagctgcataatgcagcagtggactggctgagtcggtgcaagaagtacctgtcccagaagaatgtggttgagaagctgaacgcaaacgtgatgcatggaaagcacgtgatgatactcgagtgtacttgccacatcatgagctacctcgcagacgtaactaacgcactctctcaatctaatgggcagggtccctctcacctcagcgtcgacggcgaggaacgtgctattgaagtggattccgattgggtcgaagaactcgccgttgaagaggaagacagccaggcagaggactcggatgaggatagtctctgtaataaattatgcacttttaccattacccagaaagaattcatgaatcagcactggtaccattgccacacttgtaaaatggtggacggggtcggggtgtgcacagtgtgcgcaaaagtatgccataaagatcatgagatctcatacgctaaatatggctccttcttctgtgactgcggggctaaagaggatgggagctgtcttgctctggttaagcgcacaccaagcagcggaatgagctcgactatgaaagaatcagcctttcagagcgaaccaagaatcagcgagagcttggtgcggcatgcctctacgagtagtcccgccgacaaggctaaagtcactatcagcgacggcaaagtagcggacgaggagaagccaaagaagtccagtctatgtcggacagtggaggggtgtagggaggagctgcagaaccaggctaacttttccttcgcccccctcgtcctagatatgctgaactttttgatggatgctatacagacgaacttccaacaggcaagtgcagtcgggagtagttctagggcacagcaggcactgtctgaactacataccgtagagaaggccgtcgaaatgaccgatcaactgatggtgcccactctcggtagccaggaaggtgcctttgaaaacgtacgcatgaattattcaggcgaccagggtcagactattaggcagttgatctctgctcacgtccttcgacgagttgccatgtgtgtgctaagcagccctcatggtcggcggcagcacctcgcggtgtcacacgagaaggggaaaataactgtattgcagctgagtgcactgctcaagcaggcagattctagcaagagaaagttaaccctgacacgcctggcttcagcccccgtcccgttcactgtgttgagcctgaccgggaacccttgtaaggaagattacctcgcagtgtgcggtctcaaagattgtcacgtcctaacgttcagttcgagcggcagtgtctccgatcatctggtactacatccacagctagccaccggaaatttcataatcaaggctgtctggctgccgggaagtcagacagagctggctatcgtaactgccgattttgtcaagatttatgacctgtgtgtggacgcattgagccccacgttttactttctactgccgtccagcaaaattcgcgatgttacgttcctctttaacgaggaagggaagaacataatagtgatcatgagcagcgccggatacatttatacccagctgatggaggaagccagcagcgcacaacagggcccgttctatgtaacaaatgtgctcgagataaaccatgaagacctgaaagatagtaattcccaagtggcaggtggcggcgtgagcgtgtactactcacacgtgcttcaaatgctgttctttagttactgtcagggaaaatccttcgctgctaccatttccagaacgaccctagaagtcctgcagttgttcccaataaacataaagtcatccaatggcggtagcaagacaagccctgccttgtgtcagtggtctgaggtaatgaatcatcccggtttagtctgctgcgtgcagcagaccactggggtccctctggtggttatggttaaaccggacaccttcctgatccaagaaatcaaaactctgcccgcgaaagccaaaatacaggatatggtagcaatcagacacaccgcttgcaatgaacaacaacgcacgacgatgatcctcctttgcgaagatggcagcctgcgcatctacatggctaacgtggaaaacacatcttattggctgcagccatcactgcagcctagctcagtcatcagtataatgaaacctgttcgcaaaaggaaaactgctactattaccacaagaacttccagccaggtgacattccccattgacttttttgaacacaatcagcagctgacggatgttgagttcggcggcaatgatctgctgcaggtgtacaatgcacagcagatcaagcaccggctgaactctaccgggatgtacgtggctaacactaaaccaggggggtttacgatcgaaatatccaataataattccacaatggtgatgacaggcatgaggattcagataggtactcaggccatcgaaagagcgccttcgtacatcgagatctttggtagaacaatgcagctgaaccttagtaggtctagatggttcgacttccccttcaccagggaggaagctcttcaggctgacaagaaacttaacctttttatcggtgcttccgtggatcctgccggggtgaccatgatcgatgctgtgaagatctatggcaagacgaaggagcagtttggatggcctgacgagccgcccgaggagtttcccagcgcgtcagtttcaaacatttgccccagcaaccttaatcaatctaatgggacaggcgacagtgactccgcggctcctaccactacttcgggcactgtgctggaacgactggtagtgagctctctagaggcacttgagtcttgtttcgctgtgggtccgattattgagaaggagcggaacaagaacgctgcacaagagctcgctactctgttactgagcctgccggccccggcgagcgttcaacagcagagtaagagcctgttagcatccttgcatacctcccgtagcgcctatcattcgcacaaggaccaggcactgctgtccaaagcggtgcagtgtcttaatacaagttccaaggaggggaaggatctcgatcctgaagtgttccagcggctggtgattacagctcggagtatcgcaattatgcgccctaacaatctcgtgcatttcaccgagagcaaattaccccaaatggagaccgattgtttcttcccccggtgcgcgtgttggtctctcggcatagtggggatattaatcggagcacctctggaaactcctagcccagagggcatggacgaaggaaaggagccccagaagcaactggaaggagactgctgctcttttatcacacagctggtgaaccacttctggaagctgcatgcctctaagcccaaaaatgcttttttggcaccagcctgtctccccggtcttacccacattgaagccacagtgaacgccctggtggacatcatccacggatactgcacatgcgagttggactgtatcaatactgcatcaaaaatctacatgcagatgttactctgtcctgaccccgcagttagtttttcctgcaagcaggccctaatcagggtcctccgtcctcgtaacaaaagacggcatgtgacgctgccatccagtccccgctcaaacacgcctatgggcgacaaagatgatgatgatgacgatgacgcggatgagaagatgcagtcttccggcatccctaatggtgggcacatccggcaggagtctcaggaacagagtgaagtggaccatggagattttgaaatggtctctgagtccatggtcctagaaactgccgaaaatgtgaataatggcaacccctccccgttagaagctctactagctggagctgaaggatttcctccaatgctcgatatccctcccgacgccgatgatgagaccatggtggaactggctatagctctgtcacttcaacaggatcagcaggcccccgcttctgacgacgagggatccaccgcggctaccgacggatctacattacgcacatcccccgccgatcatgggggaagcgtgggtagcgagtcaggaggttccgcagttgacagcgtcgccggtgagcactccgtgagtggaagaagttccgcctacggtgacgcaactgccgagggacatcccgccggcccgggctcggtaagctcatccacgggggccatatccaccacaacaggccatcaggagggcgacgggagtgaaggggaaggagaaggggaaaccgagggcgatgtgcacacctccaaccggctgcacatggtcagactcatgttattggaaagattattgcaaactctgccacagctgcgcaatgtgggaggcgtccgggcgatcccttatatgcaggtcattctgatgcttacgacagacctcgatggagaggacgaaaaagataagggggctctggacaacctgctctcccagcttattgccgaactcggcatggacaagaaagacgtctccaagaagaacgagcggtcagccctaaacgaagtgcacctggtggtgatgcgcctgttaagcgttttcatgtcacggaccaaatcaggttcgaaatcctccatatgtgagagttcctctcttatctcttccgccactgctgctgccctcctgtcttcaggagcagtcgactattgtttacatgttcttaaatctttgttagagtattggaagtctcaacagaacgatgaggagcccgtcgctactagtcagttgctgaaacctcacaccacatctagccctcccgacatgagtccattctttttgaggcagtatgtgaaaggccacgctgccgatgtcttcgaagcttatactcagttgctcacagagatggtgctgagattaccctaccagattaagaaaattacggacacaaattctaggatcccgccacctgtgtttgatcattcatggttctacttcttatcagagtatctcatgattcagcagacaccttttgtcagaagacaggtccgcaagctgctcctgttcatctgcgggagcaaggaaaaataccgacagcttcgcgatctgcacacgttggatagtcacgtgagaggcattaagaagttacttgaggaacaagggatttttctccgggcaagcgtggtgactgcatcctcgggatccgcattacagtacgacacacttatcagcctgatggaacatcttaaggcttgtgctgagatagccgcacaacgaactattaactggcaaaagttttgcattaaggacgacagcgtgctgtattttctgctacaagtcagtttcctggtggatgagggagtgtcacccgttctgctgcaattacttagctgtgcactttgtggatcaaaagtcctggcagcccttgccgcgtctagtggcagttccagtgcaagttccagttcagctccagtcgcagcaagtagtgggcaggcgactacacagagtaaaagcagtaccaagaagtccaagaaggaggagaaggagaaggagaaagacggagagacgtctgggtctcaggaggaccaattgtgtactgctcttgtcaatcagctgaacaagtttgcggataaggaaaccctgatccagtttttgcgatgttttctgttagagtccaacagttcctcggtgcgatggcaagcccactgcctgaccttacacatctaccggaatagctctaagtcgcagcaagagctgttgttggatctgatgtggagcatttggcccgagctgcccgcctatggaaggaaggcagctcagtttgtagatctgctggggtactttagcctgaagacccctcagacagagaaaaagctgaaagagtactcccagaaagctgtggaaattctaagaacccagaaccacatcctaaccaaccaccctaattccaatatttataataccctttctgggctggttgagtttgacggctactatctggaatccgacccctgccttgtctgcaacaaccctgaagtgccattctgttacattaagctgagctctatcaaggttgatactcgatatacaacaacgcagcaagttgtcaaactcatcggcagccacaccatctcgaaggtaaccgtaaagattggagatctgaagaggactaagatggtgcgcactattaatctttattataataaccggacagtgcaggctattgtcgaactgaagaacaagcccgccagatggcataaggccaaaaaggttcagctcacccctggccagacagaggtcaaaatcgacttgcccctcccaattgtggctagtaacctcatgatagagttcgcagatttctacgagaattaccaagcctccaccgagacattacaatgccccaggtgctccgcttcggtcccagctaaccccggcgtctgtggtaactgtggggaaaatgtgtatcaatgtcataaatgtcggagcatcaattatgacgagaaggatccgttcctttgcaatgcgtgcggattctgtaagtatgcacgtttcgactttatgttatacgcaaagccgtgctgcgcagtggacccaattgagaatgaggaagaccgcaagaaggcagtttccaatattaataccctgctagataaagccgatcgggtttaccaccagctcatgggccatagaccgcagctggaaaacctgctctgtaaggtgaacgaggctgcgccggaaaagcctcaggacgactccggaactgccggtgggatctcgtccacatccgcttcagtgaaccgctacattctccaactggctcaggagtattgcggagattgtaaaaactcatttgacgaattaagtaagattatacagaaggtctttgcatctagaaaggagcttttggaatatgacttgcagcagcgtgaggcggctacgaaatcttcccggacttctgtgcagccaacatttaccgcgagccaatacagagccctgagcgtactagggtgcggtcacacttcctctactaagtgctatggctgcgcctccgctgttaccgaacattgcattaccctgctaagggctttggcgactaacccagcccttaggcatattctcgtgagtcagggactgatcagggagttgtttgattacaatctgcgacggggcgccgctgctatgcgagaggaagtgcgccagctgatgtgcctgctgacacgggacaaccccgaggctacacagcagatgaatgatcttattatcggcaaggtctctaccgccttgaaggggcactgggccaaccccgacctggcctcaagccttcaatacgaaatgcttctcttgacggattcgatttctaaagaggattcctgttgggagctgagattaagatgcgccttgtcgctgtttttgatggccgttaacattaagactcccgtggtggtggagaacatcacgctgatgtgcctgagaatcctgcagaaacttataaagccgccggctcctacatctaaaaagaataaggacgtcccagtggaagccctcaccacggtgaaaccctactgtaacgagatccatgcgcaagcccagctttggctcaaaagagatccaaaagcatcctacgatgcctggaagaaatgcctcccaatcagggggatcgatggtaatggaaaggcccccagtaaatcggagctgagacatctgtatctgaccgaaaaatacgtttggcgctggaagcaatttctttctagacgaggtaaacgtacaagcccattggatctgaaactcggacacaacaattggctgcgccaagtactttttacacctgccactcaagctgcccgtcaggccgcctgcactattgtggaggcattagcgactataccttccagaaaacagcaggttctggatctattgacgtcttacctggatgaattgtccatagccggggagtgtgccgccgaatacctggccctgtaccagaaactcataacttctgctcattggaaagtctacctggcagcacggggagtcttaccatacgtaggcaaccttatcactaaagagatcgccaggctcctggctctcgaggaggccaccctcagtacagatctgcagcaggggtacgccctcaagtcactaaccgggctcctgagttcattcgtggaagttgaaagcataaagcgacacttcaaatcccggctcgtcggcacagtgcttaacggttatctgtgtctccgtaaattagttgtgcaacgcactaaactgatcgacgagacgcaagacatgctgctcgaaatgttggaagacatgactactggaactgaatccgagaccaaggcttttatggctgtatgcatagaaacggccaagagatacaatctcgacgactaccgaacccccgttttcattttcgaaaggctgtgtagcattatctaccctgaggaaaatgaggttaccgaattctttgtgaccctcgaaaaggaccctcagcaagaagacttcctgcagggcaggatgccggggaacccgtacagctccaatgagccggggataggaccgttaatgagagacatcaagaataagatctgccaggactgtgatctggtagcacttctggaggacgacagcgggatggagctgttagtcaacaataaaatcatttctctagacctgccagtagcagaagtgtataagaaggtatggtgtacaaccaacgaaggggaaccaatgagaatagtgtataggatgagagggctcctgggcgacgccaccgaagagtttattgagtccttggacagcaccactgacgaggaggaagatgaagaagaggtgtataagatggcaggagtcatggcacagtgtggtggcctcgagtgcatgcttaacaggttggccggcatcagggactttaagcagggccgccacctgctgacagtgctcctcaagctcttttcctactgtgtgaaagttaaagtgaacagacagcaattggttaagctggaaatgaacacgctgaatgtcatgttggggactttgaatctagcactggtggcagaacaggagagtaaggacagtggtggggctgccgtggctgagcaggtactgagtataatggagatcattttggatgagtctaacgccgagccactgtccgaggataaaggaaatttgctgctgaccggagataaagaccagctggtaatgctgctcgaccaaataaattcaacctttgtgagaagcaacccatctgttttgcagggattgcttaggattattccatatctgagtttcggtgaggtggagaagatgcagattctggtcgaaagatttaaaccttattgcaacttcgataaatatgatgaggaccactcaggggatgacaaagtcttcttggattgtttctgtaaaatcgcagcaggcattaaaaataactctaatggccaccagctgaaggacttgattttacaaaagggcatcacccagaacgcattggactatatgaaaaagcacattccttccgccaagaatctagatgccgacatttggaaaaaattcctatcacggccggcactgccatttatattgcgtctcttacgtggcctggccattcagcatcctggtactcaagttctaattggcacggactctatcccgaatctccacaaacttgagcaagttagcagcgatgaagggattggcaccctcgccgagaatcttctggaggcactcagggaacatcctgatgtgaataagaagattgatgccgccagacgggaaacccgggctgagaagaagagaatggctatggccatgcgacagaaagctttagggaccctggggatgaccactaatgaaaaaggacaggtggtgacgaagacagcgctcttgaagcaaatggaagaactgatagaagaacccggcctaacctgctgtatctgtagggagggttataagtttcagcccaccaaagtgcttggaatttatacctttaccaagagagtcgcgttggaggaaatggaaaataagccacgcaaacaacagggctactccacagtctcccattttaacatcgttcattatgactgccatttagcggctgtgcgactggcccggggaagggaggagtgggagtccgcagcccttcagaacgccaataccaagtgcaacggtcttttgccagtctggggcccccatgtgcccgaatcagctttcgccacatgtctggcccgccataatacatacctgcaagaatgtacggggcagcgcgagcctacctatcagctgaacattcacgacattaagttgctctttttgcggttcgccatggagcagagcttctccgctgatacgggagggggaggacgcgaatctaatattcacctgatcccttatatcattcataccgttctttacgtcctgaacacgacacgggccacttcccgagaggagaagaacctgcagggcttcctcgagcagccaaaggagaagtgggtagagtcagccttcgaggtcgacggcccatattatttcacagtgctggccctgcacattctcccacccgagcagtggagggcaactcgagtggaaattttgcgtagactgttagtgaccagccaagcccgggcagtcgctcccgggggcgctacccgcctaacagacaaggctgtgaaggactacagcgcctataggtcatcactattgttctgggccctggtagacctgatttataacatgttcaagaaagtgcccacatctaatacagaaggcggatggtcttgtagcttggcagaatatattaggcataacgacatgcccatctatgaagccgccgacaaagccctgaaaactttccaggaagaattcatgcctgtggaaacattctctgaatttctggatgtggctggacttctaagtgagatcacggaccccgaatccttcttgaaagacctcctgaactctgtcccctag

SEQ ID NO: 47704 - DNA, 639 bp, Artificial Sequence
  Description of Artificial Sequence: Synthetic coding sequence
atggtgcggaccatcaacctgtactacaacaaccggaccgtgcaggccattgttgaactcaagaataaacccgctcggtggcataaagccaagaaggttcaactgaccccggggcagacagaggtcaagattgaccttcccctccccatagtagcctcaaatctcatgatagagttcgccgatttctatgagaattatcaggcctccactgaaactctgcagtgcccacgttgctccgcctcagtccccgccaacccgggcgtgtgtggcaattgcggcgaaaacgtttatcagtgccacaaatgcagaagtatcaactacgacgagaaggacccctttctgtgcaatgcctgtggcttttgcaagtacgcccgtttcgactttatgctctacgccaaaccttgctgcgcagtggatcccatcgagaacgaagaggataggaaaaaggccgtctccaacatcaacaccttgttagataaagcagacagggtctatcaccagcttatgggccatcggccccagctcgagaacctgctatgcaaagtgaatgaggccgctccagagaaaccgcaggttgtccctcgatgcaaaggtcatctagataaggggcttggcctggaccaaaaaacggcctcgtag

SEQ ID NO: 47705 - DNA, 2673 bp, Artificial Sequence
  Description of Artificial Sequence: Synthetic coding sequence
atgctggaggacatgaccaccggcaccgagagcgagaccaaggcctttatggcagtgtgtatcgagactgcgaaaaggtacaatttggacgattacaggacccccgtctttattttcgagaggctctgctccattatctatcctgaagaaaatgaagtgacagaattcttcgtgacccttgaaaaggaccctcaacaggaagacttcctccagggaaggatgcccggcaacccctatagctccaatgaaccaggaatcggccctctgatgcgggacattaaaaataaaatttgccaggactgtgatctggtggcactcctggaggatgacagtgggatggagctgttggtgaacaataaaatcatcagcctcgaccttcctgtggcagaggtatataaaaaggtgtggtgtactaccaacgaaggggaaccgatgcggatcgtgtaccgcatgcgggggctactcggcgacgccacagaagaatttatcgagtctcttgattctaccactgacgaagaggaggacgaagaggaggtttacaagatggccggcgtcatggcccagtgtggcggtctcgagtgcatgttgaatcgcctcgctggtattagagacttcaagcaggggcggcatctgctcacagtgctcttgaagctattttcatattgcgtgaaggtgaaggtgaaccgacaacaactggttaagctggagatgaacacgctcaacgtgatgctgggcacacttaacttggctttggtggcagagcaggaatccaaggatagtggcggcgctgcagttgccgagcaagtcctgtcaattatggaaatcattctagacgagagcaacgccgaaccactctcagaggataagggcaatctactcctgacaggggacaaagatcaacttgtcatgctcttagatcaaatcaattctactttcgttcggtctaaccccagcgtcctccagggcttactgcggattataccttatttatcttttggggaggtggaaaaaatgcagatcttagttgaaagattcaaaccatactgcaactttgataagtacgatgaggatcatagcggagacgataaagtgttcctcgactgtttctgtaagatagcagctgggataaaaaataactccaatgggcaccagctgaaggacctcatactgcagaaaggcattactcagaacgcgttagattacatgaaaaagcacattcccagcgccaaaaatctggacgcagatatttggaagaaattcctcagccgtcccgcgctgcctttcatcctccgtctcctgagaggtctagcgatacaacatccagggacacaggtgctgataggcactgattccatccctaacctgcacaaattagaacaggtgtcctctgatgaggggatcggtacactcgccgaaaatttgctcgaggcgcttcgggaacacccggacgtcaacaaaaagattgacgccgctcggcgggaaacccgcgcagaaaagaagcggatggcgatggctatgagacaaaaggcactcggaacactgggcatgactactaatgaaaaaggtcaagttgtgacaaagactgccctactgaaacagatggaagagctgatcgaggagccaggcttgacttgctgcatttgccgggagggttacaagttccaacccacaaaagtactcggcatctataccttcacaaaaagagtggcgctggaggagatggagaataagcccaggaagcaacaaggctattctaccgtcagccactttaacatcgtgcattatgactgtcacctggccgcagtcaggctcgctcggggcagagaagagtgggagagtgcagcgctgcagaatgccaataccaagtgtaacggactcctgcctgtatggggccctcacgtccccgaatccgcatttgctacctgtctggcccgccataatacatacctgcaggagtgtactggccaaagggaacctacgtaccagctgaacattcatgacattaaactactcttcctgagattcgccatggaacagtccttctctgccgataccggcggaggcgggagggagtccaatatccacctcatcccatacattatacataccgtgttatatgttctaaataccacccgcgccacaagcagagaagaaaagaatctccaggggtttctggaacagccaaaagagaagtgggtggagagcgcttttgaagtcgatggaccctactatttcacagtcctagctctgcatattctcccacctgagcaatggagggccacaagggtcgagattctccgcagactgttggtaacttcccaagcccgtgccgtggcccccggcggagccactaggctgaccgacaaggccgtgaaggactattctgcctacagatcatcgctcctattctgggccctcgtggacttgatctataacatgttcaaaaaggtacctaccagcaatacggagggcgggtggagttgctcccttgccgagtatatccgccacaatgatatgcccatatacgaagccgccgacaaagcccttaagacttttcaagaagaatttatgcccgtggaaacctttagtgagttcctagatgtggccgggctgctgagcgagattaccgaccctgagtccttccttaaggatttgttaaactctgtaccctag

SEQ ID NO: 47706 - DNA, 777 bp, Artificial Sequence
  Description of Artificial Sequence: Synthetic coding sequence
atgggccccggcaagaagggccggtgccgggaggagggccccggccgcggtcgtcgtgcatggataatccgagggagtggctctagtcggcaagggtgggttggcagcgttgagagttccaaacgttctgcgaatgtcacaaggcagaggcagatcgagcagattttaccagcgctggctgcaggaagctgtttccatcccgcctttatcctgtcgtgcagatttagctctcgcactagagccacatcccgcgaggagaaaaacttgcagggctttcttgagcagcctaaagaaaagtgggtggaaagcgcttttgaggttgatggtccatattactttactgtgctggccctccatatcctgccccccgagcaatggcgtgccacgcgggtcgagatcttgcgacgtctgctagtcactagccaggctcgcgccgtagccccggggggggccactagacttaccgacaaagcggtgaaggattacagcgcctatcgctcatccctcttattctgggcactggtcgacctaatctacaacatgttcaagaaagtgccaacttccaataccgagggcggatggtcctgcagtctagccgaatatatccgccacaatgacatgcctatatacgaagctgcggataaagctctgaaaacctttcaggaggagttcatgccggtggaaaccttctccgagttcctcgacgttgccggcctgttgagtgaaattaccgaccccgagtccttcctcaaagacctcttaaatagcgttccatag

SEQ ID NO: 47707 - DNA, 15480 bp, Artificial Sequence
  Description of Artificial Sequence: Synthetic coding sequence
atggccaccagcggcggcgaggaggccgccgccgccgcccccgccccagggaccccagccactggcgcggacactaccccaggctgggaggttgcagtccgcccgttgctgagtgcatcctacagtgcattcgagatgaaggagttgccgcagttagtggcctccgttatagaaagtgagtcggaaattttgcaccacgagaagcaatacgaacctttctattcttcttttgtggctttatcaactcactacatcactaccgtctgtagtttaatcccgcgaaatcaattacagagcgtggcagccgcctgcaaagttttaattgagttttcgctgttaagattggagaatccagatgaagcttgcgccgtaagccagaagcatctgatcctgcttattaaagggctgtgcacgggatgttccaggctggatcgcactgagattatcacattcaccgctatgatgaaaagcgcgaagcttcctcagactgttaaaactcttagtgacgtggaggaccagaaggagttggcgagcccagtaagccccgagctaaggcaaaaagaagtccaaatgaattttctgaaccagctcacctccgtttttaatccaagaaccgtagcctcccagcctattagcacacaaaccctggtggaaggcgaaaacgacgagcaaagctccaccgatcaggcatccgccatcaagaccaaaaatgtgttcattgcccagaatgtcgccagcctacaagagctgggggggtcagagaagctattacgagtgtgtttgaacctgccttatttcctccggtacatcaacagattccaggatgctgttctggccaactcattttttattatgccagctacagtcgcggacgctactgctgtaaggaatggcttccatagcttggtaatcgatgttaccatggcactagacaccctgagccttccagtcttggagccccttaatccgagtcgacttcaagatgtgacagtgctgagtctgtcgtgcctgtacgctggcgtgtcggtagccacctgtatggccattttgcacgtggggtccgcccagcaggtgagaaccggatctacctctagtaaagaggatgattatgaatcagacgctgccaccattgtccagaagtgcctggagatttacgacatgattggacaggcgatctcatccagcagacgggccgggggagagcactatcagaattttcaactgcttggggcctggtgcttattaaactctttgttcttgattttgaatctctcccctactgcccttgccgataaagggaaagagaaggaccccctggccgcactgagagtgcgggacatcctcagcaggacaaaggagggcgtgggatccccaaaactgggcccggggaagggacaccagggattcggcgtgctcagcgtgatattagccaatcacgccataaagctgctgacttccttgtttcaagatcttcaggtggaggcgcttcacaagggctgggaaactgacggacccccagctgccctgagcatcatggcccagtcaacctccatccagcgcattcagcgcttgatcgactccgtgcctttgatgaacttgttgctgacactcctttctacctcctatcggaaagcatgtgtgctacagaggcagcgtaaaggaagcatgtcttccgatgccagcgcctccacggactctaacacatactatgaggacgacttcagcagcaccgaagaggattcctctcaagacgacgactcggagcccattctgggtcaatggtttgaggaaaccatttctcccagtaaagagaaggctgctcccccccctcctccccctccccctccactcgagtccagccctagggtcaagagcccctctaagcaggctcctggtgaaaaagggaacatccttgcttcacgtaaagacccggaattgtttttaggtctcgccagcaatattctcaacttcatcaccagctcgatgcttaactctagaaacaacttcatcaggaattacctttccgtctccttaagtgagcaccatatggctacccttgctagcatcatcaaagaagttgataaagacggcctcaaagggtcttcggacgaggagtttgccgcagctctctaccacttcaaccattctcttgtgactagtgatctgcagtccccaaatctgcagaacactctcctgcagcagctgggcgtggccccattcagcgagggaccctggccactgtatattcatcctcagagcctgtcagtgctctctaggttacttttgatttggcaacacaaggccagcgctcagggtgatcccgacgtgcccgagtgcctaaaggtgtgggatcgcttcctctccacgatgaaacagaacgctctgcagggcgtcgtccccagtgaaacggaggacctaaacgtcgagcatctacaaatgctgctgctcattttccacaatttcaccgaaactgggcgaagggcaatcctgtcgctatttgtccagattatccaggagttgagtgttaacatggatgcccaaatgcgttttgtacccctcattttagctcgactgctgctcatattcgactaccttctacatcagtattcgaaggcaccggtctatctgtttgaacaagtccaacacaatttactgtctccgcctttcggatgggcctccgggagtcaggattcaaactcacgccgcgcaacaacaccactgtatcacggcttcaaggaggtggaagagaattggagtaaacattttagttctgacgcggtcccccatccaagattttactgcgtgctgtctcctgaagcaagtgaggatgatctgaatcgcctggattcagtggcatgtgatgtcctgttcagcaagctggtgaaatacgatgagttgtacgctgcgctcaccgcgctgctggctgccggtagtcagctggataccgtgagacgcaaggaaaacaaaaacgttacagccctggaggcatgcgcactgcagtactattttctgattctgtggcgaattcttggcattttgccgccttccaaaacttacattaatcagctctcaatgaacagccccgagatgagtgagtgtgatatactccacacactgagatggtcatcgagattgcggatcagctcctacgtgaattggatcaaagaccatctaatcaaacaaggaatgaaagccgagcacgcaagctccctactcgaactggcttctactactaagtgcagctctgtgaagtacgatgttgagatcgttgaggaatacttcgcccggcagatctcctcattttgttcaatcgactgcacaactatactgcagctccatgagatcccaagtctgcagagcatctatacactggatgcagccatctcgaaggtccaggtgtcacttgatgaacacttttcaaagatggcagccgaaacagatcctcacaagtccagcgagattacaaagaacctcctgccggcgactttacaactcattgacacatacgccagctttacacgagcttacctgttacagaattttaacgaggaggggacaacagagaaacccagtaaggagaaattacaagggtttgccgccgttttagctattggttcttcacggtgcaaagccaacactttgggccccaccttggtacagaacttacccagctcagtgcagacagtgtgtgaatcttggaataatataaatactaacgagttccccaacatcggatcttggcgcaacgcattcgcaaatgacacaattccgtccgagagttacatcagcgcagttcaggccgcccatcttgggacactttgcagtcaatcccttccattggcagcctcgctgaagcatactctactcagcttagttaggttgactggagatctgatcgtctggtctgacgaaatgaatcccccccaggtcatccgcaccctgctgcccctgttgctcgagtcctccaccgagtctgtcgccgaaatctcatcaaactcccttgagaggattctaggaccagcggagtcagatgagttcctcgcccgtgtatacgagaagctgatcacaggctgctataatattctcgccaaccacgctgaccccaactctggtctcgatgaatcgatcttagaggaatgtctccaatatctcgaaaagcaactggagagttcccaagcccgaaaggccatggaagaattctttagcgacagcggagagttggttcagatcatgatggctaccgctaatgaaaacctgagcgcaaaattttgcaaccgggtcctcaagttctttacaaagctcttccagttaacagaaaagtctccaaatccctcactactccacctttgtgggtctctggcacagctggcctgcgttgagcccgtgcgtcttcaggcttggctgacccgtatgaccacatccccaccgaaggactccgaccagctggatgttattcaggagaaccgccagctgctgcagttgctcacaacgtatattgtccgggagaactcgcaggtgggtgagggtgtgtgcgccgtgctccttggtactctaacccctatggctaccgagatgctggcaaatggcgacgggaccggcttccctgagctgatggtggtcatggccacactggcatccgcaggccagggcgcaggccacctacagcttcataatgccgcggtagattggctcagccgatgcaagaaatacctgagtcagaagaatgtggttgaaaaactgaacgccaatgtcatgcatggaaaacacgtcatgattctagagtgtacctgccatatcatgtcgtatttagccgacgtgactaatgcattgtcacagtcgaatggtcagggccctagccacctgagcgtggacggagaagagcgtgctattgaagttgatagcgattgggttgaggagttggcagttgaggaggaggacagccaggccgaggactcagatgaggatagcctttgtaataaactttgtacattcactattacacagaaagagttcatgaatcagcattggtatcactgccatacttgcaagatggtcgacggggttggcgtgtgtaccgtctgtgctaaggtgtgccacaaagatcacgagatttcctatgccaaatacggttcgtttttttgcgattgcggcgccaaggaggacggctcttgcctggctctcgtcaagagaaccccatccagcgggatgagctctaccatgaaagaatcagccttccagtctgaacctcgtattagtgagagtctggtgcgccacgcaagtaccagttcacccgctgacaaggcaaaggtgactatttcagatgggaaggtggcagatgaagagaagccaaaaaaaagcagcctctgccgtacagtcgaaggctgccgggaggaattgcagaaccaggccaacttctccttcgctccattggttttggatatgctcaatttcctgatggatgcaattcaaactaacttccagcaagctagtgctgttgggagtagctcgcgcgcacagcaagcactcagcgagctccataccgtggaaaaagccgtggagatgacggatcaactcatggtgcccacactgggctctcaggagggtgcctttgaaaatgttcgaatgaactactccggggatcaggggcagactataaggcagctgatttcggcccacgtcctgaggagggtggctatgtgcgtgctgtcgagcccccacggtagacgccagcacctggccgttagtcatgagaaggggaaaatcacagtcctccagctttccgccctattaaagcaagccgattcttctaagcgaaaactgaccctgacacgcttggcatctgccccagtgcccttcacagtgctgtcactcaccggcaacccatgcaaggaggactacttagccgtgtgcggcctgaaagattgtcacgttctcactttctcctcatctggttctgttagtgatcatcttgttctgcacccacaactcgcgacaggtaacttcatcataaaggccgtgtggctgccaggatctcagaccgagctcgccatcgtcacagccgactttgtgaaaatctacgacctgtgcgtggacgcactctcaccgacattctacttcctgcttccaagctccaagattcgcgacgtgacattcctgtttaatgaggaagggaagaacattatcgtgatcatgtcaagtgcaggttatatctacacacaactcatggaagaagcctcctctgcccaacaggggcccttttatgtcaccaacgtgctcgaaatcaatcatgaagacctgaaggacagtaactcccaagtagccggaggaggggtttccgtatattactctcatgtcctgcagatgttgttcttttcctattgccaaggtaagagcttcgcagccactatttctcgaactactcttgaggtgcttcagctttttcctatcaatattaaatcctccaacggtggctctaagacatcccccgcactctgccaatggtccgaggttatgaaccatcccgggctggtgtgttgtgtgcagcagacgaccggcgttcccctggtggtgatggttaaacccgacaccttcctgatccaagagataaaaacacttcctgccaaggctaaaatccaggacatggtggccattagacacaccgcatgtaacgagcaacagagaaccaccatgatcctcctgtgcgaggacgggagcctgagaatttatatggccaacgttgagaacacatcctattggctgcagccaagtttgcaaccaagtagcgtgatttccatcatgaagcccgtgaggaaacgcaagacggctaccattacaactcggacctccagtcaggtcacatttcccattgacttttttgaacataatcagcagctgaccgacgtggaatttggcgggaacgatcttcttcaggtttataatgcccaacagatcaaacaccgcttgaatagtaccggcatgtatgtggctaataccaagccagggggcttcacaatcgagatatctaacaataacagcaccatggtgatgactggcatgaggattcagattggcacgcaagcgatcgagcgcgcaccatcctacattgagatcttcggtcggaccatgcagctcaacctcagtaggagtcggtggtttgatttccccttcacgcgcgaggaggccttgcaagccgacaaaaaattgaatctctttattggggcatctgtggacccagccggtgttaccatgattgatgccgtgaagatatatgggaaaacgaaagaacagttcggctggcccgatgaaccacctgaagagttcccgtccgcttctgtgagtaacatttgtccttctaacctaaaccagagtaatggaaccggagactccgattctgccgctcctacaacaacatcaggcacagttttagaatcctctgaaactgaatctcttactaaacttgatcggcttgttgtaagttctttggaagctctggagtcgtgttttgctgtggggcctattatcgaaaaggagcgtaataaaaacgccgcacaggagctggccaccctgcttttgagcctgccggctcctgcttccgtgcaacaacagtccaaaagtctcctcgcctctctgcacacctctcgctccgcttatcactcacataaagatcaggcattgctatctaaagcggtacagtgtctcaacactagctcaaaagaaggtaaggatctcgatccagaagttttccaaagattagtgatcacagctcgcagcattgccattatgagaccaaataatctcgtccacttcaccgaatcgaagttgccccaaatggaaaccgagggcatggacgaaggcaaagagccacaaaagcagctggagggggactgttgctcctttatcacgcaattggtgaatcacttctggaaactgcatgcatcaaagccgaagaacgccttcctggcccctgcatgcttaccgggtctgacccacatcgaggccacagtcaatgccctggttgacatcattcacggttactgcacgtgtgagctcgactgcattaatacggcctctaagatttacatgcagatgctgttgtgtcccgacccagctgtatcatttagttgtaaacaagccctcatcagggtgctgcggccaagaaacaagcggcgacacgtgactttgccatcttcccctaggtccaatacccctatgggcgacaaggatgacgatgatgatgacgatgcggatgaaaagatgcagtcaagtggaatccccaacggtggacatatccgccaggagtcacaagagcagagtgaagtagaccacggtgactttgagatggtatcagaatccatggtcctggaaactgccgagaatgtcaataacggaaatccatcaccacttgaggcattacttgcgggagccgaaggcttcccacccatgctcgatattcctcctgacgccgacgatgaaacaatggtggagctggcgattgccctgtcgcttcagcaggaccagcaggcgcctgcctccgacgatgagggctctactgctgccactgatggatctaccctgcggacctcccctgcggatcacggcggttctgtcgggtcggagagtgggggtagtgcggttgattctgtggctggagagcactctgtctctggcaggtcctctgcctatggtgacgcgacagcggaaggtcatccggccggacccggaagcgtcagctcctcaaccggagccatatcaactacaacggggcaccaggaaggagacggtagtgagggcgagggtgagggggagacagagggcgacgttcatacatctaaccgactgcacatggtgcgactcatgttgctcgagaggctgttgcagacgctgccccaactgaggaacgtgggcggggtgcgcgcgattccttatatgcaggtgattctcatgcttacaacagacttagacggagaagatgagaaggataagggggcactagataatctcctgtcccagctcatagcggaactgggaatggacaagaaggatgtgtctaagaagaacgaacgatcagcactgaatgaagtgcatctggttgtgatgcgtctcctgagtgtctttatgagtcgcactaagagcgggagtaaaagcagtatttgcgaatccagcagcttgatttcatctgccacagccgctgccctgttgtcgtccggcgccgtcgactattgcctgcatgttctcaagtcactcctcgagtactggaagtcccagcaaaatgacgaggagcctgtcgcaacctcacaacttctgaagcctcatactacaagtagtccgcctgatatgagtccattttttctgcgacagtacgtgaagggccacgccgcggacgtgtttgaagcatacacacagctgctgacagaaatggttttgagactcccttatcagatcaaaaagataaccgataccaattcaagaataccaccaccggtgttcgatcattcatggttttactttctgagcgaatatctgatgattcagcagactcccttcgtacggcgacaagtgagaaagcttctcttgtttatttgcgggagcaaagagaagtaccgtcaactaagagacctacacaccctggattcgcacgtgagagggataaaaaagctgcttgaagagcagggtatatttctgagggcctccgtggtcacggcctcaagcgggagcgctctacagtacgacacgctcatatctctgatggagcatttgaaagcttgtgctgagatagctgcccaaaggaccataaactggcagaagttctgtattaaggatgacagcgttctgtatttcctgttgcaggtgtctttcctcgtcgacgagggagtctcgccagtccttctgcagctgctctcatgcgcgttgtgcggatctaaggttcttgccgccctggccgcctccagcgggagctcatccgcgtcttcttccagtgcacccgtcgccgcttccagtggccaagctactacgcaaagcaaatcctctacaaagaagtcgaagaaggaagagaaggagaaagagaaagatggagaaactagcggctctcaagaagatcagctttgcaccgctctggttaaccagctcaacaaattcgccgacaaggagaccctaatacagttcctgagatgcttcctgctggagagcaattcctcctcagtccgctggcaggcgcactgccttaccctccatatctatagaaattctagcaaatcccaacaggagctgctgctggacctgatgtggtccatttggcctgagctaccagcatacgggcgcaaggctgcccagttcgtggatttgctggggtacttttcactgaagactccacagacagaaaagaaactgaaggagtattctcagaaggccgtggagatcttacgaacacaaaaccacattttgaccaaccaccccaatagcaatatatataacacactctcaggtcttgttgaattcgacggatactatctggagtctgatccatgcctagtctgtaataaccccgaggttcccttttgttacattaagctatctagcattaaggtagataccagatatactactactcagcaggtagtaaaattaattgggagtcacaccatatccaaagttaccgttaagatcggcgacttgaaacgcaccaagatggtgagaacaattaatctctactacaataacaggaccgtccaagcaattgtagagttgaaaaacaaaccagcaagatggcataaggccaaaaaggtccagctcactcctgggcagactgaggtcaagatagatctccctctgcccatagttgccagcaacctcatgatcgaatttgcagacttctatgagaactaccaggcctccaccgaaacactccagtgccccagatgctccgcctctgtgccagcaaaccccggagtgtgtggcaactgcggagaaaacgtctaccagtgccacaagtgtcgcagtattaactatgatgagaaagaccctttcctgtgtaacgcgtgcgggttctgcaaatatgccaggttcgacttcatgctttacgctaaaccgtgctgcgcagtggatccaattgagaacgaagaggataggaagaaggccgtcagcaatattaacactttgttagacaaggccgacagggtgtaccaccagctgatgggccaccgaccccaactggaaaatctgctgtgcaaagtcaacgaggccgcacccgagaagccgcaagacgatagtggcacagcagggggcatctcctctacaagcgccagcgtcaatcgctatatcctccagcttgcgcaagagtattgcggcgattgtaaaaattcattcgacgaactttcaaaaatcatccagaaggtcttcgcttctagaaaggagctcctcgagtacgacctccaacagcgggaagccgccacaaagagcagtagaacttcagtacagccgacattcactgcttcacaataccgggccctgtccgtgctgggatgcggtcacacttcctctactaaatgctacggctgtgccagcgccgtaacagagcattgtataacgcttctcagggcgctggctactaaccccgcactgagacacattctggtcagtcagggccttattcgcgagctgtttgactataatttaaggcgcggcgctgcagctatgagggaggaggtgcgccagctcatgtgcctgctgacacgtgataatcccgaagctactcaacagatgaacgaccttatcattggtaaggtgtctacagctctcaagggccactgggcgaatccagatttggctagttctctgcagtacgaaatgcttctcctgaccgattccatctccaaagaggatagctgttgggaacttaggctgaggtgcgccctcagtctgtttctgatggccgttaatatcaagacacccgtggtagtagaaaatattacgctaatgtgtctgcggattttgcaaaagcttatcaagcctcctgccccaacatctaagaagaacaaggacgtgcctgtagaagccctcaccactgtcaagccctactgtaacgaaatccatgcccaagcacaactctggctgaagcgggaccctaaggcctcctacgatgcttggaaaaagtgcttaccgattcggggaatcgatggcaatggtaaggcaccaagtaagtcagaactccggcacctctatctcactgaaaagtatgtatggaggtggaagcagtttttatcacggaggggcaaaaggacatcgcccctggaccttaaacttggccataacaattggctccggcaggtgttgtttacaccggccacacaggctgccagacaagccgcatgtactatcgtagaagccctcgcgacaatcccatcgcggaagcagcaagtgttggatctattgacaagctatctggatgaactttccattgctggcgaatgtgctgctgagtacttggcgctgtatcagaagctgatcacaagtgctcactggaaggtgtacctggccgccaggggcgtgttgccttatgtgggaaacttgattaccaaggaaatcgccagactgctcgcattagaagaagctactctgtccacggacctccagcagggatatgccctgaagtcgctgaccggcctgttatcctcgtttgtagaggtggaatccataaagaggcacttcaagtcccgcctcgtgggcactgtcctgaacggatatctgtgtcttaggaagctggtggtgcaaaggacaaaactcatcgatgagacccaggacatgctcttagagatgctagaagacatgacgacaggaacggaaagcgaaacaaaagctttcatggccgtgtgtatagaaacagccaaaagatacaacctggacgactatagaacccctgtgtttatctttgagagattgtgcagtatcatctaccccgaggagaatgaggtgactgagttcttcgtgaccctagaaaaagacccacagcaagaagatttcctccaggggagaatgcccggcaacccgtactcatcgaatgaacctgggatcgggccactaatgcgggacataaagaataaaatctgtcaggattgcgacttagtggcacttctggaagatgacagcgggatggaactactcgtaaacaacaagatcatctctttggacttgcctgtggccgaagtgtataaaaaggtatggtgcacgacaaacgagggggagcctatgcgaatcgtctatcgcatgcgcgggctgctgggggatgctacagaggaattcattgagtccctcgattccacaacagatgaagaggaggatgaggaagaggtttacaagatggccggagtcatggcccaatgtggcggccttgagtgcatgctcaaccgcctggctggcattcgcgactttaagcagggcagacacctgttaaccgtgctactcaaactgttttcctattgcgtgaaagtgaaagtcaataggcagcagcttgtcaaactcgaaatgaatactctaaatgtaatgctgggcacactgaatctggccttggtggccgagcaagaatcaaaagattccggtggagctgctgttgccgagcaggtactgtccatcatggagatcatactcgatgaaagcaatgctgaacctctctctgaagacaaaggcaacttgttgctgacgggagataaggaccaactggtcatgctcctcgatcagatcaattccacctttgtgcgaagcaaccctagcgtgttgcagggactgttaaggataataccatacctgagtttcggcgaggtggagaagatgcagatcctggtggaacggttcaagccttactgtaacttcgacaagtacgatgaggaccactcaggtgacgacaaggtgtttcttgattgtttctgcaagatcgctgcagggatcaaaaacaattccaatggccaccagctgaaagatctgatcctgcagaaaggcatcacccagaatgctctggattacatgaagaagcacatcccctcagctaagaatctagacgcagatatttggaaaaaattcctatcgcgaccggcattaccatttattctgaggctgttaagagggcttgccattcaacaccctggaactcaagttttaatcggaacggacagcatccccaatttacataaactggaacaggtctccagcgacgaggggattggcactctcgccgagaaccttctggaggccctgagggagcacccagatgtcaataaaaaaattgacgcagctcggcgcgaaacaagagcagaaaaaaagcggatggcaatggccatgcgtcagaaagccttgggaactctcggcatgactaccaacgaaaaggggcaggtcgtgactaagacggccctgctgaaacagatggaggagctcatcgaagagcccggcctgacctgttgcatctgtcgcgagggttataagtttcagccaactaaggtcctgggtatctacacattcaccaaacgcgtggccctggaagaaatggaaaataagccacggaaacagcagggctactccacggtatcacatttcaatattgtacattacgactgtcacttggcggctgtcaggctcgcgcgcggacgcgaggagtgggagagtgcggcccttcaaaacgccaacacgaaatgtaacggcttgttacctgtgtggggcccccacgttcccgagtcagcctttgcaacttgccttgcccggcataacacatacctgcaagagtgcaccggtcaaagagagcccacataccagctcaacatccacgacatcaagctgctctttctgagatttgcaatggaacaaagttttagtgctgataccggcgggggcggcagggagtcaaacatccatcttatcccttatataatccacacagtgctgtatgttctaaatactacaagagctacaagccgcgaggaaaagaatttgcaggggttcctggaacagcccaaagagaaatgggttgaatccgcctttgaggtcgacgggccctattacttcacagtgctggccctgcatattctccctcctgaacagtggagagcaacacgcgtcgaaatcctccgtcgcctgctggtcacctctcaggcccgggctgtggcccccggaggagccacacggctgactgataaagccgttaaggattactctgcatataggtcatcactgttattttgggccctggtcgacctgatctataatatgtttaaaaaagtccctaccagtaacacggaaggagggtggtcctgctccctcgccgagtatattcggcataacgatatgcccatatacgaagctgccgataaggcgctgaagacatttcaggaggaatttatgcccgtagagaccttcagcgaatttcttgatgtggctggtctcctgtctgaaatcacagaccctgaaagttttctcaaggacctcttaaactcagtcccctag

SEQ ID NO: 47708 - DNA, 15552 bp, Artificial Sequence
  Description of Artificial Sequence: Synthetic coding sequence
atggccaccagcggcggcgaggaggccgccgccgccgcccccgcccctggcacaccggcgactggggccgatactactcccggttgggaagtggcagtaagaccactgctctcggcatcatatagtgccttcgagatgaaggagttaccccaacttgttgcaagcgtgattgaatctgaatcagaaatactccatcacgagaaacaatacgaacccttctacagctcttttgttgccctcagtacccactacatcaccacagtttgtagtttgatcccaagaaatcagcttcaatctgtagccgcggcctgtaaggtgctgatcgaatttagcctgctaaggctagagaatccagacgaagcatgtgccgtgtcccagaaacatctcatcctcttgataaagggactttgcacgggttgttctcgactagacaggactgaaatcatcacttttactgccatgatgaaatccgcaaagttgcctcagactgtgaagaccctatctgacgttgaggaccagaaggaactggccagcccagtaagccctgaactcagacagaaggaggtgcaaatgaatttcctcaaccagctgacctccgtgtttaatccaagaaccgtcgcaagtcagcccatctcaacccaaactctagtggagggcgaaaatgacgaacagagttctaccgatcaggcttcggccataaaaacgaaaaacgtgtttatcgcccagaacgtcgcatctctgcaggagctggggggcagtgaaaagctgctgcgggtttgccttaacctgccttattttttacgttatataaaccgttttcaggatgctgtgctcgccaactctttctttatcatgcccgctacagtggcagacgctacagccgtccggaatgggtttcactccctggtgattgacgtgacaatggcgctggacacgctctcactgccagtgcttgaacctctgaatcccagtcggctgcaggatgtgactgtgctgtcactatcatgcctatatgcgggcgtgagcgttgcaacttgtatggccattctgcacgtgggcagtgctcagcaggtacgaactgggagcacaagctctaaagaagacgactacgagtccgatgctgctacaatagttcagaagtgtctggaaatctacgatatgattggtcaggccatctcctctagtaggagagctggcggtgagcactaccagaacttccagctcctcggcgcatggtgtctgctgaacagcctattcctgatcctgaatctgagcccaacggctctggcagataaggggaaggagaaagaccccctggcagccttgagggtccgcgatatcttatcccgtacgaaagaaggtgttgggtccccaaaattagggccgggcaaagggcatcagggcttcggtgtgctgagcgttattctggcaaatcacgcaatcaagttgctcacttctctgtttcaagacctgcaggtcgaagcccttcacaagggatgggagacagatggccctcccgccgccctttcgatcatggcccaatctacgtctatccagcggatacagaggcttattgactcggtcccactcatgaatcttctattgactttgcttagtacatcttatcgcaaagcttgtgtgcttcagcggcagcgtaaggggtctatgagctccgatgcgtccgcttcaacagactctaatacatattacgaagatgattttagtagcaccgaggaagacagcagtcaggacgatgactcagagcctatcctgggccagtggtttgaggaaacaattagtccaagcaaagaaaaggccgccccacccccccccccccccccgcctcccttggagtctagccccagagtgaagagccctagcaagcaagctccaggggagaagggcaacatccttgcttcacgaaaggacccagagttgtttctcgggctcgcctcgaacattttgaactttatcacatcatcaatgctgaatagcaggaacaacttcatccgaaattacctgtcagtgtcccttagtgaacaccatatggctaccctcgcaagcatcatcaaggaagtcgataaggacggactaaaagggagttccgacgaagaatttgccgcagccctgtatcacttcaaccatagtctggtcacatccgacctgcagtctccaaatctccaaaacactctgctgcagcagctcggcgtagctcccttctccgaaggcccctggcccctctatattcacccgcagtcccttagtgtcttaagccgactgcttttgatctggcagcataaagccagcgctcagggtgacccagatgtgcccgaatgcctaaaggtatgggaccgtttcctgagcaccatgaagcagaacgcacttcagggcgtggtcccctcagagacagaggacttgaacgtcgagcaccttcaaatgttgcttctgatatttcataactttacagaaaccgggcggagagccatcctgagtctgttcgtgcagattattcaggagctctctgtaaatatggatgcccagatgcgcttcgtgcctctcatcctggcaagactgttactaatcttcgactatctgctgcatcagtatagcaaggccccagtctacctctttgagcaggtacagcacaacctgctgtctccaccctttgggtgggcgtcaggaagtcaggattctaattctcggagagccactacgcccctgtaccacggttttaaggaagtggaagagaactggagcaaacatttctccagtgacgcggtgcctcacccaagattctactgtgtgctgtctccagaggcctcagaggacgacctgaaccgtcttgacagcgtggcttgtgacgtgctcttctcaaagctcgtgaagtatgatgagttatatgcagcccttactgcgcttctcgcggccggatctcaacttgatacggtacgcagaaaagaaaataaaaacgtgacagccctagaagcctgcgctctgcagtattatttcttgatcctgtggcggatattgggaatcctaccaccttctaaaacatacatcaaccaactttcaatgaactccccagagatgagcgagtgtgacattctacatactcttcggtggtcctcaagactgaggatctccagttatgtgaattggattaaggaccaccttattaaacagggaatgaaagccgagcacgctagctccctcctggagctcgccagtaccaccaagtgcagcagcgttaaatacgatgtggagattgtcgaggagtacttcgctagacagattagctctttttgcagcatcgattgcacaaccatcctacagctgcatgaaattccttcattacagtcaatatacacactggatgctgccatctcaaaagtgcaggtatccttagacgagcacttttccaagatggccgcagaaacggatccacacaaaagttctgaaatcaccaaaaacttgctgccagccactctccagcttattgacacgtatgcaagtttcacaagagcctacttattgcagaatttcaacgaggagggcactactgaaaagcccagcaaggaaaaactacagggctttgctgctgttttggcaatcggctcatccagatgtaaggcaaacaccctgggaccgacgctggtccagaatctgccatcgtcagtgcagaccgtgtgtgagtcttggaataatatcaacacaaacgagtttcccaacatcggctcttggagaaatgcttttgccaacgacaccatcccaagcgagagttacattagcgctgttcaggcagcccacctgggaactctttgttcccagagcctgcccttagccgctagtcttaaacataccctcctcagccttgtacgactgacaggtgatctcatcgtgtggtccgatgagatgaaccctcctcaggtcatcagaacactcctgccgctgttgttggagtcctcaactgagtctgttgctgagattagtagcaatagcttggaacggatcctgggcccggcagagtctgacgagttcctggcaagggtgtatgaaaagctgatcacaggctgttacaacattcttgcaaatcatgccgatcctaatagcggcctggatgaatctatcctggaggaatgtttgcagtacctcgagaaacagttagagagctcacaggcccggaaggcgatggaagaattcttcagtgacagcggtgagcttgtgcagatcatgatggcgactgccaacgaaaacctgtctgcgaaattctgcaaccgagtgctgaagttcttcaccaaactgtttcagctgaccgaaaagtcccctaatccctcccttttgcacttgtgtggcagcctggcgcaactggcttgcgtcgaacctgttcgacttcaggcctggctcacgcgaatgactacttcaccgcccaaggatagtgatcagttggacgtgattcaggaaaaccggcagctgttacagttactcacgacctacatcgtcagggagaacagccaagttggagagggcgtgtgcgcagtgctgttagggaccctgaccccaatggccaccgagatgctggccaacggagatggaacgggattcccggagctgatggtagtgatggcaaccctcgcatctgctggccagggcgccggtcacttacaactccacaatgccgccgtggattggctgtctcgttgtaagaagtatctctctcagaagaacgtggttgagaaactgaacgccaatgtgatgcacggtaagcacgtcatgattttggaatgcacttgccacatcatgagctacctggccgatgtgaccaatgccctgtcacagtccaacggacagggcccctcacatctgagcgtcgacggtgaggaacgcgcaatcgaggtagattccgactgggtagaggagctcgcagtagaggaagaggactcccaagcagaagattctgacgaagattctctctgtaacaagctctgcacctttaccataactcagaaggagtttatgaatcagcattggtaccattgtcacacttgtaaaatggtagacggcgttggggtttgcacagtgtgtgccaaggtctgccacaaagaccatgaaatatcatacgcaaaatacggatctttcttttgcgactgtggggccaaagaagacgggtcatgtctcgccctggtgaagaggacgccatcaagcggtatgtccagcacaatgaaggaatccgccttccagtccgaaccaagaatctcagagagtctagtgaggcatgcatccacgagctcccccgcagacaaggccaaagtaaccatctccgatgggaaggtggccgacgaagagaaacccaaaaagtcaagcctatgcagaacagtcgagggctgtagggaggagctgcagaaccaggcgaattttagcttcgcccctctcgtcttagatatgctgaatttcctcatggatgccattcaaactaatttccagcaagcttctgctgtgggttcgagctctcgggcacaacaggccctgagcgagctgcacaccgtcgaaaaggcagtggagatgacagatcaactcatggttccaaccctcggaagtcaagagggagctttcgagaacgtgagaatgaattactccggcgaccagggccagaccatacggcagttgattagcgcacacgtcctgagaagggtagcaatgtgtgtccttagtagcccccatggtagacggcagcacttggccgtgagccatgaaaaaggtaaaatcacagtgctgcagctaagcgcactcctgaaacaggctgattctagcaaaaggaagttaacactcacccggctggcctccgctccagtgcctttcactgtgttgagcctgacaggcaacccatgcaaagaagactacctcgctgtctgcggcctcaaagactgtcatgttcttaccttcagcagctccggcagtgtgagcgatcacttagtccttcaccctcaactcgccacggggaactttattatcaaagccgtgtggctgcccgggtcccagaccgagttagccattgtgactgccgacttcgtgaaaatatacgacctgtgcgtggatgcgctgtcccccaccttttacttcttgctgccctctagtaaaattcgtgatgttactttcctgttcaacgaggaaggaaaaaatatcatagtaattatgtccagcgcaggttacatttacacacagctcatggaagaggctagctctgcccagcagggcccattttatgtgacaaatgtgctcgaaatcaatcacgaagacttaaaggatagcaattctcaggtagccgggggcggcgtgtcagtgtattatagccatgtgctacaaatgcttttttttagttactgtcaggggaaatccttcgccgcaacaatcagcagaacaaccctggaagtccttcaattattcccgattaacattaagagttctaacggcggaagcaaaacgtctccagcattatgccagtggagcgaagtgatgaatcatccaggactggtgtgctgtgtccaacagaccacaggagtaccgctggtagttatggtgaagcccgatactttcctgatccaggaaatcaaaaccctgcccgccaaagctaaaatacaggacatggtcgctatcaggcatactgcctgtaatgaacagcagcgtacaactatgattctactgtgcgaggacggttcactgagaatttacatggctaatgtcgagaacaccagctactggctgcagccctcgcttcagccatcctcagtaataagcataatgaagcctgttagaaaacgcaaaacagccaccatcacaacacggacaagctcccaggtgacattccccattgacttcttcgaacacaatcagcagttgaccgacgtggagttcgggggtaatgatctcttgcaggtgtataacgcccagcagatcaagcatcgcctgaattcgacagggatgtacgtcgcaaataccaaaccaggaggattcacaatcgagatttcaaataataatagtaccatggtgatgaccggtatgaggattcagattggcactcaggctatcgagagggccccgtcctacatcgagatttttgggcgaaccatgcaattaaatctgagtcgctctaggtggtttgacttccctttcacgagagaggaggctctgcaggctgataagaaactgaatcttttcataggcgcctcagtggaccctgcgggcgtaaccatgattgatgcagtgaagatatacggtaaaactaaggaacaatttgggtggcctgatgaaccacctgaagagttcccaagcgcatctgtgtccaacatctgcccctctaacttgaaccagtccaacgggacaggagacagcgattcggccgcccccactacgaccagtgggaccgttctcgagcggctggtcgtgtcttcccttgaagcgctggaatcgtgctttgctgttgggccaataatcgagaaagagcgcaacaagaacgccgctcaggagctggccactttgctgttgagcttgcccgcccccgcttcagtgcagcagcagagcaagtccctccttgcttccctgcacacttctcgctctgcatatcactcccataaagaccaggccttattgagcaaagcagtccagtgtctgaacaccagctcaaaggaaggaaaagacctggacccagaggttttccagaggctggtgattaccgcacggagtattgcaattatgcgtccaaataacttggtccactttacagagagcaagctgcctcagatggagacagagggcatggacgaaggaaaagagcctcagaaacagttagaaggagactgctgtagctttatcacacaactggtcaaccacttctggaagttacacgcatccaagcccaagaatgcttttctggcacccgcatgcttacccggcctgacccacatcgaggcaaccgtgaatgctctcgtcgatattattcatggatattgtacgtgcgaactcgactgtatcaacaccgcctctaaaatctacatgcaaatgctcttatgtcctgatccagctgtatctttctcatgtaagcaagccttgatcagggtgttgagaccccgcaataagaggaggcacgttaccctgccttcaagtccacgatccaatactcctatgggtgataaagacgacgatgatgacgacgatgctgacgagaaaatgcagtcatccggaattcccaatggcggccacatcaggcaggaatctcaggagcagtctgaggtggaccatggcgatttcgagatggtcagtgagtcaatggtcctggaaacagccgagaacgttaataatggaaacccctcacctctcgaagcgctcctcgccggcgccgaggggttccccccaatgctggacatcccccccgacgcagacgacgagacaatggttgaactggccatcgccctgagcctgcagcaggatcagcagggatcaagcagcagcgccctcgggcttcagtcattaggcctcagcgggcaggctccttcgtccagctccctggacgctgggactttgtccgatactaccgcttctgcccccgccagcgacgatgaaggatcaaccgcagccacagatggctctacactgaggacatcccccgcagaccacgggggctccgtaggctctgagagcgggggtagcgccgtagacagcgtagcaggcgagcactcagtgagcggacgctcttctgcttatggggatgcaaccgcagaggggcatcctgccggtccggggtctgtgtcttcctcaactggtgccatcagtacaactactggacaccaggagggagatggatcggagggggaaggcgaaggcgaaaccgagggtgacgtgcatacatcaaaccgcctccacatggtgcggctcatgcttttagaacgtttgctgcagaccctcccacaattgagaaatgtgggcggcgttcgggctattccttacatgcaggtgattcttatgcttactaccgaccttgatggtgaagacgagaaggataagggcgctttagataatttactatctcagttaattgcagagctggggatggataagaaagacgtcagtaagaaaaacgagcgatcggcacttaacgaggtccacctggttgttatgagactgttaagtgtgtttatgtctcggacaaaatcagggtctaagagcagcatctgcgagtcatcgtcactgatttctagtgccaccgctgccgctcttctgagctctggcgctgtggactactgccttcacgtattaaagagccttctggaatattggaaatcgcagcagaacgacgaggaacctgtcgccacgtcccagctgctgaagcctcacactactagctccccgccggatatgtcccctttcttcctgcgacaatatgttaaagggcatgctgccgatgttttcgaggcctatacacagctgttgaccgaaatggttttgcgcctgccataccagatcaagaagattaccgacactaattcccgcatcccgccgcccgttttcgaccactcttggttctacttcttatctgagtacttgatgatccagcaaaccccctttgtgcgtcgacaggtcaggaaactcctgttatttatttgcggatccaaggagaagtacaggcaactgcgcgaccttcataccttagacagtcatgtccgtggaataaagaagctgctggaggaacagggaatatttctgcgtgcctctgtagtgactgcatcctccggctctgccctacagtacgatacattgatcagtctcatggagcacctaaaagcttgcgcagagatcgcagcccagagaactataaattggcaaaaattctgtatcaaggacgattcagtgctgtatttccttctgcaagtgagcttccttgtcgacgagggcgtatcgccagtgctgctccagctcctcagttgtgccttgtgtggcagcaaagtgctggctgcgctggccgctagctccgggtcttccagtgctagcagctcgtctgccccagttgccgcctcttctggacaggcgactacgcagtcgaagagctcaaccaagaagtctaagaaggaggaaaaagagaaagaaaaggatggtgaaacaagtggaagccaggaagatcaattatgtaccgcactggtgaatcagctgaacaagttcgcagataaggaaaccctaattcagtttctcagatgttttctgcttgagtcaaattcctccagcgtgcgctggcaggctcactgccttaccctccacatttatcggaactcctcaaagtcccagcaggagcttctgttagacctcatgtggtccatttggcccgagcttcctgcttacgggaggaaggctgcacagtttgtggatcttctcgggtacttcagcctgaagacaccccagaccgaaaaaaagctgaaagaatactctcaaaaagctgtcgagatccttagaactcagaatcacattttgacaaaccatcctaactccaatatctacaataccttaagcgggctcgtggaattcgatgggtattatctggaatcagacccgtgtctcgtctgcaataatcccgaagtgccattttgttatatcaagctgtcctcgattaaggtcgatacaaggtacacaacaacgcagcaagtagtcaaactgattgggtctcacaccattagcaaagtgaccgtaaagattggagacctgaaaagaacgaagatggtacgcaccattaatttgtattataataatagaacagtccaggcgattgtggagcttaagaataaacctgctcgctggcataaggcgaaaaaggtccaattgacccctggccagaccgaggtgaaaatagatctccccctccctatcgttgcctccaatctcatgattgaatttgccgatttttacgaaaactaccaggcctctaccgaaactctgcagtgtcctcgctgctccgcaagcgtgcctgcaaaccctggcgtgtgtggaaactgcggcgagaacgtttatcaatgccataaatgcaggtcaattaactatgacgagaaggacccgttcctgtgcaacgcctgcggtttctgcaagtatgccaggtttgattttatgctctatgcaaagccatgctgtgccgttgacccaattgaaaacgaggaggaccgaaagaaagccgtttcgaatattaacactttgctggacaaagccgaccgtgtttatcaccagctgatggggcacaggccacagctggagaacctgttgtgcaaagtcaacgaggccgccccggaaaagccccaggatgactctggtaccgccggcgggatcagcagtacttcagcttcagtgaaccgttatatcttgcagctggcccaggagtattgcggtgactgcaaaaactcattcgatgaactctccaagattattcagaaagtctttgcttcgcgaaaagagctgctggagtacgacctccaacagcgggaagctgctactaagagttctaggacatctgttcaacccacatttactgcttcccaatatcgagcgctgtcagttctgggttgtgggcacaccagctctacaaagtgctacggatgtgctagcgccgttactgagcactgcatcaccctgctgcgtgccctggctactaacccagctctgagacatatcttggtgagccagggattgatccgagagctgttcgactacaacctaaggagaggagccgccgcaatgcgggaggaggtgcgccagttaatgtgtctactcacccgcgataaccccgaggctacacagcagatgaacgatcttattatcggaaaggtgtcaaccgcactgaagggccactgggccaatccggacctagccagctcactccaatacgagatgttgctcctgacagattccatcagcaaggaggactcttgctgggagcttcgccttaggtgtgccctttccctgttcctcatggcggtcaacatcaagacacccgtcgtggtggaaaatattaccctgatgtgcctccgtatccttcaaaagttaataaaaccccctgcgccgaccagtaaaaagaataaggatgtgcctgtggaggccctgaccactgtaaagccttactgtaacgagattcacgcgcaggctcagctgtggttgaaacgggatcccaaggccagttacgacgcttggaaaaaatgcctccccattagaggtattgacggcaatggaaaggcccctagtaagtcagagctgcgtcatctgtacctgaccgaaaagtatgtctggcggtggaagcaatttctcagtaggcggggcaagagaacatcccccctggatctaaagctgggtcacaataattggctgagacaagttttattcaccccagctacacaggccgcacgccaggctgcatgcactatcgtcgaagcactggccactattccctctcgcaagcagcaagtcttggaccttctgacctcttatcttgacgagcttagtatcgccggagagtgtgccgctgaatatctcgctctgtaccagaaactaattacctctgcgcactggaaagtctatctcgccgcccggggggtcctgccctatgttgggaatctcatcaccaaagagatcgcgcggctgctggccctcgaggaggccactttgtccacggacctgcagcaaggatatgcacttaaatccctcactgggctgctatcgtcattcgttgaggtggagtctattaagaggcacttcaagtcgagactggtgggtaccgtcctcaatggatacctctgtctgagaaagctggtcgtgcaacgcaccaagttaatcgacgaaacacaggacatgctgctggaaatgctggaggatatgaccactgggacagagagtgaaaccaaagccttcatggcagtgtgtattgaaacggccaagagatacaacctggatgactacaggacaccagtttttatcttcgaaagactgtgttctattatttatccagaggaaaatgaggttactgaattttttgtgacattggagaaggacccacagcaggaagatttcttacaaggaagaatgccagggaacccttactcttcaaatgaacccggcatcggcccccttatgagagatatcaagaacaagatctgtcaggattgtgacttggtggcgctcctggaggacgattccgggatggagcttttggtgaataacaagattatctctctggacctcccagtggcggaagtttacaagaaagtctggtgcaccaccaacgaaggagaacccatgcgcattgtttaccggatgcgcggactcttaggcgacgctacagaggagtttattgagagcctggacagtacaaccgatgaggaagaagacgaggaggaggtgtacaagatggcaggagtgatggcccagtgcggtgggctggaatgtatgctcaaccggctggctggcattcgggatttcaaacaagggcgtcatctgctcacagtcttattaaagctcttctcttactgcgtgaaagtgaaagtgaatagacagcaactcgtgaaattggagatgaatacccttaatgtcatgcttggaaccctgaaccttgcattggtggccgaacaggagtctaaggatagtgggggggccgcagtcgccgagcaagtactctctatcatggaaatcatcttggacgaaagcaacgccgagccgctgtctgaagataaggggaacctgttactgaccggcgacaaggaccaactggttatgctgttggatcaaattaactcaactttcgtgaggtcaaacccatcagtgctgcagggcctcttgcgtatcatcccgtatctgagttttggagaagtggagaagatgcagatcctggtggaaaggttcaagccatactgcaatttcgataagtacgacgaagatcatagcggagacgacaaggtcttcctcgattgcttttgcaaaattgccgccggcataaaaaataattctaacggacatcagctaaaggacctaatcctccagaaggggattactcagaacgcgttggactatatgaagaaacatatccccagcgctaagaacctcgatgccgatatttggaaaaagtttttatctagacccgccctgccattcattctgaggctactgcgggggttggctattcagcaccccggtacccaggttctcattggaacagactccattccgaacctccacaagttggagcaggtctcctcagatgaaggcattggcactctggcggaaaatttactggaggctctgagggagcatccagatgtcaacaaaaagatagatgccgctagaagggagaccagggccgaaaaaaagcggatggctatggccatgcgacaaaaggcgctcgggacgcttgggatgacgactaacgaaaagggccaggtggtgaccaaaactgccttgctgaagcagatggaagagttaatagaggagcccgggctgacatgttgcatatgcagggagggatacaagtttcagcctactaaggttcttgggatctacactttcactaaaagagtagccctggaggaaatggaaaacaaaccacgaaagcagcagggatacagcactgtctctcacttcaatatcgtgcattacgactgtcatctcgcggctgtgagattagctcgcgggagggaggagtgggaatcagctgcccttcagaacgccaataccaagtgtaatggtctactgcccgtgtggggacctcacgtgcctgagtcagcctttgccacatgcctggcccgtcacaatacatatcttcaggagtgcacaggccagcgcgagccaacgtaccagctaaatatacacgacatcaaactgttgtttcttcgcttcgcaatggaacaatctttcagcgccgatactggcggaggtggacgcgagagcaacatccacctgatcccctacatcatacacacagtactgtacgttctgaatacaacccgggctacctcacgggaggaaaaaaacctgcagggtttcctcgagcagcctaaggaaaagtgggtggagagcgcattcgaagtcgacgggccctactacttcacagttctggccctgcacatcctcccgcctgaacagtggagagcaacccgggtggaaatactgcggagattgctggtgacatctcaagctagggcggtggcaccggggggagcaacgagattaaccgataaggccgtaaaggactattccgcctaccgatcctctctcctgttttgggcactcgtagatctgatatacaacatgtttaagaaggttcccaccagcaataccgaggggggatggtcgtgcagcctagccgagtacatccgacacaacgatatgccaatctacgaagctgccgacaaggccctcaagactttccaggaggagttcatgcctgtagaaaccttcagtgagtttctggacgtggcggggttgctgtcagagataaccgacccggaatcatttctgaaggaccttttgaactctgttccatag

SEQ ID NO: 47709 - DNA, 15615 bp, Artificial Sequence
  Description of Artificial Sequence: Synthetic coding sequence
atggccaccagcggcggcgaggaggccgccgccgccgcccccgcccctgggacccctgcaacaggtgcagacaccaccccgggatgggaagttgccgtcaggccactcctgagcgccagttacagtgctttcgaaatgaaggagcttccccagctggtggcctccgtcatagagagtgagtcagagattctccaccacgaaaaacagtatgaaccgttttattcatctttcgtggcgctgtcaactcactacatcactactgtttgcagcctcattccaaggaatcagctccagtctgtggcggccgcctgtaaggttctaatcgagttttccctcctacggcttgagaatccagacgaagcgtgcgctgtctcccaaaaacacctaatcctcctaattaagggcctctgcactgggtgttcaaggcttgaccggacggaaattatcacttttacggcaatgatgaagtccgctaaactcccgcagaccgtgaaaaccctgtctgacgtcgaggatcaaaaagagctggcgtctccagtctctccagaactccggcaaaaagaggtgcaaatgaattttcttaaccagctcacgtctgtgttcaaccctaggactgtagctagccagccaatctccacacagactttggttgagggtgaaaatgacgagcagtctagcactgaccaggcaagcgccattaagacaaaaaatgtgtttatagcccaaaacgttgcctccctgcaggagctgggaggatccgagaagctgctcagagtctgcctcaatctcccatattttttgcgctacattaatagattccaggacgcagttctcgcaaactcttttttcataatgcctgccacggtggccgatgctactgccgtgaggaatgggttccatagtctagtgatcgatgtgactatggctttagataccctcagtctgccagttctggaaccactgaatccctcccggttgcaggacgtgacagtgctgagcttgtcctgcctttacgctggagtgagtgttgcaacctgtatggccatcctgcatgtgggatccgcacagcaagtaaggacagggagcacttcaagcaaggaagatgactacgagtctgacgccgcaacgatcgttcaaaaatgccttgagatctatgacatgatcggacaagctatctcaagctctaggagggctggcggggagcattaccagaattttcagctcctgggtgcctggtgtcttttgaattctctattccttatcctgaatcttagcccaacagctctcgctgataaaggcaaagagaaggacccactggccgccctgcgagtccgagacatactgagtcggacaaaagaaggtgttggtagcccaaagctcggacccggtaagggacatcagggctttggcgtgttgtccgttattctagcgaatcatgctattaaactgcttacttctctcttccaagatctgcaggtggaagcactccataaaggatgggagactgacgggcctccggccgctctgtccattatggcacaatccacctccatccagcggattcaaagactaatagattcagtccctctcatgaacctcctgcttactctgctaagtactagttatagaaaggcatgcgtgcttcaaagacagcgtaagggcagcatgtctagtgacgcttccgctagcactgacagcaatacgtattacgaggatgacttcagttcaaccgaggaggacagctcacaggacgacgacagtgaaccaatcctagggcagtggttcgaggaaaccatctctccctccaaagaaaaggccgcgccgcctcctcctcctccacccccaccattagaatcctctcctcgcgtcaagagtccttccaagcaggcacctggggaaaaaggcaacattttagctagtcggaaagatcccgaactattcctggggcttgcctccaacatcttgaatttcatcacatccagtatgctgaacagtcgaaataatttcatcaggaattatctctctgtgagcctgtcagagcaccacatggcgacattagcatccataatcaaggaagttgacaaggatggactcaaggggtcatcagacgaagagttcgccgccgccctctaccattttaaccattccctcgtgaccagtgacctgcagtctccaaacctacagaacacactattgcagcagctcggtgtcgccccattctccgagggtccctggcccttatacatccatcctcagtccctgagcgttttgagccgcctgctcctgatttggcagcacaaagccagcgcacagggggaccctgacgtccctgagtgcctaaaagtctgggaccgatttctcagcacaatgaagcagaacgcattgcagggtgtagtaccatcagagacggaagacctcaatgttgagcatctacaaatgctcttactaattttccataactttaccgaaacgggaaggcgggccatactgtctctgtttgttcaaatcatacaagagctgtcagtaaatatggacgcccagatgcgcttcgtgccattaatactagctcgcctgctcctcattttcgattacctactgcatcagtacagcaaagctccagtatatctgttcgagcaggtgcagcacaacctgctgtcccctccttttggttgggcctcaggctcacaggactccaattcacgaagggccacaactcccctctatcatggctttaaggaggtggaggaaaactggtctaagcacttttccagcgatgccgtgccccatccaaggttctattgcgtgctgtctccggaggccagtgaggacgacttaaatcgcctggactctgttgcttgcgacgtgttattttccaaactcgttaagtatgacgagctgtatgccgcgcttaccgctttgcttgccgccgggtctcagctagacacggtacggcggaaggagaataagaacgtgacggctctggaagcttgtgctctccagtactatttcctcatcctctggcggattcttgggattctgcctcccagcaaaacctacattaaccagctgtccatgaactcccccgaaatgtctgagtgcgatattttgcatactctgcgatggtcaagcagactgcgaatcagcagctacgtgaattggatcaaggatcatctaataaagcagggcatgaaagcagaacacgcatcctcactgctggagctggcctcaactactaaatgttcctctgtaaaatatgatgttgagatagttgaggaatactttgcccggcagatctcaagcttctgctcaatcgactgtacgacaatactgcaactccatgagatccccagcctgcagagcatttataccctggacgccgcgatttccaaagtgcaggtatccctggatgaacacttttccaagatggccgcagagactgacccacacaagtcgtctgagattacaaaaaatctcctgccagcaacccttcagctcattgacacatatgccagcttcactcgtgcgtatcttctacagaattttaacgaggagggaacaaccgaaaagccaagcaaggaaaagctacagggattcgcagcggttctggctatcggatcatccaggtgcaaggctaatacactgggacctaccctggtgcagaaccttccgagctctgtacagacagtttgcgagagctggaacaacattaacaccaatgagtttccaaacatcggatcatggagaaacgcattcgcaaacgacacgattccatcagaatcttacatcagcgccgtgcaggctgcccatttagggacactgtgttcccagtccctcccgctggccgccagcctgaagcatacactgttatcgttggtgcggctgacaggagacttgattgtgtggagcgatgaaatgaatccgccccaggtcatccgcaccttgctgccgctgctgctcgagtccagtacagagagcgtggcagaaatctcctcaaatagcctcgagaggatcttgggacctgccgagagcgacgaatttctagcgcgcgtttacgaaaagctgatcacaggatgctataacatacttgccaatcatgctgaccccaattcaggactggatgaaagcattctggaggagtgtttgcagtaccttgaaaaacaactcgaatctagtcaggctcggaaggcgatggaggagttcttctccgattcgggagaattggttcagatcatgatggctacagccaacgagaacctgtctgccaagttttgtaacagggtccttaaattcttcaccaagctatttcaattgacagaaaaaagtcctaatccaagccttctgcatttatgtggatccctggctcaactagcttgcgtagagccggttcggcttcaggcctggctcaccagaatgacaacctctcccccaaaagatagcgaccagttagatgtgatccaggagaatcgccaactcctgcagctcctaaccacctatatagtcagggagaattcccaagtgggagaaggcgtgtgcgctgtcctgctcggtacactgacacctatggctaccgagatgctggcaaatggtgatggtacgggctttcccgaattgatggtggtcatggccacactcgccagtgccggccaaggcgccggacacctccagttgcacaatgccgccgttgattggctgagtaggtgcaaaaaatatctgtctcagaaaaatgtggtagagaagctgaatgccaacgtcatgcatggcaagcacgttatgattctggagtgcacatgccacatcatgtcatatctagcagatgtgacaaacgccttatcacagtcaaatggccagggcccctcacatttgagcgtcgatggagaagaaagggccatcgaagtcgattccgactgggttgaggagctggctgtggaggaggaggactcccaagctgaggactcagatgaggattctctctgcaataagttgtgcacattcacaataacccaaaaggagttcatgaatcagcactggtaccactgccatacctgtaaaatggttgacggcgtgggcgtatgcaccgtgtgcgccaaagtctgtcacaaagatcacgaaatttcctacgccaaatatggcagtttcttctgtgactgcggagctaaggaggacggctcatgtctcgcgctcgtgaagcgtactccatcgagcggaatgtcttcaacaatgaaggagtccgcctttcagtctgagcctagaatctccgaatctttagtcagacacgctagcacctcctctcctgccgacaaggctaaagtgactataagtgacggtaaggtcgcggacgaagaaaagcctaaaaagtcttctctgtgtcggacagtggaagggtgtcgtgaggagctgcaaaaccaggccaatttctcctttgcgcccctagtgctcgacatgctcaatttcttgatggatgccatccagactaactttcagcaagcgtcagcagtgggctcgagttcaagagctcagcaggcactttccgaactacataccgtggaaaaggcagtcgagatgactgatcaactgatggttcctacactgggctcccaggagggagcttttgagaacgttaggatgaactattctggggatcaaggccagactatccggcagctgatttctgctcacgtcctgcgccgtgttgctatgtgcgtgctctcttcccctcacggcagacggcaacatctggctgtgagccacgagaagggcaagattactgtgctgcagcttagtgctcttctcaaacaggcagacagttcaaaacgtaaacttacactgaccagactggcatccgccccagtcccgttcactgtgctcagccttaccggtaatccctgtaaggaggattacctggccgtgtgcggactcaaggattgccacgtgttaaccttcagtagtagcggatcagtgtcagatcacttagtattgcatccgcagcttgccacaggaaattttataataaaggccgtttggttgccgggctcgcagaccgagcttgctatcgtgaccgcagacttcgttaaaatctatgacctgtgcgttgacgctctgtctccaactttctatttccttttgccttcaagcaagatccgcgacgttactttcctgtttaatgaggaaggcaagaatattatcgtcataatgtctagcgctgggtatatatacacacagctgatggaagaagctagttcggctcaacagggtccattttacgtgacaaatgtgctggaaatcaaccacgaggatcttaaggactccaatagtcaagtcgccggaggcggtgtttcggtgtattactcacacgtgttgcagatgttgttctttagctattgccaagggaagtcttttgctgcaaccatctccagaacgactctggaggttttacagctgttccctatcaatattaaatcttccaatggtggttctaagacttcccctgccctctgccagtggtcagaggtgatgaaccatcccggcctcgtgtgctgcgtgcagcaaaccacaggcgtgcccttggtcgtcatggtgaaacctgatacattcttgatccaggaaatcaaaacccttccagcaaaggctaagatccaggatatggtcgcgatcaggcacacagcttgcaatgagcagcagaggacaaccatgattttgctctgtgaggatgggagcctccgcatttatatggccaatgtggaaaacacctcttactggctgcagcctagccttcaaccgagtagtgtgatctctatcatgaagccagtgagaaaaagaaaaaccgctactattaccaccaggaccagcagtcaggtaacgttccccattgatttctttgaacataaccaacagctgacagatgtcgagttcggaggtaacgacttactacaagtatataatgcacagcagatcaagcacagactgaattctactggtatgtatgttgccaatacgaaaccaggtggctttactatcgagatttctaacaataacagtaccatggttatgactgggatgagaatccagattgggacacaggctatcgaacgcgcaccatcttatattgaaatttttggccgcactatgcagctgaacctcagccggagcagatggtttgacttcccttttacccgcgaggaggccctacaggcagataagaagttaaatttgtttatcggggcatcagtggacccagcgggggttaccatgatcgacgccgtcaagatttacggaaagacaaaagaacagttcggttggccagatgagccccccgaggagttcccatcagcttccgtatcgaacatctgccccagtaatctcaatcagtccaacggcaccggagactctgattctgccgcccccacgacgacatccggcacagtactcgagcgtctcgtggtatcttccctggaagcactggaatcatgctttgccgtcggtccaatcatcgaaaaagagaggaacaagaatgcggcccaggaactggcaacccttcttctgtcactccctgcccccgctagtgtgcagcagcagtctaagagtctcctggcctccctgcacacgagtagatctgcttatcactcccacaaggatcaagctctgcttagcaaagctgttcagtgcctgaatacgagcagcaaggagggtaaggatcttgaccctgaggtgtttcagcggcttgttattactgctcgctctatcgcaattatgagaccaaataacttggtacacttcacggagagcaaactaccccagatggaaactgaaggaatggatgagggtaaggagcctcagaagcagctcgagggtgattgctgcagctttattacacagttagtcaaccacttttggaagctgcacgcaagcaaacccaagaacgccttcctcgcccctgcctgtcttccagggctgacgcacattgaggccacagttaatgcattagttgatatcatccacgggtactgcacctgcgagttggactgtattaatactgcctccaaaatatatatgcagatgctgttgtgtcctgaccccgccgtgagctttagctgtaaacaggccctgatcagggtgttaagaccgcgcaataagcgcagacacgtcaccctaccctcgtctcctagatcaaatacccccatgggcgataaagatgatgatgacgacgatgatgccgatgagaaaatgcagtccagcgggatccccaatggaggccacatccgacaggagagtcaagagcagtctgaggtggaccatggagatttcgagatggtgtccgagagcatggtcctggagactgcggaaaacgtgaacaatgggaacccatctcctctggaggctcttctcgctggagccgaggggttcccaccaatgcttgacatccctccagacgcagacgacgagactatggttgagctggccattgctctctctttacagcaagatcagcagggctctagttcctcagcactcggcctgcagtcccttggcctgtctggtcaggcaccatctagcagtagtctcgatgccggtacgttatccgacacaaccgcctcggcacctgctagtgacgacgagggttccacagctgccactgatggctcaacccttcgaacatctcctgccgaccatggaggatcagttggcagcgaaagcggcggcagcgctgtggatagtgtcgcaggagagcactccgttagcggccgttcttccgcatatggcgatgcaacagccgaaggccaccctgcaggtccaggctcggtttcatccagcacaggggcgatatcgacgaccaccggacaccaggagggtgatggcagtgagggagagggcgaaggagagacagaaggagatgtgcatacctcaaacaggctgcacatggtccgactgatgctgttagagaggctattgcagactttgccccaactccgaaacgttggcggcgtgcgcgctatcccatacatgcaggtcatcctgatgctgactacagaccttgatggagaggatgagaaggacaagggagcgctggacaacctcctgagccaacttattgccgaacttggcatggataaaaaggacgtctctaagaaaaacgagcggagtgccctaaacgaggtgcatttagttgttatgcggctactgtccgtttttatgtcgcgtacaaagtccggctctaagtcctccatatgcgagagctcaagccttattagcagcgctactgcggccgccttgctatcgagcggcgctgtcgattattgcctgcacgttcttaagtctctcctggagtactggaagtcccaacagaacgacgaggaacccgtggctacctcccagctgcttaaacctcataccaccagttcgcctcctgatatgagtcctttttttctgcggcaatacgtgaaggggcatgccgctgatgtgtttgaggcctatacccagttgctgacggaaatggtcttgagattaccctatcagatcaaaaaaattaccgacaccaactcaaggatcccaccccccgtgtttgatcactcttggttttacttcctttctgaatacctgatgatccaacagaccccatttgtccgaagacaggtgcgcaaactgctactgttcatttgtggcagtaaggagaagtacagacagctgcgcgacctccacacactggactcccatgtgcgaggtatcaaaaaactgctcgaggagcaaggcatcttcctccgggcctccgtggtcaccgccagttctgggagtgccctgcagtatgacactctgatcagtctgatggagcatttgaaggcctgcgcggagattgccgcacagcggacgattaactggcaaaagttctgcattaaagatgattcggtgctttattttctgctccaggtctccttcctggtggatgaaggggtgtctccagttctgctgcagcttctatcatgcgctctgtgtggttccaaggtcctggccgcgttggctgcatcctccggcagctcttcagcctcctccagctccgctccagtggcagcctcctcaggccaggcaacaactcagagtaaatccagcacgaaaaaatcaaaaaaggaagaaaaagaaaaagaaaaggatggagaaacctccggatcgcaggaggatcagctgtgtacggcccttgtcaaccagctcaacaaattcgccgataaagaaacactgattcaatttctccgatgctttttgctggagagcaatagcagttcagtgcgctggcaggcacattgtttgacccttcatatataccgtaattcttctaaatctcaacaagagttgttactggacctcatgtggtccatctggccagagttacccgcttacgggcggaaggccgcacaattcgtggacctgctggggtatttcagccttaagaccccacagaccgagaagaaacttaaagagtattcacaaaaggcagtcgaaatcctacggacacaaaaccacattctgacaaaccacccaaatagcaatatctataacaccctctccggcttagtggagttcgacgggtattatctcgagagcgacccatgccttgtctgtaacaatccagaggtgccattttgctatatcaagctttcctcaatcaaggtggatacacgctacacaactacccagcaggttgtgaagttgatcgggtctcataccatcagtaaagttactgtcaagatcggagacctgaaacgaacaaagatggtgaggacaattaacctttactacaacaaccgaactgtgcaggcaattgtggagctcaagaataagccggcccggtggcacaaggctaaaaaggtgcagttgacccccggacagacagaggtgaagattgacttgcccctgccaatcgttgcatcgaaccttatgattgagtttgcagatttttacgagaattaccaggcaagcacggaaacacttcagtgtccccgttgtagtgccagtgtccctgccaatccaggagtgtgtggaaactgcggcgaaaacgtgtaccagtgtcacaaatgcagatccattaattacgatgaaaaggacccctttctgtgtaacgcttgcgggttctgcaagtatgctcgctttgacttcatgctgtatgctaagccttgctgcgccgttgaccctatagagaatgaagaagaccggaaaaaagcagtcagcaatattaataccctgctggacaaggccgaccgggtgtaccaccaactcatgggacacaggccacagctcgaaaatcttctgtgtaaagtgaatgaagctgctccggagaaaccacaggatgactcgggcaccgcgggaggaatctcctcaacatctgcaagcgtcaataggtatattctgcagttggctcaggaatactgcggcgactgtaaaaactcatttgatgagctgtccaaaatcatacagaaggtatttgctagccgcaaggaattgctggaatatgatctgcagcagagggaggctgccaccaaaagtagtcgtacgtcagtgcagcctacatttacagcaagtcagtatcgggctctgagtgtattaggctgtgggcacacctctagcacgaagtgctacggctgtgcatcagctgtcacagagcactgtatcacactgttaagagcattggctaccaatcccgccctgaggcacattttagtgagccagggcttgatccgggaactctttgactataatctcagaaggggcgccgcagctatgagagaggaagtgagacagcttatgtgcctcttgacccgggataatccagaggccacacagcagatgaatgatctcattataggcaaggtctccaccgcattaaaggggcactgggccaacccagacctcgccagctctctgcagtacgaaatgctactgctcaccgactctatttctaaggaggacagctgctgggaactgcggttaaggtgtgcgctttccttattcttgatggccgtcaacattaaaacccctgtggtggtggaaaatatcacactgatgtgcctgaggattctgcagaaacttatcaagcctccggcgcccaccagcaagaagaacaaggacgtgcccgttgaggcactcaccaccgttaaaccatactgcaacgaaattcacgctcaggcacagttatggctcaagagggatcccaaagcgagctatgacgcctggaaaaagtgcctaccaatccggggtatcgacggcaacggcaaagctccaagcaagtctgaactccgacacttgtacctgacggaaaaatatgtgtggaggtggaaacaatttctgtccagaaggggcaaacgaacatcccctttggacctgaaactcggccataacaattggctgagacaagtcctctttactccggctacgcaggcagcgcggcaggccgcctgcaccatagtcgaagccctggcgacaatcccatctagaaaacagcaggttctagatctgctcacatcgtaccttgatgagctgtctatcgccggggagtgcgcagccgaatatctggccctgtatcaaaaactcattacatcagctcactggaaggtgtacctcgctgccaggggagttctcccttatgtgggtaatctgataacaaaagagatcgcacggttactggcattagaggaggccaccctctccactgacttgcagcagggatatgcactgaagtcactaactggcctgctctcttcttttgtggaggtagagagcatcaagcgacactttaagtcaaggcttgtgggcaccgtcctgaatggatacctctgcctccggaagctggtcgtccagcgcaccaagctgattgatgaaactcaggacatgctgttggaaatgttagaggacatgactacgggtactgagtcagaaaccaaagcctttatggccgtgtgtatcgaaacggcaaaaagatacaatttggacgattaccgcaccccggtattcatctttgaaaggctgtgttcaatcatctaccctgaagagaacgaggttaccgagtttttcgtcacactcgagaaggaccctcagcaggaggacttcctccagggaagaatgccaggcaatccctacagttccaacgagcccggcattggcccccttatgagagatatcaagaacaagatctgccaggactgtgatcttgtggccctgcttgaagatgactcggggatggaattgctggtcaataacaaaatcatatcgctagacttaccagttgccgaggtctataagaaggtgtggtgcacaactaatgagggagagcccatgcgcattgtttatagaatgcggggcctccttggcgatgccactgaggaatttattgagagcctcgactcaaccacagacgaggaagaagatgaagaagaagtctacaaaatggctggagtgatggctcagtgtgggggcttggaatgcatgctaaatcggctggccggcatcagagactttaagcagggtaggcatctgcttacagtgcttttaaagcttttctcctactgtgttaaggtgaaggtaaatcgacaacaactggttaagttagaaatgaatacactgaatgtaatgctaggaacgttaaatttggctctggtagccgagcaggaatccaaggatagtggcggggcggccgtagctgagcaggttttgtctatcatggagatcatcctggacgaatccaacgccgagcctctgtctgaagacaaggggaatcttcttttgaccggggacaaagatcagctagtaatgctgttagaccagattaactccacatttgtgcggagtaacccttccgtcctgcaagggctgctaagaatcattccatatctatcttttggagaggttgaaaaaatgcagattctggtggaacgctttaagccatactgtaacttcgataaatacgatgaggaccacagcggagatgacaaggtgtttctggattgcttctgcaagatcgccgccggcattaaaaacaactccaacgggcatcagcttaaagatctgatcctccagaagggaatcacacagaacgccctggattatatgaagaagcacattccatctgcgaaaaacctcgatgccgatatttggaagaagttcctcagtcgcccagctctgcccttcatcctgcgtttgctcagggggttggccattcagcatccaggcacacaagtgctgatcgggacagattccattcccaacctacataagttggagcaggtttcatcagatgagggcatcggtaccttggccgagaacctgctggaagctcttagagaacaccctgacgtgaacaaaaaaattgatgcggccagacgcgagactcgggccgaaaaaaagcgtatggccatggcaatgcgacagaaagctctcggaacactgggaatgaccacgaatgaaaaaggtcaggttgtgactaagaccgcacttcttaagcagatggaagagctcatagaagagccaggcctgacgtgttgtatctgtcgggaggggtataagttccagcccactaaagtgttggggatctacaccttcaccaagcgggtcgcattagaggagatggagaacaagcctcggaagcaacaggggtactctacagtctcccacttcaatatcgtccactacgactgccatctggcagccgtcaggctcgctcgtgggcgcgaggaatgggaaagcgccgccctgcagaatgccaacacgaagtgcaatgggttgcttcccgtgtggggcccccatgtgccagagtccgcgtttgccacttgcctcgccaggcacaacacatatctgcaggagtgcacagggcagcgcgagcctacttaccagttaaatattcatgacataaaactgttgttcttgcgctttgcgatggagcagagtttcagtgcagataccggaggtggcggaagagaatccaacatccatctgattccgtacatcattcatacagttctctacgttctcaacactacaagagcaaccagtagagaggaaaaaaacctccaaggcttcctcgaacagccaaaggaaaaatgggtggaatcagccttcgaggtggacggaccttactatttcacggtgctagctctccacatattgcctcccgaacaatggcgggctacccgtgtcgaaattcttagaaggctgctggtaaccagccaagcgcgggccgttgcacctggcggtgccacacgactcacagataaggccgtaaaggactattcggcataccgcagttccctactgttttgggcattggtggatttaatctacaatatgttcaaaaaacagacgacacccaccgtgggcggtatagataccgggagtttggaaccgtgtgtgtgcgagaaggtcccaacttcaaacaccgagggcggatggtcatgcagcctggctgagtacatccgccacaacgacatgccaatttacgaagctgccgataaagccctcaaaacattccaggaggagtttatgcccgtagagactttcagtgagttcctggatgttgcgggacttctatctgagataaccgatccggagagctttttaaaggacttgctgaacagcgttccctag

SEQ ID NO: 47710 - DNA, 6177 bp, Artificial Sequence
  Description of Artificial Sequence: Synthetic coding sequence
ctggtgcggctgaccggcgacctgatcgtgtggagcgacgagatgaacccgcctcaggttatacggaccctcctgccgcttctcttggagagttctacagagagtgttgcggagatttcctcaaattccctggaacgaatcctgggtccagcagagtccgacgaattcctggcaagagtgtatgagaaattaatcacagggtgctacaacatcctcgctaaccacgctgatcccaacagtggactcgacgagagtatcctggaagagtgcctgcagtacctcgaaaagcagttggagagcagccaggctcgtaaagcaatggaggaatttttctctgattctggagagttggtacagataatgatggccaccgccaatgaaaatttaagtgcaaaattctgcaatcgggtgctcaaattcttcacaaagcttttccaactgacggagaagtcaccgaatccctccttgttacacctgtgcggtagcttggcacagcttgcatgtgtggagcccgttcggctacaggcttggctcacaagaatgactacatcccctcccaaggattcagatcagttagatgtgatacaggagaacagacaactactgcaactgctgacgacatatattgtgagagaaaatagtcaagtcggcgaaggggtctgtgctgtgcttttggggaccctcactcccatggctacggagatgctagccaacggcgatgggaccggatttcctgagttgatggtggttatggctaccctcgcgagcgctggtcagggtgccggccacctacagctccacaacgcagcggtagattggttgtcgcgctgcaaaaagtatctctcacaaaaaaacgtcgtggagaaactgaacgccaatgtgatgcacggaaagcacgtgatgatactcgagtgcacatgccatataatgtcctacttagcggacgtgacgaatgccttgagtcagtccaatggacagggtcccagccatctgagcgtggacggagaagagcgggcaatcgaagtcgattccgattgggtagaggaactcgctgttgaggaagaggattctcaggccgaagattctgatgaagacagcctgtgtaacaagctgtgtacattcactattactcaaaaagaattcatgaaccagcactggtaccactgccacacctgcaaaatggtggacggcgtgggcgtgtgcacagtgtgcgctaaagtgtgtcataaggaccacgaaatctcttatgctaaatacggatcattcttctgcgactgcggtgctaaagaggacggtagctgtctagctctagtgaaacgcacgccctcctccgggatgtcctccactatgaaagaatctgcattccagtcagaaccccgcatctctgagtccctggtcaggcacgccagtacatccagtcctgccgacaaagccaaggtgaccattagcgacggcaaggtggcagacgaggagaagccaaaaaaatcctctctgtgtaggactgtggagggttgccgagaggaactgcagaaccaggccaacttctcctttgcccccctcgtattagatatgcttaattttctcatggacgccattcagaccaattttcaacaggctagcgcagtaggatcttcctcacgggcccagcaagcgttatctgaactccacaccgtggagaaagcagtggaaatgacagatcaactaatggtccccaccttgggctcacaggagggtgcctttgagaatgtgcggatgaactattccggagatcagggtcagaccatccgacaattaatttccgcgcacgtcttgagaagggtggccatgtgcgttctgagctccccccatggacggaggcaacatctggcagtttctcatgaaaagggaaagattacagttctccagctgtctgcgctattgaagcaggcggacagtagcaagaggaagttgactttaacccggctagcctctgcacccgtgccttttacagttctgtcgctcaccggaaacccgtgtaaagaggattatctagcagtatgcgggctcaaggactgccatgtgctcacattttcatcatccggatcggtgagcgatcatctggtattgcacccccagctcgcaactggcaattttattatcaaggccgtgtggcttcccggctctcagactgagctcgcaattgtgacagcggactttgtaaaaatctacgatctctgcgtggatgccctgagccccactttttatttcctgttgccttcctccaaaatccgagacgtaacttttctcttcaacgaggaaggaaagaacataattgttatcatgtcgagcgccggttatatctacacgcaactgatggaagaggcctcaagtgctcagcagggtcccttttacgtaacgaacgtgctcgaaatcaaccacgaagatctcaaggactcaaatagtcaggttgctggcggaggggtgagcgtgtactattcacacgtgcttcagatgctgttctttagctattgtcagggaaagtccttcgccgctactatctcccgcactaccctggaagtactgcagctgttccccattaacatcaaaagcagtaatggcggttccaagaccagccccgctttatgccaatggagtgaagtcatgaaccaccccgggcttgtctgctgtgtgcagcagaccaccggagtaccactggtagtaatggttaaacccgacacttttctgatccaggagattaaaacgcttccggcaaaagccaaaatacaggatatggttgccattaggcacacagcatgcaatgaacagcagcgcaccacaatgattttactgtgtgaagacgggtcattgaggatttacatggctaacgtggagaacacttcttactggctccagcctagtctgcagcccagcagtgttatatccatcatgaagcctgtgagaaaaagaaaaaccgctacaataacaactcgaaccagtagccaggtgacctttccgatagatttttttgaacacaatcagcaactcactgatgtagagtttgggggcaacgacctgttgcaagtttataacgcccagcagatcaagcaccgcctgaactcaaccggcatgtatgtggcgaacaccaaacccgggggattcaccatcgagatctcaaataataacagtaccatggtcatgaccggcatgcggatccagatcggtacccaagccatcgaaagggcgccgtcgtacatagagatcttcggtaggacaatgcagctgaacctatcccgaagtcgttggtttgacttcccttttacccgagaagaagctctgcaggccgacaagaagctcaacctattcataggcgcatcagttgacccagcaggggtaaccatgatcgatgctgtgaagatctacggtaagacaaaagagcagtttggatggcctgacgagccccctgaagaattccctagtgcctctgtaagcaacatctgtccctctaaccttaaccagtctaacggcactggcgacagtgatagtgccgcaccgaccactacatctggcacggtcttggaatcgagtgagaccgagagcttgaccaaacttgatagactggtggtgtcatccctcgaagccttggaaagttgctttgccgtgggccccatcatcgaaaaggagagaaataagaatgccgcccaggagctagccaccctcttgctgtctctgcccgcacctgcctccgtgcaacagcaatcaaagtctctcctagcatcactacatactagtcggtctgcctatcacagccataaggaccaggcccttctgagtaaagctgtgcaatgccttaacacaagttccaaggagggaaaggaccttgatcccgaggtctttcagagactcgttataacagctagatcaatcgctattatgcgccctaataacttagtccatttcacagagtccaagctacctcagatggagacggaaggcatggacgagggaaaggaacctcagaagcagctcgagggagattgttgtagtttcatcacccagctcgtcaatcacttctggaaacttcatgcctccaagcccaagaacgccttccttgcacccgcttgtctccccggactgacccacattgaggccaccgtcaacgccctggtcgacatcattcacggctactgtacatgcgagctggactgcattaatacagcaagcaaaatatacatgcaaatgttgctttgtccagacccggctgtgagcttctcctgcaaacaggctctcattcgtgtgttaagacctcgaaacaaacggaggcacgttactctgccctcgtcaccccgcagcaacacccctatgggagacaaagacgatgatgacgatgacgacgcagacgagaagatgcagtcgagcggaattccaaacggaggtcacatccgccaagaaagtcaggaacaatctgaggtggatcacggcgactttgagatggtcagcgagagtatggtcctggagactgccgaaaatgtgaataacgggaatccttcacctctcgaggctctgctggctggtgctgagggcttcccaccaatgctggatatcccgcccgatgctgacgatgagacaatggtggagctggcaattgcattgagcctccagcaagatcagcaggcgcccgcttcagatgacgaggggagcacagcagctactgatggtagcacgctgcgaacctcaccagcagaccacggcgggtctgtcggatctgaatctgggggcagcgctgtggactcagtggctggcgagcacagtgtctctggacggtctagcgcctacggagacgccactgccgaaggccatccagccggcccagggtccgtgagctcatccacaggagcgatttcaactacgacaggccatcaggagggagatgggagtgagggagaaggagagggggaaaccgaaggagatgtgcacacatcaaatcgacttcacatggtccggttgatgttacttgagcgactgcttcagacgctgccccagttgcgtaacgtaggcggcgtgagagctataccgtacatgcaagtcatcttgatgctaaccacggatctggacggcgaagacgaaaaagacaaaggagccctcgacaacctgctatcccagctgattgcagagctgggcatggacaaaaaggatgttagcaaaaagaacgaacgaagtgcactgaacgaagtgcatctcgtggtgatgcgcctgctgagcgtgtttatgagccggactaagtcaggtagcaaatccagcatctgcgaatctagctctctcatttcatcagccaccgccgccgctttgctgagttctggcgctgtggactattgcctccacgtgcttaaatccctgcttgagtactggaaatcgcaacagaatgacgaggagcctgtagcaactagtcagttgctcaaacctcacacaacctcttcaccaccagacatgtccccattttttctcaggcagtacgtaaaaggccacgccgcggacgttttcgaagcatacacccaacttcttacagagatggtattgcggctgccataccagattaagaaaatcactgacactaacagcagaattccacctccggtgttcgaccatagctggttctatttcctgtctgagtatctgatgattcagcagacccctttcgttcgtcggcaggttagaaagctgctcctgttcatttgcggctctaaggaaaaatacagacaacttcgagatttgcataccctggactctcacgttcgcggcatcaagaagctgttggaggaacaggggatattcctgagggctagcgttgtgaccgcttcttcaggtagcgccctacaatacgatactttgatcagcttgatggaacacctcaaggcatgcgccgagattgccgctcaaaggaccatcaattggcagaagttttgtatcaaggacgatagcgtgttgtattttttgctccaggtttcctttctggtggacgagggtgtctccccggtactgctgcagttacttagctgcgcactgtgtgggtcaaaagtgctcgctgctctggctgctagctccggatcctccagcgcgtccagtagttctgcacccgtcgcggctagctccggccaggctaccacacagagcaagagctctacaaagaaaagcaaaaagtag

SEQ ID NO: 47711 - DNA, 5019 bp, Artificial Sequence
  Description of Artificial Sequence: Synthetic coding sequence
cggttcctgagcaccatgaagcagaacgccctgcagggcgtggtgcccagtgaaacggaggatctaaacgtagagcatttgcagatgctcttgctgatcttccacaactttacagagaccggacgccgggccattttgtcactcttcgtgcaaattatccaagaacttagcgtgaatatggatgctcagatgcggtttgttcctcttatcctggcacgtttgttgctgattttcgattacctcctacatcaatactccaaagccccggtctaccttttcgagcaggtgcaacataatttactttctcccccattcggatgggcgagtggaagtcaagatagtaatagccgccgagccaccacccccctttatcacgggtttaaagaggtggaggagaattggtctaagcatttctccagcgacgccgttcctcaccctcgcttctattgtgttctgagccctgaggcctccgaagatgacttgaacaggttggactcagtggcctgcgacgtgttgttctccaaactggttaaatacgatgaattgtacgcagctctcactgccctgctggctgctggatcccagttagataccgttagaaggaaagaaaataagaatgttacagccctggaggcttgcgcactccagtactacttcctcatcctctggcggatcctgggcatcctgcccccgtcgaagacatacatcaatcagctttctatgaattcacccgagatgtctgagtgtgacatcctccacactctaaggtggagctcccgactccgtattagcagctacgtcaattggatcaaggatcacctgatcaagcagggaatgaaggctgaacatgcctcttccctgttggaattagccagcacaaccaaatgttcaagcgtcaagtatgacgtggaaatcgtcgaggaatacttcgctcgccaaatttcttccttttgtagtatcgattgcaccacgatcttgcaactgcacgaaattccctcgctgcagagcatttacacactggatgctgcgattagcaaggtgcaggtctcattggacgaacacttttccaaaatggcagccgagactgatcctcacaaatcttccgagattacgaagaacctcttgcccgcaactttgcagctgatcgacacctacgcaagttttacccgagcatatttactccagaattttaacgaggaaggaactacagaaaaaccctctaaggaaaagttgcaaggcttcgcagccgttttggctattgggtccagccgatgcaaagccaatactctcggccctactcttgtgcagaatctgccttctagtgtccaaactgtgtgcgagtcgtggaacaatataaatacgaacgaattccccaacattggctcctggcgcaacgcctttgcgaatgatacaatccccagtgagagttacatcagtgccgtccaggctgcccatctcggcaccctctgcagccagagcctccccctcgctgcttcactgaaacacaccttactgagtctggtgcgcctaactggcgacctgattgtttggtccgatgagatgaatccaccccaggtgatcaggacccttctgcctctgttactcgaatctagtactgaatccgtagcggagattagctctaatagcctggaacgcattcttggacccgccgagtctgacgagttcttagcaagagtgtacgagaaactcattaccggatgctacaacattctggccaaccatgccgatcccaattcaggactggatgaatcaatcctcgaggagtgcctgcagtatcttgaaaaacagctggagagctctcaggcccgtaaggccatggaagaattcttctccgacagtggcgagctcgttcaaatcatgatggctaccgcaaacgagaatctgtcggctaagttttgcaaccgcgtgctcaagttttttactaagctttttcagcttaccgaaaagagtcctaacccaagccttctgcacttgtgtggaagcttggcccagctggcctgcgtggagccggtcaggctccaggcatggctgaccagaatgactacatcccccccgaaagactcggatcagctggacgtgattcaagagaatcggcagcttctccagttgctaaccacctatatagtccgtgaaaatagccaggttggtgaaggggtgtgcgccgtcctcctcggcaccttgacgcccatggcaacagagatgctcgccaacggggatggcactggtttccctgaactgatggtggtcatggcaactctggcttccgccgggcagggtgccgggcacctgcaactgcacaatgctgcggtcgactggctgtctcgctgcaagaagtacctgagccagaaaaacgtggtggagaagttgaatgctaacgtgatgcacggtaagcacgtaatgattctggagtgtacttgtcatattatgtcctatctggcagatgtgacgaacgccttatcccaaagcaacgggcagggcccctctcacttgagcgttgatggcgaggaacgcgccatcgaggtggactcagattgggtggaagagctcgctgtggaggaagaagattctcaggcagaggactctgacgaggatagcctgtgtaacaagctctgcacatttaccattacacagaaggagtttatgaaccagcactggtaccattgtcacacttgtaaaatggtggatggcgtcggggtctgtacggtctgtgccaaggtctgccacaaagaccatgaaatctcctatgccaagtacggttcttttttctgcgattgcggagccaaggaagacggatcatgcttggctctggtgaagcgcactcccagctctggtatgtcttccacgatgaaggaaagcgcattccagtcagaaccaagaataagtgagtctctggtgcgccacgcaagcacgtcttcccctgccgacaaagcaaaagtgacgatcagcgacggcaaggtggcagacgaggagaagcccaaaaaaagttctctctgtcggacggtcgaaggctgccgcgaggaacttcagaatcaggcaaatttcagctttgctcctctggtcctggatatgctgaattttctgatggatgcgatccagaccaattttcagcaagcctctgctgtcggatcgagctctagggcacaacaggctctgagcgaactgcacaccgtcgagaaagctgtagagatgacggatcagttgatggtcccaacactgggaagccaggaaggcgcgttcgagaacgtgaggatgaattacagcggggatcaggggcaaaccattcgccagttaatttcagctcacgtcctccgacgcgttgccatgtgtgttttgtccagccctcacggacgccggcagcacctggcagtctctcacgaaaaggggaaaattaccgtcctacagttaagcgccttactgaaacaggcagattcctctaaaaggaagctgacccttacgaggcttgcatctgccccagtccctttcactgtcctcagcctcaccgggaacccatgtaaagaagattacctggctgtctgcggacttaaagactgccatgtgttgacgttcagcagctcaggcagcgtaagtgaccatctcgttcttcaccctcagctcgctacgggaaatttcatcatcaaggccgtatggctgccggggagccaaacagaactggctattgtgacggctgacttcgtgaagatctacgatctgtgcgtcgacgctttgtcccccaccttctactttttgctaccgtcatctaaaatcagggacgtcacatttcttttcaatgaagaaggcaaaaatattattgtcataatgtccagcgccggctacatttacacacagctcatggaggaagcctcatccgcccagcaggggccattttatgtcacgaatgtacttgaaattaatcacgaggaccttaaacaggacagtaacagccaggtggctggcggcggtgtgtccgtatattacagtcacgttcttcagatgttgtttttcagctattgccaaggaaagagtttcgccgcgactatttcgagaactactctggaagtacttcagctgttcccaataaacattaagtcttctaatggaggctctaaaacgagtcctgccttgtgccaatggtcagaagtgatgaatcatccaggccttgtgtgctgcgtgcagcagaccaccggagtaccactggtggtgatggtaaaacccgacactttccttatccaggagatcaaaacattacctgctaaggccaaaatccaagacatggtcgctatccgccacaccgcgtgcaacgaacagcagcgtaccaccatgattctgctttgtgaggatggctctctccgcatctacatggctaatgtcgagaataccagctactggctgcagccttcactccaaccctcatccgttatttctatcatgaagcctgtgcgtaaacgaaagaccgccactatcactacacgcaccagttcccaggtgacattcccaatcgactttttcgaacataaccaacaactgaccgacgtggagttcggcggtaatgatttattacaagtatacaacgcccaacagattaaacacaggctgaactccacagggatgtatgtcgccaatacaaagcccggtgggtttaccattgagatatctaataataatagcacaatggtgatgacagggatgcgtatccagatcggaacccaggccatcgagcgtgctccatcatatatagagattttcgggcggaccatgcagctgaatttgagccgctcgcgatggttcgattttcccttcactcgcgaagaagcgctccaggctgacaagaagctgaacctattctctgaaagtcctacccctggagccgatagtgttctcatcgtgacagcaaagctgggggcgacaggattgtggctctctaacattctgggctcattacactcagccgatttttctgttctgagctcaggcaactttgagctgcatttaatgtactag

SEQ ID NO: 47712 - DNA, 2955 bp, Artificial Sequence
  Description of Artificial Sequence: Synthetic coding sequence
gacttccccttcacccgggaggaggccctgcaggccgacaagaagttgaacctgtttatcggggcctctgttgaccctgccggagtgactatgattgatgccgtgaagatttatgggaagacaaaagagcagttcgggtggccggatgagcccccggaggaattccctagcgcaagcgtatctaatatctgcccctcaaatcttaaccagtccaatggcactggtgattctgactctgctgcacccaccacaacgtctgggactgtcctggagcgcttagtggttagttcattggaagctttggaaagctgttttgccgtgggacctatcatcgagaaggaaagaaacaagaatgccgcacaggaactggcaactcttctgctgagtcttccggctccagccagtgtgcagcagcagagcaagtccctgctcgccagccttcacacgagcagaagtgcctaccattcgcataaggatcaagctctcctgtctaaggccgtccaatgccttaatacaagctcaaaagaaggcaaagacttggatccagaggtcttccaacgactggtcataactgccaggagtattgctattatgaggcccaacaacttggtgcacttcacagaaagcaagctgcctcaaatggagactgattgcttttttcccagatgcgcctgctggtccctaggaattgtgggcattctgattggggcgccattggagactccctctcccgaaggcatggatgagggaaaagagccccaaaaacagctggagggcgattgttgctcttttattacccagctggttaaccatttctggaagctgcacgcgagtaagcctaagaacgcctttctggcccccgcctgccttccaggcttaacacatattgaagctactgtgaacgcactggttgatataattcatgggtattgcacatgcgagcttgattgcattaacaccgcaagcaagatctacatgcaaatgctgctttgccctgacccagcagtgtccttcagctgcaagcaagctctcataagggtgcttcggcctcgcaacaaaaggcgccacgtgactttgccgagtagtccccgatccaatactccaatgggcgacaaagacgacgatgatgacgacgacgccgatgaaaaaatgcagagctccggcattccgaacggcggccatataagacaagagtcacaggagcagagtgaggtagaccatggagatttcgagatggtgtcagaatccatggtgctcgaaacagccgagaatgtgaacaacggaaacccaagtcctctggaagcactgctagctggagcagaaggcttcccccccatgctggatattcctccggacgcggatgacgagacaatggtagagcttgccatcgcactgagcctgcaacaggaccagcaggccccagccagcgacgacgaaggatccacagccgcaaccgatggaagcactctgagaacctctcccgccgatcacggggggtctgtaggttcagagtcggggggatccgctgtggactccgtggctggggaacacagtgtgagcgggcggtcttctgcatacggagatgcaacagctgaggggcacccggccggtcctggatcggtatcttcttccacaggcgcaatatccaccaccacagggcaccaagaaggcgacggctccgagggcgagggcgagggggaaaccgagggggatgtacatacctccaatagactgcacatggtcagactgatgcttctggaacggctgctgcagacacttccacagctccgtaatgtcggtggggtgcgcgccatcccctatatgcaggtcattctcatgctgacaaccgatctggatggcgaagatgaaaaggacaaaggggccctggacaacctgttaagccagctaatagctgagctggggatggacaagaaggatgtctctaagaagaatgaaagaagtgctcttaacgaggtgcatctcgtagtgatgaggttgctttccgtgtttatgagcagaactaaatccggctccaaatcaagcatctgtgagtcttcctcattgataagctctgccactgctgccgccctgctcagctccggagccgtggactattgtctacacgtactcaaatctctactggaatattggaaaagtcagcagaatgatgaagagcctgtcgccactagtcaactcttgaagccccatactacctccagcccacctgacatgagccctttcttcttgcgccaatacgttaagggtcacgccgctgatgtctttgaggcctacacacagctgctgacggagatggtgctccgcctgccttatcagataaagaaaattaccgatacaaactctaggatccctccgcctgtctttgatcacagttggttctattttctgtccgagtatcttatgattcagcagaccccgtttgtgcgccggcaggttcgtaagctccttctcttcatttgcggctccaaagagaagtatcgacagctgcgggacctgcacacactcgatagccacgttagaggaatcaagaaacttctggaggaacagggcattttcctgcgggctagtgtcgtaacagcatcaagtggctccgcgctgcagtatgataccttgatttcattgatggaacatctgaaagcttgtgcggagattgccgctcagcgtacaattaattggcagaagttttgcataaaagacgactccgtactatacttcctcctccaggtgagttttctcgttgacgaaggcgtcagcccagtccttttgcagctcctctcgtgcgccctatgcggctctaaggtgcttgctgccctggccgcgagctccgggagttcaagcgcaagtagcagctcagcaccagtggctgcgtcctcaggccaggccacaacacagtctaagtcttccacgaagaagtccaaaaaggaagaaaaagagtag

SEQ ID NO: 47713 - DNA, 2121 bp, Artificial Sequence
  Description of Artificial Sequence: Synthetic coding sequence
atgcggatcgtgtaccggatgcggggcctgctgggcgacgccaccgaggagtttattgagtccttagatagtacaacggacgaggaggaagatgaggaagaagtgtacaagatggcaggggtgatggcccagtgcggtggcctggagtgtatgctgaaccgcttggccggcatccgagacttcaagcagggccgtcacctgctgacggtgcttctgaagctatttagctactgcgtgaaggttaaggtgaaccgccagcaattggtaaagttggagatgaacacattgaacgttatgttgggtaccttaaatctagggaacttactcctgaccggcgacaaagaccagttggtgatgctgctggatcagatcaactcaactttcgtgagatccaacccctcagtgctacaaggactactaaggattatcccctatctgtcgtttggcgaggttgaaaaaatgcagatcctggtcgagcggttcaaaccctattgcaactttgataaatatgatgaggatcacagcggggatgacaaggtgttcctcgattgtttctgcaagatagccgcgggcattaagaataactctaacggccaccaactgaaggaccttatcttgcagaagggaattacccagaacgctctggattacatgaagaaacacatccctagcgccaagaacttagacgctgatatttggaaaaaatttctgtcacggcctgcacttcccttcatattgcggttgctgagggggttggcgatccagcatcccgggacccaggtgctgatcgggaccgactcaatccctaatctgcacaagttggagcaagtcagcagcgatgaggggattgggacattggccgagaatcttttagaagctctccgcgagcatcctgacgttaataagaagatcgatgccgcacgcagggaaacccgggctgaaaaaaaaagaatggcaatggctatgcgccagaaggcattagggaccctcggaatgacgacaaatgaaaagggccaagttgtgacaaagacagccctgttaaaacagatggaggagctaattgaagaacccggtctgacatgctgtatctgtcgggaaggctacaaattccagcccactaaggttctgggaatttacacctttacaaaacgggtggccctcgaagaaatggagaacaagccgagaaagcagcagggctacagtaccgtgtctcattttaacatcgtacactacgactgccatcttgccgcggtgcggcttgctagagggagagaggaatgggagagtgccgcccttcagaacgctaacacgaaatgcaatggcctgctgcccgtgtggggaccgcatgtgcctgagtccgcatttgctacctgcctggcccggcacaatacttacctgcaagagtgcacgggacaacgcgagccaacctatcagttgaacattcacgacatcaagctgctgttcctgcggttcgcaatggaacagtctttcagtgcagatacgggagggggcgggagagagagcaacattcacctgatcccttacatcatccatacagtactgtacgtgctcaacaccactcgtgccacctcacgagaagagaagaacttgcaagggttcctggaacagccaaaggagaaatgggtggagtctgccttcgaggtagatggaccatattattttaccgtcttggccctccacatcttgcctccagagcagtggagagccacgcgcgtcgaaattctgcggcgtctcctcgtcaccagtcaggcccgggcggttgccccaggcggagccacccggcttaccgacaaagccgtaaaggactactctgcgtaccgctcttcactcttgttctgggctttggtggacctgatatataatatgtttaagaaggttcccactagtaatactgaaggcggctggagctgttcactcgctgagtatatcagacacaacgacatgcctatatatgaagctgctgataaagctctgaagactttccaagaagagttcatgcccgtggagactttctctgagttcctggatgtggccggcctgctgtccgaaatcactgatccagaatccttcctcaaggatcttctgaattccgtgccgtag

SEQ ID NO: 47714 - DNA, 2544 bp, Artificial Sequence
  Description of Artificial Sequence: Synthetic coding sequence
atggccgtgtgcatcgagaccgccaagcggtacaacctggacgactacaggaccccagtgttcatttttgaacggctttgttcaatcatctatcctgaagaaaacgaggtaaccgaattcttcgtgactctcgagaaggatccacaacaggaggacttcctgcagggacgcatgccagggaacccctatagctcaaatgaacctgggatcggcccactgatgcgggatatcaagaacaagatttgtcaggactgtgacctcgtggctctgctggaggacgattctggaatggagggggaacccatgcgcatcgtgtatcgtatgaggggtcttctgggagacgccaccgaggagttcatagagagcctggatagcaccaccgacgaggaggaggatgaggaggaggtgtataaaatggccggagtgatggcgcagtgcgggggccttgagtgcatgttgaaccgcctggctgggattcgggattttaaacagggaaggcacctcctcaccgtactgctgaagctgtttagctactgcgtgaaggtcaaggtaaacaggcagcagttagtcaaattagagatgaataccctcaatgtgatgctcggaacattaaatctcgcgcttgtggcggaacaggaaagcaaagattccgggggtgccgcagtggccgaacaggtgctcagcatcatggaaatcatcctcgacgagagtaatgccgagcctctgtccgaggacaagggtaacttgctgctgacgggcgacaaggatcagttagtgatgctgctggaccagatcaatagcacctttgttcgctctaacccaagcgtgctgcagggactgctaagaatcattccttacctaagctttggcgaggtggagaaaatgcagatactggtggagaggtttaaaccgtactgcaatttcgataaatacgatgaagaccactcgggggatgacaaggtttttttggactgcttctgcaagatcgcagccgggatcaagaacaactcaaacggccaccagctcaaggatcttattcttcagaaggggatcactcaaaacgccctcgattacatgaagaagcacatcccgtctgccaaaaatctggatgccgacatctggaagaagttcctttctagacctgcgctaccgtttattcttcgccttttgcggggactagctatccaacaccccggtacgcaggtccttatcggcacggactccatccctaatcttcacaagctggagcaggtatcctccgacgagggaatcggaacacttgcagagaatctgcttgaagccctgcgggaacatcccgatgtaaataaaaagatagatgcggcccgtcgtgaaactagagctgagaagaaaagaatggctatggctatgcggcagaaagccttgggtacactggggatgacaaccaatgagaaggggcaggtggtgaccaagaccgcactcctaaagcagatggaggaattgattgaggagcccggactgacttgctgtatatgcagagagggatacaagtttcagcccacaaaggtgctggggatctatacttttactaagcgggtggcacttgaggagatggagaataaaccccgcaaacaacagggatacagcaccgtatcacacttcaacatcgtccactacgattgccacctcgcagctgtccggcttgcaagaggacgagaggagtgggagtctgcagcactgcaaaacgccaacacaaaatgcaatggattgttaccagtatggggtcctcacgttcccgaaagtgcctttgctacctgtctggctcgacacaacacatatcttcaagaatgcactggccaacgagagcctacctaccagctcaacatccatgacattaagctcctcttcctaagatttgcgatggagcaatcattctctgccgatactggaggggggggccgggagtcaaatatacacctgatcccttatattattcacacagtgctgtacgtactgaacacaaccagggccacaagccgcgaagagaaaaacttacagggattcctagagcagccgaaagagaaatgggtcgagagtgccttcgaagttgacgggccttactacttcacagtgttagcgctgcatattctcccacctgagcaatggcgagccacccgcgtggaaattctgaggcgcctgctcgtaactagtcaggcgagggccgtggctcctgggggggctacacggttgacagacaaagccgtcaaggattactctgcctatcgatcatccttgctcttctgggcgttggtggacctcatctacaacatgttcaaaaaggtgccgacaagcaatactgagggcggctggtcctgctcactcgctgaatatatcaggcacaatgacatgccaatatacgaggccgctgacaaggctctaaaaacgttccaggaagagtttatgccggtggagactttctcagaatttcttgatgtcgccgggctcctctctgagatcactgatccggagagcttcctgaaggaccttctaaatagcgtcccctag

SEQ ID NO: 47715 - DNA, 3957 bp, Artificial Sequence
  Description of Artificial Sequence: Synthetic coding sequence
atgagcggcggcgccagcgccaccggcccccggcggggcccccccggactagaggacacgacttccaagaagaagcagaaggatcgcgccaatcaggaatcaaaggacggcgatccacgcaaagaaaccggctccagatatgtggcgcaagccggtctggagcctttggcctctggggatcctagcgcctctgcctcccatgctgctgggattacaggttcacggcacagaacaagactcttctttccatccagttcaggcagtgcgtcgactccacaggaagaacagactaaggagggagcgtgcgaggatccccacgacctgttggcaaccccaactccggagttgctcctggattggagacagagtgccgaggaggtcatagtgaagctgagagtgggcgtgggacccctgcagttagaagacgtcgacgcagctttcactgacacagactgtgtagtgcgattcgctggaggccagcagtggggaggtgtcttttacgctgaaattaagtcaagctgtgcaaaggtccagacacgcaagggcagtctgctgcatctcacccttcctaagaaggtcccgatgttgacctggccatcactgctagtggaagcggatgagcagctgtgcatacccccgttaaacagccagacttgtttactaggaagcgaagagaatctggcccctctggcgggggagaaggctgtgcctcccgggaatgaccccgtgtctcctgccatggtacgatcccgcaaccccggcaaggacgattgtgcgaaagaagaaatggctgtcgccgcagatgccgcgaccctggtggacgagcctgagagcatggtgaacctcgcattcgtcaagaatgactcatacgagaagggacctgattcagtggtggtgcacgtgtatgtgaaggaaatttgtcgcgataccagcagagtgctcttcagagaacaggacttcactctgatcttccaaacccgggatggaaactttctgcggctccatccaggatgcggccctcacactacctttcgttggcaggtgaagctacgcaatctgatagaaccagagcagtgcaccttttgttttacagcgtcacgaattgatatctgtctgcgtaagagacagagccagagatggggcgggctcgaagcgccagccgctagggtcggcggcgctaaagtcgcagtacccaccggacccacccctctggattccaccccacctgggggtgctcctcaccccttgactgggcaggaggaggctcgagctgtggagaaggacaaaagcaaagccagatccgaagatacagggctcgactccgtagccaccagaacccccatggagcacgtgacaccaaaacccgagacccatttggcctctcctaagcctacgtgcatggtgccgcctatgccacattcaccagtttcaggagattccgtcgaggaagaagaggaggaggagaagaaggtctgtctcccaggattcacgggcctcgttaacctcggtaatacttgtttcatgaattccgtgatccagtctcttagtaacacccgggagctaagggattttttccatgacagaagttttgaggccgagattaattacaataatcctctgggtactggggggcgcctagcgatcgggtttgctgtcctgctaagagctctctggaagggcactcatcatgcctttcagccttctaagctcaaagctatcgtggcttctaaggctagccagttcaccggttatgctcagcacgacgctcaagaatttatggcattcctgctcgacggattgcatgaggacctgaatcggatccagaacaaaccgtacacagagaccgtggatagcgacgggcgcccggatgaggtcgtagccgaggaggcatggcagagacacaaaatgagaaatgacagcttcattgtcgatctcttccaggggcagtacaagagcaaactggtgtgtcctgtatgtgccaaagtttcgattacgttcgatccttttctttatcttcctgtgcccctcccccagaaacagaaagtgctgcctgtgttctacttcgcacgtgagcctcactccaaaccaattaagtttcttgtgagtgtgtctaaagaaaactcaactgcctccgaagtgctggatagcctgtcgcagtcagtccacgtgaaacctgagaatctccgcctcgcggaggtcatcaaaaacaggttccaccgcgtgttccttccttcccactctctggacacagtgagtcctagtgatacactcctgtgttttgagcttctgagctcagaactggccaaggaaagggttgtggtactggaagtccaacagcgaccccaggtgcctagcgttcccatctccaagtgtgcggcatgtcagcggaaacagcagtcggaggatgaaaaattaaaaagatgcacccggtgttacagggtgggctactgtaaccagttgtgccagaagactcattggccggatcacaaaggcttatgtcgtcccgaaaacattggatacccatttttggtgtcagtgccagccagcaggctgacctacgcccgactcgcgcagctactcgaggggtacgcaaggtactccgtgagtgtctttcagccaccgttccagcctggaagaatggcccttgagtcacagtcaccaggctgcactaccctcttgtcaacagggtccctggaagcgggcgattccgagagagacccaatccagccaccggaactccaacttgttacgcctatggccgaaggagacacaggtctcccaagagtgtgggctgctcctgaccgtggccctgtgccctccacgtctggcatctctagcgagatgctggcatccggccccatcgaagtcggctccctcccagccggtgaaagggtctcacgccccgaagctgccgtccccgggtatcagcacccgtctgaggcaatgaacgcacataccccgcaatttttcatttacaagattgactccagcaatagagaacaacgcctggaggacaagggcgatacgcccttagaactaggtgatgactgcagcctggcactggtttggagaaataacgaacgcctgcaagaatttgtcctggtggcctcaaaagagctcgaatgcgcagaagatcccggttccgctggggaagctgccagggctggccactttactctggaccagtgcttaaatctgttcacaaggcccgaggtacttgccccagaggaggcctggtactgtccacagtgcaagcagcacagagaggcaagcaaacagctgctgctgtggcgtctgcccaacgttctcatcgttcagcttaagcgtttttcgttcaggtcttttatatggcgtgataaaatcaacgatctcgtggaattcccagtgaggaatcttgacttgagtaagttctgtattggacagaaggaagagcagctgccatcgtacgatctgtatgcagtgattaaccattatgggggcatgatcggcggccactatacagcctgcgctaggctgcctaacgacagatcaagccagcgcagtgatgtgggctggcgactcttcgacgactcgactgtgaccacggttgacgagtctcaggtcgtaacgagatatgcatacgtgctgttctatagaagacgtaattcaccagtcgaaagaccgccgagggccggacatagtgaacaccaccccgacctgggccctgccgccgaggctgccgcctcgcaggcaagtaggatctggcaggaactagaggctgaggaggagccagtacccgaggggtccggcccgcttggcccttggggaccgcaggattgggtgggtcctctgccccgtggccccactacccccgatgagggctgtctgagatatttcgtgctcgggactgtggcagctttggtggctctcgtgctgaatgtcttttacccgctggtatctcagtctcgatggaggtag

SEQ ID NO: 47716 - DNA, 1548 bp, Artificial Sequence
  Description of Artificial Sequence: Synthetic coding sequence
atgagcggcggcgccagcgccaccggcccccggcggggcccccccggccttgaagataccacttccaaaaaaaaacagaaagatagagccaatcaggagtccaaggacggagacccaaggaaggagacaggctcgcggtacgtggcccaggccggactggagcccttggccagtggcgatccttctgcgagcgcaagccacgccgctgggatcaccggatccagacacaggacccgcctattctttcctagctcttccggaagtgccagcacacctcaagaagagcagacgaaagaggagcttctgctcgactggaggcagtctgcagaagaagtgatcgtaaaactgcgtgtgggagtcgggcccctgcagctggaagacgtcgatgcagcattcacagacacggattgcgtcgtgcggttcgccggggggcagcagtgggggggcgtattttacgccgaaatcaaatcctcatgtgcaaaagtccagacccgcaaggggtccttgttgcacctgaccttgcctaagaaagtgcctatgcttacatggccttcccttctcaaaaaacccctgggtacccaggaacttgtccccggcctgaggtgccaggaaaacggtcaagagctctccccaatcgccttggaacctggccccgagccccatcgggccaagcaggaggccaggaatcaaaagcgtgcccaggggcggggagaagttggcgcgggagctggtcccggagcccaagccgggcctagtgcaaaacgcgccgtccacttgtgtagaggccccgaaggcgatgggagcagagatgatccaggaccacgcggagatgcaccaccttttgtggccgaccccgcaacccaagtggaggctgatgagcagctctgcattccacccttgaattctcagacttgtcttctggggtctgaagaaaatctcgcccccctggccggcgagaaggctgtgccacctggaaatgaccctgtctccccggcaatggttcgtagccggaacccaggaaaggatgattgcgccaaggaagagatggccgtggcagcggacgcagccacacttgtcgatgagcccgagtccatggtgaatttggctttcgtcaaaaacgactcgtacgagaaggggccggacagcgtggtggtgcacgtctacgtcaaagaaatatgcagggatacctctcgcgtcctctttcgggaacaggatttcaccctgatcttccagacacgcgacggcaacttcctccggttacaccccgggtgtggcccacacaccacctttcggtggcaagttaaactgcgaaacctgatagaacccgagcagtgcaccttctgttttactgcctcaagaatcgatatttgcttgaggaagcggcagagccagcgctgggggcccggcggaccaggttgtacaagatgttcaggatggtgtaagggctgccgggcggatagaagcaacccgtctggcttcaatccaacacgtagatgcagccctccccccgaccgccccgggggagggcccgggtgtggcgaagggtag

SEQ ID NO: 47717 - DNA, 4155 bp, Artificial Sequence
  Description of Artificial Sequence: Synthetic coding sequence
atgagcggcggcgccagcgccaccggcccccggcggggcccccccggactcgaggatacaacctctaaaaagaaacagaaagatcgcgccaatcaggagagcaaggacggagatccccggaaggaaacaggatcgcgttacgtcgctcaggctggactggagcctctcgcgtccggcgacccatccgcctccgcgtctcatgcagccggtataaccgggagccgccatcgaacaagactttttttcccgtcaagctctggttcggcgtccacaccacaggaagagcagaccaaagagggggcctgtgaggacccgcatgacctcctggccactcccactccggaactcctgctggactggcgacagtctgccgaagaagttatagtcaagctccgcgtaggggtcggtccactccagcttgaagacgtggatgctgccttcactgatactgactgtgtggtgagattcgccggcgggcaacagtggggcggcgtcttctatgctgaaataaagtctagctgcgcaaaggtgcaaaccaggaagggctcacttctgcatctgacattgcctaagaaggtgcccatgctgacctggcccagcctgctaaagaagccgctcggcacccaggagctagtccctggtctgagatgccaagaaaacgggcaggagctctcaccgatcgctctggagccgggacccgagcctcatagggcaaagcaggaggcccgtaaccagaagagggctcaaggcaggggcgaggtcggcgccggggccggaccaggagcccaggctggaccctccgccaaaagggctgtgcacctgtgcagaggaccggagggtgacgggtctagagacgaccccggcccacggggggacgcacctccatttgtggctgacccggcaacccaagtcgaggccgatgaacagttatgcatacctccactgaatagccagacttgccttctgggtagcgaagaaaatctggcacccctagccggtgaaaaagccgttcccccaggtaatgatcccgtctcacccgccatggttcgctcccgtaatccagggaaggacgactgtgctaaggaggagatggccgtggccgcagatgcagccactctagtcgatgagcctgagtcaatggtgaacctcgcgttcgtaaagaacgacagttacgaaaaggggcctgacagtgtagtcgttcatgtgtacgttaaggagatttgtagagacacttcacgcgtgttgttccgggaacaggacttcactctgatctttcaaacccgggatgggaattttctgcggctgcaccctgggtgtggccctcacacgacatttaggtggcaggtcaagttgcgtaacttgatcgagccagagcagtgtacattctgtttcacggctagtcgcatcgatatttgcttgcgtaaacgccagtcgcaaaggtggggtggccttgaagcacctgccgcgaggggggctgtgggtggagccaaagtggcagtgccaacgggcccaacccctctagacagcaccccccctgggggggcacctcaccccttgactggtcaagaggaggcacgggcagtcgaaaaagacaagtccaaagctcggagtgaggacacaggccttgactcggttgcgacgcgaacccctatggagcacgttacccctaaaccagaaacacaccttgccagtcctaaaccaacctgcatggtcccacccatgccacacagtcctgtctccggcgacagcgtggaagaagaggaggaggaagaaaagaaagtgtgccttccagggttcacaggactcgttaacctcggtaacacatgctttatgaattcagtgatccaatcgctgtccaatacccgggagctgagggacttctttcacgatcgtagtttcgaagccgagataaattacaacaatcctcttggcacaggagggcgactcgcaattgggttcgcggtgttgctgagggccctatggaagggtacccatcacgcctttcaaccaagtaagctaaaggccattgtggcgagcaaagcttcacagttcaccggctacgcccagcatgatgctcaagaatttatggcttttctgctggacggcctgcatgaggatctaaaccggatccagaataaaccatatacggagacagtagattcagatgggaggcccgacgaagtcgtggctgaggaagcttggcagcggcataaaatgcgcaacgatagctttattgtcgaccttttccaaggccagtacaaaagtaagctggtgtgtcccgtgtgtgctaaagtgagcatcaccttcgaccctttcctgtatctgcctgtgcctctgcctcaaaaacagaaggtgctccccgtgttttacttcgcccgagaaccacattctaagcccatcaagttcctcgtgtcagtgtctaaggagaacagcactgccagcgaggttctcgacagtctcagccagtccgttcacgtgaaacctgaaaatctaagactggccgaagtgatcaaaaaccggtttcaccgagtgttcctcccgagccatagtttggataccgtgtctccctctgatactctgctgtgttttgaactactgtcatctgagcttgccaaagaaagggtggttgtgttggaggtccagcagaggccccaagtcccaagtgtccccatctctaagtgcgcggcttgccaaagaaagcagcagagcgaggatgaaaagcttaaacggtgcacccgatgctacagagtaggctattgtaatcagctgtgccaaaaaactcactggcccgatcacaagggtttgtgccgccctgagaatatcggctacccattcctggtctctgtaccagcctctcggctgacctatgccaggttggcacaactgctcgagggatacgcccgctactccgtgagtgtctttcagccgccttttcagccgggaaggatggcactggagagtcagagcccaggctgtacgacattgctgagcaccgggagcctggaagccggagactccgaaagggatcccattcaacctcctgagctgcagctggtgacccccatggctgagggcgacaccggcctgccccgcgtgtgggctgccccagatcgcggtcctgttccatccacctcaggtatttcaagcgagatgctagcttctggaccaattgaagtgggaagtcttccggctggggaaagagtgagccgccccgaagctgccgtacccggttatcagcatccctccgaagccatgaacgcccacaccccacagttctttatatataaaatcgattcgagcaaccgggagcagagactggaagacaaaggtgacacccccctcgaattaggagacgattgcagtctggcactggtgtggcggaataacgagcgcttgcaagagttcgtgcttgtggcctcaaaggagttagaatgcgccgaagacccagggagcgccggtgaagccgcaagagccggccacttcacactggatcaatgcctcaacctgttcacaagacctgaagtgctcgcccccgaggaagcttggtattgcccacagtgcaagcagcatagggaggcttcgaaacagcttcttctgtggcggctgcccaatgtgttgatcgtccagctgaagcgatttagtttcagatccttcatttggcgagataagattaatgacctggttgaattccccgtaagaaacctagacttgtcgaaattctgcatcgggcaaaaagaggagcagctgcctagctacgacctctacgctgtgatcaaccattacggaggaatgatcggcggtcactacacagcctgcgcacgcctgcccaatgatcggtcttctcagagatccgatgtgggatggaggttatttgatgattctactgtcacaaccgtcgatgagtcacaagtggtcactaggtatgcctatgtgctcttctatagaaggagaaattcaccggtcgagcgcccaccgcgcgctgggcactcggaacatcatcctgacctgggacctgccgccgaggcagccgcctctcagggactcggaccagggcaggctcctgaggtcgcacctacaagaaccgcccccgaaaggttcgcgccacccgtggacaggcccgccccaacctatagcaacatggaagaggtggattag

SEQ ID NO: 47718 - DNA, 4260 bp, Artificial Sequence
  Description of Artificial Sequence: Synthetic coding sequence
atgagcggcggcgccagcgccaccggcccccggcggggcccccccggtcttgaggataccaccagcaagaagaagcagaaggacagagcaaaccaggaatcgaaagacggagatcctcgaaaagagaccggctcccgctatgtggctcaggcaggcctcgagcccctagcatctggtgacccatcagcctccgcaagccatgcagcggggatcacagggtccagacaccggaccagactctttttcccaagctcctctgggtccgcatccacaccgcaggaagagcagactaaggagggggcctgtgaagacccacacgatttattggccacacctacacccgaactcttgctggactggcgccaaagtgccgaagaggtgattgtgaagcttagagttggagtgggtccactgcagctcgaggacgtagatgctgcctttactgatactgactgcgtggtgcgctttgctggcggacagcagtggggaggggtcttctacgccgagatcaagtcttcttgtgcgaaagttcaaacacgaaagggcagtctgcttcaccttacacttcccaaaaaagtgcctatgttgacgtggcctagcctgcttaagaaacccctggggacacaagagttggtgcctggactgagatgccaggaaaatgggcaagagctgtcacccatagctctcgagccaggtcccgagccacaccgcgccaaacaggaggcccggaatcaaaagcgtgcccaaggccgcggggaagtaggggcaggcgcaggccccggcgcacaggcggggcccagtgcgaaaagagccgtgcacctgtgcagaggacctgagggtgacggctcgagagatgatccaggaccaagaggagatgcacctccgttcgtcgccgacccagcgacccaggtggaagccgacgagcagttgtgtatccccccactaaatagccagacctgtctgcttggttccgaagaaaatctcgccccactcgcaggtgagaaggccgtgccaccaggcaacgatccagtcagccccgcaatggtgcgcagtcgcaaccccggcaaggacgattgtgcgaaggaggagatggcagtggctgcagatgccgcgacgctggtcgatgaacccgagagtatggtcaacctggcattcgtaaagaacgactcatatgagaaaggaccagactctgtcgtagtgcacgtttatgtgaaggaaatttgtagggacacatcacgggtcctgtttagagagcaagattttactctgattttccaaaccagagatggtaatttcctgaggctgcaccctgggtgcggtccccacactaccttcagatggcaggttaagctgagaaatctaattgagccagagcagtgcactttctgcttcaccgctagtcggatcgatatctgccttaggaagagacagtcccagaggtggggaggtctggaagcacccgcggcccgagtgggaggtgcaaaggtggccgtgcccaccggcccgacccctttggacagtacaccccctggaggagccccacatcctctgaccggccaagaggaagccagagccgtggaaaaggacaaatccaaagcaaggtccgaagacactggcctcgacagcgtcgccactcgcactccaatggagcacgttaccccgaagcctgagacacatttggcatcacctaagccaacttgtatggttcctcccatgccccattcaccggttagtggcgattcggtggaggaggaggaggaggaagagaagaaagtgtgtctccctggctttacaggcctagtgaatctaggaaacacatgttttatgaatagcgtgatccagagccttagtaatacccgcgaacttagggatttctttcacgaccgatcctttgaagcagaaatcaactacaacaaccctctcggcaccggcggcaggctggcaattgggttcgccgtgctgctccgcgcgttgtggaaaggaacgcaccatgctttccagccaagtaagcttaaggccatcgtggctagtaaggccagccagtttacaggctacgctcaacacgacgcgcaggagttcatggctttccttctcgacggactccacgaagacctcaatcgcattcagaacaagccatacaccgagactgtggatagcgacggacggcccgatgaagtggtcgcagaagaagcttggcagcgccataagatgcgtaatgactcttttatcgttgatctcttccaaggccagtacaaatccaaacttgtgtgtcctgtgtgcgcaaaggtgagcattacctttgaccctttcctgtacctcccagtcccattgccacagaaacaaaaggtactccctgtattctacttcgccagggagccacattctaaacccattaaattcctcgtgtctgtaagtaaggaaaacagcaccgcaagcgaggtacttgattctctgagccagagtgtgcacgtaaagccagaaaatctgcgtctcgcagaggttatcaaaaaccgattccaccgcgtcttcttaccgagccacagcctggatacagtgagcccatccgataccttattatgctttgaattactctcttccgaactggcgaaggagcgggtggtggtcctcgaggtgcagcagagacctcaggtcccctctgtccccatttctaaatgtgccgcatgtcagcgtaagcagcagtcggaagatgaaaaactgaaacggtgcacccggtgctaccgcgtgggctattgtaaccagctgtgccagaagacccattggcctgatcataagggactgtgtaggcccgaaaatatagggtatccatttctagtcagtgtgcccgctagtcggttaacatacgcacgccttgcgcagttactagagggctatgctagatactccgtttctgtttttcagccgccgtttcagcctgggcgaatggctctggagagccaatcccctgggtgtactacgctgctgtccactggaagcctcgaggccggagattccgaacgggatcccattcaacccccagagctacagctcgtaacaccaatggccgaaggtgatactggactgcctagagtgtgggccgcaccagatcggggacctgtcccatcgacatctgggattagttccgagatgttggcatcagggccgatcgaagtgggctctctccctgcaggggagagagtttccagacccgaagccgctgtacccggataccagcatccatcagaagcaatgaatgctcacacaccacaattcttcatctacaaaatcgactccagcaaccgtgaacagagattagaggataagggcgacactccactagagctgggagacgactgctcactggctctggtgtggcggaataacgagcggcttcaggaatttgttttggttgctagcaaagagttagagtgtgctgaagaccccggctccgctggcgaagccgctcgtgcaggtcatttcaccctggaccagtgcctgaacttattcaccagacctgaagtcctggcccctgaggaggcttggtactgcccccagtgtaaacagcaccgtgaggctagtaaacagctactcctttggcggttgcccaacgtcttgatcgtgcagctgaagcggttttctttccgaagctttatctggcgggataagataaacgacctggtcgaatttcccgtcagaaacctcgatcttagcaagttttgtatcggccagaaggaggagcagctgccttcttatgacttgtatgccgtgatcaatcattacgggggaatgataggcgggcattacactgcatgcgccaggctgcccaacgaccggtccagccaacgcagtgacgtaggctggagattattcgacgacagcaccgtgacaacggtggacgagtcacaggtcgtaacaaggtatgcctacgtacttttctataggaggcggaatagccccgtcgagaggccaccacgagccggccattcggagcaccaccctgatcttggccctgccgcggaggccgcggccagccaggccagccggatctggcaggagctcgaggctgaggaagagcccgtccctgaaggcagcggaccactgggcccctgggggcctcaagactgggttggccccctccctagggggcctactactccggatgaagggtgcctacgatactttgttctgggaaccgtagccgccctggtggctttggtgttaaacgtgttttacccgctggtgagccagtctcgctggcgttag

SEQ ID NO: 47719 - DNA, 4119 bp, Artificial Sequence
  Description of Artificial Sequence: Synthetic coding sequence
atgagcggcggcgccagcgccaccggcccccggcggggcccccccggcctggaagacacaaccagcaagaagaagcaaaaagatcgagccaatcaggaaagtaaggacggggatcctagaaaagagaccggctcacgttacgtggctcaagccgggctggagcccctggcttcgggtgacccttcagctagtgcatcccatgccgctgggattactgggagtaggcaccgcacacgcttattctttcctagcagttcaggcagcgccagtacgcctcaggaagagcagacaaaagagggtgcgtgcgaagacccacacgatctgctagccacccccactcccgagctgctcctggattggaggcagtcggccgaggaggtgatcgtgaagctgagggtgggtgtcggtccattgcaactggaagacgtggacgccgctttcactgacaccgattgtgtggtaagatttgctggcgggcagcagtggggcggcgtcttctacgctgaaatcaagtcaagctgcgcaaaagtccaaacacgaaaaggctcgctgctccatctgaccttaccaaagaaaaaaaagcctctgggtacacaagaactggtgcctggcctgcggtgccaggaaaacggccaagaactctcacccattgccctggaacccgggcccgagccacatagggcaaagcaggaggccaggaatcaaaaacgggctcagggccggggagaggtaggagcaggggcagggcccggagctcaggcaggcccctctgcgaagagggcggtccacttgtgtaggggcccagagggggatggcagtcgtgacgacccaggcccgaggggtgacgctccgcctttcgtggctgatcccgcaacacaggtcgaagctgacgagcagctgtgcatcccacccctcaattctcagacctgtctcctgggctctgaagagaacctggcaccacttgctggggagaaggccgtgccacctggaaacgacccagtgtctccggcaatggtacgaagccgcaatcccgggaaagacgattgtgctaaggaggagatggcagtcgccgccgacgctgccactttggtggacgagcctgaatcaatggtcaatctagcattcgtgaaaaacgactcttacgagaaggggccagactccgttgtggtccatgtctatgttaaggaaatttgtagggatacctctagagtcctgttcagagagcaggacttcacactgatctttcagacaagggacggaaacttcctgcgactgcaccctggttgcgggccacataccacttttcgatggcaggtgaagttaagaaacctgattgaacctgaacagtgtactttctgctttacggcctctcgcattgacatttgtctacgcaaaaggcaatcgcagcggtggggagggctggaagctccagcagcgagagtggggggggcaaaggtggctgtgcccacgggacccacaccgctcgatagcacaccacctggaggtgctccccatcctctcactggacaggaagaagcgcgcgctgttgagaaggataagtctaaggctcggagcgaggacaccgggctggatagcgtcgccacacgaacaccgatggagcacgtgactcccaagcctgagacgcacttggcctcaccaaagcctacgtgcatggtgcccccaatgccacactctcccgtgtctggcgactctgttgaggaggaggaagaggaggaaaagaaggtctgcctccccggttttacaggactggtcaacttggggaacacctgtttcatgaatagcgtgattcagagcctctctaacactcgcgaactcagggacttttttcacgatagatcattcgaggcggagatcaactacaataacccattggggaccggggggcgactggcaattggctttgccgtacttctgcgtgccctttggaaaggaacccaccacgcgtttcaaccctccaagctgaaggccatagtagcaagcaaagcgagccagtttacagggtatgcccagcacgatgctcaagagttcatggcttttttgctggatggacttcacgaagatttgaacagaattcagaataagccttataccgagaccgttgacagcgatggccgccccgacgaagtcgtggccgaagaagcctggcagcgccataagatgcgaaatgattcctttatcgtggatttatttcagggtcagtacaaatctaagctcgtgtgtcctgtgtgtgcaaaggtgtctataacctttgatcctttcttatatctgcccgtgccccttccccagaaacagaaggtgctcccagtgttttacttcgcacgagagccgcactccaagcccatcaaattcctagtcagcgtgagcaaggaaaatagcactgcttccgaagttttagactccctgtcccagagcgtgcacgtgaagccagaaaacctccgtcttgccgaagtcataaaaaatagatttcatcgggtgtttttgcccagccattcgcttgatacagtttctccctccgataccctcctttgcttcgagctgctctccagcgagttggcaaaagagagggttgtggtgcttgaagtacagcagagaccccaggtgccttccgtgcctatctcaaaatgtgccgcttgccaaaggaaacagcagtcggaggacgagaagttgaaaaggtgcactagatgctatcgtgttggttactgtaaccagctctgtcagaagacgcattggcccgatcacaaaggactgtgcagaccagaaaacattggatacccttttctggtcagtgtgccagccagccgtctgacttacgcacggttggcccagctcctcgagggttatgccaggtactccgtctcagtgttccagccacctttccagccaggacgcatggccttggagtctcagagtcctggctgtactaccttactgagcaccggatccctcgaggctggtgactcggagagggacccaatccagccacccgagctccagctggttactcctatggctgagggtgacaccggacttcctagggtctgggcggctcctgacaggggaccggtgccatctacctcaggaattagttccgagatgctcgcttcagggcccattgaggtgggatccctcccggctggcgagcgcgtgtcacgcccggaggccgctgtgcccgggtatcagcacccatctgaagccatgaatgcacatactccccagtttttcatttataaaatcgactcttccaacagggagcagcggctggaggataagggggacactcctctggaactgggggacgactgttcccttgcccttgtttggcgcaacaatgaaagactccaagagtttgtgctggtcgcctctaaggagcttgagtgcgctgaggatcccggctccgccggggaggctgcccgtgccggacactttactctcgaccagtgcctgaacctgttcacaagacccgaggtcctggctcccgaggaggcatggtattgtccccaatgcaaacagcatagagaggcttctaaacagctgttactgtggcgtcttcctaacgtgctcatcgtacagctcaagagatttagcttccgcagctttatttggagagataagattaacgatctggttgagttccccgtgaggaacttagatctctccaagttctgcatcgggcagaaagaagaacaacttccttcttatgatctgtatgcagtgataaaccactatgggggcatgatcggtggacattatacagcatgtgcccgcctgccgaatgaccgaagctctcagcggtccgacgttggatggcgccttttcgatgacagcactgtcacaacagtagatgagtcacaggtcgtgacacggtacgcatacgtgctcttctacaggcggcgcaacagtccagtggagaggccgccacgcgccggtcatagtgagcatcatcccgacctggggccagccgctgaagctgccgcctctcaagggttgggcccgggtcaggcacccgaggttgcacctaccaggaccgccccagagcgtttcgctcctcccgtggaccggccagcccccacctactctaacatggaagaagtggactag

SEQ ID NO: 47720 - DNA, 3357 bp, Artificial Sequence
  Description of Artificial Sequence: Synthetic coding sequence
atgcccgccgtggccagcgtgcccaaggagctgtacctgagcagctcgctcaaagaccttaataagaaaactgaagtaaagcccgaaaagattagcactaagagctacgtccacagcgcactcaaaatttttaaaacagcggaagaatgccggttagacagagacgaggaaagagcttatgttctttatatgaagtatgtaaccgtgtacaatctgatcaaaaagagacctgacttcaagcaacagcaggactacttccatagcatattaggacccggcaacatcaagaaagcggtcgaagaagccgagaggctctctgaatcactgaaactccgttatgaggaagcagaagtgagaaagaaactggaagagaaagacaggcaggaggaagcccagcgtctccagcaaaaacggcaagagacagggcgcgaggatggtgggacacttgccaagggatcactcgaaaacgtactggatagcaaagacaaaacgcagaaatccaacggcgagaagaacgaaaagtgtgaaactaaggagaagggagccatcacagcgaaagagctgtacaccatgatgacagacaaaaatatcagcttgatcataatggacgccaggcggatgcaggattatcaggacagctgcattctgcactcattgtcagtgcccgaggaggcaatttcccctggagtgaccgcgagctggatcgaggcacatcttccagacgattctaaggatacctggaaaaagagaggcaatgtagaatatgtagtgctgctcgactggttttctagcgctaaggatcttcaaattggcactaccctgagatcactgaaggacgcccttttcaagtgggaatcaaagacggtgctgagaaacgagcctctggtgctggagggcggatacgaaaattggttgctttgttatcctcagtataccacaaacgctaaagttaccccacccccacgccgacagaacgaggaggtgtccatttcgcttgattttacatatcctagcctggaagaaagcatcccgagcaaaccagctgcgcagacgccacccgcatctattgaagtcgatgagaacatcgaactgattagtgggcagaacgagcgtatgggcccactaaacatctcaaccccagtggaacctgtagcagcaagtaagagtgacgtgtccccgattatccaacccgtgccctcaatcaagaatgtcccacagatcgaccggaccaagaaacccgctgtgaaattgccagaagagcatcgcattaaaagtgaaagtactaaccacgaacaacagtccccccaatccggcaaagtgatccctgatagaagcaccaagccagtggtttttagtcctacccttatgcttaccgatgaggaaaaggcaaggatccatgccgagaccgctctgctgatggagaagaacaaacaggaaaaggagcttagggaacgtcagcaggaggagcagaaggaaaaactaagaaaagaggagcaggagcagaaggccaagaagaagcaggaggccgaggaaaatgagatcaccgaaaagcaacagaaagcaaaggaagaaatggagaagaaggagagcgagcaggccaagaaggaagataaggagacctctgcaaagcgcggcaaggagattaccggtgtgaagagacaatccaagagcgagcatgaaactagcgatgccaaaaagagcgtcgaggatcgcggcaagcggtgccccacgccagaaattcagaaaaagtcaaccggtgatgtccctcatactagcgtgacaggcgactccggttctggaaaaccattcaaaatcaaagggcagcccgagagcggaattcttaggactgggaccttccgggaggacactgacgacactgagcggaacaaggcacagcgagaacccctgacacgagcccggtcggaggaaatgggaaggattgtgcctgggctgccgtccggatgggctaaattcctggatcccatcaccggcacttttagatactaccacagcccaactaatacagtgcacatgtatccacccgagatggcgccctcctctgctccaccctccacccccccgacccataaagctaaaccgcagattcccgccgaacgggaccgggagcctagcaagctgaaacgctcctactcaagtcctgatatcacccaggctatccaagaggaagaaaagagaaaacccactgtgacccccaccgtaaaccgggagaataaacccacctgttacccaaaggccgaaataagcagactcagcgcaagccagataagaaatttaaatccagtgtttggcggttccgggcctgccctcactgggctccgcaatctcggcaacacttgttacatgaactccattctccagtgcttgtgtaacgccccccatctcgccgactatttcaatcgcaattgttatcaggacgacatcaatagaagcaatttgctcggacacaaaggcgaagtggctgaagagtttggaataattatgaaggctctatggacagggcaatatagatatatctcccctaaggacttcaaaatcactattggaaagatcaatgaccagttcgcaggctatagccaacaggacagccaggaactgcttctgttcttgatggacgggctacacgaggacctgaataaggctgataataggaaacggtataaagaagagaataatgaccaccttgacgatttcaaggccgccgagcacgcttggcaaaaacacaagcagctgaacgaaagcatcatcgtcgcgctttttcagggacagttcaagagtacagtccagtgtctcacttgccataagaaatcgaggacatttgaagccttcatgtacctgtctctccccttggcgtctacctcaaagtgtaccctgcaggactgcctgaggctcttctcaaaagaggagaagctgacggacaacaatagattctactgtagtcattgtcgtgctaggcgagacagtctgaaaaagatcgagatttggaaactgccaccagtactgctggttcacttaaagcgcttcagctacgacggtagatggaagcagaaactgcagacaagcgtggacttcccgctcgagaaccttgatctctcccagtatgttataggcccaaaaaacaatctcaagaagtacaacctgttctccgtgagcaaccactacggaggtctcgacggtgggcactatacagcatactgcaagaatgccgcacgacagagatggttcaaatttgacgaccatgaggtgagcgacatctcggtttccagcgtgaagagctccgcggcatacattctcttctacacaagcttggggccccgggttacagatgtggctacctag

SEQ ID NO: 47721 - DNA, 996 bp, Artificial Sequence
  Description of Artificial Sequence: Synthetic coding sequence
ctgaccggcctgcggaacctgggcaacacctgctacatgaacagcatcctgcagtgtctctgtaatgcccctcaccttgcagattatttcctgactggaaagtacatgtctaatctgctgggccacaagggcgaggtcgcagaggagtttggtatcataatgaaggccctctggacaggccagtatagatatatctcccccaaagatttcaagatcacaatcggaaaaattaacgatcagtttgccgggtacagccagcaggattcccaggaattgcttctattcctgatggacggacttcacgaagacctgaacaaattccaggctgataatagaaaacggtacaaggaagaaacggccgagcatgcttggcagaaacacaagcagctaaacgagagtatcatcgtcgccttgtttcagggacagtttaagtcgacggtgcagtgccttacctgtcacaagaaatcgcgcaccttcgaagcgtttatgtacctgagccttcccttggcgtccacaagtaaatgtactctgcaagactgccttaggttattttctaaggaagagaagttaaccgacaacaatcggttttactgttcccactgtcgggctaggagagattctttgaaaaagatcgaaatttggaaacttcctccagtacttctggttcatctcaagaggttctcatacgatggccgctggaagcagaaactgcagacctctgtcgactttccattggaaaaccttgacctgtcccagtatgttatcggacctaagaacaatctcaaaaaatacaatttgtttagtgtttccaatcattacgggggtctggatggcgggcattatacagcatattgcaaaaatgctgctcggcagagatggttcaagttcgacgatcatgaagttagcgacatctccgtgtcttcggtcaagagcagtgcggcttatatcctcttttacacttctctgggcccaagggtcaccgatgtggctacctag

SEQ ID NO: 47722 - DNA, 3357 bp, Artificial Sequence
  Description of Artificial Sequence: Synthetic coding sequence
atgcccgccgtggccagcgtgcccaaggagctgtacctgagcagctccctgaaggacctgaataagaaaactgaagtcaaacctgagaagatcagtactaaatcttatgttcatagcgctcttaaaattttcaagactgccgaggaatgtaggttagaccgcgacgaggaacgggcctacgttctttacatgaagtacgttactgtatataacttgattaaaaaacgccctgacttcaaacagcagcaggattacttccattcaattcttggtccgggcaacattaaaaaagccgtggaggaggctgagagattgagtgagtccctcaagctcagatatgaggaggcagaggttcgcaagaagctggaagaaaaggacagacaggaagaagcacagcggctgcagcaaaagcgccaggagacaggtagggaagacggggggactttggccaaagggtctctggagaacgtcctggatagcaaagataaaacgcaaaaatccaatggtgagaaaaatgaaaaatgcgaaacaaaagagaagggagccattaccgccaaagaactttatacaatgatgactgataaaaatatttccttgatcataatggacgctcgccgcatgcaggactaccaggatagttgtattctccactctctcagcgtgccagaggaagctatctctcccggtgttactgccagttggattgaggcacatctacctgatgatagcaaggatacgtggaagaaaagagggaatgtggagtatgttgtccttctcgactggtttagctcagcaaaggatctccaaattggcactacgctgcggagtctgaaggatgccttatttaaatgggagtcaaaaaccgtactgagaaacgagcccttggtgttagagggtggatatgagaactggctcctgtgctacccccagtatacaacaaacgctaaggtgacccctccaccgcggcgccagaacgaagaggtctccatctccctggactttacctatcctagcctggaggagagcattcccagcaaacccgcagcacagacgccacctgcgagtattgaggttgacgagaatatcgagttgatttctggacagaatgagagaatgggacccctgaatatatctacccccgtcgagccagttgccgcatccaagtcagacgtgtcccctatcattcagccggtgccctccatcaaaaacgtcccacagatcgatcgcacaaagaaacctgctgtgaaactgcctgaggagcataggattaagtcagagagcactaaccacgagcagcagtcccctcagagtggaaaagtcatccctgacaggtccactaaacctgtcgtcttcagcccgactttgatgctgacagacgaggaaaaagctagaatccacgctgaaaccgcactgttaatggagaagaataaacaggaaaaagagctgcgcgaacgtcagcaggaggaacaaaaggaaaaactgcgcaaggaagagcaagaacagaaggctaaaaaaaaacaggaagccgaagaaaacgagataactgaaaagcagcaaaaggctaaggaagagatggagaagaaggagtccgagcaggccaagaaggaggacaaggaaacttctgcgaaacgtggcaaagagattaccggagtcaagagacagtccaagagtgagcacgagaccagcgatgcgaaaaaatccgtcgaagaccggggaaagcggtgtcccacacctgaaattcaaaaaaaaagtacaggggatgtgccacacaccagcgtgaccggggatagcggcagcggcaagcctttcaagattaaaggacagcctgagtcagggatccttagaactgggacatttagagaggacacagatgataccgagcggaacaaagctcaaagggagcctctgacaagagcccgctcagaggaaatgggacgaattgtccctgggttgccctcaggttgggccaagttccttgatcctataaccggaaccttcaggtactaccattctcctaccaacactgtccatatgtatcctcctgagatggcccctagttcagcgcccccttccacaccccccactcacaaagcgaaacctcagatccccgccgagcgggaccgggagccgtcgaaactgaagagaagctattcttcccccgacatcacccaggctatccaggaggaggagaagaggaaaccaaccgtgacccccaccgtcaacagagagaacaagcctacgtgctaccctaaggcagagatcagtaggctaagtgcgagccagatccgtaacctgaacccagtgttcggtggaagcggaccagcgctgacggggcttcgaaatctgggaaacacgtgttacatgaatagcatcctacagtgcctgtgtaacgcaccgcatctggctgactattttaatcgcaattgttaccaagacgacatcaacagatccaacttgttgggacacaaaggcgaagtggcagaagaatttgggatcataatgaaagccctctggaccggccaataccgttacatctctcccaaggattttaaaatcaccatagggaagattaacgaccagtttgccggctatagtcagcaggattctcaggaattgttattgtttctgatggacggcctacacgaggatctgaataaggccgataataggaaaaggtacaaagaggagaacaatgaccatctggacgatttcaaagcagctgagcatgcatggcagaaacacaagcaactcaatgaaagcatcattgtggcattgttccagggacaattcaagagcacagtccaatgcctgacttgtcacaagaaatcaagaaccttcgaggcattcatgtacctgtccctgccgttggcgtctacttcgaaatgcaccctgcaagactgtctgcgtttgttttccaaggaagagaaacttaccgacaacaaccgcttctattgctcccactgcagggccagaagggattcgctaaaaaagattgagatttggaaactgccgcccgtccttctggtacacctaaaacgttttagctatgacggaaggtggaaacagaaactgcaaacctccgtggacttcccgctggagaatctggacctgtcccagtatgtgattggcccaaagaacaatctgaagaagtataacctgttttctgtcagcaatcactatggcggactcgatggtggccactatacagcatactgcaagaatgctgcgcgtcagcgatggttcaagtttgacgaccacgaagtctctgatatttccgtgagttccgttaaatcatctgcagcgtatattttgttttatacatcactggggccacgcgtcacagacgtcgctacttag

SEQ ID NO: 47723 - DNA, 3357 bp, Artificial Sequence
  Description of Artificial Sequence: Synthetic coding sequence
atgcccgccgtggccagcgtgcccaaggagctgtacctgagcagctccctgaaagatctaaataagaagacggaggtcaaacctgaaaagatctccaccaaatcatatgtccattcagctttaaagatcttcaagacagcagaggaatgtagattggacagggacgaggagcgcgcatatgtgttgtacatgaaatatgtgaccgtgtataacttaatcaagaagagacccgattttaagcagcagcaagactactttcactcaattctcggcccagggaacattaaaaaggcagtggaggaagccgaacggctgagtgaatctctgaaattgcgatacgaggaggcggaagttaggaagaaattggaagagaaagatagacaggaagaggcccagaggctgcaacagaaaaggcaggagaccggtcgagaagatggtggcaccctggctaaaggctcgctcgaaaacgtgttggactctaaagacaagacacagaaatccaacggagagaagaacgagaaatgcgaaactaaggaaaagggcgcgattacagcgaaggagctgtataccatgatgactgataaaaatatcagcctgatcattatggacgcacggcgaatgcaagactaccaggactcatgcatcctgcattccctatccgtcccggaggaagcaattagccccggggtgacagcatcatggatagaggcacatcttccggacgattctaaagacacctggaaaaagcggggtaacgtggaatatgtggtattactcgactggttctcatcggcaaaggatctgcagattggtacaacgttgaggagtctcaaggatgccctctttaaatgggaaagcaaaaccgtactcagaaatgaaccactggtccttgaaggtggttatgagaactggctcttatgctatccacagtacaccacgaacgcaaaagttacccctccccctcggcgccagaacgaggaggtatccatttcattagatttcacttatccctcactcgaggaatccatcccgtctaagcctgcagcacaaacaccacctgccagtatagaggtggacgaaaacatcgagttgatatccgggcagaatgagagaatgggcccacttaacatctctactccagtggagcctgtggcggcatccaagtctgatgtgagtcccatcatacagcccgtccctagtatcaaaaatgtgcctcaaatcgatcgtaccaagaagccggccgtcaaactgcctgaggagcatagaatcaagagcgagagtacgaaccacgagcagcagagcccccagtctggaaaggtgatccccgatagatccacaaaacccgtggtattcagtccaacactgatgcttacagatgaggagaaggccaggatacacgctgagacggcgcttttgatggaaaagaacaaacaagaaaaagagctgagggagaggcagcaggaggagcagaaggagaaactgcggaaggaagagcaggaacaaaaagccaagaaaaagcaggaggccgaagagaacgaaatcacagagaaacaacaaaaagcgaaagaggagatggagaaaaaagaatcagagcaggctaagaaggaggataaagagactagcgcaaagagaggcaaggaaattacaggcgtgaagagacagagcaaatccgagcatgaaacctctgacgcgaaaaagtcggtcgaagatagggggaagaggtgcccaaccccagaaattcagaagaaaagcactggcgacgtccctcatactagtgtcacaggagactcaggctcaggaaagcccttcaaaatcaagggccagcccgaatccggcatcctgaggacgggcactttccgcgaggatactgatgacacagaacggaacaaagctcaaagggaaccgttgactagggctagaagcgaagaaatgggaaggattgtgccggggctcccttcaggctgggctaaattcctggatcctatcacgggaacattccggtattatcattcccctaccaatactgtgcacatgtatccacccgaaatggcccctagtagtgctcccccgagcaccccacctactcataaggctaagccccagatccctgccgagcgggaccgcgagccttccaaactgaaacgcagttactcaagcccggacattacccaggcaattcaagaagaggaaaaacgcaaacctaccgtcacccccactgttaatcgagagaataaaccaacctgttatccaaaggcggaaatcagcagactctccgcatctcaaatcagaaatttaaatcccgtttttggaggctcgggccctgctttaactgggttacggaacctggggaacacttgctatatgaattctatcctgcaatgcctgtgcaacgccccccacttggcagactattttaatcgaaattgttatcaggatgacatcaaccgctctaacctgctgggccacaagggtgaggtagccgaggagtttggtattattatgaaagccctctggaccgggcagtaccgatacatctcgcccaaggattttaaaatcaccattggcaaaatcaatgaccagttcgctggttactcccagcaggattctcaggagctcttgctcttcctaatggatggcctccacgaagacctgaacaaggccgacaaccgcaaaagatacaaggaagagaataacgatcatctggacgacttcaaggccgcagaacacgcttggcagaaacacaagcagctgaatgagtccataattgtggctctgtttcagggccagttcaagagcacagtacagtgcctgacgtgtcacaaaaaatcccgcacgttcgaggccttcatgtatctgtcccttccgctcgcttccacctcaaagtgtaccttgcaggattgcctgagactgttctccaaggaagagaagcttactgacaacaatcggttctattgtagccactgtagggccagacgcgattcattaaaaaagatcgaaatttggaaactgccacccgttctgctggtccatctgaagcggttcagttacgatggacggtggaagcaaaagctccagactagcgtcgacttccccctggaaaacctggatctgagtcagtatgtgatcgggcctaagaacaatttgaaaaaatataacctcttctcagtttccaatcattacgggggactcgacggcgggcattacaccgcttattgtaaaaacgctgcacgtcagagatggtttaaatttgacgaccacgaggtgtccgatatttcggtgtccagcgtgaagtcgtctgccgcctatattctgttttatacttctttgggaccacgggttaccgacgttgcaacctag

SEQ ID NO: 47724 - DNA, 408 bp, Artificial Sequence
  Description of Artificial Sequence: Synthetic coding sequence
atgcccgccgtggccagcgtgcccaaggagctgtacctgagcagcagcctgaaagatctcaacaaaaagaccgaggtgaaaccagagaaaatcagcactaagtcctatgttcatagcgctctgaaaatctttaaaacggccgaggaatgtcgactggatcgggacgaggagcgtgcttatgtactctacatgaagtacgtgactgtgtacaatttaatcaagaagcgacccgacttcaaacaacagcaggattattttcactccatcctgggccccggcaacattaagaaggcagtggaggaagctgagagattaagtgagtctctcaaactgagatatgaagaggcagaggttcggaaaaagctagaagaaaaagatcggcaggaggaggctcagaggctccagtag

SEQ ID NO: 47725 - DNA, 291 bp, Artificial Sequence
  Description of Artificial Sequence: Synthetic coding sequence
atgcccgccgtggccagcgtgcccaaggagctgtacctgagcagcagcctcaaggacctcaataaaaagaccgaagtgaaacctgaaaaaatctctaccaaaagctatgtgcacagcgccttgaaaatctttaaaactgcagaagagtgccggctggacagagacgaggagcgggcctacgtgctgtatatgaaatatgtcacagtatacaaccttatcaaaaagcggcctgatttcaagcaacagcaggattatttccactcaatcctcggtcctggtaacattaagtag

SEQ ID NO: 47726 - DNA, 222 bp, Artificial Sequence
  Description of Artificial Sequence: Synthetic coding sequence
atgcccgccgtggccagcgtgcccaaggagctgtacctgagcagctctcttaaggacctgaataagaagactgaggtgaagcctgagaagatctccaccaagtcgtatgtgcactcagcattgaagatattcaaaaccgccgaagaatgtagattggacagggacgaggagcgggcttatgtcttgtatatgaaatatgtgacagtctataacctcatttag

SEQ ID NO: 47727 - DNA, 132 bp, Artificial Sequence
  Description of Artificial Sequence: Synthetic coding sequence
atgagcagcaccagcagcaagcgggcccccaccaccgccacccagagactgaaacaggactatttgagaatcaagaaagaccccgttccatatatctgtgccgaacctctgccctcaaatattctcgagtag

SEQ ID NO: 47728 - DNA, 957 bp, Artificial Sequence
  Description of Artificial Sequence: Synthetic coding sequence
atggagacccggtacaacctgaagagccccgccgtgaagcggctgatgaaagaagcagccgagctgaaggatccaactgaccactaccacgcgcagcccctggaggacaatctgttcgagtggcactttactgtgcgtgggccccccgattctgacttcgatggcggagtctatcatgggagaatcgtcttgccgcccgagtacccgatgaaaccaccgagtattattttgcttaccgccaacggtcggtttgaggtcgggaagaagatttgcctttccatttcaggacaccacccggagacctggcaaccctcctggtccatcaggaccgcactgctggctatcattggttttatgcctacaaagggcgagggcgcaatcggctcactcgactacacgcccgaggagaggagggcactagctaagaagagtcaggatttttgttgtgaagggtgtggctccgctatgaaagacgtgcttctgcctctaaagtcaggatctgattcatcacaggctgaccaagaggccaaggagctagctcgacaaatctcatttaaagccgaggtgaattcaagcgggaaaaccatctcagaaagcgatctgaatcacagtttctctctcaccgaccttcaggatgacattcctaccaccttccaaggcgccacggcatccacaagttacggattgcagaactcctcggccgcctcattccaccagcctacacagcctgttgcaaaaaatacttcaatgtccccacgtcagagacgcgcacagcagcagagtcagcgtaggttgagtaccagcccagatgtgatccagggtcaccagcctagagataaccacacggaccacggaggttccgctgtactgattgtcatcttaaccttggccttggctgcactgatcttccgacggatttatttggccaatgaatatattttcgacttcgagttgtag

SEQ ID NO: 47729 - DNA, 912 bp, Artificial Sequence
  Description of Artificial Sequence: Synthetic coding sequence
atgaaggaggccgccgagctgaaggaccccaccgaccactaccacgcccagcccctggaggataatctcttcgagtggcacttcacagttaggggacctccggactcagactttgacggcggggtctatcacggtcgcattgtgctacccccagagtacccaatgaaaccaccatccattatactgctcacagctaacggacgtttcgaagttgggaaaaaaatatgcctgtctatctcaggacaccaccccgagacctggcaacctagctggtcaatcagaaccgccctgctggctataattggctttatgcctactaaaggtgaaggggcaatcggcagcctggattacacccccgaggagaggcgcgcgcttgctaagaagtcccaggatttctgttgtgagggttgcggttcagccatgaaggacgtgctactgcccctgaagtcaggctctgacagctctcaggccgatcaggaggctaaggaactggctcgacagatcagcttcaaggcagaggtgaacagttccggtaaaactatctctgaaagcgatttgaatcattctttctccttaaccgacctccaggacgacattcctactacttttcaaggtgctacagcaagcactagctatggactgcaaaacagctcggcggcttctttccaccaaccgactcagcccgttgctaagaatacctcaatgagcccgaggcagcgccgagcccaacagcagagccaacggcggctgtccacttcaccagacgttattcagggacatcagccaagagataaccataccgatcatggcgggagtgcagtgcttatcgtgattctgactcttgcgttggctgccctcatctttaggcgaatttacctagctaatgagtacatatttgacttcgagctctag

SEQ ID NO: 47730 - DNA, 675 bp, Artificial Sequence
  Description of Artificial Sequence: Synthetic coding sequence
atgtggccccaggacatcgccggccggcactacgtggtgcggggccccgaaatgaccccttatgagggcggctattaccatgggaaactgatattccccagggagttcccatttaaacccccctccatctacatgatcacacccaatggccgctttaagtgtaatacacgcctgtgtttgtctataaccgacttccacccggatacgtggaatcccgcttggtcagtgagtactattctgactggactcttgtcattcatggtggagaagggtccaaccttaggcagcatcgagaccagcgacttcaccaagagacagttggctgtgcagtcactcgcctttaacctcaaggataaagtgttctgcgaactgtttccggaggtggtcgaggaaatcaaacagaaacagaaggcccaggacgaattgtcatcccggccgcaaaccttaccgctgcctgatgttgtgcctgatggcgaaacacacttggttcaaaacggaatacagctgctgaatggccacgcgcctggggccgttcccaatctagctggccttcaacaggccaaccgacaccatggcttactggggggagccttggcaaacctgtttgtgatcgtcggttttgcagcatttgcctacacagtgaaatacgtgctcagaagcattgctcaggagtag

SEQ ID NO: 47731 - DNA, 624 bp, Artificial Sequence
  Description of Artificial Sequence: Synthetic coding sequence
atgaccccctacgagggcggctactaccacggcaagctgatcttcccacgcgaattcccttttaagcccccgtcgatttacatgatcactcccaatggacgcttcaaatgcaatacccgcctttgtctgagtattacggactttcaccctgacacttggaaccctgcctggagcgtgtctaccattctcacggggctactcagctttatggttgagaaggggcccaccctgggttctatcgagaccagcgacttcaccaaacggcagctggctgtgcagagcttagcctttaacctgaaggacaaagtgttttgcgagctcttccctgaagtcgtggaagagatcaagcagaagcaaaaagctcaggacgagctgtcctctcgtccacaaacccttcctctgccagacgtggtgcccgatggcgaaacccacctcgtacagaacgggatccaattgctgaatgggcacgccccaggggctgtaccaaaccttgccggacttcaacaggccaatcgtcaccacgggcttctgggaggcgccctcgccaacctgtttgtgatcgtgggattcgcagcttttgcgtacactgtcaaatatgttttacgctccatcgcccaggagtag

SEQ ID NO: 47732 - DNA, 624 bp, Artificial Sequence
  Description of Artificial Sequence: Synthetic coding sequence
atgaccccctacgagggcggctactaccacggcaagctgatcttcccccgagagtttcccttcaaacctccctccatctatatgattactcccaacggcaggttcaagtgcaacacccgcctatgtctcagcattactgatttccacccagatacctggaatccagcgtggtccgtttcgaccatcctaactgggcttctgagctttatggtggaaaagggcccaaccctcggctctattgaaacatcagacttcactaaaaggcagcttgcagtgcagagtctggcattcaacctgaaagacaaagtgttttgcgaactgttccccgaggtggtcgaagagatcaagcagaaacagaaagcccaggatgagctgtcctcaagacctcaaacgctgcccctgcccgatgtggtgcccgatggcgaaacacaccttgtgcagaacggtatccaactccttaatggccacgcaccaggggccgtccctaaccttgccggactgcagcaggccaatcgtcatcacggcctcttaggtggagccctagcaaacttattcgtgattgtgggcttcgcggctttcgcttacacagtgaagtatgtgctgaggagtattgcacaagaatag

SEQ ID NO: 47733 - DNA, 780 bp, Artificial Sequence
  Description of Artificial Sequence: Synthetic coding sequence
atgagcagcaccagcagcaagcgggcccccaccaccgccacccagagactcaagcaggactacttgagaataaagaaggaccccgtgccttacatctgcgccgagcccctgccctccaatatcttggagtggcactacgtagtgcgtgggcccgaaatgaccccgtacgaaggggggtactaccatggcaaactgattttcccccgggagtttccattcaaaccaccgtcgatatacatgattacaccaaacggaagattcaaatgtaatacgaggctctgcctgagtattaccgacttccaccccgacacatggaaccccgcttggtcagtgtccaccattctaactggcttattatccttcatggtggaaaaggggccaaccctcggctcgatagagactagtgattttacaaagcgccaactggccgtgcagtcgctcgccttcaatcttaaggacaaagtattctgtgagctcttccccgaagtcgttgaggagattaagcagaaacagaaagcccaagacgaactttcttcgcggccccaaacccttccgctgccagatgttgtgccagacggtgaaacacacttggtacagaacggaatccagttactaaacgggcatgctccaggagcagtcccaaacctggctggactgcaacaggctaatcggcatcatgggctgctggggggggcccttgccaatctattcgtgattgtgggcttcgccgcctttgcctacaccgtcaaatatgtgctccgtagtatagcccaggagtag

SEQ ID NO: 47734 - DNA, 780 bp, Artificial Sequence
  Description of Artificial Sequence: Synthetic coding sequence
atgagcagcaccagcagcaagcgggcccccaccaccgccacccagaggctgaagcaagattatttgagaattaaaaaagatcctgtcccctatatctgcgccgagcccctcccaagcaatatcctggaatggcattacgttgtacgaggaccggagatgacgccttacgaaggcggctactaccacggaaaattgatatttcctagggagtttccttttaaacccccaagcatctatatgatcacccccaatggaaggttcaagtgcaacacaaggctctgcctgtccatcacagacttccatcctgatacctggaacccagcgtggtccgtgtctacaatcctgaccggccttctgtcttttatggtggaaaagggaccaactttaggaagcatagagacgagtgattttaccaagcgccagctggcagtgcaatcgctcgctttcaaccttaaggacaaagtgttctgcgagctcttccctgaggttgtggaggagatcaaacagaagcagaaagcgcaggatgaactctcctctcgcccacagactttaccccttccagacgtggtgcctgatggggaaacccacctggtgcagaatggaattcagctgctgaatggtcatgcccccggcgccgtcccaaatctcgctggtctgcaacaggcaaaccggcatcatgggttgctcgggggagcactcgcaaacctcttcgtcatcgtcggtttcgctgctttcgcttacactgtcaagtacgtgcttaggagcatcgcccaggaatag

SEQ ID NO: 47735 - DNA, 624 bp, Artificial Sequence
  Description of Artificial Sequence: Synthetic coding sequence
atgaccccctacgagggcggctactaccacggcaagctgatcttccctcgggaatttccctttaagcctcccagtatctacatgataacacccaacggacgattcaagtgcaatactagactctgtctgtctattaccgactttcacccggatacctggaaccccgcatggagcgtgtcaacaattttgaccgggctcttgtcctttatggttgagaagggtccaaccttggggtcaattgaaacctccgacttcacgaaacgacagctggcagtccaaagcctggcttttaacttaaaggataaagtgttctgtgaactcttcccggaggtggttgaggaaataaaacaaaagcaaaaggcccaggatgagctgagttctcggccccagacactgcctttgcccgatgtggtgcctgatggagagacacacctggtccagaacggcattcaactcctcaacgggcacgcaccaggcgcagtgccaaacttggcagggttgcagcaggccaaccgccatcatggcttgctaggaggcgctctggctaacctgtttgtaattgtgggctttgcagctttcgcatacacagttaagtacgtcttgcgaagtattgcacaggaatag

SEQ ID NO: 47736 - DNA, 828 bp, Artificial Sequence
  Description of Artificial Sequence: Synthetic coding sequence
atgagcagcaccagcagcaagcgggcccccaccaccgccacccagagactgaaacaagattacctgaggattaaaaaagacccagtcccttacatatgcgccgagccactcccatccaacattttagaatggttcaaaagattttcatggctgtccctattgtctagctgggattatagacattacgtcgtcaggggccctgaaatgaccccttatgaaggaggttactaccatggaaagcttatatttccacgggagtttcctttcaaaccaccctcaatctacatgatcaccccgaatggccgctttaagtgtaacacccgcttgtgcctgagcattactgatttccatcccgacacctggaacccagcgtggagcgttagcaccattctaaccgggttgttgtcttttatggtggagaaaggaccaacactgggttccatcgagacgtccgattttactaaacggcagttagctgtgcagtccttggcctttaatcttaaggacaaagtcttttgtgagctgttccctgaggtggtggaggaaattaagcagaagcagaaagcacaggacgaattatcatctcgtccacagacccttcctctgcccgacgtggtccctgatggtgaaacccacctggtgcagaacgggatacagctattgaacggacatgcacccggagccgtgccgaacctggcaggactgcagcaagcaaaccgccaccatggtctgctgggcggtgcactggccaacctatttgtcattgtgggatttgcagccttcgcatacactgtgaaatatgtactgagaagtattgctcaggaatag

SEQ ID NO: 47737 - DNA, 306 bp, Artificial Sequence
  Description of Artificial Sequence: Synthetic coding sequence
atgagcagcaccagcagcaagcgggcccccaccaccgccacccagagactaaaacaggactacctccggatcaagaaggatccagtcccgtatatctgcgccgagccactgccaagcaatatcctggaatggtttaagcgtttctcctggctgtccttgttaagctcttgggattatagacattacgtcgtgcggggcccagaaatgaccccctacgagggaggctactaccacggcaagcttattttccctagagaatttccttttaaacccccatctatttacatgattaccccaaacggatag

SEQ ID NO: 47738 - DNA, 591 bp, Artificial Sequence
  Description of Artificial Sequence: Synthetic coding sequence
atgagcagcaccagcagcaagcgggcccccaccaccgccacccagcgattgaaacaggattatcttcgaataaagaaggatcccgttccgtatatttgcgccgaaccccttccaagcaacatcctcgagtggcactacgtggtcagagggcctgaaatgaccccctatgaaggagggtattaccacggaaaactgatttttcccagggagtttccattcaagcctccatccatttacatgattacacccaacggccggtttaagtgcaacacacggttatgtctttctattactgattttcacccagatacatggaatcccgcctggtctgtgtcaaccatactaaccgggctgctgagttttatggtggagaaaggtcctacactggggagcatcgaaacttctgatttcacaaaacgccagttggccgtccaaagtctcgcattcaaccttaaggataaagtgttttgcgagctctttccggaggtcgtggaggagatcaaacagaaacagaaggcccaggacgagctgtcctcgagaccacagactctccctcttccggatgtggtgcccgacggagaaacccactag

SEQ ID NO: 47739 - DNA, 132 bp, Artificial Sequence
  Description of Artificial Sequence: Synthetic coding sequence
atgagcagcaccagcagcaagcgggcccccaccaccgccacccagcgactgaaacaggactaccttcgtataaagaaggatcctgtgccctatatttgcgcggagcccttgccaagcaacatattggagtag

SEQ ID NO: 47740 - DNA, 216 bp, Artificial Sequence
  Description of Artificial Sequence: Synthetic coding sequence
atgagcagcaccagcagcaagcgggcccccaccaccgccacccagcgactaaagcaggactaccttcggattaaaaaggaccctgtgccatacatctgcgccgagcctctgccgagtaacattttagagtggcactacgtggtacggggaccagaaatgactccctacgagggcggatattatcatgggaagctgatttttccccgggaattttag

SEQ ID NO: 47741 - DNA, 444 bp, Artificial Sequence
  Description of Artificial Sequence: Synthetic coding sequence
atggccctgaagcggatcaacaaggagctgagcgacctggcccgggatccacctgctcagtgttccgccggtcctgtgggagatgatatgttccactggcaagcaaccattatggggccaaacgattcgccataccagggaggcgtgttcttcctcaccatacactttcccactgattacccctttaagccgccgaaggtcgcctttaccacccgcatctaccaccctaacatcaatagcaacggatcaatttgcctcgatattttgagaagccaatggtcacctgccctgactatctcgaaggtcctcctctccatttgtagcttgttatgcgacccaaatcctgatgatcccctcgttccggagatcgccaggatctacaagactgatagggataaatacaacaggatcagtcgagagtggacccagaaatatgctatgtag

SEQ ID NO: 47742 - DNA, 444 bp, Artificial Sequence
  Description of Artificial Sequence: Synthetic coding sequence
atggccctgaagcggatcaacaaggagctgagcgacctggcccgggaccctccagcccagtgttcagccggcccagtgggtgacgatatgttccattggcaagccacaatcatggggcctaatgactccccgtaccaaggaggggtgtttttcctgaccattcacttccccacggactacccgtttaagccaccaaaagtggcctttacaaccagaatctaccacccgaatatcaactctaatggttcaatttgcctcgacattcttaggtcgcaatggtccccagctttgaccatttcgaaagtgctacttagcatttgttcccttttatgtgaccctaaccctgatgaccctctggtacctgagatcgcgcggatatacaagaccgaccgcgacaaatataaccgcatcagtcgagaatggacgcagaaatacgcaatgtag

SEQ ID NO: 47743 - DNA, 447 bp, Artificial Sequence
  Description of Artificial Sequence: Synthetic coding sequence
atggccctgaagcggatcaacaaggagctgagcgacctggcccgggacccgcccgctcagtgttctgccggacctgtgggcgacgacatgtttcactggcaggcaaccatcatgggacccaatgattccccatatcaggggggcgtgtttttcttgactattcacttcccaaccgattacccatttaagccacccaaggtggccttcaccacaaggatttaccaccccaatatcaacagtaacggtagcatttgtctggatatcctgaggtcacagtggtcccccgcgttaacgatctctaaggtgctgctttctatttgcagcctgctgtgcgatccaaacccggacgatcccctggtgcctgagatcgcacggatctataaaaccgatagggacaaatataacagactggcccgcgagtggaccgagaagtacgccatgctctag

SEQ ID NO: 47744 - DNA, 444 bp, Artificial Sequence
  Description of Artificial Sequence: Synthetic coding sequence
atggccctgaagcggatcaacaaggagctgagcgacctggcccgggacccgccggctcagtgttccgcagggcccgttggcgacgacatgttccactggcaagcaacaatcatgggacccaacgattcaccctatcagggcggggtgttcttcctgaccatccatttccccacagattacccgtttaagccccctaaggtcgcatttaccacgcgcatttatcacccaaatattaactccaacggcagcatatgcctggacatactaaggagccagtggtctccggcgctgaccatttcgaaggtattgctgtcgatttgttcactcctttgtgacccaaatcctgatgatccactagtgcctgagatcgctaggatttacaaaactgaccgggacaaatacaacaggatcagccgggagtggacacagaagtacgctatgtag

SEQ ID NO: 47745 - DNA, 450 bp, Artificial Sequence
  Description of Artificial Sequence: Synthetic coding sequence
atgctgagcaaccggaagtgcctgagcaaggagctgagcgacctggcccgtgacccacccgctcagtgctccgctggtccggttggcgatgacatgttccattggcaggcaaccattatgggccctaacgatagcccttaccagggaggcgtgttttttctgacaatccatttccccactgattaccccttcaaaccaccaaaggtggcgtttacaacgcgaatttaccacccaaatataaattccaatggctctatctgtctggacatcttgcgcagtcagtggtctccagccctgacgatttccaaagttctgctgtcaatttgctcccttctttgcgacccaaatccagatgacccccttgttccagagatcgctcggatttacaaaaccgatcgtgacaagtataacagaatctcacgtgagtggacacagaaatatgctatgtag

SEQ ID NO: 47746 - DNA, 444 bp, Artificial Sequence
  Description of Artificial Sequence: Synthetic coding sequence
atggccctgaagcggatcaacaaggagctgagcgacctggcccgggatcctcccgcgcagtgcagtgccggccccgtgggggacgacatgtttcactggcaggctacaatcatggggcctaatgattctccataccagggcggcgtgtttttcctgacgatccactttccaacggactatccattcaaaccacccaaggtggccttcacaacccggatataccaccctaatataaatagcaatgggtctatctgcctcgatattctgaggagtcaatggtctcctgccctcaccatttccaaggtgctgctgagcatatgctctcttctgtgtgatccgaatccggacgatccactcgttcctgaaatcgcacggatttacaaaacagacagggacaagtacaaccggatcagtcgagagtggacacagaaatatgctatgtag

SEQ ID NO: 47747 - DNA, 444 bp, Artificial Sequence
  Description of Artificial Sequence: Synthetic coding sequence
atggccctgaagcggatcaacaaggagctgagcgacctggcccgggacccaccagcccagtgcagtgccgggccagtgggagatgacatgtttcattggcaggcaacaatcatggggcctaacgattctccctatcaaggcggagtgttctttctgaccatccactttcctacggactaccctttcaagccccctaaggtggccttcaccacacggatttatcaccccaatatcaatagcaatggttctatttgcttagacatcctgcggtcccaatggagccccgctctgactattagtaaggttctgcttagcatttgttctctgctctgtgatccgaacccggacgacccccttgttccagagatagctaggatctacaaaacagacagagataagtacaataggatttccagggagtggactcagaagtacgctatgtag

SEQ ID NO: 47748 - DNA, 444 bp, Artificial Sequence
  Description of Artificial Sequence: Synthetic coding sequence
atggccctgaagcggatcaacaaggagctgagcgacctggcccgggaccctccggcccagtgtagcgcaggtccggtcggagacgacatgttccattggcaggccacaatcatgggtcccaacgactccccctaccagggcggagtgttcttcctaaccatccatttccccaccgattatccctttaagcctcccaaggtggcgttcacaactagaatctatcaccccaatataaacagcaatgggtcaatctgcctcgacattttacgctcccagtggagtccagctctgacaatctccaaggtactgctaagcatctgtagtctcctttgcgatccgaatcccgatgaccccttggtgcctgaaatagccagaatttacaaaacagaccgtgacaagtacaatagaatctctcgggaatggacccagaagtatgcaatgtag

SEQ ID NO: 47749 - DNA, 444 bp, Artificial Sequence
  Description of Artificial Sequence: Synthetic coding sequence
atggccctgaagcggatcaacaaggagctgagcgacctggcccgggatccgcctgcacagtgttcagcaggtcccgtaggggacgatatgttccactggcaggcaaccatcatgggtcccaatgattcaccttatcagggcggggtattcttcctgactatacatttcccaacagactaccccttcaagcctccaaaggtggccttcacaacacgaatataccatcccaacatcaattcaaatggatcgatttgcctagacattctacggtcacagtggtcccccgctttaacaatctctaaggtccttctgagtatctgctcactcctctgcgatcccaaccctgacgatcccctggtaccagagatcgccaggatctacaaaactgacagggacaagtataatcgcatctcccgcgagtggacacagaagtacgccatgtag

SEQ ID NO: 47750 - DNA, 237 bp, Artificial Sequence
  Description of Artificial Sequence: Synthetic coding sequence
atggccctgaagcggatcaacaaggagctgagcgacctggcccgggaccctccggcccagtgttccgccggccccgtaggcgacgacatgtttcactggcaggctaccatcatgggtcccaatgatagcccctaccaaggtggtgtgttttttttaacaattcattttcctacagattacccctttaaaccccccaaggtggcctttactaccaggatttaccatcctaatatctag

SEQ ID NO: 47751 - DNA, 291 bp, Artificial Sequence
  Description of Artificial Sequence: Synthetic coding sequence
atggccctgaagcggatcaacaaggagctgagcgacctggcccgggatccacccgcccagtgttcggcagggcccgttggcgacgatatgttccattggcaagctaccataatgggcccgaacgattccccttaccagggaggcgtcttcttcctaaccatacacttccctactgactacccatttaaaccccccaaggtggccttcacaacaaggatctatcaccctaacatcaatagcaatggaagcatctgcttggatatactgagatctcaatggtcacctgcctag

SEQ ID NO: 47752 - DNA, 150 bp, Artificial Sequence
  Description of Artificial Sequence: Synthetic coding sequence
atggccctgaagcggatcaacaaggagctgagcgacctggcccgggacccacctgcccaatgttctgccggcccggttggagacgatatgttccactggcaggcaacaattatgggtcctaatgacagcccatatcagggtggcgtatag

SEQ ID NO: 47753 - DNA, 1527 bp, Artificial Sequence
  Description of Artificial Sequence: Synthetic coding sequence
atgctgtggttccagggcgccatccccgccgccatcgccaccgccaagaggagcggcgccgtgttcgtagtgtttgtcgcgggcgatgacgaacagtccacccagatggcagcaagttgggaagatgacaaggtcactgaggcaagctctaactctttcgtggcgatcaagatcgacacaaaaagcgaggcctgtttgcagttctctcagatatatccagtagtgtgtgtcccctcttctttttttatcggcgatagcggaatacctttggaagttatagccggctctgttagtgcagatgaacttgtgaccagaatccacaaggtcaggcagatgcacctgctcaaaagtgaaaccagcgtggccaacggatcacagtccgaatcttccgtttcaacacctagcgcaagctttgagcctaataacacctgcgaaaacagtcaatcccgcaacgcagagctatgcgaaattccaccaacctctgataccaagtccgacaccgctacagggggagaaagtgccggacatgccacatcttcccaagagccttctggttgctccgatcagcggcctgccgaggatctcaatatccgtgtcgagaggctcacgaaaaagttggaagaaaggagggaagaaaagcgtaaggaagaagaacagcgggagatcaagaaggagattgagcgacgaaaaactggaaaagagatgctggactacaaaaggaagcaggaggaggaactcaccaagcgaatgcttgaagaacgcaaccgggagaaggctgaagatagagcagctagagagagaataaaacaacagatcgcccttgaccgcgccgagcgagcggcccgcttcgccaaaaccaaagaagaggtcgaggcagccaaggccgcggccctgctggccaagcaagccgaaatggaagtaaaaagagagagctatgcaagggaaaggtccacagtagcccggatccagtttaggcttccggacgggagctctttcactaatcagttcccctccgacgctccgctggaggaagcgcgtcagtttgccgcgcagactgtaggtaacacttatggtaacttctccctggccacaatgtttcctcgccgcgaatttactaaagaggattacaagaagaaactcctggacctcgaactggcgccgtctgcatccgtcgtacttctcccggccggtcggcctacggcctctatcgtgcacagctcctccggggacatctggacactgcttggtactgttctttacccgtttctggcaatctggcgcctaatatctaacttcctcttttccaatcccccccccacccagacttctgtgagggtcaccagctccgaaccacctaatccagcttcttcctcgaagtccgaaaaacgagagcccgttcgtaagagagtcctcgagaagcgaggcgacgattttaaaaaggaaggaaagatttatcggcttcggacccaggatgatggagaggacgagaacaacacctggaatggcaacagcacgcagcagatgtag

SEQ ID NO: 47754 - DNA, 1473 bp, Artificial Sequence
  Description of Artificial Sequence: Synthetic coding sequence
atgctgtggttccagggcgccatccccgccgccatcgccaccgccaaacgctctggcgccgtgtttgttgttttcgtcgccggcgacgatgagcagtccacccagatggcagcatcctgggaagatgacaaggtcacggaagctagtagcaatagcttcgtggcaataaaaattgatactaagtcagaggcttgtctgcagttctctcagatctatccagtggtgtgcgtaccctctagtttttttataggtgacagcgggatccctctagaggtgatcgcaggctccgtcagtgctgacgaactggttacccggatccataaggtgcgccagatgcatctccttaagactgcttcatttgaaccaaataacacgtgtgaaaactcacagagtcgaaatgctgaactgtgcgagatccctccgacaagcgatacaaagagcgacacggcaaccggcggcgaatctgccggccacgctacaagttcacaagagccttcagggtgtagcgaccaacggcctgccgaagacctcaatattcgcgtcgagagactcacaaagaagttggaagagagaagggaggaaaaacgcaaggaggaagagcaacgggagatcaaaaaggagattgaaagacgcaaaaccggcaaagagatgctggattacaaacggaaacaggaagaggaactcaccaaaagaatgttggaagagaggaacagagagaaagcagaagatagagccgcccgagaaaggataaagcagcagattgcacttgaccgggcagaacgggctgctcgcttcgcaaagactaaggaggaagtggaggcagcgaaggccgcggcgctgctcgctaaacaggcagaaatggaggtgaaacgcgagagttatgctagggagcgcagcaccgtcgctcggatccagttccgcctccctgacgggagttctttcactaatcagttcccatcagatgctcccctggaggaggcccgccagtttgccgcgcaaactgtcgggaacacttacggcaacttttcgttagccacaatgttcccaagaagagaattcaccaaggaagattacaagaagaagttgctggacttggagctagctccctcagcatcagtcgtacttctaccggctggccggcccacagcctctatcgttcatagcagtagtggtgatatttggaccttactgggaactgtgctttaccccttcttggccatctggcggttgatcagtaacttcctctttagcaaccctcccccaactcagacctcagtaagggtgactagctccgagcctccgaaccctgccagcagcagtaagagcgagaaacgtgagccggtaagaaaaagagttctggaaaagaggggagacgacttcaagaaagagggcaagatctaccggcttagaacacaggatgacggtgaggatgagaacaacacatggaacgggaacagcacccaacagatgtag

SEQ ID NO: 47755 - DNA, 1470 bp, Artificial Sequence
  Description of Artificial Sequence: Synthetic coding sequence
atggccgcccacggcggcagcgccgccagcagcgccctgaagggcttaatacaacaattcacgacaattacaggagcctccgagtccgttgggaagcacatgttggaggcctgcaacaacaacctagagatggctgtgactatgtttctggatggcggcggtattgctgaggaacccagtactagcagcgcatctgtgtctaccgtgcgaccgcataccgaagaggaagtgagagccccaatcccgcagaagcaagagatcctagttgagcctgagccacttttcggggcccccaaaaggaggcgaccggccagatccattttcgacggattccgcgacttccagacagaaactattcgacaggaacaggagctgaggaacgggggggccatcgataaaaagctaacgaccctggccgatttgttcagaccccctatcgacctgatgcataagggtagcttcgaaactgctaaggagtgcggacagatgcagaacaagtggctcatgatcaacatccaaaacgtccaggatttcgcatgccagtgtctgaacagagacgtctggtctaacgaggcggtaaaaaatatcattcgggagcatttcatattttggcaagtataccacgactctgaggaaggtcagagatacatacagttttataagctgggtgatttcccatatgtgagcattctggatcctcgaacaggacagaaactagtggagtggcatcagcttgatgtgtctagcttcctggatcaggtcaccggttttctcggggaacacggacagctggacgggctgtccagtagcccccccaagaagtgcgcccgatccgagagcttaatagacgcctctgaggactctcagctagaagcagccatccgcgcatcgctgcaggagactcacttcgacagcacgcagaccaagcaggacagtcgtagcgatgaggagagcgagagcgaattgttcagtggatctgaggagtttatatcggtgtgcggaagtgatgaggaagaagaggttgaaaacctggccaagtccaggaaatccccccataaggacctcggccatcgtaaagaagagaaccggagaccccttacagagccgcctgtcagaactgatcccgggacggccacaaaccaccagggtctacccgctgtcgattccgaaatactcgaaatgcctcccgagaaagccgacggcgtggtggagggtattgacgtgaatggtcccaaagcacagctgatgctcagatatcctgacgggaaacgagagcagatcacccttcctgagcaggctaagcttctcgcactggtaaagcacgtgcagtcgaagggatatcccaatgaaaggtttgaattactcacaaactttcccaggcggaagctctcccatttggattatgacattacccttcaagaggctggcctgtgccctcaagagactgttttcgtccaagaacgaaattag

SEQ ID NO: 47756 - DNA, 1026 bp, Artificial Sequence
  Description of Artificial Sequence: Synthetic coding sequence
atgcacaagggcagcttcgagaccgccaaggagtgcggccagatgcagaataagtggctgatgataaacattcagaacgtccaggattttgcatgccagtgtttgaatagagatgtgtggtccaatgaggcagtgaagaacatcatccgggagcatttcattttttggcaggtatatcatgacagcgaagaggggcagcggtatatacaattttacaagctcggagacttcccctacgtgtctattcttgaccctcgtaccggtcagaagcttgttgaatggcaccaactagatgtttccagcttcttggaccaggtgacaggcttcctcggggaacacggtcaactggacggtttgagtagctcccccccaaaaaaatgtgcaaggagcgaatccctgatcgatgcgtctgaggattcacagcttgaggctgcaatcagggctagtttgcaggaaacacactttgactccacgcagaccaagcaggattcacgatcagatgaggaatcggagtctgagctgttctccggttctgaggagttcatctctgtatgcgggtcagacgaagaagaggaggtagagaacctggccaagagtagaaaaagccctcacaaggacttgggccacaggaaggaggaaaaccgtcggcctctcacagaaccacccgtaaggacagacccaggcactgcgacaaatcaccagggccttcctgctgttgatagtgagatcctcgaaatgcccccagagaaagctgatggagtggtggaaggtatcgacgttaatggacctaaagcccaattgatgctgcggtaccccgacggtaaacgagagcagatcaccctgcctgaacaggctaaattgcttgcgttggtgaaacacgtccagagcaaagggtaccccaacgaaaggttcgagctcctaactaatttccctagaagaaagctgtctcacctggattatgacatcacactgcaggaggccggattatgccctcaggaaacagtgtttgtgcaagagaggaactag

SEQ ID NO: 47757 - DNA, 1584 bp, Artificial Sequence
  Description of Artificial Sequence: Synthetic coding sequence
atgcggagcgacaagagcgccctggtgttcctgctgctgcagctgttctgtgtgggatgcggtttctgtggtaaggtcctagtgtggccttgtgacatgtctcactggctcaatgtgaaggtaatcttagaagagctgattgttcggggtcacgaagtgactgtcttgacccattcaaaacctagcctgattgattaccggaagccttctgcgcttaagtttgaggtggtccatatgccacaggatagaactgaagagaacgaaatcttcgtagacctagccttgaacgtactgccggggctgtctacttggcagagtgttatcaagctcaacgatttctttgtcgagatccgagggacactgaaaatgatgtgtgaaagtttcatttataatcagaccctcatgaaaaagctgcaggaaaccaactatgatgtcatgctgattgaccccgtgatcccctgtggcgatctcatggctgaactgctggcagtcccattcgttctgacgttgaggatttcagttggcggtaatatggaacggtcttgcggcaagctgcctgctccgctgtcatatgtgcccgttccgatgacaggcctcacagacaggatgaccttcttggaaagagtgaaaaactctatgttgtcggtgttgtttcatttctggatccaggattatgattatcatttctgggaggaattctactctaaggccttagggaggcccaccactctctgtgagaccgtaggcaaggccgagatatggttgatcaggacatattgggacttcgagttcccccagccttatcagcccaatttcgagtttgtgggggggcttcactgcaaacccgccaaggctctgccaaaggaaatggaaaacttcgtacagtcttcaggtgaggacggtattgtggtcttcagtttgggttctctttttcagaatgtcacagaggagaaggcaaatattatcgcctctgccctggcgcaaatcccccagaaagtcctgtggagatataaagggaaaaaaccttcaactctaggcgcgaacaccaggctttatgattggatcccacagaatgatctgctgggtcatccaaaaaccaaggcttttataacacatgggggaatgaatggcatttacgaggccatctatcatggcgtgccaatggtcggtgtgccaattttcggcgatcaactcgataatattgcccacatgaaggccaaaggggccgcagtagaaatcaacttcaagaccatgaccagcgaggacttgctgagggcgctcagaacagtcattaccgactcatcatacaaggaaaatgccatgcgcctgagcaggatccatcatgatcagcctgtaaaaccactggatcgagctgtcttttggatagaatttgtgatgcgccataagggcgctaagcatctgcggagcgcagcccatgatttaacatggtttcagcactatagcattgacgtcatcggttttctgctggcttgtgttgccaccgcgatcttcttatttaccaagtgtttcttgttttcttgtcaaaaattcaacaagacacgaaagatagaaaagcgcgagtag

SEQ ID NO: 47758 - DNA, 717 bp, Artificial Sequence
  Description of Artificial Sequence: Synthetic coding sequence
atggagaacttcgtgcagagcagcggcgaggacggcatcgtggtgtttagcctgggaagcctcttccagaatgtgacagaggagaaagccaatattatcgcgagtgccctggctcagatcccacagaaagttttatggaggtataaaggcaaaaagccatcaaccctaggggccaatactagactgtatgattggatcccacagaacgacttgctgggacatcccaaaactaaggcatttatcactcacggcggtatgaatggcatctacgaggcaatttaccatggagtccctatggttggcgtgccaatattcggtgaccagctagataacatagcccacatgaaggctaaaggtgctgcagtcgaaataaattttaagacaatgacaagtgaagacctgttgcgggctctgcgcacagtcatcaccgatagctcctacaaggagaacgcaatgcggctgagccggatccaccacgaccagcctgtgaaaccactggatcgtgctgttttttggattgagtttgtgatgaggcacaaaggcgccaagcaccttaggtctgccgctcacgacctgacatggttccagcattacagcatcgacgtgattggcttccttcttgcttgtgtcgcaactgctatcttcctgttcacaaagtgcttcctgttttcgtgccaaaaattcaataagacacgaaaaatcgaaaagcgcgagtag

SEQ ID NO: 47759 - DNA, 1587 bp, Artificial Sequence
  Description of Artificial Sequence: Synthetic coding sequence
atggccctgaagtggaccaccgtgctgctgatccagctgagcttctacttcagcagcggaagctgcgggaaagtattagtatgggccgccgagtacagcctgtggatgaacatgaaaaccattctaaaggagttggttcagcggggacacgaggttacggtgctggcctccagcgcctctatactgttcgacccaaacgactccagcactctgaagctcgaggtgtatcccaccagtctcactaagaccgaattcgagaatatcatcatgcagctggttaaaaggctttccgagattcagaaggacaccttttggctgccattttctcaggaacaggagatcttatgggcgatcaacgatattatccgcaatttttgcaaggatgtcgtatctaacaaaaagttaatgaaaaagctgcaggaaagcagatttgacatcgtgtttgctgacgcatatctgccatgcggagaactgttggctgagttatttaacatcccattcgtttattcacacagtttctctccagggtatagtttcgaacggcactccggtgggttcatattccctccatcctatgtgccagtcgtgatgtccaagctctccgatcagatgactttcatggagcgcgtcaaaaatatgctgtatgttctgtacttcgacttttggttccagattttcaatatgaagaagtgggaccagttttattctgaggtacttggaagacccactacactgagtgaaacaatgagaaaagccgatatctggctgatgcgcaatagctggaacttcaaatttccgcatccatttctgccaaatgtggattttgtgggggggctgcactgtaaaccagcaaaaccgctgccaaaggagatggaagagtttgtgcagagctctggtgagaatggtgtggtcgtgttctctctcggtagcatggtgagtaacatgacggaagaaagagctaacgtcatcgccacagctctggctaaaatcccccagaaagtgttgtggcggttcgacggaaacaagcctgatgcactcggtttgaacaccagattatataagtggataccacagaacgatttgctaggacacccaaagactcgagccttcattacgcatgggggggccaacgggatctatgaggccatctatcacggcattcccatggttggcatcccactgttctttgaccaaccagacaacattgcccacatgaaagctaagggggctgccgtcagggtggattttaacacaatgtcttctaccgatctcctgaatgccctgaaaacagtgattaatgacccgtcatataaggaaaacattatgaaactgagccgaattcagcatgatcagcccgtgaagcccctggatagagccgtcttctggattgagttcgtgatgaggcataagggggccaagcatcttcgcgtagctgctcataacctgacctggttccagtatcattccctagacgttataggatttctgctggcctgtgtagcaacagtgctcttcatcattaccaagtgttgcctgttctgtttttggaaatttgctaggaaaggaaagaaggggaaacgagactag

SEQ ID NO: 47760 - DNA, 1572 bp, Artificial Sequence
  Description of Artificial Sequence: Synthetic coding sequence
atggtgggccagcgggtgctgctgctggtggccttcctgctgagcggagtcctgttatccgaggccgcgaaaatactgacaatctccaccctcgggggaagccactatctgttgctagatcgcgtgtcccagatcctgcaggagcatggacacaacgtaacaatgctgcaccagtctggtaagttcctgattccagacattaaagaggaagagaagagttatcaagtaatacgttggttctccccagaggatcaccaaaaaaggataaagaaacacttcgattcctacatcgagacagctctagatgggcggaaagagtcagaagccctggttaagctgatggaaatcttcggtacgcagtgctcctatttgctgagccgcaaagatataatggactctctaaaaaatgagaattatgatcttgtgttcgttgaggcttttgacttctgctccttccttatcgccgagaaactggtcaagcccttcgttgctatcttaccgactacctttggctcccttgacttcgggttgccaagtccactgagttatgttccagtctttccctcactgctgaccgaccacatggacttctgggggcgcgtgaaaaactttttgatgttcttctcattcagtcgttcgcagtgggatatgcagtctacctttgacaatacaatcaaggaacatttccctgagggaagtaggccagtcctgagtcatttactactgaaggctgagctttggtttgtgaattccgacttcgcattcgattttgctcgccctctcctacccaacactgtgtatatcggcggattaatggaaaagcccattaagcctgtgcctcaggatcttgataacttcatcgccaatttcggcgacgccggctttgttctggtggcattcggatcgatgcttaatacccatcagagccaggaggttctcaagaaaatgcataacgctttcgcacatctgccccaaggtgtgatttggacctgtcagtcaagtcactggccacgagatgtgcatctcgcgacaaatgtaaagattgtggattggctcccgcagtcggacctgcttgcgcacccgtccatccggttgttcgtaactcatggcgggcagaactccgtgatggaggccatacgtcatggggtacccatggtaggcctgccagtgaacggggatcagcacggcaatatggtgcgtgtggttgccaagaattacggcgtgtctatccgtctcaaccaggtcactgccgacaccttgacactcactatgaagcaggtgattgaagacaaaagatacaagtccgcggtggtcgcagccagtgtcatcctccactcccaaccgctgtcccctgcgcagcggctggttggttggatcgaccacattctgcagacagggggagccacccacctgaaaccttacgcattccagcagccttggcacgaacagtacctgatagacgtattcgttttcctgctggggctgacgctgggtaccatgtggctgtgtggcaagttgttgggagttgtcgctaggtggctccggggcgcccgtaaggttaaaaagacttag

SEQ ID NO: 47761 - DNA, 759 bp, Artificial Sequence
  Description of Artificial Sequence: Synthetic coding sequence
atgctgcaccagagcggcaagttcctgatccccgacatcaaggaggaggagaagagttatcaagtgataaggtggttttcacctgaagaccatcagaagcgaattaagaaacacttcgactcctacatcgagactgcacttgacggtaggaaggaaagcgaggccctggtgaaactgatggagatctttggcacgcagtgttcttatctcctttccaggaaagacattatggactcattgaaaaacgagaactatgatctggtgttcgtcgaagcctttgacttctgcagctttctcatcgctgagaagttggttaaaccattcgttgcaatcctgcccacaacctttggctccctggatttcggcctgccctctccattatcttatgtccctgtcttcccctccctcctcacagatcacatggacttttggggacgtgtgaaaaacttcctgatgttcttctcattcagcaggtcccagtgggatatgcagtccactttcgataacacaataaaagaacacttcccggagggatccagacccgtgctgagtcacctcttgctgaaggctgaactctggtttgtcaatagtgattttgcttttgattttgctagacccctcttgcccaacacagtgtacattggtgggcttatggaaaaacctatcaaaccagtgccacaaaacggacagcctgccttgttcacaactccctcactattttcaagcggtgtctaccctgaacctcttaggtggctgtag

SEQ ID NO: 47762 - DNA, 1626 bp, Artificial Sequence
  Description of Artificial Sequence: Synthetic coding sequence
atgaagagctacaccccctacttcatcctgctgtggagcgccgtgggaatagcgaaagcagctaagatcattatagttcctcccataatgtttgaatcacacatgtacatcttcaaaactctggcttcagctttgcacgaacgcggacatcacactgtattcctgctgtccgagggacgggacattgcaccatcgaatcactactcgttgcagcgttatcccggcatctttaattctacgacctccgatgcttttctccaatccaagatgcggaatatcttctcaggtcgactcactgccatcgagctgttcgatattctggatcactatacaaagaattgcgatcttatggttggcaaccacgccctgatccaaggtctcaagaaagagaagttcgacttgctcttagtcgaccctaacgacatgtgcggttttgtaatcgcacatcttcttggcgtaaagtatgctgtattttctacgggcctgtggtaccctgccgaggtgggcgcaccagcacctttagcatacgtgcccgaatttaacagtctactaacagacagaatgaacctgctgcagcgtatgaagaacacgggggtatacctgatctcaaggttgggggtgtcttttctagtgctgccaaaatatgaaaggattatgcagaagtataatctgctgcccgaaaaatcgatgtacgacttagtacacggttcctccttatggatgctgtgcacagatgtagctctcgagttcccacgacctaccctccctaatgtggtttacgttggagggattcttacaaagccagctagccccctcccagaggacctccagagatgggtgaacggggctaatgaacacggcttcgtgctggtgtcatttggtgctggagtgaagtacctatcggaagacattgccaacaagctcgctggcgcacttggtcggctgccgcagaaagtcatatggaggttctcaggccctaagcccaaaaatctcgggaataacacaaagctgattgaatggctgcctcaaaacgacctgctgggccactccaagatcaaagctttcctatctcatggaggtctgaattctatctttgaaaccatctaccacggcgtccccgtggttggtatccctttgttcggggatcattacgacacaatgacgagagttcaagctaaaggtatgggcatacttctggagtggaaaacagttactgagaaggagctctatgaggctctcgtaaaagtgattaacaatccaagttaccgccagagagctcaaaagctaagcgagatccacaaggatcagcctggtcatcctgttaatcgcacaatctactggattgattatatcatacgtcataacggagcccaccatttacgggccgcagtgcaccagatttcgttctgccaatatttcctcctcgacatcgccttcgttctactcctgggagccgctctgctctacttcttgctgtcgtgggtcacaaaattcatttatagaaagattaaaagtttgtggagcaggaacaagcactcaacggtgaatggccactaccacaatgggattttaaacggcaaatataaacggaacgggcatataaaacacgaaaagaaggtcaaatag

SEQ ID NO: 47763 - DNA, 1626 bp, Artificial Sequence
  Description of Artificial Sequence: Synthetic coding sequence
atgaagagctacaccccctacttcatcctgctgtggagcgccgtgggcatcgccaaagcggcgaagatcatcatagtaccacccattatgttcgaaagtcacatgtacatttttaagaccctcgccagtgccctgcatgaacggggtcaccacaccgtcttcctcttatccgaaggacgtgatattgccccttcgaatcactatagtcttcagaggtaccccggcattttcaattcgaccacgagtgacgcatttctgcagagtaaaatgagaaacatattctccggacgtttgaccgccattgagcttttcgatattctcgatcactataccaagaattgcgatttaatggtgggcaaccatgcactgatccagggtcttaagaaggagaagtttgacctgcttctggtggacccaaatgatatgtgtggattcgtcattgcccacctgttgggggttaaatatgccgttttcagcactgggctgtggtaccccgcggaagtgggtgcccctgctcccctggcgtatgtaccagaattcaatagcctgctgaccgatcgcatgaacctcctacagcggatgaaaaacacgggagtctatctgatctctcgcctcggggtctccttcttggtactgcccaagtatgagcgaattatgcaaaagtataatcttctgcccgaaaagagtatgtacgacctggtacacggctccagtctgtggatgctctgtactgatgtggccttggagttccctaggcccacattgccaaatgtcgtgtacgtgggcggcattctaaccaagcccgctagtccactgcccgaggacctccagaggtgggtgaatggcgccaatgaacatgggttcgttctggtttcctttggcgcaggcgtcaagtacctctctgaagatatcgcaaataagctagccggcgcccttgggaggctcccccagaaagttatttggcgcttctcaggacctaagcctaagaatctcggtaataatacaaaacttatcgaatggctgccacagaacgatcttcttggccactcgaaaattaaggcgtttctgagccacggcggattgaactcaatattcgaaacaatttatcatggtgttcctgtcgtgggtatcccgctttttggcgaccattacgacacaatgactagagtccaggctaagggcatgggcatactgctagagtggaagactgtgaccgagaaggagctgtacgaggctctggttaaggttatcaataacccgtcatacaggcaaagggctcagaaattaagcgaaatccacaaggaccagcccggccatcccgtgaatagaacaatatattggattgattatattatcaggcataatggcgctcaccacctgagagcggcagtacaccagatttcgttctgccagtactttctgttagatatcgctttcgtcctgcttctgggggccgccctcctgtatttcttattgtcctgggtgacgaagttcatctacagaaaaataaagagcctctggtcgcgaaacaaacattccacagtgaatgggcactaccacaatgggattttgaatgggaagtataaacgcaacggccatatcaaacatgagaagaaggtaaagtag

SEQ ID NO: 47764 - DNA, 426 bp, Artificial Sequence
  Description of Artificial Sequence: Synthetic coding sequence
atgaagagctacaccccctacttcatcctgctgtggagcgccgtgggaattgctaaggcagccaagattattattgtgccccctataatgtttgagtctcatatgtatatatttaaaaccctggcatcagcactacacgagcgcgggcaccatacagtattcctgctcagcgaaggcagagatatcgccccaagcaatcactactcgctgcagcgataccctgggatcttcaatagtactacctccgatgcatttctgcagtccaagatgcgcaacatattcagcggccgactgaccgccatcgaactgttcgacattctggaccactatacgaaaaactgcgacttaatggtgggcaaccatgcacttattcaaggcctgaagaaagagaaatttgatcttctgctggttgatccaaacgattag

SEQ ID NO: 47765 - DNA, 990 bp, Artificial Sequence
  Description of Artificial Sequence: Synthetic coding sequence
atgaagctgctgcggcgggcctggcggcggcgggccgccctgggccttggtactctcgcactgtgtggtgccgccctgctgtatctggccaggtgcgccgctgaacccggcgacccgagagctatgtccggcaggtctcctccccctcccgcccccgcacgggcagccgctttcttggccgtcctcgtagccagcgcaccgcgcgctgcggagcgcaggtcagtgataaggtccacctggttagcgcgtcgcggcgctcctggcgacgtttgggccagattcgcggtgggaaccgccggtctcggggcggaagaacgaagggctttggaaagagagcaagcccgacatggggacctgctccttctgccagcactgagagacgcttacgagaatctaactgccaaggtgctggccatgctggcctggttggacgaacacgtggcctttgaatttgtgctcaaagcagatgacgactccttcgcaaggctggacgcccttttggccgaactgagagcccgcgagccggcccgccgccgaaggctttactggggatttttctccggcaggggtagggtgaagcctggcgggaggtggagggaggctgcttggcaattatgcgactactatctgccatacgcgttgggggggggatatgtactctctgcggacctggtccattaccttaggctctcgagggactatctacgcgcttggcactcagaagacgtgagtctgggagcgtggcttgcaccggttgatgtacagcgggaacacgatccccgcttcgacacagaatatagaagccggggttgtagcaatcaatacctcgtgacccataagcagtcacttgaggacatgctagagaagcacgctactctggcacgagaggggcgtctgtgcaagagagaggtgcagctgaggctctcctatgtatatgactggtccgctccacctagccagtgctgccaaagacgcgagggtatcccttag

SEQ ID NO: 47766 - DNA, 981 bp, Artificial Sequence
  Description of Artificial Sequence: Synthetic coding sequence
atggccagcaaggtgagctgcctgtacgtgctgaccgtggtgtgctgggcttcagccctgtggtacctaagcatcacaaggcctacctctagctacactggctcaaagccatttagccacctcacggtggcaagaaagaacttcacattcggaaatattaggacccgtccgataaacccgcatagttttgagttcctaattaatgagcctaataaatgcgaaaagaacatcccatttctcgtgatcctgatttctacaacacacaaggagtttgacgctcgacaggctataagagaaacttggggtgacgaaaacaattttaagggtataaagatcgccaccttgtttctcctgggcaaaaatgccgacccagtgctgaaccaaatggtagaacaggaatcgcagatatttcacgacattatcgtggaggacttcatcgattcctaccacaacctcaccctgaaaaccttaatggggatgagatgggttgccacattttgttccaaagctaagtatgtgatgaaaactgattctgatattttcgtgaacatggacaacctcatttataagctgcttaagccctctacaaaaccgcgtcgacgttacttcaccggttacgttattaacggaggcccgataagggacgtacgctcaaagtggtacatgcccagggacctgtatcctgattcgaactaccctccgttttgcagcggcacgggatatatcttcagcgcagatgtcgccgagctaatctacaagacaagccttcacactcggctccttcatcttgaggatgtctacgtcggactgtgtctgcgaaaactaggcatacacccctttcagaacagtggatttaaccactggaagatggcatactccctgtgcaggtataggcgagtcataactgtccaccagatttcccccgaagaaatgcacagaatatggaacgacatgagttctaagaagcacctgaggtgttag

SEQ ID NO: 47767 - DNA, 981 bp, Artificial Sequence
  Description of Artificial Sequence: Synthetic coding sequence
atggccagcaaggtgagctgcctgtacgtgctgaccgtggtgtgctgggcaagcgcgctttggtatctttccattactagaccaacgtcaagctatacaggaagcaagccgttttcccacctgaccgtggctcggaagaactttaccttcggaaatatacgcaccagacccatcaaccctcattctttcgagtttcttataaatgaacccaacaaatgtgaaaagaacatcccttttctggtcatcttgataagtaccacacataaggaattcgatgctagacaggcaattagggaaacgtggggagatgaaaacaatttcaaagggattaaaatcgccaccctatttcttctcggcaagaacgcggatcccgtcctcaaccagatggtggagcaggagtctcagattttccatgatatcatcgtcgaggacttcatcgacagttatcacaacctaaccctcaagactctcatgggcatgaggtgggtagccacattttgctctaaagctaagtacgtcatgaagacagattctgatatcttcgtcaacatggacaatctaatctacaagctactgaagccatccacaaagccaaggcggaggtatttcactggttacgttatcaacggaggcccaatccgtgacgtgaggtctaagtggtacatgcctagagacttatatcctgactccaactaccccccattttgcagcggaaccggatacatcttcagcgctgacgtcgctgagctgatctacaaaacatccctgcacaccaggttgcttcaccttgaggacgtgtatgtagggctctgtctgagaaagctgggaatacatcctttccaaaatagcggttttaaccactggaagatggcctactctctctgccggtatcgtcgtgtgataaccgttcatcaaatatcgccagaggagatgcacaggatctggaacgacatgtcttcaaaaaagcacctgcggtgctag

SEQ ID NO: 47768 - DNA, 1248 bp, Artificial Sequence
  Description of Artificial Sequence: Synthetic coding sequence
atgcagatgagctacgccatccggtgcgccttctaccagctgctgttggcagcactgatgctggttgcaatgctgcaacttctttacctcagcctgctaagcggcctgcacggccaggaagaacaggatcagtattttgagttcttccctccttccccgcgcagcgttgaccaggtcaaagcccagctccggaccgccctggccagcggaggagtgttagacgcgagcggtgactacagagtttatcggggcctactgaaaacaactatggatcctaacgacgtgattttagctacccatgctagcgtggacaatctcctccacctgagcggtcttctggagcgatgggaagggcctctatccgtgtccgtgtttgcggctaccaaagaggaggcacaacttgcgaccgtactcgcctatgcattgagcagccattgcccggatatgagagctcgggtagctatgcacctggtgtgcccttccaggtatgaggcagcagtccctgacccccgagaaccaggggaatttgccctactgcgcagctgccaggaagtctttgataagctggcaagggtcgctcaaccaggtataaactacgcccttgggaccaacgtgagctaccccaacaacctgctgagaaaccttgctagggagggggccaactatgccctcgttattgacgttgacatggttccaagtgaaggcctatggagaggcctgcgggagatgctggatcagtccaaccagtggggcggtacagccctggtcgttcccgcttttgaaattaggcgcgcccggcgaatgccaatgaataagaatgagctcgtccaactgtaccaagtgggggaagtacggcctttctactacggattgtgtacaccttgtcaggcccccacgaattatagccggtgggtgaacttgcctgaggagagcttgcttcggcctgcctatgttgtgccatggcaggacccctgggaacctttctacgtggctgggggtaaggtacccacgttcgacgagagatttcgacaatacggcttcaaccgtatcagtcaggcctgcgagctccacgtggctggctttgacttcgaagtcctcaacgaaggctttctagtgcataaaggttttaaggaggcgctgaagttccaccctcagaaagaagcggagaatcagcacaacaagatcctgtatagacaatttaaacaagagcttaaggcgaagtaccctaactcccctcgacgttgttag

SEQ ID NO: 47769 - DNA, 561 bp, Artificial Sequence
  Description of Artificial Sequence: Synthetic coding sequence
atggtgcccagcgagggcctgtggcggggcctgcgggagatgctggatcagtcaaatcagtgggggggtacggccctggtcgttcctgccttcgagatcagacgagctcgcaggatgccgatgaacaaaaatgagcttgttcagctgtatcaggtgggagaagtgcgccctttctactatggcctttgcacgccctgtcaagcgcctactaactatagccgttgggtcaatctccctgaagagtcgctactgcgtccagcctatgttgtgccttggcaggatccatgggagcctttctatgtcgccggaggcaaagtgccgacgtttgatgaaagatttagacaatatggcttcaacagaatttcgcaggcctgcgagctccacgttgccggatttgatttcgaagttctgaacgagggttttctcgtacataaaggttttaaggaggctctgaaattccacccacagaaagaggcagagaaccagcataacaagattctgtacaggcagttcaaacaagaactcaaggccaagtaccctaattcacccagaagatgctag

SEQ ID NO: 47770 - DNA, 1194 bp, Artificial Sequence
  Description of Artificial Sequence: Synthetic coding sequence
atgagcgtgggccggcggcggatcaagctgctgggcatcctgatgatggccaacgtatttatctattttattatggaggtctccaagtcttcctcgcaagagaagaatggtaaaggggaggtgattatcccaaaggagaaattttggaaaatttcaactccacctgaggcctactggaatagagaacaggaaaagctcaacagacagtacaaccccatactctccatgctgaccaaccagactggagaggcagggcggttgagtaatatcagtcacctaaactactgtgagcctgatctgcgggtgacgtccgtcgtgacaggttttaataatcttcccgatcgattcaaagactttctgttgtacctgaggtgtagaaattattcactgttaatcgatcaaccagacaaatgtgctaaaaaaccatttctcttgctggccattaaatccctcactcctcatttcgccaggagacaagccattcgtgaatcttggggccaggagtcgaacgccgggaaccagacagtggtgagggtgtttctcttggggcagacaccgcccgaggacaaccatccggatctaagcgacatgctgaagttcgagtcagagaagcaccaagacattcttatgtggaattatcgggacaccttcttcaaccttagtctgaaagaggttctatttctaagatgggtgtccacatcctgccccgacaccgagttcgtgttcaagggagatgacgacgtattcgtgaatacccatcacattctgaattatctaaactccctttcaaaaacaaaggccaaagacttgttcattggagatgtcatacacaacgccggcccacacagggacaaaaagctcaagtattacattcctgaggtcgtgtattcggggctgtatcctccctacgctggcggcggtggctttctgtattctggccacctggcgctgcgactgtatcatatcactgatcaagttcatctctaccctattgatgatgtctatactggcatgtgtctgcaaaaactcgggctggttccagagaaacacaagggtttcagaacattcgatatagaagaaaagaataagaacaacatctgctcctatgttgacttgatgctggtgcacagccgaaaaccacaggaaatgatcgatatctggtcacagctgcagagcgcacatctcaagtgttag

SEQ ID NO: 47771 - DNA, 1194 bp, Artificial Sequence
  Description of Artificial Sequence: Synthetic coding sequence
atgagcgtgggccggcggcggatcaagctgctgggcatcctgatgatggctaacgttttcatatattttattatggaggtcagcaaatcttccagccaggaaaaaaatggtaagggcgaggtcataataccaaaggagaagttctggaagatcagcacaccgcccgaggcttattggaaccgggaacaggagaaactcaataggcagtataacccaatcctgagcatgctgactaatcaaaccggagaggctggcagactcagcaacatttctcatctgaactactgtgagcctgatctgagggttacctctgtggttactggatttaataatctgcctgatagattcaaggactttctgctctaccttaggtgtcgcaattacagcctgttaatcgatcagccagataagtgcgccaagaagccgttcctactgctcgcaatcaaatcactaacccctcactttgctcggaggcaggcgatcagagaaagttggggacaggaaagtaatgctggaaaccagaccgtcgtccgagttttcctgttaggtcaaactccacctgaagataaccacccagatctttcagacatgctcaagtttgaaagtgagaagcatcaagatattcttatgtggaactaccgcgacactttttttaatttgtccctaaaagaggtgctgttcctgcggtgggtgtctacttcctgccccgataccgagtttgtgtttaagggggacgatgatgtatttgtgaacacacatcacattcttaattatctcaacagcctgagcaagacaaaggcaaaagacctctttatcggcgacgtgatccataatgcagggccgcaccgcgataagaagctgaaatactacatccctgaggtcgtgtactcaggcctgtatccaccctacgcaggtggcggtggattcttatactctgggcacctagctttaaggctctaccacattactgaccaggttcatctgtatcccatcgacgacgtatatactggaatgtgtctccagaaactgggactcgtgccagaaaagcacaaaggttttcggacgtttgacattgaggagaaaaataagaacaacatctgttcctacgtggacctcatgctggtgcactctcggaagccccaggaaatgatcgatatttggtctcagctccagtctgcccaccttaaatgctag

SEQ ID NO: 47772 - DNA, 1137 bp, Artificial Sequence
  Description of Artificial Sequence: Synthetic coding sequence
atgcggatgctggtgagcggccggcgggtgaagaagtggcagctgataattcaactgtttgccacttgttttttggcatcccttatgtttttctgggagcccattgacaaccatatagtgtcccacatgaagagttactcttaccgctacctgattaattcctacgacttcgtgaacgacacgctgtcgctgaagcacaccagcgctggacctagataccaatacctcattaaccacaaggaaaagtgtcaagcgcaggacgtgctcctgctattgttcgtcaagacggctcccgaaaactatgacagaagaagtggaatccggagaacctggggtaatgagaactatgttcgctcccaactgaatgccaacatcaagacactatttgcccttgggactccaaaccccctggaaggagaggagctccagcgaaagctggcctgggaggatcagcgctataatgatataattcagcaggattttgtggactccttctacaacctgacattaaaactgctgatgcagttttcttgggcgaatacatattgtccgcatgcaaagtttctgatgacagcagatgatgacatcttcatacacatgcctaatctgatcgaatatctccaatccctggaacagatcggcgtgcaggacttctggatcgggcgagtccacagaggagctcccccaatccgcgacaagtccagcaagtattacgtgtcctatgagatgtaccagtggccagcctaccccgattacacagcaggcgcagcctacgtgatctctggcgatgtggcggcgaaagtatacgaagcatcacagactctcaattcctctctgtacattgacgatgtgttcatgggtctgtgcgcgaataagataggcatagtgccacaggatcatgtcttcttcagtggggaaggaaagactccatatcacccttgtatctacgagaagatgatgacctcccatgggcatcttgaggacctccaagacctgtggaagaacgcgacagaccccaaagtaaagacaatatcaaagggtttcttcggtcagatttactgcagattaatgaagattatcttactctgcaaaatcagttacgtcgatacttacccatgcagggccgcattcatttag

SEQ ID NO: 47773 - DNA, 1137 bp, Artificial Sequence
  Description of Artificial Sequence: Synthetic coding sequence
atgcggatgctggtgagcggccggcgggtgaagaagtggcagctgatcatccagctctttgcaacatgttttctggcctccctcatgttcttctgggaacctatagacaatcacattgtgagccacatgaaaagttacagctatagatacctgattaattcatatgacttcgtcaacgatacactgagcctgaaacatacatccgcggggcccaggtaccaatatctcatcaaccataaagaaaagtgccaggctcaggacgtgctactgttgctgttcgtcaaaacagcccctgaaaactacgaccgccggtccggcattaggagaacatggggtaatgaaaactacgttcgaagtcagcttaatgctaatattaaaacccttttcgcgctgggcacaccgaatcctctggaaggggaggagctgcagcggaaactggcgtgggaagaccagaggtataacgatattattcagcaagactttgtggactctttctacaaccttaccctcaagctgctaatgcagttcagctgggctaatacctactgtccccacgctaagtttttaatgacagccgatgacgatatcttcatccatatgccaaatctcattgaatacctgcaaagcctggagcagatcggtgtccaggatttctggataggacgcgtgcataggggagctccacctatccgggataagtcgtcaaagtactacgtgagctatgagatgtaccaatggccagcctatccggactatactgctggcgccgcttatgttatctcaggcgacgtggccgctaaagtgtatgaggcttctcagacactaaactcctctctgtatattgacgacgtgttcatggggttgtgtgctaataagatcgggattgtgcctcaggatcatgtgttttttagcggcgagggcaaaaccccttatcacccatgtatttatgagaagatgatgaccagccacggacacctagaagacctgcaggacttatggaagaatgcgaccgaccccaaggtgaaaactattagcaaagggttctttggccagatttactgtcgcctgatgaagatcatcctcttgtgcaagatttcctacgtggacacatatccatgtcgcgccgcattcatctag

SEQ ID NO: 47774 - DNA, 189 bp, Artificial Sequence
  Description of Artificial Sequence: Synthetic coding sequence
atgcggatgctggtgagcggccggcgggtgaagaagtggcagctgattatccagctttttgcaacgtgctttctagcgagtctgatgtttttctgggagccgatagacaaccatatcgtgtcacatatgaagagctatagctacaggtacctcatcaactcttacgacttcgtgaacgacaccctgtag

SEQ ID NO: 47775 - DNA, 246 bp, Artificial Sequence
  Description of Artificial Sequence: Synthetic coding sequence
atgcggatgctggtgagcggccggcgggtgaagaagtggcagctgattattcaattgtttgccacctgttttctcgctagtctaatgttcttttgggagcctatcgacaaccacatagtgtcacatatgaagagctactcttacaggtatctgataaactcttatgacttcgtaaacgacacattgagcctgaaacacaccagcgctggaccccgataccaatacttgatcaaccacaaggagtag

SEQ ID NO: 47776 - DNA, 1137 bp, Artificial Sequence
  Description of Artificial Sequence: Synthetic coding sequence
atgcggatgctggtgagcggccggcgggtgaagaagtggcagctgatcatccagctgttcgctacttgttttctagcctccctgatgtttttttgggaaccaatcgacaatcatattgtttctcatatgaagtcttatagctatagatatctgatcaattcgtatgactttgtgaacgacaccctgagcctaaaacatacttcggccggccccagataccaataccttatcaatcataaggagaaatgtcaggcccaagacgttctcctcttgctatttgtaaaaaccgcccccgaaaactacgatcgtcgcagtggtattcgcagaacatggggcaatgaaaattacgttaggtcccagctgaatgctaacatcaagactctcttcgcactgggtacacccaatccactggaaggggaggagcttcagcgtaaacttgcttgggaggatcaacgctacaatgatattatccaacaggacttcgtcgattcgttctacaatttgacacttaaattgttgatgcaatttagttgggcaaacacctattgtccccatgccaagttcctgatgaccgcggacgacgacatttttattcatatgcctaatttgattgaatacttacaaagtttggaacagatcggcgtccaggatttctggattggacgggtgcaccggggagcccctccaatacgggacaaatcttccaaatactacgtgtcttacgagatgtaccaatggcctgcttaccccgactacacggccggggccgcttatgtcatttcaggcgacgtcgctgctaaggtgtatgaagcctcccagaccttaaattcaagcttatatatcgacgacgtgttcatgggtctctgcgctaataaaataggcattgtgccccaggaccacgtgtttttttcaggagaggggaaaactccctatcatccgtgtatctacgaaaagatgatgacctctcacggacacctcgaggacctccaggatttatggaagaacgccactgatcctaaagtgaagacaatttccaagggatttttcggccagatttactgccgcctgatgaagatcattctgttgtgtaaaatcagttacgtggacacatacccctgcagggccgcctttatttag

SEQ ID NO: 47777 - DNA, 153 bp, Artificial Sequence
  Description of Artificial Sequence: Synthetic coding sequence
atgcggatgctggtgagcggccggcgggtgaagaagtggcagctgatcattcaactgttcgcaacatgctttcttgctagcctcatgttcttctgggagccaatcgataaccatatagtctcgcatatgaaaagttacagttaccgctactag

SEQ ID NO: 47778 - DNA, 1206 bp, Artificial Sequence
  Description of Artificial Sequence: Synthetic coding sequence
atgagcctgtggaagaagaccgtgtaccggagcctgtgcctggcccttgccttattagtggccgtgacggtgttccagaggtcactaactccaggccaatttttgcaggaaccccccccaccaaccctggaaccgcagaaggcacaaaagccgaatgggcagctggttaatcccaataacttttggaaaaaccccaaagatgttgcggctcccactcctatggctagccagggccctcaggcctgggatgttacaactactaactgttccgcaaacattaatttaacgcaccagccatggtttcaggtcctggagccacagttcaggcagtttttgttttacaggcactgtcgctacttcccaatgttgcttaatcaccctgagaagtgtcgcggagacgtgtacctgctcgtggttgtcaaatccgtgatcacccagcatgatagacgggaagctatcagacagacctggggcagagagaggcaatctgccggcggtggaagaggtgctgtccggacgctgttcctgctgggaactgccagcaagcaggaggaaaggacccactatcagcaactgttggcttatgaggatcgcctgtacggcgatatcctccagtggggttttctcgatacattcttcaacctgacactgaaggagatccatttcttgaagtggcttgacatctactgcccgcatgtaccctttattttcaagggcgatgatgacgtgttcgtcaacccaaccaacctgctggaatttctcgccgataggcagcctcaggagaacctatttgttggggacgtgctacaacacgcccgccccattcggagaaaggataacaagtattacatcccgggcgccctgtacggcaaagcatcgtatcccccttacgctggtgggggtgggttcctcatggccggcagcctcgcccgcaggctgcatcacgcctgtgatacactggagctctaccccattgacgacgtgtttctcggcatgtgccttgaagtgttgggagtccaaccaaccgctcacgagggattcaaaacctttggcatatcacgaaaccggaattctaggatgaacaaagaaccgtgtttcttccgggcgatgctggtcgtgcataagctgctaccgccagaactgctggccatgtggggcctggttcattccaacttaacctgctcacggaaactccaagtgttatag

SEQ ID NO: 47779 - DNA, 1194 bp, Artificial Sequence
  Description of Artificial Sequence: Synthetic coding sequence
atgcggtgccccaagtgcctgctgtgcctgagcgccctgctgaccctgctcggcctgaaggtgtacatcgagtggacatccgaaagtcgcctatctaaagcatatccttctcctcggggaaccccccctagccctacacccgccaacccagagcccacattgcccgccaacctgagcacccggctgggtcagacgatcccactcccattcgcgtactggaaccagcaacagtggaggctgggcagtttgcccagtggggacagtactgaaaccggaggctgtcaggcttggggggccgctgcagccaccgagatcccagatttcgcgtcttatcctaaggatctaagaaggttcctgttgtccgccgcctgtagatcctttccacagtggttaccaggcggcggcggaagccaggtgtccagctgctccgatacggatgtgccttatctgcttctggctgtgaagtccgaacccggtcggttcgcggagaggcaggctgttcgcgaaacatggggaagtcccgcgcccggcatccgtctgctgtttctattaggctccccggttggtgaggctgggcctgacctggacagtctggtcgcttgggagagccgtaggtactccgacctgctcctctgggatttcctcgacgtgccttttaatcaaactctgaaagacctgctcttactggcatggctcggcaggcactgcccaaccgtgtctttcgtcttacgagcccaagacgatgccttcgtgcacacgccagcactattagcgcaccttcgggccctgcctcctgcttctgctcgctcattatatctgggcgaggtgttcacacaggccatgccacttcgcaagcccggcggtccattttacgtacctgagagtttctttgaaggcggttatcctgcttatgcttctggcggggggtatgttattgctggcagactagccccatggttactaagagctgctgccagagtggctccatttccttttgaggacgtatacacaggtctctgtatccgcgctctggggctcgtgcctcaagcccatcccggtttcctcaccgcatggcccgccgacagaaccgccgatcattgtgccttccgcaatctgctcctcgtgcgccctcttggcccacaagccagcatccgtctgtggaagcagctgcaggacccccggctgcagtgctag

SEQ ID NO: 47780 - DNA, 1209 bp, Artificial Sequence
  Description of Artificial Sequence: Synthetic coding sequence
atgcggcggcggctgcggctgcggcgggacgccctgctgaccctgctgctaggcgcttccctcggcctgctgctgtacgcgcaaagggatggcgccgcccccacggcttctgctcctagagggagggggcgagcagctcccaggcctactccggggcctcgggccttccaactgccagacgcaggagccgcaccccctgcatacgagggcgacacacccgctcctcctacccccactggtccatttgacttcgcccgttacctccgagccaaagatcagcgaagattccctcttctgataaatcagcctcacaaatgccgcggggacggagcacctggagggagaccagatctgcttatagccgttaaatcagtcgcggaggactttgagcgtcgccaggccgtgcggcagacctggggcgcagagggccgcgtccagggagcgcttgtgagaagggtcttcctgcttggtgtccctcggggggctgggtccgggggggccgacgaagtaggcgagggagctagaacacactggagggctttgctccgggcggagagtctagcatacgcagacatcctgctgtgggcgtttgatgatacttttttcaatctcacactgaaggaaattcactttctggcttgggcttccgcgttttgtccagatgtgaggttcgtatttaagggagatgctgacgtttttgtgaacgtgggcaatctgttggagttccttgccccaagagatcctgcccaagatttactcgcaggggatgtgattgtccacgcccggcctatacggacccgagcgagcaagtactacattcctgaagccgtgtacgggttgccggcatacccagcgtacgctggcggtggcgggtttgtcctctctggggcaaccctccaccgcctggctggcgcttgcgctcaggtggaactgtttcctatcgatgacgtgttcctggggatgtgtctgcaaagacttcgcttgactcccgagccgcacccggcctttcgcacatttggcatcccccagcctagcgccgccccgcacttgagtaccttcgatccatgcttctaccgggaactggtagtagtccacggcctgtcagccgcagacatctggcttatgtggagactgctgcacgggccacacggacctgcctgcgcacacccgcagccagtcgctgctggcccttttcaatgggacagctag

SEQ ID NO: 47781 - DNA, 1584 bp, Artificial Sequence
  Description of Artificial Sequence: Synthetic coding sequence
atgcggagcgacaagagcgccctggtgttcctgctgctgcagctgttctgcgtgggctgcggcttttgcggcaaggtcctcgtgtggccatgtgatatgagccactggttaaatgtcaaggtcatattggaagaactaatcgtgcgtggccatgaggtgacggtgcttacacattccaaaccatctctgatcgattaccgaaagccgagtgcactgaaattcgaggtcgtccacatgccccaggataggactgaggagaacgaaatctttgtcgatttggctctgaacgttctccctggccttagtacgtggcagtcggtgattaagctcaacgactttttcgtggagatacgggggaccctgaagatgatgtgtgagagtttcatatataaccaaaccctgatgaagaaattacaagagacgaactatgatgttatgcttatcgatcctgtcattccgtgcggggatctgatggcagaactgctagccgtccctttcgtgcttaccttacgcatttcagtcggcggtaatatggagaggagctgcgggaagttgcccgcccctctgtcatatgtgcccgtccctatgaccggtttaacagacagaatgacgtttctggaaagggtaaagaactccatgctttcagtgctatttcacttttggatccaggactacgactatcacttctgggaggagttctacagtaaagcgctgggcagacccacgaccctgtgcgaaaccgtagggaaagccgaaatctggctgatccggacctattgggatttcgagttccctcagccctaccaacctaatttcgagtttgtgggaggacttcactgcaagccagccaaagccctacctaaggagatggagaattttgtccagtccagtggcgaggacggaatcgtagtgttctccttgggtagcctatttcagaatgtgaccgaagaaaaggcgaacataatcgccagcgccctggctcaaatcccacagaaggttctgtggcgttataagggaaaaaaaccatctacactgggagccaatacaagactttacgactggatcccccaaaacgacctactgggacacccaaaaacaaaggccttcatcacccacggcggtatgaacggcatctatgaagctatttatcacggggtccccatggtcggcgtcccaattttcggagaccaactggataatattgctcacatgaaggctaaaggggcagccgtggagatcaactttaagacaatgaccagcgaggacctgcttagggcgctccgaactgtgatcacagactccagctataaggagaacgctatgcggctgagccgcatccaccacgaccaacccgtgaaacctcttgaccgtgctgtgttttggatcgaatttgttatgcgacacaagggggccaagcatctaagatctgctgcccacgacctgacctggttccagcattactccatagatgtcataggtttcctgctagcctgcgtggccacagccattttcctcttcaccaagtgcttcctattttcttgccagaagttcaacaaaacgagaaagattgagaagcgggaatag

SEQ ID NO: 47782 - DNA, 717 bp, Artificial Sequence
  Description of Artificial Sequence: Synthetic coding sequence
atggagaacttcgtgcagagcagcggcgaggacggcatcgtggtgttcagtctggggagcttgtttcagaacgtgacagaagagaaagcgaatattatagcgagcgcactggcacagatacctcaaaaggtcctgtggcggtacaaagggaagaaaccctccacattgggcgccaacaccaggctgtacgattggattcctcagaatgacctcctggggcatcccaagaccaaagcctttatcactcatggaggcatgaatgggatctatgaagctatctatcatggggtcccgatggtgggcgtccctatcttcggtgatcagttggataatattgcacatatgaaggccaaaggtgcggcggtcgagatcaactttaagactatgaccagcgaagaccttttgcgagcactgcgcaccgtgatcaccgattcaagttacaaagagaacgcaatgaggttgtctagaatccaccacgaccagccagtgaaaccactggatagagccgtattttggatcgaatttgttatgagacacaagggcgccaaacacctccgttccgcagcgcacgaccttacctggttccaacactatagcatcgacgttataggatttctgctggcatgtgttgcgaccgctatcttcctcttcactaaatgctttttgttctcttgtcagaagtttaataagacccgtaaaattgaaaagcgtgagtag

SEQ ID NO: 47783 - DNA, 1587 bp, Artificial Sequence
  Description of Artificial Sequence: Synthetic coding sequence
atggccctgaagtggaccaccgtgctgctgatccagctgagcttctactttagcagtggttcttgcggcaaagttctcgtgtgggctgccgagtactctctgtggatgaacatgaagaccatactcaaagaactggtacagcgcggtcacgaagtaactgtgctcgctagctccgcctcaatcctgttcgaccccaacgattcttcaacactcaagctcgaggtttaccctacaagtctgacaaagaccgagttcgagaatataatcatgcaactggttaaaaggcttagcgagatccagaaggacacattttggctaccatttagccaagagcaggagatcttgtgggctatcaatgatatcattcggaatttttgtaaagatgttgttagtaacaagaagcttatgaagaagctgcaggaaagccgcttcgatattgtcttcgctgacgcatacctgccgtgcggcgaacttctcgctgaactctttaatattccgtttgtgtatagccactccttcagcccagggtatagcttcgagcgtcattccggtggattcatcttccctcccagctatgtaccagttgtcatgagcaaactgagcgaccagatgaccttcatggaaagagtcaagaatatgctgtacgtattatacttcgatttctggtttcaaatttttaacatgaagaagtgggaccagttctactcagaggtccttggaaggcccaccactcttagcgaaaccatgagaaaggccgacatctggcttatgcgtaattcctggaactttaaatttccccatccattcttaccgaatgtggactttgtcggagggcttcattgtaagcccgcgaagcctttacccaaggaaatggaggaatttgtgcagagcagtggagaaaacggggtggtcgttttcagtctcggctcaatggtgtcaaacatgacagaggaacgcgccaacgtgatagcaactgctctggctaaaatccctcaaaaagttctgtggcgttttgacggaaacaaaccggacgctttaggcttaaacacccgcctatacaaatggattccgcaaaacgatcttctgggtcaccccaaaactcgcgcctttatcacacacggaggggcaaatgggatttacgaagcgatctatcatggtattcctatggtgggcatccccctgttcttcgaccagcctgacaacattgcgcatatgaaagcaaagggcgcagccgtccgagtagattttaatacgatgtccagtacagacctgcttaacgctttaaaaacagtaattaatgacccaagctataaggagaatattatgaaactgtctaggatccagcacgatcagcctgtgaaaccgcttgatagagctgtcttctggattgagttcgttatgcggcataaaggtgccaagcacttaagggtggctgcacacaatctgacttggtttcagtaccactcgctggatgtgattggcttccttctggcttgcgtcgccacagttctctttatcattaccaaatgctgcctgttttgtttctggaaattcgcccggaagggcaaaaagggcaaaagggattag

SEQ ID NO: 47784 - DNA, 1827 bp, Artificial Sequence
  Description of Artificial Sequence: Synthetic coding sequence
atgggcagcgtgaccgtgcggtacttctgctacggctgcctgttcacatctgctacctggacagtattactttttgtatacttcaactttagcgaagtgacccagccccttaaaaacgtacccgtgaaaggtagcggaccacacggaccttccccaaaaaaattctacccgaggttcactaggggaccttcccgcgtcttggaacctcagttcaaggcaaataaaatagatgacgttattgattccagggtggaggaccccgaggagggccatctgaaattttcgtctgaattaggcatgatattcaatgaacgagaccaggaactgagggacttgggctaccagaagcacgcctttaatatgctcatatctgacagattgggctatcacagagatgtgcctgacacccgcaacgccgcctgtaaggagaaattttaccctcctgatctccctgctgctagcgtggtaatatgtttttataatgaggcattctcagctcttttacgcacggtgcattccgtgattgacagaacacctgcacatttattgcatgagatcattctggtcgacgacgactcagatttcgacgatctgaagggcgaactggacgagtatgtgcaaaaatatcttcccggcaaaatcaaggtaattcgaaataccaagcgagaaggcctgatccgcggtcgcatgataggcgcagctcacgccaccggggaggtgctggtgttcctggatagccactgtgaggtcaacgtgatgtggttacaacccctactggcagccattcgagaggatcgacacacagtggtatgtccagtgattgacattatttctgccgacacgcttgcctactcatcatctccggtcgtaaggggcggatttaactggggacttcatttcaaatgggatctggtgccgctgtccgagttaggacgcgccgagggggcgacggcaccaatcaaatcccctactatggcaggcggcctattcgctatgaaccgccagtatttccacgagctcgggcagtatgatagcggtatggatatctgggggggagagaatctcgaaatcagttttcggatttggatgtgcgggggtaaactgttcattatcccttgttccagggttggacacatattcagaaagcggagaccatacggatcaccagaaggtcaggatacaatgacccataattcattgaggcttgcgcatgtgtggttggacgagtacaaagaacagtacttttccctgcgccctgacctgaaaactaaatcctatggtaacatctcggaaagagtcgagctccgaaagaaactgggctgcaagtcctttaaatggtatttagataacgtgtatcctgagatgcagattagtggttcgcacgccaaacctcagcagcccatctttgtgaacagaggccctaaacgtcccaaggtcttacagaggggcagactttaccatttgcaaacaaataaatgtctagtggcccagggccgaccttcccagaagggtggactcgtggtgctgaaagcctgtgactattcggatcctaaccagatctggatctacaacgaagagcatgagctggtgttgaacagcttactgtgtctcgatatgagcgaaacgcggagcagtgatcctccaagactgatgaagtgccacggctctgggggtagccaacaatggactttcggcaaaaataatcgcctgtaccaggtgtccgttggccaatgtctacgagcggtggaccccctgggacagaaaggtagtgtggccatggctatttgcgatgggtctagctcccagcagtggcatctggagggctag

SEQ ID NO: 47785 - DNA, 609 bp, Artificial Sequence
  Description of Artificial Sequence: Synthetic coding sequence
atgggcagcgtgaccgtgcggtacttctgctacggctgcctgttcacttccgccacttggacagtcctcctctttgtgtatttcaacttcagtgaggtgactcaacctcttaaaaacgtgcctgttaaagggagcggccctcacgggccatcgccgaagaagttctatccgcgatttacccgcggcccgtcaagggtcctcgagccacaattcaaggcaaacaaaatcgatgacgtcatcgacagtcgcgtggaagatccagaggagggccatctgaagttcagcagtgagctagggatgatatttaatgaaagagaccaggagctgagggatctgggctaccaaaaacacgcattcaacatgctgatttcagatagactcggataccatagagacgtgcccgatactagaaacgccgcgtgtaaagagaaattctacccacccgacctgccggccgccagcgtggtgatttgcttctataacgaagcatttagcgccttacttcgaactgtgcattcagtaatcgataggacaccagcgcatctgctgcacgagataatcctcgtcgacgacgacagcgactttggaaaagaatgctgcacttggtag

SEQ ID NO: 47786 - DNA, 561 bp, Artificial Sequence
  Description of Artificial Sequence: Synthetic coding sequence
atgggcagcgtgaccgtgcggtacttctgctacggctgcctgttcacatccgcaacctggaccgttctgctgtttgtatacttcaattttagcgaagttacacagccgcttaagaatgtgcctgttaagggatctgggccccatggccccagccccaagaagttctatcctcgatttacccgcgggccaagccgtgtgttggagccccagttcaaagcaaacaaaatcgatgacgtgatagacagtagagttgaggacccagaagaaggtcatcttaaattctccagtgaattaggcatgatttttaacgaacgggaccaagagttgagggatcttggttatcagaagcacgcttttaatatgctgatctccgaccggcttggctatcatagagacgtcccagatactcggaatgcagcctgtaaggagaaattctacccacctgaccttcccgctgcttcggtggtgatctgtttttacaacgaagcatttagcgctctcctgagaacagtgcatagcgttatagaccggacacccgcgcacttactccacgagatctag

SEQ ID NO: 47787 - DNA, 402 bp, Artificial Sequence
  Description of Artificial Sequence: Synthetic coding sequence
atgggcagcgtgaccgtgcggtacttctgctacggctgcctgttcacaagtgctacctggaccgtgctgcttttcgtctatttcaatttctctgaggtgactcaaccgctcaagaacgtaccggtgaaaggtagcggcccccacggaccgagtcctaagaaattttaccctaggttcacgcggggcccatcccgggtcttggagccccagttcaaagccaacaagatcgacgacgttatcgacagcagagtggaggacccagaggaggggcacctcaagttctcttcagagcttgacgtcaaaaagtcttcaacccatctgacttgtcaattgttagtgctgctctccgtgagtattatgaagcggtttctgccatgcttcggacagtgtacagtgtcctag

SEQ ID NO: 47788 - DNA, 1827 bp, Artificial Sequence
  Description of Artificial Sequence: Synthetic coding sequence
atgggcagcgtgaccgtgcggtacttctgctacggctgcctgttcaccagcgctacatggaccgtactcctgttcgtttatttcaatttttctgaagtgacacagcctttaaagaatgtcccggtgaaaggcagcggaccgcatggcccctccccaaagaagttctaccctaggtttactagaggacccagtcgggtgttggagccacaattcaaggccaataagatcgatgatgtcatagattccagagtcgaggatcccgaggagggtcacctcaaattctccagtgaacttgggatgatcttcaacgaaagagaccaggagctgcgggacctcggataccagaaacatgcttttaatatgttgatcagcgatcggctcggatatcatagagacgtgcccgacacaagaaatgcagcatgtaaggagaaattttatccaccagacctccctgcagccagcgtcgtcatctgcttctataatgaagcttttagcgcactcctaaggaccgtgcattccgttattgatcgaacacctgcacacctactccatgagataattctggtcgatgacgacagcgactttgacgacctcaagggagagttggacgagtacgtacaaaagtatctccctgggaaaatcaaagtcataaggaataccaaaagggaaggcctaattagaggccgcatgattggtgccgctcacgcaacaggcgaggtcctggtgtttctggattctcactgcgaagtgaacgtcatgtggttgcagcctcttctggccgccatacgagaagatagacatacagtcgtttgcccagtgattgacattatctctgcagatacattggcgtattcttctagcccagtcgtgcgcggcggatttaactggggactgcatttcaaatgggacctggtgcccttatcagaactagggcgcgcggaaggtgccactgcgccaattaaatccccaactatggcgggagggctcttcgctatgaaccgccagtacttccatgagctggggcagtatgactcgggcatggacatctggggaggcgagaacctcgaaattagtttcagaatttggatgtgtggcggcaagctctttattattccctgctccagggtcgggcatatcttccggaaacgtagaccctacggaagcccagagggccaagacactatgacccataacagcctgcggttggcacacgtctggctagacgagtacaaggagcagtacttttctctgagacccgatttaaaaaccaaaagttacggtaatataagtgagcgtgttgagcttcggaagaagttgggatgtaagtcatttaagtggtacctagacaacgtgtatcccgaaatgcagatttccggtagccacgctaaaccgcaacaaccaatctttgtgaatcgaggccccaagcgcccaaaggtactccagcggggccgcctctaccatctgcagaccaacaaatgtctcgtggcccaaggaaggccttctcagaaaggaggcctggtcgtgctgaaagcttgcgactattctgaccccaaccagatatggatttacaatgaggaacacgaactcgtgctcaactctctgctgtgtctggacatgtccgaaacccgttcctcagacccacctcggctgatgaaatgccatggttctggcggttcgcagcagtggacatttggaaagaacaataggctttaccaggtgtccgtagggcagtgtttacgggcagtagatccactagggcagaagggcagcgtggccatggctatatgcgacgggtcctcatcccagcagtggcatctcgagggatag

SEQ ID NO: 47789 - DNA, 297 bp, Artificial Sequence
  Description of Artificial Sequence: Synthetic coding sequence
atgggcagcgtgaccgtgcggtacttctgctacggctgcctgttcacatccgcgacgtggacggttctcctgtttgtgtattttaatttttccgaggtgacgcagccgctgaaaaacgtgcccgtcaaggggtccggcccacatgggccctctcctaagaagttttatcctcgctttacccgcggacccagccgggtgttagaaccacagttcaaggccaacaaaattgatgacgtgatagactcaagggtggaagaccccgaggagggtcatctgaagttctcatctgagttatag

SEQ ID NO: 47790 - DNA, 1827 bp, Artificial Sequence
  Description of Artificial Sequence: Synthetic coding sequence
atgggcagcgtgaccgtgcggtacttctgctacggctgcctgttcaccagcgccacctggactgtgctactctttgtgtactttaacttctccgaagtgacgcaaccgttgaaaaatgtgcctgtaaaaggtagcggtcctcatgggccaagccctaagaaattctatccccgcttcacaagaggaccctcacgggttttagaaccgcaatttaaggctaacaagatagacgacgtgatcgatagcagagtggaggaccccgaagagggacatctcaagttctcctcagaactcggtatgatcttcaatgagagagatcaggaattgcgagaccttggttaccaaaagcacgcctttaatatgttgatcagcgatcgactggggtaccatcgcgatgtgcctgatacccggaatgcagcctgcaaagaaaagttttaccctccggacctcccggcggcctctgtcgtcatctgcttctataatgaggcgttcagcgcactgttgagaacagtgcactctgtgattgatcgtacccccgcacaccttctccatgaaattattttggtcgacgatgatagtgacttcgacgatcttaagggcgaactggatgaatacgtgcagaagtacctgcctggcaaaatcaaggtgatccgcaatactaagcgcgagggtcttatccggggcaggatgatcggggcagcacatgcgacaggagaggtgctggtgttccttgatagtcattgtgaggttaacgtgatgtggctgcagccactccttgcagccataagggaggacagacataccgtggtgtgccctgtgatcgatatcatctctgcagatactttggcctacagctcctctccggtggtaaggggaggatttaactggggattacattttaaatgggacttagtccccctgtccgagctgggaagggcagagggtgctacggcacccataaaatctccgactatggccggtggtctctttgccatgaataggcagtacttccatgaactaggacagtacgattctggtatggatatctgggggggtgagaatctcgagatcagcttccgtatctggatgtgcgggggaaagctcttcatcatcccttgttcaagagtggggcatatatttcggaagcggcgtccatacggatccccagagggccaggatacaatgactcataactccctgcgtttggctcacgtctggctggatgagtacaaagagcagtacttttcactgcggcctgatctgaaaacaaagtcttacggaaacatcagtgagagagtggagcttcgcaagaagttgggatgtaagtccttcaagtggtatctggacaacgtatatcctgagatgcagatctccggttcacacgcaaaacctcaacaacccatatttgttaatcgagggcccaagaggcccaaagtcctccaacgaggcagactgtaccacctccaaacaaataagtgccttgtcgctcagggaagaccctcccagaaaggggggctcgtggtgctaaaagcctgtgactactcagatcctaaccaaatttggatctacaatgaagagcacgagttagttctgaatagcttactatgcctggatatgtccgagactcgatcatcagacccacctaggctgatgaagtgtcacggctcaggcggcagccaacagtggaccttcggcaaaaacaaccggctctaccaggtctctgtaggacaatgcctccgcgccgtcgatccactcggccagaagggatctgtggctatggccatatgcgatggctcctcgagccagcaatggcacctggaaggttag

SEQ ID NO: 47791 - DNA, 1827 bp, Artificial Sequence
  Description of Artificial Sequence: Synthetic coding sequence
atgggcagcgtgaccgtgcggtacttctgctacggctgcctgttcacctcagccacctggaccgtgctgctcttcgtgtacttcaactttagcgaagtgacccagccactaaagaatgtgcctgtgaaagggtccggaccccacgggcctagcccgaagaaattctacccccgattcacacgaggaccttcacgagttctggagccccagtttaaggcgaacaagatagatgacgttattgatagtagagttgaagatccagaggagggtcatctgaagttttcatccgagctgggcatgatattcaacgaaagagatcaggagctcagggacttaggataccagaagcatgcgtttaacatgctgataagtgatcgcctgggctaccacagggacgtccctgataccaggaacgcagcttgtaaagagaagttttatccccccgatttgccagctgcctccgtcgtgatctgcttctataatgaagccttttccgcattacttcgtactgtgcacagtgtcatcgacaggacgcctgcccacctgctgcacgaaataatcctcgtcgatgacgattctgacttcgacgacctgaagggagagctggacgaatatgttcaaaaatatctgcccggcaagatcaaagttatcaggaacacaaagcgggagggcctgatcagaggccgaatgataggtgctgcccacgctaccggcgaggtgctcgtgttcttggactctcactgtgaggttaacgttatgtggttgcaacccctgctggctgcaatccgagaggacagacacacagtggtgtgccccgttatcgatatcattagcgccgacactcttgcttattcttcctcccctgtagttcgcggaggcttcaactggggattgcactttaagtgggatctggtgccccttagtgaattggggcgagcggaaggggcaaccgcaccaataaagtctcctactatggccggaggattgtttgcaatgaacaggcagtattttcacgaactgggccagtacgacagtgggatggacatttggggcggggaaaatctggagatcagtttccgcatttggatgtgcggcggcaaattattcatcattccctgctccagggttgggcacatatttcgcaaaagacggccctacggcagtcccgagggccaggacactatgacacataactcactgcgacttgctcatgtgtggctggacgagtataaggaacaatacttttctctcaggccagacctcaaaacaaaatcttatggcaacatcagtgagagggtggaactgcgaaagaagttgggatgcaaatcttttaagtggtacctggacaacgtctatcccgaaatgcagatcagcgggtcgcacgctaagcctcaacagcccatctttgtgaaccgaggcccaaaacgccctaaggttctccagcgaggtagactctaccaccttcagaccaataagtgccttgtcgcacagggccgcccgagccagaagggcggcctagtggttctcaaagcgtgtgactactcagatccaaatcaaatctggatttataatgaggagcacgagctggttctgaacagtctgttgtgccttgatatgtccgagacacgctcatccgacccaccaagattaatgaagtgtcacggctccgggggcagtcagcagtggacattcggaaaaaataataggctctatcaggtatccgttggacagtgtctgcgagctgtggaccccctcggccagaagggatccgtcgctatggctatttgcgacgggtcctcttcccagcagtggcatctggaggggtag

SEQ ID NO: 47792 - DNA, 483 bp, Artificial Sequence
  Description of Artificial Sequence: Synthetic coding sequence
atgggcagcgtgaccgtgcggtacttctgctacggctgcctgttcacgtccgccacgtggaccgtactgttgtttgtctactttaacttttcagaagttacccagccattgaaaaatgtgcccgtcaaggggtcagggccccacggaccttcaccgaagaagttctatccgaggtttacccgaggcccttcacgcgtgcttgaaccacagttcaaggcaaacaaaattgacgacgtcattgatagcagggtggaggaccccgaggaagggcatctgaagttttcatccgagctcgggatgatcttcaacgaaagagaccaggagcttcgtgatctcgggtaccaaaaacacgcgttcaacatgctcatatccgatcgccttggttaccatagagacgtccccgatacgagaaatgcggcttgtaaggaaaaattctatcctcccgatctgccagctgcctcagtggtaatatgtttttattag

SEQ ID NO: 47793 - DNA, 1584 bp, Artificial Sequence
  Description of Artificial Sequence: Synthetic coding sequence
atgccccagcccgagagccagaaggccgccatcctgggctgcggccagggtggtatgattttcaatgagcgcgaccaagagctcagggatctgggatatcagaaacacgccttcaacatgctgatcagtgatagactgggctaccaccgggatgtgccagatacacggaacgccgcctgcaaagagaaattctacccaccagacttgcctgcggcatctgtggtgatctgcttctacaacgaagcgttttctgcccttctgcgtacagttcactctgtaatcgaccgaacccccgcccaccttttacacgagatcatcctagttgacgacgatagcgatttcgatgacctcaaaggcgagttagatgagtacgtgcaaaaatacctgcctgggaagatcaaagttataaggaacacgaaaagggagggactgataaggggacggatgattggtgcagcgcacgccaccggagaagtgctggtctttctggactcccattgcgaagtcaacgttatgtggttgcagcctctcttagccgcgatccgtgaagatagacacactgtcgtttgcccagtcattgatatcatcagcgctgatacactcgcctatagttcttcaccagtcgttagaggggggtttaattggggtctccacttcaagtgggacctggtgccgcttagcgagttaggtcgcgcagagggtgccactgcacccattaaatctcctacaatggccggaggtctgttcgcaatgaaccgtcaatacttccatgagctgggccagtacgactccggcatggatatatggggcggagaaaacctggaaataagttttcgaatctggatgtgcggtggtaagttgttcattatcccgtgtagtcgggttggccacatcttccgcaaaagacgcccgtatggctccccagagggacaggacaccatgacacacaacagtctacgtctggctcatgtctggttggacgagtacaaggaacagtacttcagtctccgccctgacctgaaaaccaagtcgtacggtaacatctctgaacgtgtagagttaagaaaaaagctgggttgtaagtcctttaaatggtacctggacaatgtttaccccgagatgcagatatccgggtcccacgccaagcctcagcaacctatcttcgtcaaccgcgggcctaaaaggcctaaggttctccagagaggacggctttaccatttgcaaaccaataagtgcctcgtggcccagggacggccctcccagaagggcggtctggtggtcttgaaggcctgcgactacagtgatccgaatcaaatatggatctacaatgaggagcacgaactagtgctcaattcactcctgtgtttggatatgtccgaaacccggtcttccgatcccccaagacttatgaaatgccatggctcaggcgggtcccagcagtggacatttgggaagaacaaccgcctgtatcaggtttccgtcggacagtgcctgcgagccgtggatccccttggacagaaagggagcgtagccatggcaatctgcgatgggagctcttctcagcagtggcatttggagggctag

SEQ ID NO: 47794 - DNA, 2823 bp, Artificial Sequence
  Description of Artificial Sequence: Synthetic coding sequence
atgaaccggatccggaagttcttccggggcagcggccgggtgctggcttttatattcgtggcctccgttatctggcttttatttgacatggcggcactacggctctcctttagcgagataaatacccgcgtgattaaggaagatattgtgaggcgagagagaatcggcttccgcgtacagccagaccagggcaagatattctatagctcaatcaaggagatgaagcctcctttaagaggccacggaaagggtgcatgggggaaggaaaacgtgagaaagactgaggagtctgttcttaaagtcgaagtggacctggatcaaacacagagggagcgcaaaatgcagaatgccttaggacgcggcaaagtggtgcccctgtggcatcctgcgcacctgcagactctacccgtcacgcccaacaagcagaagactgatgggagaggaactaaaccagaagcgagcagccatcagggaacccccaagcagacaacagcccagggggcaccaaagacgagcttcatcgctgcaaaaggcactcaagtggttaaaattagtgttcatatgggaagagttagcctgaagcaggagcccaggaagtcccattcgccttcttcagatacctctaagttagccgccgagcgggatctgaatgtgaccatttctctttcaacagatcggcccaaacagaggtcacaggctgtcgctaacgagagagcccatcccgcatccaccgccgtgcccaagtctggggaggctatggcccttaataaaacaaaaacccagtctaaggaggtgaatgcaaacaagcataaagcaaacaccagcctcccttttccgaaatttacagtcaactccaacaggttacgtaaacagtcaattaatgagaccccattaggatcattatccaaggatgatggggcaaggggggcgcatggtaagaaacttaacttctctgagagtcatctggtgattattacgaaggaagaagagcaaaaggcagatccaaaggaagttagcaactccaagacaaagacaatctttccgaaagtcctcggcaagtcccagtcaaagcacattagtagaaacagaagtgagatgtctagttctagccttgcccctcacagggtcccactctcgcagactaaccacgccctcaccggggggctggagccggcaaaaatcaatatcactgccaaagctcctagcaccgaatacaaccagtctcacattaaagctctactgccggaggacagtggcacacaccaggtcctacgaatcgacgtaaccctgagcccacgagatccaaaagctccgggtcagttcggccgcccagtggtggtgcctcacggaaaggaaaaagaagccgagagaaggtggaaagagggcaacttcaatgtctatctgtccgacctaattccagtggacagagccatcgaagacaccaggcccgcaggatgtgccgaacaacttgtgcacaacaatctaccgaccacctccgtgatcatgtgcttcgtagacgaggtgtggagtactctgctgcggagtgtgcacagcgtaatcaatcgtagtccacctcatcttattaaggagatcctccttgtggatgatttttccaccaaggattacttgaaagataatctggataagtacatgtcccagtttccgaaggttcgcatcctaaggctcaaagagcggcacgggctcatcagagctcgcctagccggagcacagaatgcaactggtgatgtcttgacttttctggattctcatgtcgagtgcaacgtgggatggctggaaccgttgctcgagcgggtttacctcagccggaagaaagtcgcttgccccgtgatcgaagtaatcaacgacaaggacatgtcatacatgaccgtcgacaatttccaacgtggaatatttgtgtggccgatgaacttcgggtggcgcacaattccccccgacgtgattgctaagaaccgcattaaagaaacggatactatccgctgcccggttatggccggagggctgttctctatagataaatcctacttttttgagttgggaacatacgatccaggcttggacgtgtggggcggtgagaatatggaattatcatttaaagtctggatgtgtggcggggagatcgagataataccatgctctagggttggccatattttcaggaatgacaacccctactccttccccaaagaccgaatgaagaccgttgaaaggaacctggtgagagtggcagaagtgtggctggatgagtacaaggagctgttctacggtcacggagaccatttgatcgaccaaggattggatgtgggcaatctaacccagcagcgcgagctccggaaaaaactgaagtgtaagagttttaaatggtatctagaaaatgtgttcccggacttgagggcgcccatcgtccgggcatcaggcgttttgataaacgtggctctgggcaagtgcatcagtatcgaaaatacgacagtgatcctggaggactgtgacgggagtaaagagctgcagcagttcaattatacttggctgagactcattaagtgtggcgagtggtgcattgcgccaatcccagacaaaggagcagtgcggcttcatccatgcgacaaccgcaacaagggcctgaagtggctccacaaaagtacttcagtgtttcacccagaactggtgaatcatatcgtcttcgagaataatcagcagctcctgtgcctcgagggcaatttcagtcagaagatactgaaggtagctgcctgcgaccccgtcaagccttatcagaagtggaagttcgaaaaatactatgaagcctag

SEQ ID NO: 47795 - DNA, 1677 bp, Artificial Sequence
  Description of Artificial Sequence: Synthetic coding sequence
atgcggaagatccgggccaacgccatcgccatcctgaccgtggcctggatcctcggtactttttactacctgtggcaggacaatagagctcacgcagcgagttctggcggaagaggcgcgcagagagccggcagacgaagcgaacagctgagggaagatagaactatccccctgatcgtgaccggaaccccgtcaaaaggcttcgacgagaaggcctatttatctgccaaacagttaaaggcgggtgaggacccatataggcagcatgcgtttaatcaattagagtccgacaaactctcaccagatagaccaatccgcgatacccgtcattattcctgcccttccgtctcatattcttctgatttgcctgccaccagcgttatcatcacattccataacgaggcgcgcagcacacttctgcgaaccgtcaagtccgtcctcaacagaacacctgcgaacttaatccaggagatcattctggtcgacgacttctcatcagatcctgaggactgcttactcctgacccgcatccccaaagtgaaatgcctgaggaatgaccgtcgcgagggtctcattagatctcgggtgcggggtgccgatgtggcagcagccaccgttttaacatttctagattctcattgtgaagtgaacaccgaatggctgcctccaatgctgcagcgggtcaaggaagatcatacccgtgtcgtgagccccatcattgatgtgatcagcctggataactttgcttacttagccgcctcagcggaccttcggggcggatttgattggtccttgcattttaaatgggagcagatcccgttagaacagaaaatgacacgcaccgatcctacccgcccaatccgcacccccgtgatcgcagggggaatttttgtcatcgataaatcatggttcaaccatctgggcaaatacgatgctcagatggatatctggggaggggaaaatttcgaactttcctttcgcgtctggatgtgcggaggttctttagaaatagtgccgtgctcaagagtcgggcatgttttccgtaaacgccatccttataatttccctgagggcaacgctctgacctacattaggaacacaaagaggactgcagaagtttggatggatgaatacaaacagtactactacgaagcccggccgtctgcgattggcaaagcctttggtagcgtggctaccaggatagaacagaggaagaagatgaactgtaagtcatttaggtggtaccttgaaaacgtctatcccgagttgacagtgcccgtgaaagaagctttacctggtatcatcaagcagggcgtgaattgcctcgagagtcaggggcagaacacagccggggattttctgctcggtatgggtatatgccgcggctcggccaagaacccccagcccgcccaggcatggttattttcagaccacctaattcagcagcagggcaagtgtttggccgctacaagcacattaatgtcctcccctgggagccccgtgatcctgcaaatgtgtaaccccagggagggtaagcagaaatggcgtaggaagggctccttcattcaacacagtgtctcaggactctgtctggagaccaaaccagctcagctcgtgacctcaaagtgtcaggctgatgctcaggcccagcagtggcagctgttgccacatacatag

SEQ ID NO: 47796 - DNA, 1677 bp, Artificial Sequence
  Description of Artificial Sequence: Synthetic coding sequence
atgcggaagatccgggccaacgccatcgccatcctgaccgtggcctggattctcggaaccttctattatctttggcaggacaaccgcgcccacgctgcatcttccgggggccggggagctcagcgagcgggcagaaggtctgaacagctacgggaggaccgcaccattccactgatcgtcaccggtactccgagcaaaggatttgatgagaaagcctacctttctgcaaagcagctgaaggcaggtgaggatccctatcggcaacacgccttcaaccagctagagagcgacaagctaagtcctgataggcctatcagggacaccaggcattacagttgcccgtctgtgtcttacagctctgatctgcctgctacatcagtgatcatcaccttccataatgaggcaaggagtacgctccttcgcacagtcaagtccgtgctgaataggacaccagctaacctcattcaagaaataatcttggtggacgacttttcttccgatcctgaggactgtcttctattaacgagaatccctaaggttaaatgcttgcgcaatgacaggcgagagggcctgattcgttccagggtcaggggcgctgatgttgccgcagcaactgtgctcacctttttggacagccattgcgaggtcaatacggagtggctcccgcccatgctacagcgagttaaagaagaccatactagagtggtctccccgattatcgacgtgatttcactggacaatttcgcgtacctagctgcgtcagcggatttaaggggcggctttgactggagcctgcacttcaaatgggagcagattcccctggaacagaagatgaccaggaccgacccaactagaccaattcgcacaccagtcatcgcgggtgggattttcgtgatcgacaaatcgtggtttaaccacctggggaagtacgatgcgcagatggacatctggggcggcgagaactttgagctgtccttcagagtgtggatgtgtggcggctctttagaaatcgtgccgtgttcccgtgtaggacatgtgtttaggaagcgtcacccctataattttcctgagggaaacgctctgacctacatccgaaacacaaaacggaccgccgaagtgtggatggatgagtataagcagtactactatgaagctcgcccaagtgcaataggtaaggcgttcgggtccgtggcgacgcgcattgaacaacggaaaaagatgaattgcaagagtttcaggtggtatctggaaaatgtctaccccgagctgaccgtgccagttaaggaagcattacccggcatcatcaaacagggcgtaaattgcctggagtcgcagggtcagaacactgccggagactttctcctgggcatgggtatttgtcgtggatccgctaagaatccacaaccagcacaggcgtggttgttcagcgaccacctgatccaacagcaggggaaatgtctcgcggcaacttccaccctaatgtcttctcccggtagccctgttatacttcagatgtgcaatcctcgggagggaaaacagaagtggcgccggaaggggtcttttattcagcactcagtttcaggtttgtgtttggagaccaagcccgcacaattggttacgtctaaatgtcaggccgatgcccaagcccagcagtggcaactcttgccacacacgtag

SEQ ID NO: 47797 - DNA, 555 bp, Artificial Sequence
  Description of Artificial Sequence: Synthetic coding sequence
atggacgagtacaagcagtactactacgaggcccggcccagcgccatcgggaaggcctttggcagcgttgccacaagaattgagcaacgaaagaaaatgaactgcaagtcattccggtggtacttggagaacgtctatcccgaactgaccgtccccgtgaaagaagccctgccaggcataattaaacaaggggtgaattgtttggagtcccagggacagaatacggcgggggattttttgctggggatgggaatttgtagagggagtgccaaaaatccacagccggcccaagcgtggttattttccgaccatctgatccagcagcagggcaaatgtttagccgccacaagcactctgatgtcatcgccaggctccccagtgatccttcagatgtgtaatccccgggaaggcaagcaaaagtggagacgaaaggggtcgtttatacagcactctgtgtctggattgtgcctcgagactaaaccagcacaactggtgactagcaaatgccaggccgatgcccaggcacaacagtggcaacttctgccccacacatag

SEQ ID NO: 47798 - DNA, 1629 bp, Artificial Sequence
  Description of Artificial Sequence: Synthetic coding sequence
atgcggaagatccgggccaacgccatcgccatcctgaccgtggcctggatcctaggcaccttctactatctgtggcaggacaatcgtgcacatgcagcttcttccgggggtagaggggcccagcgcgcggggcgaaggtcggaacaactgcgagaagaccgtaccataccacttatcgttaccggtacgccctcaaaaggattcgacgaaaaggcctatttaagcgcgaagcaactgaaagcgggcgaggatccctataggcagcacgccttcaaccagctggagtcggacaagctgtcacccgatcggcctattagggatacccgccactattcatgcccctccgtttcttacagctccgacctgccagcaacttcggtcatcattacatttcataatgaggcaaggtccactcttctgcgcaccgtgaagagcgtgttgaatcgcacacccgctaatctgattcaggaaataatattggtcgatgatttctcatccgaccccgaagactgcctcttgctgaccagaatccccaaggtgaaatgccttcggaacgaccgaagggagggcctgattaggtcaagagttaggggggcagatgtggcagctgccacagtgctcacttttctcgatagccattgtgaagtgaacactgaatggctgccaccaatgctccaacgcgtaaaagaggaccatacgcgcgtagtgtctccaatcatcgatgtgatcagcctggacaacttcgcctacctcgcagccagtgcagacctgcggggaggctttgattggagtcttcactttaaatgggagcagattccactggaacaaaaaatgacacggaccgatcctacacgccctatacgaacaccagtgattgctggcggcatttttgttattgataagtcttggtttaaccacctaggtaaatacgatgctcaaatggatatctgggggggggagaacttcgaactgagctttcgagtgtggatgtgtggcggctctttagagattgtgccctgctctcgggttggccatgtcttccggaaaaggcacccctataacttccccgaggggaatgcactgacttatattagaaataccaaacgcacagctgaagtctggatggatgagtataagcagtattattatgaagcacggccttccgctatcggcaaggcctttgggagtgttgctactcggatcgaacaaaggaaaaagatgaactgtaaatcattcagatggtatctcgagaatgtgtatccggaattgactgtccccgtgaaggaagctctcccaggcataattaaacagggagtgaactgcttggagtcccaagggcagaacaccgccggggatttccttctgggtatgggaatttgtaggggctctgctaagaacccacagccagctcaggcatggctcttctctgaccacttgatccagcaacaggggaaatgtctggcagctacatcaactctcatgtctagccccggctcccccgttatcctgcaaatgtgtaatcctcgtgagggtaaacaggtgtccttgctcgcctccgggcccgaggcccagcagcccgaaggaccttgtctgagagtggcagacctgggacggcgagcacctgattag

SEQ ID NO: 47799 - DNA, 1920 bp, Artificial Sequence
  Description of Artificial Sequence: Synthetic coding sequence
atgctgctgcggaagcggtaccggcaccggccctgccggctgcagttcttgctgctgctgttgatgttgggctgcgtgctgatgatggtggcgatgctccacccccctcatcacaccctgcaccagaccgtgaccgcgcaggcatccaagcatagccccgaagccagataccgacttgatttcggcgagagtcaggactgggtcctggaagccgaagatgagggtgaagagtattctccattggaagggcttccacccttcatctcactacgagaagaccaactgcttgtggcggtcgcccttcctcaagcccgcaggaaccagtctcagggtcgaaggggcggctcataccgcctcatcaagcagccacgtagacaggacaaagaagccccaaaaagggattggggggctgatgaggacggcgaagtgagcgaagaggaggaacttacacccttctccctcgaccctagaggactccaagaagctctatcagcccgaatacccctgcagcgcgctctcccagaggttaggcaccctttgtgtctccaacagcacccacaggattcgttgccgaccgccagcgtgattctatgtttccacgatgaggcttggtctacacttctgcgtacagtgcactccatcctagacactgtgccaagggcctttctgaaagaaatcatccttgtggacgacctatcccagcaggggcagctgaagtcagctttgtctgagtacgtggcaagactggagggagtgaagcttctccgaagcaacaaacgcctcggcgccatcagagccaggatgctgggtgctactcgcgcaactggcgatgtactggtgttcatggacgcacattgcgagtgccaccccggctggctggagccactgctgtcaaggatagcaggtgataggtcacgggtggtgtcaccagtcatcgacgtgatcgactggaagaccttccaatactatcctagtaaggacctccaacgcggcgtcctggattggaagctcgactttcattgggagcccctgcccgagcatgtgaggaaggcactgcaatcccctatatcacccattcgctcacctgttgtcccaggggaggtggtcgcaatggacaggcattacttccagaacaccggcgcgtatgatagtctgatgtcccttcgcggcggcgaaaacctggagctgagttttaaagcttggctttgcggcggatcagtggagatcctgccctgctctcgtgtaggccatatttaccaaaatcaggattcacatagccccctggatcaggaagcaactcttcgaaacagggtcagaattgctgaaacttggctgggcagctttaaagagaccttctataagcacagtccagaggcattctcattgagcaaagccgaaaaacccgactgtatggagagacttcagctccagcgccggttaggctgcaggacctttcattggtttttggccaatgtgtacccagaactgtacccttctgaacctcgcccttccttctccggcaaactgcataataccggactcggactgtgcgcagattgccaggccgaaggcgatatcctcgggtgtccaatggtgttagcaccctgttcagatagccggcaacagcagtatctccagcacacatccaggaaggaaatccacttcggctcgccccagcatctctgctttgccgtcaggcaggagcaggtgatactccagaattgcactgaggaaggacttgcgatccatcagcaacactgggatttccaggagaacggtatgatcgtgcatattctcagcgggaaatgcatggaggcagtcgtccaggaaaacaataaggacctgtatcttagaccttgcgatgggaaggctaggcaacagtggcggtttgatcagataaatgctgtggacgagcgctag

SEQ ID NO: 47800 - DNA, 591 bp, Artificial Sequence
  Description of Artificial Sequence: Synthetic coding sequence
atggagcggctgcagctgcagcggcggctgggctgccggaccttccattggttcctggctaacgtctatccagagctctatcccagcgaaccacggcctagcttttctgggaaactccacaacactggccttggtctctgtgcggattgccaggccgaaggggatatcctgggctgtccgatggtccttgcaccatgcagcgatagcagacagcagcaatatctgcagcatacttcccggaaggaaatacatttcgggtccccccagcatctatgtttcgcggttagacaggagcaggtcatactgcagaattgtaccgaagaaggcttagcaatccaccaacaacactgggatttccaggaaaatggtatgattgttcacatacttagcggcaaatgtatggaagcagtcgtgcaggaaaacaataaggacttatatctgcgaccctgcgatgaaaaacccgcatcatccggtgtattgacccgctccatgctttggatgaacgacgagtgccagtgccagaaagagaaaaggatactcgcgatcaaaatccagctgcaagtgaatttaaagtcactgtatattagctag

SEQ ID NO: 47801 - DNA, 1737 bp, Artificial Sequence
  Description of Artificial Sequence: Synthetic coding sequence
atgctgccctgcctggtggtgctgctggccgccctgctgagcctgaggttgggaagcgatgcacatggcactgagcttccgagcccgcctagcgtttggtttgaagctgagttcttccaccacatcttgcattggacacccatccccaatcagtctgaatcaacatgttacgaagttgcactgctgcgctatggaattgagagttggaattccatctccaactgttcccaaacactatcctacgacctgacagctgtcaccctcgatctttatcactccaacggatatcgcgcccgcgtgcgggccgtcgacgggagtcggcatagtaactggacagtgacaaatacccgattttcagtggatgaggtgacactgaccgttgggtctgtgaacctcgagatacataacggcttcatcttgggcaaaatacaattacccagacctaaaatggcccctgctaacgacacatacgaaagtatattttcccacttcagggagtatgaaattgctatccggaaggttcctggcaattttacgtttacacacaagaaggtgaaacatgagaacttcagcctgctgacctctggtgaggtaggggagttttgcgtccaggtcaaaccgtcagtagcttcgaggagtaacaaaggcatgtggagcaaggaagaatgtatttcgcttaccagacagtactttactgtaacaaacgtgattattttctttgcatttgttttgctattaagcggggctttggcgtattgcctggctttgcaactgtacgtgagaagaagaaaaaagcttccatctgtgctgctgttcaaaaagcccagtccatttattttcatatcccaacgacctagtcctgagactcaggatactattcatcccctcgacgaagaggcgtttcttaaggtctccccggagctcaagaacctggatctccatggatctaccgattcgggctttgggtccacgaagccctcactccagacagaagagccccagttcctgcttccggaccctcaccctcaggccgatcgcaccctggggaaccgggagcctccagttttgggggattcttgctctagcgggagtagcaacagcactgactcggggatttgccttcaggagccatccctcagtccttctacaggcccaacctgggaacagcaagtcggctctaatagtcgtgggcaggacgattccgggatcgacctggttcagaattctgagggtagagccggcgatacccagggcggaagtgccctgggtcaccatagcccacctgagcccgaggtccccggggaggaagatccagctgctgttgcatttcaggggtacctgcggcaaactagatgcgcagaggagaaggctacaaagactggctgcctggaggaggagagtccactgaccgatggacttgggcccaagttcgggaggtgcctggtagatgaagccggcttgcacccacccgctcttgccaagggatacctgaaacaggatcccctggagatgaccctcgcgagttccggcgcacccactgggcagtggaaccaacctactgaggagtggtcattacttgcactgtcatcctgcagcgacctgggaatttcggactggtcctttgcccacgacctggcacccctgggctgtgtcgccgcgccagggggcttgctcgggagtttcaattctgatctagttacattaccactgattagctccttacagtctagtgaatag

SEQ ID NO: 47802 - DNA, 1332 bp, Artificial Sequence
  Description of Artificial Sequence: Synthetic coding sequence
atgcggaacgccatcatccagggcctgttctacggcagcctgaccttcgggatatggactgccctattattcatatacttgcaccacaatcacgtgtctagctggcagaagaaatcacaagaacctttgagcgcctggagtccgggtaagaaagtccatcagcagattatctacggctctgagcagattcccaaacctcacgtcatcgtcaaacgaacagacgaagataaggccaagagcatgcttggcacggattttaatcacaccaaccccgagcttcacaaagaattgttaaaatatggattcaatgtcattatcagtaggtctctgggaatagagagggaggtcccagacactcgaagcaaaatgtgcttacaaaaacactatcccgcccgcctcccgacagccagcatcgtgatttgcttctacaacgaggagtgcaacgccctttttcagaccatgtcctccgttaccaatctgacgccgcattactttttggaggaaatcattttggtggacgacatgtctaaggtggatgatctgaaggagaaactggactatcatctggagactttcaggggtaaggtcaagattattaggaacaaaaagagggaagggctgatcagggcacgacttatcggggcctcacacgcttcaggagatgtcctggtgtttttggatagccactgtgaggttaacagagtttggctcgagccattgctccatgccatcgcaaaggaccccaaaatggtggtgtgccccctgattgatgtgatcgacgatcgcactctagaatataaaccatcccccctagtgagaggcactttcgactggaatctgcagtttaagtgggacaacgtttttagttacgagatggacgggcccgagggctcgactaagcccatcagatcccctgctatgtcgggtggcatctttgccataaggcggcattatttcaacgagattggtcagtatgataaggacatggacttttggggcagggagaatctggagctttcactaaggatttggatgtgtggtgggcaactattcattatcccttgcagccgcgttggtcacatttccaaaaaacagaccggcaagccatctacaattatctccgctatgacacataactatctccgactggtccatgtgtggctggatgagtacaaggaacagttttttctaaggaagccaggactcaagtacgtcacatacgggaacattcgggaacgggttgagctgcggaaacggctgggctgtaaatcattccagtggtacttagataatgtgtttcctgaactggaggccagtgtgaacagtttgtag

SEQ ID NO: 47803 - DNA, 1332 bp, Artificial Sequence
  Description of Artificial Sequence: Synthetic coding sequence
atgcggaacgccatcatccagggcctgttctacggcagcctgaccttcggcatctggacggccttactgttcatttacttgcaccacaaccacgtgtcttcctggcagaagaaaagccaggaacccctgtctgcctggtctcccgggaagaaggtgcaccagcagataatttacggatcagagcaaatccctaagccacacgttatagtcaagcgaaccgatgaggacaaggccaagagtatgctgggcacagatttcaaccacactaaccctgagcttcataaggagctgttaaagtacggtttcaatgtgatcatttcgaggtcactaggtatcgagagagaggtacctgacacccgttctaaaatgtgccttcaaaaacactaccctgcacgtttgccgacagcgtcaatcgtcatctgcttctacaacgaggagtgcaatgctctctttcaaacgatgagctcggtcactaacctcaccccacactacttcctcgaggagattatcttagtagatgacatgtcaaaggtagacgatctcaaggaaaaactcgattatcacctggaaacatttcggggcaaagtgaagatcatccggaacaagaaacgggagggcctgattagggcccggctgatcggcgcgagtcatgccagcggcgatgtcctcgtgtttctggactctcactgcgaggtcaatcgcgtgtggctggagccattgctgcatgctatagccaaagacccaaagatggttgtgtgccctcttattgatgtgatcgatgatcgcacactggaatacaagccaagtcctcttgtccgcggcacgtttgattggaatctccagtttaagtgggataacgtgttctcttacgagatggatggacctgagggctctaccaaaccaattaggtcccccgcaatgtccggaggtatcttcgcaatcagacgccactacttcaacgagatcggccagtacgataaggatatggacttttgggggagggagaacctggaattgtccctgcgaatttggatgtgcggaggacaactgtttattatcccttgttccagggtgggacatatctctaaaaagcagacaggaaaaccatccaccatcatctccgccatgacccataactaccttaggctggtacatgtctggctggatgaatacaaggagcagttctttcttagaaaaccgggactcaaatatgtgacatacggcaatatccgggaaagggtggagttgaggaagagactaggctgcaagtccttccagtggtacctcgacaatgtgttcccggaactggaggcgagtgttaactctctctag

SEQ ID NO: 47804 - DNA, 681 bp, Artificial Sequence
  Description of Artificial Sequence: Synthetic coding sequence
atgaagcggaagcagaagcggttcctgcagatgaccctgctgttcaccgtggccctgatctttctgcccaacgttgggttgtggtctctctacaaggacaagcacctcgtaaagtccgccgaaccgggagagcagcagactttcccgctgggcttgggagatggacagttctactcatggacggatggactgcggcggaaagactggcacgattatgagtcaatccagaaagaggcaatgcgatccgggaaaggggagcacggaaagccttacccacttacagaggaggatcacgatgactcagcctatcgagaaaacggcttcaatatcttcgtttctaataacatagcactggaaagaagcctgcccgacatcagacacgcaaactgtaaacacaagatgtacctcgaaaggctacccaacactagcattatcatcccctttcataatgagggttggacttccctgctcagaacaatccattcaataataaaccgcacaccaggatctttgatcgctgagattatactggtcgacgattttagtgaacgggagcatttgaaggacaagttggaggaatacatggctaggttctcaaaggttaggattgtccgcaccaaaaagcgagagggttcagggccagtgagctggggccacctttggccagaggaaaaatcatag

SEQ ID NO: 47805 - DNA, 1806 bp, Artificial Sequence
  Description of Artificial Sequence: Synthetic coding sequence
atgaagcggaagcagaagcggttcctgcagatgaccctgctgttcactgtagctttgatctttctgccaaatgtgggcctgtggtccttgtacaaggacaagcatctggttaaaagcgctgagcctggcgaacagcagacttttcccctggggctgggcgatggccagttttacagctggaccgacggactccggcggaaagactggcacgattacgagtccatccagaaagaggccatgcggtctggcaagggcgagcacggcaagccctaccctctcactgaagaggatcatgatgatagcgcttatagagagaacgggttcaacattttcgtctcaaacaacatcgcactggaacggtcactcccagatataaggcacgcaaattgcaaacacaagatgtatctcgagcggctcccgaatactagcatcatcatcccctttcacaacgagggatggactagccttctgcggacaattcactcaatcattaacagaacgcctgggtcgctaatcgccgaaatcattctagtggatgatttcagcgaaagggaacacctcaaagataagctggaggaatatatggcccgattttccaaagtgagaatcgtgcgcacaaagaaacgtgagggcctcatcagaacgagactgctcggagcctccatggcgcgcggtgaggttctgacattcctggacagccactgcgaagtgaacgtgaattggctcccccctctccttaaccagatcgccctcaaccacaagactattgtctgtcctatgatcgacgtgattgaccacaatcactttgggtatgaggcacaggctggggatgccatgcggggggccttcgactgggaaatgtactataagaggatcccgatcccccccgagttacagagggccgacccttcagacccctttgaaagccccgtgatggccggcggcctgttcgctgtcgataggaaatggttctgggaactgggagggtacgacccagggctggaaatttggggaggggaacagtacgagatcagcttcaaggtgtggatgtgcggaggtgagatgtttgatgtcccatgttcacgggtggggcatatctatagaaagtatgtgccgtataaggtaccgtctggcacatcactggctagaaacctcaaacgcgtagccgaaacttggatggatgagtttgctgaatacatataccagcgaagacctgaatatcgacacctgtctaccggagacatctcagcccagaaggagctccgcaagcagcttaagtgcaaagactttaagtggttcatggccgctgttgcatgggatgtccccaagtactatccacccgtcgaacccccgcctgccgcttggggtgaaatccgcaacgtggcagctaatctgtgcgttgacagtaaacatggcgcaaccggcaccgaattgcggttggacatctgcgttaaggatgggtctgaacgcacatggtctcatgagcaacttttcacattcggatggagggaggacattcgccctggcgagccattgcacaccaggaaattctgtttcgatgccatttctcacaactcccccgtcactctgtacgattgtcatggaatgaaaggaaatcaactatggggctacaggaaggataggactcttttccatcccgtctcaaacagctgtatggattgtaatcccgcagaaaagaagatcttcatggcacggtgtgacccactgagtgaaacacaacaatggatcttcgagcacatcaacatgaccgtgttggaaaagtttaaccatcacgctaattcttag

SEQ ID NO: 47806 - DNA, 1569 bp, Artificial Sequence
  Description of Artificial Sequence: Synthetic coding sequence
atgaacatcaacgacctgaagctgaccctgagcaaggccggccaggagcacttgctcagattctggaacgagcttgaagaagctcagcaggtagaactctacgcagaactccaagccatgaattttgaggaactgaatttcttttttcagaaggcgattgaagggtttaaccagtcaagccaccaaaagaatgtcgacgccaggatggagcccgtgcctagagaggtattgggatcagctacacgcgatcaggaccagctgcaggcctgggagtccgaaggactgtttcaaattagccagaacaaggttgcggttcttcttctagccgggggccagggcacacgcctgggagtggcttatccgaaaggaatgtatgatgtcggacttccctcccggaaaaccctgttccagatccaggcggagcgaatcctgaagttacagcaggtcgctgagaagtattatggtaataagtgcatcatcccctggtatattatgaccagcggacgaaccatggagagtactaaggagtttttcacaaagcataagtactttggtctgaaaaaagagaatgtcatcttctttcagcaggggatgctccccgctatgtcttttgacggaaaaataatccttgaagaaaaaaacaaggttagtatggctcccgatggcaatggcggcctatatagagcccttgcagcccagaacatcgtagaggacatggaacagagagggatctggagcatccacgtgtattgcgtggacaacatactggtgaaagttgcagacccccgctttattggtttctgtatccagaagggtgctgactgcggagccaaagtggtcgagaagacaaatcctaccgagccagttggtgtggtgtgtcgagtagatggcgtatatcaagtggtggagtatagcgagatctctctcgccactgcccagaaacgatcatccgatgggcggctcctctttaatgccgggaatatcgccaaccattttttcactgtgccctttttacgcgatgttgtaaacgtgtatgagccacagttacaacatcacgtcgcccagaagaagatcccctatgtggatactcagggacagctgattaaacccgacaagccaaatggcatcaaaatggagaagttcgtttttgatatcttccagtttgcgaagaagttcgtcgtctacgaggtcctgcgggaggacgagttcagccctttaaagaacgctgactctcagaatggtaaggacaatccaaccaccgcacgtcatgcccttatgtctttgcatcactgctgggtcttaaacgcaggtggccactttatcgatgaaaatgggtctagactccccgccatacctcggtctgctactaacggcaagtctgaaaccataacggcagacgtgaaccataatctgaaggacgctaatgacgtgcccatccagtgcgagatctcaccccttatctcttacgctggcgaaggactggagtcttatgtggccgacaaggagttccatgccccccttattatcgacgaaaatggggtacatgaactggtaaaaaacggaatatag

SEQ ID NO: 47807 - DNA, 1566 bp, Artificial Sequence
  Description of Artificial Sequence: Synthetic coding sequence
atgaacatcaacgacctgaagctgaccctgagcaaggccggccaggaacacctgctccgcttttggaacgagttggaagaggcccagcaagttgaattgtatgcggaactgcaggcgatgaatttcgaagagctgaacttctttttccagaaggcgattgagggcttcaatcagagctctcaccaaaagaatgttgatgcgaggatggagccagtccccagagaagtgctaggctctgctactagagatcaggaccagttgcaggcgtgggagtctgaggggctgttccagatctcccaaaacaaggtggcagtccttctcctggcaggaggacagggcacccggttgggagtcgcgtatcctaaggggatgtacgatgtaggattaccctctaggaagactctgttccagatccaagcagagaggatcctgaaactgcagcaagtggcggaaaagtattatggaaataagtgtattatcccttggtacatcatgacatcaggcagaacgatggaatccacgaaagaattctttaccaagcataaatactttggacttaaaaaggagaatgtgattttcttccagcagggaatgctgcccgccatgtcttttgacggcaaaattattcttgaggagaagaataaggtgagcatggcccccgatggaaacggagggttataccgggccctggccgcccagaatattgtagaggacatggagcaacgcggcatctggagcattcacgtatattgcgtagataatattctggtgaaagtggccgaccctaggttcatcggattctgtattcagaaaggcgcggattgcggcgcaaaggtagttgagaaaaccaacccaactgaaccagttggagtggtctgccgggtagacggggtctaccaggtggtcgaatactccgagatctctcttgctacagcacagaaaagatcctctgacgggaggctgctctttaatgcaggcaatattgccaaccactttttcactgttcccttcctccgcgacgtggtgaatgtctacgaaccacaacttcagcatcatgtcgctcagaaaaagattccatacgtagatacccaggggcaactgattaaacctgataagcccaacggcataaagatggaaaaatttgtgtttgatatcttccagtttgctaagaagttcgtggtgtacgaggtcctcagggaggacgagttcagtccactgaagaatgccgacagccagaacggcaaagacaaccctactacagcccgccacgcgctcatgagtctgcatcattgttgggtcttgaatgctggcgggcacttcatcgacgaaaatggaagtcggctgcctgccatcccacgcgccaccaacggaaagagcgagacgatcaccgctgatgttaatcacaaccttaaagatgcaaacgacgtccccattcagtgtgagatttccccgcttatttcatatgctggcgaggggctcgaatcatatgtggccgacaaggaattccacgcacccctgatcatcgacgaaaatggagtgcacgagctcgtgaaaaacgggatatag

SEQ ID NO: 47808 - DNA, 1569 bp, Artificial Sequence
  Description of Artificial Sequence: Synthetic coding sequence
atgaacatcaacgacctgaagctgaccctgagcaaggccggccaggaacatctactgcgcttctggaacgaactggaagaggcacagcaggtggaactctacgcagagctgcaggcgatgaacttcgaagagctgaatttctttttccagaaggccatagaaggctttaaccagagttcacaccagaagaatgtcgacgcccgaatggagccggtgcctcgagaggtgctgggctcggccactagggatcaggatcaacttcaggcctgggagagcgaagggctgttccagatcagccagaataaggtggctgtactgttattggcaggcggacagggaactcgtctgggagttgcctaccccaaaggaatgtacgatgtcggactgcctagccgaaaaaccttgtttcagatccaggcagagcggatcctgaagctgcagcaagtggccgagaagtattacggcaacaaatgtatcatcccatggtacataatgaccagcgggcgcactatggaatccaccaaagagtttttcactaagcacaagtatttcgggctaaaaaaggagaacgtgatcttcttccagcagggcatgctccctgccatgtcctttgatgggaaaatcatcttggaagagaaaaataaggtatctatggccccagacgggaatggcggactttatcgtgcacttgccgcacagaatatagtcgaagacatggagcagcgcgggatctggagcatccatgtgtactgtgtcgataacattctggtgaaggtggctgatcctagatttattgggttctgcattcagaagggcgccgactgtggagcaaaggtagtcgagaaaaccaacccgacagagccagtgggggtcgtgtgtagggtggatggggtctatcaagttgtggagtattctgagatctcactggcgacggcccaaaaacggtccagcgacggccgcttactgtttaacgcaggaaatattgcaaatcacttttttaccgtcccgtttctacgcgatgtagtgaacgtttacgaaccacagctgcaacaccacgtggcccagaagaagataccctacgtcgacacacaagggcagttaatcaagccagacaaacccaacggtataaaaatggaaaaattcgttttcgatatttttcaattcgctaagaagttcgtggtctatgaagtgttacgagaggatgagttctcacccctgaagaatgctgactcccagaatgggaaagacaaccccacaacagccagacacgcgctcatgtctctgcaccactgttgggttttgaatgcaggtgggcacttcattgatgaaaatggttcccgccttcccgctataccacggagcgcaacaaacggaaaatcagaaacgatcaccgccgacgtgaaccacaacttaaaagacgccaatgatgtgcccatccagtgcgaaatctctcctctgatttcgtacgctggggagggcttagaatcatacgtggctgacaaggagtttcatgctcccctcattatcgatgagaatggagttcacgaattggtcaagaacggcatttag

SEQ ID NO: 47809 - DNA, 1518 bp, Artificial Sequence
  Description of Artificial Sequence: Synthetic coding sequence
atgaacatcaacgacctgaagctgaccctgagcaaggccggccaggagcatttactaagattctggaatgagctcgaagaggctcagcaggtagagctctacgcagagctgcaggcaatgaatttcgaggagttgaatttctttttccagaaggccatagagggattcaaccagagcagccaccaaaagaatgtagacgcgaggatggagccagttccacgggaggttcttggctctgcgaccagagatcaggatcagttgcaagcctgggagagcgaaggcttgttccaaatttcgcagaacaaggttgctgttctcctgcttgccggcggacaggggacccgcctgggggtggcttatccgaaggggatgtatgatgttggcctgcctagtcgtaagaccctgtttcagatccaagcagaacgcattctgaaattgcagcaggttgccgagaagtattacgggaacaagtgcatcattccctggtacattatgacctcagggaggacaatggagtctactaaagaatttttcacaaagcataagtacttcggactgaagaaggaaaacgtcatttttttccaacaggggatgctgcctgcaatgagctttgacggcaagatcatccttgaagagaagaataaggtgagcatggctcccgacggtaacggagggttatatagggcccttgccgcacagaacattgtcgaggatatggagcagcggggaatctggtctatccacgtgtactgcgttgacaacatcctggtcaaagtcgccgaccctaggttcatcgggttctgcattcagaagggcgccgactgcggcgctaaggtcgtggagaaaacaaatccgacagaaccagtcggcgttgtgtgtcgcgttgatggggtttaccaggttgtggaatactccgaaatctccctggctacagcccagaaacgatcctccgacggtcgtttactgtttaatgctgggaatatcgctaaccacttctttacagtacccttcctacgggatgtagtcaacgtttacgagccccagctgcaacaccacgtggcccagaaaaagataccttatgttgatacccaggggcagctgattaagcccgataagcccaatggtattaagatggaaaagtttgtgttcgacatatttcaatttgccaagaagttcgtggtctatgaggtattgagggaggatgagttttcacccctcaaaaacgctgacagccagaatgggaaggataatcctaccacggcacgacatgcacttatgtctcttcaccactgctgggtgttgaacgctggcggccatttcatagacgagaacggatcgcggctgccggctatcccaagactcaaggatgcaaacgatgtacccattcagtgtgaaatctctccactcatttcttatgctggagaagggctcgagagttatgtcgcagataaagaatttcacgccccacttatcattgacgagaacggagtgcatgagctggtcaaaaatggaatctag

SEQ ID NO: 47810 - DNA, 663 bp, Artificial Sequence
  Description of Artificial Sequence: Synthetic coding sequence
atgaacatcaacgacctgaagctgaccctgagcaaggccggccaggaacacctactgcggttctggaatgaactagaagaggcgcagcaggtcgaactttacgccgagttgcaggcaatgaactttgaagaacttaacttcttttttcaaaaagccattgagggctttaaccagtctagtcaccaaaagaatgtagatgcccgaatggagcctgttcccagagaagtcctgggctccgccacccgggaccaggaccaactccaggcgtgggagtccgaggggcttttccagatctcccagaataaagtggcagtgctgttactggcgggcggccaggggacgagactcggcgtagcctatcccaaaggcatgtatgacgtcggtctcccctcccgcaagactttgttccagatccaggcggagaggattttgaagctccaacaggtagccgaaaagtactacgggaataagtgcataattccatggtatatcatgacctccggaagaacgatggagtctaccaaggagttttttaccaaacacaaatactttggcctcaagaaggagaatgttattttttttcagcagggcatgcttccagcaatgtcattcgacggcaaaatcatcttggaagaaaagaacaaggtgtccatggcgccttag

SEQ ID NO: 47811 - DNA, 4776 bp, Artificial Sequence
  Description of Artificial Sequence: Synthetic coding sequence
atgagcctgctgtgcgtgcgggtgaagcgggccaagttccagggctcgccagacaagttcaatacctatgtgaccctgaaggtacagaatgtgaagtctaccacagtggccgtgaggggagatcagccttcctgggagcaggattttatgttcgaaatctcacggctcgacctcggattgagtgtggaggtgtggaataagggtttgatttgggacactatggtagggacggtatggattgcacttaaaactattagacaaagtgatgaggaggggcccggcgagtggtctactctggaggccgaaacactaatgaaagatgatgaaatctgcggaactaggaatcccacccctcacaaaatcctccttgacacacggtttgagctgcctttcgacatcccagaggaggaagccagatattggacctataaatgggagcaaattaacgccctcggtgcggacaacgaatactcatcgcaggaagaatcccagaggaaacccctacccaccgctgcagcgcaatgttccttcgaggaccctgacagcgcagtggacgatagagactccgactatagaagtgagacttcaaactctttccctcctccctaccacactgcaagccaacccaacgcatcagtacatcagtttcccgtgccagtcaggtcaccccaacagctgttgctgcagggctcttccagggactcatgcaatgactctatgcagagctatgacctcgactacccggagcgccgcgcaatcagccctacaagtagttcgagatatgggagttcctgcaatgtttctcagggctcgtctcaacttagcgagctcgatcagtatcacgagcaggacgatgatcaccgagaaaccgattccattcacagttgtcattcttcccacagtctgtctagggacggccaggccggcttcggagaacaagaaaaaccactggaagtgaccggtcaggcagaaaaggaggcagcgtgtgagcctaaagaaatgaaagaggatgccactacacaccccccaccggacctagttctgcagaaagatcattttctggggcctcaggagagctttcccgaagaaaacgcctctagtcctttcacccaagccagggctcactggatccgagcagtgacaaaagttagactgcagctccaggagattccagacgatggagatccttccctcccacaatggctgcccgagggacctgcaggcggactttatggaatagattcaatgcccgatctgagaagaaagaagccactgcctttagtgagtgacctttccctcgtccagagccgaaaggcgggtatcacatctgcaatggctaccagaacttccctgaaggacgaagaactgaagtcccacgtttataagaagacgcttcaggctctcatctacccaatcagctgcactacaccccacaactttgaagtgtggactgctacaactcctacatactgttatgaatgcgaaggtctgttgtggggtattgcccggcagggcatgaggtgcagcgagtgcggtgttaagtgtcacgaaaagtgtcaggacctcctcaatgccgattgcctacaaagagccgctgaaaagtcttgtaagcatggcgctgaggatagaactcagaacatcatcatggccatgaaggatagaatgaagataagagagcgaaataaacccgagatctttgaagtgatccgtgatgtgtttacggtgaacaaagccgctcatgttcagcagatgaaaacagtaaaacaatctgtgctggacggtacgtctaagtggtcggcaaaaatcacaatcaccgtggtctgtgcccagggtcttcaggccaaagacaaaacagggtccagcgatccctacgtgaccgtacaggtttctaaaacaaagaagaggactaaaacaatctttggaaacctgaaccccgtatgggaagaaaaattccattttgaatgccacaattctagcgatcggataaaggtgcgcgtatgggacgaagatgacgacattaagtctcgggtcaagcagcgcctgaaaagagaaagcgacgactttctcggccagacaatcatcgaagtccgcacactcagcggagaaatggatgtgtggtataacttggaaaaaagaaccgacaaatcagctgtgagtggcgcaatccgccttcagatctcagtcgagattaagggagaggagaaggtagctccttaccatgtgcagtacacatgtctgcacgagaatttgttccactatctgaccgatattcagggtagcggtggagtccgcataccagaagcccgaggcgacgacgcctggaaggtgtatttcgacgagacagcacaggagatagtagacgagttcgccatgagatacgggatagaaagcatttatcaggcgatgacccacttcgcttgtctcagttcaaaatacatgtgtcctggagtgcccgctgtgatgtccaccttgctcgcaaatatcaacgcttactacgctcacacgacagccagcactaacgtgtcagccagcgatcggtttgctgctagcaatttcggaaaggaacgcttcgttaaattgctggaccagctccacaatagcctgcggatcgacctttcgacctaccgtaataatttcccagcaggcagtcctgagcgtctgcaggacttaaagtctaccgtagatttgctgacatccatcacatttttccgcatgaaggtacaggagctgcaaagcccacctagagcgtcccaagtcgtgaaggactgtgtcaaggcttgcctgaattcaacatatgagtacattttcaataattgtcatgacctatactctcgtcagtaccagctcaaacaggagctgcctcctgaagagcagggtccctcaatcaggaacctcgatttttggccaaagctgattacccttattgtgtcaataatcgaagaggacaagaatagttatacccccgtgttgaaccaatttcctcaggaattaaatgtcggaaaagtgtcagccgaggtgatgtggcacctcttcgcccaagacatgaagtacgcccttgaagagcacgagaaggatcacctgtgtaaaagcgcagactatatgaatctgcactttaaagtcaagtggctgcacaacgaatatgtgcgggatctgcctgtcctgcagggtcaggtgcccgaataccctgcctggtttgaacaatttgtgttgcagtggctcgatgaaaatgaagatgtgagcctggagttcctacggggggcgctggagcgggataaaaaagatgggttccagcaaacaagcgaacacgcactgttctcatgtagtgttgtggatgtcttcacccagcttaaccagtccttcgagattataaggaagctggagtgtcccgacccctcgatactagcccactacatgcgaaggttcgcaaagacaattggcaaagtcctgatgcaatatgccgatattctgtctaaggatttcccagcctattgtaccaaagaaaaactgccttgtatactcatgaataacgtgcaacaactgcgggtccaactcgagaaaatgttcgaggccatggggggtaaggaactggatctcgaagctgccgactctctgaaggaactccaggttaaacttaataccgtgttagacgagttatcgatggtgttcgggaactcctttcaggtgcggatcgatgagtgtgtccgccaaatggccgatattttgggccaggtaaggggcactggtaatgcgagcccggacgctagagcatcagctgcacaggacgctgattctgtactgcggccactgatggatttcctggacggcaacctcacgctgttcgccaccgtatgtgagaaaacggttttaaaacgggtactaaaagagctgtggcgagtggtgatgaacactatggagcgaatgatcgtgctgccaccgctaaccgatcagaccgggactcagctcatctttacagctgcaaaggagctctcacatctgagcaagctaaaggatcacatggtgagagaggagaccaggaatctgactcccaagcagtgcgctgtgctggatttagctttagacaccatcaagcaatattttcatgccggcgggaatggactgaagaagactttccttgagaagagcccagatctacagtccctgcgatacgccctatctctgtatacacagactactgatactctgataaagacgttcgtgcggtcccagaccacccagggctctggtgttgacgatcccgtcggcgaggtgtccattcaggtcgacctgttcacccatcctgggacaggtgagcacaaggtgacggtgaaagtggtggccgccaatgatctgaagtggcagacagccggcatgttcaggccttttgtcgaggtgaccatggtagggccccatcagtctgataagaaaaggaagttcacgactaaaagcaaatccaacaattgggcccccaagtacaatgagaccttccacttccttctcggcaacgaagagggcccagagtcttacgagcttcaaatttgcgtaaaggattactgttttgcccgtgaagatagagtgctcggtctggctgtaatgcctctgagagatgtcactgctaaggggagttgtgcctgctggtgccctctgggcagaaaaattcatatggacgaaaccggtctgactatcctgaggattctcagtcaacggtctaatgatgaggtggcccgggaatttgtcaagcttaagtccgagtctcggtccacagaggagggcagctag

SEQ ID NO: 47812 - DNA, 4833 bp, Artificial Sequence
  Description of Artificial Sequence: Synthetic coding sequence
atgagcctgctgtgcgtgcgggtgaagcgggccaagttccagggctctcccgacaagtttaatacttacgtgactcttaaggtccagaatgtgaaatccactactgtcgcagtgaggggagatcagccttcgtgggagcaggactttatgtttgagatatcaagactcgatcttgggctgagtgtggaagtgtggaataaggggctgatctgggacactatggttggaactgtttggatcgccctgaagaccatccggcaaagtgacgaagaagggccgggagagtggtccaccctggaggcggagactcttatgaaggatgatgagatttgcgggacgcgaaatccgacaccccacaagatcttgcttgacacacggttcgagctccccttcgacattccagaggaagaggcccgctactggacgtataaatgggaacagatcaatgctctaggagccgataacgagtactcttcacaggaggagtcacagcggaagccccttccaaccgccgctgctcagtgctctttcgaggacccggacagtgcagtcgatgacagagactctgattaccgaagcgagacaagcaattcatttccgcccccctaccatacagcgagccagccaaatgcaagtgtccatcaatttccagttccggtcagatccccacaacagctgcttctccagggctccagtagggacagctgtaatgactccatgcagagctacgatttggattaccccgaacgcagggccatctcccccacctcttcaagccgatatggatcgtcttgcaacgtgagccaggggtcaagccagttgagtgagctagaccagtatcacgaacaggacgacgaccatcgagaaaccgactcaatacacagttgtcacagctctcactcattgagcagggacggacaggccggattcggcgaacaggaaaagcctctcgaagtgaccggtcaggcagagaaggaagcagcctgcgagcctaaggagatgaaagaagatgccaccacacatcccccccccgatttagttttgcaaaaggaccattttcttggcccacaggaatccttccccgaggaaaacgccagttcaccttttacacaggccagagcccactggatcagagcggtcactaaagtccgcttgcagttacaagagatccctgacgatggcgacccttctcttcctcaatggctgcccgagggtcccgcaggcggattgtatgggatcgactccatgcccgacctgaggcgaaaaaaacccctgccgctcgtgtcagacttatcactggtccaatcaagaaaggcaggcattacatccgcgatggccacccgtacgagtctcaaggatgaagaattgaagtcccacgtctacaaaaaaacactccaggcccttatttaccccatatcctgcacgacgccccacaatttcgaagtgtggacagccactaccccgacatactgttatgagtgcgaaggtctcctctggggaatcgcccgacaaggtatgaggtgttccgagtgtggcgtgaagtgccatgagaaatgccaggacctcctcaatgctgattgtctccagagggccgccgaaaagtcctgtaagcatggcgcagaggacaggacgcagaacatcataatggcaatgaaggaccgtatgaagatccgagaaagaaacaagcccgaaatattcgaggtcattcgcgacgtgtttaccgtgaataaagccgcccacgtccagcagatgaaaacggttaaacagagtgtactggatggaacaagtaagtggagtgccaagattaccattacggtcgtctgtgcccagggacttcaagccaaggacaaaaccgggtcgtctgacccatacgtgacagtgcaggtttcgaagactaaaaaaaggaccaaaaccatcttcggcaaccttaaccccgtctgggaggaaaagtttcacttcgaatgtcacaactcaagtgatagaattaaggttcgggtgtgggacgaagatgacgacatcaagagcagggtaaaacagagactgaagcgggaatctgacgactttctcggacagaccatcatcgaagtgcgcaccttgtcgggtgagatggatgtgtggtataatttggaaaagagaaccgacaaaagtgcagtgtccggggctatccggctgcaaatcagcgtagagatcaaaggcgaggagaaggtggccccgtaccatgtacagtacacgtgcctgcacgaaaacctgtttcattacttaactgatatccagggcagtggaggggtgcggatccccgaagcccgtggagatgatgcttggaaggtttacttcgatgagacagcacaggaaatagtggacgagttcgcaatgcgttatggtatcgaaagcatatatcaggctatgacccactttgcttgtttgagcagcaagtatatgtgtccaggcgtcccagccgtgatgtctactttgctggctaacatcaacgcctactacgctcataccaccgcgtcaaccaacgtgagtgccagtgaccgatttgcagccagcaattttgggaaggaaagattcgtgaagctgttggaccaattacataattccctgcggatcgacctcagtacgtatagaaataattttcccgccggctcccctgaaagacttcaagacctgaagtccacggtagacctcttgacatctataacttttttcagaatgaaagtacaggagctgcaatctccacctcgcgctagccaggtggtaaaagactgtgttaaggcctgtttaaatagtacttacgagtacatcttcaacaattgccacgatttgtattctcgccagtatcaattgaagcaggagcttccgccagaggagcagggcccgagcatccggaacctggatttctggcccaagctgatcaccctaattgtatcaattatagaagaggataagaactcgtacacaccggttctgaatcagtttccccaagagctcaacgttgggaaggtttccgcagaggtgatgtggcatcttttcgcgcaagatatgaagtatgccttggaagagcatgagaaggaccacctgtgcaaatcagccgactatatgaacttacattttaaggtgaagtggctccacaacgagtatgtgagagacctgcctgttttacagggccaggttcctgagtacccggcttggttcgagcaattcgtgctgcagtggttggacgaaaacgaggatgtcagcctggaatttttgcgaggcgcccttgagcgagataagaaagatgggttccagcaaacaagtgagcatgctcttttcagttgctccgtggtagatgtgtttactcagttaaaccagtcctttgagatcataagaaagctggagtgccctgacccctcgatcctcgctcactacatgagacggttcgcaaagaccatcggcaaggtcctgatgcaatatgccgacattctcagtaaggatttccccgcttactgcaccaaagagaagctcccctgcatcctgatgaacaatgtccagcagcttcgagttcagttagagaagatgttcgaggcaatgggcgggaaggagcttgatcttgaggccgccgattccctgaaagagctgcaggtcaaactgaacacggtgctggacgaactctctatggtgttcgggaatagctttcaggtacgcatcgatgagtgcgtgcggcagatggcagacatcctggggcaggtcagaggcactgggaatgccagcccagacgctcgggcctctgccgcccaggacgcggactctgtgctccggcccctaatggattttctggacggaaatcttactctgtttgcaacagtgtgtgagaaaaccgtgctcaaaagagtgctgaaggaattgtggagggtggtgatgaacaccatggagaggatgattgtcctgccgccactcacagatcagaccggtacacagctcattttcactgcagctaaggaattatctcatctcagtaagcttaaagatcatatggtgcgggaagagacgcgaaacctgacacccaagcagtgcgccgtactagatctggctctagacaccatcaaacaatactttcacgctggtggcaatggactgaaaaaaacttttctagaaaagagcccggacttacagagtttgagatacgctttatccctttacacccagactaccgacaccctgatcaagacttttgtcaggagccagaccactcaggtccatgacggtaaggggatcaggttcaccgcaaatgaggacatcagacccgagaagggctcaggcgtcgatgatcccgtgggagaagtctctatacaggttgacctcttcacgcacccgggcaccggggagcataaggtaaccgtcaaggtcgttgccgctaacgacttaaagtggcaaacagccggtatgttcagaccattcgttgaggtaacaatggtcggaccccatcagtcagacaagaaacgcaaattcacaactaaaagcaagtccaataattgggcgcctaaatacaacgagacattccactttctacttggtaacgaagaagggcccgaatcctatgaactgcagatctgtgtgaaggactattgctttgctagagaggaccgagtgctgggtctggctgtgatgcccctgcgtgacgtgaccgcgaagggaagctgtgcctgttggtgtcctctcggcaggaagatccacatggatgaaaccggcctgaccatcctgaggatactgtctcagcgctccaacgatgaggttgcacgtgagtttgttaagttgaagagcgaatcgagaagcacggaggagggctcctag

SEQ ID NO: 47813 - DNA, 4869 bp, Artificial Sequence
  Description of Artificial Sequence: Synthetic coding sequence
atgagcctgctgtgcgtgcgggtgaagcgggccaagttccagggctcaccagataagttcaatacttacgtaacattaaaggttcagaatgtgaagtctaccaccgtggcggtcaggggtgatcaacctagctgggaacaggatttcatgttcgagatctcgcggctggacctgggcctttctgtagaggtgtggaacaagggcctcatctgggacaccatggtcggcacagtgtggattgccctcaagacaattaggcaatctgacgaggagggacctggggagtggagcaccttagaagcagaaacgctgatgaaagatgacgagatctgcgggaccaggaatcctaccccgcacaagatcctgctggacactcgcttcgaactgccgtttgatattccggaggaggaggccagatattggacgtacaaatgggagcaaattaatgctctgggagctgataacgagtattccagccaagaagagagtcaaaggaaacctctacccaccgccgctgcgcagtgttgccattggacttaccttggttggggcgaacaacagacttttgaggatcccgattccgccgtagacgacagggatagtgactacaggagtgaaactagtaatagttttccacccccatatcacaccgccagtcagccaaacgctagcgtccaccaattcccagtgccagtcaggtccccacagcagctgctgctgcaggggagctctagggattcgtgcaatgacagcatgcaaagttacgacctagattacccggagcgcagagccatatcccccaccagctcttcaagatatggcagcagttgtaacgtgtctcaaggcagctcacagttaagcgagctcgaccagtatcacgagcaggatgatgaccatcgcgagacagattctatccacagctgccattccagccacagcctctcccgcgacggtcaagcgggattcggcgagcaggagaaacctctggaagtgaccggccaggccgagaaggaggcagcctgcgagcccaaggagatgaaggaagacgcaacgacacatcccccccccgacctcgtattgcaaaaggatcacttcttgggaccgcaggaatccttcccagaagagaatgcatccagcccctttacccaggccagggcccattggatccgggctgtgactaaagttcggctgcagctacaagagattccagacgacggagatccctcactgccacagtggctgccagaggggcccgcggggggcctatacggtattgatagcatgccggacttgaggagaaagaaaccgctccctctagtcagcgacctgtccctggtgcagtcgaggaaggctggaatcacctccgccatggccacccggacttcactgaaagacgaggagctgaagtctcacgtgtataagaagactttgcaggcactgatttaccctatttcctgtaccactccacacaactttgaggtctggacagctactacacctacatattgttatgagtgtgaggggctcctgtgggggatcgcccggcaaggaatgcgatgtagcgagtgtggtgtgaagtgtcacgaaaagtgtcaggatttgctgaatgccgactgcctccaacgcgccgccgagaagagctgtaagcatggggccgaggacagaacccagaatatcatcatggccatgaaggatagaatgaagatcagagagagaaataagcccgagatttttgaggtaattagggacgttttcaccgtaaataaagccgcccatgtgcagcagatgaagacagtcaaacagagcgtgcttgatggaacttctaagtggagtgccaaaataacgattaccgtggtgtgtgcacagggccttcaagcaaaagacaaaactggaagctcagatccttatgtcaccgtgcaggtgtccaagaccaagaaacggactaaaacaatttttggaaatttaaaccctgtctgggaggagaagttccatttcgaatgtcacaatagttcagaccgcattaaggtccgcgtgtgggacgaagatgatgatataaagagcagagtcaagcagaggcttaagcgggaatccgacgattttctcgggcagacaattattgaggtgcgaactctaagtggggagatggacgtgtggtacaatctagagaagaggacggacaaatccgccgtctcgggcgcgatccgcttgcagatctctgtggagatcaagggggaggagaaagttgctccctaccatgtacagtacacttgcctccacgagaacctgtttcactacctcaccgacattcaagggagcgggggtgttaggatccccgaggccaggggtgatgacgcttggaaggtatacttcgacgagacggctcaggagatcgtggacgagtttgccatgcgctacggtatagaatccatctatcaggcaatgacccatttcgcctgccttagttccaagtatatgtgccccggtgtgcctgcagtcatgtcaactctgctcgctaatattaatgcgtattatgcccacactactgcttcaacgaacgtctccgcaagcgaccggttcgcagcgtccaactttggcaaagagcggtttgtgaagcttcttgatcagttgcacaattcgttgcgtatcgatctgtcaacgtatcgcaataatttccctgcagggtccccagagcgcctgcaggatcttaagagcactgtggaccttctaacatctatcaccttctttaggatgaaagtccaagagctgcaatcacccccacgggccagccaagtggtcaaggattgcgtgaaagcctgtctgaatagcacatacgagtacatcttcaacaactgccacgacttgtactcccgacagtaccaattaaaacaggagctccctcctgaggaacaggggccctccattagaaacctcgacttttggcccaaactgatcaccctgatcgtgtccataattgaggaggataagaatagttatacccccgtcttgaaccagtttcctcaggaactcaatgtaggcaaagtgagcgctgaggtaatgtggcatctgttcgcacaggacatgaagtatgccctcgaagaacatgaaaaagatcacctctgcaagtctgctgactacatgaaccttcactttaaggtcaaatggcttcataacgagtatgtaagagatctgcctgtgctgcagggtcaagttcctgagtaccctgcatggttcgaacaatttgtgctgcagtggctggacgagaacgaagacgtgagtctggagttccttcgtggggctcttgagagggacaagaaggacggattccagcagacctccgagcacgcactgttctcctgctcagtagtggacgtcttcacgcaattgaaccaaagctttgaaattattcggaagctggaatgcccagacccaagtattttggctcattatatgaggaggtttgccaagactataggcaaagtattgatgcagtacgccgacatcctgagcaaggactttcctgcctattgcaccaaggagaaacttccctgtatcctgatgaacaatgttcagcaactgcgagttcagttggagaagatgtttgaggcaatgggtggtaaggagcttgatttggaagccgctgacagcctgaaggagttacaggtcaaactcaacacggttctcgacgaactgtctatggtgttcgggaacagcttccaggtgcgcattgatgagtgcgtcaggcaaatggccgatattctaggccaggtacggggaactggtaatgcctcccctgatgctagagctagcgcggcccaagacgctgacagcgttctgcgacccctgatggatttcctcgacggcaatctaactctcttcgcaacagtttgtgagaagactgtgctcaagagggtcttaaaagaactatggcgagtggttatgaatacgatggagcgaatgatcgtcctgccgcctctcactgatcagactgggacccagcttatttttaccgctgctaaagagctcagtcatctatcgaagctcaaagaccacatggtacgggaggaaactcggaacttgacaccaaagcagtgtgcagttctcgatttagcgctcgacactatcaagcagtattttcacgctggaggcaacggactgaaaaaaactttcctggagaagtccccagatcttcagagcctgaggtacgctttgtctctgtacactcagaccactgatacgctgattaaaacctttgtacgctctcaaaccacccaagttcacgacggcaagggcattaggtttacagcaaacgaggacatccgaccggagaaggggtcaggcgtggacgacccagtcggtgaggtgtccatccaggttgatctcttcacacaccccgggacgggggagcacaaagtcaccgtaaaggtcgttgctgctaacgacctaaagtggcagaccgccggtatgtttagaccgttcgtagaggttacaatggtcggcccccaccagagtgataagaagcggaaattcactaccaagtcaaagtccaacaattgggcgcccaaatacaacgagacttttcactttctgctgggtaatgaagagggacccgagagttacgaactgcaaatctgcgtgaaagattattgcttcgcccgcgaggacagagtgctgggcctcgctgtgatgccccttcgggacgtcactgccaaggggtcctgcgcgtgctggtgccctcttggcagaaagattcatatggacgaaaccggcctaacgatactgagaatcctgtcacaacggtcaaacgacgaggtcgcacgagaattcgttaagctgaagtctgagagcagatcaactgaagagggctcttag

SEQ ID NO: 47814 - DNA, 3594 bp, Artificial Sequence
  Description of Artificial Sequence: Synthetic coding sequence
atgcccgacctgcggcggaagaagcccctgcccctggtgagcgacctagtcaagtcattagtgcagtctcggaaggccggcataacgagcgcaatggccactaggacttccttaaaggacgaggagctcaagagccacgtgtataagaaaaccctccaggcgttaatttatcctatctcctgcactacaccacataactttgaggtttggactgccacaacccccacttactgttacgaatgcgaaggtctgctctgggggattgcacgacaaggtatgcgctgctcagaatgtggggtcaaatgccacgagaagtgccaggatctgctaaacgctgactgcctgcagcgggccgctgagaaaagttgtaaacacggggctgaggatcggacccagaatattattatggcaatgaaggataggatgaagattagagaacggaataaacctgaaatcttcgaggtgatcagggatgtgttcaccgtaaataaagcagcccatgtccagcagatgaagaccgttaagcagagcgtcctggatggtacttccaagtggtccgctaagattactataacagtcgtgtgtgctcagggcctgcaggctaaggataaaaccggcagctcagacccatacgttacggtccaggttagtaagacaaagaagcggacaaaaactatttttggaaacctaaatcctgtttgggaggagaaattccatttcgagtgccataatagtagcgaccgaatcaaggttagggtgtgggatgaagacgatgacatcaaatccagagtgaaacagcgcctgaagagagagtcggatgatttcctggggcaaactataatcgaggtacgcaccctttctggtgagatggatgtgtggtacaacctggagaagcgtacagacaagtccgccgttagtggcgctatccgcctgcagatctcagtggaaattaagggagaggaaaaagtcgccccataccatgtgcagtacacttgcctgcacgaaaacctgtttcactatttaactgacatccaggggagtggaggggtacgcataccggaagcaagaggagatgatgcgtggaaagtctattttgatgaaacggcccaggaaattgtggatgaattcgctatgcgctacgggatcgagtctatttaccaagcaatgacacactttgcctgtttgagctccaaatacatgtgccccggagtgccagctgtaatgtcgacactgctggccaacattaatgcgtattacgcccataccaccgctagcaccaatgtctccgcttccgaccggtttgccgcctccaacttcggtaaggagagattcgtaaagctgctagatcaactccataacagtttgcggatcgacctgtctacatacagaaataatttccctgctggcagtcccgaaagattgcaggatctaaaatctacagtcgatctgttgaccagcatcactttctttcgaatgaaggtgcaagaactgcagtccccaccacgcgcgagtcaggtggtgaaagactgtgtgaaagcctgcctcaatagtacctatgagtatatcttcaataactgtcacgacctgtattctagacagtaccagctgaagcaagagctcccaccagaagagcagggtccttccataagaaatttggatttttggcccaaattgatcaccctgatcgtgtcgatcattgaggaagacaagaactcctacacacctgtgctaaatcagtttccacaggagctgaacgtggggaaagtgtccgcagaggtcatgtggcacctttttgcccaggacatgaaatatgctctggaggagcacgaaaaagatcatctgtgcaaaagtgccgattacatgaacttacacttcaaggtaaagtggctacacaacgagtatgtcagggatctgcctgttctgcaaggacaggtacctgaatacccagcttggtttgaacagtttgtactgcaatggctggacgagaatgaggatgtaagtctggagttcctaaggggggcattagaacgcgataaaaaagacggatttcagcaaacctccgagcacgctttgttctcttgctcggttgtagacgtgtttacccaactgaaccagtccttcgaaatcataaggaaacttgagtgccctgacccatctattctggcccactatatgaggcggttcgctaagacaattggcaaggtcctgatgcagtacgcagacatcctgtccaaggacttccctgcttactgtaccaaggaaaaacttccgtgtatactgatgaacaatgtgcagcagctgagggtgcaactggagaagatgttcgaggcaatgggcgggaaggagctggaccttgaagccgctgacagtctaaaggagctccaggtgaagctgaataccgtccttgatgagcttagcatggtctttggcaattctttccaggtgaggatcgatgagtgcgttaggcagatggcggatattttaggccaggttagaggtactgggaacgcctctcctgacgctcgtgcctcggctgctcaagatgccgatagtgtcctacgtccccttatggacttcctcgatggcaacctgacactttttgctacggtgtgcgaaaagaccgttctgaagagggtgctgaaggagctgtggagagtggttatgaatacaatggagcgtatgatcgtgttgccacctcttactgaccagactggcactcagctgatttttacagctgctaaggagctgtcacacctgtcaaagctgaaggatcacatggtccgcgaagaaacgagaaacctgacaccgaaacaatgtgctgtgctagatctcgcgctggataccatcaagcagtactttcacgctgggggcaacggtctgaaaaaaaccttcctggaaaaatccccagatctccagtccctccggtatgccctgtctctctacacccagacaacggatactctaatcaagaccttcgtccgctctcagactacacaagtccatgatggcaagggcattcgctttacggccaatgaagatattaggcctgagaagggttccggggtcgacgaccctgtgggtgaagtgtcaatccaggtcgatctgttcacccaccctggcaccggtgaacataaagtgaccgtcaaagtggtcgctgccaatgacttgaagtggcaaaccgcgggaatgtttcggcccttcgtggaggtgactatggtggggcctcaccagtctgacaaaaagcgaaaattcacaacaaagagcaaatccaataattgggctcccaagtacaacgagacctttcactttctcctcggcaacgaggagggcccagagtcttacgaactgcagatttgtgtcaaagactattgctttgcgcgtgaagacagagtcttgggcttggccgtcatgccgctgcgggatgtcacagccaagggatcctgcgcctgttggtgcccattaggcagaaagatccacatggatgagactggacttacaattctgaggatactaagtcagcgatctaacgatgaggttgcccgcgagttcgtgaaattgaaaagcgagtctaggtctaccgaggaggggtcatag

SEQ ID NO: 47815 - DNA, 6645 bp, Artificial Sequence
  Description of Artificial Sequence: Synthetic coding sequence
atggtggccaacttcttcaagagcctgatcctgccctacatccacaagctctgtaagggcatgttcaccaagaaactggggaacacaaataaaaacaaagagtatcgacaacagaagaaggaccaggattttccgaccgccggccagacaaagtccccaaagttcagttatactttcaagagtaccgtgaaaaaaattgcaaagtgtagcagcactcataatctcagtaccgaggaggacgaagcgagcaaggagttttccctgtcacctacattcagttaccgggtggctatcgctaatggcctgcaaaaaaacgccaaagtcacgaactccgataacgaagatttgcttcaggagttatctagtatcgaaagcagctactccgaaagcctgaacgagttgcgcagtagcacagagaaccaggctcagagcacccacaccatgccagtgcggaggaatcggaagtccagctcatccttggcaccttctgaggggtcctctgacggagaaagaacattacatggactgaagttgggggctctgaggaaactgcgtaagtggaaaaaatcacaagagtgtgtctcctccgactcggaattgtctacgatgaaaaaatcctggggcatccggagcaaaagcctggaccggacggttcgcaatccgaaaacaaatgccctcgagccaggattctcctcttctggatgtatcagccagactcacgatgttatggagatgatttttaaagagctccagggaatctcccaaatcgagaccgagctctcagagctccgaggacatgttaacgccttaaaacactccattgacgagattagcagctcagttgaggtcgtacagagtgagatcgagcaactgagaaccggcttcgttcagtccagaagagaaacccgcgacatacacgactacattaaacatctcggtcacatgggatcaaaagccagcctgaggtttctaaacgttactgaggaacgctttgaatacgtggaaagtgtcgtgtatcagattctgatagacaagatggggttctctgatgcccctaatgctattaagatcgagttcgcccagagaatcggccaccagagggactgccctaacgccaagcctaggcctatactcgtctactttgagacgccccagcagagagatagcgtgttaaagaagtcctacaaactgaaggggaccggtatcgggatcagtacagatattctcacccacgatattcgcgaacgcaaggagaagggaataccaagttctcagacctatgagtcgatggctattaaattgagtacacctgagccaaagatcaagaaaaacaactggcaatccccggacgatagtgatgaggacctggaatccgatctgaaccgtaattcgtatgccgtgctgtccaagagtgaacttctgaccaagggcagtacctctaagccatcaagcaaatctcactctgccagatccaagaacaagactgcaaatagtagcaggatatccaataaaagcgactatgacaaaatctcaagccagttgcctgaatctgacatacttgagaagcagaccacaactcattacgccgatgctacaccattgtggcatagtcagtcagatttcttcacggccaaattgtcacgaagcgaatcagacttcagcaagctgtgtcaaagctatagtgaggatttctcagaaaaccagttcttcactaggactaacggctcatccttgttaagctcaagcgatagagagctgtggcagcgcaagcaggaaggaacggccaccctatatgactctcccaaagaccagcatttgaacgggggcgtacaggggatacaaggtcaaaccgaaacggaaaacaccgagaccgtggacagtgggatgagtaacggtatggtgtgcgcatccggagacaggagccactattcagacagtcagctgtccctccacgaggacctgtccccctggaaggagtggaatcagggtgcggatctaggtcttgacagctctacacaggagggattcgactatgagaccaactctctttttgaccagcagcttgacgtatataacaaagacctagagtaccttggaaagtgccactccgacctccaggatgactcggagagctacgacctgacccaggacgacaacagctctccatgtcccgggctggacaatgagcctcaaggccagtgggtgggccaatatgattcgtaccaaggcgccaattccaatgagctgtaccagaatcagaatcagctgagcatgatgtatcggtctcagagtgaactgcaatccgatgactcagaagatgcgcccccaaagtcctggcatagtagactgtcaatcgacctgagtgacaagactttctcatttcccaagttcggcagcaccctgcagcgcgccaagtccgcattagaagtcgtgtggaataaaagtacccagtctttgagcgggtacgaagactctgggtctagcctgatgggcagattcagaaccctgtcacagtcgaccgccaatgagagttccacaacccttgactctgacgtgtatacagaaccatactattataaggccgaagacgaggaggactatacagagcccgttgcagataacgaaactgattatgtagaagtcatggaacaggttctagctaaactggagaatcggacatccatcaccgagaccgacgagcagatgcaggcctatgaccatctcagttatgagacaccatacgagacaccgcaagatgaaggatatgatggcccagccgatgatatggtgagcgaggaggggctggaaccacttaacgagaccagcgccgagatggaaatcagagaagacgagaatcagaacattcctgaacagcctgtggaaatcactaagccaaagagaatccgtccttcttttaaggaagcagctctgcgcgcttacaagaagcagatggccgagctcgaggagaaaattctagctggcgattcatcatctgttgacgaaaaagccagaatagtgtctgggaatgatctggacgcaagcaagtttagcgctctgcaggtatgtggcggcgctggtgggggcttgtatgggatcgactccatgccagatctgaggaggaaaaaaacactccccatcgtgagggatgtggccatgactcttgccgcaaggaaatccgggctgtcattggcaatggtgatcaggacaagcctgaacaatgaagagctgaagatgcatgtgttcaaaaaaacactccaggccttaatctatccgatgtcctccaccatcccacacaattttgaagtgtggactgccactacaccaacctactgctatgaatgtgaagggctcctgtggggtatcgctagacaaggcatgaaatgtctcgaatgcggagtgaagtgccatgaaaagtgccaagatctgctcaacgccgactgcctccaacgggccgctgagaagagtagcaaacatggagctgaggataagacacagacaattattacagccatgaaggaacgaatgaaaattagagagaagaatcgcccagaggtgttcgaggtgatccaggagatgtttcagatttctaaggaggactttgtgcagttcactaaagctgcgaagcagagcgtgctcgatgggaccagcaaatggagcgcaaagattaccatcactgtggtgagcgctcagggcctccaggcgaaggacaagaccggaagctccgatccttacgtgaccgtccaggtcggaaagaacaaaaggagaacgaaaactatcttcggtaacctcaatccggtctgggacgagaaattctattttgaatgtcacaactccaccgacaggatcaaggtgcgagtgtgggatgaggatgatgacatcaagagtcgcgtgaagcaacactttaaaaaagagagcgacgattttctcgggcaaacaattgtggaggtgcgcaccttatccggcgagatggatgtttggtataatctggagaagcggacggataagagtgccgtttccggagccattaggctaaaaatcaatgtcgagattaagggggaggagaaagtggccccttaccatatccagtacacttgccttcacgaaaacctgtttcattacttaaccgaagttaaatccaacgggggggttaagataccggaggtcaaaggcgatgaagcttggaaagtcttctttgacgacgccagccaggagattgtggacgaatttgccatgcgctacggtatcgaatcaatttaccaggccatgactcacttctcttgcctcagctcaaagtatatgtgcccgggagtccccgctgtgatgagcacactgttagcaaacatcaacgctttctacgcccacactactgttagtactaatatccaggtcagtgcaagcgacaggttcgccgcgacaaatttcggtcgcgaaaagttcattaagttgctcgatcagctgcacaacagtttgcgcattgacctctccaaatatcgcgagaacttccccgcttcaaatactgagaggctgcaggacctgaaaagcaccgtcgatctcctgacatctattacatttttccgtatgaaagtgctcgagctacagagcccaccaaaagccagtatggtggtgaaggactgcgtcagagcctgtcttgactccacgtacaaatatatttttgataactgtcacgagttgtacagccagctgaccgacccctctaaaaagcaggatatccccagggaggatcaggggcctacgaccaagaatctggatttttggccccagctgataaccctcatggtgactattatcgacgaggataaaaccgcatacacacctgtgcttaaccagttccctcaagagctgaacatgggaaagatttccgctgagattatgtggaccctgtttgcactagatatgaagtacgccttggaggagcatgaaaaccagcgtctctgcaagtctaccgactatatgaatctgcattttaaggtgaaatggttttacaacgagtatgtcagagagctgccagcatttaaagacgcagtaccggagtactccctgtggttcgaaccatttgtgatgcagtggctcgacgaaaacgaggacgtgagcatggagtttctccatggcgcccttggccgtgacaaaaaggatggttttcagcagactagcgaacacgcgctcttttcatgctcagtggtggacgtgttcgcacagctaaatcagtccttcgagattatcaagaaattggagtgtccgaatcccgaggctctgagccatctaatgaggaggtttgccaagaccataaacaaggtcctcctccagtacgctgccattgtgtcctctgatttcagcagccactgcgacaaggaaaatgtaccgtgcattctcatgaataatattcagcagctgcgtgtgcagctcgagaagatgttcgaatcaatgggggggaaagaactggacagcgaggcatccacaatcctgaaggagctacaggtaaagctgtccggagtgctcgacgagctctcagtgacttatggggaatcttttcaagtcattatcgaagaatgcattaagcagatgtcatttgaacttaaccaaatgagagccaacggaaacactacctcaaacaaaaattcagcagcgatggatgccgaaatagtgctccgtagcttgatggactttttggacaagacactctctctgagcgctaagatctgcgagaaaaccgtcctgaagagagtgctcaaggagctctggaagctggtgctgaacaagattgagaagcagattgtactaccccctctaacggatcagactggcccccagatgattttcattgccgccaaggatttgggacagctctcgaaattgaaagaacacatgatcagggaggatgccagaggactaacaccccgtcagtgcgctataatggaggtcgtcctggctaccatcaaacagtacttccatgcaggcggcaacggcctgaagaaaaactttctcgaaaagtctcctgatctgcagagtctcagatatgccctctctctctatacccagaccaccgatgccctgatcaaaaaattcatagacacccagaccagtcaatcccggtcctccaaggacgcggtcgggcagataagcgtgcacgtggatattacggccacacctgggactggtgaccataaggtgactgtcaaggtcattgcaattaatgacctgaattggcagaccaccgcgatgtttagaccttttgtggaggtgtgtatcctcgggccaaacttaggagataagaagcggaagcaggggaccaagacaaagagcaacacatggtccccaaaatacaacgaaacctttcagtttattctaggcaaggaaaaccggcccggagcctacgagctccatctgtccgtcaaagattattgtttcgctagggaggatcgcatcatcggcatgacagttatccagctccagaacattgccgaaaagggctcctacggtgcctggtaccctctgctgaaaaatatttccatggatgaaactggcctgaccattctgcgtattttatcccagaggacctccgacgacgtggcaaaagaattcgtgagactgaaatctgaaaccaggtcgaccgaggaatccgcgtag

SEQ ID NO: 47816 - DNA, 6639 bp, Artificial Sequence
  Description of Artificial Sequence: Synthetic coding sequence
atggtggccaacttcttcaagagcctgatcctgccctacatccacaagctgtgcaagggtatgtttacaaagaaattgggcaacaccaataaaaacaaggagtaccgacagcagaaaaaagatcaggactttccgacagctgggcagactaagagccctaagttctcttatactttcaagagcacagtgaaaaagatcgctaagtgctcgtcaactcacaatctttcaacagaagaggatgaagcctccaaagagttttcgctgtcacccacatttagttacagagtggctatcgccaatggccttcaaaagaatgccaaggtcacaaactcagacaatgaggacctgctgcaggagttgagttcaattgagagttcatattcagagtctttgaacgaactgcgatcatccacagagaaccaggcacagtccacccacacaatgcccgtgcggaggaaccgaaaatcgtcatcttccttggcgcctagtgaggggagtagtgacggggagaggactctgcacggacttaagttgggagcccttcgcaaactgagaaaatggaaaaagagccaggaatgcgtctcgtccgactcagaactcagtaccatgaaaaaatcgtggggaatacgcagcaaaagtctggacaggaccgtcaggaaccctaaaacgaatgcacttgaacccgggttttcctctagcgggtgtatttcccagacccacgatgtgatggaaatgatcttcaaggaactccagggtatcagtcagatcgagaccgagctctccgaactgaggggtcatgtcaacgccctcaaacacagcatcgatgagatttcttcctcagtggaggtcgttcaatctgagattgaacagcttcgcaccggttttgtacagagccgcagggaaacccgcgacatccatgattacataaagcacctaggacacatggggtccaaagctagtctacgcttcctgaatgtgaccgaagagcggtttgaatacgtggaatcagtggtttaccagattctgattgacaagatgggatttagtgatgccccaaacgccataaaaatcgagttcgcacagcgcatcggccaccagcgtgattgtcccaatgcgaagcctaggcccatcctcgtttatttcgagacgccacagcagagagacagtgtactgaagaagagctacaaattgaaagggacaggcatagggatttcgacagatattctcacccatgatatcagagagagaaaagaaaaaggcataccaagttcacagacatatgaatctatggcaatcaagctgtcaacaccagagccaaaaattaagaaaaacaactggcagtctcctgacgatagcgacgaggatctggagtccgacctcaatcgtaactcgtatgctgtgctttccaagtctgagttgctcacgaaggggagtacatcaaaaccatcttctaaatcacattcagcgcgcagcaagaataagacagctaatagctctcgtatttcgaacaagtctgattatgataaaatctcaagccagctaccagaaagcgacatcctggagaagcagacaactacccattatgctgacgccacacctctctggcattcacagtctgacttctttacagcaaaactgagcagatccgagagtgatttctctaaactgtgccagtcctattctgaggatttctctgaaaatcaattctttactaggacgaatggatccagtctgctaagctcctctgatcgagagctttggcagcgaaagcaggaggggaccgctacactctatgatagtcccaaggaccaacatctgaacgggggcgtccagggaatccaggggcagactgagacagaaaacaccgagaccgttgatagcggcatgagcaatggcatggtctgtgcctctggagacaggtcccactactccgattcacaactttccctacacgaagatctgagcccctggaaggagtggaaccagggggccgatcttggtctggatagctccacccaggagggctttgattatgagaccaattctttgtttgaccaacagcttgatgtgtataacaaggatttggaatacctgggtaagtgccacagcgacctccaagacgattccgagagctacgatctcacccaagatgacaactccagcccttgccccggcttagacaatgaaccacaggggcaatgggtgggacaatacgactcctaccagggggccaacagtaatgagctttaccagaatcaaaaccaattatccatgatgtaccgaagccaatctgaacttcaaagcgacgatagcgaggacgccccaccaaagtcctggcatagcagattatcgatagatctgtccgacaagaccttttctttccccaaatttggctcaaccctccagcgggcgaagagtgcactggaagttgtatggaacaaatcaacccagtcactgagcggatacgaggatagtggctccagcctgatggggagattcaggactctgtcacagtcaaccgctaacgaaagctctaccaccctcgactctgacgtttatactgagccctattattataaagccgaggacgaagaagactacacagagcccgtggctgacaacgagactgactatgtggaagtcatggagcaagttctggcgaagctggagaaccggacttcgattaccgaaaccgacgagcaaatgcaagcctacgatcatctcagctacgaaaccccttatgaaactccccaggatgaaggctacgatgggccggccgacgacatggtgtcagaggaaggcttggagcctttgaatgaaacttctgctgaaatggaaataagagaagatgagaaccagaacattccagaacagccggtggagatcacaaagccaaaacggatacgtccttcgtttaaagaggccgccctaagggcctataaaaaacagatggctgagttagaagagaagattctcgccggggacagctctagcgttgacgaaaaggcgagaatcgtcagcgggaatgacctggatgccagtaagttttcagcccttcaagtctgcggaggtgcaggtggcggtctgtatggcatcgactcaatgccagatctgcgcaggaagaagacacttcctatcgtgagagacgtgactctcgcagcacgtaaaagcgggctcagcctagccatggtcattcgcacatcactcaataacgaagagctcaagatgcatgtcttcaagaaaacactgcaggccctaatctacccaatgtcaagcacaattccccacaattttgaagtgtggacggctactacccccacttattgttacgagtgtgaaggcctgctctgggggatagctaggcaaggcatgaagtgcttggaatgtggggtgaagtgtcacgagaagtgtcaggatctgttgaacgccgattgcctgcagcgcgctgcagaaaagtccagtaaacatggggccgaagataaaactcagacaattattaccgcgatgaaagaaagaatgaagatcagggagaagaaccggcccgaggtgttcgaagtgatccaagagatgtttcaaatctccaaggaggactttgtccaatttactaaggcggcaaaacaatccgtcttggatgggacctctaagtggtctgccaagatcaccattacagtggtatcggctcagggacttcaggcaaaagataagaccggttcatcggatccctacgtgactgtgcaggttggcaagaacaagagacggacaaagacaatctttggcaatctgaaccccgtttgggacgagaaattttactttgaatgccataattctacagacaggataaaagtgagggtctgggacgaggacgatgatattaagagtcgggttaagcagcattttaaaaaggaatccgacgactttctggggcaaaccattgttgaagtgaggactttgagtggcgaaatggatgtttggtataaccttgagaaacgaacagataagagcgcagtatctggcgcaatcaggctgaaaatcaatgtcgagatcaaaggcgaagagaaagtggcaccctaccacatacagtacacttgcctacacgaaaatctgttccactacttgaccgaagtcaaatccaacggaggagtcaaaatcccagaggtgaaaggcgatgaggcctggaaagtgtttttcgacgacgcgtcacaggagattgtcgacgagtttgcgatgcggtacggtattgaatctatatatcaggccatgacccatttttcttgtctctcgagcaaatacatgtgtcctggggtgccggccgtgatgagcaccttgctggcaaatataaacgccttttatgcgcatactactgtctccacgaacattcaggtgtcggccagcgacaggtttgctgcgacaaactttggaagagagaagttcattaagttgttggatcagctgcacaacagcttgcgaattgatctgtcaaagtaccgagaaaatttccctgcttctaacacagaaaggttacaggatctgaaatctaccgtggacctacttacttccataactttcttccgcatgaaggttctcgagctccagtctcctcctaaagctagtatggtggtaaaagactgtgtgcgcgcatgcttagactctacctataaatacatcttcgataactgccacgagctctactcacagctcacagacccctccaaaaagcaggacattccacgcgaggatcaaggccctacaactaagaacttggatttctggcctcagttgataaccctcatggtgaccatcattgacgaggacaaaaccgcatacaccccggtcctgaaccaattcccccaggaactcaacatgggaaagattagcgcagagatcatgtggacactcttcgctctggatatgaaatacgccttggaggagcatgagaaccagaggctgtgtaagagcacggactacatgaatctgcacttcaaagtaaaatggttctacaatgagtatgtccgagaactgccagcctttaaggacgccgtcccagagtacagtctgtggtttgagccgtttgtaatgcagtggctcgacgagaatgaggacgtgagtatggagtttctgcatggagctctcggccgcgacaagaaggatggcttccagcagacatctgaacacgcactgttctcctgctccgtagtggacgtgtttgctcagctgaatcagagctttgagatcattaagaaactcgagtgcccgaaccctgaggcactgtcccacctgatgagacgtttcgctaaaactattaacaaggtactgttacaatatgccgccatcgtgagctccgatttctcttcccactgtgataaagagaacgtgccttgcattctcatgaacaatattcaacagctccgggtgcagttggagaagatgttcgagtctatggggggcaaggagctggactccgaggcttccacaattctcaaagagctgcaggtaaaactgtccggcgtgctggacgaactgagcgtcacttacggggaatcttttcaggtgataattgaggagtgcatcaagcaaatgtcctttgagctgaaccaaatgcgtgcaaatgggaacaccactagtaataaaaattcggctgctatggatgctgagatcgttttgcgcagcctgatggatttcctcgataaaacactgtccctttcggcaaaaatttgcgaaaagactgtgcttaaacgcgtgctgaaagaactgtggaagctggtcctcaataagatcgaaaaacaaatcgtgctcccccccctcacagaccaaaccggtcctcagatgatatttattgcagccaaagatctgggccaactgtctaagcttaaagagcatatgatccgcgaggacgctagagggctgactcctcgacaatgcgctatcatggaagtagtgctggccacgattaaacagtattttcatgctggcggaaacggactcaagaaaaattttctcgagaaatcacctgacctccagagccttagatatgcactgtcactttacactcagaccaccgatgcgctcattaagaaattcatcgacacccagacctcccagtctcggtcaagcaaagacgctgtgggtcagatctccgtccacgtcgacattactgctacgccaggcaccggcgaccacaaggttaccgtgaaggtcattgcaatcaacgacctgaattggcagacaaccgccatgtttcgccccttcgtggaggtatgtattctgggccccaatctcggcgataaaaaacggaaacaaggcaccaaaactaaatcaaatacatggtctcccaagtacaatgaaaccttccaattcatcttaggaaaagaaaatagacccggagcatacgaattacacctgagcgtcaaggattattgttttgccagggaagacagaatcatcgggatgaccgtgatacaacttcagaacatagctgagaagggttcttacggcgcatggtacccattgctcaagaatatttccatggacgagacgggcttgacgatacttcgcatcctgagccagaggaccagcgatgatgtcgctaaagaatttgtcagactcaagagcgaaacaaggtcaacagaggaaagcgcatag

SEQ ID NO: 47817 - DNA, 6645 bp, Artificial Sequence
  Description of Artificial Sequence: Synthetic coding sequence
atggtggccaacttcttcaagagcctgatcctgccctacatccacaaactgtgcaaaggtatgtttactaaaaagctcggtaatacaaataaaaacaaagagtaccgccagcagaaaaaagatcaggacttccccaccgccgggcaaaccaagagcccaaagttcagttatactttcaaaagcactgtcaaaaaaatcgccaaatgctcttctacccataatctgtcaaccgaggaagacgaggcatccaaggagttcagtctgtctcccaccttttcttatcgcgttgccattgctaatggactgcaaaaaaatgccaaggtgacaaattccgacaacgaggacttgctgcaggagctttcctccatcgagtcctcctatagcgagtctttgaatgaactcagaagctctactgagaatcaggcacagagtacacataccatgcctgttaggcgcaatcggaaatcttcatcctcccttgcgccatctgagggatcttccgacggcgagagaacattacatgggctgaagctgggtgccctccgcaagcttcgtaaatggaagaaaagccaggagtgcgtctctagcgacagcgaactcagtacaatgaagaaatcctggggaattcgtagtaagagcctggatagaaccgtaaggaatcccaagacgaatgccctggagccggggttcagctcttccggatgcatttctcagacacatgatgtaatggaaatgatattcaaagagctacagggtataagccagatagagactgaactgagcgaactgcggggacatgtgaatgctcttaagcacagcatcgatgagattagctctagcgtggaagtggttcagagtgaaatagagcaacttagaaccgggttcgtgcagtctcggcgcgaaacccgggacattcacgattatatcaaacatctgggccacatgggcagtaaggcttccctgagatttcttaatgttacagaagaacgatttgagtacgttgagagtgttgtctaccagatactgatcgacaagatgggcttcagcgacgccccgaacgcaatcaaaattgaattcgctcagaggatagggcaccaaagggattgcccaaacgccaagccaagacccattctggtttatttcgaaacccctcaacagcgcgacagcgtgttgaaaaaatcatataagctcaagggtaccggcataggaatttccaccgatattctcactcacgacatccgcgagcggaaagagaagggaatcccgtctagccagacatacgagtcaatggccattaaactcagcacccccgaacccaaaataaagaagaacaactggcagtctcccgacgacagcgatgaagacctcgaatctgatctgaaccgcaattcctacgctgttctgagcaagagcgagctgctaaccaaaggctccacatccaagcccagctccaagtctcattctgcccgctccaagaacaagacagccaactcttctagaatcagtaataagtcagattatgacaagatttctagccagctgccagaaagcgatattttagagaagcagacaaccacccattacgccgatgctacgccactctggcacagccagtccgatttcttcaccgcaaaactatcaaggagtgagagcgacttctccaaactgtgtcagagctattcagaggatttttccgaaaatcaattttttactcgaacgaacggaagtagcctcctgagctcttctgatagggagttatggcagagaaagcaagaaggtaccgccacactgtatgatagccccaaagatcagcaccttaatgggggagtgcaaggcattcagggccagaccgagaccgagaatactgaaacggtggactccggcatgtctaatggaatggtatgtgcatcgggcgatcggtcccactattcagacagtcagttaagtctccacgaggacctgtccccttggaaggagtggaaccagggagccgatctcggattggattccagcacccaagagggctttgactacgaaaccaactcgctgttcgatcagcagttggatgtctacaataaggacctggagtacctcggcaaatgtcattctgatctccaagatgattcagaatcatacgatctgacgcaagacgacaacagtagcccctgtcccggcttagataacgagccccaaggtcagtgggtaggtcaatacgacagctatcaaggtgccaactcaaacgaactttaccagaaccaaaatcagctgagcatgatgtataggtcacaatccgagctccagagtgatgatagcgaggacgcacccccaaaatcttggcactcccgactgagtatagacctgagtgataaaaccttttcctttccaaagtttgggtccactctgcagagagctaagagcgcattagaggtggtgtggaataagagcacacagagtttgtccggctatgaggattctgggtccagcttaatgggaagattcagaaccctttcccagtctaccgcgaatgagtcgtctaccacgctggactctgacgtctacacagagccatactactacaaggccgaagacgaagaagactacactgagcctgtcgcagataatgagactgattacgtagaagttatggagcaggttttagccaaattagagaaccgaacaagcatcacagagacagatgagcagatgcaggcctacgatcacctgtcctatgagaccccgtacgagacaccgcaggatgagggttacgacggtcctgccgatgatatggtgtcagaagaggggcttgagcccctcaacgagacaagcgcagagatggagattagagaggacgagaaccagaacatcccagagcaaccggtggagatcacaaaacccaaacggatcagaccatcatttaaagaggcggcgttaagagcttacaagaagcagatggccgagcttgaggagaagatacttgctggggtgagcttagatgtggatctagaggcacgtatcgtgtctggcaatgatctagatgcttccaaattttcagccctgcaggtttgtggaggtgcgggcggcggcctgtacgggattgacagtatgccagatttacggaggaaaaagacactcccaatcgtaagggacgttctcctcactctcgccgccaggaaaagcggactcagcttggccatggtgatccgaacctctctgaataatgaggagctcaagatgcacgtgtttaagaaaaccctgcaggccctcatctaccccatgtcgagcacaattcctcacaacttcgaagtctggaccgccacgacacccacgtactgttacgagtgcgagggtctgttgtggggcatcgctaggcagggaatgaaatgtctcgaatgtggggtcaagtgtcatgagaagtgccaggacctgcttaacgctgattgcctccagagagccgcagagaagagctctaagcatggcgccgaagacaagacgcagacaattatcaccgctatgaaggagaggatgaagattcgagagaagaatagacctgaggtgttcgaagtgatccaggaaatgttccagatcagcaaggaggactttgtgcaatttactaaggccgccaagcagtctgttcttgacggaaccagtaagtggagcgctaagatcacgatcaccgtggtatcggcacagggcctgcaggcaaaggacaaaaccggctcaagcgatccttatgtgacggtacaagtgggaaagaataagcggcggaccaaaacaatcttcgggaacttgaaccctgtgtgggatgaaaagttttatttcgagtgtcataacagtactgaccgcattaaggtccgagtgtgggatgaggatgacgacatcaaatcgcgggtaaaacagcatttcaaaaaagaatcagatgatttcctggggcaaactatagtcgaggtccgtactttgtccggagagatggatgtgtggtacaacctggagaagcggactgataagtctgccgtgtcaggagccatacggttgaaaataaatgtcgaaatcaagggtgaagagaaggtggctccataccacattcagtatacatgcctccacgaaaacctcttccactatctgactgaagtaaaaagtaatggcggcgtgaagatcccagaagtgaagggagatgaggcctggaaggtgtttttcgacgacgccagtcaagaaatcgttgacgaattcgcgatgagatatggcatcgaaagcatctatcaggcaatgacgcacttcagttgtttgagtagtaagtatatgtgccccggagtgcccgcggtcatgtcgacgctgctcgccaacatcaacgccttttatgctcacaccacagtaagtacaaacatccaagtgtcagcctctgatcgatttgcggcaactaatttcgggcgggaaaagttcattaagctgctggaccaactccacaatagcctacgcatagatctttcaaagtatcgcgaaaatttccctgcatcaaacactgagagactgcaggatctcaaatctaccgtggacttgcttacatctatcacgttttttcgtatgaaagtgcttgagttgcagtcaccacccaaagcatcgatggtggtcaaggattgcgtgcgggcctgcttagacagtacctataagtacatcttcgacaactgtcatgaactttacagtcagttgaccgacccttccaagaagcaggacatcccccgcgaggaccagggacccaccaccaaaaaccttgatttctggccccaactcattaccctcatggtgactatcatcgacgaagacaagacagcatacaccccagtcctgaatcagtttccacaggaactgaacatgggcaagatcagcgctgaaatcatgtggactctgttcgctttggatatgaaatacgccttggaggaacacgagaaccagagattatgtaagtccactgactacatgaacttacatttcaaggttaagtggttttataatgagtatgtgcgcgagctgcctgccttcaaggacgcagtgccggagtattccctgtggttcgaaccttttgtgatgcaatggcttgatgagaacgaggacgtttctatggagttcttgcacggtgccctcgggcgtgataagaaagacggatttcagcaaacctccgaacacgccttattcagctgttccgtcgtcgatgtattcgcgcagctgaatcagtctttcgagatcataaagaagctcgagtgtcccaacccagaagctctgtcccatctgatgcggagatttgcaaaaaccattaacaaggtgctgttacaatatgcagccatagtctcaagtgacttttccagccactgcgacaaggagaacgtcccctgcatattaatgaacaatatccagcagcttagagtgcagctggaaaaaatgtttgaaagcatgggcgggaaagaactggattccgaggcatccactatactgaaagaactgcaggtgaagctcagcggggtgctggacgagttgagcgtgacctatggagaaagttttcaggtcattattgaagagtgcattaaacagatgtcgtttgaactgaaccaaatgcgtgcaaatggcaacacgacatctaataaaaatagcgccgccatggacgctgagattgtcctgagaagtttgatggacttcctcgacaagacactcagcctcagcgctaagatctgcgagaagaccgtactcaaacgggtgcttaaggagctgtggaagctagtgctgaataagattgaaaaacaaatcgtgctccctccattgaccgatcagaccggaccacaaatgatcttcattgccgctaaggacctgggtcagcttagcaagctgaaggagcacatgattagagaggacgctaggggcctgactcctagacagtgcgccattatggaagtggtcctcgccactattaagcaatactttcacgctggcggcaatggcctgaagaaaaatttcttagagaagagtcccgacctccaatctctcagatatgctctgtctttatatacacaaacgacagacgcgctgattaagaaattcattgatacccaaacaagtcaatcccgctcttccaaggacgccgttgggcagattagcgtgcatgtagatattactgccactcccggaaccggagatcacaaggtaactgtgaaagtgatagccataaatgatctgaactggcaaacaacagctatgttcagaccatttgtcgaagtgtgtatcctcggtccaaacctgggggacaaaaagaggaagcaggggaccaagaccaaaagcaatacttggtccccaaagtataacgagactttccagtttatcctgggtaaggagaacaggcccggggcatatgaactacacctgtccgtaaaggactactgctttgctcgggaggatcgcattataggaatgaccgtcatacaattacagaatattgctgagaagggatcctatggcgcgtggtatcctcttctgaagaacattagtatggacgaaacagggcttactattctccggatcttgtctcaaagaactagcgacgacgtggccaaagaattcgtccgtttaaaaagcgagactagatctaccgaggaaagcgcttag

SEQ ID NO: 47818 - DNA, 1557 bp, Artificial Sequence
  Description of Artificial Sequence: Synthetic coding sequence
atgtgcccccaggagagcagcttccagcccagccagttcctgctgctggtcggcgtgcccgtcgcgtccgtcctcttgctcgcgcaatgtctgagatggcattgcccgcggcgtttactcggagcttgctggacactgaatggccaagaggagccggtgtcacaaccgaccccacaactggagaacgaagtaagccgacagcacctgcccgcaactctgccagagatggtggctttctaccaggaactccatactccaacgcaggggcagaccatggtacgacagctcatgcataagctactagtgttttccgcacgggaagttgatcatcgcggtggatgcctaatgttacaggatacaggcatttctctgttaatcccaccaggagccgtcgctgtaggccgccaggaacgggtgagtttgatcctggtatgggacttatccgacgccccctcgctcagccaagcccaaggtctcgttagccctgtcgtagcctgcggcccacacggggctagcttcttaaaaccttgtacactaaccttcaaacactgtgcagagcaaccaagccacgcccgcacatactcttcgaataccaccttactcgatgctaaggtgtggcggcctctcggccgacccggggctcatgctagccgcgacgagtgtagaatacacctctcccacttctcactctatacctgtgtgctagaggccccagttggacgggaagcccgaaagtggttacagctggctgtattctgtagtcctttggtgcccggacagtctcatctccagctgcggatctattttttgaacaatacaccttgcgctctgcagtgggctctgacaaacgagcagccgcatggagggcgacttcgagggccatgtcaacttttcgacttcaatggagccagaggcgaccaatgtctgaagctaacatatattagcgagggttgggagaacgtcgacgattctagttgccagctcgtcccccaccttcacatctggcacggtaaatgtcccttcaggtctttttgttttcgcagaaaggctgccgacgagaatgaggactgctccgctttgacaaacgagattatagtgacaatgcatacctttcaggacggactggaaactaagtatatggagatcttgaggtttcaggccagtgaagaggaatcatgggccgccccaccacctgtgtcacagccacctccgtgcaacaggttaccccctgagttgtttgaacagttacgcatgttgttggaacccaacagcatcacaggcaacgattggcgaagacttgctagtcatttaggactctgcgggatgaaaatccgcttcctgtcctgtcagcgctccccagctgctgccattctcgaactgtttgaagagcagaatgggtcgctgcaggagctgcattacctgatgactgtgatggagagactagattgcgctagcgctatccaaaactatctgtctggtactcacggaggatcaccaggcccagagcggggtggagcaagggacaaccagggcttggagctggatgaaaagctgtag

SEQ ID NO: 47819 - DNA, 1557 bp, Artificial Sequence
  Description of Artificial Sequence: Synthetic coding sequence
atgtgcccccaggagagcagcttccagcccagccagttcctgctgctcgtaggagttccggtagcgagcgtgctgctcttggctcagtgcttaaggtggcattgccctagacgtcttcttggcgcctgttggactctcaacggccaagaagaaccagtgtcgcagccaactcctcagcttgaaaacgaagtttcccgccagcacttgcccgcaaccctcccagaaatggtggcattttaccaggaactgcatacccccacccagggccagacaatggtgagacaactgatgcacaagttgttagtcttttcagctcgggaagtggatcaccggggggggtgtcttatgctgcaggatactggaatcagtctgctgataccccccggcgccgtggctgtgggccgtcaggagcgggtgtcacttattctcgtgtgggaccttagtgatgcacccagtttgtctcaagcgcaggggctggtctctcccgttgtggcctgcggcccgcatggcgccagctttctgaagccctgcacactgacatttaaacactgtgccgaacagccaagtcacgctagaacctattcatcaaacacaaccctgctagacgccaaggtgtggcggccattgggtcgaccaggggcccatgcaagcagggatgagtgtcggatacacctgtctcactttagcctgtatacatgcgttctggaggctcctgttggtagggaagcccggaaatggttgcaactcgccgtgttttgctcgcctcttgtcccgggccagtcgcatttgcagctgcgcatctactttctgaacaacacaccctgcgcgctgcagtgggcccttaccaatgaacagccccacggtggccgactgaggggtccatgtcaactttttgattttaacggagcccgaggcgaccagtgtctgaaacttacgtatatctctgagggatgggaaaacgtcgacgattctagttgtcaattagtaccgcacctgcacatatggcacgggaaatgtcctttcaggtcattttgcttcagacgcaaagctgccgatgagaatgaggactgtagtgcactgacgaatgaaatcattgtgactatgcacacgtttcaggatggcctggaaaccaagtacatggagatcctccggttccaggcttctgaagaggaaagttgggctgctccccctcctgtatctcagccacccccatgcaataggctgcctccagagttgtttgaacagctgagaatgctacttgagccaaattctatcacaggcaatgattggagaaggctcgcctctcacctgggtctttgtggcatgaagattcgcttcctgtcctgccagcgctcccccgcagccgctatactggagcttttcgaagagcagaacggttcactccaggagctccactatctaatgacagttatggagagacttgattgtgcatcagccatacagaactacttatcaggcacacatggaggtagccctggcccagagagagggggggctagggataatcaggggcttgaactagacgagaagctgtag

SEQ ID NO: 47820 - DNA, 2862 bp, Artificial Sequence
  Description of Artificial Sequence: Synthetic coding sequence
atgggccgggccgccgccaccgccggcggcggcggcggcgcccggcggtggttgccctggctcggcctgtgtttctgggctgccggaacagctgcggcgcggggtacagataacggcgaggcccttccggagagtataccgagcgcacctggtaccctacctcattttatcgaagaacccgacgatgcctacatcatcaagtccaatcccattgcactcagatgcaaagctcggcctgcgatgcaaatctttttcaaatgtaacggcgagtgggtccaccagaacgagcacgtcagcgaagagaccctcgacgaatcttctggcctaaaagtgagggaggtgttcattaacgtgacacggcagcaggtcgaggacttccacggccccgaggattactggtgtcaatgcgtggcttggagccacctgggaacctccaagagccgcaaagcctctgttcggattgcttatcttcggaagaactttgagcaggatcctcagggtcgggaagtgccgatcgaggggatgattgtgcttcattgtcgccctcccgagggcgtgcctgcagcagaggtcgagtggctcaaaaacgaggaaccaattgatagcgagcaggacgagaatattgacacgagggccgatcacaatctcatcatcaggcaggctcggctgagcgattctggtaattacacatgtatggctgcaaatattgtcgctaaacggcgctccctaagcgcgaccgtagtagtgtatgttaatggtggatggagcagctggacagagtggtctgcatgcaatgtccgttgcggccgtggttggcagaaaaggtcaaggacgtgcacaaaccctgctcccctgaacggtggagcgttctgcgaaggcatgagtgtgcagaagattacgtgcacttccctttgtcccgtggatggcagctgggaggtgtggagcgagtggagtgtgtgctcccctgaatgtgaacatctcagaataagagaatgtaccgcaccacccccacgcaatggcggcaagttttgcgaaggcctgagccaggaatcagaaaactgtaccgacggcctgtgtattttggataagaagcctctgcacgagattaaaccacagagtattgagaatgcatcagacattgccctttatagtggcctaggagctgccgtcgtggcagtggctgtgttggtgatcggcgtaactttataccgacgctcccagtccgactacggagtggacgtaattgattccagcgcactgacaggaggcttccagacatttaacttcaaaacagtaagacaagggaactccctgctgctgaactccgccatgcagcctgacctgacagtgagccgaacatatagcggtcccatttgccttcaggatcctctagataaggagctgatgactgagagcagcttgttcaatcctctttctgacatcaaggtgaaggtccagtcatcgttcatggtgagcctgggcgttagcgaacgggctgaataccacgggaagaaccatagtcggacttttccgcacggaaataaccattcatttagtactatgcaccctcgaaacaaaatgccctacatccagaacctcagctctttaccaacaaggaccgagttacgcaccaccggagttttcggacatctcggggggagactggtgatgcccaatactggcgtgtcacttctcattccccacggtgcaatccccgaagaaaatagttgggaaatttatatgtctataaatcagggtgagcctagccttcaatctgacggttctgaggttttactaagtcccgaggtgacgtgtggcccacccgatatgatagtcacaacacccttcgctctgaccatcccgcactgcgccgacgtgagcagcgagcattggaacattcacctgaagaagcggacccagcagggcaagtgggaggaagtaatgagtgtcgaggatgaatctacttcctgctactgccttctagaccctttcgcatgtcacgtgctcctggacagctttggtacatacgctctcacaggggagcctatcaccgattgcgctgttaaacagctgaaagtggccgtgtttgggtgtatgtcgtgcaactcgttggattacaatctccgagtatactgtgtggacaacactccttgcgcattccaggaggtcgtgagtgacgaaagacaccagggcggacagttactggaggaacctaagctgctccattttaagggcaatacatttagcctccaaattagtgttctagacatccctccttttctgtggagaatcaagcccttcacggcctgccaggaggttccatttagcagggtgtggtgctcaaatcgccagccattgcattgtgccttttccttagagcgctatacccctacaacgacgcagctgagttgcaagatctgtatccgacagctcaaaggccatgaacagatcttacaggtacagaccagcatactggagtccgagcgcgagacaataaccttttttgcccaggaggactccactttcccagctcaaaccggccccaaggctttcaagatcccctattcaattcgccagaggatctgtgccacatttgacacccctaacgctaagggtaaagattggcagatgctcgcccagaaaaactcaataaaccgaaacctgagctacttcgctacgcagagttcaccttccgccgtgatccttaatctgtgggaagctagacaccagcacgatggagacttggacagcctggcttgtgccctcgaggagatcggccgcacacatacaaaattaagcaacatatcagaatcccaactggatgaagctgattttaactattcacgtcaaaatgggttgtag

SEQ ID NO: 47821 - DNA, 2847 bp, Artificial Sequence
  Description of Artificial Sequence: Synthetic coding sequence
atgatcctggtgctggtgaaggccctgagcgacgtgtgcgccggcacctcagggtttcttttggatttctcgtcccaaacgtcccctgggacagataacggcgaggccctgcccgagagcatccccagcgctcctgggacccttcctcatttcatcgaggaacccgatgatgcctatattattaagagtaacccaatcgctctgaggtgcaaggcaagacccgcaatgcagattttcttcaaatgtaatggtgaatgggtgcaccaaaacgaacacgtcagcgaggagacgctggatgagtctagcggtctgaaagtccgagaagtgttcatcaacgtcacccgacagcaagtggaagacttccacggccccgaagattactggtgccagtgcgtggcatggtcccatctgggaactagtaagtctcgaaaggctagtgtccggattgcgtaccttcggaaaaatttcgagcaggaccctcaggggagagaagtgccgattgaaggcatgatcgtgttacattgtagacctccagagggggtcccggccgccgaagtagaatggctaaagaacgaagaacctatcgactctgaacaagatgaaaacattgatacacgcgcagaccataaccttatcatccgccaagcgagactgagcgattccggcaattacacctgtatggctgctaacatagtcgcgaagcggcgaagcctgtcagctacggtcgtcgtgtacgtaaatgggggctggtcaagctggaccgaatggtctgcttgtaatgttagatgtggtagaggctggcagaagcggtctcggacatgtacaaacccggcccctctcaatgggggcgccttttgtgaaggaatgagtgtgcagaagatcacctgtacttctctctgtccggtcgacggaagctgggaagtttggtcggaatggtctgtgtgttcaccggaatgtgagcacctccgaatccgtgaatgtacagccccacccccgagaaacggcgggaagttctgcgagggtctctcacaggaaagtgagaattgcaccgatgggttgtgtatacttgacaaaaagcccctgcacgaaataaaacctcagtccattgagaacgccagcgatattgccctctacagcggactgggtgctgcggtagtcgccgttgctgttctcgttatcggtgtgacactttatcggcggtcacagtccgactatggagtggacgttatcgatagttccgctcttacgggcggcttccagaccttcaacttcaagactgtgcggcagggtaatagtctgctactgaattctgctatgcagccagacttgacagtgtcaaggacatactccgggcctatttgtcttcaggaccccctcgataaagagctcatgactgagtcaagtcttttcaaccccctgtccgatattaaagtgaaggtgcagtctagctttatggtttcattgggagttagtgagcgcgctgaatatcacggaaaaaatcatagtcgtacgtttccccacggaaacaatcactccttctctactatgcacccccgcaataaaatgccgtacatccaaaacctaagcagtcttccgactcgtaccgagctccgtaccacgggggtgtttggtcacctgggtgggcggctcgtgatgcccaataccggagtctcgctccttattccgcacggagccatcccagaggaaaattcctgggagatttacatgtcaatcaaccagggggagccctccctgcagtccgatggctccgaggttctgctgtccccagaggttacctgcgggcccccggatatgatcgtcactacaccctttgcactgacgatcccccattgcgcagacgtcagcagcgaacactggaatatacatctgaagaagaggacccagcagggcaagtgggaggaagtcatgtctgtcgaagatgagtccacttcatgttactgcctgctcgatccattcgcatgtcatgttctgctcgactcattcggcacatacgctttgacaggagaacctatcactgattgcgcagttaagcaactgaaggtcgccgtcttcggctgcatgtcttgcaattccttggactacaacttgcgtgtgtactgcgtcgacaacactccatgtgccttccaggaagtggtgtcagatgaaaggcatcagggtgggcagctgctcgaggagccaaagctactccacttcaagggcaatactttcagcttgcagatctcagtgctggatatcccccctttcctgtggcggattaagcccttcactgcctgccaggaagtgccattctcacgtgtatggtgctctaatcggcagcccctgcattgcgcttttagcctggaaaggtacacaccaactacaactcagcttagctgcaagatctgtattcggcaactcaagggacacgagcagattcttcaggtgcagactagcatccttgaatctgagagagagacaataaccttttttgcccaggaggactcaactttccctgcgcagacgggcccgaaagctttcaaaataccctattcgatccgccagcgcatctgcgcaactttcgatacacccaacgccaagggcaaggactggcaaatgctggcgcagaaaaattccatcaaccgtaatctgagctacttcgccacacagtcatccccttcagccgttattcttaacctgtgggaagccagacaccagcatgatggggatctcgatagcctggcctgtgctctagaagagatcggccggacccataccaaactgtctaacattagcgaaagccagctggacgaagccgacttcaattattctcgacagaacggcctttag

SEQ ID NO: 47822 - DNA, 780 bp, Artificial Sequence
  Description of Artificial Sequence: Synthetic coding sequence
atgctgcccagcaccagcgtgaacagcctggtgcagggcaacggcgttctgaattccagggacgccgcacgtcacaccgcaggcgccaaaaggtataaatatttgcgtcgtttgtttcgcttcagacaaatggatttcgagttcgccgcatggcagatgctgtacctatttacgtccccccagcgcgtgtatcgtaattttcactatcggaagcagacaaaggaccagtgggcccgcgacgatccagcctttctggttcttctgtccatttggctgtgcgtgtctactattggcttcggctttgtgctggatatggggttttttgagactataaaactgttgctgtgggtggtcctgatcgattgcgtcggcgtgggactgcttatcgccaccctgatgtggttcattagcaataaatacctcgtcaaacggcagtccagagactatgacgtggagtggggctacgcgtttgacgtgcacctaaatgcgttttatccgcttcttgtcatcctgcactttattcagctcttctttatcaatcacgtaatactgactgataccttcattgggtacctagtgggcaataccctatggcttgtagcagtcgggtactatatctacgtcacctttcttggatactctgccctcccctttctcaaaaatactgtaattctgctttatccctttgcacccttgattcttctatacggcctgagtctagcacttggctggaactttactcataccctctgttcattctacaaatacagggtgaagtag

SEQ ID NO: 47823 - DNA, 831 bp, Artificial Sequence
  Description of Artificial Sequence: Synthetic coding sequence
atgttcctgcagaacacctgcaagcggaacgtgttcctgcccagccggaagatgctcccatctacatcagttaattcattggtacagggaaacggcgtacttaattccagagacgccgcacggcacacggcaggtgctaaacggtataaatatttgcggcggttgttccgcttccgccaaatggactttgagttcgccgcttggcagatgctgtacctgttcacgtcaccacaaagggtgtatcgtaatttccactataggaaacagaccaaggatcagtgggcacgggacgacccagccttcctcgtgctattatcaatatggctgtgtgtgagtacgatcgggtttggcttcgtgcttgatatgggttttttcgaaaccatcaaactgctcctctgggtggtccttatagattgtgtcggcgtcggcctgctgattgccacactaatgtggttcattagcaacaagtacctagtcaagagacagagccgggactacgacgtggagtgggggtatgccttcgatgtacacttgaacgccttctatccactgctggtcatcctccacttcattcagcttttttttatcaatcacgtgatcctgacagatacatttatcggttatctggtggggaatacgttatggctcgtggccgtcggctactatatctacgtgacttttttgggttactcagctttacccttcctgaagaatacagtgattcttctttacccgtttgcccctctgatactcctgtatggccttagcttggcactggggtggaatttcacccatacgctgtgcagcttttacaaatacagggtaaagtag

SEQ ID NO: 47824 - DNA, 831 bp, Artificial Sequence
  Description of Artificial Sequence: Synthetic coding sequence
atgttcctgcagaacacctgcaagcggaacgtgttcctgcccagccgcaagatgctccccagcacgagtgtaaattcattggtccagggaaatggtgtcctaaactccagagatgctgcccggcataccgccggtgccaagaggtacaagtacctgcgccgtctgttcaggttcaggcagatggactttgagtttgcagcatggcagatgttgtacctgttcacaagcccgcagagagtctaccgcaacttccactaccgcaagcagaccaaagatcagtgggcgcgggacgacccagccttcttagttctgctgagtatctggctttgcgttagcacgattggtttcggattcgtgctcgacatgggcttttttgagacgatcaagcttctcttgtgggtcgttctgattgactgtgtgggagtgggcctgttaattgcaactctgatgtggttcattagcaataagtacctcgtcaagcgccaatctagagattatgatgtggagtggggctacgcatttgatgtccatctgaatgcgttttatccgctccttgtcattctccattttattcaactgttctttatcaaccatgtgatactgacggacacctttatcggatatctagttggaaataccctgtggctggtggccgtgggttattatatttacgttacgttcctgggatacagcgcactgccctttctcaaaaacactgtgatcttactgtaccctttcgcgcccctgatcctgctgtacggactctccttagctctgggctggaatttcactcatactctatgtagcttttacaaataccgtgtcaaatag

SEQ ID NO: 47825 - DNA, 3111 bp, Artificial Sequence
  Description of Artificial Sequence: Synthetic coding sequence
atggaggtggtgggcgacttcgagtacagcaagcgggacctggtgggccacggagcctttgcggttgtgtttcgtggacgccatcggcagaaaactgattgggaagtagccatcaagtcaataaacaagaaaaatctcagtaagagccagattctgctcggaaaagagattaaaatcttgaaggaactgcagcatgaaaacatcgtagcactttacgacgtccaggagttgcctaacagcgtctttctggttatggagtactgcaatggcggggatcttgcagattacctgcaggccaaagggacgctgagtgaggacactatcagagttttcctgcaccagatcgccgccgccatgaggatcctgcactccaagggaatcattcacagggatttgaaaccccagaacattctcctaagctacgccaatagaagaaaatcgagcgttagcgggatcaggatcaaaatcgcagacttcggattcgctcggtacctccacagcaacatgatggccgcaaccctgtgtggcagtccaatgtacatggcccctgaagtcattatgagtcagcactatgacgccaaagctgatctctggtccattggaacagtaatctaccagtgcctcgtcggtaagcctccatttcaggctaactcgcctcaggatcttaggatgttctatgagaaaaatcgcagcctcatgccaagtattccacgggaaacttccccatatctggcaaacctgctgctgggtcttctccagagaaaccagaaagaccgaatggacttcgaggcgttcttcagtcatccttttctggagcaggggccagtgaaaaagtcatgccccgtgccagtccctatgtattctggaagtgtgtctggctcctcatgtggcagcagcccttcttgtcgctttgcgtctcctccctcattaccagacatgcagcacattcaggaagagaacctcagttctccaccactgggcccccccaactatcttcaggtgtctaaagattcagcatccacttcgtctaaaaactcctcctgcgacactgacgacttcgtgcttgtcccacataatatcagctcagatcatagttgtgacatgcctgtgggcactgccggaaggagggccagcaatgaattcctggtgtgcgggggacagtgtcagcctacagtgagcccacatagcgaaaccgctcctatccccgtgccgacccagataagaaactatcaacgaatagagcagaatcttacatcaacagcaagctccgggaccaatgtccatggaagcccccgatccgctgtagtccggcgctcgaatactagtccaatgggcttcctccgcccggggagctgtagtcctgtccctgccgacacagcgcagaccgtgggaagacgactgagcacggggtcttcgaggccttatagtccaagcccacttgtgggcaccatccctgagcagttttctcagtgttgttgcggccatccacagggccatgattccagatccagaaatagcagcgggagccccgtgccccaggcccagagccctcagtcattactcagcggggctagactacagagcgctccgacgctgactgacatttaccagaacaaacaaaaattgcgaaagcagcatagtgacccagtttgtccaagtcacacgggtgctggatatagttactcccctcagccatcacggcccggtagcttgggaaccagtcctactaaacatctgggctcatcgccccgatcaagtgattggttcttcaagacccctctgcccacaatcatcgggagtccgacaaagaccaccgccccgtttaaaatccccaaaacccaagcatccagtaacctgttggcgctggtaactagacacgggcccgcggaggaacagagtaaggacggcaatgagccgagagagtgtgcacactgcctcttagtgcagggttcagaaaggcagcgagccgaacagcaatcgaaggcggtgtttgggagaagtgtttcaacgggcaagctttctgatcagcagggaaaaacccctatatgtcgtcatcaaggttccactgacagtctgaataccgagcgaccgatggatatagctccagccggagcctgtggaggcgtattagcaccgccggccggaaccgccgcttccagcaaagcagtcctctttactgtcggtagtcctccacatagtgcagccgccccgacctgtacgcacatgttcctccgtacccgcactacgtccgtgggtccctcaaattccggtgggtcactgtgcgccatgtccggcagggtctgcgttggaagtcctccaggaccaggctttggatcttcccctcctggcgcagaggccgctccctctcttcgatacgtgccatacggggcctctccacccagcctcgaagggttaattacctttgaagcgcctgagctgcccgaggagaccctgatggagagagagcataccgacacactccgccacctaaatgtgatgcttatgtttacagaatgtgttcttgatctcaccgcaatgcggggcggtaacccagagctttgcacctcagcagtttcattgtaccagatacaggagtctgtggtggtcgaccagatctcacagctgtccaaggactggggccgagttgaacagcttgtcctgtacatgaaggccgcccaactgctggcagcaagcctgcatctcgctaaagctcagatcaaatctggtaagctgtccccctcaaccgccgtgaagcaggtggtgaagaacctgaacgagaggtacaagttttgtatcaccatgtgtaagaaactgactgagaagctgaaccggtttttctcagataaacaaagattcattgacgagattaattcggtcactgcagaaaagctcatatacaactgtgcagtggagatggtgcagtctgccgccctcgacgaaatgttccagcagactgaggacattgtctatcgttatcacaaggccgccctgctgcttgagggactctcccggatcctgcaggatcccgcagacatcgagaatgtgcataagtacaagtgctccatcgagagacgtctctccgctctctgccattccacagccaccgtctag

SEQ ID NO: 47826 - DNA, 3111 bp, Artificial Sequence
  Description of Artificial Sequence: Synthetic coding sequence
atggaggtggtgggcgacttcgagtacagcaagcgggacctggtgggacacggagctttcgctgtcgtgtttaggggcaggcaccgacagaagaccgattgggaagtggcgatcaagtcaattaataagaagaatctgagcaaaagtcaaatacttttgggaaaggagattaagatcctgaaggaactccaacacgaaaatattgtggccctctatgacgtgcaagagctccccaatagcgtgtttctggtcatggagtattgtaacggtggtgacttagccgactacctccaagctaaaggtacactgtctgaagacaccatcagggtgtttctgcatcagatcgctgcagctatgcggatcttgcattcaaagggcatcattcatagggaccttaagccccagaatatcttgctgtcatacgcaaacaggagaaagagtagtgtgagcggaatccgcatcaaaatcgcagacttcgggttcgcccggtatctgcatagcaatatgatggcagccacactctgtggatctcccatgtatatggcaccggaggtgattatgtctcagcattacgatgctaaggctgatttatggagtattggtacggtgatttaccagtgcttagtagggaaacctccttttcaggcaaacagcccccaggatttgcgcatgttctacgaaaagaaccgctctctcatgccgagtattccacgcgagacgagcccctatcttgctaacctgctgctggggcttcttcaaagaaaccagaaagatagaatggatttcgaagctttctttagtcacccgttcctggagcaaggtccggtaaaaaagtcgtgtcccgttcctgtgcctatgtatagtggcagcgtgtcaggcagtagttgtggcagctccccctcatgccgattcgcgtccccaccctccttacctgacatgcagcacattcaggaggagaatctgtcctcgccacccctgggccctccaaattatctgcaagtgtccaaagactctgcgtctaccagttcaaaaaactcgtcttgtgatacagacgacttcgttctcgtgccgcataacatcagttccgaccacagctgtgatatgccagtggggacggctggtcgcagggcttctaacgaattcctggtgtgcgggggccagtgccagccgaccgtgtcacctcacagtgagactgcgccaattcctgtgcccactcagatcagaaactaccagagaattgaacagaatctcacatccacggcctcctcaggaactaatgtacatgggtccccccgctccgccgtggttagacgctcaaatacttcgcctatgggattcctccgcccgggcagctgtagccctgtcccagccgatacagctcaaacagtgggtcgcaggctgagcacagggtcatcaagaccttactcaccctcacccctggtgggcaccataccagagcagttctcacagtgctgttgcggacatccccaaggccatgattcgagatcaaggaattcttctgggtcacccgtgccccaggcccagtctcctcagtctctgcttagcggagctagactgcagtccgctccaaccctgactgacatataccagaacaagcaaaaactcaggaagcagcactccgatcccgtatgcccctcccacacaggggccgggtacagttacagtccccagccttctaggcctggctctcttggaacctcacctactaagcatctgggctcctcccctaggtctagtgactggttttttaaaacccccttacctaccattattgggagccctaccaaaacaaccgccccctttaagataccaaaaacacaggcttccagtaacctccttgcattagtgactcggcacgggccggcagaggagcaatcaaaggacggcaacgaaccccgggaatgtgcacactgtctcctggttcaggggagtgaaaggcaaagggcagaacagcaatccaaagcagttttcggacggtcagtgtcaaccggaaagctgtcagaccagcaggggaaaaccccgatttgccgccatcagggatcgaccgattcactgaacactgaacggcctatggatatcgcccctgccggcgcatgcggaggcgtcctcgccccacctgccggaaccgctgcatcgtccaaggcggtactgttcacagtgggctcccctccgcattccgccgccgccccaacttgcacccatatgtttctgcggacccgtacaacctccgtgggaccatcaaacagcggcggctcactatgtgcaatgagcggcagagtttgtgtcgggagcccgccagggccgggattcgggagcagcccccccggcgccgaggccgcaccatccttacgctatgtcccatacggcgcttcccccccgtctttagagggactaatcaccttcgaggccccagagctcccagaggagacattgatggagagggagcacactgataccctccggcacctgaacgtcatgctcatgtttaccgagtgcgtgctggacctcaccgcgatgcgaggcggcaaccccgagttgtgtacttcagccgtgagcctgtaccagatacaggaatccgttgtagtggatcaaatctcgcagctgtcaaaggattggggacgggtagaacagcttgttctctatatgaaagccgcccaactgctggctgcttctctgcatctagctaaggcgcagatcaagtctggcaagctgagcccgagcactgctgtgaagcaggttgtgaagaacctcaacgagagatacaagttttgcatcacaatgtgtaaaaagttaacagaaaagctcaatagattttttagcgataagcagcgcttcatcgatgaaattaatagcgtaaccgcagaaaaactcatctacaattgcgctgtcgaaatggtgcaatccgctgcactcgatgagatgttccaacagactgaagacattgtgtacagatatcacaaggccgcactcctactggaaggcctgtctcggatcttacaggaccctgccgatatcgagaatgtgcataagtataagtgcagcatagaaaggcgcctctctgctctgtgtcactcaacggccaccgtgtag

SEQ ID NO: 47827 - DNA, 2532 bp, Artificial Sequence
  Description of Artificial Sequence: Synthetic coding sequence
atgcggctgcccgacctgcggccctggaccagcctgctgctggtggatgctgcactattatggctattacagggccccctcggcacactgttaccacaagggctgccaggcctttggctagagggtaccctcagactgggtgggctgtgggggctgttaaaactgaggggactcctgggttttgtcgggaccctcctcttaccactttgtctcgcgacccccttgacagtgtctctgcgggccctcgtcgctggcgccagccgggccccccccgcccgggtcgctagcgctccttggtcatggctcttggtggggtatggcgccgctgggctgtcgtggtccctgtgggcagtgctttcaccgcccggggctcaggaaaaggaacaagatcaggtgaacaataaggtgttgatgtggcggctgttaaaactttcaaggccggatctaccactgctggttgcagccttcttcttcttagttctcgctgtgctcggagagacgctgataccccattatagcgggcgcgtgatcgatatcctgggaggggactttgaccctcacgcattcgcgagcgcgattttttttatgtgtctgttttcctttggctccagtctgagtgccggttgtagaggaggctgtttcacttataccatgagccgaataaatttgaggattcgggagcagctgtttagtagtctcctccggcaggacctggggttctttcaggagactaagacaggagagctcaactcgagactgtctagcgataccaccctcatgagcaactggttaccccttaatgctaacgttctcctgcggagccttgttaaggttgttggcctgtacggcttcatgttgtccatatccccaagacttacattgctcagtttattgcatatgccatttactatagctgcggaaaaagtgtataacacaaggcaccaggaggtgttacgcgagattcaggacgcggtggccagagctggtcaggtcgtacgggaggccgtcggtggtttgcagacagtgcgatcattcggcgcggaggagcacgaggtttgccggtacaaggaagccctcgaacaatgccgccagttgtactggcggcgggatttggaacgtgccttatacctgttggtgaggcgtgtgctgcatctaggtgttcaaatgctcatgctgtcatgtggactccagcagatgcaggatggcgagctgacccagggtagcctgcttagtttcatgatctaccaggaaagcgtcggttcttatgtacagaccctcgtgtacatttatggggacatgctgagcaacgttggggccgcagagaaggtcttctcatacatggaccgccagcccaacttaccgtctccaggcaccctggctcccacaacgctgcaaggtgtggttaagttccaggatgtgtcctttgcataccccaaccggcctgataggcccgtgctgaagggcctcacattcactctgaggcctggcgaagtgacagctttagtaggtccaaacggaagtgggaagtccaccgtggccgccttgctgcagaatctgtatcagcccactggcggccaagtgctgttggatgaaaagcctatttctcagtatgagcactgctatctacactcccaggttgtgagcgttggacaagaacctgtgctcttcagcgggagcgtgcgtaacaacatcgcctacggtctgcagagctgcgaggacgataaggtgatggcagctgctcaggccgcgcatgctgatgactttatacaggaaatggaacacggcatttataccgacgttggggaaaagggctcacagctggctgccggccagaaacaacggctggctatcgcccgcgccctggtccgggatcctcgagtgctcattctagacgaggctacatctgctctcgacgtgcagtgtgagcaggcaaacgggttctgggttggtccgttaggcggaggttccgcgtccgagtcggacccaacaggcttcctccacgacagccgccatagactctcttctgacgtagggatgttcgtcgccttgaccaagcttggccaacctgatgctgagcagtggaactcacggctggatctgctggagaggtctcgccaggcagtcgacggggtgtgcagacacaattacaggttgggtgcacccttcaccgtgggtcggaaagtgcagcctgaggtgactgtgtaccccgagcgtacccctctgctgcatcagcacaacctgctgcactgtagcgtgaccgggttttatccaggtgatattaaaattaaatggttccttaacgggcaggaagagagggcgggcgtcatgagcacggggcctattaggaacggcgactggactttccagaccgtggtcatgcttgagatgacacccgagctgggacatgtatacacatgtctggtggaccactcaagcctcctgagtcctgtgtctgttgagtggagagcgcagagcgagtactcttggaggaagatgttgtcaggtattgcagctttcctattgggcctctag

SEQ ID NO: 47828 - DNA, 2247 bp, Artificial Sequence
  Description of Artificial Sequence: Synthetic coding sequence
atggaccagcaccagcacctgaacaagaccgccgagagcgccagcagcgagaaaaagaagacaagacggtgcaacggctttaagatgttcctggccgcgctatccttctcatacatcgctaaggctttgggcgggattatcatgaagatctccattactcaaatagagcggcgctttgacatcagttcctctttggccgggctgatcgatggcagcttcgagattggaaacctgttagtcatcgtttttgtgtcttactttggctccaaattgcacaggcccaaactgatcggaattggctgccttctgatgggcacaggttcaattttgacctcactcccgcacttctttatgggatattacaggtattctaaagagacacatataaacccatccgaaaactcaaccagttcactcagtacttgcctaatcaaccagacactgtcttttaatggcacctcacccgagattgtggagaaagactgtgtgaaggagtcagggagccacatgtggatctacgtgttcatgggcaatatgctccgcggtattggcgaaacacctatcgtaccattaggcatttcctatatcgacgattttgccaaagagggtcattcttccctgtacctaggaagccttaatgcaatagggatgattgggccagtcattggctttgccctgggcagcctgtttgcaaagatgtacgttgacatcggctatgtggacctgtccaccatccgcatcacgcccaaagattctcgatgggtaggagcatggtggcttggctttctagtctctgggctgttcagcattatctctagtatcccattcttcttcctgccaaaaaatcccaataaaccacaaaaagaacgtaagatcagcttaagcctccacgttttaaagacaaacgacgacagaaaccagactgcaaacttaacaaatcaaggaaaaaacgtgactaagaacgtcacagggttctttcaatctctcaagtctatactgaccaatccactgtatgtgatctttctgttgttaacgctgcttcaagtgtcctctttcattgggtcgtttacatacgtgttcaaatatatggagcagcaatacggccagagcgcctcccatgcgaattttctgctcggaattatcaccattcccactgttgcaaccgggatgttcttaggcggattcatcatcaagaagttcaaactgtctctggtgggcattgccaagttcagtttcctcactagcatgattagctttctgttccaacttctgtatttccctttgatatgcgagtctaagagtgtagccggcttaacactgacgtacgatggaaacaatagtgtggcttctcatgtcgacgtgccgttaagttactgcaactcagaatgtaactgtgatgagtcccagtgggagcctgtgtgcggaaataacggtatcacttatctgagtccttgcctagctgggtgtaaatcgtcgagcggcattaagaaacacaccgtgttctacaactgttcgtgcgttgaggtcacaggcctccaaaaccggaattattcagctcacctgggtgagtgccccagggacaacacctgcactaggaaattctttatctatgttgctattcaagtcatcaactcccttttctctgccaccggtggcacaacctttatactcctgaccgtcaagattgtgcagcctgaactgaaggcccttgcaatgggcttccagtccatggtcattcggacattgggaggcattcttgcacccatctattttggggcactgattgataaaacttgtatgaagtggtcgaccaatagctgcggcgcccagggagcctgccggatttataacagcgtctttttcggaattgttcagcctgagctgaaagccctagctatcgggtttcacagcatgattatgcgatccctgggcggtatattagtgcccatttacttcggtgcactaatagatacgacttgcatgaaatggtccaccaattcttgtggggctcggggcgcttgcagaatctacaactccacctacctgggacgtgcatttttcgggcttaaggtggccctgatcttccccgtactggtcctgctcacagtcttcatttttgtagttcgcaaaaagtcccatggcaaagacactaaggtgttagaaaacgaacgacaggtcatggatgaagccaatctagagtttctgaacgactcagaacatttcgtgccctctgctgaagaacagtag

SEQ ID NO: 47829 - DNA, 582 bp, Artificial Sequence
  Description of Artificial Sequence: Synthetic coding sequence
atgagcccctgcggcggcgaggacatcgtggccgaccacgtggccagctacggtgtcaacctctaccagtcctacgggccctcgggccagtatacacacgagttcgacggagatgaacagttctatgtagatctgggaagaaaggagaccgtctggtgcttacctgtcctgcgccagtttagattcgatccccagttcgctcttaccaacatcgccgtgctgaaacacaatctgaactcactaataaaaagaagcaactcaactgccgcaactaatgaggtccccgaagtaaccgtgttctcaaaatcaccagtgactctcggccagcctaatattctgatttgcctcgtcgataacattttcccacccgtggtcaacattacttggctctctaacggacactctgtgactgaaggagtaagcgagacaagtttcctttcaaaatcagaccatagcttctttaagatcagttacctgacccttttgcccagcgccgaggagtcatatgactgtaaggtcgaacattggggattggataaaccactcctgaagcattgggtgcatggcttcttgtccttttag

SEQ ID NO: 47830 - DNA, 762 bp, Artificial Sequence
  Description of Artificial Sequence: Synthetic coding sequence
ggctgcctgggcaagcggatgatcctgaacaaggccctgatgctgggtgccctggctctgactaccgtcatgtccccgtgtgggggcgaggacatcgtcgcagaccacgtcgcctcctacggtgttaacttataccagtcctatggtccaagcggacagtacacccatgagtttgatggggacgaacagttttatgttgatttgggccggaaggagaccgtctggtgtctccccgtcctgaggcagttcaggtttgatccccaatttgccctcaccaacatcgccgtgttgaaacacaacctcaactctctgatcaagcgaagtaatagtactgcagctacaaatgaggttccggaagtaacagtgttttctaagagtcccgtgaccttaggccaaccgaacatactgatttgtctcgtggataacatctttccacccgtagtcaatattacctggctttcgaacggacacagtgtaaccgaaggagtatccgaaacttcttttctcagtaagagtgaccattccttcttcaagattagttatctaaccctgcttccttcagcggaagaaagctacgattgcaaggtggagcactggggccttgataagccgcttctgaagcattggggcaaagatgagttccaccattttctgatgctgtcatgccttagctcctctgagttacccgccttctattcttacatccctaagcttgtgttccacacctcgtgggtgtctttcttcttgattttcttcttctag

SEQ ID NO: 47831 - DNA, 441 bp, Artificial Sequence
  Description of Artificial Sequence: Synthetic coding sequence
atgatcctgaacaaggccctgatgctgggcgccctggccctgaccactgtgatgagcccctgtggtggcgaggatatcgtggccgaccacgtggccagctacggagtcaatctgtaccagagttatggcccttccggccaatacacccatgagttcgacggcgacgagcaattctatgtggatctggggcggaaggaaactgtgtggtgcctgcctgtgctgcgtcaatttcgttttgacccgcagttcgccctcactaacatgtgtatcgcaatttaccgtagtcgccgggtggatctcctgcacgacttggcactgttttctggacctatctatcacattccgttcctcctacaaatgtttctactctcccctttgctgtgggacctgaattgttatatctgcagtgagctcacaaacgcctttgaactgtttccttag

SEQ ID NO: 47832 - DNA, 765 bp, Artificial Sequence
  Description of Artificial Sequence: Synthetic coding sequence
atgatcctgaacaaggccctgatgctgggcgccctggccctgaccactgtgatgtctccctgcggaggtgaagatatcgtcgcagaccacgtcgctagctacggcgtcaatttgtaccagagctacgggcccagtgggcagtacactcatgagtttgatggcgatgaacaattttacgtggacctggggaggaaagaaacagtgtggtgccttcctgtgttgcgacagtttcgtttcgacccacagttcgccttgaccaacatagcagtgctcaagcataacctgaactccctcataaagcgatcaaactcgactgccgccaccaatgaggtcccggaggtgacagtgtttagcaagagcccagtgacccttgggcaacccaacatcctgatctgtctggtcgacaacatatttccccccgtcgtgaacattacctggctgagcaacggacactccgtgaccgagggcgttagcgaaacgagcttcttaagcaagtctgatcacagtttctttaagatatcgtacctgacgctgctgcccagcgctgaggagagctacgactgcaaggtggaacattgggggctggacaagccactgctgaagcattgggagccagaaattccggcccctatgtccgagctgaccgagacagtggtgtgtgcgctcggcctatctgttggtctggtcgggattgtcgtaggcaccgtcttcatcatccggggtttacggtcagtgggtgcatcgcgccaccaaggtccattgtag

SEQ ID NO: 47833 - DNA, 498 bp, Artificial Sequence
  Description of Artificial Sequence: Synthetic coding sequence
atgacccggctgtgcctgccccggcccgaggcccgggaggaccccatcccagtgccccctcgaggccttggtgcaggggagggcagtgggagtccagtccgtccacctgtttctacttggggtccaagctgggcccagttgttagatagtgtgctgtggcttggtgctcttggcctgaccatccaagcggtcttttccaccacaggacccgctctactgctgctgctggttagttttctgacatttgaccttcttcatcgcccagcagggcatacactgccacagagaaagttgctgacaagaggccagtctcagggggccggtgaaggccccggacagcaagaagctctgctgttgcaaatggggaccgtgtctgggcagcttagccttcaggatgcactgttgctgctgctgatggggctgggccccctgctgcgagcctgtggcatgccacttacactgctcgggctggctttctgtcttcacccatgggcgtag

SEQ ID NO: 47834 - DNA, 513 bp, Artificial Sequence
  Description of Artificial Sequence: Synthetic coding sequence
atggtgaccgtgctggaccagatgaaggccggcacctacaagctgacttttgataccgaggggtactggcgaaagcggggccaggagtccttctacccccatgtggaagtagtgctgacaatcaccagcaaagcccaaaagttccacgtcccattggttctgcaccatttacccagggagctggagcgcagactggcagcgggtgggtgcctccctgtgcccgcacggtggctacacccgccgtccccccagcagtcgggtctgtgcgctcaccagggagccttagcccaccacttcctcggtaaatccaggccgccgggggagagtcattgggccgccgtgacgcaggtatccatgaagctggtgccggcgccagccaagttgagcatccggtgggacaactctggagctaagactggcagtaccgcacgccattgtcccaaccctcaagtgtctgctggacatagcgaaaaggtgccgccaactgtcgtcgggggagagacacgtgaatag

SEQ ID NO: 47835 - DNA, 780 bp, Artificial Sequence
  Description of Artificial Sequence: Synthetic coding sequence
atggccgccagccggctggagctgaacctggtgcggctgctgagcaggtgcgaggcgatggccgccgagaaaagggaccccgatgaatggcgcctggagaagtacgtcggagcgcttgaggatatgctgcaggccctcaaagtgcatgccagcaaacctgccagcgaggtcattaacgaatacagctggaaagtggactttctcaaaggaatgctgcaggccgaaaagcttacatcaagttccgagaaggctctcgctaatcaatttctagctcccggtcgcgtgccaaccaccgcccgcgaacgagttccagccaccaagaccgtgcacttgcagagtagggcccgatatacttcggagatgaggtcggagctgcttggaacagatagcgcagagcctgagatggacgttagaaagaggaccggcgtggccgggagccagccggtatcagaaaaacagctggcagcagagctcgatcttgtactgcagcggcatcagaatctacaggaaaaattagccgaagagatgttggggctggcaaggtcgcttaaaaccaatacgctggcagctcagtcagtgataaagaaggataaccaaaccctgtcccatagcctgaagatggcagaccaaaacctggaaaaactgaaaaccgagtctgagcgacttgaacagcacacccagaagagcgtgaactggctgctgtgggctatgcttatcatcgtgtgcttcatcttcatttctatgatcctgttcataagaatcatgccgaaactgaagtag

SEQ ID NO: 47836 - DNA, 177 bp, Artificial Sequence
  Description of Artificial Sequence: Synthetic coding sequence
atggccggccccgagagcgacgcccagtaccagttcaccggcatcaagaagtatttcaattcatacaccctgaccggacggatgaattgcgtactagctacttacggatccatcgctctgattgttctctatttcaaactgaggtctaaaaagactccggccgtcaaagctacatag

SEQ ID NO: 47837 - DNA, 177 bp, Artificial Sequence
  Description of Artificial Sequence: Synthetic coding sequence
atggccggccccgagagcgacgcccagtaccagttcaccggcatcaaaaaatacttcaattcctacaccctaacagggagaatgaattgtgtgctggccacctacggctccatagctctgatcgtgctttacttcaagctgcgtagcaaaaaaacccccgctgtgaaggccacctag

SEQ ID NO: 47838 - DNA, 177 bp, Artificial Sequence
  Description of Artificial Sequence: Synthetic coding sequence
atggccggccccgagagcgacgcccagtaccagttcaccggcatcaaaaaatacttcaattcttacacactcactgggagaatgaactgcgtgttggccacttacgggtctatcgctctgatagtgttgtatttcaaactgaggtccaagaagacccctgccgtcaaagctacatag

SEQ ID NO: 47839 - DNA, 177 bp, Artificial Sequence
  Description of Artificial Sequence: Synthetic coding sequence
atggccggccccgagagcgacgcccagtaccagttcaccggcatcaagaaatacttcaattcgtatactctgaccggcagaatgaattgtgtgctcgcgacttacgggtccatagcgctgattgtgctctacttcaaactgcgcagcaagaagacaccagcggtaaaggccacctag

SEQ ID NO: 47840 - DNA, 177 bp, Artificial Sequence
  Description of Artificial Sequence: Synthetic coding sequence
atggccggccccgagagcgacgcccagtaccagttcaccggcatcaaaaagtactttaattcctacaccctaacagggagaatgaattgtgttcttgcaacatacggctcaatcgccttgatcgttctgtactttaagttacggtcaaaaaagacgcccgcagtcaaggccacatag

SEQ ID NO: 47841 - DNA, 792 bp, Artificial Sequence
  Description of Artificial Sequence: Synthetic coding sequence
atggacaacagctggcggctgggccccgccatcggcctgagcgccggacaaagtcagctcctcgtgagtctcttattgctgctcacccgtgtacagcccggaactgatgtcgcagcccctgagcacatctcatatgtgccacagctgtcaaacgacaccctcgccggacggcttaccttaagcacatttactcttgagcagccgctggggcaatttagtagccataacatatcggatctggatacgatctggttggtcgtggccctgtctaatgctactcagtccttcacagcgcctaggacaaaccaagatataccagccccagcaaacttttcccagcggggctattaccttactctacgagccaaccgggtcctctatcaaacacgcggccagctgcacgtgctgagggtgggtaacgatactcactgtcagcccacaaagatcggctgcaatcaccctctgcctggcccaggtccataccgagtgaaattccttgtgatgaacgacgagggaccagtggccgaaaccaagtggtccagcgacacccggctgcagcaggcccaggccttgcgggcagtgccagggccccagagcccaggcactgtggtgattatcgcaatcctatcgattttgctggccgtgctattgaccgtgttacttgctgtgctgatctacacttgttttaattcttgccggtcaacatcactcagcggacccgaagaggccggctcagtccgcagatacacaacacatctggcattctccactccagccgagggtgcttcctag

SEQ ID NO: 47842 - DNA, 1170 bp, Artificial Sequence
  Description of Artificial Sequence: Synthetic coding sequence
atggccctgacccccgagagccccagcagcttccccggcctggccgccaccggatcctccgtgcccgagccacctggcggaccgaatgcgactttaaactcaagctgggcgagcccgactgagccctcaagtctcgaagacttggtcgcgacagggactattggaacactcttgtctgccatgggggtagtcggcgtagtgggtaatgcttatactcttgtggtgacctgtagaagcttgagagccgtcgctagtatgtacgtgtacgttgtgaaccttgctctggccgacctcctctacctgctctccattccctttatcgtcgctacgtatgttacaaaagagtggcacttcggagacgtcggctgcagagtcctttttggactggattttttgacgatgcacgcctccattttcaccctgacagtcatgagcagtgagaggtacgctgcggtgctgcgccctctcgatacggtgcagaggcctaagggctacagaaagctgctggctttaggaacttggctccttgccctattgctgaccctcccagttatgttagctatgcggctggtgcgtcgagggccaaaatcattgtgcctgcctgcttggggcccaagggcccatcgagcctatctcactttgctgttcgctacctccattgctggccccggcttgctgattgggctcctatatgctcggctggctcgggcttaccggcgaagccagcgcgccagttttaaaagggcgagacggccaggtgctcgggcactgcggctggtcctggggatagtcttgcttttctgggcatgcttcctgcctttctggctgtggcaacttctcgcccagtaccaccaggcccctcttgctcctcgaacagcccggattgtcaattacctgaccacgtgcctcacctacggtaactcctgcgcaaatccattcttatatacactcttgactcggaactaccgggatcatctgcggggacgcgttagaggccccggaagcgggggcggacggggccccgtgccaagcttacaaccccgtgcacgcttccaaagatgttccggcagaagcctgtcaagctgctcgccccagcccaccgattcactggttttggctcccgcggcccctgccaggcccgcgcccgaagggccaagagccccggcttag

SEQ ID NO: 47843 - DNA, 1578 bp, Artificial Sequence
  Description of Artificial Sequence: Synthetic coding sequence
atgatgccctggctgtggaccgccccccaccagaaggagagccagaaggccgatgagtaccttagagagatacaggaactaggccagctgactcaggccgtgcagcagtgtatcgaagcagcaggccatgaacaccaacccgacatgcaaaaaagcttgctacgggttggtctcgacgggcgcgccggtgaggggggcgccgggagaggatgggacggccagcaggggtctagcctgctgtctccgagcgggtccagtcaagcagcatccttcggcaagtgcttcctggacagatttcctccagacagtttcgttcatatgtgccaggacctgcgagtgttgaatgctgtgcgagattaccacataggaatcccactgacctactcacagtataagcagctcacaatccaggtgctgctcgacaggctcgtcctacgacgcctgtacccactggccattcagatttgcgaatacctccgcttacccgaagtgcagggagtgtccagaattctggctcactgggcatgttacaaggttcaacagaaagacgttagcgatgaggatgtggcccgcgccatcaaccagaagcttggggataccccaggagtcagctattctgacatcgctgctagggcctacggctgcgggagaaccgagctggctatcaagctcttggagtatgagcccaggtcgggtgagcaggtccccctcctgctaaaaatgaagcgctccaagcttgcattgagtaaagccatagaatcaggagacactgacctggtgtttacagtgctcttgcaccttaagaatgagctcaataggggagacttttttatgacgctacgaaaccaacctatggccctgagcctgtacagacagttctgcaagcaccaggaactggaaacattgaaggatctgtataatcaagatgataaccatcaggagctcggctcctttcatattagagccagctacgcggcggaggaaaggattgagggaagagtggctgctctgcagaccgccgcagacgctttttacaaggctaaaaatgagttcgcagcaaaggctactgaggatcaaatgaggttactcagactgcaacggcgcctagaagatgaactaggaggacaattcctggacctgagcctccatgacactgtgaccaccctgatactgggagggcacaataaacgcgcagagcagctcgcgagggattttcgaatacccgataaacgtctctggtggcttaagctgacggccctggcagatctggaagactgggaggagctggaaaagttctccaagtctaaaaagtcccctattggatacctcccattcgttgagatttgtatgaagcagcacaacaagtacgaggccaaaaaatacgcttcacgggttggacccgagcaaaaggttaaagcactcttgctggtgggtgacgtagcgcaggctgctgatgtcgctatcgaacatcggaatgaagcagagctgagcctcgtgcttagtcattgcacgggcgccactgacggcgctacggccgacaaaattcaaagagctagagcgcaagctcaaaaaaaatag

SEQ ID NO: 47844 - DNA, 2520 bp, Artificial Sequence
  Description of Artificial Sequence: Synthetic coding sequence
atggactgctacaccgccaactggaaccccctgggcgacagcgccttttatagaaagtacgaactgtactccatggattgggacctgaaagaggagctgcgggattgtctcgtcgccgctgccccttatggcggcccaatcgctctgctgcgcaatccatggaggaaggaaaaggctgccagtgtgaggccggtcctggacatctactctgcttctggaatgcccttagcatcacttctgtggaagagtggccccgtcgtgtctcttggttggtcggctgaggaggaattactgtgcgtgcaagaggacggggcagtccttgtgtatggtctccatggcgactttaggaggcatttctctatgggcaatgaagtgttgcagaacagagtgctggatgccaggatatttcacacggagtttggatctggcgtagctatcctaacaggcgctcaccggtttaccctgagcgctaatgtgggggatttaaagctacgcagaatgcccgaggtgcctggcctccagagtgctccctcttgttggaccgtcctgtgtcaggatagagtggcccatatccttctcgcagtgggccctgacctgtatttactggatcacgctgcctgtagtgcggttaccccacctggcctagcacccggtgtgagctcttttttgcagatggccgtttcattcacatataggcacctggccttatttaccgacaccggttatatctggatgggaaccgctagtttaaaggaaaagctgtgtgaatttaactgcaacatcagagccccacccaagcagatggtgtggtgttcacgcccaaggtcaaaggagcgcgctgtagttgtggcctgggagagacgactgatggttgttggggatgcgcccgagtcaatacagtttgtactggacgaggatagttacctggtccccgaacttgacggagtgagaatcttttctcgctcaacccacgaattcctgcacgaggtgcccgccgcatccgaggagatcttcaagattgcctccatggcccccggggctctcctactcgaagctcaaaaggagtatgaaaaggaaagccagaaggcggatgagtatctgcgcgagattcaggagctcggtcagctgacacaggctgtgcagcaatgtattgaggcagccggccatgagcaccaacctgatatgcagaaatctctgctgcgggccgcctcctttgggaaatgcttcctggatagattcccccccgactcctttgtgcacatgtgccaggatctacgggtattgaatgccgtccgggactatcatatcggaattccgctgacatatagtcaatacaagcaactaacgattcaggttctgctggataggctggtgttacgacgactgtaccctctagctatccagatatgtgagtatctccgcctgccggaggtccagggcgtctcaagaattctggcccactgggcttgctataaagttcagcagaaagatgtgtctgacgaagatgtagctagagcgatcaatcagaaactcggtgacaccccgggggtttcctattctgacattgctgcgagggcatatggctgtgggagaactgaactcgccatcaagcttctcgaatacgagccccggagtggcgaacaggtcccgttgttgctgaagatgaaacggtccaagctagccctgtcgaaggccattgaaagcggggataccgatctggtgtttaccgtactgctgcacctgaaaaacgagctgaatagaggtgatttttttatgacactccgaaatcagccaatggccctcagcttgtacagacaattttgcaagcaccaggaactggagacccttaaagacctctacaatcaggatgataaccatcaagagctgggaagttttcatattagagctagttatgccgccgaagaaaggattgaaggacgagtggctgccttgcagactgctgccgacgctttctataaagcaaagaatgaatttgccgcgaaagcgaccgaggaccagatgagacttctgaggttgcaaaggaggcttgaagatgagctgggaggccagttcctggacctcagtctacacgatacagtgaccaccttaatcctgggtggccataacaagcgggcagaacaactcgctcgcgactttcgtatcccagacaagcgactgtggtggctcaaactcacagctctggcagatctagaagactgggaggaattagagaagttttcgaagtcaaagaagagccccatcggctacctgcctttcgttgagatatgcatgaagcagcataataagtacgaggctaaaaagtacgcatccagggtgggtcctgagcaaaaagtgaaggctttgctgttggtaggcgacgtggcccaggcggccgacgtcgccatcgaacatagaaatgaggccgagttgtctttagttctgtctcactgtactggtgcaaccgacggggctactgccgacaaaattcagcgagccagggcccaagcccagaagaagtag

SEQ ID NO: 47845 - DNA, 2088 bp, Artificial Sequence
  Description of Artificial Sequence: Synthetic coding sequence
atggactgctacaccgccaactggaaccccctgggcgacagcgccttctaccggaagtatgaattgtattcgatggattgggacctgaaggaagagctccgcgactgcctggtcgctgccgcaccttacgggggaccaatagccctgcttcgcaatccctggaggaaggaaaaagcagcgagcgtgaggcctgtcctagacatctactcagcatctggcatgcctctcgcgtctttgctgtggaaatccggacctgttgtgtcacttggttggagcgccgaagaagaactgttatgcgtgcaggaagacggagccgtacttgtgtacggcttgcatggtgatttcaggagacacttctcaatgggtaacgaggtccttcagaatagggttctggacgcccgcatatttcacactgaatttgggtcaggggtggctatcctgacaggcgcacatcgattcacactcagtgctaatgttggggatttaaaactccgaagaatgcccgaagtgcccggcctccaaagtgccccttcgtgttggacagttctatgccaggatagggtggcccacattctactggctgtgggccccgatctctatctgctcgatcacgctgcctgctcggccgttacacccccaggtctcgctccaggagtctcttcctttctgcagatggccgtgagtttcacttacagacatctggctttgtttaccgacacgggttatatctggatgggcacagctagcctcaaggaaaagctttgtgaatttaattgcaacatcagggctcctcccaagcagatggtatggtgtagccgccctagatccaaggaacgcgctgtggtagttgcctgggaacgtagactaatggtggtcggcgacgcccctgagagcatacagtataagcaacttactatccaggtgctgctggatcgcctggttctgcgccgtctctatcccctggcgatccaaatttgcgagtaccttcgcctaccagaggtccagggcgtttctaggatacttgctcactgggcctgttacaaagttcagcagaaggatgtgagcgatgaggatgtcgcaagggctatcaaccagaaactgggtgatacgcctggagtcagttactctgatatagcggcaagagcctacgggtgtggcaggaccgaactggcaataaaattactggagtatgaacctagaagtggcgaacaggtgcccctgctgctcaagatgaaacggtcaaagttggccttgagcaaggcaatagagtccggtgataccgacctggtttttaccgtgttgctgcaccttaagaacgagctaaatcgcggggatttttttatgaccctgaggaaccagccaatggcactatcactgtataggcagttctgtaaacaccaggaactggaaacccttaaagatttgtacaatcaagacgataaccatcaggaactaggaagctttcatattcgtgcttcatacgccgccgaggagaggattgaaggccgagtggcagctcttcaaaccgccgcagatgccttttataaggccaaaaacgagtttgccgccaaagccactgaggatcagatgagacttctgcggctgcaaaggcgtctggaggacgaactaggtggccagtttctcgacctgtccttgcacgatacagtcactactctgatccttgggggccacaacaaacgcgccgaacaactcgcccgggacttcagaatccctgataaaagattgtggtggctcaagcttactgcactggctgatctggaggattgggaggagctggagaaattcagcaagtcaaagaaatcaccaatcgggtacttaccctttgtggaaatatgcatgaagcagcacaataagtatgaagctaaaaaatacgcgtctagagttggtccagaacagaaagtgaaagcattgttactggtgggagatgtggctcaagctgccgatgttgcaattgagcatcgcaatgaagctgaactgagtctggtgctgtcccattgtaccggcgccacggacggggcaacggccgataaaattcaacgcgctcgcgcccaggcacagaaaaaatag

SEQ ID NO: 47846 - DNA, 684 bp, Artificial Sequence
  Description of Artificial Sequence: Synthetic coding sequence
atgggcgcccccctggaggtgctgcagaaccgggtgctggacgccaggattttccacacagaattcgggagtggcgtggcaattttgaccggtgcgcatcgctttacgttgagcgccaacgttggagacctgaaattgcggaggatgccggaggtccccggactgcagtcagcgcctagctgctggactgtgctgtgtcaggacagagttgcgcacattctgcttgccgtgggtccagatttgtacttactggatcatgccgcctgctctgccgtcacgccacctgggctggcgccaggcgtatcctcctttctccagatggccgtttcattcacctatcgtcatttggctctgttcactgacaccggctatatctggatgggcaccgcttcactcaaagagaaattgtgcgagtttaattgcaacatccgtgctccccctaaacagatggtgtggtgcagccgaccgcgatctaaggaacgcgctgtcgtggtggcatgggaacgaagactaatggtcgtcggagatgccccagaatctattcagtttgtgctggacgaggattcataccttgtccccgaactagacggggttcgcatcttctccagaagtactcatgagttcctccatgaagtccccgcagcgagtgaagagattttcaagatagcttccatggccccttag

SEQ ID NO: 47847 - DNA, 825 bp, Artificial Sequence
  Description of Artificial Sequence: Synthetic coding sequence
atgggcgcccccctggaggtgctgcagaaccgggtgctggacgccaggatcttccacacggaattcgggtccggagtcgccattctcactggcgcgcacaggtttactctatccgctaacgttggcgatctcaagctgcggagaatgcctgaggttccaggattacaatccgcaccaagctgctggacagtcctgtgccaggatagagtggctcatatactcctggccgtcgggcccgatttatatttgcttgatcacgctgcctgttcggccgtgacaccgcctggtctagctcctggagtgagtagcttccttcagatggcagtgtctttcacttatcggcatctggcactgttcacggacaccggttacatctggatgggtaccgccagccttaaagaaaagctctgtgagttcaattgcaacatcagggcaccccctaagcagatggtttggtgctcccggccacggtccaaagaacgggcagtggtagtggcttgggaacgacgcctcatggtggttggagacgcccctgagtctatccagtacaagcagctgactattcaagtgctccttgaccgccttgtcctccgccgtctgtatcccctggctattcagatctgtgagtatctgcggctgcctgaggtgcaaggcgtcagtcggattctcgctcactgggcatgttataaagtgcaacagaaagacgtgtctgatgaggatgtggcccgagcaattaaccagaaactcggcgacacacccggggtgtcctacagtgacattgccgcccgagcctatggttgtggtcgaacggagcttgctatctag

SEQ ID NO: 47848 - DNA, 711 bp, Artificial Sequence
  Description of Artificial Sequence: Synthetic coding sequence
atgcccccccgggagctgagcgaggccgagcccccccccctgcgggctccaacgcccccacctcggagacggtcagcacctccagagcttggaatcaagtgcgtcttggtcggagatggagcagtgggaaaatcatctttgatcgtgagctatacatgtaatggataccctgcccgttataggccaaccgccctggacaccttttccgtgcaggtgctggtggacggcgcacctgtgaggattgagttgtgggacactgcaggacaagaggattttgataggctaaggtcactgtgttacccagatacggatgtgttcctggcttgcttcagtgtggttcagcccagttcgttccagaacataactgagaaatggctgccagagatccgtacacacaacccccaggcaccagtcctgctcgtgggcacccaggccgacctcagagatgacgtgaacgtactaattcaactggaccagggcggacgagagggaccggtccctcagccgcaagcccaagggctcgctgaaaagatacgcgcctgttgctatcttgagtgttccgcgctgactcagaagaatctaaaagaggtctttgattctgcgattctgtccgctatcgagcacaaagcccggctcgaaaaaaagttaaatgccaaaggagttcgcacactgtcaaggtgtaggtggaagaagttcttttgcttcgtctag

SEQ ID NO: 47849 - DNA, 561 bp, Artificial Sequence
  Description of Artificial Sequence: Synthetic coding sequence
atggccggccaccggctggtgctggtgctgggcgacctgcacatccctcacagatgtaattcactgccagccaagttcaagaaacttctggtgcccggaaagatccagcatatcctgtgtactggaaatctgtgcacgaaggagtcatatgattatctcaagaccttagcaggcgacgtgcacatcgttcgaggtgactttgacgaaaatctcaactacccagagcagaaggtggtgactgttggacagtttaaaatcggtttaatacacgggcatcaggttataccatggggcgatatggcatctcttgcgttactgcagcgacagttcgatgttgatatacttatcagcggtcacactcacaaatttgaggcctttgagcacgagaacaagttctacatcaatccaggttctgcaacaggcgcttataacgctttagaaactaacatcatacctagctttgtcttaatggacattcaggcctcaaccgtggtgacttatgtgtaccaactcattggtgacgatgtgaaagttgaacggatcgaatacaagaagccctag

SEQ ID NO: 47850 - DNA, 264 bp, Artificial Sequence
  Description of Artificial Sequence: Synthetic coding sequence
atggccagcctggccctgctgcagcggcagttcgacgtggacatcctgatttcagggcacactcataagttcgaagcttttgaacacgaaaacaaattctacatcaacccaggaagcgccacaggagcatacaacgctctcgaaactaacatcattccatcctttgtcctcatggacatccaagcaagcacagtcgttacgtacgtgtatcagctgattggagacgatgttaaagtagagagaattgagtacaagaaaccctag

SEQ ID NO: 47851 - DNA, 549 bp, Artificial Sequence
  Description of Artificial Sequence: Synthetic coding sequence
atgctggtgctggtgctgggcgacctgcacatcccccaccggtgcaattccctccctgcgaagtttaaaaaattgctggtgccaggcaagatacagcacatcctctgtaccggaaatttgtgtaccaaagagtcctacgactatctgaagacactcgcgggcgatgtgcacatcgtacggggagatttcgacgagaatctcaactacccggagcaaaaggtggtgaccgtcggccaattcaaaataggactcatacacgggcaccaggtgattccctggggggacatggcctcgctagctctgctccaaagacagttcgatgtggacattttaatcagtggccacacccataagttcgaggcctttgaacacgagaacaaattctacatcaatccaggaagcgcaacaggggcttataacgccctcgagactaacattataccctcttttgtgctgatggatatccaggcttcaaccgttgtgacatatgtataccagctcatcggagacgatgtcaaggttgaacgcatcgaatataagaaaccttag

SEQ ID NO: 47852 - DNA, 2172 bp, Artificial Sequence
  Description of Artificial Sequence: Synthetic coding sequence
atggccgccgccgccaccatggccgccgccgcccgggagctggtgctccgcgctgggacaagtgacatggaggaagaggaaggaccactggctgggggccccgggctacaggagcccctccagctcggggaactggacatcacatccgacgagtttatccttgacgaggttgatgtgcacattcaggccaatcttgaagacgaactcgtgaaggaggctctgaagacgggggttgatttgagacactactcgaagcaagtcgaactggagctgcaacagatcgaacaaaaaagcattcgtgactacatccaggagagtgaaaatatcgcatccctccataaccaaattaccgcatgtgacgcagtcctggaacgaatggagcaaatgcttggcgctttccagtctgatctgtcatcaatctcctctgaaatcagaacgcttcaggagcagagcggtgcaatgaatatccgcttgcgtaatcgccaggccgtgcgagggaaactgggcgagctcgtggacggtctggtggtgccttccgctctggtaaccgccattctagaggctcccgtcactgaaccgcggttcttggaacagctacaggagctcgacgcgaaagccgccgctgtgcgagagcaggaggcgcggggcactgccgcttgcgccgacgtgaggggtgtgctggacagactgcgcgtgaaggctgtgacgaagattagggagtttatattgcaaaaaatctactcctttcggaagcctatgactaactatcagatcccacagacagccctactgaaatataggttcttctatcaattcttactgggcaatgaaagagcgactgcgaaggaaatacgtgatgaatacgtggaaaccttgagcaagatttacctttcgtactaccgatcttacttgggtagacttatgaaggtgcagtacgaggaagttgcggagaaagacgatctgatgggcgtcgaagatactgccaagaagggcttcttctccaagccatccttgaggagccgaaatactatctttacgcttgggaccagaggaagtgttatctctcccaccgagctggaagctccaatcctcgtgccccatacagcccagaggggggagcagcgttacccgttcgaggccctgttccggagccagcattacgctttactggataactcatgtcgagagtaccttttcatatgtgaatttttcgtggtcagtgggcccgctgctcatgatcttttccacgccgtcatgggacgaacactgtcgatgacgttaaagcaccttgattcttatctggccgactgctacgacgcaatcgccgtcttcctgtgcattcatattgttctgagattccgcaacatcgctgctaagcgggacgttcccgcccttgatcggtattgggaacaggtgctggccctgctatggccgcgcttcgagctgatcctggagatgaatgtgcaaagtgtgagaagcacggaccctcagcggctgggtggactggataccagaccacactatatcaccagacggtatgcggagttctcctcggccttggttagcataaaccagaccatacccaatgagagaactatgcaattactggggcagctgcaggtggaggttgagaacttcgtgttgcgtgttgcagccgaattttccagccgaaaagagcaactggtttttttgattaacaactacgacatgatgctgggggtcttgatggagagggctgccgacgactctaaggaggtggagagctttcagcagttgttgaatgctcgcacacaggagttcattgaggaactactttccccccccttcggcggccttgtggcgttcgtgaaagaagccgaagcgttaattgaaaggggacaagcggaaagacttcgcggagaagaagctcgagtaacacagcttatacgtggttttggttctagctggaagagcagcgttgagagcctgtcacaagacgtaatgagatcattcaccaattttcggaacggaacctcaattattcagggagcactaacacagttaatacaactgtaccatcggtttcatcgggtgctgtcacagccacagctgagggctctacctgctcgcgcagagttgattaatattcaccacctgatggtggagttaaagaaacataaaccaaacttttag

SEQ ID NO: 47853 - DNA, 2106 bp, Artificial Sequence
  Description of Artificial Sequence: Synthetic coding sequence
atggaggaggaggagggccccctggccggcggccccggcctgcaggagcccctacagctcggtgaactagacatcacttccgacgagtttattctggatgaagtcgacgtacatattcaagccaacctggaggacgagttggtgaaagaggcattgaagaccggagttgatctgagacactattccaaacaagtcgaattagagttacaacaaatcgaacagaaatccatccgtgactatatccaggagtcggagaatattgctagccttcacaatcagatcactgcctgcgacgccgtgctcgagcgtatggagcagatgctgggagcctttcagtccgatctgagcagcatttcttccgagatccgcacactgcaggagcagtctggggcgatgaacattcgcttaaggaacagacaagccgtgagaggaaagctcggcgaactagtggatggcttggtggtgcccagcgcactggtaacagctatcctagaagctcccgtcaccgaacccaggttcctggaacaacttcaggagcttgatgccaaggccgctgccgtgagagaacaggaggctcgtggaacagccgcttgcgcagatgtccggggggtgctggacagactcagggtcaaagctgttaccaagatcagagaatttatccttcagaagatctatagcttcaggaagcccatgactaactatcagattcctcagactgctctcttaaagtataggttcttctaccagtttttactagggaatgaaagagctaccgctaaagagattagagacgagtacgtggaaactctctccaaaatctacctgtcctattatagatcctacctaggcaggcttatgaaggtgcagtacgaagaagtggccgagaaagatgatttaatgggcgtcgaggacacagcaaagaaaggcttctttagtaagcctagcctgcggtcgagaaatacaattttcacgctgggcaccagaggtagcgttatttcgcctacagaattggaagcaccaattttggtaccccatacagctcagcggggagagcagcgctaccccttcgaggctctattccggtcccagcattacgcactcctcgacaattcatgcagagagtatctcttcatatgcgaattcttcgtcgtgtccggccccgctgcacatgacctctttcacgccgtgatgggcaggactctatcaatgaccctcaaacatctggacagttatctggcagactgttatgacgcgatcgctgtgtttctgtgcatccacatcgtgctgcgctttcgaaacattgcggccaaaagagacgtccccgccctggatcgatattgggaacaagtgcttgccctgctctggccgaggtttgagctgatcttggagatgaacgtgcaatccgtcagaagtactgacccccagaggctcggtgggttagataccaggcctcattacattactcgtcggtacgccgagtttagttccgcccttgtctcgatcaaccaaacgatccccaacgagagaaccatgcaactcttggggcagcttcaggttgaagtggagaactttgttctacgtgtggcagccgagttttctagcaggaaggagcagctggtctttctgattaacaactacgacatgatgctgggcgttctgatggagagagcagccgatgatagcaaggaggtggaaagctttcaacagctgctcaatgcacgcacgcaagagttcattgaagagttactttctccacctttcgggggcctcgtcgcgtttgtcaaagaagccgaagctctcatcgaaagggggcaggccgaacgcctgcggggggaagaagcgcgtgtcacgcagctcattcgcggattcggatctagttggaagtcatccgttgagtccctgagtcaagatgtcatgcgatcctttaccaatttcagaaacggtacttctatcattcagggtgccctgactcagctgatccagttatatcacaggttccatcgggtgttgtcgcagccccagttgagggcgctcccagcccgtgctgagctcatcaatatccatcacctgatggtcgagctgaaaaagcacaaaccaaatttctag

SEQ ID NO: 47854 - DNA, 2172 bp, Artificial Sequence
  Description of Artificial Sequence: Synthetic coding sequence
atggccgccgccgccaccatggccgccgccgcccgggagctggtgttgcgcgctggcacctccgacatggaggaggaggagggccctctggccgggggtcccggcctgcaggaaccacttcagctaggagaattagacatcacctccgacgaatttattctggatgaggttgacgtgcacattcaagccaatcttgaggacgaactggtgaaagaagcactgaaaaccggagtcgaccttagacactactctaaacaagtggagctggagctacagcagattgagcagaagtctattcgggactacatccaggaaagtgaaaacattgctagcctgcacaaccaaatcacggcttgtgacgctgtgctcgagaggatggaacaaatgctcggtgcattccaaagtgatttatccagcatttcaagtgagattaggacccttcaggagcaatccggcgccatgaatatccggctgcgaaaccgtcaggcagtgcgcggcaagcttggcgagctggtggacgggctggtcgtaccctctgccctagttacggcaatcctggaggcccctgttacggagcctagatttctggagcagttgcaggagctggacgccaaagccgccgcggttagggaacaggaggccagagggactgctgcttgcgccgacgtgagaggcgtgctcgatcgcttgcgggtgaaagcggtcacaaaaatccgtgagtttattctgcagaaaatctacagcttccggaagccaatgacaaactatcaaatcccccagactgctctgttaaagtaccggttcttctaccagtttcttctgggaaacgagcgcgccacagcgaaagagatccgagatgaatatgtcgaaacactgtctaaaatctacctgtcgtactacagatcttatctcggaagactgatgaaggtccaatatgaagaggtagcagagaaagatgatctgatgggtgtcgaagatacagcaaagaaggggttcttctcaaagccatcactgaggtccagaaacacaatcttcacactaggtaccagaggaagcgttattagtccgaccgaactcgaggctccaatcctggtgccacatacggcccagagaggagaacaaagatacccatttgaagccctgttcaggagtcaacactacgccttgttggacaactcttgccgtgaatacttgttcatttgtgagtttttcgttgtgtcaggcccagctgcacatgacctattccacgccgtcatggggcgaacactgagcatgacactcaaacatctggattcatacttagctgactgctatgacgctatcgcggtattcctgtgtatccacattgtgcttcggtttcgcaacatagctgcaaaacgcgatgtgcccgccctggataggtactgggagcaggtgcttgcccttctctggcctcgctttgaactcatattggagatgaatgtacagagcgtgcgatcgactgacccccagcgccttggaggtttagatacgcggccgcactacatcactagacgctatgcagagtttagctcagcactggtttccattaatcagaccataccaaacgagcgcacaatgcagctgttgggccagcttcaggtcgaagtggagaacttcgtcctccgagttgccgccgaattctcaagccgtaaggagcagctggtgtttcttatcaataactacgatatgatgttaggtgtcctgatggaaagggcggccgatgattcaaaagaagtggagtcctttcaacaattgctgaatgcccgtacacaggagttcatcgaagaattgctgtccccacctttcggaggactagtcgcttttgtcaaagaggctgaagccctcattgaacgcggacaagccgagaggctaaggggggaagaagctcgggtgacccagctgatcagaggtttcggaagctcttggaagagttctgtcgaaagccttagtcaggatgtaatgcgaagttttacgaactttaggaacggcacgtctattatccagggggccctgacccagctcatccaactttaccaccgctttcacagagttttgtcgcagccgcaactgcgggcactccctgcacgggccgagctgatcaatatccaccatctaatggtggaattaaagaaacacaaacccaatttttag

SEQ ID NO: 47855 - DNA, 1797 bp, Artificial Sequence
  Description of Artificial Sequence: Synthetic coding sequence
atggagcagatgctgggcgccttccagagcgacctgagcagcatcagctcagagatcagaactctgcaggagcaaagtggagcaatgaatatccgtttgagaaatcgccaggccgtgcgaggaaaactgggagagttagtcgatggtttggtcgtcccttccgcattggtaactgctattctggaggcccctgtgactgagccaagatttctcgagcagctgcaggaactggatgccaaagcagccgcagtccgagaacaggaagcacgtggtaccgcagcttgtgctgatgttaggggcgtgctcgatcgcctccgcgtcaaagcagtgaccaagattagggaatttatcctccaaaagatttatagctttagaaaacctatgaccaactaccaaattccccagacagccctgctgaaatatcgtttcttctatcaattcctgctcggaaacgagagggccacagcaaaggagatcagggatgaatatgttgagaccctgagcaaaatctatttatcctactaccggtcctacctgggacgattaatgaaggttcaatatgaggaagtagccgaaaaggatgacctgatgggggttgaggataccgcaaaaaaaggatttttctccaaaccatcactgagatctcgcaatacaatatttacgctaggcacgcgaggttctgtcattagccccacagaactggaagcaccaatccttgtaccacataccgcacagcggggggaacagaggtacccttttgaagccttgtttagatcgcagcactatgctctccttgacaactcctgtagagagtatctcttcatatgcgaattctttgtcgtttctggccccgcggcccatgatctgtttcacgcggtcatgggccggaccctttccatgaccctgaaacacctggattcctatttagcagattgctacgatgccatcgccgttttcctgtgcattcatattgttctgaggtttagaaatatcgcggccaaacgggacgtgcccgctctggaccgctactgggagcaagtccttgctcttttatggccccgcttcgagctcattctggaaatgaacgttcagtctgtccgatccacagatccccagcggctgggagggcttgatactagaccacattacattacacggcgttacgcggagttctcctccgcactggttagcatcaaccaaactatacctaacgagcgaaccatgcagctcctcgggcaactgcaagtcgaagtggagaatttcgtgcttagggtggcagcggaattctcaagtcgaaaggaacaacttgtgttcctgattaataattatgacatgatgctgggggtgttgatggaacgagcagccgacgacagcaaagaagtagaatctttccagcagctgctgaacgcccggacacaggaattcattgaagaactgctcagccctccatttggtggtctggttgctttcgtgaaggaggccgaggccctcatagagcgcgggcaggctgagcggctccgaggtgaagaagcaagagtcacccagcttatacggggcttcggatcaagctggaaatcttcggtggaaagcctctcccaagacgtcatgcgatctttcacgaatttccgtaacgggacctcgatcatccagggagccctcacacagttaatccagctctaccacagattccacagagtcttgtcacagccacagctgcgcgctctgcccgcccgtgcagaactaatcaatatccatcacctgatggtagaactgaagaaacacaagcccaatttctag

SEQ ID NO: 47856 - DNA, 2172 bp, Artificial Sequence
  Description of Artificial Sequence: Synthetic coding sequence
atggccgccgccgccaccatggccgccgccgcccgggagctggtgctgagggctgggacctctgacatggaagaggaagaagggcctctggcaggcggcccaggtcttcaggagcccctccaactcggcgagttagatattacatctgatgaatttatcttggatgaggtcgatgtgcatattcaggccaacttggaggacgagcttgtgaaagaggcactgaaaacaggcgtcgatctcaggcattactccaagcaggtggagctagagctgcagcaaattgaacagaagagtatcagggactacatacaggagagtgaaaacattgcatcgctccataaccagatcactgcttgcgacgcagttttagaacgtatggagcaaatgctgggagccttccagtctgacctcagttccatctcttccgagattcggaccctgcaggaacagtcaggagcaatgaatataaggctgcgaaacagacaagcagttcgcgggaaactgggagagcttgtggatggtttggttgtcccaagtgccctcgtcacagccattcttgaggccccagtcacagaaccacgtttcctcgagcagctgcaggagctggatgccaaagcagcagctgttcgagaacaagaggcccggggcacagcggcatgcgcagacgttaggggcgtgcttgaccgcctgagggtgaaggccgtcaccaagatcagagagttcatcctccagaagatttattcctttcggaaaccgatgaccaactatcagatccctcagacggctctgctaaagtataggttcttctaccagttcctactcggcaacgagagggctaccgccaaggaaatcagggacgaatacgtggagactctaagtaaaatttatctgtcgtactatcgctcgtatctcggacggcttatgaaagtacaatatgaagaggtagccgagaaggacgacctcatgggagtcgaggacacagctaaaaaaggcttcttcagcaagccctctctgaggtccaggaataccatcttcactctagggaccagagggtcagtgatcagtccaaccgaactcgaggctcccatattagtgcctcataccgcccagaggggggagcaacgctatcctttcgaggccctgttcagaagccagcactacgccctgttggataatagttgccgggagtacctattcatatgtgaattcttcgtggtctccggccctgctgcccatgacctcttccacgctgttatgggacgcacgctgtctatgactctgaagcacctggatagttacctggcagattgttatgacgccattgccgtgtttctgtgtatccatatcgtgctgcgttttagaaacatagccgccaaacgggatgttcccgcattggacaggtactgggaacaggtcctagccctgctatggccaaggtttgagctaatccttgagatgaatgtgcagagcgtgaggtccaccgatccacaacgcctgggcggccttgatacacggcctcactatataacaagaaggtacgctgaattttccagcgccttggtatcaattaatcagaccatacctaatgagcgaaccatgcagctgctgggccagctccaggtggaagtggagaatttcgtgctgagagtggccgctgagttttctagtagaaaagaacagctggtgttcctgattaacaattacgacatgatgctgggggtgctaatggaacgagcagcggatgacagtaaggaagttgagtccttccagcaactgctcaacgcccggacccaagagttcattgaagagctcctttccccaccttttggcggcctggtggcctttgtaaaggaagctgaagccttaattgaaaggggccaggctgaacggctcaggggtgaagaggcccgcgttacgcaacttatccgcggattcggcagctcctggaagtcctcagtcgaatcactgagccaagacgtgatgcgctcgtttacgaactttagaaacggcaccagcattattcaaggcgcgttaacgcaacttatccagctgtaccatcggtttcaccgcgtgctctcccagccccagctccgtgcactccctgcaagagccgaactgataaacatacaccacctgatggtagagctgaaaaagcacaagcctaacttttag

SEQ ID NO: 47857 - DNA, 2172 bp, Artificial Sequence
  Description of Artificial Sequence: Synthetic coding sequence
atggccgccgccgccaccatggccgccgccgcccgggagctggtgcttcgggccggcacatcagatatggaagaggaggaaggacctctggcaggcgggcccgggctgcaggaacctctgcagctgggagaattggatatcacatcagatgaatttattttggacgaagtcgatgtccacattcaagccaaccttgaagacgagctagtaaaggaggccctaaagactggagtcgatctccggcactactccaagcaagtcgaactggaattgcagcaaattgaacagaaatccattcgcgactatatacaagagagcgagaatatcgccagtctgcataaccagattactgcatgtgacgccgtgctggaacggatggagcagatgcttggagcctttcaatctgacctttctagtatttcttccgaaatccggacccttcaggaacagtcaggcgccatgaatatccggttaagaaacagacaggccgtacgcggcaagctgggcgaattggtcgacggattggtcgtgccctccgccctcgttaccgcgatccttgaagcacccgtaaccgagcccaggttccttgagcagctgcaagaactggacgctaaagcggccgccgtgagagagcaggaagccaggggtaccgccgcctgtgctgatgtccggggggtgctggatcggctcagggttaaagccgtgacaaaaatccgggagttcatcctgcagaaaatatactctttccgtaaacctatgacgaattaccagattccacagaccgcacttctcaaatacagattcttctaccaattcctgctgggtaatgagcgcgctacagccaaggagattcgcgacgaatacgtagaaacattgtcgaaaatctacctgagctactatcgcagttacctcggacggctcatgaaagtgcaatatgaggaggtggctgagaaggacgatctcatgggagtggaggatacggctaaaaaagggtttttcagcaaacccagcttacgtagtaggaatacaatctttactttagggacacgggggtcagtcattagccccactgaactagaagcccctatactggtcccgcatactgcacagcggggcgaacagcgctatcccttcgaagccctgtttcgctcacagcactatgcacttttagataactcttgtagggaatacctattcatctgcgaattttttgtggtctctggtcccgccgcacatgatctgtttcatgccgtaatgggacgtaccctgagcatgactctgaagcatctggattcttacctcgcagattgctacgatgcaatcgccgtcttcctgtgcatccacattgttttgagattcagaaacattgctgccaagagggatgtccccgcccttgacagatactgggagcaggttcttgccctcctgtggccaaggttcgagctgatcctggaaatgaacgtacaatctgtaaggtcaaccgatccccagaggttgggaggtcttgacacacgcccacactacattactcgccggtatgctgaattcagcagtgctctcgtgagtatcaatcagacaatccccaatgagcgaactatgcagctgctgggccagcttcaagtggaagtagagaacttcgtgctgcgggtagctgccgagtttagcagccggaaggagcagctagttttcctaattaacaactacgacatgatgctaggcgtgcttatggaacgtgccgccgacgactcgaaggaggtcgaatcctttcagcaactgttaaatgccaggactcaggaattcattgaggaactgctgtctccgccatttggcggcctggtcgcatttgttaaggaagcagaagccttgatcgagagaggacaagcagaaagacttcgcggtgaagaagcacgggttacacagctgatccgcggattcggctcttcttggaaaagcagtgtggagtccctaagccaagatgtaatgcgatccttcaccaactttagaaacggtacgagcatcattcagggcgccttaactcagctaattcaattataccaccgtttccatcgagtactcagccagccccagctgagagccctgcccgctagggccgaactaatcaacatccaccacctgatggtcgagttaaagaagcataagcctaatttctag

SEQ ID NO: 47858 - DNA, 2172 bp, Artificial Sequence
  Description of Artificial Sequence: Synthetic coding sequence
atggccgccgccgccaccatggccgccgccgcccgggagctggtgctgcgcgcaggtacgagtgacatggaggaggaagaggggcccttggccggagggcctgggctccaggagcctctgcagctgggagaacttgatattaccagcgacgagtttattttggacgaagtggacgtgcacatccaagcaaacctggaggacgagctggtaaaagaggccctgaagaccggcgtggatcttcggcattattctaaacaggtggagttggagcttcagcagatagagcagaaaagcatcagggactacattcaggagtctgaaaacattgcgtcattgcataaccaaatcactgcatgcgacgctgtgttggaaagaatggagcagatgctgggcgcgttccagagcgatctgagctctattagctccgagatcaggaccctacaggaacagagtggcgcaatgaacatacgtctgcggaataggcaggccgtgcggggcaaactgggagagctggtggatggactcgtcgttccctccgcactcgtgacagccatcttggaggctccggtcacagagcccaggttcctcgagcagttgcaagaattggacgctaaggctgcggccgtgcgtgagcaggaagctcgtggtaccgcagcttgtgcggacgttagaggtgtactagaccggcttagggttaaggccgtgacgaaaatccgcgagttcatattgcagaagatatattcatttaggaagccaatgaccaactatcagattccacagactgctctcttgaaatatcggtttttttatcaatttctcttgggtaatgaaagggctaccgctaaagagattcgtgacgagtacgttgaaacattatctaaaatttacctgagctattaccggtcatacctggggcgcttgatgaaagtgcaatacgaggaggtggcagagaaggacgacctgatgggagtggaagacaccgccaaaaagggctttttttccaagccttcactgcgcagcagaaacacaattttcacactgggcactcggggctccgtgattagtcccactgagctcgaagcaccaattctcgtaccgcataccgcccagagaggggagcagcggtatccgtttgaggctctgtttcggtctcagcattatgcacttctagacaactcatgtagagaatacttatttatatgtgagttctttgtggtgagtggtcccgcagcccatgacctcttccacgctgtaatgggccgcacgctgtccatgaccctcaagcacctcgactcatatctggctgactgttatgatgcaattgcagtcttcctgtgtatacacatcgtactacggtttcgcaacatcgcagccaaacgggacgtcccagcccttgatcgctattgggagcaagtgcttgcactcctttggccacgatttgaactgatcctcgaaatgaatgtgcagagtgtccgctccactgacccgcagcgactggggggcctggacacgaggccgcactatattaccaggcggtacgctgagtttagcagtgctctggtatcaatcaatcagaccatcccaaacgaaaggacaatgcagcttctgggacagctccaggtggaggtggaaaattttgttctccgggtcgccgcggagttctcttcacgcaaagagcagttggtctttctgattaataactatgacatgatgttgggggttctgatggagcgagccgctgatgactcaaaggaagtagagagttttcaacagctgctaaatgccagaacacaggaattcatcgaagagctgctaagcccgccgtttggggggttagttgcctttgtcaaggaggctgaggcccttatcgagaggggtcaggcagagagactgcgaggtgaggaagctcgggtgacccagctaatccgcggcttcggcagctcttggaaatctagtgtggaatccttgagccaagatgtgatgaggagttttactaattttcggaatggtacctccattatccagggggcgctgacccagctgatccagttgtatcatcgttttcaccgagtgctgagccaacctcaattgcgcgccctgcccgcaagagcagaactgattaacatacatcacctcatggtcgagctgaagaagcacaagccaaatttctag

SEQ ID NO: 47859 - DNA, 2172 bp, Artificial Sequence
  Description of Artificial Sequence: Synthetic coding sequence
atggccgccgccgccaccatggccgccgccgcccgggagctggtgctacgagcgggcacaagcgacatggaggaagaagaagggcctctggctggagggcccggattgcaggagcctctccagctgggggaactggacattacttcagacgagttcatactggacgaggtggatgtccacatccaagccaacctagaagacgagctcgtcaaagaggcccttaaaacgggcgtggatctcagacactattccaaacaagttgagttggaacttcagcagattgaacagaagtccattcgcgactatattcaggagtccgagaatattgctagtctccataaccagatcaccgcctgcgacgctgttctggagcggatggagcagatgttaggcgccttccaaagtgatttatcgtccatctccagcgaaatccgaaccctgcaagaacagtccggggctatgaacatccgtctacggaacaggcaggcagtccggggtaaactgggcgaactggtcgatggcctcgttgtgccaagtgccctggtcaccgccatcctggaagcacccgtgaccgagcccagatttctcgagcaactgcaggaactggacgccaaggctgctgcagttcgggagcaggaggccagggggaccgccgcttgcgcagatgtgaggggggtgctcgatcgcctgcgagtcaaggctgtgacaaaaatccgggagttcattctccagaaaatctactcctttcgcaagccaatgaccaactatcagataccgcagaccgcgcttctgaaatacaggtttttttatcagtttctgttgggcaatgaacgcgcaaccgccaaggaaatcagagatgagtatgtggaaaccttgtctaagatatacctgagttattacaggagctacctgggtcggctgatgaaagtgcaatacgaagaggtcgcggagaaagatgacctgatgggtgtagaagatacagctaagaaaggcttcttctctaagccttcgctgcggtcgcgtaatactatctttactctgggaacacggggtagcgttatctcacctactgagctcgaagcccccatcctcgttcctcacaccgcacaaaggggcgaacagaggtaccccttcgaggcgctgtttagatcacaacattatgcactgctcgataattcctgcagagagtacctgttcatctgcgaattcttcgtcgtgtctggacccgcagcccatgatttgttccacgctgttatgggtagaaccctgtcaatgaccctgaaacacttggatagctatctcgctgattgctatgatgctatcgccgtctttctttgtatccatattgtcttaagatttaggaacatagctgccaaaagagacgttcccgccctcgaccgatactgggagcaggtacttgcactcctgtggccacgcttcgagctgattctggagatgaacgtgcagagtgtgagaagtacagatccccagcgcttgggcggtctggacacgaggccccactacatcacccgaaggtacgcagagttctcaagcgctttggtcagcataaaccaaacaattcccaatgagaggacgatgcagttactcgggcagcttcaggtcgaagtcgaaaacttcgtgctacgggtggctgccgagttctcctcacggaaggagcagttggtgttcctgatcaacaactatgacatgatgcttggcgtgcttatggagagggccgccgacgactctaaggaagtggaatccttccaacagctgctgaacgctcgcacacaggagttcatagaagagctgctgtctccgccgttcggtgggctggtagccttcgtcaaggaggcagaggcactgattgagagggggcaggcagagagacttcggggggaggaggctagggtaacccagcttatacgcggatttggaagcagctggaagtcctccgtcgagtcgctatcacaggatgtgatgcgaagttttacaaattttcggaacgggacaagcatcatccagggggcactgacccagctgatccagctctaccaccgctttcaccgggttcttagccagccccagctccgagctctgccagccagagcggagctgatcaatattcaccatctgatggtcgaactcaagaaacacaagcctaatttttag

SEQ ID NO: 47860 - DNA, 2106 bp, Artificial Sequence
  Description of Artificial Sequence: Synthetic coding sequence
atggaggaggaggagggccccctggccggcggccccggcctgcaggagcccctgcaactcggcgaactggacatcacatctgacgagttcattctagatgaggtggatgtccacattcaggccaacctcgaagatgagcttgtaaaggaggcgctcaaaaccggggtggaccttcggcactacagtaaacaggtcgaactcgagcttcaacagatagagcagaagtccatccgtgattatatccaggaatcggagaacatcgcgagcctccacaaccaaatcaccgcttgcgacgcggttctggagcgcatggaacaaatgctgggcgcctttcagagcgatctgtcgagtatctcctctgaaatcagaacactgcaggaacaatccggggccatgaacattaggcttagaaacagacaggctgtcagaggaaagctgggcgagctggtcgatggcctcgttgtaccaagtgctttggtcactgcaattctggaggctcctgtcacagagccgagattcttggaacaattacaggaactggacgcaaaagccgcagccgttagagaacaggaggcccgtggtacagccgcctgtgcagatgtgcgaggagttctggaccggcttcgtgtcaaagcagtaaccaagatcagagagttcattctccagaagatctactcttttagaaagcctatgaccaattatcagatccctcagactgccctgctgaaataccggtttttctaccagttcttattaggaaatgagcgcgctactgctaaggaaatacgggatgaatacgtggagaccctgagcaagatctacctctcctattataggagctacttaggccgcctgatgaaagtgcagtatgaggaagtggcagaaaaggatgatctgatgggcgtggaagacacggccaagaaggggttcttctcaaagcccagccttcgcagccggaatacgatctttacattggggacgcggggtagcgtgatttcccctactgaactcgaagccccaatcctggttccgcacaccgctcaacggggggagcaacggtatccctttgaagctctcttcagatcacagcactacgccttgctggacaattcatgtcgtgagtacttgttcatatgcgaattttttgtcgtctccgggcccgccgcccacgacctctttcacgctgtgatgggaagaacactgtctatgacccttaaacacctggactcttacctcgcagactgttacgatgcaatagcagtatttctgtgcatacacatcgtgctgcgattcaggaatatcgctgccaaaagagacgtgcccgcgctggatcgttactgggagcaggtcctggccctgttatggccccgtttcgagctgatcttggagatgaacgtccagagcgttaggtccacagatccccagcggttgggggggttggatacccggcctcactacatcacccggcgctatgccgaatttagtagtgccctcgtctcaattaatcagactatccccaatgagcgcacgatgcagcttctgggacagttacaggttgaggtggagaacttcgtgctgcgggtggctgcagagttctccagtcggaaggaacagcttgtgttcttgatcaacaattatgacatgatgctcggcgttctgatggaacgtgccgctgatgacagtaaggaagttgagagtttccaacagctgttgaacgctcgtactcaagagtttattgaggaactgttatcacccccctttggcggactcgtggcctttgttaaagaggcggaagccctcatcgagcgaggacaggctgagcgtcttaggggcgaggaggcacgagtgacccagttaatcaggggatttggcagctcgtggaagtcttccgtcgagagcctctcacaggacgtaatgaggtcgtttaccaattttaggaatggcacctctattattcagggcgctctgacgcaactgatccaactgtaccatagattccatagggtcctttcccagccccagcttcgggcccttcccgcccgcgccgaactcattaacatacaccatctgatggtggagctgaagaaacataaacctaatttctag

SEQ ID NO: 47861 - DNA, 2106 bp, Artificial Sequence
  Description of Artificial Sequence: Synthetic coding sequence
atggaggaggaggagggccccctggccggcggccccggcctgcaggaaccactgcagctcggagaactagacataacctctgatgaatttatcctggatgaagtagatgttcacattcaggctaacctagaggacgaactggttaaagaggccctcaaaaccggagtggacttgcggcactactccaaacaagtcgaacttgaactccaacagatcgagcaaaagagcatccgcgattatattcaggagtccgagaatatcgccagcctccataaccagatcacagcatgtgatgctgtgctcgagcggatggagcagatgcttggagcattccagtcagatctgtcttctatctcttctgaaatcagaaccctgcaggaacagtctggcgcgatgaatatccggttgcggaatcggcaggccgtccggggcaaactcggagagcttgtggatggactggtcgtcccctccgcccttgttactgccatactggaagcccctgtgactgagcccagatttcttgagcaactgcaggaactggatgcaaaggccgcagctgttcgcgaacaggaagctagggggacagctgcttgcgctgatgtccgcggggtcttggataggctccgggtgaaagcagttaccaaaatcagggaatttattctgcagaaaatttatagcttcagaaaaccaatgaccaactatcaaatcccccagacggctctgctaaagtaccgctttttttatcagttcctgttaggtaacgagcgcgctaccgccaaagaaatcagagatgagtacgtagaaaccctcagcaagatctacctgagctactacagaagttacttgggtaggctgatgaaggtgcagtacgaggaggtcgccgagaaggacgatctgatgggagtcgaggatacagccaaaaaaggtttcttcagtaaaccatccctcaggtctaggaacacaatctttacattaggcacgcgaggtagcgtcatctcacctactgaactagaagcgccaattctggtgccgcatacagcacaaagaggggagcagcgctatccatttgaagctctttttcgctctcagcactacgccctcttagataatagctgcagagaatacctctttatctgtgagtttttcgtggttagcgggccagcagcccatgaccttttccatgcagtgatgggaaggaccttaagcatgacgctgaaacatctcgatagctatcttgcggattgttatgacgctatcgcagtttttttatgtattcatatcgtactgcggttccgtaacatagctgctaaaagggatgtgcctgcattggaccgctactgggaacaggtcttagctttgctctggccgcgctttgagctgatcctggaaatgaacgtgcagtctgtaaggtccaccgacccccagcgcctgggcggcttggatacccggccccactacatcacacgaagatacgcagagttttcctctgctctggtgagtattaaccagacaatccccaacgagcgtaccatgcagcttctggggcaactgcaggtggaggtcgaaaacttcgtactgcgggtggcagccgaattctcatcccgcaaagaacaactcgtttttctcataaacaattacgacatgatgctcggggtgctcatggaacgtgccgcggacgattctaaggaggtcgaatcattccagcagctgctgaatgctagaacacaggaatttattgaggagcttctgtcacccccctttggtggactcgtggcattcgtaaaggaggcagaagcgctgattgagaggggacaggcagaacggcttcgtggagaggaggcgcgtgtgacccagcttatcaggggcttcggaagctcctggaagtcaagcgttgagtccctctctcaggacgttatgagatcatttaccaacttcaggaatgggacttcaatcattcagggcgccctgacgcagctgattcaactgtaccatcgatttcatcgcgttttgtctcagccgcaactgcgagcccttccagctagggcagaactcatcaatatccatcatctgatggttgagctgaaaaagcataaacctaatttctag

SEQ ID NO: 47862 - DNA, 1797 bp, Artificial Sequence
  Description of Artificial Sequence: Synthetic coding sequence
atggagcagatgctgggcgccttccagagcgacctgagcagcatctcctcagagattcgaaccctgcaggaacagtctggagcaatgaatatccgccttcggaaccgtcaagcggtgcgcggcaagctgggggaactggtggacgggctggtagtgcctagtgccctggttaccgcgattcttgaggcgccggtgactgaaccaaggttcctggagcagctgcaggaactagacgcaaaagcggccgctgtgagagagcaggaagccagggggacagccgcctgtgctgatgtgcgcggtgtactggaccgtctccgtgtgaaggcagtgacaaagatccgtgagttcattctccagaaaatctatagctttagaaagcccatgacaaattatcagattccgcagaccgccctgctgaaataccgatttttttatcagtttctcctgggcaacgaacgtgctacagctaaggagattagagacgagtacgtggagaccctttccaaaatttatttgagctattatcgatcctacctcgggcggctgatgaaagtgcagtacgaggaagtcgcagagaaggacgaccttatgggggtggaggatacggctaaaaaagggttctttagcaagcctagtctgaggtccagaaatacaatttttacgctcggcacacgcgggtccgtgatcagtcctacagagttagaagcccctattctggttcctcatacagctcagaggggcgagcagcgctatccatttgaggccttgttccggagtcagcactacgccctgctcgataatagctgcagggagtacctgttcatatgcgaattttttgtggtgtccggtcccgcggcacacgatctctttcacgctgtgatgggacgaacgctttccatgactctgaagcacttggactcttacctcgcagattgttacgatgccatcgcggttttcctgtgtattcacattgtgctcagattccgcaacatcgccgccaaaagggacgtaccagccctggaccgctattgggagcaggtgctagcgctcctgtggccaaggttcgagctgatcttggaaatgaacgtccaatcagtgcgatctaccgatccccagcggctggggggcttggatacccgcccccactacattaccaggcggtacgccgagttttcctcggccctcgtgtctatcaaccagaccatcccaaacgagcgcaccatgcagctcctgggacagctccaggtcgaggtggagaactttgtacttagagtggctgctgaattttctagcaggaaagagcagctggttttcctgatcaataactatgacatgatgctgggcgtgttgatggaacgagcagctgacgattctaaagaggtggagagcttccagcagctgctcaacgcaaggacgcaagagttcatcgaggaactgttgtcgcctccattcggcggtctggtggccttcgtcaaagaagccgaggcgctgatcgagaggggccaggcggaacgcctgagaggggaggaggctagagtgacccaattgatacgaggcttcggatcaagctggaagagcagtgtcgagagcctcagccaggacgtgatgcgaagtttcactaatttccgcaacggaacaagcataatccaaggcgctcttactcagctgatccagctgtatcacagatttcatcgagtgttgtcacagccgcaattaagggccctcccagctcgggccgaactcattaacatccatcacttgatggtggagctaaaaaagcacaagcctaacttctag

SEQ ID NO: 47863 - DNA, 1797 bp, Artificial Sequence
  Description of Artificial Sequence: Synthetic coding sequence
atggagcagatgctgggcgccttccagagcgacctgagcagcatctccagtgaaatccgtaccctgcaagagcagtccggtgcgatgaacatccgcctcaggaatagacaggccgtcaggggcaaacttggcgagctcgtagacggactcgtagtgccatctgcgttagtaacagccatcctggaagcgccagtgacagagcccaggtttctggagcaactgcaggaacttgacgccaaagctgctgccgtgcgcgagcaggaggcccgcggcaccgcggcttgcgccgatgtgagaggggtgctcgatcgcctgcgggtgaaagccgtgacaaagataagagagtttattctgcagaaaatatactcttttcgcaaaccaatgacaaactatcagatcccacaaactgccttactgaagtatcgttttttctaccagttcttgctgggtaacgagcgcgccacagccaaagaaataagggacgaatacgttgagacgctgtctaagatatacctgtcctattacagatcgtatcttggcaggcttatgaaggtccaatatgaggaagtagccgaaaaagatgatctgatgggcgttgaggatacagcaaagaaaggattcttttccaagccatcactgcgttcccgaaacactatctttacgctcggaaccaggggttccgtgatctccccaactgaacttgaggctcccatcctggttccccataccgcccagagaggtgaacagcggtacccctttgaggccttgtttagaagccagcattatgctctgttggacaatagttgtcgggagtatctttttatttgcgaattctttgtcgtgtcaggacccgcggctcacgacctttttcacgcagtgatgggcaggacattgtcaatgacgcttaagcatttggactcatacttggcagactgctatgatgccattgccgtattcctgtgtatccatattgttttgcggtttaggaatatagctgcgaaacgggacgtcccagcactggaccggtactgggaacaagtgctggcactactgtggccccgcttcgagctcatcctcgaaatgaacgtccagtctgtgcggtcaacagaccctcagcgtctcggaggacttgacacccgccctcactatattacccggagatacgctgaatttagtagcgccctcgtttctatcaaccagacgattccaaacgagagaaccatgcagctgctggggcagctgcaggtcgaggtggaaaactttgtcctgcgggtggcagctgaatttagctctcggaaagagcagctcgtttttcttatcaataactatgatatgatgctgggtgtactcatggaacgagcagccgatgattcaaaggaagtggaatcatttcaacagttgctgaatgcgcgaacacaggagttcatcgaagaactcctgtcccctcccttcggtggacttgttgcgtttgtgaaggaagccgaggctcttatcgaaagaggtcaggccgaaaggctgaggggggaggaggcccgtgtcacccagctaataaggggattcggctcttcatggaagtctagtgtggagtccctgtcccaggatgtgatgagatctttcaccaacttccggaacggcacatcaataatccaaggtgcattgactcagcttattcaattataccacagatttcatagggtgctttcccagccacaactgcgagcgttacccgcccgggcggagcttataaatatacaccacctgatggtggaactcaagaagcacaaaccaaatttttag

SEQ ID NO: 47864 - DNA, 1443 bp, Artificial Sequence
  Description of Artificial Sequence: Synthetic coding sequence
atgagcgacgtggccatcgtgaaggagggctggctgcacaagcggggcgagtacatcaaaacctggagaccgcgatacttcctactcaagaacgacggaaccttcattggatacaaagaaagaccacaggatgtcgaccagcgggaggcccctttgaacaatttcagcgtggcacagtgtcagctgatgaagactgagaggccccgtccaaataccttcattatacggtgcctacaatggaccactgtgattgaacgcacctttcatgtggaaacgcccgaagagagagaggagtggaccacagcgatacaaaccgtcgctgatggcctcaaaaaacaggaggaagaagaaatggatttcagatccggcagcccctctgataactcaggagccgaggagatggaggtgtctttggctaaaccgaaacatcgggtgacaatgaacgaatttgaataccttaaactgctgggcaaaggcacctttgggaaggtgattttggtcaaagaaaaggctacggggaggtattatgctatgaaaatcctgaagaaagaggtcatcgtggcgaaagacgaagtggcccatacgcttaccgaaaatcgagtgctacagaactccagacatcccttcctgactgcactaaagtatagttttcaaacccacgaccggctgtgcttcgtgatggaatacgccaacggtggcgagctttttttccatctctctcgagaacgtgtgtttagtgaggaccgagccagattctacggggccgaaatcgtcagcgcgttggactatctgcactcggaaaaaaatgtcgtctaccgcgatctgaagctggagaaccttatgctggataaggacggccacatcaagatcacagatttcggactttgcaaggagggaatcaaggatggcgccactatgaagaccttttgcgggacgccagagtacctggctcctgaagttcttgaggacaatgactacggtagagccgtcgattggtgggggctgggagtcgtgatgtacgagatgatgtgtggccgcttgccgttctacaatcaggaccatgagaagctgttcgagcttatattaatggaggagatccgattcccgcgcacacttggacctgaagctaagtccctcctgtctggactgttaaagaaagaccctaaacagcggttgggcggaggaagcgaagatgcgaaggagatcatgcagcataggttttttgccggaatagtctggcagcacgtgtatgagaagaagctgtcccccccatttaaacctcaggtgacctcggagacagatactcggtactttgacgaggagtttaccgcccagatgatcacaattacacctcctgatcaggacgacagtatggaatgcgtagactccgagaggaggccccatttccctcagttttcctattcggcttccgggaccgcatag

SEQ ID NO: 47865 - DNA, 3192 bp, Artificial Sequence
  Description of Artificial Sequence: Synthetic coding sequence
atgccccacctgcccctggccagcttccggccccccttctggggcttacgacattcccgagggctacctaggtttcatagcgtcagtacacagagcgagcctcatggaagcccaataagtcgcaggaaccgcgaggccaagcagaagagactacgagagaaacaagcgactctcgaagctgaaatcgcaggcgaatcaaaatcgcctgctgagagcatcaaagcttggcggccaaaagaattggttctctacgagattccgacaaaaccgggtgaaaaaaaggatgtcagcggaccattacctccagcttactccccccgctatgtcgaagccgcatggtacccctggtgggtccgggagggttttttcaagccagagtaccaggcgaggcttccacaagctacgggggaaactttcagcatgtgtattcccccccctaatgtgaccgggagcctacacattggccatgctctgacggtggccatccaggatgcactggtgagatggcatcggatgaggggcgatcaagtgttatgggtgccaggtagtgaccatgcgggcattgcaacccaggcagtcgtggagaagcagctgtggaaggagcgcggtgttagaagacacgaactgtctcgggaggcgttcctgcgtgaggtctggcagtggaaggaggctaaagggggcgagatttgtgaacaattgcgggccctgggagcctctctggactgggatagagagtgcttcaccatggatgtgggatctagcgtagctgtcaccgaggcatttgtgagattgtataaggcgggactactttatagaaatcatcagctggtgaattggagctgcgccctgcgaagcgcaattagtgacattgaggtcgaaaacagacccctgccagggcacacacagcttaggctgcccggctgcccaactcccgtatccttcggtctgttgttctctgttgccttcccggtggacggggaacccgacgccgaggtagtcgtcggcaccaccagaccggagactttaccaggggatgtcgctgtcgctgtgcacccagacgatagcaggtatacacacttgcacggtcgccagctccggcatcccctcatgggccaacctttgcccctgattacagactatgctgtgcaacctcacgtggggacaggcgcggtgaaagtcacacccgcccactctcctgccgatgcagagatgggcgctaggcatggcttatcccccctgaatgtaatcgcagaagacggaacaatgacctccctgtgcggcgactggttgcagggtctccatcgcttcgtcgcccgtgagaaaatcatgagtgtcctatcagagtggggtttattccgaggtcttcaaaatcatcccatggtgctccctatctgtagtcggtccggtgacgtaatcgaatacctgctcaaaaaccaatggtttgtaaggtgccaggagatgggagcccgagctgccaaggcagttgaatcaggtgccctggaactcagccccagtttccatcaaaaaaactggcaacattggttttcacacattggcgactggtgtgtgtctcgccagttatggtggggacaccagattcccgcctatctcgttgtggaggatcacgcccaaggagaagaagactgctgggttgttggacggtcagaggccgaagccagagaggttgctgcagaactgaccggcagaccaggagctgagttgactctggagagggatcccgacgtgttagatacctggttttcttctgcactcttcccattctcagcgctgggatggcctcaggagacacctgatctggcacgtttttaccccctcagtcttctcgaaacaggctctgacctgctgctgttttgggtgggtcgaatggtgatgctggggacccaattaaccggacagctgcctttttccaaagttctgctgcatcccatggttcgcgataggcagggtaggaagatgtcaaaatcactggggaacgtacttgatccgagggacattatttccggtgtagagatgcaggtcctgcaggaaaagctcagaagcggtaacctggaccctgccgagctcgctatcgttgctgccgcccagaagaaggattttcctcacgggatcccggagtgtggaaccgacgcgctccggtttaccctgtgttctcatggggttcaagccggagatctccatttgagcgtgtctgaggtgcagtcttgtcggcatttttgcaataagatttggaacgccctcaggtttatcctcaatgccctcggtgagaaatttgtccctcagccagctgaggaactttcgccaagcagccctatggatgcatggatcctctcccgtctcgctcttgctgcccaggagtgcgaacgaggtttcctcacgcgggaactgtctctggtgacacatgccttgcatcatttctggctacacaacctctgtgacgtatacctcgaagcggtgaagccagtgctgtggcattccccacggcccctaggccccccccaggttctatttagctgcgccgacctgggccttcgccttctcgccccacttatgccatttttagcggaagagctctggcagcggctcccccctcgaccaggctgtccaccagccccctccattagcgtggcaccatatccatctgcctgcagcctggaacactggaggcaaccagagctggagcgccgcttcagcagagtccaggaggtggtccaagttcttcgagctctgcgggccacctatcagttgaccaaggccagaccgcgcgtattactgcagtcatcagaaccaggggatcagggcttattcgaagcatttctagagccgctggggacactcggatactgcggggcagtcgggctcttaccccctggagccgctgcccctagcggatgggctcaagcgcccctttctgacaccgcccaggtctacatggagctgcaggggttggttgatccccagatacagctcccactgctggccgccaggcgctacaaactacagaaacaacttgacagcctgacggcccgaacgccttctgagggcgaagcaggaacgcagcgtcagcagaagcttagttccctccagctcgagttgtcaaaactggataaagctgcatcccatctgcagcagctgatggatgagcctcccgccccaggctctccagaattgtag

SEQ ID NO: 47866 - DNA, 348 bp, Artificial Sequence
  Description of Artificial Sequence: Synthetic coding sequence
atgccccacctgcccctggccagcttccggccccccttctggggcctgagacactcgagaggtctcccaagattccattctgtgagtacccagagtgaaccccacggcagtcccattagccgtaggaaccgtgaagctaagcaaaaacgtctgcgagagaagcaggcaacgcttgaagccgaaattgctggggaaagcaagtctcctgccgagtctattaaagcttggcgcccaaaggaactcgttctgtatgagatccccactaaacctggggagaagaaagatgtgtccggaccactgccacctgcctattctccccgttatgtagaggccgcctggtacccctag

SEQ ID NO: 47867 - DNA, 981 bp, Artificial Sequence
  Description of Artificial Sequence: Synthetic coding sequence
atgccccacctgcccctggccagcttccggccccccttctggggcctgcggcacagtcggggccttccacggtttcactccgtgtctacacagagtgagcctcacggatcccctattagccggcgaaaccgggaagccaaacagaagaggcttagggaaaaacaggccacccttgaagccgagattgctggggagagcaaaagcccggccgaatctatcaaggcctggagacctaaagagttggtgctttacgagatacctaccaagccgggagaaaaaaaggacgtgtcggggcccctgccgccagcttattcccccagatatgtggaggctgcatggtatccatggtgggtccgggaaggcttctttaaacccgagtaccaggcaaggctgccccaggccacgggagagaccttttcaatgtgcattccgcctccaaatgtcacggggtctctacatattggacacgcgctgaccgtggcgatccaggatgctcttgtgcggtggcatcggatgcggggggaccaagtgctctgggtccccggaagtgaccacgctggaatcgcaacgcaagctgtcgtggagaagcagctgtggaaagaacggggtgtccgacgccacgagttgagtagggaggcatttttgagggaagtctggcaatggaaagaggcaaaagggggggaaatttgcgagcaactgagagccctgggggcatcattagactgggatagggaatgcttcaccatggatgtgggatcctctgtggcggtaacagaggccttcgtgaggctgtacaaggcgggattactttaccggaaccatcagctggtcaactggtcttgcgctttgcgctcagctataagtgacattgaggtggagaaccggcctcttcccggccacacacagttgcgtctaccagggtgtccaacccccgtgagctttggtctgctgtttagtgtcgcattccccgtcgatgggtag

SEQ ID NO: 47868 - DNA, 774 bp, Artificial Sequence
  Description of Artificial Sequence: Synthetic coding sequence
atgccccacctgcccctggccagcttccggccccccttctggggcttgagacactccagggggctgccaagatttcatagcgttagtacacagtcagaaccacacggatcaccgataagcagacgcaacagagaagccaagcaaaagcggctccgcgagaaacaggctaccctggaggccgaaatagcgggtgagtctaagtcccctgcggagtcgataaaggcctggcgccccaaggaactggtcctgtatgagattccgacaaaaccaggcgagaaaaaagacgtgtcaggacctctaccaccagcctacagcccccgctacgttgaggcagcttggtatccttggtgggtccgagagggttttttcaagcccgagtaccaggcccggttgccacaggccacaggtgagactttttcgatgtgtatcccccctccaaatgtaactggatccttgcatatcggacacgctctaaccgtggccatccaggacgccctggtgagatggcaccgaatgcgtggcgatcaagtgctctgggtgccaggcagtgaccatgcaggaatcgccacgcaggccgtagttgagaagcaattatggaaagaaaggggcgtgagaagacacgagctttcaagggaggctttcctgcgagaggtctggcaatggaaggaggcgaaggggggcgagatctgcgagcagttgcgcgctctgggagcatctttggactgggaccgggttttttatcacggttgttggctcctgtccggatgcgattag

SEQ ID NO: 47869 - DNA, 2772 bp, Artificial Sequence
  Description of Artificial Sequence: Synthetic coding sequence
atgtgcatccccccccccaacgtgaccggcagcctgcacatcggccatgccctgactgttgcaattcaggacgccctagttaggtggcatcgcatgaggggagaccaggtgttgtgggtgccaggctcagaccatgccggcattgccacacaggccgtagtcgaaaagcaactgtggaaggaacgcggagtgcgccgccacgaactctcacgcgaggccttcctccgcgaggtgtggcagtggaaggaggccaaaggtggagaaatctgtgagcagctccgtgctctgggggccagtctggactgggaccgagagtgcttcacaatggacgtaggtagttcagtagcggtgacagaggcatttgtgcgattgtacaaagctggcctcctgtatagaaatcaccaactcgtcaactggagctgtgccctgcgttccgcaatttcggacattgaagtagaaaatagacccctccccgggcacacccagttacggcttccggggtgccctactcctgtttccttcggtttgctctttagcgttgcatttccagtagatggagaaccggacgctgaggtggtcgtggggaccactcgacccgagactctgcccggcgacgtcgccgtcgccgtgcatccagacgacagcagatacacccatctacacgggcgtcaactgcggcaccctcttatgggccagccactccccctgattactgattatgcagtgcagccacatgtcggcacgggggccgtaaaggtgacacccgcgcacagcccagctgatgcagagatgggggccagacatggactctcaccactaaatgtgatcgccgaagacggtacaatgacaagtctgtgtggggactggttgcagggactccataggtttgtagccagggagaagattatgtccgttctcagcgagtggggattgtttcggggtttacagaaccaccccatggtgctgcctatctgttctcgatccggcgatgtgattgagtatctgctgaaaaatcagtggttcgtgaggtgtcaggaaatgggtgctcgggccgccaaggccgtcgagagtggtgcactggagctttccccctcatttcaccagaaaaactggcagcactggttctctcacatcggagactggtgcgtcagcaggcagctttggtggggtcatcaaatccctgcgtacctggtggtggaagatcacgcccagggggaagaagactgctgggtggtcggccgctccgaggcggaagcacgagaggtcgctgctgagctcacaggcaggcccggcgcggaactgactcttgagagagatcccgacgtacttgacacatggttttcaagcgccctctttcctttctccgcactgggctggccacaggagactccggatctggcccgcttctacccactgtcgctgctggaaacaggctccgacctcctcctgttttgggttggcaggatggtgatgctgggaacgcaactgacgggacagctgcctttttccaaggtcctgttgcacccaatggtgcgggataggcagggacgtaaaatgtctaagagcctgggcaatgttctggatccgagagatatcatttcaggggtagagatgcaggtgctccaagagaaactgagaagcgggaacttagaccccgctgagctcgccatcgtcgccgctgcacaaaagaaagattttccacatggaattcccgaatgcggcaccgacgctctgcggttcactctgtgctctcacggcgtccaggcaggcgacctacacctctctgtctcggaggtgcaaagctgcaggcatttctgcaacaaaatctggaatgccctgagattcatactaaacgccctgggcgaaaaatttgtgccacagcccgccgaggagttatcgccttccagtccgatggatgcctggattctttccagacttgcactggccgcccaggagtgcgagagaggatttctgactagagagctcagtctcgttacacacgccctgcatcatttctggcttcacaatctgtgtgatgtgtatttggaagctgtcaaacccgtgctctggcatagtcctaggcccctcggacccccgcaggtgctgttttcctgtgctgacctgggcctgcgtttgctggcgcctctgatgcctttcctggctgaggaactctggcaaagactcccacccagaccaggctgtcctcctgccccttccatttctgtggcaccttatccaagtgcatgctctctggaacactggcgacagccggagctggagcggcggttctccagggttcaggaggttgtgcaggtactgagagccctgcgggcaacttatcaactcaccaaagcacgaccacgcgtgctgctgcagagtagcgagccaggggatcaggggctttttgaagcctttctggaacctcttgggacactcgggtattgtggtgccgttggcttgctcccgcccggcgcagctgccccaagtggttgggctcaggctcctctgtccgataccgcccaggtctacatggagctacaaggcctggtggacccacaaatccaacttcccttgcttgcagccagaagatacaagcttcaaaaacagctggattctcttacagccaggaccccctcagagggcgaggccggcacacagaggcagcagaagttatccagtcttcagttggaactgagcaaattagacaaggccgccagtcatctgcagcagctgatggacgagccccctgcgcccggctctccggagctctag

SEQ ID NO: 47870 - DNA, 3282 bp, Artificial Sequence
  Description of Artificial Sequence: Synthetic coding sequence
atgggcggcaaggcctggccccggcgggccgtgggcaccgccggcggcccctgtgccgagcagatctccgccccttttcagacactcctcatgcctcaccttccgttggcctctttccgaccacctttctggggcctaagacattctcgaggactgccaagatttcactctgtcagtacccaaagtgagcctcacggaagcccaattagcaggcgcaaccgagaggcaaagcagaagagacttagagaaaaacaggccaccttagaggcggagattgccggagagtctaagtcgcccgccgaaagtattaaagcttggcggcccaaggagctcgtcctctatgaaatccctaccaaaccaggagagaagaaggacgtgtctggacccctgcccccagcctatagcccccgttacgtggaagcagcctggtacccttggtgggtccgagagggcttttttaaacctgagtaccaagcgagattgccccaggcaaccggcgagacattctctatgtgcataccccctcctaacgtcaccggatccctccatataggacatgccttaacagtggcgattcaggatgctctggtgcggtggcatcggatgaggggggaccaggtgttatgggtccccggcagcgatcacgccggaattgccactcaagccgtggtggagaagcagctgtggaaggagagaggggtgcggcgacatgagctcagcagagaggcttttcttagggaggtgtggcaatggaaagaggccaagggcggggagatctgtgagcagcttcgcgcccttggggcttctctagactgggacagggagtgctttacgatggacgtgggctctagcgtcgctgtgactgaggcatttgtccgcttgtacaaggctggactgctgtaccggaatcaccagctggtcaactggtcatgcgccctgagatctgctatctctgatatcgaagtggaaaaccgaccactgccaggtcacacacagctgcggctgcccggctgccctacacccgtctcctttggattactgttttctgttgctttccccgtcgacggtgaacccgacgcagaagtggtagtgggcacaacccggccagaaacactcccgggagatgtggcagttgcagtgcacccagacgactccagatacacgcatctgcatggaaggcaattacgccacccactgatgggccaacctctgccattaatcaccgattacgctgtccagcctcatgtcggaacaggggctgttaaggtgacacccgcacattccccagctgacgccgaaatgggggctcgccacggcctcagccctctgaatgtgattgcagaggacggcacaatgaccagtctttgtggagactggctgcagggcctgcaccggttcgtggcgcgtgaaaaaatcatgtccgtcttatcggagtggggactttttaggggcttacagaaccacccaatggtgttacccatatgttcacgaagcggcgacgtcattgaatatttgcttaaaaatcaatggttcgtgcgatgccaagaaatgggcgctcgcgcagcaaaagccgtcgagtctggcgcgcttgagttgtctcctagctttcatcagaagaactggcagcactggttcagccatattggcgattggtgtgtttcgcgacagctgtggtggggccatcagatccctgcatatcttgtggtcgaagaccacgcacaaggggaggaggactgttgggtggtagggagatccgaggcagaggcccgcgaggtggctgcagagctgaccgggcggcccggcgctgagttaactctggaaagggacccagatgtgctggacacctggttttcatctgccctctttcctttttccgccttaggatggccacaggagacacctgatcttgcgagattttatcctcttagtcttcttgagactggctcggacctcttactgttctgggtgggccgcatggtgatgttgggtacccagctaaccggacaactgccctttagtaaagtgctgcttcacccaatggtaagggacagacaaggccggaagatgtctaagagtctgggcaacgttctcgaccccagagatatcattagtggggtggagatgcaagtcttgcaggaaaagctgagaagtgggaatctcgaccctgccgagctagccatcgtggcagctgctcagaaaaaagacttcccccacggaatacctgagtgcggtacagacgctctgaggttcacactatgtagccacggggtacaggcgggcgacttacatctatcagtgagcgaagtgcaaagttgtaggcacttttgcaacaaaatttggaacgccttgcgttttatcctgaacgctctcggtgaaaagttcgtcccacaaccagcggaggagctttcccccagctcgcccatggacgcttggatcctgtcaagactggctctcgcagctcaagaatgtgagcgaggcttcttaacaagggagctaagcctcgtcacacacgcactgcatcacttttggctgcacaacctgtgtgacgtgtacttggaggccgtgaaaccggttctttggcacagcccaagacctttagggcctccgcaggtgttgttttcatgcgccgacttggggttgcggctgctcgcccccctgatgccgttcctcgcagaggagctttggcagcgcctgccgccacggcccggatgtcccccagccccttccataagtgtagcaccttatcctagcgcttgctccctcgaacactggagacaaccagaactggagcggcgattttccagagtgcaagaggtagtccaggtgctacgggctcttcgggcgacttaccagctaaccaaagctcgccccagggtcctgttgcagtcctctgagcctggcgatcaaggactattcgaagcattcctggagcccctcggcactctaggttattgcggggctgtgggcctgctgccccctggagccgctgccccttctggctgggctcaggcacctctgtcagacacagcgcaggtttatatggaattgcaggggcttgtagatccacagatccagttaccgttgctggcagcgcggcggtataaactgcaaaagcagttggacagtctgactgcacgtaccccttcggaaggggaggccggtacccagagacagcagaaactgtcttccttgcagctggaacttagcaagctggataaggccgcctctcatctccagcagcttatggatgagcccccagcccccggtagccctgaactgtag

SEQ ID NO: 47871 - DNA, 699 bp, Artificial Sequence
  Description of Artificial Sequence: Synthetic coding sequence
atggccagcagcgccgccagcagcgagcacttcgagaagctgcacgaaatttttcgggggttacacgaggatctgcagggggtcccggagcgcctgttaggcacagcaggcactgaagagaagaagaaacttattagagacttcgatgaaaaacaacaagaggcaaacgaaactttggccgaaatggaagaggaactgcggtacgcacccttatcctttcggaatcctatgatgtcaaaactccggaattatcgtaaggatctcgccaagcttcaccgagaagtgcgatcaacccctctgaccgccactccagggggacgcggcgacatgaaatacgggatttacgcagtggaaaatgaacatatgaaccggctgcagtcacaaagggcgatgttgctgcagggcaccgagtcactgaatcgagccactcaaagcatcgaaaggtctcaccgcatcgccaccgagacagatcagataggaagtgaaataatcgaagaactgggagagcagcgggaccagctcgaacgcactaagagcagactggtgaacacatctgagaacctatcgaaatcccggaagatcttgaggtcaatgtcacgcaaggtaaccacgaataagctactcctgtcgatcatcatattgctagagctggcgatcctgggggggctcgtgtattacaaattctttaggagccattag

SEQ ID NO: 47872 - DNA, 426 bp, Artificial Sequence
  Description of Artificial Sequence: Synthetic coding sequence
atgccccccaagttcaagcggcacctgaacgacgacgacgtgaccgggtctgttaagagcgagaggcgcaacctcttggaggacgatagcgacgaagaggaagactttttcctacgcgggccatcggggccccgtttcggtccccggaatgacaagattaagcacgtacagaatcaggttgacgaggtcatagatgtcatgcaggaaaatataactaaagtaatcgaaagaggcgagagactggacgagctgcaggataagtccgaatcactttccgataacgcaacagccttttcgaacagaagtaagcaactgcggcgacagatgtggtggagaggctgtaagatcaaagccattatggctttggttgccgctatcctgcttctagtcattattatactgattgtgatgaagtataggacctag

SEQ ID NO: 47873 - DNA, 423 bp, Artificial Sequence
  Description of Artificial Sequence: Synthetic coding sequence
atgccccccaagttcaagcggcacctgaacgacgacgacgtgaccgggtcagtcaagtcagaacggagaaaccttctggaggatgattccgatgaggaggaagactttttcctggggcccagcggccctagattcggcccccgcaatgacaaaattaagcacgtacaaaaccaggtggacgaggtgatcgacgtcatgcaggagaacataacaaaggtgatagaaagaggggagcgcctggatgaactgcaggacaagagcgagagcctgtctgacaacgccacagctttttcaaaccgcagtaaacagctgagaaggcagatgtggtggcgtggttgcaagataaaagccattatggcgctggtcgccgcgatattgctgttggtgatcatcattttgatagtgatgaagtacaggacatag

SEQ ID NO: 47874 - DNA, 423 bp, Artificial Sequence
  Description of Artificial Sequence: Synthetic coding sequence
atgccccccaagttcaagcggcacctgaacgacgacgacgtgaccggatccgtcaaatcagagcgcaggaacctgttggaagacgatagcgacgaagaggaggatttttttttggggccttccggacctcgctttggaccaaggaacgataagataaagcatgtgcagaatcaggtggatgaagtgatcgacgtaatgcaggagaacatcactaaagtcatagagcgcggcgagagactggatgagctccaggacaagagtgagtccctaagcgataatgcgactgcgttctctaatcgcagcaaacagctgcgcaggcagatgtggtggaggggctgcaagattaaggccattatggccttggtcgccgccatcctgctgctcgtcataataatcctgattgtaatgaagtatcggacttag

SEQ ID NO: 47875 - DNA, 426 bp, Artificial Sequence
  Description of Artificial Sequence: Synthetic coding sequence
atgccccccaagttcaagcggcacctgaacgacgacgacgtgaccgggtctgtaaaaagcgagagaaggaacctgttggaagatgacagcgatgaagaagaagactttttcttgagggggccatctggccctcgctttgggcccaggaacgacaaaataaaacacgtgcagaaccaagtagacgaagtgattgacgtgatgcaggaaaatatcactaaggtaatagagagaggggaaaggcttgacgagttgcaggacaagtctgaaagccttagcgataatgcaactgcattctctaatcggtctaagcagcttcgccggcagatgtggtggagggggtgtaaaattaaggcaatcatggccttggtcgcggcaatcttgctgctggttattataatcttgatagtcatgaagtacagaacgtag

SEQ ID NO: 47876 - DNA, 519 bp, Artificial Sequence
  Description of Artificial Sequence: Synthetic coding sequence
atgcggcggcagcccgccaaggtggccgccctgctgctgggcctgctgctggagtgcaccgaggccaagaagcactgctggtactttgagggcttatacccaacatattacatctgtcggtcatacgaggactgctgtggctctagatgctgtgtgcgagccctgagcatccagcgtctctggtatttttggtttctgctaatgatgggagtactgttctgctgcggtgccggattcttcattagacggaggatgtacccgccccctctgatagaagaaccagcttttaatgtctcatacacacggcagccgcctaaccctgggcccggagcccagcagccagggccgccttactacactgatcccggcggccccggcatgaaccctgtgggcaatagcatggctatggcctttcaggtccctcctaatagcccacagggaagtgtggcatgccctcctccccctgcctactgcaacaccccaccccccccatatgagcaggtggttaaggccaagtag

SEQ ID NO: 47877 - DNA, 510 bp, Artificial Sequence
  Description of Artificial Sequence: Synthetic coding sequence
atgctgagcgagaccctgggctacctgagcagcgtgctgctgcagtgcacagaagcgaagaagcactgttggtattttgaaggcctttatccaacatactacatttgcagatcgtatgaagactgctgtggttcccgttgctgcgtgcgcgcattaagtattcagagactgtggtatttttggtttctgttgatgatgggcgttctcttctgctgcggcgccggttttttcattaggcgcagaatgtaccctccccctctgatcgaggaacccgcctttaacgttagttacacacgtcagccccccaaccccggacccggggcacaacagccggggccgccatattatacggatccaggaggacctggtatgaatcctgtggggaactcaatggcaatggcatttcaggtccctccgaactctcctcaagggtccgtagcatgcccacctcctccagcttactgcaacacaccaccacctccttacgaacaggtcgtgaaggccaagtag

SEQ ID NO: 47878 - DNA, 2196 bp, Artificial Sequence
  Description of Artificial Sequence: Synthetic coding sequence
atgctgaaggagtgggccatcaagcagggcatcctgctgaaggtggccgaaactattaagtcttggatcttttttagtcaatgcaataaaaaggatgacctacttcacaaactggacatcggtttcaggctggactccctgcacaccattcttcagcaggaggtgctgctgcaggaggatgtcgaactcatcgaactgctggacccctccatcctgagcgccggtcagtcgcagcagcaagaaaacggccacctacccacactgtgtagtctggcgaccccaaacatttgggatctttccatgctgtttgcgttcatctcgctattagtgatgctccccacctggtggatcgtaagtagttggctcgtctggggcgtcatcctgttcgtgtacttggtgattagagccctgaggctgtggagaactgcaaaactgcaggttaccctcaagaagtactccgttcaccttgaagatatggccactaacagccgagctttcaccaatctggttagaaaggcactgcgtcttattcaggagacggaagttatcagccgcggatttactctggtctccgcagcctgcccattcaacaaggccggccagcatcccagtcaacacctaattggcttaagaaaagctgtgtaccggacccttagagcgaatttccaggcagcacggctggcaactctgtatatgctgaagaactaccccctcaatagtgagtcggacaacgttaccaactacatttgcgtcgtccccttcaaggaacttggacttggcctgtccgaagagcagatcagtgaggaagaggcccacaacttcaccgatggctttagcttgcccgctctgaaagtattgttccaactttgggtggctcaaagtagtgagttctttcgacgcctggccctgctgttatcaaccgccaattcgcctccaggaccgcttctgacccctgccctactgcctcacagaattctctctgacgtgacacagggactgccacacgcacactctgcttgcttagaggagcttaaaagatcctacgagttctaccggtattttgagacccagcaccagtctgtcccccagtgtttatccaagacccagcagaaaagtcgggaactgaacaacgtgcataccgcagtgagaagtttacaactgcaccttaaggccttgctaaacgaagtgatcattctggaggatgaactggaaaaacttgtctgcaccaaggagactcaggagctggtgagtgaggcctaccctattcttgagcaaaagctgaagttgattcagcctcatgtgcaggcctctaacaactgctgggaggaggcgattagccaggtggataagctactgaggagaaacaccgacaagaagggtaagcctgagattgcctgcgagaatccacactgcaccgtcgtgccactgaaacagcctacccttcatatcgccgataaggatcccataccagaggagcaggaactggaggcatacgtggatgacatcgatattgacagcgatttccgaaaggatgatttttactatctatcacaagaagacaaggagagacaaaagcgcgaacacgaggagtctaaaagagtattgcaagaacttaaaagtgtgttgggtttcaaggccagcgaggccgaaaggcagaagtggaagcagctcctcttttccgaccacgctgtgttgaaatccttaagcccggtggatccagtagagccgatctcaaacagcgagccgtcgatgaattctgacatgggaaaagtttcaaaaaatgatacagaggaggagagcaataaatcagccactactgataacgaaatttctcggacagagtacctgtgtgagaactctctcgaggggaaaaataaagacaactctagcaacgaagtgtttccccagggtgccgaggagagaatgtgttaccagtgtgagtccgaggatgaaccccaggcggatggctccgggttgaccaccgctcctccaactcccagggatagtctccaaccatccatcaagcagcgcctcgctcggcttcagctgtcgccagactttacctttactgctgggctcgctgcagaagtcgcagcgcgcagtctctccttcacaaccatgcaggagcagacttttgggggggaggaagaggaacaaattatcgaggaaaacaagaatgaaatcgaggagaagtag

SEQ ID NO: 47879 - DNA, 2340 bp, Artificial Sequence
  Description of Artificial Sequence: Synthetic coding sequence
atgctgcccgacatggaggacgtgcacctgttccagaacagccccctgtaccagtacctacaggatttgggtcatactgattttgaaatatgcagctccctgtcaccaaaaactgagaaatgcactacagaaggtcaacaaaaaccccccacccgggtactgcccaaacagggaattttactgaaggtggccgagactatcaaaagttggatcttttttagtcagtgtaataaaaaagacgacttgctccacaagctggacataggttttaggctcgacagtctgcatactatcctgcagcaggaggtgctgttgcaggaagacgtagagctgatcgaactcctggatccaagtattctctccgctggacagagtcagcagcaggagaatggccacctacctactctttgttcactggcaacacctaacatttgggacctcagcatgctattcgctttcatctctttgctggtgatgctgcctacatggtggattgtgagctcttggctcgtatggggggtgatactcttcgtctatcttgttatcagagcattgaggctgtggcggactgccaaactgcaggttactctgaagaaatattctgttcatctcgaagacatggctaccaacagccgcgcctttacgaaccttgttcgcaaagccctgaggctgattcaggagaccgaagtgattagtcggggatttacactggtgagcgccgcctgtccatttaataaagcaggtcagcatccttcgcagcacctgatcgggctgagaaaagcagtgtaccgcacactccgtgctaacttccaagcggctcgattggctactctgtacatgctgaagaattatccactcaacagcgagtctgataacgtgacaaattatatctgcgtcgtccctttcaaagagctggggctcggcctctccgaagaacagatttctgaagaagaagcccacaacttcacagatggattctcattgccagcactcaaagtattgttccagctgtgggtggctcagtcttctgagttttttcgccggcttgcactgctgctcagcaccgcaaactcacctccggggcccctgctaacacctgccctcctaccacatcgcatcctctccgatgtcacacagggcctgccacacgctcattctgcgtgtctggaggaactgaaacgctcctatgagttttatcgttactttgaaacacagcaccaaagcgtcccgcagtgtctttccaagacacaacagaaatcacgcgaactaaataacgtgcacaccgccgtcagaagtttacagctgcacttgaaggccctgttgaacgaggtgatcatcctggaggacgaacttgagaaactagtctgcaccaaagagacacaggagctggtaagtgaagcgtacccgatcttggaacagaaacttaagcttatccagccccacgtgcaggctagtaacaactgctgggaggaggctatttctcaggtcgacaaactgttgaggaggaatacagacaaaaagggtaaacccgaaattgcctgcgaaaatccccactgcacagttgttccgctgaagcagcctactctgcacatcgctgacaaagaccccatcccagaagagcaggaactggaagcctacgttgacgacatagatatcgacagcgattttagaaaagatgatttctactacctgtctcaggaggataaggagaggcaaaagagagagcacgaagaaagcaagcgtgtactccaggagctgaaatccgttctgggttttaaagcatccgaagcagagcgccagaaatggaagcagctcttgtttagcgaccacgcagttctcaaaagcctttctccagtcgatcctgtcgaaccgatctcaaatagcgagccctccatgaattcagatatgggcaaagttagtaaaaacgacaccgaagaagagtccaataagagtgcaaccaccgacaacgagatatcccggacagagtatctctgtgaaaattccctcgaaggcaaaaataaggacaattcctctaatgaggtatttccgcagggagccgaggaaaggatgtgctaccagtgtgagagtgaagatgaaccgcaggccgacggttccggcctgacaacggcccctcccacccctagagatagtctgcaacccagtataaaacaaaggctggctcggctgcaactcagccccgattttactttcaccgctggcctggccgcagaggtggctgctcggagcctctcctttaccaccatgcaggaacagacattcggaggcgaagaggaggaacagatcatcgaggagaataaaaatgaaattgaggaaaaatag

SEQ ID NO: 47880 - DNA, 2340 bp, Artificial Sequence
  Description of Artificial Sequence: Synthetic coding sequence
atgacccccgagttcgacgaggaggtggtgttcgagaacagccccctgtatcagtacctgcaggacttgggacataccgacttcgaaatctgctcttcactgtctccgaagaccgagaaatgcacaacagagggacaacagaagccgcctactcgggtgttgcccaagcagggaatccttctgaaggtcgccgaaaccataaagtcgtggatattttttagtcagtgtaacaagaaagatgatttactccataagctagacattgggtttagattagactcactgcatacaattctgcagcaggaggtcctcctgcaggaggatgtggaactcatagagcttctggaccctagcattttgagtgcgggccagagccagcagcaggaaaatgggcatctgcctaccctatgcagcttggcaacacccaacatctgggacctgtcgatgctattcgccttcatcagcttgttggtaatgttgcctacctggtggattgtctcttcttggctggtgtggggcgtaattctcttcgtctaccttgtcatccgggccctgagattatggcgtacggccaaacttcaggtgacattgaagaagtacagcgttcatctggaggacatggccacaaactctagagcattcacaaacttagtgcgcaaggcactccggctgatacaggaaactgaagtgatctcccgaggatttaccttagtctccgcggcctgcccttttaataaggcgggccagcacccctcacagcacttgatcggcctcaggaaggccgtataccgcacactgagggctaacttccaggccgctcgtctggccactctctacatgttgaaaaattatcctctgaattcagaaagtgacaacgtcacgaattatatatgcgtggtcccgtttaaggagttgggcctgggcctttcggaagaacagatcagcgaagaggaggcccataacttcactgatggatttagcctaccagctctgaaagttctctttcaactctgggtagcacagtcatcagaattttttagacggctagcactgttgctctctacagcaaatagtccacctgggcccctcctaacccccgcactcctgccacatcgcatactctccgatgtcacacagggccttccacatgcacactcggcctgcctggaagagcttaagaggtcctatgaattctaccgatactttgaaacccagcaccagagtgttccacaatgcctgtctaaaacccagcagaaaagccgagagctgaataacgtgcacacagctgtccggtctttgcagcttcacctgaaggccttactgaacgaagttatcattctcgaagacgaactggaaaaactggtctgcacgaaagagacccaggaactggtgtcagaggcttatcctattttggagcagaaattgaaattgattcagccgcacgtgcaggcaagtaacaattgttgggaggaagcgatctctcaggttgacaagctgttacgaagaaataccgataaaaaaggaaagcctgaaattgcctgcgaaaaccctcattgcaccgtcgtacccctgaaacagcccacattgcacatcgctgacaaggacccaattcctgaagaacaggagctcgaagcctacgttgacgacattgatatcgatagcgatttcaggaaggatgacttttactatctgtcccaggaggataaggaaagacaaaagcgggaacatgaggagtccaagcgggtcctccaggagctgaagtcagtattggggtttaaggcaagcgaggccgagcggcaaaagtggaagcagctgttgttctccgatcacgccgtcttgaagtccctgtctcctgttgaccccgttgaacccattagtaattccgagccttctatgaatagcgacatgggcaaggtcagtaaaaatgacacagaagaagaatcaaacaagtctgccacaactgataatgagatctctaggaccgagtatctatgcgaaaatagtctggagggaaagaataaggacaacagctcaaatgaggtgttcccccagggagcagaggagcgcatgtgctatcagtgtgagagcgaggatgagccacaggcagatggtagcggattgacaaccgcccccccaacgccccgcgactccctccagcctagcattaaacagcgattggctagactgcaactgtcccccgacttcacgtttacagccggactcgcagccgaagtagccgccaggtctctgagtttcacaacgatgcaggagcagacctttggcggcgaagaagaagagcagattattgaggaaaacaaaaatgaaatcgaagaaaaatag

SEQ ID NO: 47881 - DNA, 531 bp, Artificial Sequence
  Description of Artificial Sequence: Synthetic coding sequence
atggccgcccccgtgctgctgcgggtgagcgtgccccggtgggagagggtggccagatatgcagtgtgcgccgccgggatattattatctatctatgcctatcatgtagagcgcgagaaagaacgggaccctgagcatagagctctgtgcgacttgggcccctgggtgaagtgctctgccgcactggcaagccgctgggggagggggttcggcctgctgggctccatttttggtaaagacggggttctgaatcagcccaactccgtctttggattaattttttatatactgcagctcttgctggggatgactgccagtgcagtggccgccctgatcctcatgaccagttccattatgtctgtagtcgggtctctatacctcgcatacatcctgtactttgtactcaaggaattctgcattatctgcatcgtgacatacgttctgaactttctgctgcttataatcaactataaacggttggtatacttaaacgaggcttggaaacggcaattgcagccgaagcaggactag

SEQ ID NO: 47882 - DNA, 306 bp, Artificial Sequence
  Description of Artificial Sequence: Synthetic coding sequence
atggagcggcccgacaaggccgccctgaacgccctgcagccccccgagttccggaacgagtcatccctcgcatctaccctcaagacgctgttgttctttactgccctgatgatcaccgttccaatcggcctgtactttactacaaaaagctatatatttgagggcgccttgggtatgagtaaccgcgactcgtatttttatgccgctatcgtcgctgtggtggctgtgcacgtcgtgctcgcattatttgtttatgtggcctggaatgaaggatctcgccagtggcgtgaaggaaaacaagattag

SEQ ID NO: 47883 - DNA, 471 bp, Artificial Sequence
  Description of Artificial Sequence: Synthetic coding sequence
atgctgggcagcccctgcggcccccagctgagcgaccgggacgccgacgaagaccaatgtagcagagaattccgggggcggcgaagtcggcgcccaccccgacgcacaatgctaagaggaaaatcccggctgaatgtggaatggctgggctactcacccggcctgcttctagagcatagaccgcttcttgctgggcgcacgccccgttctcaccggaggaatgagtcatcacttgcatccacactgaaaacattgctgttcttcacggcacttatgatcaccgtacctattggcttgtatttcacaacaaagtcatacatcttcgagggcgctctgggtatgagcaaccgagatagctacttctatgctgccatcgtcgcagtggtggctgttcatgtcgtgctagccttgtttgtgtacgtagcttggaatgaaggcagccgacagtggcgtgaggggaaacaggactag

SEQ ID NO: 47884 - DNA, 1188 bp, Artificial Sequence
  Description of Artificial Sequence: Synthetic coding sequence
atgacccacaccctgtaccccacccccttcgccctgtaccccatcaacatttctgccgcttggcacctgggacccctaccggtgagctgcttcgtgtcaaataagtaccagtgctcactcgcatttggggccacaaccgggttacgcgtgctggtggtggtagtgccccagacccagttaagcttcctgtcctcactgtgtctggtgtccctgtttttgcactcacttgttagtgctcatggagaaaagccaaccaagccagtgggactcgaccccacactgttccaggtagtagtcggtatcctggggaacttttcgctgctgtattactacatgtttctttatttcagaggctacaaacccagatcaaccgacctgatcctcagacacctgacagtagcagatagcttggtcatccttagtaagcgcatcccagagacgatggcaacattcgggctcaaacatttcgacaactatttcgggtgtaaattcctgctgtacgcccaccgtgtgggcagaggcgtgtccattggaagcacatgccttttatccgtgttccaggtcataacgattaatccccggaattctcgctgggcagagatgaaggtgaaggcacctacctatatcggcctgtcaaacatcttgtgctgggccttccacatgctggtgaatgcaatttttccaatctacactactggaaagtggtcaaacaacaatatcactaagaaaggggacctcggatattgctccgctccattatcagacgaggtgacaaagagtgtctatgctgccctgaccagctttcacgatgttctatgccttggcctgatgttatgggcaagctcctcaatagttctggtcctctaccgccataagcagcaggtgcagcacatctgtagaaacaatctgtatccaaactcctctccaggcaatcgggccatccagtctatcctggcacttgtgtctactttcgccctgtgttatgccctctcctttatcacctacgtttatttggcgctgttcgacaactcctcttggtggctggttaatacagccgccctgatcattgcctgctttcctaccatttctccattcgtgttgatgtgccgggatccttctcgcagcagattatgttctatttgctgcagacgcaatcggcgtttctttcatgacttcaggaagatgtag

SEQ ID NO: 47885 - DNA, 8487 bp, Artificial Sequence
  Description of Artificial Sequence: Synthetic coding sequence
atgcccaagcgggcccactggggcgccctgagcgtggtgctgatcctgttatgggggcaccccagggtcgccctggcctgcccacatccgtgcgcatgctatgtgccaagtgaggtgcactgtacatttcgctccctggcaagcgtcccagcgggaattgctaagcatgtcgagcgcatcaacttgggcttcaacagcatccaggcactcagcgaaactagcttcgcaggactgaccaagttggagttattgatgattcacgggaacgagatcccgagtattccggatggcgctctgcgcgatctctcctctctgcaagtgttcaaattttcctataacaagctccgggtgattacaggccagacactgcagggcctaagtaacctgatgcgtctgcatatcgaccacaacaagattgagttcatccacccacaggccttcaatggtctgacgtccctgagactgctgcacttagagggaaacttattgcatcaactgcatcccagtacattttcaactttcacctttctggattattttcgactttccacaatcagacatctctacctcgctgagaacatggttcgtactctgcccgcctctatgctccgcaatatgcctctgctggagaatctctacctgcagggcaacccgtggacctgcgattgcgagatgcggtggtttctcgaatgggatgccaagtcaaggggcatcttaaagtgtaaaaaggacaaagcctacgagggtggccagctgtgtgccatgtgtttcagccctaagaaactatacaaacacgaaatccacaagttgaaagatatgacatgcctcaaaccaagtatcgagtcacctctgagacagaacaggtcccggagtatagaggaggagcaggagcaagaggaggacggcggaagtcagctgatcctggaaaaattccagttgccacagtggtccatctcactgaacatgacggatgagcatggaaacatggtgaacttagtctgtgatatcaaaaaacccatggacgtgtacaaaattcatcttaaccagactgacccgcctgatattgacataaacgcaactgtcgcgctggattttgagtgcccaatgacgcgggagaattatgagaaactttggaaactcatcgcctactattctgaagtccctgtgaagctccacagggagctgatgctaagcaaagacccacgggtcagttaccagtaccgacaggacgctgacgaggaggccctttattacacgggcgtcagggcacagattctcgctgaacctgaatgggtaatgcaaccctcaatcgatattcaactgaacagacggcagagcactgccaaaaaagttctactctcatattacacacaatactcccagactatatcaaccaaggatactcgtcaggctcggggccgtagctgggtgatgatcgaacctagcggcgccgttcagagagaccagacagtgctcgaaggcgggccttgccagttgtcatgtaacgttaaggcttcagaatctccaagtattttttgggtccttcctgatgggagcatcctgaaggctcctatggatgatccagactcaaaattctctatattgtctagcggttggttgcggataaagagcatggagccgagcgacagcgggctgtaccagtgcatcgcccaggtgagagacgagatggatcggatggtttacagagtgcttgtgcaatctccgtctacacagcctgcagaaaaggatacagtgacaatcggaaaaaaccccggagagtccgttactctgccatgtaatgcattggcaatcccagaggcgcatttgtcttggatcttgcctaaccggagaatcatcaacgatctcgccaatacttcccacgtctatatgcttcccaatgggaccctgagtattcctaaagtccaggtatccgactccggttactaccgttgcgtggccgtcaatcagcaaggggccgatcactttaccgttggaattacggttactaagaaaggctctggtctgcccagcaagagaggaaggcgccctggcgccaaggccttgtcaagagtgagggaggacattgttgaggatgagggcgggtccgggatgggcgatgaggagaacacttctaggcggctgctgcaccccaaagaccaggaggtcttcctgaaaactaaggacgacgcaatcaacggcgacaaaaaggctaaaaaaggaagaagaaaactgaagttatggaaacattccgaaaaggaacctgaaacaaacgtggcggaggggcgtagagtttttgagagccggcgccgcattaacatggcaaacaaacaaatcaatcccgaaagatgggcagacattcttgcgaaggtccgcggtaagaacctgccgaagggtactgaagtaccccctctgattaagactacaagcccgccctccctttcactcgaagtgacccccccattccccgcaatatcacctccatccgcaagccccgtgcagactgtgactagcgcagaggagtcttccgccgacgtaccactgctgggggaggaggagcacgttttaggcactatttcaagcgcctccatgggactggagcataatcataacggagtgatcttggtggagcccgaagtgaccagcactccactggaggaggtggttgacgatctttccgaaaaaaccgaagagattacaagtacagaaggtgacctgaagggaaccgccgcgcctacactcatctccgagccgtatgagccatcccctacactgcacactctggatacagtgtacgagaagcccacccatgaggaaactgccactgaaggatggtccgctgccgacgtgggttcctcccccgagccgacatctagcgagtacgaacctccacttgatgcagtcagtttggcagagtcagagcccatgcagtatttcgacccagatctggaaacgaaatctcagcccgacgaggataagatgaaggaggacacctttgcccacttaacaccaaccccaactatttgggtgaatgactcatcgaccagccagctcttcgaggacagcacaatcggagagcctggagttccagggcaaagccacctccaggggcttaccgataatattcatttggtcaaatcaagcctctcaacccaggacacactgcttatcaagaaaggtatgaaagaaatgagtcagactctgcaggggggaaatatgctggaaggggacccaactcattctcgcagctctgaaagtgagggacaagagtccaagtcaatcacactccctgatagcacactcggcattatgtcatccatgagtccagtcaagaaaccagcagaaacgaccgtagggacactattagataaagatactactacggccactactactccacgccaaaaagtagcaccgagctccacaatgtctacacacccatcccggcgccggccaaatggtcgccgccgccttagaccgaacaagttccgtcaccgacacaaacagacacctccaaccacttttgccccttcagagacattttcaacccagcccacacaggccccagatatcaaaattagtagccaggtggagtccagtctggtgccaaccgcctgggttgacaacacagtaaataccccgaaacaactcgagatggagaagaatgccgaaccaacctccaagggcacacctcggaggaagcacgggaagcgccccaacaaacacagatatactcccagcacagtgtcgtcgcgcgcctcgggctcaaaaccaagccctagccctgagaataaacacaggaatatagtgacaccctcctctgagacaatcctcctgccgcggaccgtttctctgaagactgaggggccctacgatagcttggactacatgacgactacaaggaagatctactccagttaccctaaagtgcaggaaactctgccagtgacgtataagcctacatccgacgggaaagaaatcaaggatgatgtcgccactaatgtggataagcacaaatccgacattctggttaccggcgagtccatcaccaatgccatccctacaagcagatcgttggtgtctacaatgggtgagtttaaggaagaaagtagccccgtgggatttcctggaacaccgacctggaacccatcaaggaccgctcagccaggacggctgcagacggggatacccgtcacaacctcaggagagaacttgacagatccgccgctactgaaggagcttgaggacgtggatttcaccagcgaattcctgagctcacttaccgtgtctactccattccatcaggaagaggctggcagttccaccacattgagcagcattaaggtggaggtggcaagctcccaggcggaaactacgaccctggaccaggatcatctcgaaacaaccgtcgccatacttttgtctgagactagaccccagaaccacaccccgaccgctgcacgcatgaaggaaccagcgagcagctcacccagcaccattctgatgtcgctcggacagacaactactactaagcccgcactgccatccccccgaatttctcaggcctcaagggacagcaaagaaaacgtttttcttaactatgtgggaaacccagagacagaagctactccagtaaacaacgaagggacccaacatatgtccggccccaatgagctctcaaccccgtcaagcgatcaggatgccttcaacctgagtaccaagctggagctcgagaaacaggtttttggctcccgaagcctgccaaggggtcccgattctcaacgccaagatggccgggttcatgcaagccaccaactcacccgtgttcctgctaaacctatacttcccactgccaccgtccggctccctgagatgtctacccagtcagccagtagatatttcgtaacctctcaatctccccggcattggacaaacaagcccgagatcacgacgtacccatccggggcactcccagaaaacaagcagttcaccactccccgattatccagcacaacaattcctctgcctctgcatatgtcgaagccatctatcccgagtaagtttaccgacagacgaacagaccagtttaatggctatagtaaagtgttcgggaacaataacatacctgaggcacgcaatcctgtcggcaagcccccaagtcctaggatcccgcactattcaaacggaaggttgcccttcttcactaataagactctgtcatttccccaacttggggtgacccgaaggccacagatccccacaagccctgccccagttatgcgcgagagaaaagtgatacccggctcttacaacaggatccactcacattcaacgttccaccttgatttcggcccacctgctcctcctctcctgcatacaccgcagacgacaggcagccccagtacaaacctacaaaacattccaatggtctcatcaactcagtccagcatttcttttattacgagctctgttcagtcaagcggctctttccaccaatcctcatctaagtttttcgccggcgggcccccagcctcaaagttctggagcctgggagaaaagcctcagattcttactaagtctccccaaaccgttagtgtgaccgcagagactgataccgtatttccctgtgaggccaccggaaagcctaagcccttcgtaacatggaccaaggttagtactggcgcactaatgacaccaaacacccgtatccagcggttcgaggtattaaaaaacggaacactggtcattcggaaggtccaggtgcaagaccgtggccagtatatgtgtactgcttcgaacctccatggcctcgaccgtatggtcgtgttgctgagtgtgacggtgcagcagccccagattctggcaagccactatcaggacgttaccgtttacctgggcgataccatcgcaatggaatgcctggccaaagggaccccggcaccccagatatcctggatctttcccgataggagggtgtggcagactgtctctccagtagaagggcggataaccctccacgaaaataggactctgtccattaaagaggccagcttcagcgaccgcggagtgtacaagtgcgtggcttcaaatgctgcaggcgccgactctctggcaatccgacttcatgtggccgcattgccaccggtgatccaccaagaaaaactcgagaacatctccctccccccagggctgagtatacacatacactgtactgcgaaggccgctcctttgccttccgtccgatgggtgctcggcgacggaacacagatcaggccgagccagtttttacacgggaacctgtttgtgttcccgaacggcacactatacattaggaacctggcccctaaggactccgggcgatacgagtgcgtcgccgcaaatctggtaggcagcgccaggcgcactgttcagctgaacgttcagcgggccgccgcgaacgcgaggatcacgggcacctcgccacggaggactgacgtaagatatggcggcacactcaagctggattgcagcgctagtggggacccttggccccgtatactttggcggctgcccagtaagcgaatgatagacgcactgttttcttttgatagcaggatcaaagtttttgcgaatgggacactcgtcgttaaatccgttaccgataaggacgcaggcgactacttgtgtgtagccagaaataaggtgggggatgattacgtggttcttaaagtggacgtggttatgaaacccgccaaaatcgagcacaaggaagaaaatgatcacaaggttttttatggcggggatctgaaggtggactgtgttgccaccggtctcccaaatccggagatctcatggtctttaccagacggttcgctggtgaacagctttatgcagtcggacgattccggcggcaggaccaagcgttatgtggtctttaataacgggaccttgtacttcaacgaagtaggcatgcgagaagaaggggactacacttgctttgctgagaatcaagttggaaaggatgaaatgcgcgtgagggtgaaggtggtcacagcccccgcgactattcgcaataaaacatacctggccgtgcaggttccatacggcgatgttgtgactgttgcttgtgaggctaagggcgagccgatgcctaaagtgacctggttgagtcccacaaataaggtcatcccaacctcttccgagaagtaccagatttaccaggatgggaccctgctgatccagaaggcccagcgatcagacagcgggaattacacatgtctcgtgcgaaactccgccggagaggaccgcaaaaccgtgtggattcatgtgaacgtgcaacctcccaagatcaatgggaatccgaaccccattactaccgttcgcgaaatcgctgctgggggaagccgtaaacttattgattgtaaggccgagggaatacctacgccccgagtgctgtgggccttccctgagggcgttgttttacctgcgccttactatggcaaccgaatcacagtgcatggaaacggctcattagacatcaggagtctccgaaaaagcgacagtgtgcagctggtgtgtatggccaggaacgaaggcggagaggccaggttgatccttcagctgaccgtgttggaacctatggaaaagccaatattccacgatcctatcagtgagaagattacggctatggccggtcataccataagtttgaactgctctgcagcagggacgccaactccctcgctggtgtgggtattgccaaacggaaccgacttacagagcggccagcaacttcagagattctaccacaaagcagacggtatgctgcatatctctgggttaagttctgtagacgctggcgcttatagatgcgtagcccgcaatgctgcaggccacacggagcgcctggtgagcctgaaggtagggctgaaacctgaggcaaataagcaataccacaatctggtctcaatcattaacggggaaactctcaaactgccctgtacccctcctggcgctggtcagggcagattctcttggacgctccctaatgggatgcacctggagggtccccagacactgggccgggtgtcactgctggataacgggacactgacagtgagggaggcctcagtgttcgacagagggacctacgtttgcagaatggagactgagtacggccccagcgtcacatcaatcccagttatcgtcatcgcgtaccctccacgcattactagcgagcccacccctgtgatatacaccagacccgggaacaccgtcaagctcaactgtatggccatggggatccctaaagccgatatcacctgggagctgcccgataagagccacctcaaggccggcgtccaagcccggctgtacggcaatcgattcctgcacccacagggctcacttaccattcagcatgctacacagcgggacgccggattctacaaatgcatggctaagaacatcctaggatccgattctaagaccacttacatccatgtcttctag

SEQ ID NO: 47886 - DNA, 1272 bp, Artificial Sequence
  Description of Artificial Sequence: Synthetic coding sequence
atggtgttcgccttctggaaggtgttcctgatcctgagctgcctggccggacaagtgtctgtggttcaggttactataccggacgggttcgtgaatgtcactgtgggctcaaatgtgaccctgatatgcatatacactacgaccgttgcctcccgggaacagctgagtatccaatggtcattttttcataagaaagagatggagccaataagccactccagttgcctaagcactgaagggatggaagaaaaggccgtaagccagtgccttaaaatgacccacgcccgggacgctagggggagatgttcctggactagcgagatttacttctctcagggggggcaggccgttgctatcggacaattcaaggaccggataactggctcaaatgatcccgggaacgccagcattaccatctcccatatgcagcctgcagactcaggaatctacatttgtgatgtgaacaatccaccagactttctgggtcagaatcaagggattctcaatgtgagcgtactggtaaaacccagtaagccactgtgttcggttcaagggcggcccgaaaccgggcatactatcagtctgagttgcttatccgcattggggaccccaagcccagtatattattggcacaagctggagggtagagacatcgtccccgtcaaggagaactttaatcctacgaccggtattctggtcattggcaatctaactaatttcgaacaggggtactatcagtgtactgccattaataggctgggcaactcctcctgtgaaattgacctgacctccagtcatcccgaggttggaattatcgttggtgccctgatcggcagcctggtgggggcagccatcataatctccgtggtttgctttgcacggaataaagccaaggctaaggctaaagagcgcaattcaaaaactattgctgaactggagccaatgacgaagataaaccccagaggagaatctgaagccatgccccgcgaagatgctacacaactggaggtgacactcccctcctctattcatgagacgggcccggacactatccaggagcctgattacgaaccaaaaccgacacaggaacccgcgccggagcctgcaccgggatcggaacctatggcagtgccagatctagatattgagcttgaattggaacccgagacccaaagtgagctcgagcctgaacctgagccagaaccagagtccgaaccaggagtggtggtggagcctctgagcgaggacgaaaagggcgtggtcaaggcatag

SEQ ID NO: 47887 - DNA, 1623 bp, Artificial Sequence
  Description of Artificial Sequence: Synthetic coding sequence
atggccgccggcggcagcgcccccgagccccgggtgctggtgtgcctgggagctctgctggccgggtgggtggcagtagggctggaggctgtggtgattggggaggtgcatgaaaatgtgactcttcactgcggcaatatttcgggactccgcggccaggtaacctggtaccgaaacaacagcgagcccgtgtttttgctgagcagcaacagctctctgcgccctgcagaacctcggttcagcctagtagatgcaactagcttacacatagaatccctgtctcttggggatgagggcatttatacttgccaagagatactaaacgtcacgcaatggtttcaggtctggcttcaggtcgcctcaggcccttatcagatagaggtgcacattgtggcaactggaactctacccaatggtaccctttacgcagccagagggtctcaggtggacttcagttgcaatagcagctcacgccctcctccagtggtggagtggtggttccaggctctgaactctagctcagaatcttttggccacaatctgaccgtcaattttttcagcctcctattaatttccccgaacctgcaggggaactacacatgcctggcactgaaccagctgtcaaaaagacatcgcaaagtaaccacggagcttttagtgtattacccacctccctccgccccccagtgctgggcccagatggcaagcgggtcattcatgctacagctgacctgtaggtgggacggcggctatcccgaccccgacttcctctggatagaggagcccggcggagttatcgtgggtaagagtaagctgggggtcgaaatgctgtccgaaagccagcttagtgacggaaagaagttcaaatgtgttacaagccacatagttgggcccgagagtggggcttcttgtatggtgcaaattcgagggcccagcctcctctctgagccgatgaagacctgtttcacgggcggaaatgtaactctcacctgtcaagtgagtggcgcatacccaccagcaaaaatcctctggctaagaaatctaactcagccagaagttatcattcagcctagttcccggcatttgatcactcaagacggacaaaactctactctgactatccacaattgttcgcaggacctagacgagggctactatatatgccgcgctgacagcccagttggagtgagggaaatggagatttggctttcagtgaaagagcccttgaatataggcggcatcgtgggcaccatagtgagtctgctcctgctgggattggccatcatttctgggctcctgctgcattatagtcccgttttttgctggaaggttggaaacacctccagggggcagaacatggatgacgtgatggtcctcgtggactcagaggaagaagaagaagaagaagaagaggaagaggaagatgccgctgttggagagcaggagggagcacgcgagcgggaggagttaccaaaagaaatccctaagcaggaccacatccatcgggtaaccgccttggttaacggtaatatagaacagatgggtaatggatttcaggatctgcaggatgattcctccgaggagcaatccgacatcgtccaggaagaagatcggcctgtgtag

SEQ ID NO: 47888 - DNA, 2604 bp, Artificial Sequence
  Description of Artificial Sequence: Synthetic coding sequence
atggacaacccccaggccctgcccctgttcctgctgctggccagcctagtgggcattctcaccttgagggcctcgtcgggactgcagcaaactaactttagtagcgcttttagctctgactccaaaagctcgagccagggcctgggggtggaggtgcctagtatcaagccacccagctggaaagtgcctgaccaattcttggacagtaaagcttcagctggaatttccgacagtagttggttccccgaggccctgtccagcaatatgagcggcagcttctggagcaacgtgagcgcagagggacaggacctcagtccagtatccccatttagcgagacacccgggagcgaagttttccctgacatttccgatccccaggttccagccaaagaccccaagccatcatttacagtgaagacaccagcatcaaacatctctactcaggtgagccatacaaagctctctgtggaagcacccgatagtaaattcagtccagacgatatggatctgaaactgtcagcccagtctccagaatccaaattcagcgcggagacccactcggccgcttcctttccccagcaggtgggtggtcctctcgccgtgctggttggcactactatccgtctaccacttgtaccaatccccaatcccggcccaccgaccagcctggtggtgtggagaaggggttcaaaagtgttggcggctgggggtctaggcccaggggctcccctcatctccctggatcctgcccatcgggatcatctacggtttgatcaggcgcggggggtccttgaactggccagcgctcagctagacgacgcaggtgtctacaccgcagaagtgattcgggcaggtgtctcccagcagactcatgaatttaccgtaggggtgtacgagcccctgcctcagctttcagtgcagcccaaagcgccagaaaccgaggagggagctgcagaactgaggctcagatgtttgggatgggggccaggtagaggcgagctcagttggtcaagggatggtcgggcgcttgaggccgcagagagtgagggcgccgaaacgccccggatgcgtagcgaaggagaccagttattgatagtccggccagtccggagcgatcacgctcggtatacgtgccgtgtacgtagcccgtttggccaccgtgaagctgccgcagatgttagtgttttctatggtccagatccccccaccatcaccgtgtccagtgaccgagacgctgcccccgcccgttttgtgaccgcaggttctaatgtaacattgcgttgcgcggccgcgtcacggccccctgctgatataacgtggagcctagccgaccctgccgaagccgcagtccccgccggatcacggctcctgctgcctgccgtaggcccggggcacgccggaacctacgcgtgtctcgctgccaatcctcggactgggagacgtaggagatcacttctgaacctcaccgttgcggaccttcccccaggagctccacagtgctccgtcgagggcggtcctggcgatcgttccctgagatttaggtgttcttggccaggaggcgcaccagccgcgagtttacagtttcaggggttacctgagggcattcgggccgggcccgtatcatcagtgctcctcgccgctgtcccagcccacccccgcctgagtggagtgccaattacatgtctcgcccgccacctggttgccacaaggacctgcacagtgactcctgaggcacctcgcgaggtccttctccatcccctggtagccgaaactagattaggcgaagcggaggtggctctggaggcatccgggtgtcccccacctagccgtgccagctgggccagagagggacgccccctcgcacctggcggtggaagcaggttgcgactgagtcaggacggtcgcaagttacacattggtaacttctccttagactgggatttaggcaactacagtgtgctctgcagcggagcgctgggagcaggaggtgaccaaattactcttatagggccctccatctcatcctggcgactgcagcgagcacgcgatgcggcagtccttacttgggacgtagagaggggtgccctgatctccagttttgaaattcaggcttggccagatggcccagcgctggggcgtacatccacgtatcgggattgggtcagtctgctgatccttgggcctcaagaaagatctgccgtcgtgcccctgcctcccaggaacccaggcacatggacctttcgtatactgccgattctgggtggacaaccagggactccatctcagtccagggtgtaccgggctggacccactcttagccacggcgccatcgccggcattgtgttgggctctttgttgggattggcgctcctggcggtgctcctcctgctgtgtatttgctgtttatgtcgcttccggggcaaaacccccgagaaaaaaaagcacccatctactctggttccagtcgtcactccaagtgagaagaagatgcatagcgtcactccagtggaaatttcttggccccttgatctgaaggtgcctctggaggatcactcaagcactcgagcttaccaagcccaaacaccagtgcagctgtctctgtag

SEQ ID NO: 47889 - DNA, 147 bp, Artificial Sequence
  Description of Artificial Sequence: Synthetic coding sequence
atggacaacccccaggccctgcccctgttcctgctgctggccagcctcgtgggtatcctgacactgcgcgcgtcgagcggattacagcagacaaacttctcctccgcactgcatcgcgctttttgggctagaactagctatttctag

SEQ ID NO: 47890 - DNA, 1200 bp, Artificial Sequence
  Description of Artificial Sequence: Synthetic coding sequence
atgggcatcctgctgggcctgctgctgctgggccacctgaccgtggacacttatgggcggccgatcctcgaggtgccagagtctgtgacaggaccctggaaaggcgatgtcaatttgccatgtacctatgatcctctccagggatatacacaggttctggtgaaatggctggtgcagcggggatcagatcctgtgactatcttcctccgggattccagtggggatcatattcagcaagccaaataccaggggcgtctgcacgtctcccataaggtgcccggagacgtgtcacttcaactctccacactggagatggacgaccgctcgcattacacctgtgaagttacttggcagaccccagacggaaatcaggtagtgcgagacaaaataacagaacttcgggttcagaagctgtcggtttcaaaacccacagtgacaaccgggtctggatatgggttcacagtacctcagggcatgcggatatccctgcagtgccaagcacgtggtagcccccctatctcctacatctggtataaacagcagacaaataatcaggaacccatcaaagtggcaactcttagtacactgttattcaagccagccgtgatcgctgattccggcagctacttctgcacagcaaagggccaggtggggtctgaacaacacagcgatatcgtgaaattcgtcgttaaggactctagcaagctgctgaaaacaaagactgaagcgcctaccactatgacctacccgttgaaggctacttccacagttaagcagtcctgggactggacaactgatatggacggctatctgggcgagacatctgccggacccggaaaaagcctgcccgtctttgcaattatccttattatctccttgtgttgcatggttgtctttacaatggcttacattatgttgtgtcggaagacctctcaacaggagcacgtctatgaagccgctagggcccacgctagagaagctaacgatagcggggagactatgagagtagctatcttcgccagtggttgctcctccgacgagcccacgtcccaaaatctgggaaataattactcggatgaaccttgcattgggcaggagtaccagatcattgcgcagattaacggcaactatgctcgactgctagacaccgtgccactggactacgagttccttgctactgagggcaaatcagtgtgctag

SEQ ID NO: 47891 - DNA, 918 bp, Artificial Sequence
  Description of Artificial Sequence: Synthetic coding sequence
atgggcatcctgctgggcctgctgctgctgggccacctgaccgtggatacgtacgggcgccccatcctcgaagttcccgagagtgttaccgggccatggaaaggggatgtgaatttaccttgcacatacgacccactgcaaggctatacacaggtgctagtaaaatggttagttcagcgcggctccgatccagtcacgattttcttgagggactccagtggcgaccatatacagcaggccaagtatcagggtaggctgcatgtcagccataaggttccaggagatgtgtcattacagctttctacgctggaaatggacgaccgatcgcactatacctgcgaggtaacgtggcaaacccctgacggaaatcaggtggtccgcgataaaatcactgaactgagagtccaaaaacactccagtaaactactgaaaacaaagaccgaggctcccaccaccatgacctatccgctcaaagccaccagtaccgtgaagcagagctgggattggacgacggacatggacggctacctgggcgagacatcagccggacccggaaaaagtctgccagtcttcgcaataatacttatcatctccctttgttgcatggtggtgttcacaatggcctacatcatgctttgcagaaaaacgtcacagcaggagcacgtttatgaggctgcaagggcccatgcccgagaagccaacgattctggtgagaccatgagagtagcaatatttgcaagcggatgctcatccgacgaaccaacgtcccagaacttaggcaacaactatagcgacgaaccatgtatcggtcaggaatatcagattatagcccaaataaacggtaattacgctcgtctcctggacacagttcctctggactacgaattcctggctaccgagggaaagtccgtatgttag

SEQ ID NO: 47892 - DNA, 606 bp, Artificial Sequence
  Description of Artificial Sequence: Synthetic coding sequence
atgggcatcctgctgggcctgctgctgctgggccacctgaccgtggacacctatggccgtcccatactcgaagtgccagagtctgttacaggcccctggaagggagatgtgaatctgccgtgtacctacgaccctcttcaaggatatacacaggtactggtgaagtggcttgtccagaggggatcagatcccgtgacaactgtcactactggaagcggttacggattcaccgtccctcaggggatgcggatttctctgcaatgtcaggcaagagggtcccccccaatttcttacatttggtataaacagcaaaccaacaatcaggaacccattaaggtcgccactctctcaaccctgttattcaaacccgcagtgattgccgattctggcagctacttctgcaccgccaaggggcaggttggttctgagcaacattctgacatagttaagttcgtagtgaaggacagcagcaagcttctaaagacgaaaacagaagcgcccacaacaatgacgtaccccctgaaggcaacctccacggttaagcagagctgggactggacgacggatatggatggatacctgggagaaaccagcgccggaccatag

SEQ ID NO: 47893 - DNA, 825 bp, Artificial Sequence
  Description of Artificial Sequence: Synthetic coding sequence
tgagaccacatccagcaggccaagtaccagggccggctgcacgtgtctcataaggtgcctggggatgttagcttacaattgtctacgcttgagatggatgaccgctcccattacacctgcgaggtaacttggcagacacctgatggtaatcaggtggtgagggacaagataactgaactcagggtgcagaagctgagcgtctccaaacccactgtgacaacaggatcgggttacgggtttaccgtgccacagggtatgcggatcagccttcagtgtcaagccagggggtctcccccgatctcatacatctggtataagcagcagactaacaatcaggagcccatcaaggtggccacgctgagcacacttttatttaaacctgctgtgatagcagactccgggagctatttctgcactgcaaagggacaggtgggttcagaacagcactccgatattgtgaaatttgttgtcaaagatagctccaagttgctgaagacaaagaccgaagccccaaccaccatgacttatccactcaaagccacaagcaccgtaaagcagtcctgggattggacaaccgacatggatgggtacctgggcgagacatctgccggacccggtaagagcctgccagttttcgcaattatactgatcatctcactgtgttgtatggtggtgttcacaatggcctacattatgctctgtcgtaagacatcacagcaagaacacgtttacgaggcagcttcccccaagtgccctccaacaaatacaggcgcagctggttcccactggctgtgccccggaatctgccagatgcacctgaagtag

SEQ ID NO: 47894 - DNA, 966 bp, Artificial Sequence
  Description of Artificial Sequence: Synthetic coding sequence
atgggcatcctgctgggcctgctgctgctgggccacctgaccgtggacacttatggtcggccaattttagaagtgccagagtctgttaccggaccttggaagggcgatgtgaacctgccttgcacctatgatcccctccaggggtacacccaggtgctggtgaaatggctcgtgcagcggggcagtgatccggtaaccatttttctgagagattcttccggagaccatatccaacaggcaaagtaccaggggagactgcatgtgtcacataaggttcctggcgatgtatccctccaactgtcaacgctcgaaatggatgatcggtcacactatacttgcgaagttacctggcagactccagacggaaatcaagtcgtccgtgacaagattacggagctccgggtccagaagctgtcagtcagcaagccgacagtgacgacgggttctggttatggatttactgtgccacagggtatgagaataagtctgcagtgccaagcacggggctccccgcccattagttatatatggtacaagcagcaaactaataatcaagagcctattaaagtcgccactttgtcaactctactttttaaaccggccgtaatcgccgattctgggtcctacttctgcaccgccaagggccaggtggggagcgaacagcactctgacatcgtcaagtttgtggtaaaggatagctccaaactcttgaagacaaagactgaggccccaacgacaatgacctatcccctcaaagctacaagtaccgtgaaacagtcctgggattggaccactgacatggatggatacctgggtgagaccagcgccggccccggaaagagtcttcccgtgttcgccataattttgattatctccctgtgctgcatggttgtgtttaccatggcctacataatgctatgtcggaaaactagtcaacaagagcacgtctatgaagcggctagatag

SEQ ID NO: 47895 - DNA, 1245 bp, Artificial Sequence
  Description of Artificial Sequence: Synthetic coding sequence
atgcgggtgggcggcgccttccacctgctgctggtgtgcctgagcccagcactgttgagtgccgtcaggatcaatggtgacggacaggaagtgctgtacttggccgagggtgataatgtacgtttggggtgcccgtacgtgctggacccagaggactatggccctaacgggctggacatagaatggatgcaggtaaattcagatccagcccaccacagggaaaacgtgtttctctcttatcaggataagcgcattaaccacggcagcctcccccacctgcaacagagggtgaggttcgcggctagtgatcccagtcagtacgacgcctctataaaccttatgaacttgcaggtgagtgacacagccacctacgaatgcagggttaagaaaaccactatggctacccgtaaggtgattgtcactgttcaagccagacctgccgtgccaatgtgctggacagaggggcacatgacttacgggaacgacgtcgtcctgaagtgttacgccagtggggggagtcagccgcttagctacaagtgggcaaaaatctctgggcaccactatccttatcgcgctggctcttatactagccaacatagctatcattccgagctgtcctaccaagagtcatttcattcctccatcaatcaaggccttaacaatggggatctagtgcttaaagatatcagcagggctgatgatgggctataccagtgcacagttgcgaacaacgtggggtattctgtctgcgtggtcgaagtcaaggtatccgactctcgacggattggggtcataatcgggatagttcttggaagcttgctggcgcttgggtgtctcgccgtcggaatttgggggctcgtgtgctgctgttgtggcgggtcaggtgctggcggagctaggggggccttcggttatggcaacggagggggagtgggcggaggcgcttgcggagaccttgcctccgagattcgggaggacgctgtggcacctgggtgcaaagcctcgggccgtggcagcagggtgactcacctgcttggctacccaacacagaatgtgtctcgatccctgaggcgaaaatacgctccccctccatgtgggggcccagaggacgtggccctggcaccctgcaccgccgctgccgcttgtgaggctggacccagcccggtgtacgtgaaagtgaaatctgcggagcccgccgattgcgcggagggacccgtccaatgcaagaatgggctccttgtttag

SEQ ID NO: 47896 - DNA, 576 bp, Artificial Sequence
  Description of Artificial Sequence: Synthetic coding sequence
atgcggctgctggccctggccgccgccgccctgctggcccgggcccccgcgccggaggtgtgtgcagccctaaacgtgaccgttagcccagggcccgtggtggactatctggagggtgaaaatgcaacgctattatgtcacgtctcacaaaagaggcgcaaggactctctgctggctgttcgatggttcttcgcgcattcttttgactctcaggaggcacttatggtgaagatgacaaagctccgcgtggtgcaatattacgggaacttctcaaggtccgctaagcgacgtcggctgagactgctggaggagcagaggggggccctctacaggctgagcgtccttaccctgcagccaagcgaccagggtcactatgtgtgccgcgtccaagaaatctcccgccaccggaataagtggactgcatggagtaatggctcctccgctacagaaatgcggggagtatcgtcccatcctgtggagcgaggtgcattcttaggcatttcactggtgattctgcctcactccctcccctttaccgccgatctgacaatggcgagctttcttcagtcttcatag

SEQ ID NO: 47897 - DNA, 963 bp, Artificial Sequence
  Description of Artificial Sequence: Synthetic coding sequence
atgcggctgctggccctggccgccgccgccctgctggcccgggcccccgctcctgaagtgtgcgccgcacttaatgtcactgttagccctggacccgtggtggactacctggagggtgagaacgctaccttactctgccacgtctctcagaaaagacggaaagattctctcttggccgtgcggtggttcttcgcccatagcttcgactcccaggaagctttgatggttaagatgacgaagctcagagttgtccagtattatggtaactttagccggtccgctaaacgcagaagattgaggttattggaggagcagaggggcgcattgtacagattgtccgtgctcaccctccagccctctgaccagggacactacgtctgccgcgtccaggaaatttcccggcaccggaacaaatggacagcctggtccaatggctcctctgctacagaaatgagagtgataagtctgaaggcaagcgaagagagctcttttgaaaaaactaaggagacttgggccttctttgaggatctctatgtctacgcagttctggtgtgttgcgtcggcatcttatctatcctcctgtttatgttggtgattgtgtggcaatccgtcttcaataaaagaaaaagtcgggttagacattacttagtgaagtgcccacaaaatagtagcggggagaccgtgacttctgtcacgtccctcgctcccttacaacctaaaaaaggcaagaggcaaaaagagaaacccgatatcccgccggctgtaccagcaaaggctcctatcgcgcccacctttcacaagccaaagctactcaagccacaacggaaggttaccctgcctaagattgccgaggaaaacctaacttatgcagaactcgagcttatcaagccccatcgcgctgcaaagggtgctcccacgtccacggtgtacgcgcagatattgtttgaagagaacaagctctag

SEQ ID NO: 47898 - DNA, 603 bp, Artificial Sequence
  Description of Artificial Sequence: Synthetic coding sequence
atgcggcccctgcccagcggccggcggaagacccggggcatcagcctgggcctgttcgccctgtgcctggcagccgcacgctgtctacagagtcagggggtgtctttatacattcctcaggctacaatcaacgcgacggtcaaggaagatatcctcctgagcgtggagtactcctgccatggagtgcctacaattgagtggacctattctagcaactgggggacccagaaaatcgttgagtggaagcctggtacccaggctaatatatcccagagccacaaggaccgtgtgtgcacctttgacaacggctccatacagctgttcagcgtcggggtcagggattccggatactatgtgattaccgtcaccgaacggcttggctcaagccaatttggcaccatagtcctccacgtctctgaaattctttacgaggatctgcactttgtcgctgtgattttggccttccttgctgccgtcgccgccgtgctgatatctttaatgtgggtttgcaacaaatgtgcttacaagtttcaacggaagaggcgtcataagttgaaggaatccacaaccgaagaaattgagctagaagacgtggagtgttag

SEQ ID NO: 47899 - DNA, 501 bp, Artificial Sequence
  Description of Artificial Sequence: Synthetic coding sequence
atggccagcctgggccagatcctgttctggagcatcatcagcatcatcatcatcttagcaggtgccattgccctaattatcgggttcgggatctctgcgttctctatgcccgaagtaaacgttgattacaatgcatcctcagagaccctgcgctgcgaggccccccgatggttcccacagcccactgtagtgtgggcaagccaggtggaccagggtgcaaactttagcgaggtgagtaacacatccttcgagctgaatagtgagaacgttacaatgaaggtcgtgtctgtactctacaacgtaacaataaataatacatatagttgtatgatcgaaaacgatattgccaaggcgactggcgatattaaagttactgagtccgaaatcaaacgcagatctcaccttcaactgctgaacagtaaggcttccctgtgcgtgtcttctttctttgcaattagttgggcactgctgccgctttccccctacctgatgctgaagtag

SEQ ID NO: 47900 - DNA, 858 bp, Artificial Sequence
  Description of Artificial Sequence: Synthetic coding sequence
atggtgctgctgaccagccggatgaagcccctgaccagccggatcatttccatcataatcatcctggctggggcgatcgcactcataataggtttcggaattagcgggagacactcaataacggtgaccaccgttgccagcgccgggaatattggtgaggatggcatcttaagctgtacattcgagcccgatataaaactgtccgacatcgtcatacagtggctgaaggagggggtactgggtttggtccacgaattcaaggaaggtaaggatgagctcagcgaacaggatgaaatgtttagagggagaacagcagtgttcgctgaccaggtgatcgtaggtaacgcatccctgagacttaaaaacgtgcagttaacagatgcggggacgtacaaatgttatattattactagcaagggcaaagggaatgccaatttggagtataagacaggcgcttttagcatgcccgaagtaaatgtggattacaacgcctcatccgaaactctgcgttgcgaagcaccccgatggtttcctcagcctacagtggtctgggcgagccaggtggatcaaggagctaatttttctgaagtctctaacactagttttgagttgaattccgagaatgtcaccatgaaggtagtttccgtactatacaacgtgacaatcaacaacacctattcctgtatgatcgaaaacgacattgctaaagctaccggagatatcaaggtgaccgagtctgagataaaacgcagatctcatttacagttgctcaactctaaggcgagcttgtgtgtcagctccttttttgctatcagctgggcccttttgccgctgtccccttatctgatgcttaaatag

SEQ ID NO: 47901 - DNA, 258 bp, Artificial Sequence
  Description of Artificial Sequence: Synthetic coding sequence
gccaccctgcggaacaagctgatgtggaacatcatcagcatcatcattattctggcgggcgcgattgcccttatcatcggctttggtattagcgaggtgagcgtgtggctttctgcaatgaagggctgcaggtcaagcaaggccagcctttctatcgacctttgttttctaaattgcagggaaaccctacaccatagccactattgccgtttgtcgtgggaacactggggaggctggaaccctgagctgcatttctag

SEQ ID NO: 47902 - DNA, 849 bp, Artificial Sequence
  Description of Artificial Sequence: Synthetic coding sequence
atggccagcctgggccagatcctgttctggagcatcatcagcatcattattattcttgccggagcgatcgcgttaataatcggattcggcattagcggacggcattctattactgttaccactgtcgcatcagcaggcaacatcggcgaggacgggatattatcctgtaccttcgagcctgacattaaactctctgatattgtgattcagtggttgaaggaaggagtactggggctggtgcatgagttcaaagaggggaaggacgagctctctgagcaagatgagatgttccgcggaaggacggctgtgtttgcggatcaggtgatcgtgggtaacgcatctttaaggctgaagaacgtgcaattaaccgacgcaggcacctataagtgctatatcattacaagtaaagggaaagggaatgccaacctagagtataagacaggggctttcagcatgcctgaagttaatgtggactacaacgcatctagcgagaccctgagatgtgaagccccacgttggttcccccagcccaccgtcgtctgggctagtcaggtcgaccagggcgccaacttctccgaagtctcaaatacttcctttgagttaaacagcgaaaacgtaaccatgaaggtggtgagtgttctgtacaatgttacaattaacaatacatacagttgcatgattgaaaatgatattgccaaagcaacaggcgacatcaaggtgacagaatcagagataaagagaaggagccacctgcagttgctgaactcgaaagcaagcttatgtgtctcctccttcttcgcaatcagttgggcgctgctgccactctccccctacctgatgctgaagtag

SEQ ID NO: 47903 - DNA, 564 bp, Artificial Sequence
  Description of Artificial Sequence: Synthetic coding sequence
atgttccggggccggaccgccgtgttcgccgaccaggtgatcgtgggtaacgcctcccttagactaaaaaacgttcagctgacagatgcagggacatacaagtgttatattatcacttccaagggaaaggggaacgccaacctggaatacaaaacgggcgcctttagcatgcctgaagtcaacgtggattataacgcgtctagtgaaactctgaggtgcgaggcccccaggtggttccctcagcctaccgtggtgtgggcaagccaggtggatcagggcgccaatttctcggaggtgagcaatacctcctttgaactgaatagtgaaaacgttactatgaaggtcgtatccgtcttgtataacgtgaccattaataacacatatagttgcatgattgagaatgacattgcaaaggcaacaggggatattaaagtgacagagtccgagatcaagcggagatcccatctacaactgttgaatagtaaggcgagcctgtgtgtgtcctccttttttgccatctcctgggccctgttacccctgagcccttacctaatgttgaagtag

SEQ ID NO: 47904 - DNA, 1434 bp, Artificial Sequence
  Description of Artificial Sequence: Synthetic coding sequence
atgagcggcgtgatgtgcctgaaggccagcgacacctgggccagcggcatccggtcccaaccccagggttgtctaggcaagtggaggagcatgcggtgtaagcacacgagaatgcacctggctcacctaggaaacagccggcagctgattagtctgggtccccctaggacccgggaggacggatcaaggatttctcagcaagtggagcagtctcgatctcaggtgcaggcgattggagagaaagtatccctggcacaggccaagatcgaaaagatcaaaggctcaaaaaaagccatcaaggttttctccagcgccaaatacccagctcccgagcggctgcaggagtatggctccatattcactgatgcccaggaccctggtcttcagcggcgcccaaggcacagaattcagagcaagcagaggcccctggacgaacgggcattgcaggaaaagttgaaggatttcccagtttgtgtgagtacaaaacctgagcccgaagatgatgccgaggaaggcctcggcggcttacccagtaatatttccagcgtgtccagtctgctgctctttaataccaccgagaacctttacaaaaaatacgtcttcctggacccactggctggcgcagttacaaagacgcacgttatgctgggcgccgaaaccgaagaaaaattgtttgacgccccactgtctatctctaaacgcgaacagctcgagcagcaagtcccagagaactatttttatgtgcccgacttgggccaggttcccgagattgatgttccaagctatttaccagacctccctggaatcgccaatgacttaatgtatatcgcagaccttgggcctggaattgcgccctccgccccgggtaccatcccagagctaccaacctttcacacagaggtagcagaacctctgaaggttgatctgcaggatggcgtcctgaccccccctccacctccccccccacccccacccgctcccgaggttcttgcctccgcacctcccctccccccatctacggcggcaccggttggtcagggtgcacgccaggatgactccagttcgtcagcttctccttctgtgcagggagccccaagggaggtcgttgatccttcaggaggctgggcgactttactcgagagtatccggcaggctggagggattgggaaagccaaactgagatcgatgaaggagcgtaagctggaaaagcaacagcaaaaggaacaggagcaggttcgagctacctcccaaggaggccacctcatgtctgacctctttaataagctggttatgcgacgtaagggcattagcggaaaaggcccgggcgccggcgatgggccgggtggcgccttcgctcgggtatcagattctatcccacccctcccacccccccagcagccgcaggccgaagatgaagacgactgggagtcttag

SEQ ID NO: 47905 - DNA, 510 bp, Artificial Sequence
  Description of Artificial Sequence: Synthetic coding sequence
atgagcggcgagatggccttccacgagatgcaggcccacaagaacgcattaggcacgtcaggggagcagcaggctgcggatatcacgggcccaacaccacatcagggtggatggaagcaggtggagcaatctaggtcccaggtgcaggctattggtgagaaggtctctctggcccaggcgaagattgaaaagattaaggggagcaagaaggccatcaaagtcttctctagcgctaagtaccctgcccctgaacgtctacaggaatatgggtccatttttacagacgcccaggacccgggattacagcgccggcctcgtcatagaatccagtctaaacagcggccactggacgaaagggccctccaggaaaagctgaaggattttcccgtttgcgtcagcactaaaccagaacccgaagacgacgccgaggaaggcctaggggggctcccctcaaacatctcttcagtcagttctctgctgcttttcaacaccaccgagaacctttactag

SEQ ID NO: 47906 - DNA, 1344 bp, Artificial Sequence
  Description of Artificial Sequence: Synthetic coding sequence
atggccttccacgagatgcaggcccacaagaacgccctgggcaccagtggggaacagcaggcagcagacatcacagggcccactcctcatcaggggggttggaagcaggtggaacaatctcggtcacaggtccaggcgatcggcgaaaaagtgtcccttgcccaggccaaaatcgagaaaattaaggggtccaaaaaggcgattaaagtgttcagttctgcgaagtatcccgcccctgagcgcctacaagagtatgggagcattttcaccggcgctcaggatccagggcttcagcgccggccacgacacaggatccagagcaagcacaggccactggacgaacgcgccctccaggaaaagcttaaagacttccccgtctgtgtctctacaaagcccgagcctgaggacgatgcggaagaaggacttggcgggctgcctagcaatataagcagtgtgtcttctttgttgctgtttaacacgacagagaatctttataagaaatacgtgtttctagatcccctcgcaggggccgtcactaaaacacacgtgatgcttggtgccgagaccgaagagaagctcttcgatgcccctttgtctatttctaagcgggaacagcttgaacagcaagttcccgaaaattatttctacgtgcccgatctgggtcaggtgcccgagatcgatgttcctagttaccttccggatcttccatctattgcgaacgacctgatgtattccgctgacttaggtccaggcatagcaccatccgcgcccgggaccattccagagctcccaacatttcacaccgaagtggcagaaccattgaaagcagatctgcaagacggggttcttaccccccctcctccacccccccccccccctccggcaccagaagttctagcaagcgctccaccattgcccccgtctacagcagcccccgttggacaaggcgcccggcaggacgatggtagctccagtgccagtccttctgtgcagggcgcccctcgggaggtcgtggacccctctgggggatgggcaacccttctggagtccatccgccaggccggcggtatcggcaaagcaaagttacgatctatgaaggagcggaagctggagaagaaaaagcagaaggagcaagagcaagtgcgcgcaacctcccaaggggggcacctcatgtctgatctgttcaacaaacttgttatgcggagaaaggggatctcagggaaggggcccggtgctggggaggggccaggaggcgctttcgcgagggtgtctgacagcattccacccgtccccccaccccagcaaccacaggcagaagaggacgaagacgattgggagtcctag

SEQ ID NO: 47907 - DNA, 1437 bp, Artificial Sequence
  Description of Artificial Sequence: Synthetic coding sequence
atgagcggcgtgatgtgcctgaaggccagcgacacctgggccagcggcattcgctcgcaaccgcagggatgtttgggtaaatggagatctatgcgctgtaagcatactcgcatgcatctggcgcaccttggcaactcaaggcagctgatttctctgggcccacccagaactcgcgaggacggctcgcggatatcccagcaggtggagcagtctcgaagccaagtccaggcaatcggagagaaggtcagtctagcgcaggccaagatagagaaaatcaaaggctctaaaaaggcaattaaagtttttagcagcgcgaagtatccagctcctgaaagactgcaggaatatggctccatcttcacaggagcccaggaccccggtttgcagcggcggcctaggcatagaatacagtcaaaacaccgccccctggatgaaagagccctgcaagagaagctgaaggatttcccagtgtgtgtcagcactaaaccagaaccagaggatgatgcagaagagggactcgggggacttccatctaacatctcttcagtaagttcgctgctcctgttcaataccactgagaacttgtacaaaaagtacgtcttcctggacccactcgccggggctgtaaccaagacgcacgtaatgttgggcgctgagactgaggaaaagctctttgacgcccctctgtccataagcaaaagagagcagctagagcagcaggttcctgagaattatttttacgtccctgatttaggacaggtaccagagattgacgtgccaagctatctccccgatctgccatccattgccaacgatttgatgtattcggccgaccttggacctggcatcgctcctagcgctccaggtacaatccctgaactgccaactttccacacagaggtagctgaacctcttaaagcggatctacaggacggagtacttacacctcccccacctccccccccacctccacccgctcctgaagtgctggccagcgctcctccgttacctccctctaccgccgccccagtaggacagggagcccggcaagatgacggctcctcgagcgccagccctagcgtgcaaggggcgccgcgagaggtagtggatcctagtggcgggtgggccacgctattagagtcaattagacaagccggcgggatcggtaaggccaaacttcgcagcatgaaggaaaggaaattggagaaaaagaagcagaaagagcaagaacaggtgcgagctaccagccagggaggacacttaatgtcagatctattcaacaagctggtgatgaggagaaagggcatttcagggaagggtccaggggccggagaaggcccaggtggagcatttgctcgggtgagcgattccatcccgccagtaccccctcctcagcagccccaggctgaggaggacgaggatgactgggagagctag

SEQ ID NO: 47908 - DNA, 10581 bp, Artificial Sequence
  Description of Artificial Sequence: Synthetic coding sequence
atgaacatggtgaagcggatcatgggccggccccggcaggaggagtgctccccccaagacaatgcgcttggactcatgcacttgcggaggttgttcacggagttgtgtcatccacctaggcacatgacccagaaagaacaggaagagaagctgtatatgatgctgcctgtgtttaacagagttttcggtaacgcacctcctaacacaatgacagagaaattcagcgacctcctgcagtttacaactcaggtatcccggttaatggtaaccgagatccggaggcgcgcgtctaataagagtaccgaggccgcctccagagccattgtgcagtttctggagataaatcagtcagaagaggcgtccaggggttggatgttactcaccaccattaacctgctggcatcaagcggccagaagactgtggactgtatgactaccatgtccgtcccgagcaccctcgtgaagtgcctatacctgtttttcgatctgccacatgtgccagaagcagtcggtggggcccagaacgagctgccactagcagagcggcgcggacttcttcagaaagtttttgtgcagatcctcgtgaaactctgctccttcgtcagcccagccgaagaacttgcgcagaaagacgatctccagcttctgtttagcgctatcacttcttggtgcccgccatacaatttgccctggcgaaaaagtgcaggcgaagtgcttatgacgatctctcgtcacggcctctctgtgaacgtggtgaagtatattcatgaaaaggagtgtctatccacctgcgtccagaacatgcagcagtcagatgacctgagtccgttggagattgtcgagatgttcgctggcctatcatgtttcctgaaggacagttcagatgtgtcacagacgctgctggacgattttcgcatatggcagggatacaatttcctctgtgatctcctgctgcggcttgagcaggctaaggaagcagagagtaaggatgctttaaaggacctagttaacttgatcacttcactgactacatacggagtatccgaattgaagccagcgggcattaccaccggcgcccccttcttgctgccaggattcgccgtgccgcagccagcaggcaaaggtcactctgtgagaaacgtgcaggctttcgccgttttacagaatgcattccttaaggctaaaactagcttcttagcccagataattcttgatgccattaccaatatttacatggccgacaatgccaattatttcatcctggaaagccagcatacgctgtcccagtttgctgaaaagatctccaagctacccgaggtccagaacaagtattttgagatgctcgaattcgtggtttttagccttaattatattccctgcaaagaactcatttctgtgtccattctcctgaaaagcagttcttcataccattgcagtatcattgccatgaaaaccctcctgaaatttacccggcatgactatatttttaaagatgttttccgcgaagtcggccttttggaggtcatggttaatcttctccataaatatgctgcactgctgaaggaccccacacaggccctgaacgaacagggtgattcaaggaataattcatcggtcgaggaccagaagcatctcgccctcttagtgatggagacactcactgtgctattgcagggctccaacaccaatgctgggatctttcgtgaatttggcggtgccaggtgtgctcataacattgtgaagtaccctcagtgcaggcagcacgctctcatgacaattcagcagctggtgctctctcctaacggcgatgacgatatggggacacttctcggtctgatgcactcagctcccccaacagagctccagttgaagacagatatcctaagagcccttctgtcagtcctaagggagtctcacaggtctagaaccgtctttcgcaaggtgggtggctttgtctatatcacaagccttctagttgccatggaacggtctttatcctgcccccccaagaatggatgggagaaggttaatcagaaccaggtgttcgagcttttacacactgtgttttgcaccttaacagctgcaatgcgctacgagcccgctaatagccatttttttaagacggagatccaatatgaaaagttggcagatgctgtgcgcttcttgggctgcttttcagacctcaggaaaattagcgccatgaatgtgttcccatccaatacccagccatttcagaggcttctggaagaagatgttatttctatcgagtcagtgagtcccactctgagacattgcagcaagttattcatttacttatataaagtagccacagattcgttcgactccagggccgaacagattcctccctgcctaaccagcgagtcttctctgccctctccctggggaacccctgccctgtctagaaaacggcatgcctatcacagtgtgtctactccaccagtttatccaccaaaaaacgtcgccgacctaaagcttcatgtcacgacgagctccctccagagcagcgacgccgtgatcattcatcccggagcgatgctggcaatgctcgacctcctggcgtctgtgggtagtgtcacccagccagaacacgctctggaccttcaacttgctgtcgccaacatcctccagagtctggtgcacacagaaagaaatcagcaggtgatgtgcgaggcgggtctgcatgcccgtctgctgcagcggtgcagcgcagccctcgcagacgaggaccattcacttcatccccccctgcagcgcatgtttgagcgcctggcctctcaggctctggaacccatggtgctgagggagtttctcaggttagccagtccgctcaattgcggggcctgggataagaaactccttaaacagtatagggtccacaagcccagcagcctcagctacgagcccgagatgcgctcttcaatgatcacctctctggagggcctgggaacagataacgtgttttctctccatgaggacaaccactacagaattagtaaatcccttgttaaatctgccgaaggaagcaccgtgcctctaaccagagtcaaatgtctagtgagcatgacaacaccccatgacattcggctccatggtagtagcgtgacgccggctttcgtggaatttgatacatctctggagggatttgggtgtctattcctgccctccctagcccctcacaacgctcctaccaataacacagtcactaccggacttattgacggagccgtggtatcagggatcgggtccggcgaaagatttttccctcctccctcaggtctgtcatacagttcatggttctgtatagaacacttcagttctccgccaaataatcaccccgtgaggctgttaactgttgtgagaagagctaacagctcggagcagcattacgtatgtctggcaattgttctgtctgcgaaagatcgctccctgattgtgtccaccaaagaagagctattgcagaattacgttgacgactttagcgaggaatcttctttctatgaaatactgccctgttgcgcacgctttcgttgcggcgaactgatcatcgagggccaatggcatcatctcgtcctggtgatgtcaaagggcatgctaaaaaacagcaccgctgccctgtacattgacgggcaactagttaatacagtgaagctgcattacgtgcacagcacgccagggggatccggctccgccaatcccccggtcgtgtccaccgtgtatgcctacatcggcactccaccagctcagcgacagatcgcctccctagtttggagacttggacctacacacttcctggaagaagtgctacctagttccaatgttacaacaatctatgaattaggacctaattacgtgggcagcttccaggccgtttgcatgccttgcaaagacgctaagagtgagggggtcgtccccagtcctgtaagcctggtcccagaggaaaaggtaagttttggtttgtacgccctgtccgtgagttccctgacagtggctaggattcggaaggtctacaataagctggactcaaaggctatcgccaagcagctgggaatctcctctcacgagaatgcaactcctgttaaactcattcataactccgccggacatctcaatggctccgctcggacaataggggccgccctgatcggataccttggagtccgaacctttgttccgaaacccgtggcgacaactctgcagtacgtcgggggagcagccgctatcctgggtctggtggctatggcctccgacgtggaggggctgtatgccgccgtgaaagctctggtctgcgtggtgaagagtaatccgttggcatctaaagagatggagcggatcaaaggctaccagctcctggccatgttactgaaaaagaagaggagcttactgaatagccacattttgcacctcacattctccctggtcggcacagtagactctggccatgagaccagcattattcccaattcaactgcatttcaggatttattgtgcgatttcgaagtctggctccacgctccctacgaactacacctgagccttttcgagcattttatcgagctgcttactgagtcctccgaggcctcaaagaacgcaaaattgatgcgggaatttcaactgatacccaagctcttgcttactttacgagacatgtcactaagtcagccgacaattgcagccatatcaaacgttctctctttcctgcttcagggatttcccagctcaaacgacctactgcgctttggccaatttatatcatccactctgccaacctttgcggtctgcgagaaattcgtggttatggagatcaacaacgaggaaaaacttgacacagggaccgaagaggaattcggcggattagtatccgcgaatctgatacttttgagaaataggttactggacatcctgctaaaactgatctatacttccaaggagaaaacttcaatcaacctgcaggcttgtgaagaattggtgaagactctggggttcgactggatcatgatgttcatggaagagcatctgcactcaacaaccgtcaccgctgctatgagaattctagttgtcctgctgtctaaccagagcattttaatcaagttcaaggaaggattgagcggtggtggatggctggagcagacagattcggtcctcaccaataaaataggcactgtcttggggttcaacgtgggccggagcgccggcggacgctccacagtgcgggaaattaatcgagacgcatgccattttcctggttttcccgtactccagtcctttttgccaaaacacacaaatgttcccgcgctttatttcctgcttatggctctgtttttgcagcagcccgtcagcgaactcccagaaaacttgcaggttagcgttcccgtgatctcctgcaggagtaaacaggggtgccagttcgacctcgactctatctggactttcatttttggagttcctgccagctcagggacagttgtttcctctattcacaatgtctgcaccgaggccgtatttctcctcttaggcatgctcaggtcaatgctcacctctccatggcagtctgaggaggaaggctcgtggctcagagaatatcccgtcactcttatgcagttcttcaggtacttataccacaacgtccctgacctggcgtccatgtggatgtcaccggacttcctgtgcgccctggcagcaaccgtttttcctttcaacatccgtccctattccgagatggttaccgacctagatgacgaggtggggagcccagcagaggaattcaaggcgtttgcagcagacacaggaatgaatcgcagccagtcggaatattgcaacgtggggacgaagacttatctgaccaaccacccggcaaagaaattcgtgttcgatttcatgagagtgctgatcatcgataacctgtgtctcactccagcttcaaaacaaacaccactgattgacctattactggaagcctctcctgaaagaagtaccagaacacagcaaaaagaattccagacctacatcctcgattctgtgatggaccatttgctagctgccgatgtcctgcttggcgaggacgccagcctgccaatcactagcggaggaagttatcaggtcctggtcaacaatgtcttctactttacacagcgggtggtcgataagctgtggcagggcatgttcaacaaggaatcaaagctgctgattgatttcattattcagctgatagcgcagagcaagaggagatcgcagggcctcagcctggatgccgtataccattgtctaaatcgaactatcctttaccagttttcccgggcacacaaaactgtgcctcaacaagtggccctcctagactcactgcgcgttctgacagtaaaccggaacctgattctgggcccaggcaaccacgatcaagagtttataagctgcctagcacattgtctgatcaacttgcacgtggggtcgaatgtagacgggtttggtctagaagctgaagcacggatgaccacctggcacatcatgattccctcagacatcgaacctgacggtagctactctcaggatattagcgaaggaagacagctgctcatcaaagcggtcaatagagtgtggacggaactcattcacagcaagaagcaggttctggaggagttgtttaaggtgacccttccagtgaacgaacgggggcacgtagatatcgccaccgctcggccactcatcgaagaagcagccctgaaatgctggcaaaatcatttagcccacgaaaagaaatgcatctcgcgtggagaagcactggcaccaaccacccaatccaaactaagccgtgtttcaagtggattcggccttagcaagctgacaggctctagaagaaacagaaaagaaagcgggcttaacaagcattcccttagtacccaagagataagtcagtggatgtttacccatatcgctgtggtgcgcgacctggtcgatacacaatataaggagtaccaagaacgccagcagaatgcattaaagtatgtgactgaagaatggtgccagatcgaatgtgaacttctcagggaaaggggtttgtggggaccacctatcggtagccacttggataaatggatgctggagatgaccgaggggccttgccgcatgagaaaaaaaatggtgcggaatgacatgttttataatcattatccctacgtgcctgagaccgagcaggagaccaacgttgcatctgaaataccgtctaaacaacctgaaactccagacgatattcctcaaaagaaacccgcaaggtacaggagggctgtgagctacgatagcaaggaatattacatgcggttagcctctgggaatcccgctatcgtacaggatgctattgtcgagagtagtgaaggcgaagccgcccagcaggagccggagcacggggaagacacaattgccaaggttaaggggctcgtgaaaccgccactgaaaaggtctcgctctgccccagatggcggggacgaagagaaccaggagcagttgcaggaccagattgccgaggggtcttcgattgaagaggaggagaagaccgacaatgcaactctgctgaggctcttagaagagggggagaaaatccagcacatgtacaggtgtgccagagtgcaaggactggacaccagcgagggcctactgctgttcggaaaagaacacttctatgtcattgacggctttaccatgaccgccacgagagaaatcagggacatcgagacattacccccgaacatgcatgagccgatcatccctcggggggcacgacaaggaccgtcacagctaaaacgaacctgtagcatctttgcctacgaagatattaaagaagttcacaaacgcagataccttttgcagcccatcgccgtggaggtattctccggcgacggacgcaattacttgctggccttccagaagggcatcaggaacaaggtttatcagaggttcctggccgtggtgccaagcttaactgatagttcagaaagtgtctcaggccagagaccaaacacaagtgtagagcaggggagcggtttactttcaacgctggtgggggaaaagagcgtcactcagcgctgggaacgcggggaaataagtaattttcagtacctgatgcacctgaatactctcgctggtaggtcctataacgatctcatgcagtatcccgtgtttccctggatactcgccgattacgatagtgaggaggtggatttgacaaatccgaagacattccggaatttagccaaacctatgggggcacagacagacgagcgccttgcccagtataaaaaaaggtacaaagactgggaggatccaaacggggaaacgccagcttatcactacggcacacactattcgtccgccatgattgtcgcctcctatttagtgcgcatggaaccctttacccagatcttcctgcggttgcagggaggccattttgatttggccgataggatgttccacagcgtgagagaggcctggtactcggccagtaagcacaacatggcagatgtcaaagaactcatccccgagttcttctacctgccagaattcctgttcaattccaacaacttcgatctgggctgtaagcagaatggaaccaagttgggagacgtgattttacccccttgggcgaagggggaccctagggaatttattcgggtgcacagagaagccctggagtgtgattatgtgagcgctcatcttcacgagtggatcgacctaatcttcgggtacaagcagcagggacctgccgctgtggaggcagtgaacgttttccaccatctgttctacgagggccaggtcgacatttacaacatcaatgatcccctgaaagaaaccgcaacaatcgggtttattaataatttcggccagatcccaaaacagctttttaagaaaccacaccccccaaagcgcgtacgttctaggctcaacggggacaacgccggtatctctgtgctgcctggctctaccagcgacaagatattcttccaccacttggacaatcttcggccaagccttaccccggtcaaggagctcaaggaaccggtgggccagatagtctgtactgacaaaggcatactagcggtagagcagaacaaagtgctcatcccgcctacctggaataaaaccttcgcatggggttatgccgacctgtcatgcaggctaggcacttatgagtccgacaaagccatgaccgtttatgaatgcctatccgagtggggccagattctttgcgcgatttgtccgaacccaaagttggtcattacaggcgggacaagcacagtagtgtgcgtgtgggagatggggaccagcaaggagaaagccaagacagtgacactgaagcaggcattactgggtcatacagatactgtcacatgcgcaacggcctcactcgcgtatcacattattgtttctggctctcgggaccgcacttgtatcatctgggaccttaacaagctttcctttttaacccagctgcgggggcaccgggccccggtgtctgccctgtgcattaacgagttgacgggtgacatcgtgagctgtgccggtacctatattcacgtgtggagtatcaacggtaatccgattgtgagcgtgaacaccttcacgggccggagccagcagattatctgctgctgtatgagcgaaatgaacgagtgggacacccagaacgtcatagtgacaggacactctgacggggtagtaaggttttggcgcatggagtttttacaggtgcccgagacacccgccccagaaccagcggaagtcctcgagatgcaggaggattgtccggaagcacaaatcggacaagaggcacaggacgaagactctagtgactctgaggcagacgagcagagcatttcccaagatccgaaggatactccctcccagccatcctccacatctcacaggccacgagccgctagctgtagggccacagcagcctggtgcacggacagtgggtctgacgattcacggaggtggtcagaccagctctcccttgatgagaaagacggtttcatctttgtcaattactcagagggtcagactcgagcgcacctgcagggtccgttgagccacccgcaccccaaccctattgaggtccgaaactatagtcgcttaaagcccgggtacagatgggagcgtcagctggtgtttcggtccaaactgacaatgcatacagctttcgatagaaaagataatgcacatcccgccgaagtgaccgcactggggatcagtaaagaccatagccgtattctggtgggggacagccgcggaagagtgtttagctggagtgtgtccgatcagcctgggcgcagtgcggccgaccactgggtcaaggacgaaggcggggattcatgcagtggctgttctgttagattctcactgaccgagcggagacaccactgtcggaattgcgggcagttgttctgccagaaatgctcccggttccaatccgaaattaagaggctgaaaatttctagcccagtgcgtgtctgtcagaattgttattacaacctgcaacacgaacgcgggagcgaggacggccctagaaactgctag

SEQ ID NO: 47909 - DNA, 10530 bp, Artificial Sequence
  Description of Artificial Sequence: Synthetic coding sequence
atgaacatggtgaagcggatcatgggccggccccggcaggaggagtgttcaccccaggacaatgctcttggtctgatgcacctgaggcggctgttcacggagctgtgccatccacctcgccatatgacgcagaaggagcaggaagaaaagctctacatgatgctgcctgttttcaacagagtcttcggcaacgcaccccccaataccatgaccgagaagttctcggatttacttcagttcacgacgcaagtctctcgtcttatggttacagaaattaggagacgcgcaagcaataagtccactgaggcagccagtcgtgcaattgtgcagtttttagagatcaaccagtcggaggaggcttcgcgcgggtggatgctgttgactacaattaacctgctggcttccagtggacagaaaaccgttgattgtatgacgacaatgagcgtgccctctacactggtgaagtgtctatacctgttttttgatttgccacacgtccccgaggccgtggggggcgctcagaatgagcttccacttgcggagagacgcggattgctgcagaaggtatttgtccaaattctggtcaagctttgctcattcgtgagcccagccgaagagctggctcagaaggacgacctgcaattattattttcggctattacttcatggtgtccgccttacaacctgccctggagaaagtctgccggtgaagtgctaatgacaatatcacggcacggactgtctgttaacgtggtgaagtatatacacgaaaaggaatgtttaagcacttgtgtccaaaacatgcagcagtcggacgacttatccccactggagatcgtggagatgttcgcgggtctgagctgcttcctgaaggacagctctgatgtatctcagacactgctcgatgacttccgcatttggcaggggtacaattttttgtgcgatctgctgctgcgccttgaacaggccaaagaagcagagtctaaggacgccctcaaagacctggtgaacctcattacaagcctcacaacatacggggtgagcgagctgaagccagctgggatcacaacgggtgctcctttccttctacccggtttcgcagtgccccagccagcaggcaagggccacagtgtacgaaacgtgcaggcattcgctgtgctgcaaaatgcatttctgaaagccaagacctcatttctggcacaaatcatactagatgcaatcacgaacatttatatggcagacaacgctaactattttatactggaatcccagcataccctctcacagtttgccgagaagatctccaagctccctgaagtacagaacaaatacttcgagatgttggagtttgtagtgttttcgttgaattatatcccctgtaaggaattgatctccgtgtcaatactgctgaaatcttctagttcctaccattgttcaattattgccatgaaaactctcctcaagttcactaggcatgactacatatttaaagatgtgttccgagaagtgggcctgctggaagttatggtgaacctgctccacaaatacgccgcactgttaaaggatcccacacaagcactgaacgagcaaggtgactcgagaaataacagctctgtggaagatcagaaacacctcgccctgctggtcatggagaccctcaccgtgctgctacagggtagtaatactaatgccggtatctttcgagagttcggaggggcacgatgcgcacataacatagttaagtacccccagtgcagacaacacgccctcatgacaatccaacagctggtcctgagccccaatggcgatgatgacatgggcactttgctgggcctcatgcactctgcgccccctaccgagctgcagttgaagacagatatcttgcgcgccctgctttctgtcctgagagaatctcacaggtctcgaaccgtcttcaggaaagtgggtggctttgtgtatattacatctcttttggtagcgatggagcgttctttgagttgcccacctaagaatggctgggagaaggttaaccagaatcaggtgtttgagcttctacacactgtattttgtacgctgacggcggctatgagatacgagcctgccaattcccatttcttcaagacagaaatccagtacgaaaaattggccgacgcagtacggttcctcgggtgtttcagcgacttgaggaagatcagtgccatgaatgtttttccttcgaacactcagcccttccagcgcctcctggaagaggacgtcatcagtatagagtccgtgagcccaacacttcggcattgtagcaagctgttcatttacctttataaagttgccactgactcttttgacagtcgcgcggaacagatccctccctgcctgacctcagagtcctccctgccttcaccctggggcacgcctgctctgtctaggaaaaggcacgcctaccacagtgtctccacacctccagtgtatcccccaaagaacgttgccgaccttaaacttcatgtgacgacatcctccctgcagagctctgatgccgttattattcaccctggggccatgctcgccatgcttgacctgttggcgtcagtcggtagtgtaacacaacccgaacacgcacttgatctgcaactggcagtagccaacatccttcagtcactcgtccacacagagaggaaccagcaggttatgtgtgaagccggtctccacgcgaggctccttcaaagatgttctgcagctttggccgacgaagatcatagtttacacccaccgctgcaacggatgttcgaacgactcgccagtcaagccctagagcccatggtgctacgggagttcctgagactggcctctcccctgaattgtggcgcttgggacaaaaagctgctaaaacagtaccgagttcacaagccttcctcccttagctacgaaccagagatgagatcgtcaatgatcacctccctggaaggtctcggcaccgacaatgtgttcagcctccacgaggacaaccattaccgtatctctaagtccctggtgaagagcgctgaaggatcgaccgtgccgctcacccgggtgaagtgtttagtgagcatgacaactccacatgacatcagactgcacgggagttccgttacacctgcattcgtcgaatttgatacctcactggagggattcggctgcctgtttctcccctctctggcacctcataacgcacccacaaacaatacggtgactacagggctgattgacggggcagtggtgtccggaataggatccggggaacggttctttccccctccaagtggcctttcgtatagcagttggttttgcatcgaacacttttcctcccctcccaataatcaccctgtgaggctgctgaccgtcgttagacgggccaactctagcgagcagcactacgtctgcctggcgattgtcctgagcgccaaagacaggagtttgatcgtgagcactaaggaggagctgctgcagaactatgtcgacgacttctctgaggaatcgtccttctacgagattctcccctgctgcgctagatttcgctgtggcgagctgataattgaggggcagtggcaccacctagttctcgtgatgtccaagggaatgctgaagaattccacagccgcactttacatcgacggacagctggtaaatacagttaaattgcattacgtgcattctacccctggagggagtggttccgccaatccaccagtggtgtcaactgtgtatgcctatatcgggaccccgcctgcccagcgacagatagcttccttggtgtggcggctcggcccgactcatttcttagaggaagttctgccttcttctaatgtcactaccatatatgagctgggtccaaactacgtagggagtttccaagctgtctgcatgccgtgcaaagacgccaagagtgagggcgtcgtgcccagtcccgtgagtcttgtgccagaagagaaggtttccttcggtctttatgctctgtccgtgtcatctttaacggtggctaggattcgtaaagtgtacaacaagctagactcaaaagcaattgcgaagcagctggggatctcatcccacgagaacgcaacaccagtaaagctgatccataattcggcaggccatctgaacggaagcgcccgtactataggagcggccctaattggctatctgggagtccgcactttcgtccccaaacccgtcgctacaaccctgcaatacgttggaggcgcagccgcaattctggggctggtggcgatggcttccgacgtggaggggctttacgctgccgtgaaggctctggtgtgtgttgttaagtcaaaccccctggctagtaaagagatggaacggattaagggataccaactccttgccatgctgttgaagaagaagcgaagtctcctgaatagccacattctgcacttaaccttttccttggtgggaacagtagactctgggcacgagaccagtattatccccaatagcactgccttccaggacctgctgtgcgacttcgaggtgtggctccacgctccttacgaactgcacctgagcctgttcgaacactttattgagctcctgactgagtcatcggaagcaagcaaaaacgctaaactcatgcgtgagttccagctcattccgaaattgcttttaactctgagagatatgtcgttgagccagccgaccattgctgccattagcaacgtcctcagctttctgttacagggcttcccctcatccaacgacttgctgagattcggtcaattcattagcagcactcttccaacgttcgctgtttgcgagaagtttgttgtgatggagataaataatgaggagaagctcgacaccggcactgaagaggaattcggaggactggtgtctgccaatttgattctcttgagaaaccggctgctcgatatattactcaagctcatctacacctctaaagagaaaacttccattaatttgcaggcatgtgaagagctggtcaaaactctcggctttgactggatcatgatgttcatggaagagcacctgcattccacaacagtgaccgccgccatgcgcattcttgttgtgctgctaagtaaccagagcatcctgatcaagtttaaggagggtctgagtgggggcggctggctcgagcaaaccgactccgtcttgacaaataaaataggtaccgtgttagggtttaacgtggggaggtccgccggtggcaggtccactgtaagggaaattaatagagatgcctgccacttcccagggtttccagtactccagagttttttgcccaaacatactaacgtgcctgccctgtatttcctgcttatggctctttttcttcagcagccagtctccgaactgcctgagaacctgcaagtgtcggtcccagtcattagctgtcggtccaagcagggatgccagttcgatttggatagcatttggacctttatcttcggcgtgccagcctctagcgggacagtggtgagctctattcacaatgtctgcactgaagccgtgtttctcctgttgggtatgctgcgctccatgttgacttcaccctggcagtcagaggaggaaggttcctggctgcgggaataccccgtcaccttgatgcagttttttaggtatctgtatcataatgtccctgacctggccagcatgtggatgtcccccgattttttgtgcgccctcgccgcgacggtattcccctttaacatcagaccttacagcgaaatggtcactgatctggatgacgaagtgggaagcccggccgaagagttcaaagcctttgccgcggacaccggaatgaataggtctcagtccgagtactgtaatgtgggcacgaagacatacctgacgaaccacccagccaaaaaatttgttttcgattttatgagggttttgattatcgataatctttgtctgactccagcttcgaaacagacacctcttatcgacttgttgctcgaggcctcaccagagaggtcaactcgaacccagcaaaaagagtttcagacttacatactggactccgttatggatcacctgctagcagccgatgtgctgctgggagaggacgcctctctgcctatcacctctggtggctcttaccaagtgctcgtgaataatgtattttattttacccagcgggtagttgataaactctggcaggggatgtttaataaggaaagcaaactgttaatcgatttcattattcagttaattgctcagtctaaacggcgcagccaaggactgtcacttgatgcagtgtatcactgtttaaataggactatattatatcaattctcccgtgcccacaaaaccgtgccccagcaagtggccttactcgatagcctccgagtcctaacagtcaacaggaacctaatacttggaccaggaaatcacgatcaggagtttatttcctgcttggctcattgtttaatcaacctgcatgtggggagcaacgttgatggctttggcctcgaggccgaggcccggatgacaacctggcatatcatgattcccagcgatatagagcccgacgggtcatattctcaggatatctctgaaggaagacagcttctgattaaggcagtgaacagggtgtggaccgaactgatccatagcaagaagcaggtactggaggaactattcaaggtgaccttacctgtcaatgaaagaggacacgttgacattgctaccgctcgaccactcattgaagaagccgccctaaagtgctggcaaaaccatttggctcacgagaagaaatgtatctcaagaggagaagctttagccccaaccacgcagagtaagttgtcaagagtatcatctgggttcggcctcagtaaattgaccggatcccggcggaaccgcaaagaaagtgggctcaacaagcatagcctgagcacccaggaaatctcccagtggatgtttactcatatcgcagtggtgcgagatttggttgacacacagtacaaagaataccaggagaggcagcaaaacgccctcaaatacgtcaccgaggagtggtgccagatcgagtgcgagctattaagagagagaggcctctgggggccgccgatcggttctcacctggataagtggatgctcgagatgaccgaagggccctgcaggatgcgtaagaagatggtcaggaacgatatgttttacaatcactatccctatgtgcctgagactgagcaggagacaaatgtggcgaagccagcaagatacaggcgcgccgtgagctatgatagcaaggagtactacatgcgcttagcgtccggaaatcccgcaattgtccaggacgcaattgtggaatccagtgaaggggaagcggcccaacaggagccggagcatggcgaggataccatcgcgaaagttaaaggcctggtgaagccaccgctgaaacgctccaggtcagccccggatggtggcgacgaggaaaaccaagagcagcttcaagaccagatagcagagggctcaagtatagaggaagaggagaagaccgacaacgccacgctgctgcgcctccttgaggagggagaaaagattcagcacatgtaccgttgtgctcgggttcagggcctggatacctctgaaggtctgctgctatttggaaaggagcacttctatgtgatcgacggtttcactatgactgccaccagagaaattagagacattgaaacgctccccccaaacatgcatgagcccatcatacctaggggtgcgcggcagggcccttctcaacttaagaggacctgttcaatttttgcttatgaggacatcaaggaagtccataagcggcgctatctactgcagcccatcgctgtcgaggttttttcgggagatgggcgcaactatctgctggccttccagaagggaatcagaaacaaggtttaccaacggttcttagccgtggtgcccagcctcaccgacagctcggaaagcgtctcgggtcagcgccctaacacctccgttgagcagggcagcgggctgctctccacccttgtgggggaaaaatccgtgacacagcgctgggaacgcggcgagattagcaacttccagtacctgatgcacctgaatactctggctggacgcagctacaacgatctgatgcagtaccctgtgtttccctggatcctggcagattatgacagcgaggaagtagatctgaccaaccccaagacctttcgaaatctggctaagccaatgggtgctcagaccgacgagaggttagcacagtacaagaaaagatataaggattgggaagaccctaacggtgaaacacctgcttatcactacggcacccattattccagtgctatgatcgtcgcctcttatcttgtcaggatggaaccttttactcaaatttttctgaggttacagggggggcatttcgacctggccgatcgaatgtttcactcagttcgggaagcctggtattccgcgagcaaacacaatatggctgacgtgaaagagctgattcccgagtttttctatctgcctgaattcctgttcaactcaaacaatttcgatctgggatgtaaacaaaacgggacaaaactcggagatgtgatcctccccccctgggcaaaaggcgatccaagggagttcataagagtgcatagggaggctctggaatgtgactacgtgtcagcccatctccacgagtggattgacctgatcttcggctataagcagcaggggcccgccgcagtggaagccgtcaatgtctttcaccacttgttttatgaaggccaagtggacatctataacatcaacgatccattgaaggagacagctaccatcggattcatcaataattttggtcagatccctaagcagctgttcaaaaagccccatccacctaagcgtgtgcgttctcgcctcaatggagacaacgcgggcattagtgtgttgccaggctccaccagtgacaaaatcttcttccaccacctggataatctgcggccatctttgaccccagtcaaagagctgaaggagcctgtcggtcagatcgtatgtactgataagggcatcctggccgtggagcagaacaaagttctgattccacccacatggaacaaaacatttgcatggggatacgccgatctgtcctgccgcctggggacgtatgagagcgacaaggccatgacggtgtatgagtgtctgagcgaatgggggcagatcctttgcgccatctgtcccaatccaaagttagtaattactggaggtacaagcaccgtcgtatgtgtttgggagatgggtaccagtaaagagaaggccaaaactgtcaccctgaaacaggcacttctggggcatacagataccgtaacttgcgctacagcatcactggcttaccacatcattgtcagcggttctagagatcggacgtgcatcatctgggatctgaataaactgtcattcttgacccagcttagaggccaccgagctccagtgtccgccctgtgtattaacgagctcactggcgatattgtatcctgtgcagggacctacatacatgtttggtcgattaatgggaacccaattgtgtcagtgaacaccttcacagggcgctcccagcagatcatatgctgctgtatgtccgaaatgaacgaatgggacacacagaatgtgatcgtgactggccatagtgacggtgtggtaaggttctggcgcatggaattccttcaggttcccgagaccccagctcccgaacctgccgaagtgcttgaaatgcaggaagactgccctgaggcccagattggacaggaggcccaggatgaagacagtagcgatagcgaggcagatgagcaatcaatctctcaggaccccaaggacaccccctcacaaccctcttcaacatctcatcgtccacgagccgcaagttgcagagctacagcggcttggtgcaccgattcaggttcagacgactcaagaagatggagtgatcagctctcattggatgaaaaagatggctttatcttcgtgaattactccgagggacaaactcgggcccatctgcaggggccactgtcacaccctcaccctaaccctattgaagtcagaaactattcccgtctcaaacccggctatagatgggagaggcagctggtgtttcggagcaaactaacaatgcacaccgcctttgatagaaaggataacgcccatcccgcggaggtcaccgccctgggcatatcaaaagatcactcacgtatcctggtgggagacagccgtggacgggtcttttcgtggtccgtcagcgaccagccgggacggtcagctgcggatcactgggtaaaggacgaaggcggggactcttgctccggatgctcggtgcgattctcgctgacagaacggcgacaccactgtcggaattgcgggcagttgttttgccagaaatgctctcgattccaatctgagattaaacgtctgaaaattagtagtccggttagggtttgccagaactgctactataatcttcagcacgagagagggagcgaggatggcccgcgaaattgctag

SEQ ID NO: 47910 - DNA, 30 bp, Artificial Sequence
  Description of Artificial Sequence: Synthetic coding sequence
atgaacatggtgaagcggatcatgggctag

SEQ ID NO: 47911 - DNA, 183 bp, Artificial Sequence
  Description of Artificial Sequence: Synthetic coding sequence
atgaacatggtgaagcggatcatgggccggccccggcaggaggagtgttcaccccaggataacgccctcgggctgatgcatctgaggcgcttattcaccgagctgtgccatccacctagacacatgacgcaaaaagagcaagaggaaaaactttacatgatgctcccagtcttcaatagatag

SEQ ID NO: 47912 - DNA, 2241 bp, Artificial Sequence
  Description of Artificial Sequence: Synthetic coding sequence
atgcggcgggagttctgctgggacgcctacagcaaggccgccggctccagggcttccagcccgctaccccgtcaggaccgcgactctttctgccaccaaatgtcgttctgtctgaccgagctccacctgtggagccttaaaaatactctccatatcgccgatcgggatatagggatttatcagtactacgataaaaaggacccacccgcaacagagcatggcaatctcgagaaaaagcagaagctcgccgagagcagagactacccatggacgctgaagaacagacggcctgagaaacttcgcgactcgctaaaggagctggaggagctgatgcagaatagccggtgtgtgttgtccaaatggaagaataaatacgtgtgtcaactgctgtttggtagtggtgttttggtatcactctcactgagcggaccccagctcgagaaggtagtgatcgaccgtagcctcgtgggcaagctgatcagcgatacaatcagcgatgccctcctcaccgactctttcatcatcctctcattcctagcacagaataagttatgctttatccagtttactaagaagatggagagttctgacgtcaacaagaggctcgaaaaactgtccgctctcgattacaagattttctattatgaaatccctggccctatcaataaaacaacagaacgtcatctcgctattaactgcgtgcacgacagagtggtctgttggtggccactcgtgaatgatgacgcatggccttgggccccaatctcaagcgagaaggaccgcgctaacctcctgctgctggggtacgcacagggacgcctagaagtcctcagctcagttcggaccgagtgggatccactggacgtaaggtttggtactaagcagccgtaccaggttttcacagtggagcactcagtctctgttgacaaagagcccatggccgattcttgtatctatgaatgcataagaaataaaatacaatgtgtgagtgtcacgaggattcctctgaaatccaaggccatttcttgctgcaggaatgtgaccgaagacaagctgattctgggatgcgaggattcaagcctgattttgtatgagactcaccgaagagtgactttgctcgctcagacggaactattgccgtccttgatcagttgccatccctctggggccattttacttgttggatcgaaccagggcgagctgcagatcttcgacatggccctgagtccaattaacattcagcttctggctgaggaccggctgccccgcgagacactccagtttagcaagctctttgacgctagctcgtcccttgtgcagatgcagtggatcgcacctcaggtcgttagccaaaagggagaggggagcgacatttacgacttgctgttcctgaggttcgaacgggggccactgggcgtattgctatttaagctcggcgtgtttacgaggggacagctgggcctgattgatatcatcttccagtacatacactgcgatgagatttacgaagcgattaacatcctaagtagcatgaactgggacacattggggcaccaatgcttcatttcgatgtccgccattgtgaatcacttacttcgtcagaaactaacacccgagcgggaggcccagttagagaccagcctggggacattttacgctcccaccaggccactccttgattctaccattttagagtaccgtgatcagatctcaaaatatgctcgacggttttttcatcatctgctgcgataccagcgatttgagaaagcctttctgttggcggtcgacgtcggggctcgcgacctgtttatggatattcattatctcgctctggacaagggcgaacttgcccttgctgaggtcgcacggaagagagcaagcgatatcgacgctgagtctattactagcggcgtggagctgcttgggcccctggatagaggtgatatgctcaatgaggcctttatcggtctatctctagctccacaaggcgaggattctttccccgataacctgcctccgtcttgccccacacatcgtcatatcctgcagcaaaggatcctaaatgggtctagtaatcgccaaatcattgataggagaaatgagctggagaaggatatttgtagtggcttcctcatgaccaacacctgtaacgcagaggacggggaacttagagaagacggcagagagcaagaaattagggatggggggtcgctgaagatgatccattttggcctggtttag

SEQ ID NO: 47913 - DNA, 2742 bp, Artificial Sequence
  Description of Artificial Sequence: Synthetic coding sequence
atggccagcgagagcgacaccgaggagttctacgacgcccccgaggacgtgcatttgggaggaggttaccctgtgggatctcctgggaaggttgggctgtctactttcaaggagaccgaaaacacagcttataaagtcgggaatgagtctcctgtacaggagctgaaacaggacgtgagtaaaaagattatcgaatccatcatcgaggagtcccaaaaagttcttcagcttgaggatgactcattggactcaaaagggaaggagttatccgatcaagctactgcgagcccgatcgtggctagaaccgacctgtccaatattcccgggctgctcgccatcgaccaggtcctcccagaagagtcccagaaggcggaatcccagaacactttcgaagaaactgaactggagctgaagaaatgctttcctagcgacgagacgtgtgagaagcctgtggacgaaacgactaaactgacacaaacttctagcacagagcagctgaatgtgctggagaccgaaaccgaggtcctgaataaagaagcggtggaggttaagggaggcggcgacgtcctggagcccgtgagctccgatagtctttcgacaaaagacttcgcggcggttgaagaagtggcaccggcaaagcctccgagacacctcacccctgagcccgatatcgtagcatccaccaaaaaacctgtccctgcaagaccccctccgcccaccaactttccccctcctcgtcctccccctccttcaaggccagcccctcctccgagaaagcggaagtcagagcttgagttcgaaacgctgaaaacacccgatattgatgtgcccaaagaaaacattacttcggactctctcctcaccgccagtatggccagcgaaagtaccgtgaaggactctcaacctagtctggacctagcgtcggctacatccggagataagattgttaccgcacaagaaaacgggaaggccccggacggtcagacggtggccggcgaggtgatgggccctcagagaccacggagcaatagcggacgcgagctgacggacgaggagatactggccagtgttatgatcaaaaatttggataccggtgaagaaatccctctcagcctggcagaggaaaaactacccacaggtatcaatcctctcactctgcacattatgaggcgaactaaagagtacgtctccaatgatgcggctcagagcgacgatgaggagaagctgcagagtcagccgactgatactgacgggggcaggctcaaacagaaaacaacccagctcaagaagttcctgggcaagtccgtgaaaagagccaagcacctggccgaggaatacggcgagcgggccataaataaagtcaaatcagtgcgcgacgaggtgttccacacagaccaagatgatcccagctcctctgacgatgaggggatgccttacactcggccagtgaagttcaaggcagcccacggattcaaggggccttatgactttgatcaaattaaagtcgtccaggatttgtcaggagagcacatgggcgccgtctggactatgaagttctctcactgtggaagactacttgcctcagcagggcaagataacgtcgtgcggatttgggcactgaaaaacgcattcgattattttaacaacatgaggatgaagtacaatacagagggcagagtgagcccgtccccctctcaggagagcttaagtagctccaagtccgacaccgacactggcgtgtgctctggcactgacgaagaccctgatgacaagaatgctccctttagacagcggcctttctgtaagtacaaggggcacacggccgatctcttagacctctcatggtcgaagaactacttcctcctctccagctcaatggacaagacagtacgcttgtggcatatcagtcgacgcgagtgtctgtgctgttttcagcacatcgacttcgtcacagcaatcgcctttcatccacgggatgaccgttacttcctctcaggcagccttgatgggaaactaagattgtggaatataccagacaagaaggtggctctgtggaatgaagtggatggtcaaaccaagctaatcactgccgcgaacttctgtcagaacgggaagtacgccgtaattggcacgtacgatggaaggtgtattttctacgataccgaacaccttaaataccatacccagatccacgtgaggtctacacgggggaggaacaaagtgggccgcaagattacaggaatcgaaccgctgccaggagaaaataagatccttgtgacaagcaatgattctcgaatccggctgtatgatctgagggacctgtccctctccatgaaatacaagggttatgttaattcctcttcccagattaaagcttccttctcccacgattttacctacctggtaagcggatcagaggacaaatatgtgtatatttggtccacctatcacgatctttctaagtttacctccgtgcgcagggatcgtaatgatttttgggagggtataaaggctcataacgcagtcgtcacctctgctatcttcgcccccaatccaagtctgatgctgtctcttgacgttcagtccgagaagtcagaagggaatgagaaaagcgaagacgccgaggtgctcgatgccacgccttctggaattatgaaaaccgacaacaccgaagtactgctttctgcggacttcactggagccatcaaggtgttcgtgaacaagagaaagaatgttagctag

SEQ ID NO: 47914 - DNA, 867 bp, Artificial Sequence
  Description of Artificial Sequence: Synthetic coding sequence
tggggcaagaactacttcctgctgagcagcagcatggacaagaccgtgcgcctttggcatatttccagaagggaatgcctgtgttgcttccagcatattgactttgttacagctattgccttccaccctcgggatgacaggtacttcctgtctggatcactggacggtaagttgaggctgtggaacatccctgataagaaggtcgccctttggaatgaggtcgacgggcagacaaagttaatcactgcggcaaacttctgccagaacgggaaatatgccgtgattggaacctatgatggtagatgcatcttctatgatacagaacacctcaaatatcatacacagattcatgtaaggagtactcgtggtcgtaacaaagtggggaggaagattacaggcatcgaacccctaccaggggagaacaaaattcttgtcacaagtaatgactcaaggatcagactgtacgatttgagggatctgtctctcagtatgaagtacaaaggttatgttaacagcagttcacagattaaggcctctttctcacatgacttcacatatcttgtgagtggctcagaggacaaatacgtgtatatctggagcacctaccacgacctcagcaagttcacatccgtccgtcgtgacaggaacgatttttgggaaggcatcaaagctcataatgccgtcgttacctcagcgatattcgcccccaatccatctcttatgctgagtctcgatgtgcagtcagagaagtctgagggaaacgagaagagtgaagatgcggaggtgctggacgccactccctctggggctgtggctcacgcctgtaatccctccaccttgggggggcggggccgcaggatcacttag

SEQ ID NO: 47915 - DNA, 2475 bp, Artificial Sequence
  Description of Artificial Sequence: Synthetic coding sequence
atggccagcgagagcgacaccgaggagttctacgacgcccccgaggacgtacatctgggaggaggataccctgtcgggtctcctgggaaagtgggcctgtctacgtttaagattatagaatcaatcatcgaggaaagccagaaggttctgcaactcgaggatgactcactggacagtaaaggcaaggaattgagcgatcaggccaccgcaagtccaattgttgcccgaaccgatctttccaacatacctggcctcttggcaattgatcaggtgctccctgaagagtcgcagaaggctgagtcccagaacaccttcgaggagaccgagttagagctcaaaaaatgcttcccctccgacgagacatgcgagaaacctgtggacgagacaacaaaattaacgcagacgagcagcacggagcagttgaacgtccttgaaactgaaactgaagtgctgaataaagaggcggttgaggtaaagggtggcggggatgtactggagccggtttcctccgacagtctgtccaccaaggattttgcagctgtggaagaagttgcccccgctaagcctccccgacaccttacacccgagccggacattgtggcaagcaccaagaaacctgtgccagcacgaccaccccctcccaccaactttcccccaccgcggccacctcctcctagtaggcccgcaccgccaccccgcaagcggaaatccgaacttgagtttgagacacttaagacccctgatatcgacgtcccaaaggaaaatattacctcagatagcctgcttacagcctccatggcttccgaaagcaccgtgaaagactcacagcctagcctagacttggcatcggcgacgtcaggagacaagattgtgacggcccaggaaaacggaaaggcacccgatgggcaaacggttgccggggaggtgatgggaccccagcgccccaggtccaacagcggcagggaactgaccgatgaagagattttggctagcgtgatgataaagaatctagacacgggggaagagatcccactgtccctagcagaggagaaacttcccacgggcattaacccactgacgctccacattatgcgccggaccaaagagtacgttagtaatgatgctgcacagtcagacgacgaggagaaactgcagagtcaaccaactgatactgacggcggcaggctgaaacagaagacgacccagctaaagaagttcctgggcaaatcggtgaagcgggctaagcacctggctgaggaatatggagaaagagcaatcaataaggtcaagtccgttcgggacgaggttttccacaccgaccaggatgatccatcctcgtccgacgacgagggtatgccctacacacgccctgtcaaattcaaggcagcccacggtttcaagggcccttacgactttgaccagattaaagtggtccaagatctttcaggggagcatatgggtgccgtgtggaccatgaaattcagtcactgcggccggctgctggcctccgctggtcaggacaacgtggttcgcatctgggcccttaaaaacgccttcgattattttaacaatatgagaatgaagtataatacagaagggagggtgagcccctcccccagtcaggagagcctgagtagcagtaaatctgatacagatacgggggtgtgctctggtactgatgaggatcctgatgataagaacgctccctttaggcagagacccttctgtaagtacaaaggtcacaccgccgatcttctcgacctgtcttggtctaagaactactttctgttgtcttccagtatggataagaccgtgcggttgtggcatatttccaggcgggagtgcctgtgctgtttccagcacattgacttcgtgaccgcgattgcctttcatccccgtcatctgaagtatcatacccagatccacgtccgctccactcgggggaggaataaagtggggcgcaaaataaccggaattgagcctttgcccggggagaacaaaatactggtgacctccaatgatagcaggataagactctacgatctccgtgatctttccctttccatgaagtataaagggtacgtgaattcatccagccagataaaagcgagcttctcccacgactttacctatctggtgtccggtagcgaggataagtacgtctacatttggagcacttatcacgacctcagtaaattcacatctgtcaggagagaccggaacgacttctgggagggaatcaaagcgcacaatgctgtggttactagcgccatcttcgcccctaaccctagtttgatgttatccctggacgtgcagagcgagaagtcagaaggaaatgagaagagcgaagatgctgaggtgttagacgccacaccgtccggtataatgaagacagacaatacagaagttctcctgagcgctgattttaccggggccatcaaagtgttcgttaacaagagaaagaatgtgtcttag

SEQ ID NO: 47916 - DNA, 2718 bp, Artificial Sequence
  Description of Artificial Sequence: Synthetic coding sequence
atggccagcgagagcgacaccgaggagttctacgacgcccccgaggatgtccacctggggggaggatatcccgtaggatcccccggaaaggtcgggctgtcaacatttaaggaaaccgagaataccgcgtataaggttggcaacgagtcccccgtgcaggagctgaaacaggatgtgagcaaaaaaattattgaatccataattgaagaaagccaaaaggtacttcagttggaagatgactcgcttgattccaaaggaaaagaacttagtgaccaagctactgcctcgcccatcgttgcacgtacggatctctcaaacatccccggtttgctggccatcgatcaggtgctaccagaggagtcccaaaaagcggagtcgcagaacacgtttgaggagacagaactcgaacttaaaaagtgcttcccgtctgatgaaacctgcgagaaacccgtggatgaaaccaccaaactcacccagacctccagtacagaacagctgaatgttctggagacagaaaccgaggtcctcaataaagaggccgtggaagtgaagggtggtggcgatgtgctggagcctgtttcctcagattccctgagcacaaaagattttgctgcagtggaggaagtggcacctgcaaagccgccccgccacctaacccccgagcctgatatagtagcgtccacaaagaaaccagtacccgcgagaccacctcctcctacaaactttccgccgccgagacccccacctcccagcagacccgcccccccccctcggaaacgcaagagcgagctcgaattcgagacactgaaaacaccagatatcgacgtgcccaaagagaatattacaagtgactctctgttgacagcatccatggcttccgaatcaacggttaaggactctcagccctccctggacctggcctcagcgacatctggagacaagattgtcaccgctcaggagaatggtaaggctccagatggacagaccgtcgcaggcgaagtcatggggcctcagcggcccaggtccaatagcgggagggaactcaccgatgaagagattctagctagtgttatgattaaaaatcttgacaccggagaggagatccctctttcccttgccgaggagaaactccccacgggcatcaatccattgaccctacatatcatgcgcaggactaaggaatacgtttctaatgacgccgcacaatccgacgacgaggagaaacttcagtctcaacctactgataccgatggggggcgcttgaagcagaagactacgcagctcaagaagttcctaggaaaaagcgtgaagcgagctaaacaccttgccgaggagtacggtgaacgagccataaacaaagttaaaagtgtgcgggacgaggtgttccacacggatcaggacgatcccagttcttccgacgatgagggaatgccctacaccaggcccgttaaatttaaggcggcccatggatttaaaggaccctacgattttgatcaaattaaagtggtgcaggatctctccggagaacatatgggggccgtgtggactatgaagtttagccattgtggcagactcctggcgtccgcaggacaggataatgttgtgcggatttgggctttaaagaatgccttcgattatttcaataacatgcggatgaaatataacacagaaggtagggtatcccccagtccttcgcaggagtctctgtcatcttccaagagtgatacagacaccggcgtgtgctccggcaccgacgaggatccagacgataagaatgccccttttcgccagagacctttctgtaagtataaaggccacaccgctgatctcttggatctctcctggtctaaaaactatttcctcctttccagttccatggataagactgttcgcctctggcatatcagcaggcgcgaatgtctgtgttgcttccagcacatagattttgtgaccgccatagctttccatccccgggatgatcggtacttcctgtccggttcccttgatggcaaactgcgcttatggaatatccccgataagaaggtggctctgtggaatgaagtggatgggcagaccaagctcattactgcggctaatttttgccagaatgggaagtatgccgtgattggtacgtacgacggaaggtgcattttctacgacacggaacatctgaaataccacacacagatccacgttcggtctacacgggggcggaataaggtagggcgcaagatcaccggaatcgaacccctgcctggagagaacaagattttagtgactagcaatgactcaagaatccggttgtatgacctcagggatctctccctgtcaatgaaatacaagggatatgttaattctagctcgcagattaaagcctctttcagcggttccgaagataaatatgtatacatctggagcacataccatgatctgagtaagttcacatccgttaggcgagatagaaatgatttctgggagggcatcaaggcccataatgccgtggttacatctgcgatttttgcccctaacccctcacttatgctgtctctggatgtgcagtcagagaaaagcgaggggaatgagaagtccgaagacgcagaagttctcgacgctacaccatccggaatcatgaagaccgacaatacagaagtcctcctgtcagccgacttcactggagcgattaaggtctttgtgaataaacggaaaaatgtctcatag

SEQ ID NO: 47917 - DNA, 2421 bp, Artificial Sequence
  Description of Artificial Sequence: Synthetic coding sequence
tgaaccgacctgagcaacatccccggcctgctggccatcgaccaggtgctgccggaagaatctcagaaggccgaatcgcagaatactttcgaggagaccgagctcgagctgaagaaatgctttccatccgatgagacctgcgagaaacctgtcgatgagacaaccaaacttacccagacttctagtacagagcagcttaatgtcctcgagaccgagactgaggtcctgaataaagaagctgtggaagtgaagggggggggcgacgtcctggagcccgtgagcagcgattccttaagtacgaaagacttcgcagcggtagaagaagtcgcccccgccaagcccccaagacacctcactcccgaacccgacattgtcgcgagtaccaaaaagccggtccccgcaagacccccaccccccacaaattttcctcccccacgcccaccaccaccatctaggcctgcgccccctcctcggaagcggaaaagcgagttggagttcgaaacactcaaaacaccagatatagacgtgcccaaggaaaacatcacaagcgactctctcctcaccgccagcatggcaagcgagagcaccgtaaaggatagtcagccctcccttgacctcgcaagtgctaccagtggggataagattgtgactgctcaggaaaatggcaaagctcccgatggtcaaaccgtcgccggcgaagtgatggggccccagaggccccggtctaacagcggcagggagttaaccgacgaagaaatcctcgccagcgttatgattaaaaatcttgatacgggtgaggagatccccctctccctggcagaggagaaacttccaactggaataaatcctctgaccctgcacatcatgcgccggaccaaagagtatgtctcaaatgacgccgcgcaatccgacgatgaagaaaagctgcagagccagccaacagatacagatggaggtcgccttaaacaaaagaccacccaattaaaaaaattcctgggcaagtcagtgaaaagagctaagcatctcgccgaggaatacggcgagcgcgctatcaataaggtgaaatccgtcagggatgaagtgttccacaccgatcaggacgatccatctagctccgacgatgagggcatgccctatactcgaccggtgaagtttaaagctgcgcacggctttaaaggcccttacgacttcgaccaaatcaaagtggtacaggacctcagtggcgaacatatgggcgcagtgtggacgatgaagttctcacattgcgggaggcttcttgccagcgccggtcaggacaatgtggtgcggatctgggctctcaagaatgccttcgactacttcaataacatgcgtatgaagtacaacaccgagggacgcgtgagcccctctcctagccaggagtcactcagctcgtccaagtctgatacagacacaggggtctgttctgggaccgacgaggaccctgacgataaaaatgcccctttccgtcaacggcccttctgtaaatataaaggtcacaccgctgacctcctggatctgagctggagcaagaattatttcttgctatcgagctctatggacaagaccgtccgcctttggcatatcagtcgtcgcgaatgtctgtgttgttttcagcacattgatttcgtgacagccatcgcctttcaccctagagatgatcggtatttcctgagcggcagcctggatggtaagctgagattgtggaatattccggataagaaggtggccctgtggaatgaagttgatggccagactaaactaattacggctgccaacttctgtcaaaatggcaaatacgccgttatcgggacatacgatgggagatgtatcttttacgatactgagcacctcaaataccacactcaaatccatgttcgtagcactcgagggcggaacaaagtggggcgcaaaattacaggcatcgagccgctgcctggagagaacaagatcttggttacaagcaatgattcacggataaggctctatgacttgagggacctgagcctgtcaatgaagtataaaggctatgttaattcatcttcgcagattaaggcttcattcagtcatgacttcacttacctcgtctccggcagtgaggataaatatgtgtatatctggagcacataccatgatctgtcaaaatttacttccgttcggagagacagaaatgacttctgggaggggatcaaagcccacaacgcagtggtgacctcagccatcttcgcccccaacccttcccttatgctttccctcgatgtacagtcagagaagtccgagggcaatgaaaaatccgaggatgccgaggttcttgacgctacgcccagtgcaatgagcagcaggtacgttgcccaggccggcctagaactactggctagcaaacggtattacgaggatcggtag

SEQ ID NO: 47918 - DNA, 1116 bp, Artificial Sequence
  Description of Artificial Sequence: Synthetic coding sequence
atgacccagcagcccctgcggggcgtgaccagcctgcggttcaaccaggaccagagctgtttctgttgcgccatggagacaggggtcaggatctataacgtggaacctctaatggagaaaggacatctggatcatgaacaagttgggagtatgggactggtggaaatgctccatcggagcaacttgctcgccttggtcggaggcgggtcttcaccaaagttctctgagatatctgtgctgatctgggacgatgctagagaagggaaagatagtaaagagaagctcgtgctagagttcacgttcacaaaaccagtgctctcagtgcgcatgcggcatgacaagatagttatcgtgctgaaaaacagaatctacgtctactctttccctgataatccaaggaaactatttgagttcgataccagggacaatcccaaggcagcccaccccacgcctcacttgcacacccttggactgtgcgacctatgtccctccttggagaagcagctacttgtcttccctggacataagtgtggcagtctccagctggtagacctggctagcacaaaaccggggacatctagcgcccctttcaccatcaacgcccatcaaagtgacatcgcctgtgtcagcctgaaccagccgggtacagtggtcgcttctgcttctcagaaggggacacttataagactattcgacacacaaagtaaggagaagcttgtggaacttagacgggggactgatcccgcgacactttactgtatcaacttcagccacgactcttccttcttatgtgcctcatccgataaagggactgttcacatcttcgcactcaaagatacccgattaaaccgccggtcagcgctagctcgagtggggaaggttggtcctatgattggccagtatgtcgacagccagtggagtctggcgtcttttacagttccggctgaatccgcttgtatctgcgctttcggtaggaacacgtctaagaatgtaaactcggtcatcgcaatttgtgttgacggaacatttcataaatacgtattcacacccgacggaaactgcaatagagaagcttttgatgtttaccttgatatctgtgatgacgatgatttttag

SEQ ID NO: 47919 - DNA, 1086 bp, Artificial Sequence
  Description of Artificial Sequence: Synthetic coding sequence
atgacccagcagcccctgcggggcgtgaccagcctgcggttcaaccaagatcagtcttgtttctgctgcgctatggagactggtgtccggatttacaacgtggagcctctgatggagaagggtcatctggaccatgagcaggtgggtagcatgggtctggtggagatgcttcatcgatccaacctcctggctctggttggcggcggttcctcgcccaagttcagtgaaatcagtgccgtgttgatctgggacgacgcgcgggaaggtaaagacagcaaagaaaagctcgtccttgaattcacgtttacaaagccggtgctgtcggtgaggatgcggcacgataagattgtcattgtacttaagaaccggatctatgtctactcatttcccgacaacccccggaaattatttgaatttgataccagagacaaccccaaaggactgtgcgacctttgccctagcttagaaaagcaactgctggtgtttccaggccacaagtgcgggtccctacagcttgtagaccttgcctctactaaacccggaacttcctcggctccgttcactattaacgcccaccagtcagatatcgcatgtgtgtcactgaatcagcctgggaccgtcgtcgctagtgcctctcaaaaaggtacactgatccggctgtttgatacccaaagcaaagagaagttggtggagttgaggcgaggtactgacccagcaacgttgtattgtataaacttttcacacgactcttccttcctgtgcgcctccagcgataaaggcacggtacacatcttcgccctgaaagatacaagactcaatcgcaggagcgccctcgcccgtgtcggcaaggtgggcccgatgattggccagtacgtcgattcccagtggtcgcttgcatctttcaccgtgccagccgaatcggcatgcatctgcgcctttggacgaaatactagtaaaaacgtcaattctgttattgctatctgtgtggacgggacctttcacaaatacgtcttcacacccgatggcaattgtaatcgagaggccttcgatgtctatctggatatctgcgatgatgacgatttttag

SEQ ID NO: 47920 - DNA, 1086 bp, Artificial Sequence
  Description of Artificial Sequence: Synthetic coding sequence
atgacccagcagcccctgcggggcgtgaccagcctgcggttcaaccaagatcaatcctgcttttgttgtgccatggagactggggtccgaatctacaacgttgaaccactcatggaaaaagggcacctagaccacgagcaggttggaagtatgggactggtcgaaatgttacaccgtagcaatctgcttgcgctggtgggcgggggctcgtcacctaagttttccgagatttctgcagttcttatatgggacgacgctagagaaggcaaagattctaaagagaaactagtcctggagtttacttttacaaagcccgtgttgagcgtcagaatgcgccacgacaaaatcgtcatcgtgctcaagaaccggatttatgtttacagtttcccagataatccgaggaagcttttcgagtttgatacacgcgacaatcctaagggcctgtgcgacctgtgtcccagcctggaaaaacagttactggtgtttcctggtcacaagtgcgggagtctgcaactggtcgacctcgccagtaccaaaccaggcacatcgagcgcgccttttaccatcaatgcccaccagtcagacattgcttgtgtgtcactgaaccaaccggggaccgtggtggcctctgcatcacagaagggcaccctaatcagactgttcgatacccagtcaaaagaaaagttggtcgagctgcgcaggggcactgaccctgctacgctgtattgtatcaacttctcccacgacagttccttcctgtgtgcttcttctgacaagggaacagttcacatttttgccctgaaggacactcgactcaatcgacgtagtgctttggctcgagtgggaaaggtcggaccaatgatcggacagtatgttgattctcagtggagtcttgccagctttactgtccctgccgaaagcgcctgcatttgcgcttttgggagaaatacgtcaaagaacgtgaatagtgtaatcgcgatctgcgtggacggtacctttcacaaatatgtgttcactccggatggcaactgcaatagagaggcattcgatgtgtaccttgatatctgtgacgacgacgacttctag

SEQ ID NO: 47921 - DNA, 1083 bp, Artificial Sequence
  Description of Artificial Sequence: Synthetic coding sequence
atgacccagcagcccctgcggggcgtgaccagcctgcggttcaaccaggatcaatcatgcttctgctgtgccatggagacgggtgtcaggatatacaacgtcgaacccctgatggagaagggccatctggatcacgagcaggttgggtctatgggtctggttgagatgctccacaggagtaatcttctcgcacttgttgggggcgggtcttcccccaagttcagtgaaatctctgtgctgatttgggatgatgcgcgcgagggtaaggactccaaagaaaagctggtgcttgagttcactttcactaaacctgtgttgagtgtcaggatgagacacgataaaatcgtcatagtgttaaagaatagaatctacgtttactcttttcctgacaatccgcgaaaacttttcgagtttgacactcgagacaaccctaaaggtctgtgcgatctgtgccccagcctagagaaacagctgctggttttccccgggcacaaatgcggctccctgcagctggtcgatctggctagtacgaagcccgggacctcatccgcacctttcaccatcaatgcacaccagagcgatatcgcctgcgtgtctcttaaccagcctggaacggtagtggcctccgcatctcagaaaggcacgcttatccgcctctttgatacccaatccaaagaaaaactggttgagttacgccgtggcaccgaccccgcaaccctgtactgtatcaatttttctcacgattcgtcctttctctgcgcttcgtctgataagggcacagttcacatttttgctttgaaagacacccggctgaacagacgtagcgctcttgcaagggtgggcaaagttggcccgatgattgggcagtatgtggactcccagtggtcgctcgcttcctttacagtgccagcagaatccgcttgcatctgtgctttcggacgtaatacatcaaaaaacgtaaacagcgtgatcgccatttgcgtggatggtactttccacaagtacgtcttcacaccagacggaaattgcaacagagaggcattcgatgtgtatctggacatttgtgatgacgatgacttctag

SEQ ID NO: 47922 - DNA, 168 bp, Artificial Sequence
  Description of Artificial Sequence: Synthetic coding sequence
atgacccagcagcccctgcggggcgtgaccagcctgcggttcaaccaggatcaatcctgtttctgctgtgcaatggaaaccggggtccgcatctacaacgttgagcccctcatggaaaagggtcacctggatcatgagcaggtcggctcgatgggcctggtggaatag

SEQ ID NO: 47923 - DNA, 477 bp, Artificial Sequence
  Description of Artificial Sequence: Synthetic coding sequence
atgacccagcagcccctgcggggcgtgaccagcctgcggttcaaccaagaccaatcttgcttctgctgcgccatggagacgggcgtacgcatttacaacgttgagcctctgatggaaaaggggcatctggaccatgagcaggtaggaagcatgggactggtggagatgctgcataggtccaatttgctcgccctcgtggggggggggagtagccctaagttttctgagattagcgtcttgatctgggatgacgctagagaaggcaaagacagcaaagaaaaactagtgctcgaattcaccttcaccaaacctgttctttcagtgcggatgcgccacgacaagattgtgatcgttctgaaaaaccggatttacgtgtatagcttcccagacaacccccgcaagctattcgaatttgacacgcgggacaaccccaaggcggcacatcccacgccacacctccacactctcggactatag

SEQ ID NO: 47924 - DNA, 879 bp, Artificial Sequence
  Description of Artificial Sequence: Synthetic coding sequence
atgacccagcagcccctgcggggcgtgaccagcctgcggttcaaccaggatcagagctgtttttgctgcgcaatggagacaggggtacgaatttacaacgttgagccattaatggagaaaggacatctaggactctgtgacctgtgtccctccctggagaagcagctgctggtatttcccggacacaagtgcggatcacttcagctcgtcgacctggctagcaccaaacccgggacctcttcggcacccttcacaatcaacgcacaccagagtgatatcgcctgcgtgagtctcaatcagccgggcaccgttgtcgcgtccgctagccagaaagggacactcatccgtctcttcgacacacaatccaaggaaaagttagtggagcttaggcgaggtacagaccctgcgactttatactgcatcaatttctctcatgatagcagtttcctctgtgcctccagcgacaagggcacagttcatatcttcgcgctaaaggatacccgtctgaacagacgatctgcttacgttcgacctctgcataccctgttgtctgcactggtggttgccgttgctctaggcgtgttggtgtgggctgccgaaacgcgtgccgccgtgagacggtgccggagatcccacccggctgcctgtctggcagcagtgctcgctgtgggacttctggtcctttgggttgcggggggagcatgtaccttcttgttcagtatcgccgggcccgtcctccttatacttgttcacgcttcccttaggcttaggaatctcaaaaacaaaatagaaaacaagattgagagcatcggtctgaaaagaacgcccatggggctgcttctggaggcccttggtcaggagcaagaggctggttcctag

SEQ ID NO: 47925 - DNA, 630 bp, Artificial Sequence
  Description of Artificial Sequence: Synthetic coding sequence
atggacagcgacgagaccggcttcgagcacagcggcctgtgggtgtcagtgcttgccgggcttctgttaggcgcttgtcaggcccatcccattcccgattcctcaccgctcctgcagttcggcggtcaagtgcgccagcgctacctgtacaccgacgatgcacagcagacagaagcccatctggagatccgggaggacgggacggtaggaggggccgccgatcagagtccggagagtctcctccagctaaaggcgttaaagcctggtgtcatacagatcctgggtgtcaagacttctaggttcctgtgccagcgccctgacggggccttatacggttcgctgcacttcgaccccgaagcatgctctttcagagagctgcttttggaggacggatacaacgtttatcagagtgaggcccacggcttgcctctgcacttacccgggaacaagagtccacaccgcgatccagctccacgaggacccgctagattccttccactgcccggcctgcctccggcccttcctgaacccccgggaatcttagctccccagccacccgacgtgggatcatccgacccactgtcaatggtgggcccgagtcagggcaggtccccctcctatgcctcttag

SEQ ID NO: 47926 - DNA, 321 bp, Artificial Sequence
  Description of Artificial Sequence: Synthetic coding sequence
atgagcaccaacaacatgagcgacccccggcggcccaacaaggtgctacgctacaaaccgccacccagcgaatgcaatccagccttggatgatccgactcctgactacatgaaccttcttggtatgatattttccatgtgtggtctcatgctcaagctgaagtggtgcgcctgggtagcagtgtattgctcctttataagtttcgcaaacagccggtctagtgaggacaccaaacagatgatgtcctccttcatgctatctatttctgccgtagtaatgagctacctgcaaaaccctcagcctatgacccctccttggtag

SEQ ID NO: 47927 - DNA, 2061 bp, Artificial Sequence
  Description of Artificial Sequence: Synthetic coding sequence
atgagcttcccccggggcagccagacccagaagatcaagcaccccattggcaccagaaagggacccctggaggtgccccccccgacagagaaggattggcccaaggacgatgagcaggaccatgtgctggttgaccccgatgaggaactcgattccctcccccaaccatataggatgatcaataaactggttaacctgctgttcgatcaaagctgggaaatcatagaggagcgtaatgctctgcgggaggccgagtcctctcaaattcaaccaactgtctatcctcccctgggagagatacagctcaataagatgccaaattgcatggcagtgtcccaggattatgtgttcattggcggcgcaaagggattttccatctacaatctgtactctgcaaaacaaatatatgcttgggaaaaactgaaggtagatgtgactagcatctgggctacagacctgggcaatgaaattttaatcgcgccggttgatgagatgggcatcatcaggttattttatttctataaagagggtctctatctggtcaaggcaatcaacgaggtggacgacacaagcaagcagacaacatgcattaaaatggagatcagccagggcggcgacttcgccgccttcttgcttcaaggcgcaggcgacatctggctagatgtgtacaagttaccaaaggaaacatggttgaagaaactggagcatcctcagctcacctccaacccgaagaagaaagtccgacagcctcagctgaatagccttggccctatcagcgctgaccctctagaaatggatgccaatgtgtctttcaaaggggacattaagcttagtctgccagtttacataatgaagatcaaaccccccaagccagtgaccggcactacattcaagagccccctggaggtgttcgcaaagatcaaggattgctacggcctgggctcgggtcaaaatcactttatcaaagacagtcagtgggaacagcaggcagagatctttaatgctagttataaaaaatatttggaccgcgaatgggaagaggaacctctctccacggccacattctattttctccttccctcatgtctgtttgcaatgccgcctgaggtgaaaggtccctctggaatggcatgcgtgctcggcatccactggacacgctcccataactttttcctttattctctcaacagaacattgaaggataaagcagatcctgaaggagtatggccatgtgcagcgcccatagccgtttcgcagctctcttgctctagctcctacctggtgctcgcatgtgaggacggagttctcaccttatgggatctagctaagggatttccgttgggtgtcgctgcacttcctcagggatgcttttgtcaatcgatccattttctgaaatattttagtgtccataagggtcaaaatatgtacccagagggacaggttaaaagtcagatgaagtgcgttgtgttgtgcactgacgcatccctccacctggtcgaggcctccggaactcagggcccaaccatttcggtactggtggaaagaccggtgaaacatttggacaaaaccatctgcgccgtggccccggtccctgcactccctgggatggtgttgattttcagcaagaatggcagcgtatgtcttatggacgtggccaagcgtgagataatctgtgctttcgccccacctggcgcttttccactggaggtgccctggaagccagtgtttgccgtgtcccctgatcatccttgttttttactacggggtgactatagtcacgagaccgcatcaacagacgacgctggcatccagtattccgttttttactttaatttcgaagcgtgcccgctgctcgaaaatatttcaaagaactgtaccatcccacagcgagacctggacaatatggccttcccacaagcccttcctcttgagaaacggtgtgagcgctttctgcagaagtcatatcgaaagctggagaagaaccccgaaaaggaggaggaacactgggctcgtctccaaaggtactccctgagcctgcaacgggaaaactttaaaaaatag

SEQ ID NO: 47928 - DNA, 1977 bp, Artificial Sequence
  Description of Artificial Sequence: Synthetic coding sequence
atgagcttcccccggggcagccagacccagaagatcaagcaccccattggaactcggaagggccctcttgaagttcccccccccaccgagaaggactggccaaaagacgatgaacaggaccacgtgcttgtggacccagacgaggagcttgactccttacctcaaccttatcgtatgatcaacaagctggtgaacctgctgttcgatcagagttgggaaattattgaggagcggaacgccctccgcgaggctgaaagttcccaaatccagcccacagtgtacccccctctgggcgagattcagctcaacaagatgccgaattgtatggccgtttcacaagattatgtgtttatcggaggggccaaagggttctctatctacaatctgtacagcgcgaaacagatttacgcctgggaaaaattaaaggttgacgtgactagtatttgggcgaccgacctgggaaacgaaatcttaatagccccagttgatgagatggggattattcgcctgttctacttttacaaagagggactctacttagtgaaggctatcaacgaagtggacgacacctctaaacagaccacttgtattaaaatggagatctctcagggaggcgacttcgcagctttcctcttgcagggagctggagacatttggcttgatgtgtataagctccctaaagagacatggcttaagaaactcgagcatccccagttgacatcaaatccaaaaaaaaaggtcagacagccgcagctaaatagcttgggccctattagcgcagaccctctggaaatggatgctaacgtcagcttcaagggcgacattaagttgagtctgcctgtgtacattatgaagattaagcccccgaaacctgtcaccggcaccaccttcaagagccctctcgaagtattcgccaagatcaaagactgctacggcctgggcagcgggcagaatcacttcattaaggactcccagtgggagcaacaggccgagatctttaacgcgtcatacaagaaatacctagatagagagtgggaggaggagcccttgagtaccgctaccttctacttcctcttgccctcttgcctattcgcaatgccgccggaggtcaagggccctagtgggatggcatgcgttttaggaattcactggacccgctcccataattttttcctctactctctaaacaggacactcaaagataaggccgatcccgaaggcgtctggccatgtgccgcgcctattgcagttagtcagctctcatgtagctcttcttatctagtcctcgcgtgtgaagacggcgtcctgacactgtgggatctcgctaaaggacagaacatgtatccggaggggcaggtgaagagtcagatgaaatgcgtggtgttatgcaccgacgcgtcactgcacctcgtcgaagctagcggtacacaaggcccaaccatctctgtcttagtcgagaggcctgtcaagcatctggacaagaccatctgcgcagttgctcccgtgcccgcactgcccggtatggtgctgattttcagtaagaatggcagcgtctgcctaatggatgtagccaagagagagatcatttgcgccttcgcacccccaggcgccttcccactggaggtgccatggaagccagtgttcgcagtttcacctgatcacccgtgcttccttcttaggggcgactattctcacgagacagcaagcactgatgatgcagggattcagtattctgttttctattttaactttgaggcctgtccactcctcgaaaacatttcgaaaaattgtacaatccctcagcgtgatctggataatatggcctttccccaggcgctaccgctcgagaaaaggtgcgagcgctttctgcagaagagctaccgcaagctggagaaaaatcccgagaaggaagaagaacactgggctcggctgcagagatattccctctcgctgcaaagggagaactttaaaaagtag

SEQ ID NO: 47929 - DNA, 1341 bp, Artificial Sequence
  Description of Artificial Sequence: Synthetic coding sequence
atggaggccgaggccgccgacgccccccccggcggcgtggagagcgccctgagctgtttctcattcaatcaggattgcacttctctggccacagggaccaaggccggatacaagttgtttagcctgtcctccgtcgagcagctcgatcaggtgcacgggtctaacgaaattcccgacgtgtatatagtagagcgtctgttttcctcctccctggtggtcgtggtttcgcatacgaaaccccgacagatgaacgtctatcactttaagaaagggactgaaatctgtaattattcctacagctcaaacatcctgtccatccgtctgaaccgccagcggctgttagtgtgcctggaagaatcaatctatatccataatatcaaagatatgaagctacttaaaaccctgctggatatccctgcgaaccctactgggctgtgtgccctgagtataaatcatagcaatagttacctcgcttatccgggcagcttgacctccggggagattgttctgtacgatggcaacagccttaagacagtctgtactatcgctgctcatgagggtaccctggccgctatcacatttaatgccagtggatctaagctcgcaagcgcttctgaaaaaggcactgtcatccgggtgttctccgtgcccgatggccagaaattatacgagttcagaaggggtatgaaaaggtacgtaacgatctcttctttggtcttttctatggacagccagttcttgtgtgccagcagcaacactgaaacagtgcatatcttcaagctcgaacaggtgactaactcaaggcccgaagaaccttccacatggagcggatacatgggcaaaatgttcatggccgctaccaactatctgcccacacaggtgtcagatatgatgcaccaggacagggcctttgccacagctagattgaatttctctggtcagaggaatatctgcacactctcgaccatccaaaagttgcccaggctccttgtggccagttcctctggccacctgtatatgtacaacctcgatcctcaggacggcggtgagtgtgtcctgatcaagactcacagtctgcttggttctggcacaactgaggagaataaggagaatgatcttcgtcctagcctgccacagtcctatgccgccactgtggctagaccatcagcttcctctgcctctacagttcctggctattccgaggacggcggggcgcttcggggcgaagtgataccggagcatgagtttgcaacagggccagtgtgcctggacgacgagaacgagttcccgccaatcattctatgtaggggcaaccagaaggggaaaacgaagcagagctag

SEQ ID NO: 47930 - DNA, 1095 bp, Artificial Sequence
  Description of Artificial Sequence: Synthetic coding sequence
atgaacgtgtaccacttcaagaagggcaccgagatctgcaactacagttacagtagcaatatcttgagcataagactgaacagacagagattgttggtgtgtcttgaagaaagcatatacatccataatatcaaggatatgaagctgctgaaaactcttctggatattccggccaacccaaccggactgtgtgccctgtctatcaatcactcaaacagctacttggcttatcccggatccctcacaagtggagaaattgtgctgtatgacggtaattcccttaaaaccgtttgtacaattgccgctcacgaggggacccttgccgctattacctttaatgcatccgggtccaagcttgcttccgccagcgagaaggggactgttataagagtgttctccgtccctgacggacaaaaattatacgaattcagacgaggcatgaagagatatgtgaccatctcgtcgttggtgttctccatggacagccagttcttatgtgcatccagtaacaccgagacagtgcatatcttcaagttggagcaagtaacaaattcccggccagaggaaccgtcaacgtggagcggctacatgggtaaaatgtttatggcagccacgaattacctcccaacacaggtaagcgatatgatgcatcaagacagagcctttgccaccgctagactcaatttctccggacaacgcaacatttgcaccctgagcacaatacagaaactgccgaggttattagtggcatcctcttccggccacctctacatgtataacctcgatccccaggatggcggcgagtgcgtactcatcaagacacactccctgttgggcagtgggacgacagaggagaataaagagaatgacctcagaccctctctgccacaatcatatgcagctacagtcgccaggcccagtgccagcagcgcctccaccgtgcccggatactcggaagacggaggggccctccgtggggaagtgatacctgagcacgagtttgccactgggccagtctgtctggatgatgagaatgagttcccacctattattctgtgtcggggcaatcaaaaaggcaaaactaagcagagttag

SEQ ID NO: 47931 - DNA, 1365 bp, Artificial Sequence
  Description of Artificial Sequence: Synthetic coding sequence
atgaacctggccagccagagcggcgaggccggcgccggccagctgcttttcgccaatttcaatcaggacaacactgaggtcaaaggggctagcagggcggccggcctcggaagaagggcagttgtctggtccctggcggtaggctccaagtccggatataaatttttctcattgtcctccgttgacaaactcgaacagatatacgagtgtaccgacactgaggatgtatgcatcgtggaacgactcttctcatcgtccctggtcgccatcgtgtctctcaaagcgccaaggaaactgaaagtgtgtcactttaaaaagggaacagaaatttgcaattatagctacagcaacacgatcttggctgttaaattgaaccgacagcgattgattgtgtgcctcgaagaatctctctacattcataacatccgtgatatgaaagtactccacacaattcgggagacaccccctaaccccgccgggctgtgcgcactaagcatcaacaacgacaactgttaccttgcctatccgggttccgccaccattggcgaggtccaggtttttgatacaattaatctgagggccgctaacatgatccctgcccacgactcccctctggctgctcttgcctttgacgcttccgggacaaagctcgctacagctagcgaaaagggtaccgtcattagagtgttctcaatcccagaaggccagaaattgtttgagttccggagaggcgtgaagcggtgcgtgagcatctgttctctggcctttagtatggacggtatgttcttgagtgcttcctccaataccgagacggtgcatatcttcaagctggagactgttaaggagaagccccccgaggagcccacgacctggactggttattttgggaaggttctgatggcttctacgtcctacctgcccagccaggtgaccgagatgttcaatcaggggcgggcattcgctaccgtccgcttgcccttttgcggtcataaaaatatttgctccctggcgactattcagaaaatacccagactgttggtcggagctgctgatgggtacctgtacatgtacaacctggatcctcaagaaggcggcgaatgcgcgctgatgaagcaacatcgacttgacggctccttagaaacaacaaatgagatcctggattcagcctcccacgattgccccctggttacccaaacctatggcgcggccgcgggcaaaggcacctacgtccctagctctccaacccgactggcctataccgatgatttgggggctgtagggggagcctgcttggaagacgaggccagcgcacttcgtctggacgaagattccgaacatcctccaatgattctgcgcaccgattag

SEQ ID NO: 47932 - DNA, 1314 bp, Artificial Sequence
  Description of Artificial Sequence: Synthetic coding sequence
atgctgctgcggctgcagcggatcaagaccctgcggccccccggctgtccccacccaatgaccacctgctctgccggtaccctgagcgcagttccctgcgtctcacctcggcaggtgttcgtcttcgagagacgtttctgcctttggagccatgtcgaaatgttcacgcacgtgctgccgtttgtgattagtgccgacaccgaggacgtgtgtattgtcgagcggctgttcagctcctctctcgtcgccattgtgtccctgaaagctccacgcaagttaaaggtgtgccacttcaaaaagggcacagagatttgtaattactcttactctaataccatcctagctgtgaaactgaaccgccagcgactaatagtgtgcctggaggagagcctgtatattcacaatattagagacatgaaagtgctccacacaatccgggaaaccccaccaaaccccgcaggattgtgcgccctgtctatcaataacgacaattgttacctagcctatccggggtctgctaccattggcgaggtccaggtatttgacacaatcaacctgcgcgcagcgaatatgatccccgcacacgactctccacttgcggccctcgccttcgatgcgtccggcaccaagctggccaccgcctccgaaaagggaactgtcatcagagtttttagtattcctgaaggccagaagctgttcgaattccggcggggggttaagcggtgcgtttcaatttgctctttagcatttagcatggatggaatgtttcttagtgcaagctcaaacaccgagactgtgcatatctttaaactggaaaccgtgaaagaaaagcctcctgaagagccaaccacatggactggttatttcggtaaagttcttatggcctcaacctcctacttaccttcacaggtgacggagatgttcaatcagggcagagcatttgccacggtgcgactgccattttgtgggcacaaaaatatctgttcactcgccacgattcagaaaattcctcggctgctcgtaggcgctgcggatgggtatttgtatatgtacaaccttgatcctcaggagggcggagagtgcgctctaatgaagcaacacagacttgacggaagcttggagacgaccaatgagattctcgattccgccagccacgattgccccctcgtcacccagacctatggcgccgcggcgggtaaggcttataccgatgatctgggcgccgtgggcggggcatgcttagaagatgaagcctctgcgttgcgactggacgaagatagcgagcaccctccaatgatccttcgcacagattag

SEQ ID NO: 47933 - DNA, 1278 bp, Artificial Sequence
  Description of Artificial Sequence: Synthetic coding sequence
atgaacctggccagccagagcggcgaggccggcgccggccagctgctttttgctaacttcaaccaggataacacctccctcgccgtcgggtcgaaatccggttataaatttttcagcctttctagtgtggacaagctggagcagatttatgagtgcacagacactgaggacgtgtgcattgtcgagcgcctcttctcctcctcccttgttgccatagtttcactgaaggccccccgcaagctcaaagtctgccacttcaagaagggaacagaaatttgcaattactcatacagcaacaccattctcgccgtgaaactgaaccggcagcgcttgatcgtgtgcctcgaggagtctttatacattcacaatataagggacatgaaagtgctgcatactatcagagagaccccccctaaccccgcagggttatgcgccctcagcattaataacgacaattgttacctcgcctacccagggtctgcaactatcggagaggtgcaggtattcgataccatcaacttgcgcgcagccaacatgataccagcccatgacagcccactggcagcactcgccttcgatgcatccggtaccaaactcgctactgcatcagagaagggtactgtgattagagtgtttagtattcccgagggccagaagctcttcgaattcagaaggggcgtcaagcgatgtgtttccatctgctctctggcattcagcatggacggtatgttcttaagcgcgagctccaacacagaaactgttcacatcttcaaattggagacggttaaagaaaaacccccggaggagcctacgacatggacgggttacttcggaaaagtattaatggctagtacaagctacctgcctagtcaggtgacggaaatgtttaatcagggccgagcctttgccactgtgcggctgcctttttgcggccacaaaaacatctgctcattggcaaccattcagaaaattccacggctgttagtgggggccgctgatggctatctctatatgtataacctcgatcctcaggaagggggggagtgcgctctgatgaagcaacaccggctggacggatccctcgagacgacaaatgagatcctcgattcagcctcacacgactgtcctcttgtgactcagacttatggggccgccgcaggcaaagcctataccgatgatttgggcgcggttggtggggcctgcctggaggacgaggcatccgcactgcgccttgatgaggactccgagcaccccccaatgattttacgcacagattag

SEQ ID NO: 47934 - DNA, 1311 bp, Artificial Sequence
  Description of Artificial Sequence: Synthetic coding sequence
atgaacctggccagccagagcggcgaggccggcgccggccagctgctttttgctaactttaaccaagataacacgtcactggctgtcggctctaagagtggctataaattcttctccctttcttctgtggataagcttgagcagatctacgagtgtactgacaccgaggacgtctgtatcgttgagcgcctgtttagctcatccctggtggctatcgtttcgctcaaggctcctcggaagcttaaggtgtgccacttcaagaagggcactgagatatgtaattacagttattctaataccatcctggctgtcaaacttaatcgtcagaggctgattgtgtgcttagaagaatctctctacatacataatattcgggacatgaaggtgctccacacaattagagagacccctcctaatcctgctggtctttgtgccttgtccatcaacaacgataattgctacttggcttatcctggatcggctacaatcggagaagtgcaggtgtttgacaccattaacctgcgggccgccaacatgattcctgctcatgactccccactcgctgcgttggctttcgacgcgtctggcaccaaactggctacagccagcgaaaaagggactgtaatacgcgtgttctccatcccggaaggccaaaaacttttcgaattccggaggggagttaagcggtgcgtcagcatctgctccctggcattttcgatggacggaatgttccttagcgcatcctcgaataccgagaccgtacacatctttaagttggagaccgtcaaagagaagcccccagaggaacccacgacgtggaccgggtacttcggcaaggtactgatggcaagcacatcctatctcccaagccaggtcacagagatgtttaatcagggcagggctttcgcgaccgtgcgcctgccattctgtgggcacaaaaacatttgctccttggcgaccattcagaagattcctcgactgctggtcggggccgccgatgggtacttatatatgtacaatcttgacccgcaggaagggggagaatgcgcactcatgaaacagcaccgtctagacggaagcctcgagacaaccaatgagattctggatagtgcctcacacgattgccctctggttacccaaacttacggcgctgccgcagggaaggggacttacgtgccaagttcaccaacaaggttagcctacaccgatgacctgggagctgttgggggtgcatgccttgaagacgaggcaagcgctttgagactggatgaggactcggaacaccctcccatgatccttcggactgactag

SEQ ID NO: 47935 - DNA, 1332 bp, Artificial Sequence
  Description of Artificial Sequence: Synthetic coding sequence
atgaacctggccagccagagcggcgaggccggcgccggccagctgctgtttgccaacttcaaccaggataatactgaagtcaagggcgcatctcgcgctgccggcctcgggcgacgggcggtcgtgtggagtctggctgtcgggagtaaatctggatacaaattcttcagcctcagctccgtggacaaattggagcagatatacgagtgtaccgacaccgaggacgtgtgcatagtggaaagactgttctcctcatcactggttgctattgtgtcacttaaggctcctaggaagctgaaggtgtgtcattttaagaagggcacggagatctgcaactatagttattctaatactatcctggcggtgaagctgaaccgccagcggctgatcgtgtgcctggaggaatcactgtatattcacaatatcagggacatgaaagtccttcatacaatcagagagacaccgccgaatcccgccggcctctgtgccctctccattaacaacgacaactgctacttggcctatccaggttcagccactatcggcgaagtgcaagttttcgataccatcaacctgcgagctgctaatatgatccctgcgcacgattcacctctggccgcccttgcatttgacgcatccgggactaagttagctactgcatctgaaaagggcactgttatcagggtcttctccatacctgaggggcagaaactctttgagtttagaaggggagtcaagcgctgcgtgtcaatctgctcccttgccttctctatggatggcatgtttctttccgctagttcaaataccgaaaccgtacacatctttaagctggaaaccgtgaaggaaaagccccccgaggaaccaaccacgtggactggctacttcgggaaggttctgatggcttccaccagctatcttccctcccaagtgaccgaaatgttcaatcagggccgggcatttgccacggttagactgcccttttgcggccataaaaacatctgctctcttgccaccatacagaaaataccgcgtttgctggtcggagctgcagacggttatctttatatgtataacctggacccccaggaagggggcgagtgcgccctgatgaagcagcatcggctggacggttcacttgaaaccacgaatgagattcttgactcagcctctcacgactgtcccctggtcacacagacatacggcgccgccgctggcaaggcatacacagacgacctcggtgcggtgggcggtgcctgtctggaggacgaggcatctgcactccggctcgatgaagacagtgagcatccccccatgatcctgcggactgactag

SEQ ID NO: 47936 - DNA, 1155 bp, Artificial Sequence
  Description of Artificial Sequence: Synthetic coding sequence
atgttcacccacgtgctgcccttcgtgatcagcgccgacaccgaggatgtgtgcatcgtggaacgattgttctcctcatccctcgtggctatcgtctctctgaaggcgcccaggaaactcaaggtctgtcactttaaaaaaggaacagagatatgcaactactcatattctaatacgattctagcagtcaagctgaaccggcagagactaatcgtttgtctggaggaatccctctacatacataatatcagagacatgaaagtgttacacacgatacgcgaaactccccctaacccggctggcctatgcgccctgagcattaacaatgacaactgctatctggcgtacccgggctccgcaacaattggagaagtgcaagtgtttgatacaattaacttaagggccgcgaacatgattcctgcccatgattcgccgctggccgcattggcttttgacgcctccgggaccaagttagccacagctagcgagaaaggaaccgtcatccgggtcttttcaattcctgagggacaaaagttgttcgagtttagaagaggcgtcaagcggtgcgtcagcatctgctcattggccttcagcatggacggaatgtttttatccgcttcttctaacaccgaaacagtacatatctttaaacttgagacagtaaaggaaaagcctccagaagaaccaaccacctggacaggctactttggaaaggtgcttatggcgagcaccagctatctgccatctcaagtaactgaaatgtttaaccagggaagggcctttgccacagtgagactgcctttctgcgggcacaaaaatatttgctcgctcgctaccattcaaaagatcccacgactgttggttggcgctgccgatgggtacctgtatatgtacaatctggatcctcaggaagggggggaatgtgccctgatgaaacaacaccggctagatggcagtttagaaactaccaatgaaatcctggattccgcctctcatgattgccctctcgtgacccagacatatggagctgctgcgggaaaagcctataccgatgacctgggcgctgtgggaggcgcgtgtctggaagacgaggccagcgctctgcgtctggacgaggacagcgaacacccccctatgatcctgcgaactgactag

SEQ ID NO: 47937 - DNA, 1035 bp, Artificial Sequence
  Description of Artificial Sequence: Synthetic coding sequence
atgaacctgctgccctgcaacccccacggcaacggcctgctgtacgcaggattcaaccaagaccacggatgttttgcctgtggcatggagaacggattccgggtctacaacacagaccccttgaaagagaaggaaaaacaggagttccttgagggtggagtgggacatgtggagatgttgtttagatgcaactatctcgccctcgtcggtgggggcaaaaaacctaaatacccccctaataaggtaatgatctgggatgacctgaaaaaaaaaaccgtcatagagatcgaatttagcacggaagtgaaggcagtcaaattgaggcgggacaggatcgtggtggttctggactctatgattaaggtctttacatttactcacaacccacaccagctacatgtgtttgagacgtgctataatcctaaaggtctgtgtgtgctatgtccgaattccaataattccctcttggcctttcccggaacccataccgggcacgttcagctcgtggaccttgcctcaaccgagaaaccccctgtggatatccccgcccatgaaggagtactttcttgcattgccttgaaccttcagggcacaagaatagccacggccagtgaaaaggggacccttattagaatcttcgacacgagtagcggacacttaatccaagagctgcggcgaggatcccaagccgccaacatttactgcattaacttcaaccaagatgcatccctaatctgtgttagttccgatcacgggactgtacatatctttgccgcggaagatcctaagcgaaacaagcaaagttcattggctagcgcttccttcctgcctaagtatttctcgtcaaaatggtcattcagcaaatttcaggtgccctccggctctccctgtatctgtgcgtttggtacggagccaaatgcggtcatcgctatctgcgcggacggctcatattacaagttcttatttaacccaaaaggcgagtgtatccgggatgtgtacgctcagttcttagaaatgactgacgacaagctgtag

SEQ ID NO: 47938 - DNA, 951 bp, Artificial Sequence
  Description of Artificial Sequence: Synthetic coding sequence
atggagaacggcttccgggtgtacaacaccgaccccctgaaggagaaggaaaagcaagaatttttagagggaggcgttgggcacgtggagatgctgttccgctgtaattatctcgccctggtggggggaggcaagaagccaaaatatccacccaacaaggttatgatttgggatgatctcaagaagaaaaccgtgattgaaatagagttctcaactgaagtcaaagctgtgaagttgagacgcgacaggatcgttgtggttctggactcaatgatcaaagttttcaccttcacacacaacccacaccagctgcacgttttcgagacatgctacaaccctaaaggtttatgtgtactgtgccctaacagtaataactccctgctcgccttccctggtactcacaccggtcacgtccagctcgtcgatttagcctctacggagaaaccacctgtagacatccctgcgcatgagggggtcctctcctgcattgcacttaatctacagggaacaaggattgctacagcaagcgagaaggggactctcatccgtatttttgatactagcagtggacatctgatccaggagctgcgccgaggcagccaggctgctaatatttactgtatcaacttcaaccaagacgcctctctgatatgcgtatcttcagaccatggaactgtgcacatttttgcggctgaggaccccaaacgtaacaaacagtcttcattggcctctgcctccttcttgccaaagtacttctcgtcaaaatggagtttctcaaaatttcaggtcccctcaggcagtccttgcatttgcgccttcggaactgaaccaaacgctgtgatcgctatctgtgctgacggcagctactataagtttctgtttaatccaaaaggcgaatgcattagggacgtatacgcgcagttcctcgagatgaccgacgacaaactgtag

SEQ ID NO: 47939 - DNA, 1395 bp, Artificial Sequence
  Description of Artificial Sequence: Synthetic coding sequence
atggccctggtggccctggtggccggcgcccggctgggccggcggctttctggtccaggcctgggcagaggccactggacagccgctaggaggtcgaggtccaggagggaggccgctgaggcagaagccgaagttccggtcgttcagtacgtgggcgaaagggctgctagagcggaccgggtgtttgtatggggcttctcattctccggtgctcttggagtgccttcttttgtcgtgcccagcagcggacccggcccaagggccggagcgagaccaagacggcgtatacagcccgtgccttatcgcctcgagctcgaccaaaaaatcagcagtgctgcatgtggctacggcttcaccctcctaagcagcaaaacagctgacgtgaccaaagtttggggtatgggtcttaacaaagactcccagctcggattccacaggagtcggaaagacaaaacccggggctatgaatatgtcctggagcccagtcctgtctccctgcccctcgatagaccacaggagacacgtgtgttgcaggtgagttgcggtagggcccactccctggtgttaactgacagggaaggtgtcttttcgatgggcaacaactcttacggtcagtgtggaaggaaagtggtggaaaatgagatttattcagagtcacatagagtgcatagaatgcaggactttgacggtcaagtggtgcaagtggcctgcggccaggaccattcactgttcctgaccgataagggcgaagtctactcttgtggttggggggccgacggacagactggccttgggcactacaatattacctcctcacccaccaagctgggtggcgacctggccggggtgaatgtgatccaggtggcgacctacggggattgctgcctggccgtgtctgcagacggagggctatttgggtggggcaatagcgagtatcttcaactcgcaagcgtaactgattccacccaggttaacgttccgaggtgtctgcacttcagcggggtgggaaaagtgagacaagccgcgtgcggagggaccggatgtgccgtgctaaacggagaaggacatgtctttgtctgggggtatgggatcctgggaaaaggtccgaatctggtcgagtccgccgtgccggaaatgatcccccccactctgttcgggttgacggagttcaatccggaaattcaggtgagtcgcattcggtgcgggctgagtcactttgcagctttgaccaataagggtgaattatttgtctggggcaaaaacatcaggggctgcttggggatcggccgtctcgaggaccagtacttcccatggcgcgtgactatgcctggggaaccagtggatgtagcgtgtggtgtggatcatatggtgacccttgccaaatcttttatctag

SEQ ID NO: 47940 - DNA, 1365 bp, Artificial Sequence
  Description of Artificial Sequence: Synthetic coding sequence
atggccctggtggccctggtggccggcgcccggctgggccggcggctgagcggccccgggctcgggcgcggacactggactgccgccaggcgcagcaggtcccgcagagaggcggcagaggcagaagccgaagtgcctgtggtgcagtacgtcggcgaacgggccgctagagccgaccgcgtgttcgtgtgggggttctcttttagcggtgcccttggcgtgcccagcttcgttgtcccgagcagcgggcctggccctcgggcaggggcacgtcccaggcggaggatccaaccagtgccctaccggctggaactggaccagaagatatcgtccgccgcatgcggctacggcttcacactgctgtctagcaagaccgcagacgttaccaaagtgtggggcatggggctgaataaggatagtcaactcggctttcaccgcagtcggaaggacaaaactagggggtacgagtatgttctggagccttcacctgtgagtctcccactcgaccggccacaggaaacaagagttctgcaggtctcgtgcgggagagctcactccctggtactcacagacagggaaggggtattctccatggggaacaactcatatggtcaatgtggaagaaaggtcgtcgagaatgagatttacagtgaaagccacagagtccaccggatgcaggattttgatggacaggtcgtgcaagtggcttgcggacaggatcactccttgtttctcaccgacaagggggaggtctattcatgcggttggggcgccgacggccaaaccggcctcggccactacaacatcacttcctcacccacaaagctgggcggagaccttgctggggtgaacgtgatccaggtggctacctatggggactgctgcctcgctgtaagcgccgacggcggcctgttcggatggggcaacagcgaatacctccaactagctagcgtaaccgattcaacgcaggtaaatgttccacggtgtctgcatttttcaggcgtcggaaaggtgagacaggctgcgtgtggtggcacgggatgtgcagtcctaaatggggaagggcatgttttcgtatggggatatggcatactgggaaagggcccgaatctggtagaatctgccgtaccagagatgattccaccaaccctctttgggctgaccgaattcaatcctgagatccaggtgtccaggatacggtgcggattgtcccattttgccgcacttacaaacaaaggcgagctgttcgtgtggggcaaaaacattagaggttgcctcgggatcgggaggctggaggatcagtacttcccctggcgcgcaccagcccctagtgcttccgctaaaaccactggaccgttgctatag

SEQ ID NO: 47941 - DNA, 1077 bp, Artificial Sequence
  Description of Artificial Sequence: Synthetic coding sequence
atggccctggtggccctggtggccggcgcccggctgggccggcggttgtccggtcccggcctgggcaggggccactggaccgcagcccggaggagccggtcaaggcgcgaagccgccgaagccgaggccgaagttcctgttgttcagtatgtgggtgaacgcgcagcgagggccgaccgcgtttttgtctggggtttcagttttagtggagccttgggcgtgccctctttcgtcgttccatcctccggccctggcccgagagctggggctcgcccaaggcggcggatacaacccgttccatacaggctcgagctggatcagaaaattagtagtgcagcttgcgggtatggcttcacgttgctgtcatccaaaacagccgacgtgacaaaggtgtggggaatgggcctgaacaaggattcccaactggggttccacagatcgaggaaggacaagactcgcggttacgagtacgtgcttgaacccagcccagtcagcctgcctctagaccggccccaggagaccagagtcctgcaggttagttgtgggcgcgcccacagcttagtcctcaccgaccgggaaggcgtgttttcaatgggaaataattcttacgggcagtgtggcaggaaagtcgttgaaaacgagatctattccgagtctcacagggtgcatcggatgcaggatttcgatggtcaggtggtccaggtggcctgtggtcaggaccattccttattcctgaccgacaaaggcgaagtatattcctgtggctggggggctgacgggcaaacagggctgggccactacaacatcacctcaagtcccacaaagctgggaggggatcttgctggagtcaatgtaattcaggttgctacctacggagattgctgccttgccgtctccgctgacggaggcttatttggctggggcaatagtgagtatctacagttagccagtgtcaccgactctactcaagtcaatgtcccacgttgtctccatttctcgggcgttggcaaggttcggcaggcagcttgtggaggcacaggatgtgctgtcctgaacgacacttggccacagtcatag

SEQ ID NO: 47942 - DNA, 1797 bp, Artificial Sequence
  Description of Artificial Sequence: Synthetic coding sequence
atggccagcctgcggcgggtgaaggtgctgctggtgctgaacctgattgctgtcgcaggcttcgtgctgttcctcgctaagtgcaggccgatcgcggtgcggtctggggacgctttccatgaaatcagaccaagagccgaggtcgcaaacttgtctgcgcactcagcatcaccaattcaggacgcggtgctgaaaaggctatcactgctggaggacatcgtttaccgacagctcaatggcctgtctaaatcactcgggctgattgagggatacggaggtcggggcaagggaggtttgcccgcaactctgtccccagccgaggaggaaaaggcaaaggggcctcacgagaagtacggctacaattcttatcttagcgaaaaaattagccttgaccggtctatccccgattaccggcctactaaatgtaaagagcttaaatattccaaggatcttccgcaaatcagcattatattcatattcgtgaacgaggccttgagtgtgatcctccgttccgtgcatagtgcagtcaaccacacacccacccatctgctgaaggagatcatcctcgtcgatgataattcggatgaagaggaacttaaagtaccactggaggaatatgtgcacaagagataccccggcttggtcaaggtcgtcagaaaccagaagagagagggcttgatcagagctcggatcgagggttggaaggtggccactggtcaggtaaccgggttctttgacgctcacgtcgagttcactgccggatgggcagaacctgtgttgagtagaattcaggaaaatcgtaaacgggtcattctcccctcaatcgataacattaagcaggataatttcgaggtccagagatatgagaattcagcccatggttatagctgggagctttggtgtatgtatatttctccaccaaaggattggtgggacgctggagacccgtccttacctatcaggacgccggcaatgattggatgttccttcgttgttaatcgaaagttcttcggggaaatcggactgttggatcccggaatggatgtttatggaggtgagaacattgaactgggcattaaagtctggttgtgcgggggttccatggaagttttgccatgctcacgggtcgcccatatcgagcggaagaagaagccctataatagcaacattggcttttacacaaaaaggaacgccctcagggtggcagaagtctggatggacgattataagagccacgtctacattgcctggaacctacccctggagaaccccgggatcgacattggggacgtttcagaacgaagggcccttcgcaagagccttaagtgcaaaaacttccagtggtatctggatcatgtctacccagaaatgcgtcgctacaacaataccgtggcatacggtgagctgcgtaacaataaagctaaagacgtgtgcttggatcaaggtcctctggaaaaccacaccgcaattttgtacccttgtcacgggtggggaccccagctggccagatatacaaaggagggttttcttcacctgggggccctaggcaccactactctattacctgacacccggtgccttgttgataattccaaaagccgtctcccacagctgctggattgtgataaagtgaagagctccctgtacaaacggtggaacttcattcagaacggtgctatcatgaacaaaggcaccgggaggtgtctggaagttgaaaatcgcggtttggccggaatcgacctgatcctacgctcttgcactggtcagagatggaccatcaagaactccatcaagtag

SEQ ID NO: 47943 - DNA, 1728 bp, Artificial Sequence
  Description of Artificial Sequence: Synthetic coding sequence
atggccaagcccttcttccggctgcagaagttcctgcggcggacccaatttctgctgttcttcctcacggcggcgtatcttatgacagggagtctcctgctgttgcaacgcgtgcgcgtcgccctaccacaagggcccagggctcccggaccattgcagacgctgcctgtggctgctgtggctctgggcgtgggtctcttggactccagggctctgcatgatccaagggttagcccggagctgcttctgggcgttgacatgctgcagtccccactgacacgaccacggcctggaccgcggtggctgagatcaaggaatagcgagttgcgccagctacggcggcgatggtttcatcacttcatgtctgacagccagggaccccctgcacttggaccggaggctgctcggccagccattcacagccgaggaacatatatcggttgcttttcagatgacggtcacgaacggacgctgaaaggtgctgttttctacgaccttcggaagatgaccgtgagtcactgtcaggacgcctgcgcagagcggtcctatgtctatgccggcctcgaggctggggccgagtgttattgcggaaatagattgccggcagtgtcggttggcctggaggagtgcaatcatgaatgtaagggagagaaggggtctgtgtgtggggccgtggatagattgtcagtgtacagagtggatgagctgcagcctggtagccggaagcgcagaacggccacttacagggggtgctttaggctgccggaaaacatcacccacgcctttccctcctcccttatccaagccaatgtaaccgtcggtacctgctcaggcttttgcagtcaaaaagaatttccgctcgccatcctcagaggctgggaatgctactgtgcttaccccaccccaaggttcaacctgcgggacgcaatggacagctccgtctgtggtcaagatccagaggcccaaagattggccgaatactgtgaagtgtaccagactcctgttcaggatacccggtgcacagatcgacggttcctgccaaataaaagtaaggtgtttgttgccttgtcttccttccctggggccggaaacacttgggctcgtcatctaattgaacacgccaccggattctatactggaagttactactttgacggcacactctacaacaaaggattcaagggcgaaaaagaccactggcgtagcagacggaccatatgcgtgaaaactcatgaaagtggacgccgagaaatagaaatgttcgactccgcaattctgctgattaggaatccctaccgttctctggtcgctgagttcaacagaaagtgtgcagggcatctcgggtacgcagccgatcgaaactggaaatcaaaagaatggccggatttcgtgaacagctacgcctcttggtggtctagtcatgtgttggactggttgaaatacgggaagagactgttggtcgtgcactatgaagagttgcgacgctccctggttccgaccctccgggagatggttgccttcctcaacgtctccgtgagcgaggagcggctgctgtgtgttgagaacaataaagaaggtagtttcagaaggaggggccggcggagtcacgatcccgaaccatttactcctgaaatgaaggacctaatcaacgggtatattaggaccgtagatcaggccctgcgggatcataactggactggtttaccacgggaatacgtgccccgctag

SEQ ID NO: 47944 - DNA, 1728 bp, Artificial Sequence
  Description of Artificial Sequence: Synthetic coding sequence
atggccaagcccttcttccggctgcagaagttcctgcggcggacccagttcttgctgtttttcctgaccgccgcatatctcatgaccggctcacttctcttactccaacgggtgagagttgcattaccacagggcccccgtgctccaggacctctacaaactctcccagtcgctgctgtggcgctgggagtggggttgctggactcacgagccctgcatgacccacgtgtctcgccagagttactattgggcgttgatatgctgcagtcgccactaacccggcccaggcccggtcctcgttggctaagaagtagaaatagcgaattgcgccagttgagaaggcggtggttccatcacttcatgtctgactctcagggccctcccgcattgggaccagaggcggcccgtcctgccatacacagtagaggtacctacattggatgttttagcgacgatggccatgaaagaacactgaagggggccgtattctatgacttaagaaagatgaccgtgtcccactgtcaggatgcatgcgccgagcgcagttacgtatacgccgggttggaggctggggctgagtgttactgtggcaacagactccccgccgtgtctgtggggctagaagagtgtaatcacgaatgtaagggggaaaagggcagcgtgtgtggtgccgtggatagactgtccgtttacagggttgacgaactgcagcccggtagccgaaaaaggcgaacagctacctacaggggctgtttccggctacctgaaaacataacgcatgccttcccctctagtctcatccaggccaacgtgaccgtggggacctgctctggcttttgctcccagaaggagttccccttagccatcctgcgaggttgggaatgctattgtgcctacccaacacccagatttaatcttagagacgctatggatagcagtgtgtgcgggcaggaccctgaggcccaacggctggccgagtactgtgaagtttatcagactccagtccaagacaccaggtgcactgaccggagattcctccccaacaaatcaaaagtgttcgtcgcactgtcatcatttccaggggcaggaaacacatgggcgcgccacctcatcgagcacgcaaccggattctatacaggtagctactacttcgacggcacactttataacaaaggttttaaaggcgagaaggatcactggcgttcccgtcggacaatctgcgttaagacccatgagtccggacgccgggagattgaaatgttcgactctgcaattcttctgatccggaatccttatcggtctctggtcgcagagtttaatcggaaatgcgcggggcatctgggatacgccgctgatcgaaactggaagagcaaagagtggcctgatttcgtgaacagctatgcctcctggtggtcatctcatgtccttgattggctgaaatacgggaaaaggttgctggttgtgcactatgaggaactacggcgaagcctggtgcctaccctgagagagatggtggcattcctcaacgtcagcgttagcgaggagagactgttgtgtgttgagaataacaaggaaggcagctttaggcggaggggtaggcgcagtcacgaccctgaacctttcacccccgagatgaaggacctcatcaacggatacataagaaccgtggaccaggcattgcgcgaccataactggaccggcctcccacgggaatacgttccccgctag

SEQ ID NO: 47945 - DNA, 1758 bp, Artificial Sequence
  Description of Artificial Sequence: Synthetic coding sequence
atggccaagctgtggttcaagttccagcggtacttccggcggaagcccgtcagattcttcacctttctcgctctttaccttaccgccgggtctcttgtgtttctgcactcaggattcgtcggacaaccagcggtgtccggcaaccaggcaaatcctgcggccgcagggggcccggctgaaggagccgagctgtccttcctgggagacatgcacctggggcgaggcttccgcgatactggggaggccagctctattgcacggagatacggtccgtggttcaaagggaaagacggaaatgagcgcgcaaagctgggagattatgggggtgcctggagccgggccctgaagggacgcgtggtgagggagaaagaagaggagagggcaaagtacattggatgttacctggacgatacccagtcaagggccttgcgcggtgtctccttcttcgattacaagaagatgactatctttcgctgtcaggataattgtgccgagcgtggctacttgtacggtggcttagaattcggggcagaatgctattgtggacacaagatacaagccacgaacgtgtcagaggccgaatgtgatatggagtgcaagggcgagcgggggtccgtctgcggcggggccaaccggttgtccgtgtatcgcttgcagctcgcacaggagtcagctagacggtatggaagtgctgtgttccgcggctgcttccgccgtcctgataacctgagtctggcgctgccagtcaccgcagcaatgctgaatatgtccgtggataaatgtgtggatttttgcactgagaaagagtacccgctcgctgccctggccggcaccgcctgccattgcggcttccccaccacacgctttcctctgcatgaccgggaggatgaacaactctgcgcacagaaatgctctgccgaggagttcgagagctgtgggacgccttcctactttatagtctatcagacacaagtgcaggataaccgatgtatggatcgcagattcttaccaggtaagagcaagcaattgatcgcgcttgcctctttccccggggcagggaacacatgggcccgccatttgattgagttagccaccggcttctacaccggcagctactatttcgatggctccctgtataacaagggattcaagggggaacgagaccattggaggtccgggaggactatctgtattaaaacccacgaaagcggccagaaggaaatcgaggcgttcgacgccgccatccttttaatccgcaacccttacaaagccttgatggcagagttcaaccggaagtatggcggccatatcggattcgctgcccacgcacactggaagggcaagggcgccgtcccgggctccctgcaaatcctgtttagaagcatttgtactgcaagcgtgggcgagtggcctgagtttgttaggaactacgccccttggtgggctacccacaccctggactggctcaaatttggtaagaaagtgttggtcgtgcacttcgaggacctgaaacaagacttatttgtccaactgggtaggatggtgtccttgctgggggtcgctgtccgggaggatcgactgttatgtgtagagtctcagaaagacggaaattttaagaggagtggcctgcggaagctggagtacgacccctatacagcggatatgcagaaaaccataagtgcatatatcaagatggtcgacgccgcactgaaaggcaggaatctgacaggcgtgccggatgactactaccctcggtag

SEQ ID NO: 47946 - DNA, 1698 bp, Artificial Sequence
  Description of Artificial Sequence: Synthetic coding sequence
atggccaagctgtggttcaagttccagcggtacttccggcggaagcctgtgaggttcttcacattcctggccctctacctcactgctggcagtttagtgttcctccattccggattcgtcgggcagccagccgttagtggcaaccaggctaaccccgccgccgcaggaggtccagccgaaggagctgaactaagcttcctgggcgacatgcatttgggccgaggcttcagagataccggtgaggccagctccattgcccggagatacggtccttggtttaaaggcaaggacggaaatgaacgggccaaattgggcgactacggaggtgcttggtcccgcgcactcaagggcagggttgtgagggagaaggaggaagaacgggccaaatacatcggctgttacttggacgacacacagtcacgggccctgagaggcgtttctttttttgattacaaaaagatgactatttttagatgccaggacaattgcgctgagcgtggctacctgtacgggggactcgaattcggagccgaatgttattgtggccacaagatccaggcgaccaacgtgagtgaagctgagtgtgatatggagtgcaagggcgagcgcgggagcgtatgtggtggggctaatagactttctgtgtacaggctgcagcttgcccaggagagtgcccgccggtatggatcggccgtctttagaggctgctttcgccggcccgacaacctttccttggcccttccagttactgccgctatgctgaacatgagcgtagataagtgcgtcgatttttgcactgagaaggagtatcctctggcagcactagccggtactgcctgtcactgcgggtttcctaccactagattccccctgcacgatagagaagacgagcagctgtgtgcgcagaagtgttccgccgaggaatttgagagctgcggcactccgagctacttcattgtgtatcaaacacaggttcaggacaacagatgtatggatcgacggttcctgcccggaaaaagcaaacagttaattgctcttgcctctttccctggtgcgggtaatacctgggcaaggcacctgattgagttagccactggtttctacacgggcagctattatttcgacggctctttatacaacaaagggtttaagggagagagggaccactggagaagcgggagaactatttgtatcaaaactcacgagtccggacaaaaggaaatcgaggcttttgacgccgcaattttacttatacgaaacccgtataaggctttgatggctgaattcaacaggaagtatgggggccacattggctttgccgcccacgcacactggaaaggcaaggagtggccagagtttgttcgcaactacgccccttggtgggcaacacatacgttggactggttgaaatttggaaaaaaggttttagttgtgcatttcgaagacctgaaacaggatctcttcgtccaactaggtcggatggtgtccctccttggcgtggctgtgcgggaagatcgacttctgtgtgttgaaagccagaaggacgggaatttcaagcgatcgggcctcaggaagctggaatacgacccatatactgcggacatgcagaagaccatatccgcgtacatcaagatggtggacgccgccctaaagggtagaaatttgaccggcgtgcccgatgactactatcctaggtag

SEQ ID NO: 47947 - DNA, 1698 bp, Artificial Sequence
  Description of Artificial Sequence: Synthetic coding sequence
atggccaagctgtggttcaagttccagcggtacttccggcggaagccggtccggttttttacttttctagctctgtatctgactgcggggagcctggtgtttctccattcaggctttgtgggccagcccgcggtgtctggaaaccaggccaacccagctgccgctggtgggcctgctgaaggtgctgaactgagctttctgggcgatatgcatctgggcagagggttccgggacaccggggaagcctcctccattgcccggcgatacgggccgtggtttaaaggaaaagacggcaatgaaagggctaaacttggcgactacggcggtgcctggtcacgtgccctgaagggcagagtagtgagggagaaagaggaagaaagagctaaatacatcggttgttacctggatgacacacagagtcgggcccttcgcggagttagtttctttgactataaaaaaatgacaattttccgctgtcaagataactgcgcagagcgggggtatctgtacggcggcttggagttcggagcggagtgctattgcggacacaagatccaagcgacgaacgtgagtgaggccgaatgtgatatggaatgtaagggggaacgcggatctgtttgcggaggtgcaaaccggcttagcgtgtacagactgcagttggcccaggaatcagcccgtcgttacggatctgccgtgttccgcggctgctttcgtcggccagacaatctatctttggcgttgcctgtgacagcagccatgttaaatatgtcggtggacaaatgcgtggacttctgcactgaaaaagaatatcctctagccgccctggctggcacggcttgccattgcggctttcccaccactagattccctctacatgacagagaggatgagcaactgtgtgctcagaagtgttctgctgaggagttcgagtcttgtggcacccccagctactttatagtttaccagactcaggtccaggacaatagatgcatggataggcgctttctgcctggtaagtcaaaacagctgatagccctagcttcgttccccggggcaggaaacacatgggctcgacacttaatagaattggctacaggattctacaccggatcttactacttcgatggatctctctacaataaaggatttaaaggtgaacgggaccactggcgctctggaagaacaatctgcattaagacccacgaaagcggtcaaaaggaaatcgaggcctttgacgcagccatcttgcttatcagaaatccctacaaggctctaatggcagagtttaatagaaagtacggaggacacattggattcgcagcgcatgcacactggaaaggaaaggagtggcccgagtttgtgcggaactacgctccgtggtgggccacccatactttggattggctaaagtttgggaaaaaagtcttggtagtgcattttgaggaccttaaacaggacctgttcgtacagttaggcagaatggtgagtctgctcggcgtggcagtccgtgaagatcgcctcctgtgcgtggaaagtcagaaggacggcaactttaaacggagtggcttgagaaagctggagtatgatccttatacggcggacatgcagaagacaatctctgcgtacattaaaatggtagatgctgctttgaaaggaaggaacctgacaggcgttcctgacgattactatcccaggtag

SEQ ID NO: 47948 - DNA, 1758 bp, Artificial Sequence
  Description of Artificial Sequence: Synthetic coding sequence
atggccaagctgtggttcaagttccagcggtacttccggcggaagccggtccggttttttaccttccttgccctgtacctgacggctggttctctagtcttcctccatagcgggtttgtcggtcaaccagccgtctccggtaaccaggctaatcccgccgcagctggcggacctgcggaaggagctgagctgtcctttctgggcgatatgcatttgggacgcgggtttagagatactggcgaggcctctagcatagccaggcgttacgggccctggtttaaaggcaaggatggtaatgaacgggctaagcttggggactacgggggcgcctggtcccgggccctgaaaggccgagtcgtgcgggagaaagaagaggagcgggctaagtacattgggtgctatctggacgatacgcagtcgcgggccctaaggggggtctccttcttcgattataagaagatgaccatcttccggtgccaggacaactgtgcggaacgggggtatctgtacggtggcttggaatttggcgcggaatgctattgtgggcataaaatccaggctaccaatgtctcggaagctgaatgcgacatggaatgtaaaggcgagaggggatctgtttgtggaggtgccaatagattatcagtctatcggctgcagttggctcaggagtcggcccgtcgctacggttcggctgtgttcaggggctgtttccggagaccagacaacctctctctggccctgcctgttacggcagccatgctgaacatgtcagtggacaagtgtgtcgacttctgcaccgagaaggaatatccactcgccgcattggcgggcacagcttgccattgtggctttccgactacccggttccctctccatgaccgcgaagatgaacagctctgcgcacaaaagtgtagcgcagaggagtttgaaagctgcggaactcccagctacttcatagtttatcagactcaggtccaagataatagatgtatggacagacgctttctgcccggtaagtctaaacagttgattgcactcgccagctttcccggcgcaggcaacacttgggctaggcacctcatcgaactcgcaaccggattctacacaggtagctattattttgatggatctctctataataaaggatttaagggggaaagagatcactggcgttctggccggaccatctgcattaagactcatgaatcaggacagaaggaaatcgaggcgtttgacgctgctatcctactgatcaggaatccttataaggccctgatggctgagttcaaccggaagtatggtggccatattggatttgctgctcatgcgcactggaagggaaaaggggctgtgcccggcagcctgcagattctgtttcgatctatctgtaccgcttccgtcggggagtggcccgagtttgtcaggaattacgccccctggtgggctactcacaccctcgactggttaaaattcggcaagaaggttcttgtcgttcattttgaagatctgaaacaggatctgttcgtacagctcggccggatggtctcactgcttggggtcgctgtccgtgaggatcggctcctgtgcgttgagtctcagaaggatggcaactttaaacggagcggactgagaaaactcgagtatgatccttacactgctgacatgcagaagacgatctctgcgtacataaagatggttgacgcagctttgaaaggcagaaacctgactggggtccccgacgattattatccccgctag

SEQ ID NO: 47949 - DNA, 5532 bp, Artificial Sequence
  Description of Artificial Sequence: Synthetic coding sequence
atggccgacacccagacccaggtggcccccacccccaccatgcggatggctaccgccgaggacctgcccttgcctcctccgccagcactagaggacctgcccctcccgccaccaaaggagtctttcagtaaatttcaccagcagcggcaagcatctgaactgcggcgtctctaccgacacatccatccagagctgaggaagaaccttgccgaggccgtggccgaggatttggccgaagtcctcggctcagaggagcctacagagggcgacgttcagtgtatgcgttggatctttgagaattggagactggatgccatcggcgagcacgagcgccccgccgctaaggagcccgtgctgtgcggcgacgtccaggccacatcgagaaagttcgaggaaggctcatttgcaaattccacagatcaggaaccaacccggccgcagccaggcgggggtgatgtgcgcgccgcacgttggttatttgaaacaaagcctcttgacgaattgacaggtcaggctaaggagctggaggccacagttagggagcccgctgccagcggcgacgtgcaggggactaggatgctatttgaaactcgtccgctggatcggttagggtctcggccttcgcttcaggagcaatctccgctggagctgcggtccgagatccaggaactgaagggtgacgtgaaaaagacagtgaagctctttcagaccgagccactgtgcgctatccaggatgccgaaggcgctatccatgaggtgaaggcagcctgtcgggaagagattcagagcaatgccgttaggagtgcaagatggctttttgaaactaggcctctggatgcgatcaatcaggatccgtctcaggtccgcgttatccggggaataagcctggaggagggcgctaggcccgatgtcagtgccacccggtggatttttgaaactcagccgctggacgcgatacgtgaaatcctggtggatgaaaaagactttcagccgagccctgacctgattcccccgggcccagacgtccagcagcaacagcatttgtttgaaacacgggcgctggatacactgaagggcgacgaggaagccggagctgaggcacctcccaaggaagaggtggtccctggcgacgtgcgttcaaccttgtggctctttgagactaagcctttggatgccttcagagacaaagtccaagtggggcacctgcaacgggtggaccctcaggatggagagggacacctcagcagtgacagctccagcgcactacccttcagtcagagcgctccccagagggatgaattgaagggggacgtgaaaaccttcaagaacctgttcgaaacactgccactggacagtattggccagggggaagtgctcgcccatggcagcccctcccgtgaggagggcacggattccgccggtcaggcccaaggaataggaagcccagtttacgctatgcaggatagcaaaggccggttgcacgctctaacttcggtctcccgggagcagatcgtgggaggggacgtccaagggtataggtggatgttcgaaacccagcctctggatcagctcggacggtccccgtcaacaatagacgtcgtccgtggaatcactcgccaagaggtggtcgcaggtgacgtgggcacagcgcgctggctgttcgagacacagcctctggagatgatccaccagagggaacagcaggagagacagaaggaggaagggaaatctcagggtgatccacagcctgaagcccctcctaagggtgatgtacagacaatcagatggctgtttgagacatgcccaatgtcagaacttgctgagaagcagggctctgaggtcaccgaccccaccgccaaggccgaggcccagtcatgtacatggatgtttaagcctcaaccagtcgaccggcctgtaggttcaagagagcagcaccttcaagtctcgcaagtgccagctggcgaacggcagactgacagacatgtttttgaaaccgagccactgcaggcttccggtagaccatgcggccgtaggccggtccgatactgtagccgggttgagatccccagcggccaggtgagtcgtcaaaaagaggtgttccaagccctggaggcagggaaaaaggaagaacaggaaccccgtgttatcgcaggcagcattcccgctgggagtgtgcataaattcacttggttatttgaaaactgtccaatggggtccctggctgccgaatcaatacagggggggaatcttctggaagagcaaccaatgtccccttcaggcaatcgtatgcaggaatcccaggagaccgctgccgaaggaacattacggacattacatgcaacacccggaatcttgcaccatggcggaatactcatggaggcaagaggccccggagagctttgtttggcaaagtatgtactcagcggtaccgggcaaggtcacccctatatcagaaaagaagagcttgtgagcggcgagctgcccagaatcatatgccaagtgctgagacgaccagacgtggatcagcagggccttctcgtgcaggaggatcctactggtcagctgcagctgaagcccctccgactccctactcctggaagcagcggcaacattgaggacatggaccctgaactgcagcaactgctggcttgtggactcggaaccagcgtggcaagaactggactggtcatgcaggaaacagagcagggccttgtggccttgacggcgtattccctccagccacgtctcaccagtaaagcttcagagagaagcagcgtgcagcttttggcgagctgcattgataagggagacctgagtgggctccacagcctgaggtgggaaccccccgccgatccttcgcctgtcccggcgtcagaaggggctcagagcttacaccccaccgaatctattatccacgtgccgccattagacccgtccatgggcatgggccatcttcgcgcctcaggcgcaactccttgccccccccaggccatcggaaaggccgtccctcttgcaggagaagctgcggctccagctcagctacaaaacacagagaaacaggaagattctcactctgggcagaagggcatggccgttctcggtaagtctgagggcgccactactacccccccaggccctggcgccccagacctgctggctgcaatgcagagtttaaggatggctacagcagaggcgcagtccctgcaccaacaggtgctgaacaaacacaaacagggtcctaccccaaccgctaccagtaaccctattcaggacggtctgagaaaggccggagccacgcagtcaaacatccgccccgggggaggaagtgacccgcgcatcccagccgccccaaggaaagtgtcccgggaggagcaggccctgcccaggggcctgccaggcggctgggttaccattcaggatggaatttacacagcacatccagtgaggacattcgatcccccaggaggcgtacagctctcacagcgggaaccgcagtcccgccacagggaaaccgccctgtcagtccaagccccacggcccctgcagggtggtccgggccagtccactggtccagggcgcgaagagcccggcggttgcactcaaatggcctggggaccccccggtaaggcaatggccgaagtgtgtcctggcggactgcaagctgccgaaacaactctcaagaccgccccccttggcaggcacatcctagctagcggtccacaggccgctggggctagtcctcaccctcataacgcctttgttcccccccccccaactctgccggctgccgtgacgggccctgatttcccggcaggcgctcacagggccgaggacagcatccagcaggcatccgagcctttgaaggacccacttctgcacagtcattcctcaccggcaggccagcggacaccgggagggagtcagaccaaaacccccaaactcgaccccactatgccccccaagaagaaaccccagttgcctcccaagcctgctcacctaacccaaagccaccctccgcagaggctgcccaaacccctgcctttgtcccccagcttttcttccgaagttggacagcgcgaacaccagcgaggtgaaagagatactgcgatcccccagccagctaaagtcccaaccaccgtggaccaaggtcacattcctctcgctaggtgtcctagtggtcatagccaacccagccttcagcacggcctgtccacgacagcgcccaggcctactaaaaaccaggccacaggttcaaacgcccagtcttccgaaccacccaagcttaatgccctgaaccacgaccccaccagccctcagtggggcccaggtccttcgggagagcagcccatggagggcagtcaccaaggagccccagaatccccagattccctgcaaaggaatcaaaaggagttacaagggcttctcaaccaggtccaagccctggaaaaagaagctgctagtagcgttgacgtgcaggccctgcgacgcctcttcgaagccgtcccacagctgggaggtgcggccccacaggcaccagccgcacaccagaaacccgaggcttcagtggagcaggcctttggtgagctgacaagggtgtctactgaggtggctcagcttaaagaacagacccttgcacgactcctggacatagaagaggcggttcacaaagcattgagttcaatgagcagtctgcagcccgaagctagcgcacgtggccatttccagggccctcccaaagaccactcagcccacaagatttctgtgactgtgtcaagcagcgcgaggccttcaggctccgggcaggaggtaggcggccagacggccgtcaagaatcaagctaaagtggagtgccacactgaggcacaaagccaggttaagatacggaatcatacagaggcaagggggcacacagcgtccaccgctccatccacccgacggcaggagacctctcgcgagtacctgtgcccgcctagagtcttgcctagttccagagattcccctagttctcctacatttattagtatccagtccgctacgaggaagccccttgaaaccccttcatttaaaggaaacccggatgtctcggtgaagtcaacccagcttgcccaagacatcggccaggccctgttacatcaaaaaggagtgcaagacaagactggtaagaaggacattacacagtgtagtgtccaaccagaacccgcacccccatccgctagccctctcccaaggggatggcagaaaagtgtgttggagctgcagacaggtcctggtagcagtcagcactacggagccatgaggaccgtgaccgagcaatatgaggaggtcgaccagttcgggaacactgtcttgatgtcctcaaccactgtgacggaacaagctgaacctccacgcaaccccggatcccacctcggattgcacgcaagccctctgcttcgccagttccttcactctcctgccggctttagttcggatctgaccgaggctgaaaccgtccaagtttcttgctcatatagtcaaccagccgcccaatag

SEQ ID NO: 47950 - DNA, 3366 bp, Artificial Sequence
  Description of Artificial Sequence: Synthetic coding sequence
atggccgacacccagacccaggtggcccccacccccaccatgcggatggccacagccgaggatctacctctgccccccccgcctgcgcttgaagacttgcccctacctccgccgaaagaaagttttagtaagttccaccagcagcgacaagcctcggaactgaggagactgtacaggcatattcatcctgagctgcgtaagaatctggccgaggctgtggcggaggacctagcggaggtgctcggcagcgaggagcccacagagggggacgtgcagtgcatgcgttggatctttgaaaattggcggcttgacgctataggcgagcacgaacgccctgcggcgaaggagcccgttttgtgcggcgacgtacaggctactagtcggaagttcgaagaaggttccttcgccaacagcaccgaccaggagcctaccagaccacagcccgggggtggcgacgtccgggcagctcggtggctattcgagacaaagcctctcgacgaactgacaggccaagctaaggagctggaggcaacagtcagagaacccgccgcctcaggggatgtgcagggcacccgcatgctctttgagacacggcccctagacagactcggatccagaccttctctgcaggaacagagcccattggagctgaggtccgaaatccaggagctgaaaggggatgttaagaaaacagtaaagctgttccagacagaacctttgtgtgcaatccaagatgcggaaggtgccatccacgaggtgaaagccgcttgcagagaagaaatccagagcaacgcagtgcggagcgccaggtggctatttgagacgcgtcctctcgacgctattaaccaagacccctcccaggtccgtgtgatcagagggatctctttagaggaaggagcccgaccagatgtgagtgctacgagatggattttcgagacccagcccttggatgcgattagggagattcttgtggacgagaaggatttccaacctagccccgacctcatcccccccggaccagacgtgcaacaacagcaacatttgtttgaaacacgtgcgctggacaccttgaaaggagacgaagaagccggcgctgaggcacctccgaaagaggaagtcgtgcccggagatgtccggagtacattgtggctgtttgagacaaagcccttggacgcttttagagataaagtgcaggtgggccatctgcagcgcgtggacccacaggatggcgaaggccacctaagctccgactcttctagcgccttgcccttcagtcaatccgcaccacaaagggatgaactcaagggagatgttaaaacgtttaagaatctgtttgaaacattgcccctcgattcaatcggccagggtgaggtgctcgctcacggtagccctagccgggaagagggtaccgattccgccgggcaggcccagggcataggcagccccgtgtacgccatgcaggatagcaagggccgcttacacgccctcacctcagtgtcacgcgagcagatcgttgggggggatgtgcaaggataccggtggatgttcgagacccagccgctcgatcagcttggcaggtctccatccaccattgacgttgtcagaggtataaccagacaggaggtcgtggctggcgacgtaggaactgcccgctggttgttcgagactcagcccctggagatgatacatcagcgagagcagcaggaacgacagaaggaagagggcaaaagccaaggcgatcctcagccagaggcgcctcccaaaggagacgtgcaaacaatacgctggctgtttgaaacttgtccaatgagcgagctggctgaaaaacaaggatccgaggttacagaccccactgctaaggcagaggcgcagtcctgtacttggatgttcaaaccacaacccgtcgatagacccgtgggctctcgcgagcaacacctacaggtgtctcaagtgccggcgggcgagcgccagacagatcggcacgtgtttgagaccgagccactgcaggcttctggcagaccctgcggccgaagacctgttcggtactgttctagagtcgagatcccctctggtcaagtctcacgccagaaggaggtttttcaggcattggaggccggcaagaaggaggaacaggagccccgggtgatagcgggaagcatcccggctggcagcgtccataagttcacttggctattcgagaactgtcccatgggtagtcttgccgccgagtccatccagggaggtaacctgctggaagagcagcccatgtcaccctctgggaacagaatgcaggaatcgcaagagaccgctgccgagggcaccctcaggactctgcacgcaaccccaggcatactccatcacggaggaattctgatggaagccagaggtcccggagaactctgcctagcgaagtatgtgctttcaggcactgggcaggggcacccatatattcgcaaggaagaactggtgagtggtgagctccccagaattatctgccaagtattaagacggcctgatgttgatcagcagggcctcctggtacaagaagatcccacgggccagctgcaacttaagcctctcaggctgcccactcctgggagctcaggcaacattgaggatatggaccccgaacttcaacagctgctggcttgcggattgggaacaagcgtggcgagaacgggtttggtgatgcaggaaaccgagcaggggctggtggccctcaccgcttatagtctgcagccccggcttacttctaaggcttccgaacgttccagcgtccagctcctggcctcttgcatcgacaaaggcgatctgagtggccttcattctctcaggtgggagccccccgcggacccttcccctgtgcctgcctctgaaggcgcacagtctttgcaccccacagagtccatcatccacgtgccgccactagatccctcgatgggcatgggacatctgagggcgagcggagcaaccccatgtcccccacaagctatcggcaaagccgtgccgctcgctggcgaggctgcagcccccgcacagctacaaaatacagaaaaacaggaagacagtcatagcgggcagaagggtatggccgtgttgggaaagtctgaaggcgctacaacaacacctccaggccccggggccccagatctgttggccgccatgcagtcccttaggatggctacagcagaggcccaatccctccaccagcaggttctcaataaacataaacaagggccgacccccactgccacgagtaatccgatacaggacggacttcggaaggcaggtgcgacacagtcaaatatccgtcctgggggaggttccgaccccaggattcccgctgctcctcggaagctgctatag

SEQ ID NO: 47951 - DNA, 1581 bp, Artificial Sequence
  Description of Artificial Sequence: Synthetic coding sequence
atgccccccaagaagaagccccagctgccccccaagcccgcccaccttacacagtcgcaccccccccaaaggctcccaaaacctctgccgttatctccctcttttagctctgaggtaggacaacgtgagcaccagcgtggtgaaagagataccgctatcccacagcctgcgaaagtgcctactaccgtggatcagggccatatccccctggcaaggtgcccatccggccactcccagcccagcctacagcatggcctgtctaccacggcaccacggccgaccaaaaaccaagctactggctctaatgcccagtctagtgaaccaccgaaattgaacgccctgaaccacgacccaacttcgccacaatggggaccagggccgtctggtgagcaacccatggaaggttctcatcagggcgcacctgagtctcctgatagcttacaacgtaaccaaaaagagctacagggacttctgaaccaggtccaagccttggaaaaagaagctgcaagtagcgtggacgtgcaagcactaaggcgcctttttgaagccgttccccaactggggggggctgccccccaagctccggccgcccatcagaaacctgaggctagcgtagaacaggcattcggtgaattgactagggtcagtaccgaggttgcacaactgaaagagcaaacccttgcgcggcttctggacatcgaagaggccgtgcacaaggcactgtcaagtatgagctccctgcagccggaagccagtgcaagagggcatttccaaggtccgccgaaggatcatagtgcgcacaagatcagcgttactgtgtcaagctcagctagaccgtcaggctctgggcaggaggtcgggggacagacagctgtgaagaaccaggcaaaagtcgagtgtcacaccgaagctcagtctcaggtcaagattagaaaccacaccgaggcccggggtcatactgcctccactgcacccagtacacgaagacaggagaccagtcgtgaatacctgtgtcccccccgcgttctgccgtcctcgcgggacagcccctcctcacccacgttcatctccatccaaagtgcaacgcggaagcctctggaaactccctcgttcaaggggaatccagacgtgagtgttaaatctacccagctggcacaggacatcggtcaggctctgcttcaccagaaaggcgtgcaagacaagacaggtaaaaaggatatcacccagtgttcggtacagcccgagccagcccccccttctgcgtcacccctgccaagggggtggcagaaaagtgtgcttgagctacagaccggtcccgggagcagccagcactatggtgcaatgcgcaccgtgacagagcagtatgaggaagttgatcaattcggcaacactgtgctgatgtctagcaccacagtaaccgagcaggccgagccacctagaaacccaggtagccacctgggccttcatgccagccctctgctccgacagttcttgcatagcccagctggtttcagttctgaccttaccgaggcagaaacggtccaggtgagctgttcttactcccagcccgccgcgcagtag

SEQ ID NO: 47952 - DNA, 1953 bp, Artificial Sequence
  Description of Artificial Sequence: Synthetic coding sequence
atggccgccaagagcgacggccggctgaagatgaagaagagcagcgatgtcgctttcactccgttacagaacagcgaccactctggttcagtccagggccttgcccccggcctcccctccgggagcggcgcagaggacgaagaggcagctggcggcggatgttgtcctgatggggggggatgttccagatgttgctgctgctgcgcagggtccggcgggtccgcaggctctggcgggtcaggtggagtggcagggcccgggggtggaggggcaggttctgcagcactgtgtttgagactggggcgggaacaaaggaggtacagtctgtgggactgtctttggattcttgcagccgttgccgtgtactttgccgatgttggcaccgacgtatggctcgctgtcgactactaccttagagggcagagatggtggtttgggctaacactcttcttcgtggttctgggaagcctcagtgtacaagttttcagctttaggtggttcgtgcacgatttttccaccgaggattccgctaccgctgctgctgcgtctagctgcccacaaccgggggccgactgcaagaccgtagtgggcggagggtccgccgcaggtgaaggtgaggctagaccaagtacccctcaacgtcaggcatccaacgcatcaaagagcaatattgccgctgccaactcagggtcaaactcgtccggagccacccgggcttccggtaaacatcggtcggcctcgtgtagcttctgtatctggctgttgcagtctctaattcacattttgcagcttggccagatttggagatattttcataccatttatttgggcatcaggagtcggcagagcggagagaatgatcggtggcgcttttactggaaaatggtctacgagtatgccgatgtgtccatgctgcatctgttagccacgtttctcgaaagcgcccctcagctcgtgctgcaactgtgtatcatcgttcagactcattccttacaggcgctccagggattcaccgccgctgcatctttagtaagtctcgcgtgggctctggcttcataccagaaagcccttcgtgacagccgggacgataaaaaaccaatcagctacatggccgtaatcattcagttctgttggcatttctttacaatcgctgccagagtaatcacattcgccctgtttgccagcgtgtttcagctgtattttggaatttttatcgtcctccactggtgtattatgactttctggatcgtgcactgtgaaaccgagttttgtattacgaaatgggaggaaatcgtgttcgacatggtagttggcattatctacattttcagttggtttaatgtcaaggagggccggacccggtgtcgcttgttcatctattacttcgtcattctgctggaaaatacggctctgtcggcactgtggtatttatacaaggccccacaaattgcggatgccttcgctattccagccctctgtgtcgtgttttcttcctttttaaccggtgtcgttttcatgctcatgtattacgctttttttcaccctaacgggccccggtttggacagagtcctagttgtgcttgcgaagacccggctgcagccttcactcttccaccggacgtcgccacatcgacgctccgatctatctcaaacaaccgctcagtggtctccgatagggaccagaaatttgccgaacgagatggatgcgtcccagtcttccaggtgaggcccactgccccctccaccccttcctcaagaccacccaggattgaggagagcgttattaaaatagacctgttccgaaatagatacccagcctgggaacgccatgttctggaccggtctctgcgcaaggcgatccttgccttcgaatgcagtccctcacccccgcgactgcagtataaggacgacgcactgattcaggagcgcctggagtatgagaccaccctgtag

SEQ ID NO: 47953 - DNA, 1953 bp, Artificial Sequence
  Description of Artificial Sequence: Synthetic coding sequence
atggccgccaagagcgacggccggctgaagatgaagaagagcagcgatgtggcctttacacctcttcagaatagtgaccattcgggtagcgtgcaggggttagccccaggtctccccagcgggtcaggagcagaagatgaggaagccgcggggggaggttgctgtccagatggcgggggttgtagtcgatgctgttgttgctgcgcaggatcaggcggatccgcgggttcagggggaagcggtggtgttgcgggccccggggggggaggggctggctctgcggctctctgcttgaggttaggccgcgagcagcggcgctattctctgtgggattgcctatggatacttgctgccgtcgccgtatactttgccgacgttggtacggatgtgtggctagcagtggactactatctgcgtgggcaaagatggtggttcgggctgacactgtttttcgttgtgctggggagcctctccgtccaggtgttttcatttcgttggttcgtccacgatttttccacggaggactcagcaactgctgccgcagccagcagttgtcctcagcctggtgcagactgcaagacagtcgtgggagggggttcagcggccggggagggagaagccagaccttccacccctcagcggcaggcctcaaatgcatccaagagtaatattgccgccgccaacagcggcagtaacagctcaggggcgaccagggccagcgggaagcaccgttccgctagctgttccttctgcatctggctcttgcagtcgttaatccatatcctgcagctggggcagatctggagatacttccatacaatttaccttgggatccgctccaggcagagcggcgagaatgatcggtggcggttttactggaaaatggtctatgaatacgctgatgtgtctatgctacaccttctggcaaccttcctcgagtcggcacctcaactcgtgctccagttatgtatcatagtacagacacacagcctccaggcgcttcagggctttacagcagctgcatccttagtttcactggcatgggccctggcaagttaccagaaggctctccgtgattcccgtgacgataagaagcccatctcatacatggccgtgatcattcagttttgttggcattttttcacaattgcagccagagtcattacatttgcgttattcgcctccgtcttccagctgtactttgggatcttcattgtgctacactggtgtattatgaccttctggatcgtgcactgtgaaacagagttttgcatcacaaaatgggaagaaatagtgttcgacatggtggttggcatcatttacattttctcatggttcaacgttaaagaggggagaaccaggtgtaggctattcatttactatttcgtgattctactggaaaatacagctctgtctgcactctggtacctctacaaagctcctcagatagcagacgcctttgccattccagctctctgtgtggtcttttcctcctttctaaccggagtcgttttcatgttgatgtattatgccttcttccacccaaacggaccccgatttggccaatcacctagttgcgcctgcgaagatccagcggcagccttcaccctaccacctgatgttgccactagcacactccgctccatttctaacaacaggtccgtcgtgtcagacagagaccagaaatttgctgaaagggacgggtgcgtccctgtattccaagtgcggcctaccgccccatccacaccatcctcccgcccacccagaatcgaagagtccgttattaagatcgacttgttccggaatagatatcccgcctgggagcgacatgtcctggacaggagcctgcgcaaagcaattctagcctttgaatgctcacctagtccaccaagacttcagtacaaggacgatgccctgatacaggagaggttagagtatgagacaaccctctag

SEQ ID NO: 47954 - DNA, 1089 bp, Artificial Sequence
  Description of Artificial Sequence: Synthetic coding sequence
atgatgtacgagtacgccgacgtgaacatgctgcggctgctggagacattcttagaaagtgcgcctcagctggtcctgcaactctatatcatgcttcaaaaaaacagcgcagaaacccttccctgtgtgagttcggtaacctcactgatgtccctggcatgggtgcttgcctcttaccataaattgctccgagactctagggatgataaaaaatcaatgtcctacagaggtgccattatccaggtattctggcgcttgttcacaatctccagccgggtgatttctttcgcactgttcgcatcaatcttccaactctattttggtatcttcgtggtggtgcactggtgtgccatggcattctggataattcatggtggtacggacttttgcatgtccaagtgggaggagatcttatttaatatggtggttggaattgtttacattttctgttggttcaatgtgaaggaagggcgtacacgatacaggatgtttgcatactacacgatcgtgctgactgaaaacgctgccctgacctttctatggtacttttatcgggacccagaaactaccgattcgtatgccgttcctgcactctgctgcgtgttcatcagtttcgtggccgggattgccatgatgcttttatactatggcgttcttcaccctactggtcccagggctaagattctcgccagctcgtgctgcgctgaactgctttggggcattcctctcccacctgatgtggagcccatggcgcctgagatcccgggatatcgcggcactcaggtgacacctactcgagccgtcacggagcaacaggaagatctgaccgccgacacctgcctaccagtatttcaggtgcgccctatgggtccccccactcctctgggcagaccatatttacccgaaggcccgttaatcaaaattgatatgcccagaaagcggtaccccgcttgggatgcccacttcgtcgaccgccgccttaggcgaactattaacattctgcagtatgttacccctacggccgtaggcataagatatcgcgacgggcctctcctttacgaactgctacagtacgaaagtagtctctag

SEQ ID NO: 47955 - DNA, 1926 bp, Artificial Sequence
  Description of Artificial Sequence: Synthetic coding sequence
atggccgccaagagcgacggcggcggcgtgggcgtgggcttcgcccagcttcacaacctggacgaagcagttggctctgggggagaggaagacggcgaacctggaggaggggggtgtggaggtgggggtgacgggtctgagcctggagaaagttcttctatgcacatttgccattgttgcaatacttcctcctgttactggggctgtagaagcgcctgcctgcggagtctcctgggccggaagccgagaaggagcgctgccgccgatggtggagatcagccccttcaacctcccgccgcgccgggtgctggtaggcagccccctacgccctccgccgcacgaccagagccgccaccacctcaggtggaacgcccttggctggattgcctctggatcgtgctggcactcctggtgtttttcggagatgtgggaactgacctgtggttggccctggactactaccgcaaaggtgattatgtttacttcgggttgacactgtttttcgtgctggtgccgtccctgctggtgcagtccttgtcatttcggtggttcgtgcaggactacaccgggggtggtttaggggccgtggaggggttaacatcaagaggaccccctatgatgggcgcagggtatgtacacggggccgcccgcggtggacctggagttcgggtctctcctaccccaggggctcaaagattgtgccgactgagcgtctggatctggcagagcgtgattcacctccttcagatgggccaggtgtggaggtatattagaaccatgtacctaggtatccagagtcagcgaaggaaggaacaccagcgacggttctactgggccatgatgtatgaatatgctgacgtaaatatgctcaggctgctagagacattcttagagagcgcacctcagctggtgctgcagctctatattatgctgcagaaaaattcagccgaaacgcttccctgcgtctcttccgtgacatccctcatgtctctcgcctgggtactggcctcttatcacaagctgctgcgagatagtcgggatgataaaaagagcatgtcatatcgcggagccatcatccaggtgttttggcgtctgtttacaattagcagtagggttatttcatttgctctctttgctagcatattccaactctacttcggcatcttcgtagtcgttcactggtgcgccatggcattctggatcatccacgggggaacagatttctgtatgtcaaaatgggaagagatcctttttaacatggtggtagggatcgtttacatcttttgctggttcaacgtcaaagaagggcggaccagatacaggatgtttgcttattacacaatcgtattaacagaaaacgctgccctcacatttttatggtatttctaccgtgatccagaaactaccgatagctacgcggttcccgcgctctgctgtgtatttatatcatttgtggccggaattgccatgatgctgctttactatggggtgcttcaccccacaggccccagagctaagatcctggccagtagttgttgtgccgaactgctctgggggataccactgcctcctgacgtggagccaatggcaccagaaatacctggttacagaggcacacaggtcactccaacacgggcggtgaccgaacagcaagaagatctgaccgccgatacgtgccttccagttttccaggtgagacccatgggaccccctacccccctgggccggccatatctgccagagggccccctcattaagatcgacatgccgcggaagcgttacccggcatgggacgctcactttgtggaccggcgtttgcgacgaaccataaacatcctgcaatacgtgaccccaactgccgtgggaattcggtaccgagatggtccacttctgtacgagctgttgcagtatgagagcagtctgtag

SEQ ID NO: 47956 - DNA, 2034 bp, Artificial Sequence
  Description of Artificial Sequence: Synthetic coding sequence
atgctgagcagcaccgacttcaccttcgccagctgggagctggtggttcgcgtcgatcatccaaacgaagaacagcagaaggacgtgacactaagggtatcaggagacctgcacgttgggggtgtgatgctaaagctggttgaacagattaatatctcccaggactggagtgactttgctctctggtgggaacagaaacattgctggttgctgaaaacccattggactctggacaagtacggtgtgcaggcagacgccaagttactcttcacgccccagcacaaaatgttgcgccttcgcctgccaaatctaaagatggtccggctcagagtgagtttttccgctgtggttttcaaagcggtctcagatatatgcaaaatcttgaacataagaagaagcgaggagctgtctctgctaaagccctccggcgactatttcaaaaagaagaaaaagaaggataaaaataacaaagagcccattatcgaagatatcttgaacctggaatcaagccctactgcgagtgggagttccgtgtctccaggtctttattcgaaaacgatgacgcctatttacgatcctatcaatgggactcctgctagtagcacaatgacatggttctcggatagccccctgacagagcaaaactgttcaatcctggccttcagtcagccaccccagtcgccagaggccctggctgatatgtaccagccccgtagcctcgtagataaagcaaaacttaacgcaggctggctcgactcttccaggagcctcatggagcagggcatccaggaagacgagcagctgttattacggttcaaatattactcttttttcgaccttaatcctaagtacgatgccgtaaggatcaaccaactgtatgagcaagcccggtgggcgatcctgctggaagagatagactgcaccgaagaagagatgctgattttcgctgcacttcaatatcacatttcaaaactgagcctgagcgctgaaacccaggacttcgctggcgagagcgaggtggatgagatagaagctgcactgtccaacctggaagtaactctcgaaggcggcaaggccgattccttgctggaagatatcacagacatacccaaactggcggataatctgaagctgttcaggcccaaaaagctgttgcctaaggccttcaagcagtattggttcatcttcaaggacacctctatcgcctactttaagaacaaggaactagagcagggtgaacctctggagaagttgaatctgcgcggctgtgaggtggtgcctgatgtgaacgttgcgggcaggaagttcggtatcaagctgctcattccagtcgctgacgggatgaacgaaatgtacctgaggtgtgaccacgaaaatcaatacgcgcagtggatggcggcttgtatgttagccagcaagggcaagaccatggccgattcgtcctaccagcctgaggtgctgaacattttaagtttccttcggatgaagaatagaaactctgcctcacaggtcgcatcaagcctggagaatatggacatgaacccggagtgcttcgtgtcaccaaggtgcgccaaacgccataagagcaaacagctggcagctcggatactggaagcccaccagaacgtggcccagatgcccctggtggaggccaagcttcggtttatccaggcgtggcaaagcctgcccgagttcggtctgacgtattacctcgttcggtttaaaggctctaaaaaagacgacattctgggcgtctcctacaaccggctgataaaaattgatgctgccacgggcatccccgtgactacttggcggtttaccaatatcaagcagtggaatgttaattgggagacccgccaggttgtgatagaattcgatcagaacgtgttcactgcctttacgtgcctctccgccgactgcaaaattgtgcatgaatatatcggggggtatatcttcttgagcactagaagcaaagatcaaaacgaaactcttgacgaggatctgtttcacaagcttaccggaggacaggattag

SEQ ID NO: 47957 - DNA, 1188 bp, Artificial Sequence
  Description of Artificial Sequence: Synthetic coding sequence
atgccctggagcagccggggcgccctgctgcgggacctggtgctgggagtcctgggaactgctgccttcctgctcgatcttggcacggatctgtgggcggccgtgcaatatgccttaggtggtaggtacctgtgggcagccctggtgctggcactactggggctggcatccgtcgccctgcagttgttttcatggctctggctcagagccgaccccgctgggctccatggaagtcaacccccaaggagatgccttgcactccttcacctccttcagctcggatacctgtatagatgcgtgcaagagttgcgacaaggcctgctggtgtggcagcaggaggagcccagcgaatttgatctggcctatgctgactttcttgcccttgatatctccatgttgagattgtttgagacgtttctggagaccgccccccagttgaccctggtcctcgctatcatgttgcaatccggcagagccgaatattaccagtgggtggggatctgtacgagcttcctcggcatttcctgggccttactcgactaccacagagccctgcggacctgcctccctagtaaaccactgctgggcctgggttcaagcgtgatttactttttgtggaacctgctgcttctgtggcctagagtattggctgtggctttattctccgcgctctttcctagctacgtggcactgcattttcttggactgtggctggtgttgcttctatgggtgtggctgcagggaacggatttcatgcctgatccctcctcagagtggctctatagagtaactgtggccaccatactttattttagctggttcaacgtggccgaaggccgaacccggggccgtgcaataatccattttgcgttcctgttatcggatagcatccttctcgtggcaacttgggtcacccatagttcatggctgccatccggaattcccctgcaactgtggcttcccgttggctgcggctgtttctttctcgggcttgctctccggctggtttactatcactggctccatccatcgtgctgctggaaacctgaccccgatcaagttgatggcgctcggtcacttttgtcccctgaggggtatcaactgccacagaaccgcaggatgactcacctcgctcaaaaattttttccaaaagctaaggacgaggccgcttccccagtaaagggttag

SEQ ID NO: 47958 - DNA, 1122 bp, Artificial Sequence
  Description of Artificial Sequence: Synthetic coding sequence
atgaagtacaccaagcagaacttcatgatgagcgtgctgggcatcattatctacgtgactgatctgatcgtggacatctgggtttccgtgagattctttcacgaggggcagtacgtgttcagtgccctggccctgtctttcatgttatttggcactctcgtcgcacagtgcttttcctacagctggtttaaagccgacctgaagaaggcgggccaggagtcccagcactgctttttgctcctccattgcctacaaggaggcgtgttcactcgctattggtttgcccttaaacgcggctaccacgctgcatttaagtacgactctaacacctccaatttcgtcgaagaacagattgatcttcacaaggaggtcattgatcgggtgactgatctgtcaatgctcaggttgttcgaaacatatctggaagggtgtccccagctgatcctgcaactgtacatcttgcttgagcatggacaggccaacttctctcagtatgccgccatcatggtatcttgttgtgcaatttcctggtccacggtggattatcaggtggctcttcggaaaagcctccctgataaaaagcttctgaatgggttgtgcccaaagattacctacctgttctacaagcttttcacactcttgtcctggatgctgtctgttgttctcctcctatttctgaatgtgaagatagcgctatttctcctactttttctctggctcctgggcatcatctgggcatttaaaaataatacccagttctgtacgtgcatctctatggagttcctataccgcatcgtggtggggtttattttgatattcaccttctttaatattaaaggccagaacactaaatgtccaatgtcctgttattacattgtccgggtcttgggcactctgggaatcctaacggttttttgggtgtgccccctgacaatttttaatcctgactacttcattccaatctctattacgatcgtgctaaccctgctccttggcatattgtttttaatagtctactacggatcattccatcctaatagatcggctgagactaagtgcgatgagattgacggaaagccagtgctgcgcgaatgcaggatgcggtattttttgatggaatag

SEQ ID NO: 47959 - DNA, 1122 bp, Artificial Sequence
  Description of Artificial Sequence: Synthetic coding sequence
atgaagtacaccaagcagaacttcatgatgagcgtgctgggcatcatcatctacgttactgacctgattgtggacatctgggtttcagttcggttttttcacgaaggccagtacgttttttcagccttagccctgagctttatgctgttcggaacgctggttgctcagtgtttcagctacagctggttcaaagctgacctgaagaaggccggacaggaatcccagcattgttttctcctcttacattgcttgcagggtggtgtatttacgagatattggttcgccctcaagcgcggctaccatgcggcctttaaatatgatagtaatacaagcaacttcgttgaggagcagattgacctgcacaaggaggtgattgaccgggtcacagacctgtctatgctgcgactgtttgagacgtacttggagggttgcccccaattgattctgcagctgtacatcctcctcgagcacgggcaggcaaacttttcgcagtacgctgctatcatggtatcatgttgcgctatctcatggtctactgtggactatcaagtagctctccgaaagagcctgccggacaaaaaactcctaaacggcctgtgtccgaagataacatacctcttctacaaactttttaccctgctttcctggatgctgtctgtcgtgctgcttctgttcctgaacgtcaaaattgctctgttcttactgctatttttgtggctgcttggaattatctgggccttcaaaaacaacacgcagttctgcacctgtatctctatggagttcctgtacagaatcgtggtcgggttcatattgatcttcacatttttcaatataaaagggcagaatactaagtgcccgatgagctgttattatatcgtgagagtgttgggcacgctgggaatactgaccgtcttctgggtctgtcctctcacaatttttaacccagattacttcatccccatcagcattaccatcgtccttactctgctgctcggaattctattcctcattgtgtactacgggtcctttcaccctaatcggtcggcagaaactaaatgcgatgagattgatggcaaaccggtcctgagggaatgtagaatgcgctattttttgatggaatag

SEQ ID NO: 47960 - DNA, 1182 bp, Artificial Sequence
  Description of Artificial Sequence: Synthetic coding sequence
atgggcctgctgcggggcggcctgccctgcgcccgggccatggccagactgggggcagtgaggtctcattactgcgccctgttgctggccgctgcactcgctgtgtgcgcattctactatcttgggagcggtcgggagaccttcagctccgcgactaaaaggctaaaagaggcccgtgccggggctcccgccgccccctcaccaccggctctggaactcgccagaggttcagtcgctcctgcacctggggccaaggcaaagagtttggagggtgggggtgctgggccagtggattatcatctgcttatgatgttcaccaaagccgagcacaatgcggccctgcaggcaaaggcccgggtggccctccgcagcctgctgagactggccaaatttgaggcgcatgaagtgctaaaccttcactttgtttctgaggaagctagccgagaagtggcaaagggtctgctccgcgagctcctgccaccggccgcaggattcaaatgcaaggttatattccacgacgtcgccgtcctcaccgacaaactttttcccatcgtagaagcaatgcagaagcacttttctgcggggctgggaacctactattcagatagcatcttcttcctgtccgtagccatgcatcagattatgcccaaggagatcttgcagatcatccagctggacctagacctgaaattcaaaaccaacattagggagctgttcgaagagttcgactctttcctgcccggggctatcatcggtattgcccgcgagatgcagccagtgtatcgccacaccttttggcaattccgccacgaaaatcctcagacccgcgtgggcggacccccccccgaaggcctgcctggattcaattctggggtcatgctcctgaatctcgaagccatgcgccaaagtcccctttacagcaggctcctcgagcctgctcaggtgcagcagctagcagataagtaccattttcgcgggcacctcggggatcaggacttcttcactatgattggcatggaacaccctaagctgtttcacgttctggactgtacctggaataggcaactctgcacctggtggcgggaccacggatactccgacgtgttcgaggcatacttccggtgcgaagggcacgtgaagatctatcacggtaactgcaacacaccaattcccgaggattag

SEQ ID NO: 47961 - DNA, 573 bp, Artificial Sequence
  Description of Artificial Sequence: Synthetic coding sequence
atgtggcccccccggtgcaaggaccccggccggcagagcgccgagatattgcaaataatccagcttgatctcgaccttaagttcaaaacaaatataagggagttattcgaggagttcgattctttcctaccgggtgctatcatcggtatagcccgtgaaatgcaacctgtgtaccgccacactttctggcaatttcgtcatgaaaacccacaaacaagggtgggcggaccccctccggagggcctgcctggctttaattcgggcgtgatgctccttaatcttgaagccatgagacagtctcctttgtacagtcgcttattggagcccgcgcaggtgcagcagttagccgataagtatcattttcgcggacatctcggagaccaggacttttttactatgatcgggatggaacaccccaagctctttcatgtgttggactgcacctggaatcgacagttgtgtacatggtggagggatcatggatacagtgacgtgttcgaagcctactttaggtgcgaggggcacgtcaagatctatcatgggaactgcaacacacccattcctgaagactag

SEQ ID NO: 47962 - DNA, 564 bp, Artificial Sequence
  Description of Artificial Sequence: Synthetic coding sequence
atgaacggcatgagcgtgctgatgaaggagaccctgaagagcagcgtgacaccatccccatacgaggaaactggagaacggcagccttctgttaactgggcagtctctccacaccaaacccagaatcaatgggcgcggtggtcatggacctcgcagcctctcgagctccataccttttggcagtttcgccacgaaaacccgcaaacccgggtgggcgggcccccccctgaggggctccctggattcaactcgggagtgatgcttctgaaccttgaggcaatgcgacaatctcccctctacagcaggttgctcgaaccagcacaagtgcagcaactggctgataaatatcacttccgcggacacttgggggaccaggattttttcacaatgattggcatggaacaccctaagttgttccacgtactcgattgcacctggaaccgacaattgtgcacatggtggagggaccatgggtattctgacgtctttgaggcctacttcagatgtgaaggccatgtcaagatttaccacggcaattgtaacacccccattcctgaggactag

SEQ ID NO: 47963 - DNA, 573 bp, Artificial Sequence
  Description of Artificial Sequence: Synthetic coding sequence
atgtggcccccccggtgcaaggaccccggccggcagagcgccgagatcctgcagattattcaactcgaccttgatctgaaatttaaaaccaacatccgggagctattcgaagagtttgactccttcctgccaggagcgattatcggcattgcacgggaaatgcagcccgtatatcgccataccttttggcagtttagacacgagaatccccaaacccgggtaggagggccacctcctgaaggtctgcctggctttaattcaggagtcatgctcctgaatctagaggcaatgagacagagccctttgtattcaagattactggagcccgcacaagttcaacagttagctgacaaatatcactttcgggggcatctcggtgatcaggattttttcaccatgattggcatggaacatcccaagctctttcatgttttagattgtacatggaatagacagctgtgtacatggtggcgagatcatggttactcagacgtgtttgaagcatacttcaggtgtgagggacacgtaaagatttaccacggaaattgcaacacccccatccccgaagattag

SEQ ID NO: 47964 - DNA, 570 bp, Artificial Sequence
  Description of Artificial Sequence: Synthetic coding sequence
atggtgcggtgcgtgcccagcgccgtgatcgtgtgcttcctgcggcccccacagcccggacggacagtcattttccacgacgtggctgtgttgacagataagctgtttcctatcgttgaggcaatgcagaaacacttttcagccggcctcggaacctattactcggatagtatcttctttctttcagtggccatgcaccagattatgccaaaggaaatcctgcaaatcatacagttagatctggatctgaaatttaaaactaacattagggagctgttcgaggagttcgactcttttctgcctggggctattatcggcatagcacgggaaatgcagcagttggcagataagtaccattttcgcgggcatctgggagaccaggatttcttcactatgatcggtatggagcacccaaaattgttccatgtcctggattgcacttggaatcgacagctctgcacctggtggagagatcacggctatagcgacgtgttcgaggcctactttcgatgcgaaggccatgtcaaaatttatcatggaaattgtaacacccccatacctgaggattag

SEQ ID NO: 47965 - DNA, 504 bp, Artificial Sequence
  Description of Artificial Sequence: Synthetic coding sequence
atgagcctggtgatccggaacctgcagcgggtgatccccatccggagagcgcctctgcggtctaaaattgagattgtgcgacggattctgggggtgcaaaaattcgaccttggcattatttgtgtcgacaataaaaatatccagcacatcaataggatctacagagaccggaacgtccctacagatgtcctctccttcccgtttcacgagcatttgaaggcaggagaatttccccaacccgatttccccgatgattacaatcttggcgatatcttcttgggggtggagtatatcttccaccagtgcaaagaaaatgaagattacaatgacgtccttacagtgaccgctactcatgggctctgccacttgctgggattcactcatggcactgaggctgagtggcagcaaatgttccagaaggagaaggcagtcctggatgagctgggacggcgcactggaacgagactgcaaccactgacacgggggttatttggagggtcttag

SEQ ID NO: 47966 - DNA, 375 bp, Artificial Sequence
  Description of Artificial Sequence: Synthetic coding sequence
atgagcctggtgatccggaacctgcagcgggtgatccccatccggagagcgcctctcaggtcaaaaattgaaatcgtccggcgtattcttggcgtgcaaaagtttgatcttggtattatctgtgtcgataataagaatattcagcacatcaaccgaatttacagagatcggaatgtgcccaccgatgttctctcatttcccttccacgaggttactgctactcatggactgtgccatctgcttggtttcacacacgggaccgaagccgagtggcagcagatgttccagaaagagaaggctgtactcgatgagctgggccgcagaactggcacgcggctgcagccattgacaaggggcctgttcggcggcagctag

SEQ ID NO: 47967 - DNA, 504 bp, Artificial Sequence
  Description of Artificial Sequence: Synthetic coding sequence
atgagcctggtgatccggaacctgcagcgggtgatccccatccggcgggcccccttgaggtcaaaaatcgagattgtgagaagaattctgggcgttcagaagttcgacttaggaattatatgtgttgacaataagaatattcaacatatcaaccgcatttaccgggaccgcaatgtcccaacggacgttctgtccttcccctttcacgaacacttgaaagccggtgaattcccccagcccgactttccggatgattacaacctgggcgacatctttctgggggtggagtacatcttccatcagtgtaaggagaatgaagactacaacgatgtacttactgtaactgcgactcacggtctttgccacttgctcggcttcacccacggcacagaggccgagtggcaacagatgttccagaaggaaaaggccgtcttagacgagctggggcggagaactggcacacggttacagcctttgacgcgaggattgttcggcggatcctag

SEQ ID NO: 47968 - DNA, 240 bp, Artificial Sequence
  Description of Artificial Sequence: Synthetic coding sequence
atgagcctggtgatccggaacctgcagcgggtgatccccatccggagagcaccactgagatcgaagatcgaaatcgtgaccgcgacccatgggctctgtcacctgctgggttttacgcacggtacagaggcggaatggcagcaaatgtttcagaaagaaaaagcggtcctggacgagcttggacgcaggactggcactagactgcagcccctgactagggggctgttcggagggagctag

SEQ ID NO: 47969 - DNA, 369 bp, Artificial Sequence
  Description of Artificial Sequence: Synthetic coding sequence
atgagcctggtgatccggaacctgcagcgggtgatccccatccggcgcgctcccttgagaagtaagatcgaaatacaccttaaagcaggagaattccctcagccagacttcccagatgattacaatctgggggatatcttcttgggcgtcgagtacatcttccatcaatgcaaggagaacgaagactataatgacgttctcacagtgactgctactcacgggctgtgccacttgttgggctttacgcacggtaccgaggctgagtggcaacagatgttccagaaggaaaaggccgtgctggatgagttgggacggcggacgggcacccgactccaaccactgacgagggggctgttcggagggagctag

SEQ ID NO: 47970 - DNA, 504 bp, Artificial Sequence
  Description of Artificial Sequence: Synthetic coding sequence
atgagcctggtgatccggaacctgcagcgggtgatccccatccggcgcgctcccctgcgttctaagattgagatcgttcgaagaattttaggcgtgcagaagtttgaccttggaatcatatgcgtcgacaacaaaaatatacagcacattaatcgcatctaccgggatcgcaatgtgcccacagatgtgctctcatttccatttcatgaacatctgaaagctggagaatttccacagccagacttcccggatgattataacctgggagatattttcctgggggtagagtacatctttcaccagtgtaaggagaacgaggactacaacgacgtgctgactgtaacggccacccacggactctgccatctgctgggatttacacatggcactgaagcggagtggcagcagatgttccagaaggagaaggctgtactggatgaactcgggcgccgcaccgggactcggctccagcctctgacacgcggactattcggcgggtcctag

SEQ ID NO: 47971 - DNA, 921 bp, Artificial Sequence
  Description of Artificial Sequence: Synthetic coding sequence
atggccgccgtggacgacctgcagttcgaggagttcggcaacgccgctacttctcttacagctaaccccgatgccaccacagtgaacattgaggatcctggtgaaacacccaagcatcagcctggatcacccaggggttccggtcgggaggaggacgacgaactgctcggtaacgatgactccgacaaaacagaactcctggctggtcagaagaagtcctccccattctggactttcgaatactaccagacattcttcgatgtggacacctatcaggtgtttgatcggattaaaggtagcctgctgcccattcctggcaaaaacttcgtgaggctgtacatcagaagcaacccagatctctacggccctttttggatctgtgccactctagtgttcgccattgcaatatccggcaacctcagcaactttctcattcacctcggggaaaaaacatatcattatgtgcctgagtttaggaaggtgtcgatcgcagccacaattatttatgcttatgcctggctggtgcctctggcactctggggctttctgatgtggcgaaatagcaaagtcatgaatatcgttagctacagcttcctggagattgtgtgtgtctacggatacagtctgttcatctacattccaaccgctattctgtggatcattcctcagaaagcagtgcgctggatcctggtaatgattgcattgggtattagcggatccctgttagccatgacattctggccagcagtgcgcgaggacaaccgccgggtcgctctggccacaattgtcaccatagtgctccttcacatgcttctcagcgtggggtgtctcgcgtacttctttgacgccccagagatggatcaccttccaaccaccacggctacccccaaccagaccgtcgcggccgcgaagtcctcgtag

SEQ ID NO: 47972 - DNA, 372 bp, Artificial Sequence
  Description of Artificial Sequence: Synthetic coding sequence
atgtggcggaacagcaaggtgatgaacatcgtgagctacagcttccttgaaatcgtatgtgtgtatggatatagtctcttcatctacattcccaccgctattctgtggatcatccctcagaaagccgttcgttggattcttgtgatgattgcgctggggatatccggtagcctgctcgcaatgactttctggcctgccgttagagaggacaataggagagtggcactcgcaacgattgtcacaatcgtactgttgcatatgctcttgtcggtgggctgccttgcctacttcttcgatgcccctgaaatggaccatctgccaacgacaacagcaactcctaatcaaaccgtggctgcggccaaaagcagctag

SEQ ID NO: 47973 - DNA, 654 bp, Artificial Sequence
  Description of Artificial Sequence: Synthetic coding sequence
atggccgccgtggacgacctgcagttcgaggagttcggcaacgccgccacctctctgaccgctaaccctgacgccaccaccgtgaatattgaggatcccggtgagacacctaaacatcaaccgggcagtcctagaggctctggtagagaggaagacgacgagctcctaggaaacgatgatagcgataagacagaactgctggcgggtcagaaaaaatccagccccttttggactttcgagtactaccagactttcttcgacgtggatacctatcaggtgttcgaccgtatcaaggggagcctgctgcccatccccggcaaaaacttcgtacgcttatatattagaagtaacccagacttgtacgggccgttttggatatgcgccactctggtgtttgcaatcgctatctcaggcaacctgtcaaactttctgattcacctcggcgaaaagacttatcactacgttcccgaatttcgtaaagtgagtatcgcggccacaatcatatacgcatacgcctggctagtgccgctcgccctttggggatttctgatgtggagaaattccaaggtaatgaatatcgtgtcttattccttcctggagatcgtgtgtgtgtacggttacagtctgttcatttatatcccaacagccgtttag

SEQ ID NO: 47974 - DNA, 921 bp, Artificial Sequence
  Description of Artificial Sequence: Synthetic coding sequence
atggccgccgtggacgacctgcagttcgaggagttcggcaacgccgctacctccctgacggccaacccagacgctacgactgtgaatatcgaagaccctggtgagacacccaagcatcagcccggatcccctagggggagcggccgtgaagaggacgatgaattgctaggtaacgacgacagcgacaaaacagaactgctcgccgggcagaaaaagtcttctccattttggactttcgagtactatcagactttctttgacgtggatacttatcaggtattcgacagaataaagggtagcttgttgcccattcccggcaagaactttgttcggttatatatcaggagcaatcctgacctatacggtccattctggatctgtgccaccctagttttcgcgatcgctataagcggtaatctcagcaatttccttattcatttaggtgagaagacctatcattacgtcccagaattccggaaagtctcaattgcagccactattatttatgcttatgcttggttggtcccactggctctctggggtttcctcatgtggagaaactctaaagtaatgaatatagtgtcgtactctttccttgagatcgtgtgcgtatacggatactctttgtttatctatatccctaccgcaatactgtggatcatcccacagaaagcagtcaggtggatcttagtcatgatcgcgctcggcattagtggaagcttgctggccatgacattttggccggctgtgagggaggataatcgcagagttgccttagccacaatagtaacaatcgtactcctccacatgctgctgtccgttgggtgtctggcttactttttcgacgctcctgaaatggatcacctacccacaactactgccacgccaaatcagaccgtggctgcagccaagtctagctag

SEQ ID NO: 47975 - DNA, 996 bp, Artificial Sequence
  Description of Artificial Sequence: Synthetic coding sequence
atgagcggcggcgagatcagcagccggaccctgcagatcttcttcctgatcattggcagaagacttacgggtcgcatggcagcagtggacgatctgcagttcgaagagttcgggaatgctgctacttcccttaccgctaaccctgatgctacaaccgtaaatatcgaagatccgggtgaaacgccaaagcaccagccaggttctcctagggggtcaggccgagaagaggatgatgaacttctcggtaatgatgactctgacaagactgagcttctagcaggacaaaaaaagagctcccctttttggacatttgaatattaccagacattcttcgacgtggatacttaccaggttttcgaccgcataaagggaagtctgctgcctattcccggcaaaaacttcgtacgactctacatcagatctaaccccgatctgtacggaccattttggatctgcgcaactttagtctttgctattgcaatctccggaaacctctccaactttctaatccatcttggagaaaagacctaccattacgtgcctgagttcaggaaggtcagtattgctgcaacaattatctatgcctacgcttggcttgtacctctggcactgtggggcttccttatgtggagaaatagcaaagtgatgaacatcgtgtcgtacagcttcctggaaatcgtgtgtgtgtatggctacagcctgttcatatacattcccactgccatcttatggattatcccccagaaagctgtccgctggatcttagtgatgattgctctaggtatctcaggtagcttgcttgccatgacattttggcccgccgttcgcgaagacaaccgtcgtgtggcattagccacaatcgtgaccattgtcctgttacacatgctactcagcgtggggtgtctggcatatttctttgacgctcctgagatggatcacctgcctaccaccaccgccacaccaaatcagactgtcgctgctgcaaagtcttcctag

SEQ ID NO: 47976 - DNA, 951 bp, Artificial Sequence
  Description of Artificial Sequence: Synthetic coding sequence
atggccagcgccgacgagctgaccttccacgagttcgaggaggccacaaacctgctggccgacacaccagatgccgcaactacctctagatcagaccagctgacaccccagggccacgttgcggtagctgtaggatctggggggtcatatggtgctgaggacgaggtggaggaggagtccgataaagctgcccttcttcaggagcagcagcagcagcagcagcccggcttttggacgtttagctattaccagtcctttttcgatgttgatacctctcaggtcctggatcggattaaaggatccctgctgcctaggcctggccacaattttgtgcgccaccatctgcgcaataggcctgacctctatggccccttttggatatgtgcgacactggcattcgttctcgcagtgacgggaaacctgacactggtgctggctcagaggcgggatccctccattcactactctccccaatttcacaaggtcaccgttgcgggaatctcaatctattgctacgcttggctcgttcccctggctctgtgggggttcctgagatggaggaagggcgtccaagaaagaatgggcccttacacctttctggaaactgtgtgtatttacggatattccctgttcgttttcataccaatggtagtcttatggcttatacccgtgccttggcttcaatggctgttcggcgccttggcactaggactgtctgcggccggtctggtgtttacattgtggcccgtggtgagggaggataccaggctggtggctacagtgttgctgagtgtggttgtcctgttacacgcactgctcgccatgggttgtaagctttacttttttcagtcacttcctcccgagaacgtcgcaccccccccccagattacatccctgccgtccaacatcgccctgtcacccacccttccccaaagtctcgctccaagctag

SEQ ID NO: 47977 - DNA, 735 bp, Artificial Sequence
  Description of Artificial Sequence: Synthetic coding sequence
atgcagccccccggccccccccccgcctacgcccccaccaacggcgactttacttttgttagctccgcagatgctgaggacttgtcaggctccatcgcctccccggatgttaagcttaacctcgggggagacttcatcaaggagagtactgctacaaccttcctccgccagcgcggatacgggtggttgctggaggtcgaggatgacgaccctgaggacaataagccactgttggaggagttggacattgacctcaaagatatttattacaaaattcggtgtgtcctgatgcctatgccatctttgggctttaatcggcaggtagtacgcgataatccagacttttggggcccgctcgccgtggtactcttttttagcatgatctctctgtatggacagttccgagtggtttcttggataattaccatatggatattcggatccctgactatcttcctgctcgctcgggtgctaggcggcgaggtggcttatggacaggtgctgggggtgatcggttacagtctactcccactgattgtcatcgctccagtgcttctggtcgtgggttcattcgaggttgtgagcactctgattaaactcttcggtgtgttttgggcagcatactcagccgccagtctgctggtcggcgaagagttcaaaacaaagaaaccacttctgatctacccgatttttcttctctatatatactttctcagtctctatactggtgtctag

SEQ ID NO: 47978 - DNA, 582 bp, Artificial Sequence
  Description of Artificial Sequence: Synthetic coding sequence
atggccgaggccgaggagagccccggcgaccccggcaccgccagcccccggcctctgatgagagaccttaaggcggtggggaaaaagtttatgcacgtgctatatcctcggaagtcaaataccctcttgcgcgactgggatttatggggcccgctcattctgtgtgtcacactggctctgatgctgcagagggactctgccgatagcgagaaggacggcggtcctcaattcgccgaggtctttgtcatcgtgtggtttggtgccgtgactattaccctgaactccaagctcctgggcgggaatatatcctttttccagagtttatgcgtcctaggatactgcatcttgcccctaaccgtggcgatgctgatttgccggctggtgctactggccgatcccggtcccgtgaatttcatggtgcgtctctttgtggtcatagtcatgttcgcctggtccattgtggcctctactgcctttctggcggactcccagcctcccaaccggcgggcactggccgtgtacccggttttcttgttctactttgtaatttcctggatgatccttacgttcactccacagtag

SEQ ID NO: 47979 - DNA, 567 bp, Artificial Sequence
  Description of Artificial Sequence: Synthetic coding sequence
atggccgaggccgaggagagccccggcgaccccggcaccgccagccccaggcctttgatgagagatctcaaggcggtgggcaagaagtttatgcatgtgctgtaccctagaaaatcgaacacactcctgagagattgggatttatggggcccactgatattgtgcgtaactcttgcactgatgttgcaacgagactccgctgattcagaaaaagacggtgggccgcaattcgctgaagtgtttgtgatcgtatggttcggcgccgtgaccattaccctgaatagcaagctgcttgggggaaatatatccttctttcagagcctgtgcgtcttaggttactgtattctcccgctaacagtagctatgctgatttgtaggctagtcctccttgccgatccaggacccgtgaacttcatggtcagactgtttgtggtgatcgtcatgttcgcttggagtattgttgcatccacagccttcctggctgactctcagccaccgaaccgaagggctctggctgtgtaccctgtttttctattctatttcgtaatttcctggatgattctttag

SEQ ID NO: 47980 - DNA, 711 bp, Artificial Sequence
  Description of Artificial Sequence: Synthetic coding sequence
atggccgaggccgaggagagccccggcgaccccggcaccgccagccctaggcccctgtttgctggtctaagtgatattagcatcagccaagatatccccgtggagggggagataactattccaatgcgtagcaggatccgagagttcgattcttccacgctaaatgaatctgtgcgtaacacaatcatgcgtgatctgaaggcagtgggcaagaagtttatgcatgtcctgtaccctcggaagtccaatacgcttcttagggactgggatctgtggggccccctcatcctgtgcgtgactctggcactcatgctgcagagggacagtgccgactcagaaaaggacgggggcccacaatttgccgaggtcttcgtaatcgtatggttcggggccgtgactatcacccttaacagcaagttgctgggcggcaatatttcgttcttccagtcattatgtgtcctcggttattgcatcctccctctgacagtcgcaatgttgatctgtagactggtgctcctcgcggatcccggccccgtgaattttatggtgcgtcttttcgttgtgattgtgatgtttgcctggtcgatcgttgccagtaccgcattcctggcagacagccaaccacccaatcggagagccttggccgtgtacccagtgttcctgttttacttcgtgataagctggatgatattaacgttcacgccccagtag

SEQ ID NO: 47981 - DNA, 843 bp, Artificial Sequence
  Description of Artificial Sequence: Synthetic coding sequence
atggacctgctgaagatcagccacaccaagctgcacctgctggaggatctgtcaatcaagaataagcagaggatgtccaacctggctcagtttgactctgacttctatcagtccaacttcacaatcgacaatcaggagcagagcgggaatgatagcaatgcttacggtaatctatacgggtcaaggaaacagcaggcaggggaacagcctcaacccgcctccttcgtcccctctgaaatgctcatgagcagtggatatgctgggcagtttttccagccagccagtaatagcgactactactctcagtccccttacatagatagttttgacgaagagccgcccctactcgaagagttggggatacactttgaccacatctggcaaaaaaccttaacagttttaaatccaatgaagcccgtggatggcagcatcatgaatgagaccgacctgaccggtccaatcctcttttgcgtcgcactcggcgcgacactgctgttagcagggaaagtccagtttgggtacgtctacggaatgtcagcgatcggttgtctcgtcatccacgcacttctcaatctcatgtctagctccggagtaagctatggttgcgtagcctccgtcttaggttattgcctgctaccgatggttatcctctccgggtgtgctatgtttttctccctgcaaggaatattcggaatcatgtcatcgctggtcatcatcggctggtgttccctgtccgctagcaaaatatttattgctgccttgcacatggagggccaacagctgcttgtggcgtacccctgcgctatcctctatggcttatttgccttattgacgattttctag

SEQ ID NO: 47982 - DNA, 774 bp, Artificial Sequence
  Description of Artificial Sequence: Synthetic coding sequence
tgaatgagcaacctggcccagttcgacagcgacttctaccagagcaacttcacgatagacaaccaggaacagtccggcaacgacagtaacgcctacggcaatctgtatggatctcggaaacaacaagccggggaacagcctcagcccgcttccttcgtaccatccgaaatgctgatgtcttctggttatgctggccagtttttccaacccgctagcaattcagattattactctcagagcccctacatcgactcctttgatgaagagccacctctcttagaggagctcggcatccacttcgaccacatctggcagaagaccttaacggtactcaacccaatgaaacctgtggacgggtcaattatgaatgaaaccgacctcacaggccccattcttttctgtgtcgcactgggggcaaccttattgctcgccggcaaagtccagttcggctatgtgtacgggatgtctgcaatcggctgtctggttattcacgccttactgaacctcatgtcttctagtggtgtaagttacggatgcgtggcttcagtgctgggttactgtcttctccctatggtgatactttccggttgcgccatgttcttctctctgcagggtatctttggcatcatgtccagcttagtgataatcggttggtgcagcctcagcgcttcaaagatctttatcgcagctctgcatatggaagggcagcaactgttggtcgcttatccttgtgccatcttgtacgggctgtttgcactgctgactattttttag

SEQ ID NO: 47983 - DNA, 900 bp, Artificial Sequence
  Description of Artificial Sequence: Synthetic coding sequence
atgcccggcagcgccagcaagcggcggatccccgtgagccagcccggtatggcagatccacaccaactgttcgatgacaccagcagcgcccagtccaggggttatggcgcccagagagcccccggcgggttgtcatatcccgctgcaagtcccacaccccatgccgcatttctcgccgatccggtatccaacatggcaatggcgtatgggtcatcgctggctgcccaggggaaagagcttgttgataaaaatattgaccggttcattccaattactaaactcaagtattatttcgctgtggacaccatgtacgtgggcaggaagctcggcctccttttttttccctacctccaccaagactgggaggtgcagtatcagcaagatactccagtggctccccgatttgatgtcaatgccccagacctctacatcccagccatggcctttatcacctatgtactcgtggcaggcctggccctgggcacccaagatcgttttagtcctgatctgttaggactgcaggcgtcgtcagcgctggcctggctaacgctggaggtgcttgctattcttctgtcactctatctagtgaccgtgaataccgatctaacgactatcgaccttgttgcctttctgggatacaaatacgtaggcatgatcggcggtgtattaatggggctgctgtttggcaagataggatactacttggtgctgggatggtgctgtgttgcaatttttgtgttcatgatccggactctgcggctgaaaatcctggcggatgccgctgctgagggggtcccagtcagaggtgctcggaaccagctccgaatgtacctgacaatggctgtcgccgcagctcagccaatgcttatgtactggctcaccttccatttggttcgatag

SEQ ID NO: 47984 - DNA, 876 bp, Artificial Sequence
  Description of Artificial Sequence: Synthetic coding sequence
atgcaccccgccggcctggccgccgccgccgccggcaccccccggttgccatccaagcgacgaattcccgtaagtcagcccggcatggccgaccctcaccaattattcgacgacacgtcatccgcccagtcccgtggctacggcgcccagagagcgcccgggggcctcagttatcccgcggcctcccccactccacacgcagcctttctggccgatcctgtgagcaacatggcaatggcatatgggagcagtctggctgctcagggtaaggagctcgtggataagaacattgaccggtttatcccgatcactaagctcaagtactacttcgctgtggatacgatgtacgtgggcagaaagctgggcttgttgttcttcccgtatctgcaccaggactgggaagtccagtaccagcaggacacaccagtggcacctaggtttgatgttaacgcacctgatctgtacattcctgccatggcgttcatcacatatgtgttggtggctggactggctcttggtactcaggatcgattctctccggatcttctcggattgcaggcgtcaagtgccctcgcctggctgactctggaggttctcgcgattctgctatctctttatctggtgaccgtcaacacggatttaaccacaatagacctggtggccttcctcggctataagtatgtggggatgataggtggcgttttgatgggactgttgttcggcaagatcggatactatctggtcctcgggtggtgctgcgtggccatctttgtcttcatgtttcctctcttaccaggcgccgtcgctcatgcctgcaaccctagcactctgggaggcagaggcggccggattacacgatcaggcagatgcgggtag

SEQ ID NO: 47985 - DNA, 945 bp, Artificial Sequence
  Description of Artificial Sequence: Synthetic coding sequence
atgcaccccgccggcctggccgccgccgccgccggcaccccccggctgcggaagtggccaagcaagaggagaatccctgtgtcccagcccggcatggcggatccacaccaactctttgacgatacttcatccgcccagagtcgcggatacggagctcagcgcgcacccgggggcttatcatatcccgcagcatcacctacaccccacgcagcttttctcgctgatccagtgagcaatatggccatggcctacgggagctctttggctgcgcagggaaaagagctggtggacaagaacattgatcgatttattcccatcacaaaacttaaatattacttcgctgtcgataccatgtacgtgggccgaaagcttgggcttctcttcttcccttacctgcatcaggattgggaagtccagtatcagcaggacacacccgttgcccctagatttgacgtaaatgccccagacctttacattccagccatggctttcatcacctatgtgctggtagccgggctggctttgggaacccaagaccgtttttcccccgacctgctgggcctacaagcttcctctgccctggcatggctgacacttgaagtgcttgccattctgctgtcgctttatttggtgacagtgaacacagacctgaccaccattgacctcgtggctttcttaggctataaatatgtagggatgatcggaggagtcttgatggggctgctttttggcaaaattgggtactatctcgtcctgggctggtgctgcgtagccattttcgtgttcatgattaggactctccgtctgaaaatccttgccgatgccgcagctgagggggtgccagtgcggggcgcgcgaaaccaattgagaatgtatcttaccatggccgtggctgcggcacagccaatgcttatgtactggctgactttccaccttgtgcgttag

SEQ ID NO: 47986 - DNA, 852 bp, Artificial Sequence
  Description of Artificial Sequence: Synthetic coding sequence
atggccgacccccaccagctgttcgacgacaccagcagcgcccagtctagaggatacggcgcccaaagggcacctggcggcctgagctaccccgccgcctctccgacaccacacgcagccttcttggcagaccccgttagtaatatggcaatggcctacggttcgagcttagccgcacagggcaaagaactcgttgacaagaatatcgatagattcatcccaattacgaaactgaaatactacttcgccgtggatactatgtatgtggggaggaagttgggactgctgttcttcccttaccttcatcaggactgggaggtgcagtaccagcaggatactcctgttgcacctcggttcgacgtcaatgcccctgacctctatatacctgcaatggcattcatcacttatgtgttggtagccgggctagctttagggactcaggacaggttcagtcccgacctgctcgggctccaggcgtcatctgccttagcttggctgaccctagaggtactggccattctcctttctctctacctggtcaccgtgaacacggacttaacaacaattgatctcgtggcattcctggggtacaaatatgtcggcatgatcgggggggtgctgatgggactgcttttcggtaagattggctattatctcgttttggggtggtgctgtgtggcaatcttcgttttcatgattagaaccctgcggctgaagatactggccgatgccgctgccgagggggtccccgtccgcggcgctcggaaccagctaagaatgtatctgacgatggcagtcgcggccgctcagccaatgctaatgtattggttaaccttccacctcgtccgatag

SEQ ID NO: 47987 - DNA, 609 bp, Artificial Sequence
  Description of Artificial Sequence: Synthetic coding sequence
atgagcggccggagcgtgcgggccgagacccggagccgggccaaggatgatatcaaaaaagtcatggccgcgattgaaaaggttcggaaatgggagaaaaaatgggtcacagttggggatacgagcctccggatctttaaatgggtgcctgtcacagatagtaaagagaaggaaaagagcaagagtaattccagcgctgctagagagcccaatggtttcccgagcgacgcaagcgccaactctagcttactcctagaattccaagacgagaattccaatcaatctagcgtgtctgatgtttaccagctaaaggtggactcaagtaccaatagcagtccaagtccgcagcagtctgagtctctctcgccagcgcacacctctgatttcaggaccgatgattctcagcctcccacactaggtcaagagatcctcgaagagccttcgctacctagtagcgaagtcgccgacgagcctccgacactgaccaaggaagagcccgtgccacttgagactcaggtggtggaggaagaggaagacagcggcgctccacccctcaagcgtttttgcgttgaccaaccaacagtaccccagacagcctcagagtcctag

SEQ ID NO: 47988 - DNA, 495 bp, Artificial Sequence
  Description of Artificial Sequence: Synthetic coding sequence
atgaagctgtacagcctgagcgtgctgtacaagggcgaggccaaggtggtcctgttaaaagctgcctatgatgtgagctcattttccttttttcagaggagcagtgttcaagaattcatgacgttcaccagccagctgattgtggaaaggtcttccaaagggaccagggcaagtgtgaaagagcaagactatctgtgtcatgtatatgttagaaacgactcactggcaggggtcgtgatcgccgacaatgagtatcccagtagagtggccttcacgctcttagaaaaagtcctagacgagtttagtaaacaggttgacagaatcgattggcctgtgggcagccccgcgacaatccactatcccgctttagacgggcacctgagccgataccagaaccctcgtgaggcagatcctatgactaaggtacaagccgagctggatgagactaagatcattttagcccgtaagcagaatagttgctgtgcgattatgtag

SEQ ID NO: 47989 - DNA, 1119 bp, Artificial Sequence
  Description of Artificial Sequence: Synthetic coding sequence
atggccagcaacgaggacttcagcatcacccaggacctggagatcccggccgacatcgtcgaactgcatgacattaacgtcgagccactgccaatggaggacattcctacggagtctgttcagtatgaagatgtcgacggtaactggatttacggagggcataatcacccccctctcatggtgctgcagcccttattcacgaacactggctatggtgaccatgatcaagaaatgctcatgttgcagacacaagaagaggtggtgggctactgcgactcagataaccagttgggcaacgatttagaggatcagctagccctaccagactcaatcgaagatgagcattttcagatgacactggcctctctgtccgctagcgcggcttctacctcaacctccacacagagccggtcaaagaaaccgagtaagaaaccatctgggaaaagcgcaacctccacggaagcaaatccagccgggtccagctcctcattaggcacccgcaagtgggagcagaaacagatgcaggtcaaaactctggagggggagttcagcgtcacaatgtggagccctaatgataacaacgaccagggagcagtcggagaggggcaggccgagaaccccccggactatagcgagtatcttaaaggcaagaaactgccccccgggggactgcccggcatcgatctgtcagaccccaagcagctcgcggagtttaccaaggtgaaacctaaacgctccaagggcgagccccctaaaaccgtgccatgcagctattctggatgtgagaagatgttcagggactacgcagccatgaggaagcacttgcatatccacgggccccgtgttcacgtatgtgcggagtgtggcaaggccttcctcgagagtagcaagcttcgacgtcatcagctcgtgcatactggagagaagccattccagtgtacatttgagggctgcggcaaacgcttcagcctggattttaaccttcggacgcatctccggatacacacaggagacaagccgtttgtctgtcccttcgatgtctgtaacaggaagtttgcgcaatctacgaatttgaaaacccacatactaacccatgttaagaccaagaataatccctag

SEQ ID NO: 47990 - DNA, 2301 bp, Artificial Sequence
  Description of Artificial Sequence: Synthetic coding sequence
atggccagcgacacccccgagagcctgatggccctgtgcaccgacttctgtctccgaaatcttgacggcaccctcggctacctcctggataaagaaaccctcaggctgcaccccgatatcttcctgccatctgagatttgcgatagactggtcaatgagtacgtggagctcgtgaatgccgcatgtaacttcgaaccacatgaatccttttttagcctgtttagtgatccgaggagcactcggctgaccaggattcacttaagggaagatctggtacaggaccaagatttggaggcgatacgaaaacaggatctcgtagagttatatctcacaaactgcgaaaagctttctgctaagagtcttcagaccctgaggtcattcagccatacactggttagtttgtcactcttcggctgcacgaacatcttttacgaggaggagaaccccggcggctgtgaagatgaatatctagtgaatcctacttgtcaggtcctggttaaggactttaccttcgaggggtttagcagactgcgctttctaaacctaggacggatgatcgattgggtgccagttgagagcctgcttaggccgctgaacagtctcgccgctctggacctgtctggcatccaaactagcgatgccgcttttcttactcaatggaaggactcccttgtcagcctcgtgctttacaacatggacctgtctgacgaccacatccgtgtgatcgttcaactgcataagcttcgtcacttggacatatccagggataggctgtcctcatactataagtttaaactaactagagaggtgctgtctctgttcgttcagaagctgggtaaccttatgtctctggacatctccgggcacatgatcctcgagaactgtagcatcagcaaaatggaggaagaggctggtcagactagtattgagccctctaagagctccataatcccatttagagccctgaagaggcctctgcaattcctggggctgttcgaaaactcgctgtgcagactgacccacatccctgcatataaggtgagtggcgataagaacgaggagcaggtgttaaacgccattgaagcatacaccgagcaccgccccgaaatcacgtcaagggctataaacttactgttcgatatcgcacggattgagcgctgcaatcagctcctgagagctctcaagttagtgattaccgcccttaagtgccacaagtatgatcggaatatccaggtgacaggctctgctgctctgttttatctgactaactccgagtatcggagtgagcagagcgtgaagttgcgaagacaggtgatccaggttgttttaaatggcatggagtcttatcaggaggtcacagtccagagaaactgctgcttgaccctctgcaacttttcaattcctgaggagctggagttccaatacagacgagttaatgagctcctcctatccatcctgaatcctacccgccaggatgagagtatacagaggattgccgtgcatttatgtaacgcactcgtgtgccaggttgacaacgaccataaggaagccgtgggtaaaatgggattcgtcgtgacaatgctgaagcttatccagaagaagcttctggacaaaacatgtgaccaggtgatggagttcagctggagtgctctctggaacattaccgacgaaacgccagacaactgtgaaatgttcctgaactttaacgggatgaaactctttctggactgccttaaggagtttccagaaaagcaggagctgcacagaaacatgctggggctgctcggcaacgtcgccgaggtaaaggagttaaggcctcagttgatgaccagtcagtttatttcagttttctctaatctgttggaatcaaaagctgacgggattgaagtcagctacaatgcatgtggcgtactgagccacatcatgttcgatggaccggaagcctggggagtatgtgaaccacagcgtgaagaagtcgaggagaggatgtgggcggctatccagtcttgggatattaacagtcgtcggaacatcaattatcgaagtttcgagcccattctgagactgctgccccaaggaataagcccagtttcccagcattgggctacatgggctctttacaaccttgtgagcgtgtaccccgataagtactgccccctgctgatcaaggaaggggggatgccccttctcagggatattattaagatggccacagcaaggcaggaaaccaaagagatggcaagaaaggttattgagcattgcagcaatttcaaggaggagaacatggatacctctcgttag

SEQ ID NO: 47991 - DNA, 498 bp, Artificial Sequence
  Description of Artificial Sequence: Synthetic coding sequence
atggccagcgacacccccgagagcctgatggccctgtgcaccgacttctgcttaagaaacttggacggaacactgggctacctacttgataaagagacactgagattacatccagacatctttcttccatctgaaatctgtgaccgactggttaatgaatatgtcgagctggtcaatgcggcttgtaactttgagccacatgagtctttcttctcgctgttttccgatcctcgatccactagacttacaaggatccatcttcgcgaggatcttgtgcaggaccaggaccttgaggcgatccgtaagcaggatctggtagaactataccttactaactgcgagaagctcagcgctaaatctctccagactctgcgctctttctcccataccctcgtgagcttatccctattcggctgtacgaacatattttacgaggaagaaaaccctgggggatgtgaggacgagtacctggtgaaccccacctgccaggtgctttag

SEQ ID NO: 47992 - DNA, 306 bp, Artificial Sequence
  Description of Artificial Sequence: Synthetic coding sequence
atggccagcgacacccccgagagcctgatggccctgtgcaccgacttttgcctgcgtaacttggacggaacactcggttacctgctcgacaaagagacattaaggttgcaccccgatatctttctgccatccgagatttgcgataggctggtaaacgagtatgtcgaactagtgaacgccgcctgtaactttgaaccacatgagagctttttctctctgttcagtgatcctaggtcgactagactgacacgaattcatctgcgcgaggacttagtgcaggatcaggacctggaagctatccgttag

SEQ ID NO: 47993 - DNA, 1239 bp, Artificial Sequence
  Description of Artificial Sequence: Synthetic coding sequence
atgatggccctgtggagcctgctgcacctgaccttcctgggcttcagtattactctgctgctggtgcacggccagggatttcagggcactgccgcgatctggccttcacttttcaatgtcaatttgtcgaagaaggtccaggagtccatccaaatccccaataacgggagtgctcccttactagtggacgtacgggttttcgtgtcaaatgtatttaatgtggatattctgaggtacacaatgtcatccatgcttttgttgagacttagttggctggacacacggttagcatggaacacctccgcccatccacggcacgccatcaccctcccatgggaatctctgtggacaccaagactcaccatcctggaagcactgtgggtggattggcgcgatcaaagccctcaggcccgggttgatcaggatggccacgtcaaactgaaccttgctctggccaccgagaccaactgtaatttcgagcttcttcactttcccagagatcattccaactgcagcttgtctttttatgccctctctaataccgcaatggagttagaatttcaggcccacgtggttaatgaaatcgttagtgtcaaacgcgagtacgttgtctacgatctgaagacacaagtccccccccagcagctcgtgccatgttttcaggtcactttacggctgaaaaatactgccctgaagtcgatcatcgccttactagttccagcagaagctttgttgctggctgacgtttgtggcggtttgcttccactgcgtgccatcgaacgtatcggctataaggtgactctgctcctgagctatctcgtcctccacagctccttggtgcaagcacttccgtcgtcttcatcatgcaatccactcctaatttattacttcactatcctgctactgctgctctttttgtctacaatcgaaacggtgctactggctggcttgctagccagaggcaacttaggggcaaagtccggacctagtcctgcccctcgcggagaacagcgagagcacggcaacccaggccctcatcctgcggaagaacctagtaggggtgtgaagggatcgcagaggtcctggccggaaactgctgaccggatttttttcctggtttacgtggtcggagtgctttgcactcagttcgtgtttgctggaatctggatgtgggcggcctgtaagtccgatgcagctcctggcgaagctgcaccgcatggccggagacccaggctttag

SEQ ID NO: 47994 - DNA, 381 bp, Artificial Sequence
  Description of Artificial Sequence: Synthetic coding sequence
atgatggccctgtggagcctgctgcacctgaccttcctgggcttctctatcacactcctcttggttcacggccagggtttccaggggaccgccgcgatctggccaagcctctttaatgtaaacctctcgaaaaaggtccaggagagcatacagatccccaacaacggttccgcccccctactggtcgatgttcgggtatttgtttctaacgttttcaacgtgagctcggtgctacctcgggccacagctttacacagtcacggcgactgtagcgggagcgccccttgttcaaaggcacgtggatccgggtgtcacgggctcactcccggtaaccatttgaaagtccaacctccatgcatcaacccttccggagacatttag

SEQ ID NO: 47995 - DNA, 3393 bp, Artificial Sequence
  Description of Artificial Sequence: Synthetic coding sequence
atgtgcaagtgctgcaacctgttcagccccaaccagagcgagctgttaagccatgtcagcgagaagcacatggaagaaggcgtcaatgtggacgaaatcataatacccctcaggcccctctccactccggagcctccaaacagcagcaagaccggagacgagtttctagtgatgaagagaaaaaggggccggcctaaggggagtactaagaaatccagcactgaagaagagttagcagagaatattgtctctcccacagaagattccccattggccccagaggaaggaaactcattacctccctcttccctcgagtgctccaagtgctgtcggaaattcagcaacacacggcagctaagaaagcacatatgcattatcgtcttgaatctcggcgaagaggagggcgaagccggtaacgagtccgacctggagctagagaaaaaatgtaaggaagatgacagagagaaagcctccaaaagacctcgcagtcagaaaactgagaaagtccagaaaattagtggaaaggaggcaaggcagctatcaggcgcaaagaaacctattatctccgtggtgttgactgctcatgaggctatcccaggagcaactaagatcgtccccgtcgaggccgggccgcctgagaccggagcaactaactcagaaactacttcagccgatctcgtgcctagacgcggctatcaggaatacgccattcagcagactccttatgaacagccaatgaagtcctcgagacttggacctacccagttaaagatcttcacctgtgaatattgcaacaaggtgtttaagtttaagcactccctgcaggcacatcttcgaatccatactaacgaaaaaccatataaatgcccccagtgcagttatgcatccgccattaaagctaacctcaatgtgcacttgagaaagcacaccggagaaaaattcgcttgtgactactgcagctttacctgtttgtctaaggggcatttgaaagttcatatagagcgcgtgcacaaaaagattaaacagcattgccgtttctgcaaaaagaaatattcggacgtgaaaaacctgatcaagcatatcagggatgcccacgacccacaggacaagaaagtcaaagaggccttagatgagctgtgcctgatgaccagagaagggaaacgccagctgctatatgattgccatatctgtgagagaaaattcaaaaatgagctggtggaggaagagtttgccttgcaaggggtgaatgctttgaaggaggaggcatgtccaggcgacactcagctcgaggaggggaggaaagagcctgaggcccccggggaaatgccagccccggctgtccacttggcctccccccaagccgaaagtacagccctacccccttgcgagctggagactaccgtcgtttcctcctcagacctgcatagccaggaagttgtatccgacgatttcttactgaagaatgacacttcttccgcggaggctcatgcagccccagagaagccaccagacatgcagcatcggagctctgtgcagactcaaggagaagtgattacactgctcctcagcaaagcccagtccgccgggtctgatcaagagtcacatggcgcacaaagccccctaggggaaggacagaatatggcggttctatccgcaggagatccagacccttctaggtgtctgagatccaacccagccgaagctagcgacctgctgccccctgtcgctgggggaggagacactatcacccatcagcctgatagttgcaaggctgctccggaacatcggagcgggatcaccgcgttcatgaaagtgttgaactccctccagaagaaacagatgaacacaagcctatgtgagcggattcgaaaggtgtacggagatctggaatgcgaatattgtggcaaactgttttggtaccaggtgcatttcgatatgcatgttcgaacccatacaagagagcatctgtactactgctctcagtgtcactattcctcaatcaccaaaaattgtctgaagcgtcatgtaatccaaaaacattctaacatcttgcttaagtgcccgactgatggctgtgattacagtacaccggacaagtacaaattacaggcgcatctgaaagttcacaccgcgttggataaacgttcttattcgtgtcccgtctgtgaaaagagctttagcgaggaccgcctgataaaaagtcacatcaaaacaaaccatccagaggtgtctatgtccaccatcagcgaggtgttgggccgaagagttcaactgaaggggctgatcggcaaacgcgctatgaaatgcccatattgcgatttctactttatgaaaaacggcagcgacctccagcgccacatttgggctcacgagggagtgaaaccgttcaaatgctcactgtgtgaatacgccactagaagtaaaagcaatttgaaagcccacatgaatcgacacagtactgaaaaaacccatctgtgcgatatgtgtgggaagaaattcaaaagtaaaggaactcttaaatcccataagctactacacaccgcagatgggaagcaatttaaatgtacggtctgtgactacaccgccgcccagaagccacagctgctgcggcacatggaacagcacgtgtcctttaagcccttccgttgcgcacattgtcattactcatgtaatataagcggctctctgaagcgccactacaatcggaaacatccaaacgaagagtatgctaatgtgggtacaggtgaattagccgccgaagtcctcatccagcagggcggcttgaaatgtcccgtgtgtagtttcgtgtacgggacaaagtgggagttcaaccggcatctgaaaaataagcatgggctgaaggttgtggaaattgacggcgatcccaaatgggaaacggcaaccgaggcgccagaggagccaagtactcagtacctccatataactgaggcggaggaggacgtgcaggggacacaggcagctgttgcagcccttcaggacctgagatatactagcgaaagcggggacaggttagatccgaccgccgtgaatatcctacagcagataatcgagctaggcgcggaaacccacgacgctaccgcactcgcaagcgttgtggccatggcaccagggactgttacagtggttaaacaagtgacagaggaagagcctagcagcaaccacacagtgatgatccaggaaaccgtgcaacaggcatccgtggaactggccgagcagcaccatctagttgtgtcttccgacgatgtagagggcatcgaaaccgtgactgtgtatacacaaggcggcgaagcttcagaatttatagtgtacgtgcaagaggccatgcaaccagtagaggaacaagctgtggaacagcccgcccaggagctctag

SEQ ID NO: 47996 - DNA, 3132 bp, Artificial Sequence
  Description of Artificial Sequence: Synthetic coding sequence
atggccatggccctggagctgcaggcccaggccagcccccagcccgaacctgaagagcttctgattgtcaaactggaggaagactcatggggatctgagagtaagctgtgggagaaagaccggggaagcgtgagtggtcccgaggccagcagacagaggttccgccagttccaataccgggacgctgcaggcccacacgaagctttcagtcagctctgggctctctgttgtcgatggctccgccctgagatccgtcttaaggaacagatactagagttgctggttcttgagcaatttttgacaatcctgcccagagaagttcagacatgggtgcaggcgagacacccagaaagcggagaggaagccgtggccctggtagaagactggcaccgggagacgaggacggccgggcagagcggtctagaactgcataccgaggaaacacggccactcaagaccggtgaagaagcccagtcctttcagcttcagcctgtagatccatggccagaggggcagtctcagaagaagggcgtcaagaatacatgtcccgacctccctaaccacctcaacgctgaagttgccccacagccccttaaggaatctgctgtgcttactccacgcgtgccaacactacccaaaatgggctccgtcggcgattgggaagtaactgctgaatcgcaagaggctttgggtcccgggaagcacgccgaaaaggaactgtgtaaagacccacctggggatgattgtggaaactctgtgtgtctcggagtaccggtgagcaaacctagcaatactagcgaaaaggagcaaggcccggagttttggggcctatctttgatcaactctggcaaaaggagtacagcagactattctctcgataacgagccagctcaagccctgacgtggcgggactcgcgtgcttgggaggagcagtatcagtgggacgttgaggatatgaaggtttctggagttcattgggggtacgaggagacaaagacctttcttgccatactgtcagaatccccgttcagtgaaaaactgaggacatgtcatcagaatagacaggtctacagggcaatagcagaacagctccgagcacgaggtttcttaaggactctcgaacagtgccgctatagagtgaaaaacctgttacgcaattatcggaaagccaagtccagccatccacctggcacctgccctttttacgaggaactcgaggcactggtccgcgctaggactgctattcgtgcgacggatgggcccggagaagccgtggctcttcctagactcggatattctgacgctgaaatggatgagcaagaggaaggcgggtgggatccggaggagatggcggaagattgcaatggtgctggcctggtgaatgtggagagcacgcagggacccaggatcgctggggcccccgctctgtttcaatcacgaattgcaggggtccattggggttacgaggagaccaaagcattcctggctatcctgtcagagtcccccttttcagaaaagttgaggacttgtcaccagaatagtcaggtgtatagggccattgccgaaaggttatgtgcactgggtttcctgcgtacactcgaacaatgccgctataggttcaagaatctgcttaggagctatcgtaaagcaaaatcttcccatccccctggcacatgtccattctacgaggaacttgacagcctcatgagggccagagcggccgtgcgggctatgggtacagttagagaagccgccgggctgccacggtgcggccaatcctccgcagagacggacgcacaagaggcctggggggaggtggctaatgaggatgctgttaagcctagtacactgtgtccgaaggccccagatatggggttcgaaatgaggcatgaagatgaagatcagatctccgagcaggatatttttgaaggactgccaggggccctgtctaagtgcccgactgaagccgtgtgccagcctctggattggggggaggactctgagaatgaaaacgaggacgaaggccagtggggcaatcctagtcaagagcagtggcaagagtccagctccgaagaagatttagagaaattgattgaccaccagggcctctacctggcagagaagccttataaatgcgacacctgtatgaagtcattctcaagatcttctcactttatcgcacatcaaagaattcacactggggagaaaccctataagtgcctcgaatgtgggaagaattttagcgataggtctaatctgaacacgcatcagcggatacacacgggggagaagccctacaaatgccttgaatgcgggaagtctttttccgatcactctaacctgattacgcaccagcgaattcacactggagagaagccttacaaatgtggtgaatgctggaagtcgtttaatcagtcttccaacctgctgaagcaccagaggatccacctgggtggcaaccccgatcagtgcagcgagccggggggcaacttcgcccaatctccgagcttttcggcccactggcggaacagcacagaggaaactgcccctgaacaacctcaatctattagtaaggacctaaactctccgggacctcactctaccaatagcggagagaagttatacgagtgtagcgagtgtggtcggtctttctctaagagcagcgccctcattagccaccagagaatccatacaggtgaaaagccttatgaatgtgcggagtgcggcaagtccttctcgaagtcaagtactttggctaaccaccaaagaacccacactggcgaaaagccttataagtgcgttgattgcggtaaatgcttctccgagaggtccaagctcataacgcaccagcgggtgcacacaggagaaaaaccctacaagtgcctggagtgtggaaagttcttccgcgaccgaagcaacctaattacacaccaacggatccataccggcgagaagccctacaagtgcagagagtgtggcaaatgcttcaatcaatctagttcgcttatcattcatcagagaattcacactggagagaaaccatacaagtgtactgagtgtggcaaggacttcaataactcatcccatttctcagctcacagacggacacatgcgggcggcaaagcaagttag

SEQ ID NO: 47997 - DNA, 2934 bp, Artificial Sequence
  Description of Artificial Sequence: Synthetic coding sequence
atggccatggccctggagctgcaggcccaggccagcccccagcccgagccagaggaactgttgatcgtgaagcttgagctgctagtgttggagcaatttctcacaattctccctcgcgaggtacagacctgggtccaagcacgccaccccgaatctggcgaggaggccgttgctctggtggaggattggcacagagaaactcgaaccgccggtcaatctggtttagaactccatacagaggagactaggcctttgaagacaggagaggaggcacagtctttccaactgcagcctgtggatccttggccagaaggccagagtcagaaaaagggagtcaagaacacttgccccgatctaccaaaccatttaaacgctgaagtggcacctcagccccttaaggaaagcgctgttttaaccccaagagttcccaccctgccaaagatgggcagtgtgggtgattgggaagtgacagccgaaagtcaggaggccttgggccctggcaagcacgccgagaaggagctctgcaaagacccacctggcgacgattgcggaaactccgtctgcctgggcgtgcctgtgtcaaagccctctaacacttccgagaaggaacagggtcctgagttttggggtctgtcactcatcaacagcggcaaacggagcactgcagattattcacttgataacgaaccggcccaggctctcacatggagggatagcagagcgtgggaggaacagtatcaatgggacgtggaggatatgaaagtgtctggagtgcattgggggtacgaggagacgaaaaccttcctggcaatcctctcagaatccccattttctgaaaagcttagaacctgccaccagaataggcaagtctaccgtgcgattgctgagcagttgcgagccagaggttttctcaggaccttggaacaatgcagatatagagtgaaaaatctgctccgtaattatagaaaggcaaaatccagtcacccccctggaacttgtcctttctatgaagagctggaagccttagtgagagcaaggaccgcgatacgcgcaacagacggacctggagaggctgtggctctacctcggttggggtacagtgatgctgagatggatgaacaggaagaaggcggttgggatccagaggaaatggcagaggactgcaatggtgctggccttgtgaacgtggagagcacccaagggccaagaatcgccggggctccagctctgtttcagagcaggattgccggggtccactggggctatgaagagactaaagcatttttggctatcctctctgagagccccttttctgagaagctgcgaacatgtcaccaaaattcacaggtctaccgcgccatcgctgaacgcctctgcgctctgggatttctacggacactcgagcagtgccgctacaggtttaaaaatttactgcgctcctatcgcaaagctaagtcatcgcatcctccaggcacgtgtcctttttacgaagaactggactcgctcatgcgtgcaagggcagctgtacgcgcaatgggaacagtcagagaagcagcagggctgccgagatgtggtcaaagcagcgcagaaacagacgctcaggaggcctggggtgaggtggcgaacgaagacgcagttaagcctagtactctgtgtccgaaggcacccgacatgggctttgagatgcgacacgaggacgaagaccagatcagcgagcaggacatctttgagggactacctggcgccctctctaagtgtccaacagaggctgtctgccagcctctggactggggggaagactctgagaacgaaaacgaggatgagggtcaatggggcaatccctcccaagagcagtggcaagaatcctcctctgaagaggacctggagaagctgatagaccatcagggactctacctggcagaaaagccctacaaatgcgatacctgtatgaagtctttctcaagaagttcgcattttattgcccaccagagaattcacactggagaaaaaccctataaatgcctcgaatgcgggaagaacttctccgatagatccaaccttaatacccatcagcggatacacactggagaaaaaccgtataaatgtctggaatgcggcaaatcgttttctgatcactccaaccttatcacccaccaaaggattcataccggcgagaaaccttacaagtgtggcgaatgctggaagtctttcaaccagagctccaatctgctgaagcaccagcgaattcacttggggggtaaccccgaccaatgcagcgagccgggaggtaacttcgcccagagcccatccttcagcgcgcactggcgaaacagtacagaagaaaccgctccggaacaaccccagtcaatatctaaggaccttaactctcccggtccacattctaccaatagcggcgagaaattatacgaatgctcagagtgtggccgtagcttcagcaaaagctccgcgctaataagccatcagagaatacatacaggggagaaaccatacgagtgtgctgagtgtggcaaaagcttcagtaagtccagcacactggcgaatcatcagagaactcatacaggggaaaaaccatataagtgtgtggattgtgggaaatgtttctccgagagaagtaaattaattacacaccagcgcgtccacacgggggaaaagccgtacaagtgcctagagtgcggcaagttttttagagaccggagcaatctaataacacaccaacgtattcatacgggggaaaaaccatacaagtgtagggaatgcggcaagtgttttaatcagtcctcaagcttgatcatccatcagaggattcatacaggagaaaagccgtacaagtgtaccgagtgtgggaaagactttaacaactcttcccacttctctgctcatcgtcgcactcacgcaggtggtaaggcgagctag

SEQ ID NO: 47998 - DNA, 1284 bp, Artificial Sequence
  Description of Artificial Sequence: Synthetic coding sequence
atggccatggccctggagctgcaggcccaggccagcccccagcccgagcccgaggaactgttgatagtgaaactggaagaggattcttggggttccgagtcaaaactttgggagaaagataggggctcagtgtcaggccctgaagccagtcggcagcggttcaggcagttccaatacagagacgcagctggtccccacgaagccttcagtcaactttgggctctgtgctgtcgatggctgaggccagagattagactgaaagaacaaatcctcgaacttctggtgttggaacaattcttgaccatcctgcccagagaggtgcagacatgggtgcaggccaggcatcctgagtcaggggaagaggctgtggccctggtggaagattggcaccgagaaacacgcacagctggacagtcagggctggagctacacacggaggaaactcggccgctaaaaaccggtgaggaagcacagagctttcagctccaacctgttgatccatggcccgagggccagtcacagaagaaaggggtgaaaaacacttgccccgacctgccgaaccacttgaacgccgaggtagctccccagcctctgaaggagagcggggttcctgtaagcaagccgtccaatacttccgaaaaagagcaaggacctgagttttggggactgtccctgattaatagtggaaaacgatcaacagctgactactccctggataacgagcccgctcaagctttgacctggcgagatagtcgggcctgggaggaacagtaccaatgggatgtagaggacatgaaggtgagcggtgtacattggggctacgaagagaccaagacatttctggcgatcctgagcgaaagtccattcagcgaaaaactgagaacctgccaccagaaccgtcaagtgtacagggccattgccgagcaattaagagctcgcggcttcctgcgtactttggaacagtgtcgttacagggtgaaaaatctcctgcgcaactaccgcaaagccaagagttcccacccgcctgggacatgtccattttatgaggagctcgaggctctagtgcgcgctagaaccgctatccgcgctaccgacggcccaggcgaggcagtagcccttcctcgccttggctacagtgatgctgaaatggacgagcaggaggaagggggatgggatcctgaagaaatggccgaggattgcaacggcgccggcctcgtgaatgttgagtccacccagggtccaaggattgctggtgcaccagctttgtttcagagtcgcatttag

SEQ ID NO: 47999 - DNA, 1302 bp, Artificial Sequence
  Description of Artificial Sequence: Synthetic coding sequence
atggccatggccctggagctgcaggcccaggccagcccccagcccgaaccagaagagctcctgattgttaaactggaggaggactcctggggtagcgagtccaagctgtgggagaaggacagggggtccgtgtctggccccgaggctagccgacagcggtttcggcagtttcagtatagagacgcggcaggaccccacgaagcgtttagccagctgtgggcattatgttgccgctggctgaggccggagatcaggttgaaagagcagattctggagctcctggtccttgagcagttcctgaccatcctcccccgggaggtgcagacttgggtgcaagccaggcacccagaatctggcgaggaggccgttgcgttggtcgaagactggcatagggaaacccgcacagccggccaatctgggcttgagctccacaccgaagagacgcggcctcttaagactggcgaggaggctcagagtttccagctgcagccggtggatccatggcccgaaggccagtcgcaaaagaagggcgttaagaatacctgcccagacctgcctaaccacctcaatgcagaggtcgctccacagcccttgaaggagagtggagtgcccgtttctaaacctagcaatacctctgagaaagaacagggtcccgaattctggggcctctcgctgatcaactcggggaagaggagcacagccgattactccctggataatgagcctgcacaggccttgacttggcgtgattctcgcgcctgggaggagcagtaccagtgggacgtggaggatatgaaagtgagcggagtccactggggatatgaggaaaccaagactttcctggccatactcagtgagtccccattttctgaaaagctcaggacctgccaccagaaccggcaagtgtacagagctatcgccgaacagctgagagccaggggctttctcagaaccctggagcaatgtcggtatcgggtgaagaacttgctccgcaattaccggaaggctaaatcttctcaccctcccggcacatgcccattttatgaagaactagaggccctcgtgagagcccggacggccatccgggcaacggacggcccaggcgaagcggttgcattgccaaggctcggatactctgacgccgagatggatgaacaggaggagggtggttgggacccagaagaaatggcggaagactgcaacggagcaggcctcgtgaacgtcgaaagcacccagggaccgaggatcgcaggtgcacccgcgctttttcagtccagaattggcaagaatatgggggtgtag

SEQ ID NO: 48000 - DNA, 2934 bp, Artificial Sequence
  Description of Artificial Sequence: Synthetic coding sequence
atggccatggccctggagctgcaggcccaggccagcccccagcccgagccagaagagctactgattgtgaaattggaactcctggttcttgagcagttcctcactatactgcccagagaagttcaaacatgggtccaggctcgccaccctgaatcgggagaagaagcagtggcactggtggaagactggcacagggaaaccaggaccgccggacagtctggtttggaactgcacactgaggagactcggccgctcaagacaggcgaggaggctcagagctttcagcttcagccggtggatccctggccagaagggcagtcacagaagaagggcgttaaaaacacctgccctgatctccccaaccacctcaacgccgaggttgctccacagccactcaaggaatctgcagtcctgaccccccgggtgccaacattgcctaagatgggaagcgtgggtgactgggaggttaccgcagagagccaggaagctctcggacccggcaaacacgccgaaaaggagctctgcaaagatcccccaggagacgactgcggcaacagcgtgtgtcttggggtgccagtgtcaaagccatcaaacacgagtgaaaaagaacagggccccgagttctggggactttccctcattaattcgggcaaacggagtaccgccgattacagtctcgacaacgaaccagctcaggctttaacctggagggactctcgcgcctgggaggaacagtaccaatgggatgtagaagatatgaaagtcagcggtgtccattggggatacgaggaaactaaaacgtttttagccattctctctgagtccccattttccgagaagttacgcacatgccatcagaatagacaggtttacagagctattgccgaacagctccgggcccggggcttcttacgcactttggaacagtgtcgctaccgggtcaaaaatttgctgagaaattatcgtaaagccaagtcctcccatccgcctggcacctgtccattctacgaggaactagaggccctggtgagagccaggaccgctatccgggccaccgacggccccggagaagcagtcgcacttccacgtctaggatactccgacgcagaaatggacgaacaggaggagggcggatgggatcccgaggagatggcagaggattgcaatggggctggcctggttaacgtggagagtacgcagggcccgcggatagctggggccccagccctatttcaaagccgaatcgcaggagttcattggggatacgaagaaactaaggccttcttggctattctctctgagagccccttttccgagaagttacgaacgtgccatcagaattctcaggtttatagggccatcgcagagaggctctgcgctctcggatttttgcgtaccctcgaacagtgccggtatcggttcaaaaaccttctgagatcttatcggaaggcaaaaagttcgcaccccccaggtacgtgccctttttatgaggaactggactcactcatgcgggcaagagctgccgtgcgagcgatggggactgttagggaggccgcaggccttcctagatgtgggcagagcagtgcagagactgatgcccaggaggcctggggggaggtggcaaacgaggatgcagtcaaaccatcaactctctgccccaaagcgccagatatgggatttgagatgagacatgaggatgaagaccagatctcagaacaggatatcttcgagggactcccaggcgccctgtcaaaatgtccgacagaagccgtgtgtcagcccttggattggggtgaggactccgaaaacgaaaacgaggatgagggacaatgggggaatcctagtcaggagcagtggcaggagagttcttccgaagaggatctggaaaaactcattgaccatcagggtctgtacctggcagagaagccatataagtgcgacacatgcatgaagtccttttcgcgctcatcgcactttattgcccaccaaaggatccacaccggggaaaagccttataagtgcctggagtgtggtaagaacttctctgaccgttctaacctgaacacccaccagcggatccacacaggggagaagccctacaaatgcctggagtgtgggaaatcattctctgatcattccaacctcattacacaccagcgaatccacaccggggagaaaccgtacaagtgcggtgaatgttggaagagcttcaaccagtctagcaacctcctgaagcaccagcgtatccatctgggaggtaaccccgatcagtgcagtgaaccaggaggaaattttgcccaatcccccagtttcagcgcccactggcgcaacagtaccgaagagaccgcccctgagcagccccagtccatcagtaaagatctgaactctccaggtcctcacagcactaattccggggaaaagctctacgagtgttcagaatgcggtcgatctttttcaaagtcatccgctctcatcagccaccagaggattcatactggtgagaagccctatgaatgcgccgagtgcggcaagagcttctccaagagttctaccttagcaaaccatcagagaacccataccggtgagaaaccatataaatgtgtggactgtggcaaatgtttttccgaacggagtaagctgatcacacatcagcgggtgcacactggcgagaaaccatacaagtgcctggagtgtggcaagttctttcgtgacaggagcaacctaatcacacatcagcgaatccacaccggcgaaaaaccttacaagtgccgcgagtgcggaaaatgctttaaccaatcttcttctcttatcatccaccagcgtatccacactggagagaagccttacaagtgtacagagtgcggaaaggattttaataatagcagccacttctctgcgcacagaagaacacatgctggcgggaaggccagctag

SEQ ID NO: 48001 - DNA, 1800 bp, Artificial Sequence
  Description of Artificial Sequence: Synthetic coding sequence
atgagcggcccctgcggcgagaagcccgtgctggaggccagccccacgatgtccctctgggagtttgaggatagccacagcaggcagggtacccccagaccggggcaggaacttgccgctgaggaagcttccgcactggaattgcagatgaaggtcgatttctttcggaagctgggctactccagcactgagatccattcggtgcttcaaaaattaggtgtgcaggccgataccaatacagtgctaggcgagctagtgaagcatgggaccgctaccgaacgagaacggcagacctcacctgacccatgcccccagctgccattagttcctagaggaggggggactccgaaagctcccaacctcgagccgccattaccagaagaggagaaggagggctccgacctaagacctgtggtcatagatggatccaatgtggccatgagccacgggaacaaagaggtattctcctgcaggggcatactgctggccgtcaattggtttttggagagaggtcacacggatatcaccgtatttgtgccatcctggcggaaggaacagccacgccctgatgttcccatcactgatcagcacatcctgcgtgagttagagaaaaagaagatcctcgtgttcaccccctctcggagagtgggtggcaagagagtggtgtgttacgacgacaggtttattgtcaaactggcttacgagtcagacggtatcgtggtgagcaatgatacttaccgggacctgcagggggagcggcaggaatggaagcggtttattgaagaacgtctgcttatgtacagttttgtgaatgataagttcatgcctccagacgatcctctgggacggcacggaccatctttggacaacttcctgagaaaaaagccccttacactggaacatcgcaagcagccctgtccctatggacgaaagtgcacgtacggcatcaagtgtagatttttccatccggagaggccaagctgtccccagaggtcagtggccgacgaattacgggccaatgcactcctatcgcccccaagggcaccttccaaagataagaatggacgccggccttctccaagttcccagtctagctccctgctgaccgaaagtgaacagtgctccctagatggaaagaaactaggggcccaggcgagtcccgggagcagacaggagggcctaactcagacctatgcccccagtggacgctctttagctccgtcgggggggagcgggtctagtttcggacccaccgactggctcccacagacactggactccttgccttatgtgtcgcaggattgcctcgactctggaatagggtctctagaaagccagatgagcgagctttggggagtgagaggaggcggcccaggggaaccgggacccccgagggcaccatacactggttattcaccttacggaagcgaattgcccgcaacagctgcattctcggcatttgggagagcgatgggcgccgggcatttttccgtgccggcggactaccctccagccccccctgccttccccccccgcgaatactggtccgaaccttatccactgcctccaccaaccagcgtgctgcaggagcccccagtgcagagtcctggtgctggacgcagtccttggggtcgcgctggaagtctagccaaagaacaagcaagcgtctacacaaagctctgcggagtgtttcctcctcacttagtggaggccgtgatgggacgttttccacagctgctggacccccagcagctggcagctgagatccttagctataagtcccagcacccgtcagagtag

SEQ ID NO: 48002 - DNA, 1800 bp, Artificial Sequence
  Description of Artificial Sequence: Synthetic coding sequence
atgagcggcccctgcggcgagaagcccgtgctggaggccagccccacaatgagcctgtgggagtttgaggattcacactcccggcaaggcacccctaggcctggacaggagctggcagccgaggaggccagtgcgctggaacttcagatgaaggtcgactttttccgtaaactggggtactcttccaccgagattcattcggtactccagaaactgggggtgcaggcggacacaaacaccgtgctgggggaacttgtaaaacacggaacggcaactgagagagaacggcaaaccagccccgacccctgcccccagctgccgctggtcccacgcggtggtgggacccccaaggcccccaacttagagccaccccttccagaggaagagaaggagggaagcgacctgaggcccgtggtgatcgatggcagcaatgtagctatgtcccacggcaacaaggaggtcttctcctgtcgtgggatactgttggctgtgaactggttcctggaacggggccataccgatatcactgtattcgtgccctcttggcgcaaggagcagcctcggcctgacgttcctatcacagaccagcatatacttcgggaattagagaagaagaaaatcctggtgtttactccgtcacggcgcgtggggggtaagcgcgttgtttgctatgatgataggttcatagtaaaacttgcctacgaatcagatggcattgttgtttccaatgacacctaccgcgacttacagggagagcgtcaagagtggaaacgttttatcgaagagcgacttctcatgtactctttcgtgaatgacaagtttatgcccccagatgatccactcgggaggcacggtccttcattagataacttcttgcggaaaaagcctctcactcttgagcaccggaaacagccatgtccgtatggaaggaagtgcacatatgggattaagtgtaggttcttccacccagagaggccaagctgccctcagcgcagtgtcgcagatgagctgcgggcgaacgccctgctcagtcctcctcgggcaccttcaaaagacaagaacgggcgccgcccatctccctcttctcaatcttccagcttgctgaccgagagtgaacaatgttccctcgacggcaagaagctcggagcacaggcctctcccggatctagacaggagggactcacgcagacttatgccccttccggtcgttctctcgcaccgtcaggaggaagcggcagcagctttggccctactgactggctgccccagacactcgactcactgccttatgtgtcccaggactgcttagattccggaatcgggtccctggagagccagatgagtgaactctggggcgtacggggaggcgggccaggagagcccgggcccccccgcgcaccctacaccggatatagcccctatggctctgagctgcctgcaactgcagccttcagcgcgttcggaagagccatgggcgcagggcatttttccgtccctgccgattaccctccggctcccccagcttttcctccccgggagtactggagcgagccctacccattacctccaccaacatctgtcctgcaggagccacccgttcagtccccaggggctggaaggtccccttggggacgcgccggcagcctagctaaggagcaggccagcgtgtacactaaactgtgcggagtgtttcctccacacttagtggaagcggtaatgggtcgctttcctcagctactggacccccagcagcttgccgccgaaatactgagttacaaaagtcaacacccttctgagtag

SEQ ID NO: 48003 - DNA, 1281 bp, Artificial Sequence
  Description of Artificial Sequence: Synthetic coding sequence
atgccccccaagaagcaggcccaggccggcggcagcaagaaggccgagcagaaaaagaaagaaaagattatcgaagacaagactttcggcctgaagaataaaaagggcgccaaacagcagaagtttatcaaggcagttacccatcaggtgaagtttgggcagcagaacccacgccaagtcgcacagtccgaagcggaaaaaaagctgaagaaagatgacaagaaaaaagaactccaggaactcaacgagctatttaagcctgtcgtcgccgctcagaagatctctaagggcgcggaccctaaatccgttgtctgtgcgtttttcaagcagggccaatgcacaaagggcgataaatgcaagttctctcatgatctcacactcgaacgaaagtgcgagaagcggagtgtgtatatcgacgcccgtgacgaagagctggagaaagacacgatggataactgggacgagaagaagcttgaggaagttgtcaataagaaacacggggaggcggagaaaaagaagcccaaaactcagatcgtgtgcaagcattttctggaggccattgaaaataacaaatatggatggttctgggtgtgccctggtgggggcgatatttgtatgtataggcatgccttgcctcctggctttgtgcttaagaaagataaaaagaaggaagagaaggaagacgaaatctcgcttgaagaccttatcgagcgggagaggagtgctctgggtcccaatgttaccaagattacactggagtctttcctggcctggaaaaagcggaagcggcaagaaaaaattgacaagctagaacaagacatggaacgcaggaaggctgacttcaaggcggggaaagccctggtgataagtggccgcgaggtgttcgagtttagacccgagctcgtcaacgatgacgatgaggaagccgacgacacacgatacacacagggtactggaggggatgaagtcgatgactcagtgtccgttaatgacattgacctgagcctgtacatacccagggacgtggatgaaaccgggattaccgtggcatccctcgagcgattctcaacctacacctctgataaggacgagaacaagctaagcgaggccagcggcggcagggccgagaatggagaacggtcggatttagaggaagacaacgaacgggagggtacggaaaatggagcgattgatgcagtgccagtggatgagaatctttttacaggagaggatctggacgagctggaagaggaacttaatacgctcgatttggaggagtag

SEQ ID NO: 48004 - DNA, 1179 bp, Artificial Sequence
  Description of Artificial Sequence: Synthetic coding sequence
atgccccccaagaagcaggcccaggccggcggcagcaagaaggccgaacagaagaaaaaagagaaaataatcgaggacaaaacattcggcttgaaaaataagaaaggggccaaacagcagaaattcatcaaagcggtgactcaccaggttaagttcggccagcagaatcctagacaggtggcccagtcagaggctgaaaaaaagctgaaaaaagacgacaagaagaaagagctgcaggaactgaacgagctgttcaaacccgttgtagcagcccaaaaaatttccaagggtgccgaccccaagagcgtggtttgtgcgtttttcaagcagggacagtgtaccaagggagacaagtgcaaattctcccatgacctaacacttgagcgcaaatgcgaaaaaaggtcagtgtatattgatgctcgggacgaagagctggagaaggatactatggacaattgggacgaaaagaaactggaggaggtggtcaacaagaagcacggagaggccgagaaaaagaagcctaaaactcagatcgtgtgtaagcacttcttggaagcaatcgagaataacaagtacggatggttctgggtatgtcccggcggaggcgatatttgtatgtacagacatgccctgccccctgggtttgtgctgaagaaggataaaaaaaaagaagagaaggaggacgagatctcactggaagatctgatcgagagagagcggagcgcgctcggtcccaacgtaaccaaaatcacgctggagagtttccttgcttggaagaaaagaaaaaggcaggaaaaaatcgataaacttgagcaggacatggagcggcgcaaggcagacttcaaggctgggaaagccctggtgatctctggcagggaagtgttcgaattccgtcctgagttggttaacgatgacgacgaggaggctgatgatactcgatacacccagggaactgggggagacgaggtggatgatagtgttagtgttaacgatattgatctcagcctgtacatccctcgcgatgtagatgaaaccggaatcaccgtggcctcactggagagattctccacttatacatcagacaaggacgaaaataaattgtctgaggcttccggcggccgtgctgagaacggggagagaagcgacctagaagaggacaatgagagacatgtgctctag

SEQ ID NO: 48005 - DNA, 489 bp, Artificial Sequence
  Description of Artificial Sequence: Synthetic coding sequence
atgtaccggcacgccctgccccccggcttcgtgctgaagaaggacaagaagaaagaagaaaaagaggacgagatttctttggaagacctgattgaacgggagcgttctgctctggggcccaacgtgacgaagatcaccctcgaaagttttctggcatggaaaaaacggaaaagacaggaaaaaattgataaactcgaacaggatatggaacgccgtaaggccgactttaaggccgggaaggctctggtaataagcggtagggaagtttttgaattccgacccgagctagttaacgatgatgacgaggaggccgacgatacgcggtatacccaaggaaccggaggggatgaggtgaggggatcattcgtgcctcatctgctcatgcttattgagcgcaataatcggaaataccacaatatggtaaagagccaccagcaccaatctcactcagcatgggtccaaattttgacccctaccatgggaaactag

SEQ ID NO: 48006 - DNA, 1269 bp, Artificial Sequence
  Description of Artificial Sequence: Synthetic coding sequence
atgttccagaccgcctggcggcaggagcccgtgaccttcgaggacgttgccgtgtatttcactcaaaacgaatgggccagcttggattccgtacagcgggctttgtaccgggaagtcatgttggaaaactatgctaatgtcgcctccttggccttccctttcactactccagtactcgtttcgcaactagagcagggggagttaccgtgggggctggacccgtgggagcccatggggcgtgaggccctgaggggaatttgccccggagatgaggcccgcacggaaaaggaagggctgacccccaaggatcacgtgtccaaggaaacagaatcctttaggctgatggttggaggactgccgggcaatgtgagtcagcatttagatttcggaagcagcttggagcaacctcaagggcactggattattaaaacaaaatcaaagcgccgtcatttcactgacacctctgcccgccaccatgaggcttacgaagtaaagaacggcgagaaattcgagaaacttggcaaaaatataagcgtgagcacacaactcaccactaatcagactaaccccagcggacaaatttcatacgagtgtggccaatgcggtcgctatttcatccagatggctgactttcacaggcatgaaaagtgccacaccggtgagaagtctttcgaatgtaaggagtgtggaaaatattttagatataacagtctgttgattcgccaccagattatacacaccgggaaaaagcctttcaagtgcaaagagtgcggaaaagggctctctagtgacactgccttgattcaacatcagaggatccatactggcgagaaaccatatgaatgtaaagagtgtggcaaagcattttcctcttccagtgtgttcttacaacaccagcgattccacaccggggagaaattgtatgaatgcaacgagtgctggaagacattcagttgctcctccagtttcaccgtccaccaaagaatgcacaccggggagaaaccctatgagtgtaaagagtgcggcaagcgcctaagcagcaacacagctttgacacagcatcagaggatccacacaggagagaagccctttgaatgcaaggagtgtggtaaggcctttaaccagaaaataactctgatacagcaccagcgcgtacatactggcgagaagccttatgaatgcaaggtttgcggaaaaacattttcatggtgtggtcggttcattttgcatcagaaattgcacacccagaagacacccgtccaggcctag

SEQ ID NO: 48007 - DNA, 354 bp, Artificial Sequence
  Description of Artificial Sequence: Synthetic coding sequence
atgttccagaccgcctggcggcaggagcccgtgaccttcgaggacgtcgcagtctatttcacacagaacgaatgggcgagcctggattccgtgcagagggcgctctaccgcgaagtgatgcttgagaactacgcgaacgtggctagcctagccttcccctttacaacacccgtgctggtatcccagctcgagcagggagaattaccgtggggactggatccttgggaacctatggggagggaagcccttaggggtatctgtccgggcgatgaagccaggaccgaaaaggaggggttgacccccaaggatcacgttagcaaggaaaccgagtccttccgcctgatggtaggatag

SEQ ID NO: 48008 - DNA, 933 bp, Artificial Sequence
  Description of Artificial Sequence: Synthetic coding sequence
atgggcctgtgcaagtgccccaagcggaaggtgaccaacctgttctgcttcgagcaccgcgtcaacgtatgcgaacattgcctggttgccaaccacgccaaatgtatcgtgcagtcgtaccttcaatggctgcaggattctgactataatccaaactgccgactgtgtaatatccctctggccagtagagaaacgacacgcctggtgtgttatgacctcttccattgggcctgcctgaatgagcgcgctgcccagctaccccgcaacaccgcgcccgcaggatatcaatgcccttcctgtaatggtcccattttcccgcccacaaacctggcaggtcctgtggcctctgcccttcgcgaaaaactagcaactgtgaactgggccagagcaggcctgggccttccacttatcgacgaagtcgtgagtcccgaacctgagcccctcaatacatcagatttttcagattggtcaagcttcaatgcatcttccacccctggtccggaggaggtggactctgctagcgcagcccctgcattctactctcaagcaccacgacccccagctagcccaggaagacctgagcagcacacagtgattcatatgggaaaccctgaacccctgactcacgctcccaggaaggtgtatgatacgcgggacgatgatagaaccccgggcttgcatggagattgcgacgatgacaagtacaggaggcgaccggctttgggctggcttgccaggctgctgaggagccgggccgggagccgcaagcggcctcttacacttctgcaacgtgctggactgctcctcctgctgggtcttttgggtttcttggcacttctggctctgatgtcccggttggggcgcgctgctgcggactcagacccaaatctggatccgctgatgaacccccatatcagggttggcccctcctag

SEQ ID NO: 48009 - DNA, 567 bp, Artificial Sequence
  Description of Artificial Sequence: Synthetic coding sequence
atgggcctgtgcaagtgccccaagcggaaggtgaccaacctgttctgcttcgagcatagagtcaacgtttgtgaacattgtttagtggccaaccatgccaagtgcatcgtgcagagctatctgcagtggctccaagactccgattacaaccccaattgccgcctttgcaatattcccctggcctcgcgagagacaaccaggctggtctgctacgacctgtttcattgggcctgcttgaatgagcgcgccgcacaactgcctagaaacacagctccagcggggtatcagtgcccttcgtgcaatggcccgattttcccaccaacaaatcttgccggccctgtcgcctcagccctgagagaaaagctggccaccgtgaattgggcccgcgccgggctggggctcccgctaattgacgaagttgtttctcctgagccagaaccactgaacacatcagattttagtgactggtctagcttcaatgcaagttccaccccgggcccagaagaggtggattccgctagtgcagcccctgctttctactcccaggctcctaggcctcctgcctag

SEQ ID NO: 48010 - DNA, 624 bp, Artificial Sequence
  Description of Artificial Sequence: Synthetic coding sequence
atgggcctgtgcaagtgccccaagcggaaggtgaccaacctgttctgtttcgaacacagagtcaatgtctgcgagcattgtctggttgccaaccacgcaaaatgtatcgtgcagagctacctgcagtggctgcaggattcagattacaaccccaactgccgcttgtgcaacatccctcttgcttcacgtgagacgactagacttgtctgctatgatctgtttcattgggcttgtttgaacgagcgcgctgctcagctgcccaggaatactgcacccgctgggtaccagtgtcccagctgtaacgggccaatattccctcccacaaatcttgcaggacccgttgccagcgctctacgggagaagttagccacagtcaactgggccagggccggactgggactgccacttattgacgaagtggtgtcccccgagcccgagccccttaataccagtgatttttctgactggagcagcttcaacgcttcctctacaccagggcctgaggaggtggactccgcctccgccgccccagccttctatagccaggccccccggcctccagctagccccggcaggccagaacagcatacagtcattcacatggggaaccccgagccactttag

SEQ ID NO: 48011 - DNA, 1458 bp, Artificial Sequence
  Description of Artificial Sequence: Synthetic coding sequence
atgtacaagatgaacatctgcaacaagcccagcaacaagaccgcccccgagaaatctgtctggaccgcgcccgctcagccatctggtccatcacccgaactgcagggccagagatcaagacgaaacggctggagttggccgccacacccccttcagatcgtggcatggctcctttatctgttttttgccgtcataggtttcggcatactggttccactgctgccgcatcactgggttccagctggatacgcctgtatgggcgcaattttcgcaggacacctggtagtgcatctgacagcagtctctatcgaccccgccgatgcaaatgtccgggacaaatcctatgccgggccactccccatctttaacaggtctcagcacgcacacgttatcgaggatctccactgtaatctgtgcaatgtagatgtttctgcccgttccaagcattgttctgcctgcaacaagtgcgtatgtggatttgaccaccactgtaagtggctgaacaactgtgttggtgaaagaaattaccgcctgttcctacactctgtcgcaagtgccctgctcggcgtgctgttgcttgtgctggtggcgacctatgtctttgttgaatttttcgtgaaccccatgagacttaggaccaaccgacactttgaagtcctgaagaatcacacagatgtctggtttgtgtttctaccggcagcaccagtcgagacacaggctccagccatcctggcactggccgccctgctcatcctcctcggactgctgagtaccgccctgttggggcatctgctgtgtttccacatctacttgatgtggcacaagctgacaacctacgagtatatcgtgcagcataggccccctcaagaggccaagggggtccatagagagttggaatcttgtccacccaaaatgcgaccgatccaggagatggagttttatatgcgtacttttcggcacatgaggcctgaaccgcccggacaggccggaccggcggctgttaatgccaaacacagtagaccagccagtccagacccgacacccgggaggcgggactgtgccggacctcctgtgcaggttgagtgggaccgtaagaagcctctgccctggagaagcccactgctgttactcgctatgtggggcccccaggctcctccctgtctgtgccggaagcgcggtcgcggggcttgcattaaatgcgaacgcttacgaccgaggatccggcggagaggtttgggaccgccagcggccgctcccgctaggcggcgtattccaaggactccggcattatgtaccccacttgcactccccgctcctaccactaggcgtagacagagcccctggacccggttccaatggcgtagacgcgcctgggccgctccgctatggccccctcggggagcaggagcagacagtcctaggtggagaggcagacgcgtgcgtccgccattttcctag

SEQ ID NO: 48012 - DNA, 1239 bp, Artificial Sequence
  Description of Artificial Sequence: Synthetic coding sequence
atggacacccggagcggcagccagtgcagcgtgacccccgaggccattcttaacaatgagaagctggttttaccaccaagaatctccagggtgaatggctggtcactgcccctccactatttccaagtggtaacttgggctgtatttgtcggattatcgtcagccacatttggaatatttattcctttccttccacacgcatggaaatacatcgcctacgtggtgactgggggcatattctcattccacctggtcgtacatttgatcgccagttgtattgaccccgcagattcaaatgtgaggctgatgaagaattattcacaaccaatgcctttgttcgataggtctaaacacgcccatgtaattcagaatcaattctgccacctttgtaaggtcacagtcaacaagaaaacgaagcactgcatcagttgtaacaagtgcgtgtctggcttcgaccaccattgtaaatggatcaacaattgtgtgggatcccgcaactattggttcttcttttctacggtagcctcagccactgccggtatgctctgtctgattgctattctgttgtatgtcctggtacaatatttggtgaatccaggtgtcctgcgcaccgaccctcggtatgaggatgtgaagaatatgaacacgtggctcctgttccttccacttttcccagttcaagtgcagactttaattgtcgtgataattgggatgttagttctgctgcttgattttctggggttagtgcaccttggtcagctgctgatatttcatatatatctaaaagccaagaaaatgacgacatttgagtacctcattaataaccgaaaagaggagtcctcaaaacatcaagccgtgcgcaaggacccttacgtccaaatggataaaggcgtgctccaacagggggccggtgccctggggagtagcgctcaaggagtcaaggctaagtcaagtcttctgattcacaagcatctgtgtcacttctgtacatctgtgaatcaggacggcgacagcacagccagggagggggacgaagacccttgtcccagtgccctgggtgccaaagcgaggaattctagattgatttgtagaaggttgtgtcagttctccacccgcgtgcaccctgacggcgggtcaatggcccaggaggctgatgacgcacctagcatctctactcttggacttcaacaggagacaacagagcctatgaagacagatagtgccgaatcagaggactag

SEQ ID NO: 48013 - DNA, 1239 bp, Artificial Sequence
  Description of Artificial Sequence: Synthetic coding sequence
atggacacccggagcggcagccagtgcagcgtgacccccgaggccatcctgaacaatgagaagctcgtgctgcccccacggatatcccgggtaaatggctggtccctgcccctgcactacttccaggtggtgacttgggcagtatttgttggactgtcatctgcaacattcggcatttttattccattcctgccgcacgcttggaaatatatcgcgtacgttgtgaccgggggcatttttagctttcatctcgtcgtgcatcttattgcatcctgcatcgacccagctgattctaatgttcgccttatgaagaattattctcagcccatgcccttgtttgaccgatctaagcatgcccacgtcatacagaaccagttttgtcacctgtgcaaggtcactgtcaacaagaagactaagcattgcataagttgtaataaatgcgttagcggctttgaccaccactgcaaatggattaacaattgcgtcggatcccgcaactactggttcttcttttctaccgttgcctctgccacagctggcatgctctgtctgattgctattctgttgtacgtgctcgtccagtatctggtaaacccaggcgtgctaaggacagaccccaggtacgaagatgtcaaaaatatgaatacctggttgctatttctccccttgttccctgttcaggtccagaccttgattgtcgttatcatcggcatgttagttctactgctggactttctgggtctcgtgcatttgggccagctgcttatctttcacatatatctcaaggccaaaaagatgaccacattcgagtatctgatcaacaacagaaaggaagagtcatccaagcatcaggcagtccgaaaggacccgtatgtgcagatggacaaaggcgtactgcagcagggggctggcgctcttggttcgagtgcccaaggtgttaaggctaagtctagtctgttgatacacaaacacctgtgccatttctgcacaagcgtgaatcaagatggagatagcactgcgcgtgaaggcgacgaggatccctgccccagcgcactgggagccaaagcgagaaactctcgtttgatatgtcgcaggctttgccagttctctacaagggttcaccccgacggaggttccatggcccaagaggctgatgacgcccccagcatatcaaccctcgggttgcaacaggagacaaccgagcccatgaaaaccgacagcgccgagtccgaagactag

SEQ ID NO: 48014 - DNA, 804 bp, Artificial Sequence
  Description of Artificial Sequence: Synthetic coding sequence
atggccccctgggccctgctgagccccggcgtgctggtgcggaccggccacaccgttctgacctggggcatcacgcttgtgcttttcctccatgatacggaactgcgtcagtgggaggagcagggtgagttattgctacccctgacctttctcctgctggtactgggttccctcttactgtacctcgcagttagcctcatggaccctggctacgtgaacgtacaacctcaaccccaggaagaactcaaggaagagcagaccgcaatggtgcctcccgccatccctctcaggcggtgtaggtactgcctggtgttacagcctctcagggcgagacactgtagagaatgcaggcgctgtgtgagaaggtatgaccaccactgcccctggatggaaaactgcgtgggggagcgcaaccatccccttttcgtagtctatctggccctccagcttgtggttttattgtggggcctgtacctcgcctggagcggactgcgcttctttcagccttgggggcagtggcttcgtagcagcgggctgctgtttgctaccttcctgctgctgtctctgttcagtttggtcgcatcccttctcctcgtttcgcacctgtatctcgttgcctcaaatacaaccacatgggagtttatcagtagtcatagaatcgcttatcttcgccagaggccatctaacccattcgatcgcggacttacacgtaatcttgcccactttttctgtggatggcccagcggatcctgggagactctgtgggctgaagaggaagaggagggtagttctcccgcggtttag

SEQ ID NO: 48015 - DNA, 648 bp, Artificial Sequence
  Description of Artificial Sequence: Synthetic coding sequence
atggccccctgggccctgctgagccccggcgtgctggtgcggaccggacatacagtccttacctgggggatcacccttgtgctgttcctgcacgacacggaactgcgccaatgggaagagcaaggggagttgctgctccccttaacctttctgttactggtgttagggtccctgctactgtacctagccgtctctctgatggaccccggatatgttaacgtccagccacagccccaggaagagctcaaagaagaacaaaccgccatggtacctcccgccatacctctgaggcggtgccgctattgcctggtgttgcagcctctgcgagctcgacactgcagagaatgtaggcggtgcgtgcgccgttatgatcaccactgcccttggatggaaaactgtgtgggcgaacgcaaccatccactctttgtagtgtacctggcacttcaactcgtggtactgctgtggggtctgtatctggcctggagtgggctgcggttttttcagccctgggggcaatggctgaggtcttccggactgcttttcgccaccttcctactgctctcgcactttttttgtggctggccaagtggttcctgggagaccctgtgggccgaggaagaggaagagggctcctcccccgcagtttag

SEQ ID NO: 48016 - DNA, 846 bp, Artificial Sequence
  Description of Artificial Sequence: Synthetic coding sequence
atggccccctgggccctgctgagccccggcgtgctggtgcggaccggacacactgtgctcacttggggcataactctggtcctatttctgcatgacaccggagagcccgatcctgagcgcccacgaacccaccctattccccaattgcgccagtgggaggagcagggcgaactgctgctgcccctgaccttcctgctgctggtgctgggctccctgcttctgtaccttgccgtgtctcttatggatcccgggtacgtgaatgtgcaaccccaacctcaggaggagctgaaggaagaacagacagccatggtgccgcccgctattcctctcaggaggtgtcgctattgtctggtcctccaacctctccgcgccagacactgtagagaatgtcgccggtgcgtaagacggtatgaccatcattgcccctggatggagaattgcgtaggcgagagaaaccatcctctgtttgtagtgtacctcgcgcttcagctggtggttctgctgtggggtctgtatcttgcctggtctgggctccgcttcttccaaccgtggggccagtggctccgcagttcgggtctcctgttcgctacgttcttgctgctcagcctctttagtttggtggcctctctcctactggtgagtcacttgtacctggtagctagcaataccacgacctgggaattcatttctagccacagaattgcatatcttcgccaacgacctagcaatccttttgatagaggacttactcgcaacctggcccacttcttttgtggttggccaagcggcagctgggagacactgtgggccgaagaagaggaagaaggctcctctccagccgtatag

SEQ ID NO: 48017 - DNA, 648 bp, Artificial Sequence
  Description of Artificial Sequence: Synthetic coding sequence
atggccccctgggccctgctgagccccggcgtgctggtgcggaccggccatactgtcctgacgtggggcatcactctggtcctgtttctgcacgatacagagcttaggcaatgggaagagcagggcgaactgcttttgcctctcacattcctgctcctcgtgctgggctccttgctgctctatttggccgtgagccttatggacccaggctacgtcaatgtgcagccacagccacaggaggagttaaaagaagagcagacagctatggtgccaccagctatcccgctacgaaggtgtagatattgcctggtgctccagcctctgagagctagacattgcagggaatgtaggcgctgtgtgaggcgttacgatcaccactgtccgtggatggagaactgcgttggggagaggaaccaccccctgttcgtcgtctacctggctctacagctggtggttctgctatggggtctctacttagcttggtctggacttagattcttccaaccatggggtcagtggctcaggtccagcggactgcttttcgctacgtttctgctactgtcacatttcttttgcggatggcctagcggatcttgggaaacattatgggctgaagaggaggaggagggctcttctcccgcagtctag

SEQ ID NO: 48018 - DNA, 633 bp, Artificial Sequence
  Description of Artificial Sequence: Synthetic coding sequence
atggccccctgggccctgctgagccccggcgtgctggtgcggaccggccatacagtactgacttggggcatcaccctcgtactgttcttacatgacaccgataagagtgcagacgagcttctggcaacccactcccattcatggaaccagcacctgcaagccttcgcccagccaggcactcacttcccgacatccaactgcacccccactccccccacgccggtcttgcccggtcccgcctctctgtgctcccctgcctcccccgaacttagacagtgggaagaacagggggagctcttgctcccactgacctttctactgctggtactgggcagcttgttgttgtacctggcagtgtcactcatggaccccggctatgtcaacgtccaaccccaacctcaggaagagttaaaggaagagcagacagccatggtgccacccgcaatccccctccggcgatgtcgatactgtttggtcttacagccgctgcgagcaaggcattgccgcgagtgcaggcggtgcgtccggagatatgaccatcactgcccctggatggaaaactgtgttggggaaagaaatcatcctcttttcgtcgtctatctcgccctgcagctggtggttttgctgtggtag

SEQ ID NO: 48019 - DNA, 618 bp, Artificial Sequence
  Description of Artificial Sequence: Synthetic coding sequence
atggccccctgggccctgctgagccccggcgtgctggtgcggaccggacataccgttctcacctgggggattaccctggtactgttcctgcacgatactgagctgaggcagtgggaagaacaaggagaactactgttgcctctgacattcctcctgttagttttagggagcctcctgctgtacttggcagtgagcctgatggatccaggatatgtgaatgtgcaaccacaaccccaggaggagctgaaggaggaacagaccgctatggtccctccagccatcccactcagaaggtgccgctactgcttggtgctgcaacctctcagggccaggcattgtagggaatgtcgccgatgcgtgcggcggtatgaccaccactgtccatggatggagaactgtgtgggagagcggaatcatccacttttcgtcgtttacttggctttgcagctggtagtgttactctggggcttatatctggcttgcaccaggccgctgtcccccgcgcctcaggtgaggccccccgtgttgcctgccctagggagtgtggtggccgtccagagagcccctgtgcggcacttacctgccgcggtgcctctgttggtgggcgggcagccatag

SEQ ID NO: 48020 - DNA, 1467 bp, Artificial Sequence
  Description of Artificial Sequence: Synthetic coding sequence
atgccccccggcggcggcggccccatgaaggactgcgagtacagccaaattagtacccactctagcagcccaatggagtcaccacacaagaaaaagaagatcgccgcacggcgcaagtgggaggtgttccctggacgtaataaattcttctgtaacggaaggatcatgatggcccggcaaaccggagttttctatttgacactggtcctgattttagtgacatctggcttgttcttcgctttcgattgtccctacctggccgttaagatcacccccgccatccccgcagtcgctggtatcctgttctttttcgttatgggcaccctattgcggacaagcttctcagatcccggagtcctgcctagggccacccccgatgaagctgctgatctcgagaggcagatcgacatagccaacgggacttcatccggcggatatcgtccccctcctcgcaccaaggaagtcatcattaacgggcaaaccgtaaaactaaagtattgcttcacgtgtaaaatattcaggccgcctagggcttcccactgtagtctgtgcgataactgtgtagagaggtttgatcaccactgtccctgggtagggaattgcgtggggaaacgcaattaccgcttcttttacatgtttatcctgtcgttgtcatttctgactgtattcattttcgcttttgtgataactcacgtaattctccgatcacagcaaaccggatttctaaacgccctgaaggatagtccggctagcgtcctggaagccgtagtgtgcttcttcagcgtctggtcaatagtagggctctcaggctttcatacttacctaatatcaagtaaccaaactactaacgaagatatcaagggatcttggtctaataagcggggtaaagaaaactacaatccctactcttacggaaatattttcacaaactgctgtgtcgcgctctgcgggcctatttcccccagcttaatcgacaggcgaggatacatacagccggacacaccccagccagcggcaccgagtaatggaattaccatgtacggcgccacccagagccagtcagacatgtgtgatcaagaccaatgcatccagtcgaccaaattcgtgttgcaggcggccgctaccccactgctgcagtccgagccgagcctgacatctgatgaactacacctgcctggaaaacccggcctgggcacaccgtgcgcttctctgacactgggacccccgaccccccccgcctccatgcctaatcttgccgaagcaacccttgctgatgtgatgccccgaaaggatgaacatatgggtcatcaattcctgacccccgacgaggcgcccagtccccctcgactgctggccgcagggagcccactcgcacactctaggactatgcacgtcttaggcctcgcaagccaagactcactgcatgaggattccgtcagggggcttgtcaaactttctagcgtgtag

SEQ ID NO: 48021 - DNA, 1422 bp, Artificial Sequence
  Description of Artificial Sequence: Synthetic coding sequence
atgccccccggcggcggcggccccatgaaggactgcgagtacagccagatctcgacacatagctccagtcctatggaatcgccacacaaaaagaaaaagattgctgctcggcggaaatgggaggtcttccctggcaggaataaattcttctgcaatggtcgaataatgatggctcgccagacaggagtattttatcttactctagtcctcattcttgtaaccagcggccttttctttgcctttgactgcccttatctagccgtgaagataacaccagccatccccgcggtggccgggattttatttttcttcgtgatggggaccctgctccggacatccttctccgatcctggcgtgcttccaagagcaacccccgacgaagctgccgacctcgagcgccagatcgacatcgccaatggtacttcttccggcggctatcgaccacccccccgaacaaaggaagttattatcaatggccagaccgtaaagctgaagtactgtttcacttgtaagatctttcggccgccccgtgcaagccactgttctttgtgcgataactgcgttgaacgcttcgatcaccattgcccctgggtgggcaattgtgttggcaagcggaactaccgtttcttctatatgtttatcctttcactgtcttttctgactgtgttcatctttgccttcgtaattactcatgtgattctgcgtagccaacagactggattcttaaatgcattaaaggactcccctgcaagcgttctagaggcggttgtgtgttttttctcggtgtggtcaattgttggcttgtctggattccacacctacttgatatcttccaaccagaccacaaacgaggacatcaagggaagttggagtaataagagaggcaaagagaactataatccctattcctacggcaatatttttacgaactgctgtgtggcattgtgcgggcctatctctcctagtttgatcgatcgaagaggctatattcaaccggacaccccacagcctgcggccccatctaacggcatcaccatgtatggcgccacccagagtcagtcggacatggcggccgctactcctctgctccaaagtgagccctcactcaccagtgatgagctgcacctccctggcaagcctgggctgggaaccccgtgtgcctcactaacattgggacctcccaccccacccgcatctatgcctaacttggccgaggcaacccttgcggacgttatgcctagaaaggatgagcacatggggcaccagtttctgactccagacgaagctcctagcccacctagactgctcgcagctggctcccccttggcccacagtaggacgatgcatgtacttggtctggctagtcaggacagcctgcatgaggactcggtacggggtttggtcaaactcagctccgtttag

SEQ ID NO: 48022 - DNA, 1479 bp, Artificial Sequence
  Description of Artificial Sequence: Synthetic coding sequence
gaggtggcccccgaggaggccggcggcggcggccccatgaaggactgtgaatactcccagatcagcacccactcaagcagtccgatggagagcccgcacaagaagaagaaaattgccgctcgccggaagtgggaggtgtttcctgggagaaacaagtttttctgtaacggcagaattatgatggcaaggcaaaccggagtgttctacctgacactagtgcttattctggtgacatccgggctttttttcgcattcgattgcccttacttagccgttaaaataaccccagccatcccagctgtggctggcattctgttcttcttcgttatgggcaccttgctgagaacctccttcagtgaccctggtgtgctccccagagcaaccccagacgaggcagctgacctggagcggcaaatcgacatagccaacggcacctcaagcgggggctaccggccgccaccaaggaccaaggaagttatcataaacggacaaacagtgaagctcaaatattgttttacttgtaagatcttcaggccaccgagagccagccattgctcactctgcgacaactgtgtggaaagatttgaccatcattgcccctgggtgggcaattgtgtggggaagcgaaactatcgctttttctacatgtttatactgagtctgtcgtttttgactgtgtttattttcgccttcgtgataacacatgtcattctccgatcccagcagacaggcttcttaaatgccctcaaggatagtccagcgagcgtactggaagcagtggtctgttttttctccgtgtggagtatcgtgggactcagtggctttcacacctacttgatttctagcaaccagacaaccaatgaggatattaagggctcctggagcaacaagcgcggaaaggaaaattacaatccgtatagttacggaaatatcttcaccaactgttgtgtggcactgtgtggacccatctctccaagtttgatcgacaggcgggggtacatacaacctgacaccccccagccagcagcaccttccaacgggattaccatgtatggtgccacccagtcacaatccgacatgtgtgatcaggaccaatgtatacaatctactaagttcgtcctgcaggcggccgccacgcctttgttgcagagcgaaccgtcccttacttccgatgagctccacctaccaggaaaaccaggactgggaaccccctgtgccagtctcacacttggtccacctactcctcctgcgtccatgccgaacctcgcagaggccaccctcgctgacgtgatgcctagaaaagatgaacatatgggtcaccaattcctaacccctgacgaggccccaagtccaccccgcttgctggcggccgggagccctcttgcccattccaggaccatgcacgtgctgggcctggccagccaggatagcttgcacgaggactcagtgcggggccttgtgaagttatcctctgtatag

SEQ ID NO: 48023 - DNA, 891 bp, Artificial Sequence
  Description of Artificial Sequence: Synthetic coding sequence
atgcggggccagcggagcctgctgctgggccccgcccggctgtgcctgaggctgttgctgcttctcgggtaccggaggcggtgccccccactactgaggggactggtgcagagatggcgatacggcaaggtttgcctgcgcagcctcctctataactcattcggcgggtccgatacggcagtggatgctgccttcgagcccgtttattggcttgtagacaatgttatacggtggttcggggtgggaaggaatgatatcgcgaccgtgagtatctgtaaaaaatgtatttatcccaaacccgccagaactcaccactgttccatctgcaacaggtgcgtgctcaaaatggaccatcactgcccctggctgaacaattgtgtggggcactacaatcacaggtactttttcagcttctgctttttcatgaccctcggttgcgtctactgcagttacgggagctgggatctttttagggaagcttatgccgccatcgagacttatcaccagactcccccccccacattcagctttcgcgaacggatgacccataaatcccttgtgtatctgtggtttttgtgttcctcggtagctctggcccttggcgcactgacggtctggcatgccgtgctgataagcagaggagagactagcatcgaacgccacattaacaagaaggaaaggagaagacttcaggccaaggggcgcgtgttcaggaatccctataactacgggtgccttgataattggaaggtttttcttggggtcgacactggtcggcactggctgaccagagtgctgctccctagttctcacctgccccacggcaacgggatgtcctgggaaccacccccctgggttacggcccacagcgcgtccgtgatggcggtttag

SEQ ID NO: 48024 - DNA, 1086 bp, Artificial Sequence
  Description of Artificial Sequence: Synthetic coding sequence
atgcggggccagcggagcctgctgctgggccccgcccggctgtgcctgaggctgctgctcctgttgggttatcgaagaaggtgcccgcctttgctgcgaggattggtccaacgctggcgctatggaaaagtatgcctgcggtcattactgtataactctttcggcggcagtgatacagctgtggatgccgcctttgagcctgtatactggttagtggacaacgtcatccgctggttcggggtcgtgtttgtggtgctcgtgatcgtactgactgggtccattgtcgccattgcctacctatgcgtcctgcctttaattctgcgtacctactccgtaccacgtctctgctggcattttttctacagtcactggaacttgattttgatcgtgtttcattactaccaggccatcactacgcccccaggatatcctccacagggccgcaacgacattgccacggtaagtatctgcaaaaagtgcatttacccaaagcccgcccgaacacaccactgcagcatctgtaacagatgcgtgctaaaaatggatcaccattgcccttggcttaataattgcgtggggcattataatcaccgctacttttttagtttctgtttctttatgacgctgggatgtgtgtactgtagttacggaagttgggacctgttccgtgaggcgtacgccgccattgagacatatcaccagacgccaccacctaccttctcctttcgtgagaggatgacccacaaaagtcttgtttatctctggttcctatgctcaagcgttgctctggcactgggagcgctgaccgtgtggcacgccgtattgatctcacgcggggaaacctctatcgaacgtcatattaataaaaaggagagaagacgtctgcaggccaagggtagggtgttcagaaacccatataattacgggtgtctcgacaattggaaagtctttcttggggttgatacgggacgccattggctaacaagggtcttactcccaagctcccaccttcctcatggtaacggaatgagctgggagccccctccatgggtgaccgcacactccgcatccgtaatggctgtgtag

SEQ ID NO: 48025 - DNA, 1017 bp, Artificial Sequence
  Description of Artificial Sequence: Synthetic coding sequence
atgcggggccagcggagcctgctgctgggccccgcccggctgtgcctgaggctgcttctcctgctgggatatagaagaagatgccccccactgcttcggggactggtccagagatggagatatggcaaagtatgcctcaggtcactgctttataattcgttcggcggcagcgacaccgccgtagacgccgccttcgagcctgtttactggctggttgataatgtgataaggtggtttggggtggtcttcgtagtcctagtgatagtactcaccggtagcatcgtggctatcgcatacctgtgcgttctgccacttatcttgaggacctatagtgtaccccgcctctgttggcatttcttctacagccactggaacctgatcctaattgtcttccattattatcaggccatcaccacacctcctggctatccgccacagggcagaaacgacatagccaccgtctccatatgtaagaagtgtatttacccaaagccagccagaacgcatcactgcagcatttgcaactcctacgggagctgggacctctttagggaggcctacgcggcaatcgagaagatgaaacagcttgacaaaaataagctacaggccgtcgccaatcagacatatcaccaaacccccccccctacattctcatttcgagaaagaatgactcacaaatcactggtatacctgtggttcctgtgttccagcgtcgctttagcgctcggagcactcacagtgtggcacgccgttctcatttcccgcggagaaactagcatcgaaagacacattaataaaaaggagcgacgacgattgcaggccaaggggcgagtgtttagaaacccctacaactatgggtgtctggacaactggaaagtcttcctgggtgttgacaccggccgccactggctgacgcgagtgctcctaccttcctctcacttgccccacgggaatggaatgtcctgggagcccccaccttgggtgaccgcgcactcggcaagcgtgatggcggtctag

SEQ ID NO: 48026 - DNA, 1086 bp, Artificial Sequence
  Description of Artificial Sequence: Synthetic coding sequence
atgcggggccagcggagcctgctgctgggccccgcccggctgtgcctgcggctgctactactgttgggctacagacgtcgctgccccccgctgcttagaggactcgtgcaacggtggcggtatgggaaggtctgcctacggtctctgttgtataattcattcggcggatcagacacagctgtagacgccgcattcgaaccggtgtattggcttgtcgacaatgtgattcgctggttcggcgtcgtgttcgtggtccttgttattgtcctgaccggatcaatcgttgctatcgcttacctatgcgttttgccacttattctcaggacctacagcgtacctcgtctgtgctggcactttttctattcccactggaatttaatactgattgttttccattattaccaggcaataaccaccccgcccggatatcctcctcagggacggaacgacatcgcgactgtgtccatttgtaagaagtgtatttacccgaagccagctaggacccaccactgttcaatctgcaaccgttgtgtgctcaagatggaccatcactgcccctggctgaacaactgtgtgggccattacaaccacagatacttcttcagcttttgtttttttatgacgctgggctgtgtatattgctcatatggctcatgggacttgtttagggaagcctatgccgccatagagacatatcatcagacccctccaccaacttttagttttagagagcgaatgactcacaagagcctcgtgtacctatggtttctgtgctctagcgttgccttggcattgggtgccctgactgtgtggcacgccgtgctgattagcagaggagagacctcaatcgagcgacacattaacaagaaagaacgacgcaggctccaggctaagggccgggtgtttcggaacccctacaattatggatgcctggacaactggaaggtcttcctgggggtcgacactggccgacactggctgaccagggtgctactgccgtcttcccaccttccgcacggtaatggtatgtcttgggaaccccccccatgggtgacagcacacagcgcaagcgtgatggccgtttag

SEQ ID NO: 48027 - DNA, 924 bp, Artificial Sequence
  Description of Artificial Sequence: Synthetic coding sequence
atgcggggccagcggagcctgctgctgggccccgcccggctgtgccttagattgcttctactgttgggttatcgcagacggtgcccgccattgctgcgaggattagtgcagcgctggcgctatgggaaggtctgcctgcggagtctactttataattcttttggaggatctgacacggcggtcgatgccgcttttgagcctgtgtactggctcgtcgacaacgtgatccgttggttcggagtagtgttcgtcgtgttggtgattgtgctcaccggctcaatcgtggccattgcttatctgtgtgtgctgcccttaatactcagaacatactccgtgccccgtctgtgttggcattttttctactcgcactggaacttgattctgatcgtgtttcattattatcaggccatcaccacaccaccaggttaccccccccaagggaggaacgacattgctacagtgtccatttgtaaaaaatgcatataccccaaacctgcccgcacccaccactgtagcatttgtaatcgctgtgtgcttaaaatggaccatcactgtcacattttgcctccagcactttccaaactgcccacctcattacggccttcattcctgtccagcgttgctctcgcacttggagccctaacagtctggcacgctgttctgatcagccgcggcgaaacatccatcgaacgacatattaacaagaaggagaggcggcggctgcaggccaaagggcgtgtttttagaaacccctacaattacggatgtctggataactggaaggttttcttgggcgtcgacaccgggcgccattggttaacccgcgtcctcctcccgtcgagccatttgccccacggcaatggtatgagttgggaacctcccccttgggtcacggcccattctgccagcgtcatggccgtttag

SEQ ID NO: 48028 - DNA, 1134 bp, Artificial Sequence
  Description of Artificial Sequence: Synthetic coding sequence
atgcggggccagcggagcctgctgctgggccccgcccggctgtgcctgcgattgctactgttgttgggttatcgaaggcggtgtccccccttgctgcgcgggcttgtgcaacggtggagatacggcaaagtgtgcctgagatcactcctgtataactcttttggcgggagcgacaccgccgtggacgctgctttcgaaccagtgtattggttagtggataatgtgatcaggtggtttggggttgtcttcgtcgtcctggtgatcgtactaacaggaagcattgtggcgatcgcgtacctttgcgtgctcccacttatactacggacttacagtgtgccccggctgtgctggcatttcttttactctcattggaatctgattcttatagtcttccattactaccaggccattacgacaccacctggctacccaccccaaggtcgcaacgatatcgctacagttagtatttgcaaaaaatgtatctaccctaaaccagctcgcacacaccattgttccatctgtaacagatgtgtgctgaagatggaccaccattgtccttggctaaacaactgcgtgggtcattacaaccataggtatttctttagtttctgtttcttcatgaccctggggtgtgtgtattgcagctatggcagctgggacctgtttcgagaggcatatgccgccatcgaaaagatgaaacaattggacaagaacaaactgcaggcagtggccaatcagacatatcaccagacccctcctcccaccttttcgtttcgggaacgaatgacacataagagccttgtttatttgtggtttctgtgttcctccgtcgcccttgcccttggcgctctgaccgtctggcacgcagtgctgatctctagaggggagacatctatcgaaaggcatatcaacaagaaagaacgcagaaggctgcaagccaagggaagggttttcaggaacccatataattacgggtgcctggataattggaaggtcttccttggggtggatacaggcagacactggcttacccgggtgctgctgccaagtagtcatttaccacacggaaatggcatgagttgggagcctcccccctgggtaaccgcgcattcagcctccgtcatggccgtatag

SEQ ID NO: 48029 - DNA, 1134 bp, Artificial Sequence
  Description of Artificial Sequence: Synthetic coding sequence
atgcggggccagcggagcctgctgctgggccccgcccggctgtgccttaggctcctgttactgcttggatatagacgacggtgtcctcctctgctgcgcggacttgtgcaacgttggcgctatggcaaagtttgccttcgaagcctgttatacaacagtttcggcggtagcgacactgccgttgatgccgctttcgagcctgtgtattggcttgttgataacgtgattcgatggtttggcgtggtgtttgtggttctcgtgatcgtcttgactggaagtattgtcgcaatcgcctatctctgtgtcttgcccctgatcctacgtacttactccgtgccccggttatgctggcacttcttctacagtcattggaatctgatcctgattgtgttccattactaccaggcaataacgacccctcctggttaccccccccaaggccgcaatgacattgccactgtgagcatttgtaaaaagtgcatataccccaagcctgcacgtacacatcattgcagcatctgtaaccggtgcgtgctgaagatggatcaccactgtccctggctaaataactgcgttggccactacaaccatcgctactttttctcattttgctttttcatgacgttgggttgcgtgtactgcagctacggctcatgggatctctttcgggaggcctacgcagccatcgagaaaatgaaacagcttgacaagaacaaactgcaagctgtggccaatcaaacatatcaccagaccccaccccctaccttttcatttcgcgagcggatgactcataagagcctcgtgtacctgtggttcctttgctcgtcagtggccctcgctctcggagcccttactgtgtggcatgctgttttgatctctagaggcgaaaccagtatcgaacggcatattaacaagaaagaaaggagacggttacaggccaaaggtcgggtattcaggaacccatacaattatggctgccttgataattggaaagtgttcttgggggtagatactggcagacattggcttacgcgagtacttttgccctctagtcacctcccgcatggtaatggcatgagctgggagccccctccatgggttactgcacattctgcgagcgtcatggcggtctag

SEQ ID NO: 48030 - DNA, 642 bp, Artificial Sequence
  Description of Artificial Sequence: Synthetic coding sequence
atgcggggccagcggagcctgctgctgggccccgcccggctgtgcctccgtttactactgctcctgggatatcgtcggcggtgtccaccattactacgtgggctggtgcagcgatggcgttacggaaaggtgtgccttagatcccttttgtataactcattcggagggtcggatacggcagtagacgcggcctttgaacctgtgtattggctcgtggacaatgtgatcaggtggttcggcgtggtgttcgtggtcctggtgatagtacttacaggaagcattgtcgcgatcgcttatctctgtgtgctgcccctgatcctgcgcacctacagcgtgccaaggctctgttggcatttcttttattctcactggaacctcattctcattgtgtttcattactaccaggcaattaccactccgcctggctatcccccccagggcaggaacgatattgccacagtttctatctgcaagaagtgtatctacccgaaaccagccagaacgcaccattgctccatctgcaatcgttgcgtgttaaaaatggatcaccattgtccttggctcaacaattgcgtaggacattataatcaccgatactttttttcattctgcttctttatgacattggggtgtgtatattag

SEQ ID NO: 48031 - DNA, 906 bp, Artificial Sequence
  Description of Artificial Sequence: Synthetic coding sequence
tgagccgtggacgccgccttcgagcccgtgtactggctggtggacaacgttattaggtggttcggagtggtgtttgtggtactggtgatcgtgctcaccggttctatagttgctatcgcctacctgtgtgtattacctctgatcctgagaacctactccgtccccaggctatgttggcacttcttctatagccactggaaccttatcctgatcgtgtttcattactaccaggcgatcacaaccccaccagggtaccctcctcaaggtagaaacgacattgctactgtctccatttgcaaaaagtgtatttacccaaagcctgccagaacacaccactgtagcatctgcaataggtgcgtattaaagatggaccaccactgtccctggctcaataactgcgtcggccattataaccaccgctacttctttagcttttgcttctttatgactctgggttgtgtttattgttcctacgggtcttgggacctgtttcgggaggcctatgctgctattgaaaaaatgaaacagctggacaagaataagttacaagcggtcgcaaatcagacctatcatcagaccccacctccaaccttctcctttagggaaaggatgactcacaaatctctggtttacctctggttcctgtgctcacgaggagaaacatccatcgagaggcatataaacaagaaggagcggcgacggctgcaagccaaaggccgcgtgttccgaaatccctacaactacgggtgtctggataattggaaagtcttcctgggggttgacacgggtcggcactggctgacacgagttctgctacccagttcccacttgccccacggcaacggcatgtcatgggagccacccccatgggtgaccgctcactccgcttcggttatggccgtctag

SEQ ID NO: 48032 - DNA, 960 bp, Artificial Sequence
  Description of Artificial Sequence: Synthetic coding sequence
tgacggcggtgcccccccctgctgcggggcctggtgcagcggtggcgctacgggaaggtttgtcttagaagcttgttatacaacagctttggcggctccgataccgccgtggacgcagctttcgagcccgtgtattggctcgtggataatgtgatccggtggtttggcgtggtctttgtggtcttggtgatcgtcctgaccggaagcatcgtcgctatagcctatctatgcgttttgcctctgatcctgaggacatatagtgttccccggttgtgttggcattttttttacagccattggaacctgattctaatcgtgttccactattaccaggcaatcaccacaccgcctggctatcctccacagggtaggaatgatatcgcaacagtgtctatatgtaagaaatgcatttatcctaaaccagcccggacccatcactgctctatttgcaatcgttgtgtgttaaagatggaccaccactgtccatggctgaataactgcgttgggcactacaaccaccgatactttttcagtttctgtttctttatgactctaggctgtgtctattgcagctacggctcttgggatctgtttcgtgaagcctacgcggccatcgaaacttatcaccagacccccccccctacgttctcttttagggaacgcatgacgcacaagtcactcgtgtatctgtggtttctgtgttctcggggcgaaacttctattgaacgccacatcaataaaaaagaacgcaggcgtctacaagcaaagggacgagtttttaggaacccgtataactacgggtgtttagataattggaaggtgttcctgggagtcgacacaggccggcactggctgacgcgggtgcttctcccatccagccacctcccacatggcaacggaatgagttgggagccccctccctgggtgacagcacatagcgcttcagttatggccgtgtag

SEQ ID NO: 48033 - DNA, 729 bp, Artificial Sequence
  Description of Artificial Sequence: Synthetic coding sequence
atgcggggccagcggagcctgctgctgggccccgcccggctgtgcctgagattacttctgctcttgggttaccggcgccggtgcccgccgctacttcgcggcctggtacagcgctggaggtatggtaaggtgtgcctccggagcctgctctacaactcattcggtgggagtgacactgcggtcgatgccgccttcgaaccagtgtactggttagtcgataatgtaattcgatggttcggggtgggccgtaatgatattgcaactgtgagtatctgcaagaagtgtatttatcccaagcccgctagaacacatcattgcagcatatgcaatagatgtgtactgaagatggaccaccactgtccctggctaaacaactgcgtgggtcactacaatcacagatacttcttttccttttgctttttcatgaccttaggttgcgtctattgctcatatgggtcatgggacctattcagagaagcgtacgctgctatagagaagatgaagcagttggacaagaataaactccaggccgtggccaaccagacttaccaccagaccccgcctcccacattctcgtttcgagagcgcatgacccataagagtctcgtgtatttgtggttcctctgcagttccgtggctctggccctgggcgcactgacagtgtggcacgcagtgctcatttcccgtggggagacatctatcgagaggcatattaacaagaaggaatag

SEQ ID NO: 48034 - DNA, 1167 bp, Artificial Sequence
  Description of Artificial Sequence: Synthetic coding sequence
atgaaggactgcgagtaccagcagatcagccccggcgccgcccccttacctgctagccccggagccagacggcccgggcctgcagctagccctaccccaggcccaggcccagcacctccagctgcccccgccccccccaggtggagcagttcgggctctggatctggcagtggatcaggatcattgggaaggaggccccgccggaaatgggaagttttccccggccgaaatcgcttctattgtggaggtagacttatgttggccgggcacggaggagtatttgcactcacattgttgctcatactcaccaccactggcctattttttgtcttcgattgtccttatttggcccgtaagcttactctggccatacccatcatagccgctatcctgtttttcttcgttatgtcctgcttactccagaccagttttaccgaccccggaatccttcctcgggcaacagtttgtgaagcggccgctctcgaaaagcaaattgataatacaggctcgtctacatatcgcccaccaccgagaacgcgtgaggtgttaattaatggacagatggttaaactaaaatattgtttcacctgtaaaatgtttcgtcccccaagaacttctcattgttctgtctgcgataattgtgtcgagaggtttgaccaccactgtccctgggtgggaaattgcgtcggcagacgcaactatcgttttttttacgctttcattttgtctctgagcttcctgacagctttcatcttcgcttgcgtggttacccatctcacactgagagcccagggcagtaattttctgagcacccttaaagagacacctgcttccgtgcttgagctagtcatctgctttttctcaatttggtccatcctcggacttagtggatttcacacgtacctggttgcctccaacctgactacaaatgaagacataaaggggagctggtcttctaagcgcggcggagaggcaagtgtgaacccctattctcacaaatcgatcattacgaattgttgcgccgtcctgtgcggccccttgcctccctctttgattgaccgcagggggtttgtacagtccgatacagtgctgccctctcccatccgtagtgacgaaccagcctgccgtgccaagcctgacgcttcaatggtgggcggccacccctag

SEQ ID NO: 48035 - DNA, 930 bp, Artificial Sequence
  Description of Artificial Sequence: Synthetic coding sequence
atgaccctgctgaccgacgccacccccctggtgaaggagccccaccccctgccccttgttccccggccctggttcctacctagtctgtttgccgccttcaatgtagtgctgctggtatttttctctggccttttcttcgcattcccttgccggtggctcgcccagaacggggagtgggccttcccggtgattacgggcagcctgttcgtgctgacttttttctctctcgtgagcttgaacttcagtgatccggggattttacatcaagggagtgcggaacagggccccttaacggttcacgttgtctgggttaaccacggtgcttttaggctgcagtggtgccctaagtgttgcttccaccgccctccacgaacatatcactgcccctggtgcaacatctgcgtggaggactttgaccatcactgcaaatgggtaaacaactgcattggacataggaatttccgatttttcatgctactggttctgagcctttgcctctatagcggcgcaatgctagttacgtgcctcatctttctggtgagaacaacccatctgccttttagcacagataaggccatcgcgattgtggttgctgttagcgccgctggtcttctggttcctctgagccttctgctcttaatccaggcgctctctgttagctctgctgaccgcacgtacaagggtaagtgccgccatctccagggctataatccattcgatcaaggctgtgcatccaattggtacctgaccatctgcgcgcccctagggccaaaatacatggctgaagccgtgcagctgcagcgagtcgtcggcccagactggacatctatgcccaacctacaccctcccatgtcaccatctgcgctgaatccacccgctccgacctcaggctctctgcagtctcgggaggggactccgggtgcatggtag

SEQ ID NO: 48036 - DNA, 1104 bp, Artificial Sequence
  Description of Artificial Sequence: Synthetic coding sequence
atggcccccagcggccccggcagcagcgcccggcggcggtgccggagagtactgtactggattccagtggtgtttattacccttctgctcgggtggtcatattacgcttatgctattcagctgtgcattgtctctatggagaacactggggagcaggtggtgtgtttaatggcctatcacctcctcttcgccatgtttgtttggagctactggaaaaccatcttcacattgcccatgaatccatcaaaagagtttcatctgagttacgcggagaaagatcttctcgaaagggagccccgcggggaagcgcaccaggaagtgctcaggcgtgcggccaaggaccttcccatatacaccagaacgatgagtggtgccatccgttattgcgacagatgccagctcataaagcccgacagatgccaccattgtagcgtgtgcgacaagtgtattctgaagatggaccaccactgcccctgggtgaataactgtgtgggctttagtaattataagtttttcttgctttttctcgcgtactccctcctgtactgcctgttcattgcggctacagatctccagtactttatcaaattctggaccaacgggctgccggatacacaagccaaatttcacattatgttcctgttctttgccgccgctatgttttctgtttcactctcctctctctttgggtatcattgttggctggtgagcaaaaataagtctacattggaagcattcaggtcaccagtatttcggcatggaaccgacaagaatgggtttagcctggggtttagcaaaaacatgcgacaagtgtttggtgatgagaaaaagtattggctgctgcccatattttccagcctcggggatggctgctctttcccaacctgtttggtgaaccaggatcccgagcaggcgtccacaccggcaggtctgaatagtaccgctaagaatctcgaaaaccatcaatttccagcaaaacccctccgcgagtcacaatcacacttactgacagacagtcagtcttggaccgaatcttctatcaatccaggaaagtgtaaagcaggcatgtcaaatccagctctgaccatggagaatgagacatag

SEQ ID NO: 48037 - DNA, 963 bp, Artificial Sequence
  Description of Artificial Sequence: Synthetic coding sequence
atggccccctggaccctgtggcggtgctgccagcgggtggtgggctgggtccctgttctgttcatcacttttgtggtggtttggtcttactacgcctatgtggtggaattgtgtgtcttcacaatttttggcaacgaggaaaacggcaagaccgtggtatatctggtggccttccaccttttcttcgtgatgttcgtgtggagctattggatgacaatttttacctcacccgcttcaccaagcaaggaattttacctttcaaattccgagaaggagcgctacgagaaggagttcagccaggaacggcaacaggagatcttgcgccgagcagcccgagcactgccaatatacactaccagtgcaagtaaaaccatacgctattgtgagaagtgtcagctcatcaaaccagatcgggcgcatcactgctctgcttgtgattcttgtatcctgaaaatggatcatcattgcccttgggtcaacaactgcgtcgggttcagcaactacaagtttttcctgctgtttctcctctactccctgctctattgtctcttcgtagccgctacagtgctggagtactttattaagttttggacaaacgagcttaccgacacccgagccaagttccacgtgctgtttctgtttttcgtgtcagctatgttttttattagcgtgctttctttgttctcttaccactgttggttggtgggcaaaaatcgaaccaccatagagtcttttagggcacccacattctcgtatggacctgatggcaacgggttctccttggggtgttcgaagaattggcggcaggtgttcggcgacgagaagaagtactggctgctgccaatcttttcaagtctgggagatggctgtagctttcccacccggctggtcgggatggaccctgaacaggcaagcgtaacgaaccagaacgaatacgcaagacggtcaaaactacagcgttag

SEQ ID NO: 48038 - DNA, 1065 bp, Artificial Sequence
  Description of Artificial Sequence: Synthetic coding sequence
atggccccctggaccctgtggcggtgctgccagcgggtggtgggctgggttcccgtgctctttatcaccttcgtcgtggtatggagttattacgcatacgtcgtcgaactgtgcgtgttcaccatcttcggaaatgaggagaacggtaaaaccgtggtctacctggtggcctttcacctgtttttcgtgatgtttgtctggtcatattggatgactatctttactagccccgcttcgccaagcaaggaattctatctgagcaactcggagaaagaacggtatgagaaagaattttctcaggagcgccagcaggaaatccttagacgcgccgcacgcgccctcccgatttataccacatcagctagcaagaccatcagatattgcgaaaaatgccagctgatcaagcctgaccgtgcacaccactgtagtgcctgtgatagctgcatactgaaaatggaccaccactgtccatgggtgaataactgcgtgggtttttccaactacaagttcttcttgttatttctcctttactcactcttgtactgtctgttcgtggctgctaccgtgctcgagtatttcatcaaattttggacaaacgaattgacagatacaagagccaagttccacgtgctgtttcttttttttgtcagcgccatgttttttatttccgtactgtccctgtttagttaccactgctggctggttgggaagaacaggactacgattgagtcattcagagcaccaacattctcatatggccccgatggcaatggttttagcctgggctgctcaaaaaattggcgacaggtttttggagatgagaagaagtactggctcctccccatctttagcagcctgggtgacggttgctctttccctacaaggcttgttggtatggatccagaacaggcaagtgttactaaccaaaacgagtacgcaaggagcggatcaaaccagcctttccctattaagccactatccgagtccaagaatagactgctcgactctgagtcccaatggcttgaaaacggtgcagaggaaggaatcgtgaaaagtggcgtctag

SEQ ID NO: 48039 - DNA, 1098 bp, Artificial Sequence
  Description of Artificial Sequence: Synthetic coding sequence
atggccccctggaccctgtggcggtgctgccagcgggtggtgggctgggtgcctgtcctcttcatcacgttcgtcgttgtgtggtcttattacgcttatgttgtcgaactgtgcgtgttcaccattttcggaaatgaggaaaatgggaagaccgtggtttatcttgtggcatttcaccttttctttgtgatgtttgtgtggtcctattggatgaccatctttacctctcccgcttcccccagtaaagagttttacctgagtaactcggagaaggagcggtacgaaaaggagttcagtcaggaacgccagcaggaaatcttacgtagggccgcccgcgctttacccatctacacaacatcagcctccaagaccatcaggtattgtgaaaaatgtcagttgatcaaacccgacagagcacaccattgctctgcctgcgactcctgtattttgaaaatggaccaccattgcccgtgggtgaacaactgcgtaggtttcagcaattacaagttcttccttcttttcctcctctatagccttctgtattgtctgttcgtagctgcaaccgtcctcgagtacttcattaagttctggacgaatgagttaacagacaccagggcaaagtttcacgtcctctttctgttctttgtgagtgctatgttcttcattagcgtgctgtcactgttcagctatcattgttggttggtaggcaagaaccgtactacaatcgagagtttcagggccccaacctttagctacggacccgacggaaatgggttttcgctgggctgttctaaaaactggaggcaagtcttcggggatgaaaagaaatactggcttctgcccatcttttctagcctcggggacggttgttccttccctacccgactcgtaggaatggatcctgagcaggcctcagtaacaaaccagaatgagtatgcacggtcctcaggcagcaaccaaccattcccaatcaagccactcagtgaatccaagaatagactgctcgacagtgagtcacaatggttggagaatggagcagaggaggggattgttaaatctggaacaaacaatcacgtcacagtcgcgatagaaaattag

SEQ ID NO: 48040 - DNA, 1098 bp, Artificial Sequence
  Description of Artificial Sequence: Synthetic coding sequence
atggccccctggaccctgtggcggtgctgccagcgggtggtgggctgggttccagttctcttcatcacctttgtggtcgtttggagctactacgcctatgtcgtagaactgtgtgtgtttacaattttcggcaacgaggagaatgggaaaacagttgtatacctcgtcgccttccacctttttttcgttatgttcgtgtggtcttattggatgacgattttcacatcccccgcctcaccctctaaagaattctatctgagcaatagcgagaaggagaggtatgagaaagagttttcccaggaacggcagcaggagatccttcggcgcgcagcccgcgcgcttcctatttacactactagtgccagcaagactattcggtattgcgagaaatgccagctgatcaagccagatagggcccaccactgctctgcttgcgactcttgcatcctgaagatggatcaccactgcccatgggtgaataattgcgtgggcttctcaaactacaaattcttcctcctttttctgttgtattccctgttatactgtttgttcgtcgcagcaactgtgctagaatacttcataaagttttggaccaacgagctgaccgatactcgagctaaattccatgtgttgttcctgtttttcgtgtccgccatgttctttatctccgtcctgtctcttttttcataccactgctggctcgtcgggaaaaacagaacaactattgaatccttcagagcacctacattcagttatgggcccgacggaaatggtttcagcttaggttgttcaaaaaattggaggcaggtgttcggcgacgagaaaaagtactggctgttacccatcttttcatccttgggcgacggatgctcattccccactaggctggtagggatggaccccgaacaggctagcgtgactaaccagaatgaatacgcccgctccagtggctctaaccaaccttttcccatcaagcccctgtccgagagcaagaaccgcctccttgatagtgaaagtcagtggttggagaatggcgctgaagagggaattgtgaagagcgggacaaataaccacgttaccgtcgcaattgagaattag

SEQ ID NO: 48041 - DNA, 393 bp, Artificial Sequence
  Description of Artificial Sequence: Synthetic coding sequence
atggccccctggaccctgtggcggtgctgccagcgggtggtgggctgggtccccgtgcttttcattacatttgtggtggtgtggagctactacgcttacgtcgtcgagctctgcgtatttactatattcggcaacgaggaaaacggcaagactgtggtttacctggtcgccttccaccttttcttcgtcatgttcgtgtggagctattggatgaccatatttacttcgcctgccagcccctctaaagagttttacctgtccaactccgagaaagagcggtacgaaaaggaattcagccaagagcggcaacaggagattctgcgccgggccgcaagagccttacctatatacactacatcggctagcaagtcactcatgcaatccaccaaatag

SEQ ID NO: 48042 - DNA, 879 bp, Artificial Sequence
  Description of Artificial Sequence: Synthetic coding sequence
atgttcgtgtggagctactggatgaccatcttcaccagccccgccagcccaagcaaggaattctacctaagcaatagcgaaaaggagaggtacgaaaaggaattctcccaggagaggcagcaggagatcctgaggcgggccgcgcgggcactccctatctacacgaccagcgcatctaagacaatccgctattgtgagaaatgtcagttgattaagccggatagagcgcatcactgctccgcctgtgacagttgcatcctcaaaatggaccatcattgtccttgggtgaacaactgcgtggggttttcaaattataagttcttcctgttgttccttctctactctctcctttattgtctttttgtggccgctaccgttcttgaatattttattaagttttggaccaatgagttaacagatacccgcgcaaaattccacgttctcttcttgtttttcgtgtccgccatgttcttcatttccgtactaagtctttttagttaccactgctggctggtgggaaaaaaccggaccactatcgagagtttcagagcgcctacgttctcatacgggcctgacggcaatggttttagtctaggatgtagcaaaaactggcgccaagtgttcggcgacgaaaaaaagtattggctcttgcccatcttctcctcccttggcgacggatgttccttccccacaaggttggtcggtatggacccggagcaggcaagtgtcacaaaccagaatgaatacgctcggtccagcggaagcaaccaacctttccctattaagcctctctcagagagtaaaaaccgcttgctggactcagagtctcagtggcttgaaaacggagctgaggaaggaattgtaaagtcaggcgtatag

SEQ ID NO: 48043 - DNA, 798 bp, Artificial Sequence
  Description of Artificial Sequence: Synthetic coding sequence
atgggcctgcggatccacttcgtggtggacccccacggctggtgctgcatgggactgatcgtgtttgtatggctctataacattgtgctgatccccaaaatcgtgttatttccacattacgaagaaggccatatccccggaatcctgattatcatcttctacgggatcagtatcttctgtttggtcgccctggttagagcatctatcaccgatcccggcagattgcccgaaaatcccaaaattccacacggcgaacgggaattctgggagttgtgtaacaaatgtaacctcatgcggccaaaacgtagccaccattgttctcgctgcggtcattgtgtgaggaggatggatcaccactgtccgtggataaataattgcgtaggcgaggacaaccactggttgtttctccagctatgcttttacactgagttgctgacttgttatgccctgatgtttagcttctgtcattactattactttttaccactaaagaagaggaacctggacctttttgtgtttcgacacgagttggctataatgagactcgctgcattcatgggaattaccatgctggtgggcatcactggattgttctacacacagctcattgggatcatcacagacaccacgagcatagaaaagatgtccaactgctgcgaggatatttcccgtcctagaaaaccctggcagcagaccttctccgaagtgtttgggacccgatggaaaattctgtggttcattccatttcggcagagacagccactgcgggttccataccattttgccaatcacgtttag

SEQ ID NO: 48044 - DNA, 792 bp, Artificial Sequence
  Description of Artificial Sequence: Synthetic coding sequence
atgctggccctgcggctgctgaacgtggtggcccccgcctacttcctttgtatatctttggtaacgtttgttttgcagctgtttttatttttaccctcaatgagagaggatccagccgccgccagattattctcacccgcacttctgcacggagctctctttctctttctatctgcgaacgcgcttggtaactacgtgctggtaattcagaactccccagatgacctgggcgcatgccagggggcatccgccagaaagacaccctgtccaagcccttctacccacttttgcagagtgtgcgccagagtgacactcaggcacgatcaccactgcttcttcactggtaattgtatcggcagtagaaatatgaggaacttcgtcttgttttgcctttatacatcccttgcctgcctgtacagcatggtggctggagtggcctacatcagcgctgtactgagcatcagcttcgctcaccctctggctttcttaacactcctgcccacatctattagccagttcttttccggtgctgttctaggatccgagatgtttgtaatccttatgctttacctgtggttcgctatagggctggcttgcgcaggattctgttgtcaccaacttctgcttattttgagaggacaaactcggcaccaggttagaaaaggtgtggccgttagagcaaggccgtggcgcaagaatttacaggaggtgtttggtaagcggtggttgctgggactcttggtacccatgttcaacgtcgggtcagaatccagcaaacagcaggataaatag

SEQ ID NO: 48045 - DNA, 126 bp, Artificial Sequence
  Description of Artificial Sequence: Synthetic coding sequence
atgctggccctgcggctgctgaacgtggtggcccccgcctacttcctctgtatctccttggtgaccttcgtgctacagctgttcctgttcctgccttctatgagggaagatccagccgctgcatag

SEQ ID NO: 48046 - DNA, 330 bp, Artificial Sequence
  Description of Artificial Sequence: Synthetic coding sequence
atgctggccctgcggctgctgaacgtggtggcccccgcctacttcttatgtatttccctggtgacctttgtcctccagcttttcctcttcctcccgagcatgcgtgaggatcctgccgccgctcggttgttttctcctgctctcctccacggcgctctctttctcttcctgtctgccaacgccctgggaaattatgtactggtgatccagaattcacccgatgacctcggcgcctgccaaggcgcgagcgcaagaaagacaccgtgcccttcaccatcaacccacttctgtcgagtctgtgcccgagtcactctacgacatgatcactag

SEQ ID NO: 48047 - DNA, 1230 bp, Artificial Sequence
  Description of Artificial Sequence: Synthetic coding sequence
atgacccagaagggcagcatgaagcccgtgaagaagaagaagaccgaagaacctgaactcgaacccctatgctgctgtgagtacattgatcgcaacggtgagaagaatcatgtggcaacttgcttgtgcgactgccaggacctggatgaaggctgcgatagatggatcacgtgcaaaagtcttcaacctgagacttgcgagaggattatggatactatatccgacaggctcaggataccctggctgcggggtgccaagaaggtaaacatctctattatccctcccttagttctgctgcccgtgtttctacacgtggcctcctggcatttcctgctcggagtcgtggtgttgacgtcactgccagtgctcgctctgtggtattactatctgacccacaggaggaaggagcagaccctcttctttctttccctcggtctttttagcctgggctatatgtactatgtatttcttcaggaagttgtgcccaagggaagggtggggcctgtccagttggctgtactgacgtgcggactctttctcattctgctggcactgcatcgcgccaaaaaaaaccctggataccttagtaatccggcttccggggatagaagcttgtctagtagccaacttgagtgtttatcaagaaaagggcaggagaagactaagggatttcctggggctgacatgtcaggtagcctgaataatcgcaccacaaaggatgaccctaagggatcttcaaaaatgcctgctggaagtccaacaaaggcaaaggaggattggtgcgctaagtgtcaactcgttagacccgccagggcctggcactgtcgtatctgcggcatttgcgtgcgaagaatggaccatcattgcgtgtggatcaactcctgtgttggcgaaagtaatcaccaggccttcatactggcactgctgatttttttactaacatctgtttatggcataacactcaccctagacaccatctgtcgcgaccggtcagtgttcacggcattgttttactgtcctggtgtgtatgctaactacagtagtgcactcagctttacttgcgtctggtactcggtcattattacagctgggatggcttatatctttctgatacagttgatcaatatctcttacaatgtgactgaaagagaggtgcagcaagccctacgacagaagactggtcggaggctgctttgcggcctcatcgtcgacaccgggctgctgggctag

SEQ ID NO: 48048 - DNA, 447 bp, Artificial Sequence
  Description of Artificial Sequence: Synthetic coding sequence
atgacccagaagggcagcatgaagcccgtgaagaagaagaagaccgaagagcccgaactggagcccctttgctgctgcgagtatatagaccggaatggagaaaagaaccacgtggcaacctgcctgtgcgattgccaagacctcgatgaaggatgcgacagatggattacttgtaagagcctccagcccgagacatgcgagcggatcatggacactatcagcgaccggttacgtataccatggctgcggggagccaagaaagttaacataagcattatccccccactggtgctgcttcctgtgtttctgcacgtcgcgtcatggcacttcctgctgggtgtggtggtgctgaccagcttacctgtactggccttgtggtactattacttgacgcacagaagaaaagagcagaccctgttcttcctgtccttgggtctgttctcctag

SEQ ID NO: 48049 - DNA, 855 bp, Artificial Sequence
  Description of Artificial Sequence: Synthetic coding sequence
atgggccagccctgggccgccggcagcaccgacggcgcccccgcccagctgcccttagtacttaccgccctctgggctgccgcagtgggcctggagttggcatacgtgttggtgctgggccctggtccgccccccttaggcccacttgctagagctttacaactcgccttagcggcttttcaactgctgaatcttctcggcaacgtggggctcttccttagatccgatcctagtatcagaggcgtgatgttggccgggagagggctgggccaaggatgggcttattgctaccagtgtcagagccaggtccccccgcgcagtgggcattgcagtgcgtgtagggtgtgcatattgaggcgcgaccaccactgccggctccttgggaggtgcgtgggtttcggtaactacagacctttcctgtgtttactccttcatgcagccggggtactgctccacgttagtgtcttactgggaccggcactgtccgccctgctgcgcgcacacactccactgcatatggcagccttactgcttctgccttggctaatgttactcaccggccgcgtgtccctggcccagtttgcccttgctttcgtgacggacacttgcgtggcaggtgcattactgtgtggcgccggcctgctctttcacggcatgttgttgctgcgggggcagactacatgggagtgggctagagggcaacacagttatgatttagggccatgtcacaatcttcaggctgcgctggggccacgttgggcacttgtttggctctggcctttcctggcaagccctctgccaggggacggcatcacattccaaacgacagcagacgttggccatacagcctcttag

SEQ ID NO: 48050 - DNA, 984 bp, Artificial Sequence
  Description of Artificial Sequence: Synthetic coding sequence
atgatgctgatccccacccaccacttccggaacatcgagcggaagcctgaatacttgcaacccgagaagtgtgtgccccccccttacccaggaccagtgggtacgatgtggtttatacgtgacggctgcggcatagcatgtgctatagtcacatggttccttgtgctctatgctgagtttgttgtattgtttgtgatgctgattccttcaagggactatgtgtacagcattatcaacggtatagtgtttaacctcctggccttccttgccttggcctctcactgccgtgccatgctgactgacccaggtgctgttcccaagggaaatgcaactaaggagttcattgaaagcttacaactcaagcccggacaagtcgtgtacaagtgtcctaagtgttgttcaattaagcccgaccgcgctcatcactgcagtgtgtgcaagcgctgtatcagaaaaatggaccaccattgcccatgggttaataattgcgtgggcgagaataaccagaaatactttgtcctgtttacgatgtacatcgctctaatcagtcttcacgccctgattatggtcggtttccacttcctgcactgtttcgaggaggactggaccacgtacgggttgaatcgagaggagatggccgaaaccggtatctcccttcatgagaagatgcagcccctgaatttttcctcaaccgagtgttcatccttcagcccgcccaccaccgttattctattgatactcttgtgctttgagggcttgttatttctgatatttactagcgtgatgtttggcacacaagtgcatagcatttgcacggacgagaccggcattgaacagctgaagaaagaggagcggaggtgggctaaaaagacgaagtggatgaacatgaaggccgtgtttgggcatccatttagtctgggctgggcctctccctttgccacgcccgaccagggaaaggcagacccatatcaatatgtcgtgtag

SEQ ID NO: 48051 - DNA, 588 bp, Artificial Sequence
  Description of Artificial Sequence: Synthetic coding sequence
atcaagcccgaccgggcccaccactgcagcgtgtgcaagcggtgcattcgtaaaatggaccaccattgtccctgggtcaacaactgcgtgggcgaaaacaatcagaaatactttgtcctcttcaccatgtacatcgctctgatttctctccatgctctcattatggttgggttccacttcctgcactgttttgaggaggattggactaaatgttccagtttctcgccacctacaacagttattcttctcatcctgctctgtttcgagggcctcttattcctgatatttaccagtgtcatgttcggtacccaggtgcattctatttgcacagatgagacgggcatcgagaggctgaagagaaagaaccagcctcgggaacatatggggtcatggcagtccgtaaaggagaccttcggtggtgactttagcctgaattggtttaacccgttcagcaggccgtgccaaccagaaattccctcggataaggacatggtgcgacaagtcacatcactgtccgacaccgaaacaatggaagatcctagcgaagaaactaaagacgaagatagtgtagaggtgactgacgaatag

SEQ ID NO: 48052 - DNA, 900 bp, Artificial Sequence
  Description of Artificial Sequence: Synthetic coding sequence
atgatgctgatccccacccaccacttccggaacatcgagcggaagcctgagtacctccagccggagaagtgtgtgccacctccatacccaggcccagttggcaccatgtggtttattcgtgatgggtgcggcatcgcatgcgccattgtgacctggtttctcgtgttgtatgccgaatttgtagtgctgtttgtgatgctgattcctagccgcgattatgtgtatagcattataaacggaatcgtgtttaacctgctggcgttcctggcactcgcatcacattgcagggctatgctgacagatcctggggcggtccctaagggcaatgccactaaggaattcatcgaatctttacaactgaaaccagggcaagtggtctacaaatgccccaaatgctgcagcattaagccggacagggcccatcattgtagcgtttgtaaacgatgcatacgcaaaatggaccatcactgtccctgggtgaacaattgtgtcggtgagaacaatcagaagtacttcgtgctcttcacaatgtacattgctctcatcagcctgcatgccctgattatggtgggatttcacttcctccattgctttgaggaggattggacaaaatgcagctctttctcaccacctactacagtgatcctgcttatcttgctgtgctttgaggggttattgtttttgatattcacctccgtgatgtttgggacacaagtccatagcatttgtaccgatgaaaccggaatagaacagctcaaaaaggaagagcgtaggtgggcgaagaaaactaaatggatgaatatgaaagctgttttcgggcatccattttcactgggctgggcaagcccctttgccacccctgatcaagggaaggcagacccctaccagtacgtggtttag

SEQ ID NO: 48053 - DNA, 1035 bp, Artificial Sequence
  Description of Artificial Sequence: Synthetic coding sequence
atggacttcctggtgctgttcctgttctacctggccagcgtgctgatgggcttagtcctcatctgtgtctgtagcaaaacacattccctcaaggggcttgcacgggggggtgctcaaattttctcatgtattatacctgaatgtctgcagagggctgtgcacggactgcttcactacctctttcatactaggaaccacaccttcatcgttctgcatcttgtgcttcagggaatggtgtataccgaatacacatgggaggttttcgggtactgccaagaactggaattgtccctccattacttacttctcccctacctccttctcggtgtcaatctgttttttttcactctgacctgtggaaccaatccggggatcatcaccaaggccaatgaattgttatttttgcacgtgtacgagtttgacgaggttatgtttcctaagaacgtgcgctgtagcacatgcgatctgagaaaaccagcgcgcagcaaacactgctcagtgtgcaactggtgcgttcatcggtttgaccatcattgtgtgtgggtaaataattgtatcggtgcctggaacatacgatatttcttgatctatgtcctgactctgactgctagcgccgccaccgtggctattgtgtctaccactttcctcgtgcatttagtggtcatgagtgacctctaccaagaaacgtatatcgacgacctgggccacctgcacgtaatggacacagtattcctgatccagtatttgtttctgacctttcctcgcatcgtgttcatgttaggctttgttgtggtgctgtcctttctgctcggtgggtatctgctgttcgtgctatacctggcagctacaaatcagaccacaaacgagtggtaccgtggggattgggcttggtgtcagcggtgcccacttgtcgcatggcccccatcagctgagcctcaggtgcacaggaacattcactctcacggacttcgaagtaatctccaagaaatctttctgcccgcattcccctgccacgagcgcaagaagcaggagtag

SEQ ID NO: 48054 - DNA, 1035 bp, Artificial Sequence
  Description of Artificial Sequence: Synthetic coding sequence
atggacttcctggtgctgttcctgttctacctggccagcgtgctgatgggcttggtgctcatctgcgtatgctctaagactcattccctcaagggactggcccgaggtggagcacaaattttttcctgtatcattccagaatgcctgcagagagccgtgcatggcctgctacactacctctttcacactcggaaccacacttttatcgtcctgcacttagttctgcaggggatggtctacaccgagtatacatgggaagtttttgggtactgccaggagttggaattatcactgcattacctattgttaccgtacctgctgttgggagtcaatttgtttttctttactctgacctgcggtacgaatccagggattattaccaaggcgaacgagctgctgttcctgcatgtgtatgagttcgatgaggtgatgttccccaagaatgtccgatgttccacttgcgacctcaggaagcctgctcgatctaagcattgttctgtgtgtaattggtgtgtgcacaggttcgatcaccactgcgtgtgggttaataactgcatcggcgcctggaacataaggtattttctaatctacgtccttacactgacagcatccgctgctacagtggctattgtgagcacaacattccttgtgcacttggttgtcatgtccgacctctatcaggagacgtacatagatgacctggggcatcttcatgtgatggacaccgtctttctgatccagtatttattcctgacctttccgaggatcgtcttcatgctgggatttgtggtggtgctatcttttctgctggggggctatctgcttttcgtgctctaccttgccgccaccaaccaaactaccaatgagtggtacagaggcgattgggcatggtgccagaggtgccccctagtagcctggccaccaagcgctgagccccaggtgcatcgtaatattcactcccacgggctgcggtctaacctgcaggagatcttcctgcctgccttcccttgtcacgaaaggaagaaacaggagtag

SEQ ID NO: 48055 - DNA, 1035 bp, Artificial Sequence
  Description of Artificial Sequence: Synthetic coding sequence
atggacttcctggtgctgttcctgttctacctggccagcgtgctgatgggcctagtgctgatctgcgtctgcagtaaaactcactccttgaaagggcttgcccgcggaggagcccaaatcttttcttgtatcatcccagaatgcctgcagcgagctgtccatggacttctccactatctgttccacaccagaaatcacacctttattgttctccacttggtgttgcagggcatggtgtacaccgagtacacctgggaagttttcgggtattgtcaggagctggagttgagcctgcattatttattgcttccctacctgcttctgggggtcaacctgttcttctttactctgacatgtgggactaatcccggcatcattactaaggctaatgagctcctctttctgcatgtctatgagttcgacgaagtgatgttcccaaagaatgttaggtgttctacctgtgatctgaggaagccagccagaagcaaacattgtagtgtttgtaactggtgtgtacacagattcgaccatcattgcgtgtgggtgaacaattgcatcggggcctggaatatccggtacttcctgatttacgtgttgaccctgaccgcttccgcagccacagtcgccattgtctccaccacattcctcgtgcatcttgtggtcatgtcagacctatatcaagaaacttacatcgacgatttaggacacctgcatgtgatggataccgtattcctgatccagtatctttttcttacatttcctcggatagtttttatgctgggcttcgtcgtcgtcctgtcctttttactcggcggatacttactgttcgttttgtatctggccgccactaaccagaccaccaacgaatggtacaggggcgattgggcttggtgccaaaggtgccccctggtcgcttggcctccaagcgctgagcctcaagttcatcgcaacattcattctcatgggctcaggagcaacctacaggagatcttcctgcccgcattcccttgccacgagagaaaaaagcaagaatag

SEQ ID NO: 48056 - DNA, 1035 bp, Artificial Sequence
  Description of Artificial Sequence: Synthetic coding sequence
atggacttcctggtgctgttcctgttctacctggccagcgtgctgatgggtctcgttttgatctgtgtgtgttccaagacccactctctgaagggactagcgagaggaggagcgcaaatattcagctgtatcattcctgagtgccttcagcgagccgtccacgggctgctgcattatttattccataccaggaatcatacttttatcgtactccatcttgtgctgcagggaatggtgtacaccgaatatacctgggaagtcttcgggtactgtcaggagttggagctgagcctacattacctgctcctgccctacttactgctgggtgttaacctgttcttctttactctcacatgtggaactaatccagggataatcaccaaagctaacgagctgctgttccttcacgtgtacgagttcgacgaagttatgtttccaaagaacgtccggtgctcaacctgcgacttgcgcaaacccgcacgcagtaagcattgcagtgtatgtaactggtgtgtccacaggttcgatcatcactgcgtatgggtcaataattgtatcggtgcgtggaatataagatattttttaatctacgtgctgaccctgacagcctctgctgcgaccgtggcaattgttagcacaacgttcctggtgcacttagtggtgatgtccgacctgtaccaggagacctacatcgatgatctcgggcaccttcacgtgatggatacagtgttcttgatccagtatctcttcttgacatttcccaggatcgtgttcatgctcggtttcgtggtggtcctctcttttctgttgggagggtatctgctcttcgtcctgtatctggctgctaccaaccaaaccacgaacgagtggtatcggggtgattgggcctggtgccagaggtgtcccctggtggcctggccccctagcgcagagccccaggtgcatcggaacatacattctcatggactgagatccaacctccaggaaattttcttgcccgccttcccctgccacgagaggaaaaaacaggaatag

SEQ ID NO: 48057 - DNA, 1035 bp, Artificial Sequence
  Description of Artificial Sequence: Synthetic coding sequence
atggacttcctggtgctgttcctgttctacctggccagcgtgctgatggggctggtcctcatctgtgtatgcagtaaaactcatagccttaaagggcttgctcgcggcggagcacagatctttagctgtatcattcccgaatgcttgcagagagcggtccacggcctcctgcactacttatttcacacacggaatcacacattcatcgtactgcatctggtcctgcagggtatggtttatactgagtacacttgggaggtattcgggtactgccaggaattggagctttcgctgcactacctgctgctaccttacttgcttctgggagtgaatctgtttttcttcaccctcacttgtggcaccaaccctggcatcattaccaaagctaacgagctgctcttcctacatgtatacgaattcgacgaggtcatgttccccaaaaacgtgcgttgttccacatgcgacctgcgtaagccagcaagatccaagcactgtagcgtttgtaattggtgtgtgcaccgatttgaccaccattgtgtgtgggtgaacaactgcatcggggcatggaatatccgttatttcttgatttatgtgctaaccctgactgctagtgccgctaccgtggctatcgtatctactacttttctggtccacctagtggtgatgtcggatttgtatcaggagacatatatcgatgatctgggtcacctgcatgtcatggatacagtattcctgatccaatatctcttcctgaccttccctcggatagtttttatgttagggtttgtggtggtactttcattccttctgggggggtaccttcttttcgtgctgtacctggcagccaccaatcaaaccaccaatgagtggtatcggggtgattgggcttggtgccagcgttgcccactcgtggcctggcctccaagcgctgagccccaagtgcataggaatattcattctcacgggctgcggagcaatctgcaggagatctttctgccggcttttccatgccatgagcgaaagaaacaggagtag

SEQ ID NO: 48058 - DNA, 1035 bp, Artificial Sequence
  Description of Artificial Sequence: Synthetic coding sequence
atggacttcctggtgctgttcctgttctacctggccagcgtgctgatgggccttgtgctaatctgcgtttgctcaaagactcactccttgaagggattggcgcgcggcggggctcagatcttttcatgcatcatcccagagtgccttcaacgcgcagttcacggcctcctgcactacctcttccatactcggaatcacaccttcatcgtgctgcatttggtgctccagggaatggtgtacactgaatatacctgggaagttttcggatactgtcaggagctggaactgtccttgcattatctgctcctgccctatcttctgttgggcgttaacttatttttttttaccctcacttgcggcacaaatcccgggattatcacgaaagctaatgagctgctgtttctccacgtatacgagttcgatgaggtgatgttcccaaagaacgttcggtgctcaacctgcgacctgagaaaaccagctagatctaagcactgctctgtttgcaactggtgcgtgcatcgtttcgatcaccattgcgtgtgggtcaacaactgtataggcgcatggaacatccggtacttcctgatttacgtgctgaccttgactgcctcagcagccaccgtcgctatagtcagcaccaccttcctcgtccatctagtagtcatgagtgatctgtaccaggaaacttacattgatgacctggggcacctgcatgtgatggacacagttttcttaattcaatacctgtttttgacgttccctagaatcgtgttcatgctcggctttgtggtcgttttgagttttctattgggtggatatctgctattcgtgttgtacctggcagctacaaaccagacgaccaacgagtggtacagaggcgattgggcctggtgtcagcgctgcccccttgtcgcatggcccccgagtgcagaaccacaggtccaccgtaatattcattcacacggacttagatctaatttgcaggagatattcttgccggctttcccttgccacgaaaggaaaaagcaggaatag

SEQ ID NO: 48059 - DNA, 498 bp, Artificial Sequence
  Description of Artificial Sequence: Synthetic coding sequence
atggacttcctggtgctgttcctgttctacctggccagcgtgctgatgggcctcgtcctgatctgtgtctgtagtaaaacacacagcctgaagggcctggcacgtgggggagcacaaatcttttcatgtattatccccgaatgcctgcagcgggctgtccatggtttgctgcactacctttttcataccaggaatcacacttttatcgttctgcacttggtgctacagggaatggtttatacggagtacacttgggaggtgtttggttattgccaggagctggagctctcattgcactatctccttctgccatacttgctcttaggcgtaaatctcttcttcttcacgctgacctgtggcactaatcccggtattatcacgaaagccaacgaactgctgttcctccatgtgtatgaattcgatgaagtcatgttccctaagaatgtgagatgtagcacatgtgacctgagaaagcctgctcgcagcaagcactgttag

SEQ ID NO: 48060 - DNA, 2148 bp, Artificial Sequence
  Description of Artificial Sequence: Synthetic coding sequence
atgcccgccgagagcggcaagcggttcaagcccagcaagtacgtgcctgtaagcgcagccgccatcttcctggttggagccaccacactctttttcgcattcacatgtccaggtctctctctgtatgtttcccccgccgtgccaatctacaatgctatcatgttcctcttcgtgcttgcaaatttttctatggccacgttcatggatccaggtatctttccccgagccgaggaggatgaagacaaagaggatgattttcgggcccccctgtataaaaccgtagagatcaagggcatccaggtgagaatgaagtggtgcgctacctgtcgcttctacagacccccacggtgcagtcattgctctgtctgtgataattgtgtggaggagtttgatcatcactgcccttgggtgaacaactgtataggaagaaggaactatagatatttcttcctttttttgctgagtctaaccgcccatattatgggcgtcttcggatttgggctgctgtacgtgctataccacatagaggagttaagcggcgtcagaacagcggtgaccatggctgtgatgtgcgtggccggactgtttttcatccccgtggccggccttactgggtttcatgtggtcttggttgcaaggggcagaacaacgaatgagcaggtgaccggcaagtttagagggggggtgaatccctttaccaatggatgttgtaataacgtgtcgagggtgctgtgctctagccccgccccgaggtatctggggcgccctaagaaagaaaagaccatcgttataaggcccccgtttctgcgaccagaggtgagcgatgggcagataacagtgaagatcatggataacggaatccagggagagctgcgcagaaccaagagcaaaggttctcttgagatcaccgagagccagtcagccgatgccgagccgcctccaccaccaaaaccagatctgagtagatacaccgggttgagaacacacctcggtctagccaccaatgaggactcttcactactagcgaaggactcacccccgactccgactatgtataaatatcgaccaggctactcctctagctctacatcagcggcaatgcctcactcgagtagtgcaaaattgagcagaggagattctctgaaggaacctacctcaatcgctgagagctcaagacaccccagctaccgctccgagcccagccttgaaccagaatctttcagaagtcctacctttggaaagagtttccacttcgatcctctcagctccgggtccaggtcctcttcactgaaatctgctcagggaaccgggttcgagctgggacagcttcagtctattcgctccgagggcaccacaagcactagttacaaatctcttgcaaatcagacaaggaatgggagtttgtcctatgacagtttgctgacgccatccgacagccctgatttcgagtctgtgcaggcaggaccagagcccgacccccccttaggctataccagcccctttctgagtgccagacttgcgcagcagagagaagccgaaagacatccccgcttggtgcctacaggtcctacgcacagagagccaagtcctgtcaggtatgataacctctctcgtcacattgttgcttccttacaagagcgggaaaaattgctgcgacagtctccacctcttccaggcagagaggaagaacctgggctaggcgactcgggtatccagtctaccccgggtagtggacacgccccccgtactagctcgagctccgacgatagcaaacgaagccctctgggtaaaactcccctgggcaggcctgcggtcccgagatttgggaaaccagacggccttagaggacgaggggtgggctccccggagccagggccaaccgccccctatctgggtcgatccatgtcgtactcctcccagaaggcgcagcccggcgtgtcagagaccgaggaggtggcactccagccccttctgaccccgaaggacgaggtgcagcttaaaactacctacagcaagtcaaacggacagcccaagagtctgggctctgcctccccaggacctgggcaaccaccattgtcatcccctaccagagggggtgttaagaaggtctcaggagtagggggtaccacctacgagatctccgtgtag

SEQ ID NO: 48061 - DNA, 1989 bp, Artificial Sequence
  Description of Artificial Sequence: Synthetic coding sequence
atgttcctgttcgtgctggccaacttcagcatggccaccttcatggatcccgggatcttccctcgtgccgaggaggacgaagacaaagaggatgacttccgcgccccactgtacaagacagtggagatcaaaggtatccaggtccggatgaaatggtgcgccacgtgcagattttatcggccccccaggtgttcgcattgttccgtatgcgataactgcgtggaagaatttgaccatcactgcccttgggtcaacaattgtataggccggcgcaattatcgctatttcttcctgttcctgttaagtctgaccgcccacatcatgggggtcttcggcttcggactactgtacgtgctgtaccatatcgaagaactatccggagttcgcaccgccgtgacaatggccgtgatgtgcgtcgccggcctgttttttatccctgtcgccggtctgacaggtttccacgttgttttagtggccagggggcgaacgaccaacgagcaggtgaccggcaaattcagaggaggggtgaacccattcactaacggctgctgcaacaacgtgagtcgggttctatgcagttcacctgcacctcggtatctgggtaggcctaaaaaggaaaaaaccattgtaattcggcccccctttcttcgaccagaagtgagtgacggtcagatcactgtcaaaattatggataacggaattcagggcgaactcagacgtactaagtcaaaaggaagtctggagattaccgagtcacagtctgcagacgccgagccacccccaccccccaaacccgacctttcccggtacacgggtctgaggacgcatctggggttggcaactaatgaagactcttctctcctggcaaaagatagcccccctaccccaactatgtataaatatcgacccggctattcctctagtagcacctccgctgccatgccccattcatcgagcgccaagttgtcacggggagacagccttaaagagcctacttcaatcgcagagagctctaggcacccttcatacagatccgaaccttcactcgaacccgaatctttccgatccccaacattcggaaagtcattccatttcgatcccttgtcatccgggtctcgctcatcaagcctgaagagcgctcagggcaccggcttcgagctgggccagttacaatcaattcggtctgaaggaacaacttccacttcgtataaaagcttagccaatcagacaaggaacggatctctttcttacgatagccttttaacgccgagtgatagccccgacttcgaaagtgttcaggcagggcctgagcccgacccccctcttggctataccagcccttttttgtccgctagactggcccagcagcgcgaggcagagagacatcctcggctggtccccaccgggccaacccatcgggagccttcccctgtgcgctacgataacctgagccgccacatcgtcgcctccttgcaggaacgcgagaaattactgaggcagagcccccctctgcctggtcgagaagaggagccggggctgggggattccggaatccagtcaactccaggatccggtcatgccccacggaccagtagcagttctgacgattctaagcggtcaccgcttggaaagacacctctgggccggccagccgttccccggttcggtaagcccgatggtctaagaggaagaggtgtgggtagtcccgagccaggacccaccgccccctatttgggacgtagcatgtcctactcatcacagaaagcacagccaggtgtgagcgagacggaagaggtagcactccaaccacttcttacccctaaggatgaagtccagttaaaaacaacttatagtaagagtaatgggcagccgaagagcctgggctcggcctccccgggaccgggtcagcctccactgagctcccccacaagaggcggcgttaagaaggtgtctggggtaggcggcactacttacgagatttctgtttag

SEQ ID NO: 48062 - DNA, 1230 bp, Artificial Sequence
  Description of Artificial Sequence: Synthetic coding sequence
atgggcaccttctgcagcgtgatcaagttcgagaacctgcaggagctgaaacggctgtgccattggggccccattatcgcattaggtgtgatagctatctgctcaaccatggcaatgatagattctgttctgtggtactggcccctccataccacaggcggatctgtgaatttcatcatgctcataaactggaccgtgatgattctctacaattatttcaatgcaatgttcgtgggacccgggttcgtgcccttggggtggaagcccgatacgatgtacctgcaatattgcaaggtgtgtcaggcctataaggctccccggtctcatcattgcaggaagtgtaataggtgcgttatgaagatggaccaccattgcccctggattaataattgttgtggttaccagaatcacgccagttttactttatttctgttacttgcgccacttggatgtatccacgcagcatttatattcgtaatgaccatgtatactcagctgtaccacaggctcagcttcggatggaatacagtgaagatcgacatgtccgccgctcgccgagatcctctgcccatcgtgccattcggactggccgctttcgccacaaccttgttcgctttaggtctcgcactggggacaactatcgctgttgggatgctttttttcattcagatgaaaatcattttacgaaataagacttccatcgagtcttggatagaggagaaagctaaggatcggatacaatactatcaactggatgaggtttttgtgtttccatacgacatgggctctcgctggcgaaactttaagcaggtgtttacgtggtcaggtgttcccgagggcgacggtctggaatggccagtaagagagggttgtcatcagtatagtctgactatcgaacagctgaagcagaaggcagataagagagtccgctctgttcgctacaaagtcatagaggattacagcggtgcctgctgccctctgaacaagggcattaaaactttcttcacctctccctgtaccgaagaacctcggatccagctgcaaaaaggtgagtttatcctggctacaagaggccttagatattggttatacggggacaagatcctcgacgatagcttcattgaaggcgtgagtcgtataaggggttggttccctagaaagtgtgtcgagaagtgcccatgtgacgccgagacagaccaagctcctgagggcgaaaagaagaacaggtag

SEQ ID NO: 48063 - DNA, 1242 bp, Artificial Sequence
  Description of Artificial Sequence: Synthetic coding sequence
atgggcaccttctgcagcgtgatcaagttcgagaacctgcaggagctgaagcgcttgtgtcactggggccccattatagcgctaggagtaatcgcaatctgttcaaccatggcgatgatcgacagtgtgctctggtattggccacttcacactacgggcggctcggtaaacttcataatgctgatcaattggacggttatgatcctttataactattttaacgcgatgttcgtgggccccgggtttgtcccccttggctggaaaccagagatcagtcaggacacaatgtacctccagtattgcaaggtgtgtcaggcttataaggcccccaggtctcatcactgcaggaagtgcaaccgttgtgtgatgaagatggatcaccactgcccctggataaataattgctgcggttaccagaatcacgcctccttcacactttttctgctcctggcccccctcgggtgtatccatgccgcatttattttcgtgatgacaatgtacacgcagctttaccataggctctccttcgggtggaacaccgtcaagatcgacatgagcgccgcccgccgagaccctctccctattgtgccattcggactcgctgccttcgccactactctttttgcgcttggtctggccctgggaacaacaatagccgtcgggatgttatttttcattcagatgaaaatcatattgagaaataaaacgagcatcgagtcatggattgaggaaaaagctaaggaccgaatccaatactatcagttggacgaagtgtttgtattcccttatgatatggggtcacggtggagaaatttcaagcaagtgttcacttggtccggcgtcccagaaggtgatggcctcgaatggcccgtccgggaaggctgccaccagtactcactgacaatcgagcaactgaagcagaaggccgataagcgggtgcggtcagtgaggtataaagtcatcgaggactactccggggcctgttgccccctcaacaaggggataaagacgttcttcaccagtccctgcaccgaggaaccgcgaatccaacttcagaagggcgagttcatactggctacaagagggctgcgatattggctgtacggcgataaaatcctggatgactcatttatcgagggcgtttctcgtatcagaggctggtttcctcgcaagtgcgtggagaaatgtccatgcgatgctgagaccgatcaggccccagaaggcgaaaaaaaaaaccgctag

SEQ ID NO: 48064 - DNA, 927 bp, Artificial Sequence
  Description of Artificial Sequence: Synthetic coding sequence
atgcagcccagcggccaccggctgcgggacgtggagcaccaccccttactggccgagaacgacaactacgattcctcctcttcttcaagttctgaggctgatgtggctgaccgcgtgtggtttattagggatgggtgcggcatgatttgcgcagtgatgacttggctcttggtcgcctatgccgattttgtcgtgacattcgtgatgttactacccagtaaagacttctggtactctgtggtaaatggagttatattcaattgcctcgccgtgttggcactgtcatcccatctacgaaccatgctgacagatcccggagccgtccccaaggggaatgctaccaaggagtacatggaaagtctgcaactgaaaccgggcgaagttatctacaagtgccctaagtgttgctgtataaagcctgagagagcgcatcactgctccatctgtaagcggtgtatacggaaaatggatcatcactgcccttgggttaataattgcgtgggcgaaaagaaccagagattttttgtcctttttacaatgtacattgctttaagttccgttcacgctctgatactttgcggattccagtttatctcgtgtgtgagaggacagtggacagagtgctccgatttctctccccccattacagtgatccttctgatctttctgtgtctggagggactgctcttttttacatttactgccgttatgtttgggacacagatccactcaatctgtaatgatgagacggagattgagcgacttaaatccgagaagcctacctgggaacggcgattgagatgggaaggaatgaagtcagtgtttggtggtcctccttccctgctgtggatgaaccccttcgttggcttcaggttccggcgtctgcccactaggccacgtaagggcgggcctgaattttctgtgtag

SEQ ID NO: 48065 - DNA, 1038 bp, Artificial Sequence
  Description of Artificial Sequence: Synthetic coding sequence
atgcagcccagcggccaccggctgcgggacgtggagcaccaccccctcttagcagaaaatgacaactacgactcctcttcctcctccagcagtgaggcagatgtggctgacagagtctggttcatccgtgatgggtgcggcatgatctgcgccgtgatgacttggctgcttgtggcttacgcagatttcgtggtcacatttgtcatgctccttccctctaaggatttttggtactctgtggttaatggcgtgattttcaactgccttgctgtcctggctctcagctcccatctaaggactatgcttactgatcctgagaagtcttccgattgtaggcctagcgcctgtacagtaaaaaccggtctggaccccacgttggttgggatatgtggcgagggtacagagtccgtgcagagcctgctcctgggggccgtgccaaagggaaatgccacaaaagaatatatggagtcactgcagctgaagcccggggaggtcatttacaaatgccctaagtgctgttgtatcaaaccagagagggcacaccattgtagcatttgcaagcgctgtattcgcaaaatggatcatcattgcccttgggtgaataattgtgtcggcgaaaagaaccagcgtttttttgtactgtttacaatgtatattgctctgtcttctgtccacgccctaattctgtgcgggttccagttcatcagctgcgtaagaggccagtggacagagtgctccgatttttcaccacccattacggtgattttattgattttcttgtgcctggagggcttgcttttttttacttttacagccgtcatgttcggaacacagatccatagtatttgcaatgatgagacagagatcgaaagactcaagagcgagaagcccacatgggagcgcaggctgcgatgggaagggatgaaaagtgtttttgggggccctcccagcctcctatggatgaacccattcgtaggctttaggttccggcggttgcccacaagacctcgaaaaggggggcctgaattttctgtgtag

SEQ ID NO: 48066 - DNA, 4620 bp, Artificial Sequence
  Description of Artificial Sequence: Synthetic coding sequence
atggacagctacttcaaggccgccgtgagcgacctggacaagctgctggatgattttgaacagaatcctgacgagcaggactacttacaggatgtccagaacgcttacgacagcaatcactgctcagtctcatccgagctggccagcagccagcgaactagcctgctgcccaaagatcaggagtgtgtcaacagttgtgcaagtagcgaaacctcgtatggcactaacgagtcctctctcaacgagaagacccttaaaggactgacctctattcagaatgagaaaaatgttaccggcctggacctgctgagttccgttgacggagggactagtgatgagatacaacctctctatatgggtcgttgctctaagcctatatgtgaccttataagcgatatgggaaacttggtccacgccacaaattcggaggaagacatcaagaaactgcttccagatgactttaaaagcaatgctgactctctcatagggcttgacttatcttccgtgtctgataccccatgcgtcagttcaaccgatcatgattccgacacagttagggaacagcaaaacgacatttcatcagagctgcagaatagggaaatcggaggaataaaagagctggggatcaaggttgatacgaccctttccgattcgtataactatagtgggaccgaaaatctgaaagataaaaagattttcaatcagctggagtctatcgttgactttaatatgagctccgcacttacccggcagtcctccaaaatgtttcatgctaaagacaaattgcagcacaagagtcagccatgtggccttctgaaggacgtagggctggtgaaagaagaagttgatgtcgcagtgataactgctgcagagtgcctgaaagaagaaggtaaaaccagtgctttgacctgctcccttcccaagaatgaggacctgtgccttaacgactcaaattcacgggacgagaatttcaagttacccgacttttcttttcaggaagataaaaccgttattaaacaatcagctcaagaagattctaaatccctggacctcaaggataacgatgtgatccaggactccagttctgcactgcacgtgtcaagtaaggacgtgcctagttcccttagctgcttacctgcttcagggtctatgtgtgggagcctcattgaaagcaaggcccgcggcgatttcttaccgcagcacgaacataaagacaatatccaggacgccgttaccatccacgaggagattcagaacagcgttgtactgggcggcgagccatttaaggaaaacgaccttctcaaacaggagaaatgtaagtcgatcctccttcagagtctcatagagggcatggaggatcggaagatcgaccctgatcaaacagtgatccgggcagagtctctcgatggaggagatacatcaagtaccgttgtagagagccaggaaggactgtccggaacgcatgtccctgagagtagcgattgttgcgagggctttataaatactttttcctctaatgacatggacggacaagacctcgattatttcaatattgatgagggtgcgaagagcggtccgttaattagtgatgccgaacttgacgcctttctgacagagcaatacttgcaaactactaacatcaaatccttcgaggaaaacgtgaacgacagcaagagccagatgaatcagatcgatatgaaaggacttgatgacgggaacattaataacatttacttcaatgccgaggcgggagccattggtgagtctcacggtatcaacattatctgtgagatagttgataagcagaataccattgagaacggactttcactgggcgaaaaaagtacgataccagttcagcagggcctcccaactagtaagagcgagataactaatcagctaagcgtaagcgacataaattcacaatctgttggtggggctcgccccaaacagctgttttcgctgccttctcggactcgtagttccaaagacctcaacaaacccgacgttccggatacaatcgaaagtgagccctccaccgcggacactgttgtccccatcacatgtgcaattgattcgaccgctgatccccaggtctcattcaactcaaattacatcgacatcgaatctaattccgaaggagggtcctcattcgtcaccgctaatgaagactctgttccagaaaatacatgcaaggagggacttgtgctgggacaaaagcagccaacgtgggtgcccgattctgaagcacccaattgtatgaactgccaggtaaaatttacctttaccaaaaggagacaccattgtcgcgcatgcggtaaggttttttgcggagtctgctgcaaccgaaagtgcaaactgcagtatctggaaaaggaggcgcgggtatgcgtcgtgtgttacgagaccatttcgaaggcgcaagccttcgagaggatgatgtctccgaccggatcaaacctcaagtccaatcattccgacgagtgcacaactgtgcagccccctcaggagaaccaaacctcttcaatccctagtccagccaccctccccgtgtccgcactgaaacaacccggcgtggagggactctgttcgaaggagcagaaaagagtgtggtttgctgacgggatcctgccaaatggggaagtggccgatactacaaaattgagcagcggcagcaagaggtgtagcgaagacttttcaccgctgtcaccagacgtccccatgacggtgaacacagtggatcactctcattccacgacagtagagaagccaaacaacgagaccggagatataacccgcaatgagatcatccagtctccaatctcacaggtcccctcagttgaaaaattgtcaatgaacaccgggaatgaggggctgccaacgtcaggttcgttcactcttgatgatgatgtgttcgctgaaactgaggaacccagtagccctaccggtgtccttgttaactcaaacttaccaattgcctccatttcggactaccggctgctctgtgacatcaacaaatacgtctgcaacaaaatatcactgctcccaaacgatgaagattcgcttccacctcttttggtagcttccggagagaaagggtctgtccccgtggttgaggagcaccctagccacgagcagattatcttgcttctcgaaggagagtcctttcatcccgttacattcgtcctaaacgcaaatctgctggtgaatgttaagttcatattctactcttcggacaaatactggtactttagcaccaacggattgcatggattgggacaggctgaaattattattctgctcctgtgcctgccaaatgaggacacaataccgaaggacatattccggctgttcattacgatttataaggacgctctcaaagggaaatatattgaaaatctagataacatcacatttactgagtcctttttgagtagcaaagaccatggcggatttctgttcattacacccaccttccagaagctggatgatttgagcctcccctctaatccctttctgtgcggcatcctcatccagaagctggaaataccatgggccaaggtgtttcctatgcgactgatgctgaggctgggggcagagtacaaagcctatccagctccccttacttctataaggggacgaaagcccctatttggcgagatcggccatacaatcatgaaccttttggtcgatctgaggaattaccaatataccctgcataatatagaccagctactcatacacatggaaatggggaaaagctgtatcaagattccgcgcaaaaaatactccgatgtgatgaaggttctaaattcatccaacgagcacgtgatttccattggcgcatctttttccactgaagccgacagtcatctggtgtgcattcaaaacgatgggatctacgagacacaggccaactcagctactgggcatcctcggaaagtgactggagcttccttcgtggtgtttaatggtgctttgaagacatccagtggctttcttgctaaatcttctatcgtggaggacggactgatggttcagatcacaccagaaactatgaatgggcttcggttagctctcagggagcagaaagacttcaagatcacttgcggcaaggtggacgcagtggacttaagagaatatgttgatatttgctgggtcgatgccgaagagaagggcaacaagggcgtgatatcatcggtggatgggatctccttacaaggctttccctctgagaaaatcaagctcgaggctgacttcgagactgatgagaaaattgttaaatgtactgaggtcttttacttcctgaaagaccaggatcttagcatcttgagtacctcctatcagtttgcaaaggaaatcgctatggcctgttcggccgctctgtgcccccatttaaagaccttaaagagcaacggcatgaataaaattggccttcgggtcagcatagataccgatatggtggaattccaggctggcagcgaaggccaactgcttccacaacattacttgaatgatctggacagcgctttaataccagtgatccacggagggactagcaactcatctttacctctagagattgaactggtctttttcatcatagagcacttgttctag

SEQ ID NO: 48067 - DNA, 4620 bp, Artificial Sequence
  Description of Artificial Sequence: Synthetic coding sequence
atggacagctacttcaaggccgccgtgagcgacctggacaagctgctggacgactttgagcagaatcccgatgagcaagactacctgcaggatgtacagaacgcctatgattcaaaccactgttctgttagctcagaattggcctcatcccaaaggaccagcctcctgcctaaggaccaagagtgtgtgaactcatgcgcatcttccgaaaccagttacggtaccaacgaatcatctctgaatgagaaaactcttaaggggctcacttccatccagaatgagaaaaacgttacgggtctcgacttgctcagttcagtcgacggcggaacctcggacgaaattcagccactgtatatgggacgctgcagcaagccaatttgcgatctgatatcagacatgggcaatctagttcatgctactaactcagaggaagatataaaaaaactacttcctgatgactttaagtctaacgcagactccttgattgggctggacctctcttccgtttcggacaccccgtgtgtgtcttccactgatcacgactcggatacagttcgggaacagcaaaatgacatcagttctgaacttcagaatcgcgagattggcggaattaaagaactcgggattaaggttgacacaaccctgtctgactcatataattactctgggaccgagaacttaaaggacaaaaagatttttaaccagttggaatcaatagtggattttaatatgtcgagcgctctgactagacagagcagcaagatgttccatgccaaggataagttgcagcacaaatcacaaccttgtggcctgttaaaagacgtagggctagtaaaggaggaggtggatgtggccgtgatcacggcggctgagtgcctaaaagaggaagggaagacctcagccttaacgtgttccttgccaaaaaacgaagacctatgcctgaacgacagtaattctagggacgagaatttcaagctccctgatttctcattccaggaggacaagaccgtcatcaagcagtcagctcaggaagactctaagtccctggacctgaaggacaatgatgtaattcaggacagcagttccgccctgcacgtaagttccaaggacgtgccatccagtctgtcttgtctacctgcctctgggtcaatgtgtggttctctgatcgagtccaaggcccggggggacttcctgccacagcacgaacacaaagacaacatccaggatgccgtgactatccatgaggagattcagaacagcgtggttctgggaggcgaaccatttaaggaaaatgatcttttaaaacaggagaagtgcaaaagcatccttctgcagtctctgattgaaggcatggaggatcgaaaaattgaccccgatcagaccgtgatccgcgcggaatccctggacgggggcgacaccagcagcacggtggtcgagtcccaagaagggctgagtggcactcacgtgcctgaatcatccgattgttgcgaaggcttcattaatacattctcctccaacgacatggacgggcaggacctggactactttaacatcgatgaaggagcaaagtccggccccctgatctccgacgctgagctggatgccttcctgacagaacagtacctgcaaaccaccaacatcaaatcattcgaagagaatgttaacgactctaagtcccagatgaatcaaatcgacatgaaagggctggacgatggcaatataaacaacatctatttcaacgccgaagctggagctattggcgagtcccacggcattaatattatttgcgaaattgtagataagcagaacaccatagaaaacggcctctctttgggtgaaaagagcacgattcccgtccagcaggggctccctacgtcgaaaagcgaaatcacaaaccaattgtccgtgagcgacatcaattcccagtccgttggcggggcccgtccaaagcaattgttttctcttccatcaaggacccggtcatcaaaagacttgaacaagccggatgtgccggacaccatcgagtcagaaccttcaactgctgacacggtggtcccaatcacgtgcgctattgatagcaccgccgatccccaggtgtcattcaattccaattacattgatattgagtcaaactccgaggggggatctagtttcgttaccgctaacgaggattccgttcccgaaaacacatgcaaagagggcctagtgctgggacagaaacaaccaacatgggtccccgatagcgaggcccccaattgcatgaattgtcaggtgaagttcacgttcacaaagcgccggcatcattgcagagcctgcggtaaagtgttctgcggtgtgtgttgtaatcgaaagtgcaagttgcaatatctcgagaaggaggctagagtatgcgtggtgtgttacgagactatcagcaaagcccaggcatttgagcgaatgatgagcccgactggttccaatctgaagtcaaaccactcagacgagtgtacaacagtccaacctccgcaagaaaatcagaccagttccataccgtcccccgccaccctgccagttagcgccctgaagcagcccggtgtagaaggactttgtagcaaggagcaaaaacgggtgtggttcgccgatggcatcttaccaaacggcgaggtagcggataccaccaagctgagtagtgggtccaagcgatgttcagaagacttctcacctctgtctcccgacgtgccgatgactgtcaatactgtagaccattctcattcaaccactgtggagaaacccaacaacgagacgggtgacattacgaggaacgaaataatccagagtccaatttctcaggtaccaagcgtcgagaagctgagcatgaacaccgggaatgaagggctgcctacgtccggatcctttactcttgatgacgacgtctttgccgaaactgaggaacctagctcccccaccggcgtgttagtcaacagtaatcttccaatagcttcaatatcagactatcggctgctgtgcgatattaataagtacgtatgcaataagatcagtctcctgcccaacgatgaagactctctcccccccctgctggtcgcatccggtgaaaaaggatccgtgccagtggtggaggagcaccccagtcatgagcagatcattctcctgctcgagggagagtcctttcatcccgttacctttgtgctcaacgccaacctgctagtcaacgtgaaattcatcttctactcatcggataaatattggtattttagcaccaacggtctgcacggactgggacaagcagagataatcatactgttgctgtgtctaccaaacgaagatactatcccaaaggatatatttaggctgttcatcaccatttataaagatgcactcaagggcaagtatatcgagaacctcgataatatcacattcaccgagtcctttttaagctctaaagatcacgggggatttttgttcatcacaccgacctttcagaagctggacgatctatctctgcctagcaacccttttctttgcgggattcttatccagaaactggagataccatgggcgaaagtgtttcctatgcgtctgatgctaagactaggagccgaatacaaggcgtacccggctccattgacaagtattcggggacgcaaaccactttttggggagattggtcataccattatgaatttgctggtcgatctgagaaactaccagtacacccttcacaatattgaccagctgttgattcacatggaaatggggaagtcttgtatcaaaatccccagaaagaaatactccgacgtgatgaaagtgctcaacagttctaacgagcacgttatcagtatcggggccagtttttcaacagaggcagattcccatctggtttgcattcaaaacgacggaatctacgaaacgcaggctaactctgccacggggcaccctagaaaggtcacgggcgcctcttttgttgtttttaacggggccctgaaaacgtcgtcaggattccttgccaaaagctctatcgttgaagatggattgatggtccagattaccccagagacgatgaacgggctgaggctcgccctgagggaacagaaagactttaaaatcacctgtggcaaagtggacgctgtagatctacgtgagtacgtcgatatctgctgggtggacgctgaagagaagggaaataaaggagtgatttcatccgtggacggaatcagcctacaagggtttccatcagagaaaatcaaactggaggcggacttcgaaactgacgagaaaattgtcaagtgcacagaggtgttctacttcctaaaggatcaagatctgtccattttatcaaccagttatcagttcgctaaggaaatcgccatggcttgtagcgccgcactgtgtccccatctcaaaacactcaagtccaacggaatgaataaaatcgggctgagggtgagcattgacactgacatggtcgaattccaggccgggtcagagggacagctcctcccacagcattaccttaatgacttggactccgccctgatccctgtgattcacggtggtacaagcaactcaagtctgccactggagattgagctcgtgttttttattattgagcatcttttttag

SEQ ID NO: 48068 - DNA, 4620 bp, Artificial Sequence
  Description of Artificial Sequence: Synthetic coding sequence
atggacagctacttcaaggccgccgtgagcgacctggacaagctgctggatgatttcgagcagaaccccgatgagcaagattacctacaggatgtccaaaatgcctacgattccaaccactgttccgtttcatcagaattggcgtcaagccagaggacatccctcctccccaaagatcaagaatgcgtgaactcctgcgcctctagcgaaaccagctacggcactaacgagagtagcttaaatgaaaagactttaaaaggtctgactagtattcaaaacgaaaagaacgtgaccggacttgatctgttgtccagcgttgacggcggaaccagtgacgagatccagccactttacatgggccggtgctccaagccaatctgtgacctgattagcgacatgggcaatctggtacatgctacaaacagcgaggaagacattaagaagcttctgcctgacgactttaagtctaacgcggactctctgatcggccttgacctgagcagtgtgtcggatactccatgcgtatctagtaccgatcatgacagcgataccgtgcgcgagcagcagaatgatatctcctcagagctgcagaatagagagatcggaggtattaaggaactagggatcaaggttgatacgacattatctgattcttataattactccgggaccgagaatctgaaagacaagaagatcttcaatcagctggagtccattgtcgattttaatatgtcctccgccctgaccaggcaatcatccaaaatgtttcacgccaaggataagctccagcacaaaagtcagccgtgtggactgttgaaagatgtcgggctcgtgaaagaagaggtcgacgtggccgtgattacagctgcagaatgtctgaaggaggagggaaaaacctccgccctgacctgcagcctgccaaagaacgaagacctgtgcctgaacgattccaacagtcgagatgagaattttaagttaccagatttttcttttcaggaagacaaaacagtcattaagcagagtgcccaggaagattccaagtccctggatcttaaggataacgatgtgatccaggactccagttcagctctgcacgtcagtagcaaggacgtgccttcctccctgagctgtttaccggccagtggatcgatgtgcggatctctgattgagtctaaggcgcggggggacttcctgccacagcatgagcacaaagacaatatccaggacgccgttacgattcacgaggaaattcaaaattccgttgttctgggcggagaaccgttcaaggagaatgatctgctgaaacaagagaaatgcaaaagcattctgctacagtcactgattgagggtatggaggaccgcaagattgaccctgaccaaaccgtgatcagggctgagtcactggatggcggcgatacttcctcaacggtggtggagagtcaggagggactgtcgggcacacatgttccagagagttcagactgttgcgaagggtttattaataccttctcctcaaatgacatggatggccaggatttagactatttcaacatagacgaaggggcaaagagcggtcccctgatctctgacgccgagttggatgcattcctgacggagcagtacttgcaaactaccaacataaagagctttgaagaaaacgtgaacgatagtaagtcccagatgaatcagatcgacatgaagggcctggacgatggtaacattaataatatttactttaatgccgaagctggagcgatcggcgagagccacggtatcaacatcatttgtgaaattgtggataaacagaacaccatcgaaaacgggctgtccctaggtgagaagtcgacgatcccagtgcaacaaggactcccaacaagcaaaagtgagattaccaaccagttatctgtgagtgatatcaactcccagtctgtcgggggcgcccgtcctaaacagttgttttccctgccctcgcggacccggagcagcaaggatcttaacaagccggacgtgccggacactatagaatctgagccctctaccgcagacaccgtggtcccgatcacatgcgctattgacagcacagctgatccccaggtgtccttcaactccaactatatcgatatcgaatctaactccgaaggcgggtcaagcttcgtgactgcaaatgaggattccgtgccggagaatacctgcaaggaggggttggtccttgggcagaaacagcccacctgggtgccagacagcgaggctcccaactgcatgaactgccaggtaaagttcacttttacgaagagacggcatcactgccgcgcttgtgggaaagtgttctgtggagtgtgttgcaaccgtaagtgcaaactgcagtacttggagaaagaggctcgcgtttgcgtggtgtgttatgagacaatttctaaggctcaggcctttgaaaggatgatgtccccaactgggtctaacctgaaaagtaaccactctgatgagtgtacaactgtgcaaccaccccaagagaatcaaacatcttccattcctagtcccgcgacactgcctgtgtccgctctgaagcagccaggcgtcgagggtctatgtagtaaggaacaaaaaagggtttggttcgccgacgggatcttgcccaatggggaggtggctgacacgacaaagctgtcatcgggttccaaacggtgttctgaggattttagccctctgagcccagacgtaccaatgactgtcaatacagtggaccacagtcattcgactacagtggaaaagccgaataacgagaccggtgacatcaccagaaacgagataatccaatcccctatcagccaggtgccaagcgtggaaaagttgtcgatgaatactggcaatgaaggcttaccgacatctggcagctttactctcgacgatgacgtgttcgccgagactgaggagccatcttcgccaacgggggtccttgtaaattccaatttaccaatcgcctccataagcgactaccgactgttatgtgatatcaacaaatacgtctgcaacaaaatcagccttttgcctaatgacgaggacagcttgccaccgttgttggttgccagtggcgagaaagggagtgtgcctgtggtggaagagcatccaagtcatgagcagataatattgctcctggagggggagtcctttcaccccgtcacgtttgtcctgaacgctaacctgctggtgaatgttaagtttatcttctacagcagcgacaagtactggtacttttccacaaacgggcttcacgggctcggacaggcggagatcatcattctgctgctctgtctccctaatgaggatactatacctaaagatatttttaggctatttataactatttacaaggacgctctgaagggaaagtatatcgagaatctcgataacataacattcactgagtcctttctgagtagcaaggatcacggagggttcctgtttattactccaacctttcagaaattagatgatctgagtctcccttccaatccattcctttgcggcattttaattcagaaactcgaaatcccatgggccaaggttttcccaatgcgcctcatgcttcgcctgggcgctgagtataaggcttaccccgcacccttgactagcataagaggcagaaagcctcttttcggtgagatcggccacaccatcatgaatctcctggtggatcttcgcaattaccagtatacattacataacatagatcagctgctgatccacatggagatgggcaagtcgtgcatcaaaataccccggaaaaagtattctgacgttatgaaagtgttgaatagttccaatgagcatgtaatcagcattggcgcatctttcagcactgaggccgattcacatttagtgtgcatccagaatgatggcatctatgagactcaggctaactccgctactggccatccacggaaagtgacaggtgcatcctttgtcgtgtttaacggtgcgctgaaaacctcatctggattcctggccaagtctagtatcgtggaggacggcttgatggtgcaaattacacccgaaactatgaacggccttcgcttggctttgcgggaacagaaggatttcaagatcacctgcggcaaagtggatgcagtagacctgcgagagtatgtggacatttgctgggtcgatgccgaggagaagggaaacaaaggtgtgattagctctgttgacgggatctcccttcagggatttccaagcgaaaagatcaagctggaggctgattttgagactgatgaaaagatagttaagtgtactgaggttttttatttcttaaaggatcaagatctcagtattttgagcacttcctatcagttcgctaaagagatcgctatggcctgctcagccgctttgtgcccccatttgaaaacattaaagtccaacggtatgaataaaattgggctgagggtctccatcgacacagacatggtcgaattccaggctggatcagaggggcagttgttaccacagcactacctgaatgacctggattccgcgcttatccctgtaatccacggtggcacatcgaatagtagcttgcctcttgaaatagagctggtattctttatcatcgaacatctgttctag

SEQ ID NO: 48069 - DNA, 2355 bp, Artificial Sequence
  Description of Artificial Sequence: Synthetic coding sequence
atggccagcctggacgaccccggcgaggtgcgggagggcttcctgtgcccactctgtctgaaggatctgcagagtttctaccaattgcactcccactatgaagaagaacattcaggggaagacagagatgtcaaaggacagattaagtccttggtccagaaggcgaaaaaggcaaaggatagacttctaaagagagaaggcgacgaccgcgccgagagcggcactcagggctatgagagctttagctacggcggcgtcgatccctacatgtgggaaccacaggagctaggggcagttaggtcccatctctccgatttcaagaagcacagggcagccagaatcgaccattatgtggtggaggttaacaagttaattattaggcttgagaaactgacagcctttgaccgtacaaatactgaatccgctaaaattagagctatcgaaaaatccgtggtcccatgggttaatgatcaggatgttcccttctgcccagactgcggcaacaaattttccattagaaatcggcgccaccattgccgcttgtgtggctctataatgtgtaagaaatgtatggaattgatttctctgccgttggctaacaaactgactagcgcttccaaagaatcactctccactcatacgtctccttctcagagcccaaattccgtgcacgggtctcggagagggtccatttcatcaatgtcttccgtgagctcggttctggatgaaaaggacgatgacagaatccgctgctgcacgcactgcaaagataccctgctcaaaagagagcagcagatcgatgagaaggaacataccccagacattgttaagctgtatgagaagctgcgactctgcatggaaaaggtggatcaaaaggctcccgagtatatcaggatggctgctagcctcaacgccggggagaccacttattccctagaacacgcttcagacttacgcgtggaggtgcagaaggtgtatgagctcatcgacgccctatctaagaaaatcctcacattgggcttaaaccaagatccacctccacaccctagtaatttgcgactacagcggatgatcaggtattccgccacactctttgtgcaagagaagcttctgggcttgatgagcctgcctactaaagagcagttcgaggaactgaaaaagaagaggaaggaagagatggagcgcaagcgggctgttgaacgccaagccgctttggagagccagcgaagattggaggagcggcagtctggcctggctagccgggcggccaacggagaagtagcctctctaagacgcggacccgcccctctgcgcaaagcagagggatggcttccactgtccggaggacagggacagtccgaggattctgacccgctgctccagcaaatccacaacattaccagttttatccgccaggccaaagcggccgggcggatggacgaagtgcgcactttgcaggagaacctccggcagctccaggacgaatatgaccagcagcagaccgagaaggccattgaactgtcccggcgccaagccgaagaagaggaccttcagagagagcaactgcaaatgttgagggagagggaactggaaagagaaagagagcaattcagagtcgcaagcctgcacacccgaaccaggtctctggacttccgcgagattggcccgttccaactagaaccaagcagggagccccgcacccatctcgcatacgcactggatcttgggtccagtccagtgccaagtagtactgcacctaaaaccccctcactatctagcacccagcctactagagtctggtcgggaccgcccgctgtggggcaggaacggctccctcagagcagtatgcctcaacaacatgagggaccatctctcaatccttttgacgaggaggacttaagcagccccatggaagaagctactaccggccctcccgccgccggggtgtcactggatccatctgctcggatcctcaaggagtacaacccattcgaagaagaagatgaggaagaagaggctgtagctgggaacccattcatccaacctgatagtcccgcccccaaccccttcagcgaggaggacgaacatcctcaacaacggctgtctagccctctggtgcctgggaacccttttgaggagcccacctgcatcaatccgttcgagatggatagtgattcaggccctgaagctgaggaacctatcgaggaggagttactgctgcagcaaattgataacattaaagcatatattttcgacgccaagcagtgtggtagactggacgaagtggaagtcctgacagagaatctgagagagctgaagcatactctagctaagcaaaagggggggactgactag

SEQ ID NO: 48070 - DNA, 438 bp, Artificial Sequence
  Description of Artificial Sequence: Synthetic coding sequence
atggccgccagcctgaacgccggcgagaccacctacagcctggagcacgccagcgatctgagggttgaggttcagaaggtgtatgaactcatagatgcacttagcaagaaaattctcacactcggcctgaaccaggacccaccaccccacccaagcaacctgcgcctgcagagaatgattcgatacagcgccactctgtttgttcaggaaaaacttctgggactgatgtccctgccgaccaaggaacagttcgaagagctgaaaaagaaaagaaaggaagagatggagagaaaacgggctgtcgaacggcaggcagctctggagagtcagaggagactagaagagagacagagggcctctcacccaccgtgcctgtgctttggcagcagattgtttccttcatccaaacagcatagttctcaagacccattcacatag

SEQ ID NO: 48071 - DNA, 627 bp, Artificial Sequence
  Description of Artificial Sequence: Synthetic coding sequence
atggccagcctggacgaccccggcgaggtgcgggagggcttcctgtgccctctctgtctgaaggacttgcaatcattttaccagcttcactcccattacgaagaggagcactctggtgaggaccgggatgtgaaaggccagattaagtcattggttcagaaagccaagaaagcgaaggaccgcctattgaagagggaaggggacgatcgagctgaatccggcacccagggatacgaaagtttctcctatggaggggtagacccctatatgtgggagccccaggaattaggcgctgttagatcccaccttagcgacttcaaaaaacatagggctgccagaattgatcattatgttgtggaggtgaacaaactgataatccggttggagaaactgaccgccttcgatcgcaccaataccgaatccgccaaaatccgagcaatcgagaaaagcgtggtcccttgggtcaacgatcaagatgtgccattctgtcctgactgtggcaacaagtttagtatacggaacaggaggcatcactgtaggttgtgcggaagcattatgtgcaagaagtgtatggaactgatctcccttcccctggccaagatcactacgctgcacggggagagctag

SEQ ID NO: 48072 - DNA, 2355 bp, Artificial Sequence
  Description of Artificial Sequence: Synthetic coding sequence
atggccagcctggacgaccccggcgaggtgcgggagggcttcctgtgtcccctctgcttgaaggacctgcagagtttttaccagttgcattctcattatgaggaagagcactcaggtgaggaccgtgatgttaaaggtcagataaaaagcctagttcagaaagccaaaaaagccaaggaccgccttctcaaacgggagggagacgatagggccgaaagcggcacacaaggctatgagtctttctcctatgggggcgtggatccttatatgtgggaaccccaagagcttggggccgtgagaagccatctttcagacttcaagaagcatagagcagctagaatcgatcattacgtcgtggaggtaaacaaactgattatccgactcgagaaattgacggcgtttgaccgaacaaatacagaaagcgctaagattcgtgccatcgagaagagcgttgtgccttgggtcaatgaccaggacgtcccgttttgccccgactgtggtaacaaattttccatacgcaacaggcgtcaccactgccgcctttgcggatcaataatgtgcaagaagtgcatggagctgattagtctgcctctcgctaataagctcacctccgcctccaaggagagcttatcaacccatacctccccatctcagagtcccaacagcgttcatgggtccaggaggggttctatatcatctatgtcttctgtgagctccgtattagacgagaaggacgacgatcgaattcgttgctgcacgcattgcaaagatactctgctcaaacgcgaacagcaaatcgacgagaaggaacacacacccgatattgtcaagctatacgaaaagctgagactgtgcatggagaaagtagatcagaaggctcctgaatacatcaggatggcggctagcttaaacgcaggggagacaacttatagtctggagcatgcgtccgatctcagggttgaagtgcagaaagtttatgaactgatcgatgccttgtctaaaaaaatattgacccttggcctgaaccaggatccccctcctcacccatcaaatcttaggttgcagcggatgatccgctactcagccactctgttcgtgcaggaaaaactcctggggctgatgtctctacctacaaaggagcagtttgaggagctgaaaaaaaaaaggaaagaggagatggagcgcaaacgggctgtagagcgccaagctgctttggagtctcaacgccgcctggaggagcgccagagcgggttagcgtctcgagctgctaacggcgaggtcgccagcttgaggagagggccagctcctcttcgcaaggcagaaggctggttacctctaagcggaggacagggacagtccgaggactcagatccccttttgcaacagatacataatatcaccagttttataaggcaggctaaggccgcaggtaggatggatgaagttagaacactccaggagaacttgcgtcagctgcaggacgagtatgaccaacaacaaaccgaaaaggccatcgagctgtctagaagacaggcggaggaggaggacctgcagagagagcagctgcagatgttgagagagcgagaacttgagcgtgaaagagagcagtttcgtgttgccagtctgcatacaaggacacgatccctcgacttcagggagatcggcccttttcagctcgagccatcccgcgaaccacggacccatctagcgtatgctctcgaccttggatcatcccccgttccaagcagcacggcacctaagacaccctctctgtctagcacacaacctactcgtgtgtggagtggacctcccgctgtggggcaagaaagactcccacaaagttcaatgccccagcagcacgagggtccctccctcaacccattcgacgaagaggatctcagttcccctatggaagaagccacaacaggaccacccgctgcaggcgtcagcctcgacccaagcgcccgaattctgaaagagtacaaccccttcgaggaggaagatgaagaggaggaagctgtggccggaaacccttttatccagccggacagtccagcaccaaacccgtttagcgaagaagatgagcatcctcagcagcgactgagcagtccgctcgtgcctgggaaccccttcgaggaacctacttgcataaacccattcgaaatggactccgatagcggacccgaggccgaagagccgatcgaagaagagctgctattacagcagattgataatatcaaggcctatatctttgatgccaaacagtgtggcaggttggacgaagtcgaggtcctgaccgaaaacctccgagagctaaaacatacactcgctaaacagaaaggtgggaccgattag

SEQ ID NO: 48073 - DNA, 126 bp, Artificial Sequence
  Description of Artificial Sequence: Synthetic coding sequence
atggccagcctggacgaccccggcgaggtgcgggagggcttcctgtgtcccctctgcctgaaagacctccagagtttctaccagcttcactctcactatgaggaggagcatagcggggaggattag

SEQ ID NO: 48074 - DNA, 4278 bp, Artificial Sequence
  Description of Artificial Sequence: Synthetic coding sequence
atggagaactacttccaggccgaggcctacaacctggacaaggtgctggatgagtttgaacagaacgaagacgagacagtctccagtacattgttagatacaaagtggaacaaaattctggaccctccaagccataggttatcattcaacccaacactggcctcagtgaacgaatcagccgttagtaacgagagtcaacctcaattgaaggtgttctcccttgctcactctgcaccgttgactaccgaggaggaagatcattgtgctaatggccaggattgtaatctgaatcccgagattgctactatgtggatagatgagaacgctgtggctgaggatcaacttatcaaacgcaattactcctgggatgatcagtgcagtgcagttgaagtgggcgaaaaaaaatgtggaaacctggcttgtttgcccgacgaaaagaatgtgctcgtcgtggcagtgatgcataactgcgataagaggacactccagaatgatttgcaggattgtaataattacaactcacaaagcctgatggatgctttctcatgctctctggataacgagaatcggcagacagatcagttttccttctctatcaacgagtctacagaaaaggatatgaactcagaaaagcagatggaccccctgaatcgacctaaaaccgaaggacgctcggtcaatcacctgtgccccacctcatctgactcccttgcttctgtctgcagcccctcacaactgaaagacgacgggagtattggacgggatccctccatgagcgcgatcacatccctgacagtcgatagcgttatctcatcccagggcacggatggctgtcctgccgtcaagaaacaggaaaattacatccccgacgaagacctgaccggcaagattagtagccctcgaacagacctaggaagtccaaactcatttagccacatgtctgaggggatattgatgaagaaagagcccgcagaggagtcgaccaccgaagaatcactcagaagcgggctgcccttgctgctgaagcccgatatgccaaacggcagcggtagaaacaacgactgcgagcggtgttcggattgcctggtccccaatgaagtccgcgcagacgaaaacgagggatacgagcatgaggagaccttgggaaccactgagtttttgaatatgaccgagcatttctccgagtcacaggatatgaccaattggaaactgacaaaactcaacgaaatgaacgatagccaggtcaacgaagaaaaagagaagttcctacaaatttcccagcctgaggacaccaacggtgactctggggggcagtgtgtagggctggccgatgccggtcttgatctaaagggaacatgcattagcgagtcagaggagtgcgattttagtaccgttatcgacacaccagcagctaactatttgtctaacggctgcgatagctatgggatgcaagacccgggcgtcagtttcgttcctaaaactctgccatcaaaggaggactccgtcactgaagaaaaagaaattgaagagtcaaaatctgagtgctattctaacatttacgaacagaggggaaacgaggcaacagaagggtccgggctgttactgaactcaaccggagatctgatgaaaaagaattatttgcacaacttctgctctcaagtgccctccgtgctgggccagtcaagccctaaagttgtagcaagcctgcccagcattagtgtccctttcggcggtgcacggcccaagcagccttctaacctgaaattgcagattccaaaacctctgagcgatcacctgcaaaacgacttcccagctaattcaggtaacaacacaaagaataagaacgacatactggggaaagccaagttgggcgagaacagtgcgaccaacgtatgctcgccttccctgggaaatatctccaacgtcgacaccaatggggagcacctcgagtcctatgaagccgaaattagcaccaggccatgtttagcattggcgcctgattcacccgacaacgacctgcgagctggacagttcggtatcagtgcacggaaaccgtttactaccctgggggaggtggcccccgtatgggttccagatagccaggcccctaattgcatgaaatgcgaagcgagattcaccttcactaaaaggcgacaccactgtagagcttgtggcaaagttttctgcgcttcctgttgcagtctgaagtgtaaattgctctatatggaccgcaaggaggcccgggtctgcgtcatatgccatagcgtgctgatgaatgcacaagcgtgggaaaacatgatgtccgcctcatcgcagagccccaacccaaacaacccggccgagtattgcagcacgatcccccccttgcagcaggctcaggcttccggcgccctgtcctctccgccccctactgtaatggtgcctgtaggggtgttgaagcaccccggcgccgaggtggcccaacctcgggaacagagaagagtttggtttgcagacgggatactcccaaacggtgaggtagcggacgccgccaagttgaccatgaacggcacctcttccgcgggaacactggccgtcagccacgatcccgttaagccagtcaccacgtcccccctgcctgctgaaaccgacatttgtctgttctcagggtccataacccaggttggttcgcccgtggggtccgctatgaatcttattcctgaagatgggcttcctcctatactgatctccaccggagtcaagggggattacgctgtggaagagaagccaagccaaatcagcgtgatgcaacagctcgaggatggcggacccgaccccctggtgttcgtcttgaatgctaatctgctgtccatggtgaagatcgtcaactacgtaaatcgtaagtgctggtgttttactactaagggaatgcatgctgtgggtcaaagcgagatcgtgatcctactgcagtgcctgccagatgagaagtgtctccctaaggatatcttcaatcatttcgtgcagctatatagagatgccctggcagggaatgtggtctccaaccttggccacagcttttttagccaaagtttccttgggagcaaggagcacggcggttttctgtatgttacttctacataccagtccctacaggatctggtactccctacaccaccgtatcttttcggcatccttattcagaagtgggaaacaccttgggcaaaagtattccccattcggttgatgctgagactcggagccgaatatcgactttacccttgtcccctattttcggtccggtttcggaagcctctgttcggggagactggccacacgatcatgaatctgctcgcagactttcggaactatcagtacaccctgcccgtggtgcagggcttagtcgttgacatggaagtaagaaaaacgtcaatcaagattccaagtaacagatataatgagatgatgaaagcgatgaacaagtccaatgaacacgtcttagccgggggggcttgttttaacgaaaaagccgacagccatctggtttgcgtgcagaacgatgacggtaactatcagacgcaggctatcagtatacataaccaaccgcgtaaagtgaccggagcttctttcttcgtattctctggtgccctcaaatctagcagcggatacctcgcgaagtcttcaattgtggaggacggtgtgatggtccaaatcactgccgagaacatggatagcctgcgccaagcccttcgtgaaatgaaggattttactattacctgcgggaaagcagatgccgaggagccccaagagcacatacatatacagtgggtggacgatgataagaacgtgtccaagggggtcgtgtccccaattgacgggaagagcatggaaaccatcaccaatgtcaagatattccacggatccgagtacaaggccaacggcaaagttataagatggaccgaggtcttcttcctggagaatgatgaccagcacaattgcctctcagatccggccgaccacagccgcctaaccgagcacgtcgcaaaagcattttgtctagccctctgtcctcatctcaaactgcttaaagaagacggcatgactaagctgggattgagagtgacattagattctgaccaagtgggataccaagctgggtccaatggccagccgttaccatcccagtacatgaatgacctcgattctgccctggttcccgtcatccacggtggggcctgccaactgtctgaaggccccgtcgtgatggaacttatcttttacatcctcgagaatatcgtgtag

SEQ ID NO: 48075 - DNA, 4101 bp, Artificial Sequence
  Description of Artificial Sequence: Synthetic coding sequence
atggagaactacttccaggccgaggcctacaacctggacaaggtgttggacgagttcgagcagaatgaagacgagacagtaagcagcacacttctggacacaaaatggaacaaaatccttgatccaccgtcacaccgcctgagtttcaaccctacactcgcctccgtcaatgagagtgccgtgtctaacgaatcccagcctcagttgaaagttttttctctggcacactcagcacccttgacaacagaggaggaggatcactgtgctaacggacaggactgcaacctcaaccccgagatagcaacaatgtggattgacgaaaatgccgtggccgaggatcagctcatcaagagaaactattcttgggacgaccagtgcagcgcagttgaggtcggagagaaaaaatgtggaaacctggcttgtctccccgatgagaagaatgtcttggtggtcgctgtcatgcacaactgtgacaaaaggacactccagaacgacctgcaggactgtaataattataatagccaatccctaatggacgcgtttagctgttctcttgataatgagaatcgacaaacagatcagttctcattttctatcaacgaatccacagagaaggatatgaactcggagaaacaaatggaccccctgaaccgacccaagaccgagggccgcagcgtgaaccacctttgccccacgtctagtgattccctagccagtgtgtgtagcccttcgcagctgaaagatgatggctctatcggtcgcgacccctccatgagcgctattacctccttgactgttgattctgtcatcagcagccaggggaccgacggttgcccagcagttaaaaaacaagagaattacatccctgatgaagatttgaccgggaaaatttcttcacctaggaccgacctggggagcccgaactccttctcccatatgtcggaaggaatcctgatgaagaaagagcctgcagaagagtccacgaccgaagagtccctgcggtctggcctgccactgctgttaaaaccagacatgcccaacggctccggaaggaataatgactgtgagaggtgttccgactgccttgtgccaaacgaggttagagctgacgagaacgaaggctacgaacacgaagaaacgcttggaaccaccgaatttctgaacatgaccgaacattttagcgaatctcaggacatgactaattggaaattgacaaaattaaacgaaatgaatgactcccaagtaaatgaagagaaagaaaaattcctgcagatatcacagcctgaggatacaaacggcgattcaggcggccaatgtgtgggcctggccgatgctggactggacttgaagggtacgtgcatctcagaaagtgaggagtgcgattttagcaccgttattgacacccctgcagcgaactatctctcaaatggctgcgatagctatggcatgcaggatccgggggtgagctttgtgcccaaaactttgccgtcgaaggaagactctgtgaccgaggaaaaagagatcgaggaaagcaaatcagaatgctacagcaacatttatgagcagcgcggaaacgaggcgaccgagggcagtggtctgctgctcaactccaccggtgatctgatgaagaagaattatctgcacaacttttgttcgcaagttccgtccgtgctgggccaatcaagccccaaggtagtggccagcctgcccagtatttcagtgcccttcggcggagccaggcctaaacaaccttccaacctgaagctacaaatccccaaacccttatcggatcacttacaaaacgacttcccagcgaacagcgggaataacactaaaaacaaaaacgacattcttggaaaagccaagttgggcgaaaatagcgcaaccaacgtctgcagccccagtttggggaatattagcaacgtggatactaacggagaacatctggaatcctacgaggccgagatatcaacacgtccgtgccttgcgctggcacccgatagtccagacaacgacctgagggcgggacaatttgggatttctgcacgtaaaccctttaccaccctcggagaagtggcacccgtttgggttcctgactcccaggcccctaattgcatgaagtgcgaggccaggttcacatttaccaaaaggagacatcactgtcgagcttgtggcaaggtgttttgcgcttcttgttgctccttaaagtgcaagctcttgtatatggaccgaaaggaagctagagtctgcgtcatatgtcactccgtgctcatgaacgtggcccagccccgcgaacaaaggcgtgtgtggtttgccgatggaatcctgcccaacggcgaggtcgccgatgccgccaagctgacaatgaatggaacttcctctgctggcaccctcgcggtaagccatgaccctgtgaaacctgttactaccagccccctgcctgcagaaacagacatctgcctcttttccggaagcataactcaggtgggctcaccagtcggctccgcaatgaatctgatcccagaggatggcctgccaccaattctcatttccactggcgtgaagggcgactacgcagtcgaagaaaagccttcccaaatcagtgtgatgcagcagctggaggatggcggtccagaccccttagtgtttgtgctgaacgccaatctcctgtcgatggttaagattgtaaactacgtgaacagaaaatgttggtgctttacaacgaaaggcatgcacgcagtgggtcagtccgaaatagtcatcctccttcagtgcctccctgacgagaagtgtttaccgaaagatatttttaatcactttgtgcagctatacagagatgcactagccggcaacgttgtgagcaacctgggccacagttttttctcacagagtttcctcggcagcaaggaacacggcggatttctgtacgttacatccacctaccaatcgcttcaggacttggtgctccctactcctccatatctgtttgggattctaatccaaaagtgggagacaccctgggctaaggtgttccccatccgcctcatgctgcgtctcggggctgagtataggttgtatccctgccctcttttctcagtgcgatttcgtaaacccctttttggcgagacaggacataccataatgaatctgttagctgacttcagaaactaccagtacacactgcctgtcgttcaggggctggtggtcgacatggaagtgagaaaaacaagtatcaagattccatctaatagatataatgagatgatgaaggccatgaataagagtaacgagcacgtgttggccggaggggcctgtttcaacgagaaagctgacagccacttggtgtgtgtccagaacgatgatggcaactatcaaactcaggctatttcaatccacaaccagccccgaaaagtgacaggtgcttcattcttcgtcttcagtggggcactgaagtcttcctctggatacctcgccaagtcttccatcgtggaagatggtgtcatggtccagatcactgctgaaaatatggattccctgcgccaggccttacgtgagatgaaagactttactattacttgcgggaaggccgatgctgaagaacctcaggagcatatacacatacagtgggtagacgatgacaaaaacgtttccaagggcgtggtctcgcctatagacggcaagagtatggagacaatcaccaatgtcaaaattttccacggaagtgaatataaagccaacggaaaggtgatccgctggacagaggtcttctttctggagaacgatgaccagcacaattgcctgtcagaccctgccgaccactcccgactgacagagcatgttgcaaaggcattctgtctcgctctctgcccgcacctcaaactattgaaagaggacggaatgacaaaactggggctccgagttacactggacagcgaccaggtgggctatcaagccggaagcaacgggcagccacttccttcccaatatatgaacgacttggacagtgctcttgtccccgttattcatggtggggcctgccagcttagtgagggccccgtggtcatggaactgatcttctacatcttggaaaatatcgtatag

SEQ ID NO: 48076 - DNA, 2289 bp, Artificial Sequence
  Description of Artificial Sequence: Synthetic coding sequence
atggagaactacttccaggccgaggcctacaacctggacaaggtgctggacgaatttgaacagaatgaggacgagaccgtctccagtactctgctggacactaagtggaacaagatcctcgatcccccatctcaccgtctcagctttaatcctactctggctagcgtcaatgagtccgcggtctccaatgagagccagccacagctgaaggtgttttccctagctcacagcgccccactgacaaccgaagaggaagaccactgtgccaacggacaagactgtaatctgaatccagaaattgctaccatgtggattgacgagaacgctgtcgccgaggaccaattgataaagcgtaactattcctgggacgatcagtgctccgccgtcgaagtaggagaaaaaaaatgtgggaatcttgcgtgtcttccagacgagaagaacgtgcttgtggtggccgtgatgcacaattgtgataaacgtaccctgcagaatgatcttcaagactgtaacaattacaactcccagtcgctgatggacgccttttcttgttctctagataacgagaatcggcagacggaccagtttagcttctcgatcaatgagtcaaccgaaaaggacatgaactctgagaagcagatggatcccctaaatcgacccaagactgaaggccgctctgtgaatcatctgtgtcccacaagttcagacagcttagcgagcgtgtgctctccctcacagctaaaagatgatggatcaattggacgcgatccatcaatgtctgccatcacttctctgactgtggactccgtgatctcttcgcaggggacagacggttgccctgcagtgaagaaacaggagaactacatccctgacgaagacctgactggcaagatatcaagtccacgcacggatctcgggtccccaaattctttcagtcacatgtccgaagggatcttgatgaagaaagagccagccgaagagtctactaccgaggagtcattgcgatctgggctgcctttacttctgaaaccagacatgccgaatgggtcaggtcggaataacgattgtgaaagatgtagtgactgcctggtgcctaacgaggttcgtgcggatgagaacgaggggtacgaacacgaggagaccctcgggacaactgagtttttaaatatgacagagcattttagtgagtcccaggatatgacaaactggaagctgaccaagctgaatgagatgaacgatagccaagtgaatgaagaaaaggagaaattcctgcagatttcccagcctgaggatactaacggagactcaggggggcaatgcgtgggattggcagacgccggattggatctgaagggcacctgtatctcagaaagcgaggaatgcgacttcagcaccgtgattgacaccccggcagccaattaccttagcaacggctgcgatagctacgggatgcaggatccaggtgttagcttcgtgcctaagacactcccttccaaggaggacagtgtaacagaggagaaggagatcgaggagtccaaatcagagtgctactcaaacatctacgagcagcgcggcaacgaggccaccgagggctcaggactcctgctgaatagcacgggagacttgatgaagaagaactaccttcataatttctgctcccaagtgccttctgtgctcgggcaatcgagtcctaaagtcgttgcttccctaccgagtatttcagttccctttggcggcgcgcggcccaagcaacctagtaatctcaaactccagatccctaaacctctttccgatcacttgcagaatgattttccagctaattcaggcaacaatactaaaaacaagaacgacatcttggggaaggcgaaactaggagagaactcagcaacaaatgtgtgttcgccctcactcggcaacattagcaacgtcgatactaacggtgaacacctggaaagttacgaggccgaaatttcaacccgcccatgcctggctttggcccctgacagccctgacaatgatctgcgtgctggtcagttcggtatcagcgcacggaagcctttcaccacgctgggagaggtcgccccagtctgggtacccgactctcaggccccaaattgtatgaaatgcgaagctaggttcacttttaccaaacgcagacaccactgcagggcgtgcggaaaggttttttgcgcatcatgttgctctctgaagtgcaagctgttatacatggaccggaaagaggctagagtgtgtgtcatatgccactcagtgctcatgaacggaaagtactag

SEQ ID NO: 48077 - DNA, 4278 bp, Artificial Sequence
  Description of Artificial Sequence: Synthetic coding sequence
atggagaactacttccaggccgaggcctacaacctggacaaggtgctagatgagttcgagcaaaacgaagatgaaactgtgtcctctacactcctggacacgaagtggaataagatccttgacccaccgtcgcatcggctcagcttcaaccccaccctggcctccgtgaacgagagtgccgtgagcaatgagagccagccgcagctgaaggtattttccttggctcactcagcccccctcaccactgaagaggaggaccactgtgccaatggccaggattgcaatctgaatcccgagatcgctaccatgtggatcgatgaaaacgccgtcgcggaggatcaacttattaagagaaattacagttgggacgaccagtgttccgccgtggaagttggcgagaagaagtgcgggaatttggcttgtctccccgatgaaaaaaatgtgttggttgttgctgtgatgcataactgtgacaaaagaactctgcagaacgacctacaggattgcaataactacaactctcaatccttgatggatgctttctcttgcagtctagacaatgaaaatcgccagaccgatcagttctctttctccattaacgaatcaacagaaaaagacatgaatagtgagaagcaaatggacccgctgaaccgacccaagacggagggcagaagtgttaaccatctgtgtccaacatcatccgattcactggccagcgtctgctcaccgtcccagttgaaagacgacggctccatcggcagagacccttctatgtctgccattaccagcctgacagtggatagcgtgattagttctcagggtacggacgggtgccctgctgtcaagaagcaagaaaattacattcctgacgaagatctcactggtaaaatttcctcgccacgaacagacctggggagtccaaacagttttagccatatgagcgaaggcatccttatgaagaaagaaccggctgaagaatccaccaccgaggaaagtcttcgatccggactgcccctgttactgaagccggatatgcctaacggatcaggcaggaacaacgattgtgaacgctgttctgactgtctcgtgcccaacgaggttagagccgatgagaacgaaggatatgagcatgaggaaacactgggaaccacagagtttctgaacatgaccgaacacttcagcgagagccaggacatgacaaactggaaactcacgaagctcaatgaaatgaacgattctcaggtgaatgaagagaaggagaagtttttgcagatctcgcaacctgaggatacaaacggtgatagcggcggccagtgcgttggcctggcggatgcaggccttgatcttaaggggacatgcattagtgagtctgaggagtgcgacttttctaccgttattgacaccccagccgccaactacctgtcaaatggatgtgacagctacggcatgcaagaccccggcgtgtctttcgtacccaaaaccctgccatctaaggaggattctgtgacagaggagaaggaaatcgaagaatccaaatcagaatgttatagcaacatttacgagcagcgaggaaacgaggctacggagggcagcgggttgcttttaaacagcaccggggacctgatgaaaaaaaattatctgcacaatttctgtagtcaggtgccctcagtgctaggccaatcctcacccaaagtagtagccagcttaccttccattagcgtcccatttggcggagccagaccgaaacagcccagcaacttaaagctgcagatccctaaacctcttagtgatcacctccagaatgattttccagcaaacagcggcaataacaccaaaaataagaacgacatattgggcaaggccaagctcggcgaaaactctgctacaaacgtgtgcagcccaagcctgggaaacatctctaatgtggacaccaatggagagcacctggaatcctatgaagcggaaataagcactcggccctgtctggcactggctcccgactcccccgacaacgatctcagagcaggccagtttggtatctccgcacgaaagcccttcactactctaggtgaggtagcccctgtgtgggtgccagattcccaggctccaaattgcatgaaatgcgaagccaggttcacctttacgaaacgccgtcatcactgcagggcttgtgggaaagtgttttgtgccagttgctgcagtctgaaatgcaagctgctttacatggacagaaaggaggcccgggtgtgtgtcatctgtcactcagtgttaatgaatgctcaagcctgggagaacatgatgagcgcctcctctcaaagcccgaacccaaacaatcctgcagaatattgcagcaccatcccacctcttcagcaggcccaggcttctggtgccctgtctagccctcctcctacagtgatggtgcctgtcggggttctgaaacatccaggcgctgaggtcgctcagccaagggaacaacggagagtatggtttgccgacgggattttgccaaatggtgaggtcgccgatgccgccaaactcactatgaacggaaccagctctgccggcactctggctgttagtcacgaccccgtgaagccagtaactaccagccccttaccggctgaaacggatatctgtctattctccggttcgataactcaggtgggctctccggtgggaagtgcgatgaacctgatacccgaggatgggctgcctcctattctgatctctaccggagtaaaaggcgattacgccgtggaggaaaagccctcacagatatcagtgatgcaacagctggaagacggcggtcctgaccccctggtgttcgtgctaaatgcgaacctactgtctatggttaagattgtgaactatgtgaatcggaagtgttggtgtttcacaacaaaaggtatgcacgcagtgggccaaagtgagattgtgattcttcttcaatgcttacctgatgaaaaatgcttacctaaggacatttttaaccacttcgtccagctgtatcgcgacgcgctggccgggaatgtggtcagcaacctgggccactcctttttctcccagagcttcctgggaagtaaagagcatggtggttttctgtacgtaacgtctacctaccagagccttcaggacctggtgctcccaacccccccctacctgttcggcattctgattcagaagtgggaaactccttgggcaaaagttttcccaattagactgatgctgcgattgggagccgaatataggctttatccgtgccccctcttcagcgtgcggtttaggaaacccctctttggagaaaccggtcacacaatcatgaacttgctcgctgattttcgaaattaccagtacaccctgcccgttgtacagggtctcgtggtggatatggaggttaggaaaacatcaataaaaattccctcaaataggtacaacgagatgatgaaggccatgaataaatcaaacgagcacgttttggctggaggcgcctgctttaatgaaaaagccgactctcatctggtatgtgtgcagaacgatgatgggaattaccagactcaggcaatttccattcacaatcaacctcggaaagttacgggggcctcctttttcgtgttcagcggtgcactcaagagctcttccggctacctcgctaaatcttctatcgtagaagatggggtgatggtacaaatcacagcggagaacatggactctctcagacaggccctgagagagatgaaagattttacaattacgtgtggcaaggccgacgcagaggagcctcaggagcacatccatatccagtgggtggatgatgacaagaacgtgtccaagggagtggtgtctccaatcgatggaaagtctatggagacaatcacaaacgttaaaattttccacggcagcgagtacaaggcaaatggcaaagttatccgctggacagaggtgttttttcttgaaaatgatgaccaacacaactgcctgagtgacccggcggaccactcccgactaaccgagcacgtggccaaagccttctgtctagccctatgcccccatttgaaactcctgaaggaagacggtatgacaaaactcgggttgagagtgacgttggacagcgaccaggttggataccaagccggcagcaatggtcagcctctcccgagccagtatatgaacgacctggatagtgccctggtccctgttatccatggaggcgcctgtcagctgagcgagggaccagtggtgatggagctcatcttttatatactggagaacatcgtttag

SEQ ID NO: 48078 - DNA, 2514 bp, Artificial Sequence
  Description of Artificial Sequence: Synthetic coding sequence
atggccagcaagcggaagagcaccaccccctgcatggtgcggacctctcaggtcgtagagcaggacgtacctgaagaagtggatcgcgcgaaggaaaagggaatcggaacaccacagccagacgtagcaaaggattcgtgggcagcagaacttgagaacagctccaaagagaatgaggtcatagaagtgaagagcatgggtgagtctcagagcaaaaagctgcaaggcggatacgagtgcaaatattgcccatatagcactcaaaatttgaatgaattcactgaacacgtagatatgcagcacccaaatgtcatcttaaacccactgtacgtgtgtgctgaatgcaactttacaactaagaaatatgacagtctatccgaccataatagtaaatttcacccaggggaggccaattttaaactcaagttgatcaagaggaacaatcaaaccgtgctcgaacagagcattgaaaccacgaaccacgtggtctccattactacatctggccccggtactggagatagcgacagtgggatatctgtgagcaaaactccgataatgaaaccgggaaaaccaaaagccgatgcaaagaaggtgcccaaaaaacctgaggagattaccccagaaaatcacgtagaggggacggcccgcctagtgactgacaccgctgagatacttagccggcttggcggtgttgagctgctccaggacacactaggccatgtgatgccaagcgtccagttgccacccaacatcaatcttgtgccaaaggttcctgtgcctctgaacacaaccaaatacaattctgccctggatacaaatgccacgatgatcaactcctttaataagttcccttaccctacccaagcggagctatcctggctcaccgcagccagcaagcatcctgaagagcatataagaatctggttcgccacacaaagactgaagcatggcatctcttggagcccggaggaagtagaagaggccagaaaaaaaatgttcaacgggacgatccaaagcgtgcctccgactattaccgtgctgccagctcagctggcccccaccaaagtaacacagccaatccttcagacagcacttccctgtcagatactcggccagacatcactggtcttaacacaggtgaccagtggctctaccacggtcagttgctcacccatcacccttgccgtcgcaggcgttaccaaccacgggcagaagcgcccgctggtgacgccacaggccgcacccgaaccaaaacgcccgcatattgcacaggtcccagagcccccccctaaggtggcaaacccccctctcacccccgcaagcgaccgaaagaaaacgaaagaacagatcgcccacctgaaagcttccttcttgcaatctcaattcccggatgatgccgaagtatatcgcctgatcgaagtcaccggactcgcacgttctgaaattaagaagtggttctcagaccacaggtataggtgccaacgaggcatcgtccatatcacctctgaatctcttgctaaggatcaactcgccattgcggcctctcgccacggccgaacataccacgcgtaccccgacttcgctcctcagaagttcaaagaaaagacccagggacaagtcaaaatcctggaagacagtttcctgaagagctcctttcctacacaagccgagctcgaccgcctgagagtggagactaagctgtcgcgtagagagatcgacagctggtttagtgagaggcggaagctccgggactccatggagcaggccgtgttggattcaatgggatccgggaagaagggacaagatgtgggagctccaaatggtgctctcagtcgcctggaccaactgagtggggcccagctgacatccagcctcccttccccgtctcctgcaatcgcaaagtcacaggaacaagttcatcttctgcggagtacctttgcaaggacacagtggcccacaccacaggagtatgaccaactggcggctaaaacaggactcgtccgtacggaaatcgtgaggtggtttaaggaaaaccggtgtctgctgaaaactgggaccgtgaagtggatggagcagtatcaacatcagccaatggccgacgaccacggttacgacgcggtggcccgaaaggccaccaaacctatggccgagtcccccaagaatggtggtgatgtcgttccccagtactataaggatcctaagaaactttgcgaagaagaccttgaaaaactagtcacccgggttaaggtgggatccgagccagccaaagattgcttacccgcaaagccctcagaggccacctctgacaggtccgaagggtcttcgcgggatgggcaaggctctgacgaaaacgaggaaagctctgtggtcgattatgtcgaggtcacagtcggtgaggaggatgccatctcagacaggagtgactcatggtctcaggcagcagctgagggtgtgagtgagctggccgaatcagacagtgactgtgtgcctgccgaggctggacaggcttag

SEQ ID NO: 48079 - DNA, 501 bp, Artificial Sequence
  Description of Artificial Sequence: Synthetic coding sequence
atggccagcaagcggaagagcaccaccccctgcatggtgcggacctcccaggtggtggagcaagacgtgcctgaggaggtggatcgtgcaaaggagaaggggatcggcaccccccagcccgacgttgccaaagatagctgggcagctgagctcgaaaactcatccaaggaaaatgaggtgatcgaggtgaagagcatgggggaatcacagtcgaaaaaacttcaaggcggctacgaatgcaaatactgcccatacagtacccagaacttgaatgaattcactgagcacgttgacatgcaacaccccaatgtgattcttaatccattgtatgtctgcgccgaatgtaattttaccaccaagaagtatgatagcctgtctgatcacaattccaagttccatcccggggaagcaaattttaaactgaaactgatcaagaggaacaatcaaacagtcttagagcagtccatagaaacaaccaatcatgttgtgagtatcacttag

SEQ ID NO: 48080 - DNA, 465 bp, Artificial Sequence
  Description of Artificial Sequence: Synthetic coding sequence
atggccctgctgctgagcgtgctgcgggtgctgctgggcggcttcttcgctctggtaggactggccaagttgagcgaagaaatatcagcacccgtgtccgaacgaatgaacgccttgtttgttcaatttgccgaagtgttccccttgaaagtgttcggctaccagccagaccctctgaactaccagatcgctgtgggttttctagaactgcttgcgggcctcctgctggtgatgggtccacctatgctccaggagatctccaatctctttttgattctgctcatgatgggagccatctttacgctcgccgccctaaaggaatcgctctccacctgtattccagccatcgtgtgcctcgggttcctgttgttgctgaacgttgggcaactgctggcacagacaaagaaagttgtgcgacctacgaggaagaaaaccctttccacttttaaggaatcgtggaaatag

SEQ ID NO: 48081 - DNA, 1296 bp, Artificial Sequence
  Description of Artificial Sequence: Synthetic coding sequence
atgatgctgcggttcagcatgtgccggggcaacgacgagggcttcgccatggagcagatctggctgttgcttttgctcaccatccgcgtgcttcccggctcagcacagttcaatgggtataattgtgacgctaacctacactctcgtttccctgccgaaagagatatttccgtttactgcggcgtgcaggctatcactatgaagatcaatttctgtaccgtactattttcgggatactcagagacagacttagccttaaacggccgccacggcgattcccattgtcgggggttcatcaataataatacattccccgctgtcgtgattttcatcattaacctttcgaccctcgaaggttgtggcaacaatcttgtggtgagtaccatcccaggagtttctgcatacgggaatgccacatctgttcaggtcggcaacatttcggggtacattgacacacccgatcctcctaccatcatcagctacctgcctggtctgctgtacaaattttcctgctcctaccctctggaatacctcgtgaacaatacgcagcttgcgagcagcagcgcagccatatccgttcgcgaaaacaacgggaccttcgtaagcacacttaatctcctgctctacaatgattcaacatacaatcagcagctgattatcccctcaatcgggcttcctctcaaaacaaaggtgttcgcggccgtgcaggcaacaaacctggatggacgctggaatgtgctgatggactattgctacaccacccccagcgggaatcccaacgacgacatcaggtatgacctgtttttgtcttgcgacaaagacccacaaactacggtcatagaaaacggccgcagccagagaggccgcttctctttcgaggtgttccgattcgttaaacataaaaatcaaaagatgtcgactgtgtttttacattgcgtcacaaagctgtgtagagctgacgattgtccgttcctgatgcccatatgcagccatagagagcggagagacgctggacgtcgcacgacctggagcccccagagctcatccgggtccgccgtcctgtccgcaggccccataattacccggtctgatgaaactccgacaaacaatagtcaactgggaagcccttcaatgcctccatttcagcttaacgctattacatccgccctaatttcaggtatggttatacttggtgtaaccagcttttcccttctgctgtgcagtctggccctactgcatcggaagggaccgaccagtctggtgctgaatggcatcaggaatccagttttcgactag

SEQ ID NO: 48082 - DNA, 1248 bp, Artificial Sequence
  Description of Artificial Sequence: Synthetic coding sequence
atggagcagatctggctgctgctgctgctgaccatccgggtgctgccagggagcgcccagtttaacggttacaattgcgatgcgaacctacacagccgctttcctgccgaaagagatatcagcgtttactgtggagtgcaagctatcacaatgaaaataaatttttgtaccgtgcttttttctggctattccgaaacagatctggcccttaacggaagacatggagactcccactgccggggcttcatcaacaacaacacctttcctgccgtcgtaatattcattatcaacctgtccactctggaaggctgtgggaacaatctggtggtcagcactattccaggcgtgagcgcctatggcaacgctacgagcgtacaggtgggcaatatatccgggtatatcgacacacccgaccccccaacaatcatctcgtacctgcccggactgctctacaaattctcatgcagctacccccttgagtatcttgtcaataacacacagctcgctagcagctccgctgccatatcagtccgggaaaacaacggcacattcgtgtcgacactaaacctgctgctgtacaacgatagcacatataatcagcaactgatcataccatcgatcggattgcccctgaagacaaaggtgtttgcagccgtacaagcgacaaatctggatggacgatggaatgtcttgatggactattgttacaccaccccctccggcaatcctaatgacgatatacgttacgatttatttctgagctgcgataaagacccccaaacaactgtgatcgaaaatggccgatcacagcgaggaagattctcatttgaagtttttcggtttgtgaagcataagaaccagaaaatgagtaccgtgtttctacactgtgttacgaaactctgtagggctgacgattgtccctttttgatgccaatttgcagccatagagagagacgcgatgccggacgtagaacgacatggtcaccccagtcctcctccgggtctgcggtactgagcgccggcccgatcattacacgatctgacgagacacctacgaacaactcacaactgggcagtcctagcatgccacctttccagctgaatgctatcacatccgccttaatcagcggaatggtgattctgggagtcaccagctttagcctgctcctttgcagccttgcactcctccaccggaaagggccaacaagcttggtgctcaatggtatccggaaccctgtgtttgattag

SEQ ID NO: 48083 - DNA, 1248 bp, Artificial Sequence
  Description of Artificial Sequence: Synthetic coding sequence
atggagcagatctggctgctgctgctgctgaccatccgggtgctgccaggctcagcgcagttcaacggttataattgtgacgcgaacctccattcaaggttccccgccgagagagacatttccgtctactgtggcgtgcaggctattacaatgaagatcaatttctgcaccgtgttgttttctggatatagcgagactgatctggccctcaatggcaggcacggtgatagccattgcaggggattcatcaacaacaacacgtttcccgcggtggtgattttcatcatcaacctgtctactcttgagggttgcggtaacaatctcgtggtctccaccatccctggcgtcagtgcatatggcaatgccacctccgtccaggtggggaacattagtggctatattgatacacctgacccaccaacaattatctcatacctgcctgggctactgtacaagttttcgtgcagctatcctctcgagtatcttgtcaacaatacgcaactcgcctcaagtagcgccgctattagcgttagggagaataacggaaccttcgtaagcaccctaaatctgctactgtacaatgacagcacctacaatcaacagctgattattccctcaataggtcttccgctgaaaacgaaagtgtttgccgctgttcaggctaccaatctcgacggtaggtggaacgtgctgatggattattgttacaccacaccgtcaggcaaccccaacgatgacattcgctacgacctcttcctctcatgtgacaaagatccccagacgactgtgatcgagaacggcaggtcgcagcgaggaaggttcagcttcgaggtctttaggttcgtgaaacacaaaaatcagaaaatgagtacagtctttcttcactgtgtgactaaactgtgtagggctgatgactgccctttcctgatgccaatttgttcacatcgcgagagacgcgacgcagggcggagaacaacttggtctccccagtccagcagcggttctgcggtgctgtctgcaggccccattatcactcgcagcgacgagacacccaccaacaattcccagctgggatcaccatccatgcccccttttcaactgaacgcaattaccagtgccctcattagtggcatggttatcctaggagtaacatccttcagcctgctcttatgcagtctcgcactattgcaccgtaaagggcccactagtcttgtcctgaacggcatcagaaacccagtttttgattag

SEQ ID NO: 48084 - DNA, 1131 bp, Artificial Sequence
  Description of Artificial Sequence: Synthetic coding sequence
atgggcctgctggcattcttgaagacgcagttcgtcctccacttattggtggggttcgtgttcgttgtaagtggcctggttataaacttcgtgcagctgtgcacacttgctctctggccggtctccaagcaactgtacaggagactgaattgtcggttggcttactctctctggtcccaactggttatgctgctggagtggtggtcgtgcaccgaatgcacattgtttactgatcaggctacagtggagagatttggaaaggagcacgctgttataatcttgaatcacaacttcgaaatagactttctatgtggctggactatgtgcgagcgatttggagtcctgggctcatccaaagtgctggccaaaaaagaactgctctatgtcccactgatcggctggacatggtatttcttagagattgtcttctgtaagcggaagtgggaggaggatcgggacactgtggttgaaggactgcggaggttgtccgattatccagaatacatgtggttcctgctttactgcgagggcaccagattcactgagaccaaacacagggtgagcatggaggtcgccgctgcaaaaggactcccggtcctcaagtaccaccttttgccaagaaccaagggctttactaccgcggtgaagtgcttaaggggaaccgtcgcagccgtgtatgatgttacgcttaatttccggggtaataaaaacccctctttactcggcatcctgtacggtaaaaaatatgaagcagatatgtgcgtgaggagatttccactcgaagatatccccctggatgagaaggaggccgcacagtggttgcataaactatatcaggagaaagatgcactccaagagatttataatcagaaagggatgtttccgggtgaacagttcaagcccgcaagaagaccctggacattgctcaacttcctctcttgggcaacaatccttctttcccctctgttttcttttgtgttgggcgtattcgcctcgggcagccccctgctaatcctgactttcttaggcttcgtgggggcagcctctttcggagtacggagactgatcggagtgactgagattgagaagggttcctcttatggaaatcaggagttcaaaaagaaagaatag

SEQ ID NO: 48085 - DNA, 1131 bp, Artificial Sequence
  Description of Artificial Sequence: Synthetic coding sequence
atgggcctccttgcattcctgaaaacacagttcgtgctgcatttgctagtgggcttcgttttcgttgtgtcaggactcgtgatcaattttgtgcagttgtgcacactcgctctgtggcctgtgtcgaagcagctttacaggcggttgaattgccgacttgcatacagcctctggtcacagttggttatgctgctggagtggtggagctgtaccgaatgcactttgttcactgatcaggccactgttgagcggttcgggaaggagcacgctgttatcatcctgaaccataatttcgaaatcgacttcctgtgcggttggactatgtgtgagagattcggagtacttggcagctcaaaggtgctggccaaaaaagagctcctctacgttccactgataggctggacatggtattttttagaaatagtcttctgcaaacgtaaatgggaggaagatcgggatacagttgttgagggactgaggcgcctgagtgactatcccgaatacatgtggttcctcctttactgcgaagggaccaggtttaccgaaacaaagcatcgcgtcagtatggaggtcgccgctgccaagggactgcctgtgctgaaatatcacctgctgcccagaactaaaggatttacgaccgcagtcaagtgcctgcgtggcactgtggcagccgtgtatgacgtcaccctgaattttaggggtaacaagaatccgagcctgctggggatcctctatggaaagaagtacgaggctgacatgtgtgtgaggaggttccctttggaagacattcccctggacgaaaaagaagccgctcagtggctccacaaactctatcaggaaaaggatgctctccaggaaatttataaccaaaaagggatgtttccaggcgaacagttcaaacccgcaaggcggccatggacactgctgaactttttgtcatgggccaccatcctcttatcccccctgtttagtttcgtactgggagttttcgcctccggttcaccactcctgatactaacatttctggggttcgtcggtgccgcttctttcggtgtgaggcgtctgatcggggtgacagagattgagaagggttcatcatacggcaatcaggagttcaaaaaaaaagaatag

SEQ ID NO: 48086 - DNA, 1131 bp, Artificial Sequence
  Description of Artificial Sequence: Synthetic coding sequence
atggggttgttggccttcctgaagacgcaattcgtcctccatttgctcgtgggcttcgtttttgtcgtttctggcttggtcatcaatttcgttcagctctgcacactggctctgtggccagtatcgaagcagctctacaggagactgaactgcagactcgcctactccctgtggagccagctggtaatgctgctggagtggtggagttgcacagaatgcacactttttaccgatcaggccactgtggagcggttcggaaaggaacatgccgtcattatacttaatcataatttcgagattgacttcttatgtggatggaccatgtgcgagcgcttcggtgttctgggcagtagcaaggtgcttgcaaagaaggagttgctgtacgtgcctctaattggctggacctggtacttcctggaaattgttttctgtaagcgaaaatgggaagaggaccgagacaccgttgtggagggcctgcgaagactgtctgactaccccgaatacatgtggttcttgttgtactgcgagggtacccggttcacagagacaaagcatcgggttagcatggaagtggccgctgctaagggcctgcctgtgcttaagtaccacctcctgcctcggaccaaaggttttacgactgccgtaaaatgcctgaggggaacagtagcagctgtgtatgacgtaacgctgaactttagggggaataagaatccttcgttgttggggatcctgtacggaaagaagtatgaggcagacatgtgtgtccgcagatttcccttagaggatatccccctggatgagaaagaggccgctcaatggctccataaactgtaccaagaaaaggacgccttgcaggagatttacaatcagaaggggatgtttcctggcgagcagttcaagcccgcaaggaggccatggactcttctgaacttcctctcctgggcaactattctattgtccccacttttctcatttgttctgggtgtgttcgctagcgggagccctctgcttattctgacgttcctcggcttcgtaggtgcagcatcattcggggtccgtcgactgataggagttactgaaatcgagaagggatcttcatacggtaaccaggagtttaagaaaaaggaatag

SEQ ID NO: 48087 - DNA, 1131 bp, Artificial Sequence
  Description of Artificial Sequence: Synthetic coding sequence
atggggttgctggcttttctgaagacacagtttgtgctccacctgctcgtgggattcgtattcgtggtttccggacttgtgatcaacttcgtccagttatgcaccctagccctctggcctgtatccaagcagctctacaggcggctgaactgtagattagcctactcactgtggtcacagctggtgatgcttctggagtggtggtcctgcacggagtgtactttgtttacggatcaggccacggtcgaaagatttggtaaggagcacgccgtgattatcctgaaccacaactttgaaattgactttttgtgtgggtggaccatgtgcgagaggttcggtgtcctaggatccagcaaggtgttggctaagaaggaactactttacgtccccctgattggatggacctggtacttcctcgagatcgtgttttgtaagcgaaagtgggaggaagaccgtgacactgttgttgagggcctcaggcggttatcagactacccggagtacatgtggtttctgctgtattgtgaaggaacccgcttcacagaaaccaagcatcgagtttccatggaggtggctgccgctaagggcttgcctgtgctcaagtatcacttgctacccaggaccaaaggttttactaccgctgtgaaatgccttagggggactgttgctgctgtttacgacgtaactctaaactttagaggaaacaagaatccttcacttctggggattctgtacggtaagaaatatgaagccgacatgtgcgtaagacggtttccactcgaggatatccctttggacgagaaggaagccgctcagtggctccacaaattgtaccaagagaaagatgcgcttcaagagatttacaatcaaaaggggatgttccctggggaacagtttaagccggctcgccgaccatggacactgttgaacttcctgagctgggcaacgattctcctgagtccattgttcagctttgtcctgggtgtgtttgcgagtggcagccccctgctaattttaacgtttctgggcttcgtgggagctgcatcctttggtgttagacggctgattggtgttaccgagatcgagaaggggagcagttacggcaatcaggagtttaaaaaaaaggagtag

SEQ ID NO: 48088 - DNA, 1131 bp, Artificial Sequence
  Description of Artificial Sequence: Synthetic coding sequence
atgggtttgctcgcctttctgaagacacaattcgtcctacatctgttagtagggttcgttttcgtcgtgagtggcctcgtcatcaatttcgtacagctctgcaccctcgccttatggcctgttagcaagcagctctatcggagactgaactgcagactggcgtactctctatggtcccagcttgtgatgctattggaatggtggagctgtacggagtgcactctctttacagaccaggcaacagttgagagattcggcaaggagcatgctgtcattattctgaaccacaactttgagatcgattttctgtgcggatggactatgtgcgaaaggtttggcgttctggggagtagtaaggttctcgctaaaaaggagctgctgtacgtccccctgatcggatggacttggtactttctcgaaatagtattttgcaagaggaaatgggaggaggaccgcgacaccgtggtcgagggcttaagaaggctctccgattacccagaatatatgtggtttcttttgtactgtgaggggacccgcttcaccgaaacaaaacaccgtgtcagtatggaggtggccgcagcgaagggattacctgtgctgaagtaccacctcctgccgaggacaaagggcttcactactgctgtcaaatgtcttaggggcaccgtggctgccgtgtacgacgtgaccctgaacttccgcggaaataagaacccatcactgctaggtatcttgtatggcaagaaatacgaggctgatatgtgcgtcaggcggttccctctggaggatatcccactggatgaaaaagaagccgctcagtggctccataagttgtaccaagaaaaggatgccctccaggagatctacaatcagaaggggatgtttccaggcgaacagtttaaacctgctcgcaggccctggactctgctgaacttcctgagctgggcgactatcttgctatctcccctcttttcctttgtgctgggtgtgttcgcttccggtagtcccctactgatcctcaccttcctgggattcgtcggtgctgcatcctttggtgtccgaaggctaattggggtaacagaaatcgagaaaggctcctcgtacggtaatcaagagttcaaaaagaaagagtag

SEQ ID NO: 48089 - DNA, 768 bp, Artificial Sequence
  Description of Artificial Sequence: Synthetic coding sequence
atgggtctcctggccttcttaaagacccagtttgtgctacacttgttggtgggattcgtgttcgtggtgagtggactggtgattaacttcgtgcagctttgtaccctggccctgtggccggtttctaagcagctgtacagacggttgaactgtaggctcgcctactccttgtggtcccaactcgtgatgctgcttgaatggtggtcttgcacggaatgcacgctcttcaccgaccaagctaccgtggaacgcttcgggaaggagcacgcggttataattctgaaccacaacttcgaaatcgacttcctttgcggttggacgatgtgtgaaagatttggggtgttgggttcctctaaagtgttggctaagaaagagctcctgtacgtgccactgatcgggtggacctggtacttcctcgaaatagtgttctgcaagcggaaatgggaggaagatcgcgacactgtggtggaaggactgaggcgcctctccgattaccctgaatacatgtggttcctgctctactgcgagggcactaggtttacggagacaaaacatcgagtgagtatggaagtagctgcagcaaagggacttcctgtgctgaaatatcaccttctaccccgaactaagggattcacaacagccgtgaaatgcctgagaggtacagtggctgctgtctacgacgtgactcttaactttagaggaaacaaaaacccttcactcttgggcatcttgtacggtaagaaatatgaagccgatatgtgcgtatag

SEQ ID NO: 48090 - DNA, 1113 bp, Artificial Sequence
  Description of Artificial Sequence: Synthetic coding sequence
atggggctattggccttcctcaaaacacaatttgtgctccatctgctcgtggggtttgtctttgtggtgagcggtctcgtgattaattttgtacagctgtgcacgctcgccctctggccagtttctaaacagctgtataggaggctgaactgccgtttggcctattcgttgtggtcacaactcgtaatgttgcttgagtggtggagttgcactgaatgcacactttttaccgatcaggccacagtggaacgattcggaaaggagcatgctgtgattattctgaatcataatttcgaaatcgacttcctgtgcggctggacaatgtgcgaacgatttggggtgctaggcagctccaaggttctggctaagaaggaactcctatacgtgcccctgatcggctggacgtggtactttcttgagatagtgttctgcaagaggaagtgggaagaggatcgagacacggtcgtggagggtttacgcagattgtccgactatcctgagtacatgtggttcctgttatactgcgaggggacgaggtttactgaaacgaaacaccgcgtttccatggaagtggccgcagccaaagggcttcctgtgctgaagtatcacctgctcccccgaaccaaaggcttcacgactgcggttaagtgtctgcgaggaaccgttgcagctgtgtatgatgtgactctgaattttagaggcaataagaacccctcattgctaggtattctatacggaaagaaatatgaagcagatatgtgtgtgcggagatttcccctggaggatattcctttagacgagaaagagggacactgctggcccgtagctcctgtgactcatcctgagcccggtgctacacttgaagctccccgaagggagggccctggaccccctaccggcgtctggccagttaaactccccgcttgggccgttgtgagctggggtaggcggtggcctccttctctgggacctggagccaggtgccacggcgtgtcttgcccttcctctcagggatgtcactgctgcctccatcggctacctccgtgcgagaccttagtcgtgtggtactctgccacggtctatcagacacggactctttgcgaggtcctttag

SEQ ID NO: 48091 - DNA, 387 bp, Artificial Sequence
  Description of Artificial Sequence: Synthetic coding sequence
atgggactcctggccttcttaaagacccaattcgtgctccacctgctggtaggatttgtcttcgttgtttctgggctggtgatcaattttgttcagctgtgcacgctggcactgtggcctgtaagcaagcagctgtacagaagactgaattgccgattggcttactccctctggtctcagcttgtaatgttactggagtggtggtcatgcacagaatgcacattgttcaccgaccaggcgacagtggagcgcttcggaaaagagcacgctgtgatcattctcaatcataactttgagatagattttctctgcggctggaccatgtgtgagcgatttggagtccttggtagttccaaagtactagcaaaaaaggaattactgtactag

SEQ ID NO: 48092 - DNA, 240 bp, Artificial Sequence
  Description of Artificial Sequence: Synthetic coding sequence
atgggcctcttggctttcttgaagactcagttcgtgctgcacttgctggtggggttcgtctttgttgtgtcaggcttagtgatcaacttcgtccagttgtgcaccttggcactgtggccagtatctaagcagctgtataggcgactgaactgccgactggcatacagcctgtggagtcaattggttatgctgttggagtggtggtcatgcaccgaatgtacgctctttactgaccagtag

SEQ ID NO: 48093 - DNA, 117 bp, Artificial Sequence
  Description of Artificial Sequence: Synthetic coding sequence
atggggctgcttgcttttctgaaaacacagtttgttctacacttgctggtcggattcgtttttgtggtgagtggtcttgtgatcaatttcgttcagttatgtacgctggccttatag

SEQ ID NO: 48094 - DNA, 768 bp, Artificial Sequence
  Description of Artificial Sequence: Synthetic coding sequence
atggggttactcgccttcctgaaaacacagtttgttttacacctcctagtaggcttcgttttcgttgtgtcgggcttggtgattaacttcgttcagttatgcaccctggccctgtggcccgtctctaagcaactctatcggcgacttaattgcaggctggcatactcgctgtggagtcagctggttatgctgctggagtggtggtcttgtacagaatgtacattgtttactgatcaggctaccgtcgaacggttcggtaaagagcacgccgttattatcctcaaccacaacttcgagatagatttcctgtgcgggtggactatgtgcgagcgcttcggtgtcctgggctcttctaaggtactggcaaagaaagagctgctatacgtgcccctaatcggctggacatggtactttcttgaaattgtcttctgtaaacgcaaatgggaggaggatagggacacagttgttgagggactgaggcggctatcggattacccggaatacatgtggtttctgctgtactgcgagggcaccagattcacagaaaccaagcacagggtgagcatggaggttgcagctgctaaagggctccctgtgcttaaataccacttgctcccgcgaaccaagggctttactactgccgttaaatgtctcaggggtactgtggcagctgtgtacgacgtgacactgaattttcggggtaacaaaaatccatctctgctggggattctttatggtaaaaagtatgaagccgatatgtgtgtgtag

SEQ ID NO: 48095 - DNA, 1131 bp, Artificial Sequence
  Description of Artificial Sequence: Synthetic coding sequence
atgggcctgcttgcctttctaaagactcagttcgtccttcatctgctggtgggcttcgtgtttgtcgtgtccggcttggtgatcaattttgtgcagctttgcacgttggctctgtggcccgtaagcaagcaactctatagaaggctgaattgcagattagcgtacagcctgtggagtcaactcgtgatgcttctagaatggtggtcatgtactgagtgcacacttttcacagatcaagcgaccgtggagagattcgggaaagaacacgcagtgattatactgaaccataatttcgagatcgactttctgtgcggctggacaatgtgtgagaggtttggagtgttgggcagctcgaaagtcctggctaaaaaagaattgctgtacgtgcctttaatcggatggacctggtactttctcgaaattgtgttctgcaagagaaagtgggaggaggaccgtgatacagtggtcgagggactgcgcaggctgagcgattatcccgagtatatgtggttcctcttgtactgcgaaggtacccgttttaccgagacaaaacacagagtgagtatggaggtggcagcggcaaagggcctccccgtgctgaaataccacctgctgcccaggaccaaggggttcaccaccgctgtgaaatgcctgcggggaaccgtagccgcagtttatgatgtgacgctgaactttcggggtaacaagaatccgtctctccttggaattctgtatggaaagaaatatgaagccgatatgtgtgtacggagatttccgcttgaagatattccactggatgagaaggaggccgctcaatggttacacaaactgtatcaagagaaggatgccctacaggagatttacaaccagaaggggatgtttcctggcgagcagttcaaaccagctaggaggccatggaccctactgaattttcttagctgggcaacaatcctgctcagtcccctgttcagtttcgttctcggtgttttcgcgtccggtagcccactactaatcctgaccttcctgggattcgtcggtgcagcatctttcggagtgcgcagacttattggagtaacagaaatcgaaaagggctcatcctatggaaatcaggagttcaagaaaaaagaatag

SEQ ID NO: 48096 - DNA, 1137 bp, Artificial Sequence
  Description of Artificial Sequence: Synthetic coding sequence
atggacctcgcagggttgctgaaaagccagtttttgtgtcacctcgtattctgctacgtatttatagctagcggactgataatcaacacaattcaactctttactctgcttctgtggcccataaataagcagttgttccggaagattaactgtagactcagctactgtatatctagtcagttggttatgttattggagtggtggtccggcacagaatgcacaatatttacagatccacgtgcttacttaaagtacgggaaggagaacgcaatcgtagtgttgaatcataaattcgaaatagattttctgtgcggctggagtttgtcggagcgatttgggctgctcggtggctcaaaagtcctggctaagaaggaattggcgtacgtgccgatcataggctggatgtggtacttcacggagatggtgttctgctcccgaaaatgggaacaggaccgtaaaacggtcgccacttcactacagcatttaagagactatcccgagaaatacttcttcttgatccattgtgagggcactcgctttacagaaaagaagcatgaaatctcaatgcaggtggcacgggcaaagggactgcctagactgaaacatcacctgctgccacggacaaaggggtttgctatcaccgttcggagtcttagaaacgtggtgtcggctgtgtacgactgtaccctgaactttagaaacaacgagaatcctacccttctgggcgttttgaatggcaagaagtatcatgctgatttgtatgtaaggcgcatccccctggaggacattccagaggatgacgacgaatgcagtgcatggttacacaagctgtaccaagaaaaagacgcgtttcaagaggaatattataggacaggcacatttcccgagaccccaatggttccacccaggcgcccatggaccctggtgaattggctcttttgggcctcattggtcctgtacccattctttcagtttctcgttagcatgatcagatccggctccagcctgaccctggccagcttcattcttgtgttctttgtggcttctgtgggagtgaggtggatgattggagtaactgagattgataaaggctcagcatacggtaatagcgattcaaagcagaaacttaacgattag

SEQ ID NO: 48097 - DNA, 480 bp, Artificial Sequence
  Description of Artificial Sequence: Synthetic coding sequence
atggaccttgccggactcctgaagtcccagttcttatgccacttagttttttgttatgttttcatcgcctccgggctgattatcaacactatacaactgtttactctgctgctgtggccgattaacaaacaattgtttcgcaagattaattgccgattaagttactgcatcagttcccagcttgtgatgctcctcgaatggtggtctggcactgagtgtacaatctttaccgacccacgcgcttatctgaagtatggaaaagagaacgccattgtggtcctgaatcacaagtttgagatcgactttctgtgtggatggtcattgtccgagcgctttgggctcctgggcgtgagtcagaagtgtattcccccatgtctgacacacttctctggatccgcaccgccactggtgtttctcttgcttgtgattcagaacttacagaaaaaccagcagtccttctacctgatgaagtggagttag

SEQ ID NO: 48098 - DNA, 375 bp, Artificial Sequence
  Description of Artificial Sequence: Synthetic coding sequence
atgctgctggaatggtggtcagggacagagtgcacgattttcaccgaccctagagcctacctgaagtacgggaaagagaatgcgattgtcgtgctgaaccacaaattcgaaatcgactttctctgcggctggtctttgagcgaacggtttggccttttgggaggcagcaaagtgttggctaaaaaagaattggcctatgtccccataatcggatggatgtggtattttaccgagatggttttttgctcacgtaaatgggaacaggatcgaaagaccgtggccacatcattgcagcatttgcgcgattacccagagaagtatttcgtctgcaggcatcaaagcagctgcgttccacgtgcaccggcaggtctgtag

SEQ ID NO: 48099 - DNA, 402 bp, Artificial Sequence
  Description of Artificial Sequence: Synthetic coding sequence
atggacctggccggtctactgaagtcccagtttctatgccatctggttttctgctatgtgttcattgcctcaggcttgatcatcaataccatccaactttttacccttctgttgtggccaattaataagcagctgtttagaaaaataaattgtcggttgagctattgtatatctagccagctcgtgatgctcctagaatggtggtccggaaccgaatgtaccatattcaccgaccctagagcgtacctcaaatacggtaaagagaacgcaattgtcgtactcaatcacaaattcgaaatcgatttcctctgcggctggtcactcagtgaaagatttggactcctgggatttgacctcctgcacgtggcatgcatgccccttgaactggggctgttttcatag

SEQ ID NO: 48100 - DNA, 357 bp, Artificial Sequence
  Description of Artificial Sequence: Synthetic coding sequence
atggatctggcgggtctcctgaagagtcaattcctgtgccatttagtgttctgctacgttttcatagctagtggcctgattataaatacaatccagctgttcactctcctgttgtggccaattaacaaacaacttttccgcaaaattaactgtcgtctctcatattgtatatccagccgcctgcagggtccgggacaggagcgcgctggattatgccctaactatagactcgacgtggtgcttcatagggacggtttactgtttgcgcaggttggggcaggttcccaggacggttgccatcagtttgccgcacccccaggtctgcctagagaggtcttctttccggactcattgtag

SEQ ID NO: 48101 - DNA, 318 bp, Artificial Sequence
  Description of Artificial Sequence: Synthetic coding sequence
tgatcggccgtttacgattgtaccttgaatttccgcaataatgaaaatcctacactgctgggagtcctcaatgggaagaaataccatgcagacctgtacgtccggagaattcctctggaagacatccctgaggatgacgatgaatgtagcgcgtggttacacaaactctaccaggagaagggatggggcgacacagagttcagcaagcaatacgtttcggtgtcgcggccaggcaggctggcactatgcccaagtgagaaaatcgcggagcagcaagtcgaggttgtccatggattttcgaaacagagtggcgaatag

SEQ ID NO: 48102 - DNA, 651 bp, Artificial Sequence
  Description of Artificial Sequence: Synthetic coding sequence
atggatctggctgggctgctcaaatctcagttcctgtgtcacttggtgttctgctacgtcttcatcgcctcagggttaatcataaataccatacagctttttactctcctgctgtggccgatcaacaaacaactgtttagaaagatcaattgccgcctttcttactgcatctcatcactctcagccgtgtatgattgtacactcaatttccggaacaatgaaaacccgacgctgctgggcgttctgaacggaaagaaatatcacgctgacctttacgtacgaaggatacctctcgaggacattccagaagacgatgacgaatgtagtgcctggctgcacaagctataccaagaaaaggatgccttccaggaggaatattataggacgggcactttccctgagacacctatggtgcctccacggcgaccatggacactggtgaactggctgttctgggcgtcacttgttctgtaccctttctttcagtttctggtaagcatgataagaagtggctcaagcttgacactcgcctcgtttattctggtgttttttgttgcttccgtgggggtgcggtggatgatcggggtgacagaaatcgacaaggggagcgcttatggcaattccgacagtaaacagaaactcaacgactag

SEQ ID NO: 48103 - DNA, 1095 bp, Artificial Sequence
  Description of Artificial Sequence: Synthetic coding sequence
atgcttctcagcctggttttacatacatactcaatgcggtatcttctgccatccgttgtcttacttggcacagccccaacttatgtgctagcctggggagtgtggcggctcctgtcggcgttcttgccagcacggttttatcaggccctcgatgatcgactgtactgcgtttaccagagcatggtgctgttttttttcgagaactacacaggagttcagatcctgctatatggcgaccttcccaagaacaaggagaatattatttacctggccaaccaccagtccacagtagattggatcgtagcagatattctggcaatccgtcagaacgctctcggacacgtgcgctacgtactcaaagaaggcctgaaatggctccccctgtacggatgctacttcgcccagcacgggggaatttatgttaagagatccgccaaatttaacgagaaagagatgcgaaacaaactccagagctatgtggacgctggcacaccaatgtaccttgtgatctttcctgagggcacccgatataatcccgaacagactaaagtgttatcagcctcccaggcattcgctgctcagcgcggtctcgcagttctgaagcatgtcctgacccccagaatcaaagcaacacacgttgctttcgattgtatgaagaactacctagacgctatatacgacgtcacggtggtctacgaaggaaaggacgatgggggtcagaggcgtgagagcccgacgatgacagagttcctgtgtaaagaatgtcctaaaatccacatacatattgataggatcgataagaaagacgtgcccgaggaacaggaacacatgaggcggtggcttcacgaacggtttgagatcaaggacaagatgctcattgagttttatgagagccccgatcctgagcggaggaaaaggttccccggtaaaagtgtcaactccaagctttccattaagaagacattaccctctatgctgatcctgtctgggttgacggccggtatgctgatgacagatgctggcaggaagttatacgttaacacatggatttacggcacccttttgggttgtctctgggtgacaataaaggcctag

SEQ ID NO: 48104 - DNA, 564 bp, Artificial Sequence
  Description of Artificial Sequence: Synthetic coding sequence
atgggcggactcttctggcgatctgccctcaggggacttcgctgcggacccagggctcccggaccatccctcctggttcgccatggctctggagggccttcttggacaagggaacggacacttgtggctgttaaaccggacggcgttcagagacgcctggtgggggatgtgatccagaggtttgaacggagagggttcacactggtaggcatgaaaatgttacaggcacccgagtcagtacttgccgagcactatcaggatttgaggcgcaaaccattctatcctgccctgataagatacatgtcttcaggcccagtggtggctatggtctgggaaggctacaatgtggttcgggcatcaagggccatgatcggccatacagactcagccgaggcagctccaggcacaataagaggggatttctcagtccatatctcgcgcaatgttatccatgcctctgattctgtagaaggcgctcagagggaaatacagctgtggtttcaatcctctgaattagtctcctgggccgacggagggcagcactcttccattcatcctgcatag

SEQ ID NO: 48105 - DNA, 636 bp, Artificial Sequence
  Description of Artificial Sequence: Synthetic coding sequence
atggcgcagccgcctccagacgttgagggggacgactgtctgccggcatacagacacctgttttgccctgatctgctccgcgataaggtcgccttcatcaccggagggggatctggcatcggcttccggattgctgagatcttcatgcgcgctagcgaggaccagatgggacattgcagcagttcaggcacctgtttggccggtgttgccactttcatggtcatcgtgggtaagcagccccctaatcagaaatctcgtgagactaaagaacagggacgccagatcccattcgtttgtgtccgccatggctgccatacggtcatagcttcccggtcattgcctagagtgttgacggccgctcggaaactcgctggtgcgacaggccgaagatgtctcccactgagcatggacgtgcgagcccctcccgcagtcatggccgctgtggatcaggctcttaaagagttcggcaggattgacatcctcatcaattgcagcagctcgagttgcgggcttcctttctgtcgctgtgggcgagagctaccagtccctcggtggcggttggtcctgcagcggctccaagaccgggatggccatcgctaccagcgccacctacaatgcgtgtcctgtgccctgtag

SEQ ID NO: 48106 - DNA, 813 bp, Artificial Sequence
  Description of Artificial Sequence: Synthetic coding sequence
atgccccgagacaatatggccagcctgatccagagaatcgcgagacaagcttgtttgaccttccgtgggtcagggggtggacggggagctagcgaccgggacgccgcatcaggacctgaggccccaatgcagcccggattccctgagaacttatcaaagctgaaatccttattgacccagctccgagcggaagacttgaatattgctcccaggaaggcaacacttcagccgctccctccaaacctcccccctgtcacatacatgcatatctacgagaccgacgggttttccctcggagtgttcctgctgaaatcgggcacctccattccactccacgatcaccctggtatgcatggaatgctgaaggtactatacggcacggtgcgcatttcgtgcatggataagcttgacgccggaggaggccagaggccgagagcccttcctcctgagcaacagtttgagcccccactacagccgcgtgagcgggaggcagtgcgacctggggtgcttagatcccgagctgagtataccgaggcctcagggccttgtattttgacaccccaccgtgacaatctgcaccagatcgatgccgtggaggggccagcagcatttctggatatcctcgctccaccgtacgatcccgacgacggcagggactgtcattactatagagtgctcgagcccgtcagacccaaggaggcttcaagttccgcttgtgacctcccgagagaggtctggcttctggagactccacaagctgacgacttttggtgtgagggcgaaccttatcctggccctaaagtgttcccttag

SEQ ID NO: 48107 - DNA, 1032 bp, Artificial Sequence
  Description of Artificial Sequence: Synthetic coding sequence
atgctggcaacccgcctgtcaagacccctctctaggcttcccggaaagacactttcagcttgcgaccgagaaaatggagctcgccgacccctcttgctgggcagtacgtcatttattcccattgggaggcgtacctatgcaagcgctgctgaacctgtgggctcaaaggcagtgctagtcactggatgcgatagtggttttggtttttccctggccaaacacctgcattccaaaggcttcctcgtcttcgccggatgtctgatgaaggacaagggacatgatggggtgaaagaattggattcactgaatagcgatagacttagaacggtgcagctgaatgtgtgtagttctgaggaggtggagaaggtggttgaaatcgtgaggtcatcactcaaagatcccgagaaagggatgtgggggttagtgaataacgccggaatttctacgtttggggaggtggaatttacctccttagaaacctataaacaggtcgcagaggtaaacctctggggcacggttcggatgaccaagagcttcctgccgctgattcggcgtgccaaggggagagtggttaatatatcttccatgttgggaagaatggccaaccctgctcgtagtccgtactgcattaccaagttcggagtggaggcttttagtgattgtctgcgatatgaaatgtatcctctgggcgttaaggtctctgttgtggagcccggtaactttatcgcagccacaagtctgtatagtcctgaatccattcaggctatcgctaagaagatgtgggaagagctccctgaggtcgtccgcaaagattacggtaaaaagtatttcgacgagaagatagccaaaatggagacatactgtagttcaggctctactgacacatcccctgtaatcgacgccgttacacacgccctcactgcaactactccatacacaagatatcaccccatggactactattggtggcttaggatgcagattatgacccaccttccgggagctatttcagatatgatttacattaggtag

SEQ ID NO: 48108 - DNA, 1032 bp, Artificial Sequence
  Description of Artificial Sequence: Synthetic coding sequence
atgcttgccaccaggctttcacggcctctcagcagactgcctgggaagaccctgagcgcctgcgatcgggagaacggtgccaggagaccgctgctgcttggctctactagcttcattcctatcggacggagaacttatgccagcgcagccgagcccgtgggatcgaaggccgtgttggtcactggatgtgatagtggttttggatttagccttgcgaagcacttgcactctaaaggcttcctggtgtttgcagggtgcctgatgaaagataagggtcacgacggtgtgaaagaattggacagcctcaattccgatcgcctgcgtactgtgcagcttaacgtgtgcagctccgaagaggtggaaaaagttgttgagattgtgcggagcagcctgaaggatccggagaagggaatgtgggggctggttaataatgctgggatctctaccttcggggaggtcgagtttacgtccttggagacatacaagcaggtggcggaggtgaatttatggggtacagttagaatgaccaagtccttcctgccactcatccgcagggctaagggaagagtcgtgaacatatcctccatgctgggacggatggccaacccagcccgaagcccttattgcataaccaagttcggtgtcgaggcattttctgactgtttgcgctacgaaatgtaccccctaggcgtaaaggtgagcgttgtggagccaggaaactttattgccgctacatcgctctattcccccgaaagcatccaggcaattgcaaagaagatgtgggaggagctgcccgaggttgtcaggaaggattatggtaagaagtacttcgatgagaagatcgccaaaatggaaacctattgtagctcagggtctaccgacacatctcctgtgattgatgcggtgactcacgctttgaccgccacaactccatacacaagataccatcccatggattactactggtggctgagaatgcagatcatgacccacttacccggagctatctccgatatgatctacatccgatag

SEQ ID NO: 48109 - DNA, 1032 bp, Artificial Sequence
  Description of Artificial Sequence: Synthetic coding sequence
atgctggcaactcggctgtcacgacccttaagcagacttccagggaagaccctttccgcctgcgaccgtgagaacggagcccgtaggccactgctcctgggctcaacaagttttatccccatcggacgcaggacctacgccagtgccgcagagcctgtggggagtaaggccgtgctcgtcacaggttgtgactctggattcggattttcacttgcaaagcacttgcactcaaagggattccttgtctttgccggatgcctgatgaaggacaaaggccatgacggggtgaaagagttagacagcctgaattccgacagactgcggactgttcaactgaatgtgtgctcctcagaggaagtggagaaggtcgtggagatcgtacggagctctctcaaggacccagaaaaaggcatgtggggattagtgaataacgctggtatttcaacatttggcgaggtggaatttacaagccttgaaacatacaagcaagtggccgaggtcaatctttggggcacggtgcggatgaccaagtctttcctacctcttattaggagggctaaagggcgagtggtcaacatctcgagcatgctgggacgaatggccaatcccgctcgcagcccatactgcattaccaagtttggtgtcgaggcttttagcgactgcctgcggtatgagatgtacccactgggggtgaaagtgagcgtggtggagcctggtaacttcatcgccgcaacctctctttatagtccggagtctatacaggcgatcgcgaaaaaaatgtgggaagagttgccagaggtggtccgtaaggattacgggaaaaaatactttgatgaaaagatagccaaaatggagacctactgtagttccgggtctaccgacactagcccggtgattgacgctgtgacccacgcgcttactgccacgaccccctacacgcggtatcaccccatggactattactggtggctacggatgcaaatcatgactcaccttccaggggctatctccgacatgatctatattcgatag

SEQ ID NO: 48110 - DNA, 270 bp, Artificial Sequence
  Description of Artificial Sequence: Synthetic coding sequence
atgctagccacccgtctgagcaggcccctctccagactgcccggtaaaacactcagtgcatgcgacagggaaaatggggcaagacgccctctgctgttagggagcaccagctttattcctattggtaggcggacctatgccagtgctgcagagcctgttggttccaaagccgttctcgtgacgggatgtgacagtgggtttggattctccctggccaagcatctgcatagcaaaggcttcctggtcttcgcagggtgtctgatgaagtag

SEQ ID NO: 48111 - DNA, 771 bp, Artificial Sequence
  Description of Artificial Sequence: Synthetic coding sequence
atgaaggataaagggcacgacggcgtgaaggaactcgactccctgaattccgacaggctacgaacggtgcagttgaacgtctgcagcagcgaggaagtagagaaagtagtcgagattgtgcgaagttcattgaaagaccctgaaaaaggcatgtggggtttagttaataatgcgggaatttctacattcggcgaagtcgagtttacttctctcgaaacctacaaacaagtggccgaagtcaatttatggggcacagtgcggatgacaaagagcttcctccctctaattagacgtgctaaaggtagggtagttaacattagcagcatgctgggacggatggcaaaccctgctcggtcgccctactgcataaccaaattcggcgtagaagcgtttagtgactgccttcgatatgagatgtaccctctcggtgtcaaggtgagcgtagtggaacctggcaactttatcgctgcaaccagtctctactcgccagagtcaatccaggccattgcgaagaagatgtgggaagaattgcccgaggtggtgaggaaggattatggcaagaaatactttgatgaaaagattgccaagatggaaacctattgttcctccggttccaccgacacatccccagtcatagatgcagttactcatgcactgacagccaccacgccatacacccgctaccacccaatggactactattggtggcttcggatgcaaatcatgacacatctgccaggagctatctcggacatgatctatatccgctag

SEQ ID NO: 48112 - DNA, 153 bp, Artificial Sequence
  Description of Artificial Sequence: Synthetic coding sequence
atgctggctacgcggctctcacgccctctgtctagactccctggcaaaactctctccgcctgcgatcgcgaaaacggggctcgacgaccactcctcctggggagtacctcattcatccctataggaaggcgaacatacgcctcagctgcttag

SEQ ID NO: 48113 - DNA, 1011 bp, Artificial Sequence
  Description of Artificial Sequence: Synthetic coding sequence
atggcagcgtcattgcgactgctgggcgctgcttctgggctgaggtattggtcacggaggttgcggccagccgcaggaagtttcgcagcggtgtgttccagaagtgtggccagcaaaactccggtcggctttatcggtctgggcaatatgggaaacccgatggccaaaaaccttatgaaacatggatacccactaatcatatacgacgtatttccagatgcctgcaaagagtttcaggacgccggtgagcaggtggtgtcatctcccgcagatgtggccgaaaaagcagacagaattatcactatgctcccaacatcaattaacgctatcgaggcctattctggtgcaaatgggatcctcaaaaaagtgaagaaaggctccctcctcatcgattcgtcaacgattgaccccgcagtcagcaaggagctcgccaaggaggtggagaagatgggcgctgttttcatggacgcacctgtcagcgggggagtgggtgcggcaagatcaggaaatctcacgtttatggtcggaggggttgaagacgaattcgcagccgcacaggaattgttgggctgtatgggatcgaatgttgtgtattgcggagcggttggaacaggccaagccgcaaaaatttgtaacaatatgttgctggcgatcagtatgatcggaacagccgaggcaatgaatctggggatccggcttgggctagaccctaaacttctggccaaaattttgaatatgtcatcaggcaggtgctggagcagcgatacatacaaccccgtgccgggagtaatggatggagtccccagcgcaaacaactaccagggcggattcggaactaccttgatggcaaaagacctaggtttggctcaagactctgctacatctactaagtcgcccatcctcttaggcagcctcgctcaccagatatacaggatgatgtgtgcaaaagggtattcaaaaaaggacttctcctcagttttccagttcctgcgggaggaggaaacattctag

SEQ ID NO: 48114 - DNA, 1554 bp, Artificial Sequence
  Description of Artificial Sequence: Synthetic coding sequence
atggcagccctccgcctcttggccagcgttctcggcaggggggtgcccgctggcggatctgggcttgcgcttagccagggttgcgcaaggtgctttgccacatctccaagattgagagccaagttctatgccgatcctgtcgagatggttaaagatattagcgacggagctacggttatgataggcggatttggcctctgcggtataccagagaatttgatagccgctttactgcgcaccagagtcaaagatctgcaggttgttagctccaatgttggcgtggaggacttcggacttgggctactgcttgccgcacgccaggtgcgacgtattgtgtgctcttatgtgggcgaaaacacactgtgtgagagtcagtaccttgccggagaactggagcttgaactcacaccgcaagggaccctggcagaaagaatccgagctggaggggctggcgttcccgcattttatactccaacagggtatgggactttggttcaggaaggcggtgccccaataaggtacactcctgatgggcatctggcgctgatgtcacaaccgcgtgaggtccgggagttcaacggggatcactttctcctagaaagagctattagggcagactttgctttggtaaaagggtggaaagccgacagggctggcaatgtcgttttccgaagatctgctaggaacttcaatgtgcccatgtgtaaggcggctgatgtgaccgcggtcgaggtggaggaaattgttgaagttggcgcatttccgccagaagacatccacgtcccaaatatttacgtggaccgcgtgatcaagggacagaagtacgagaaaagaatcgagaggctgacaatcctcaaggaggaggatggagacgccggaaaggaggaggacgctcggaccagaatcatccgcagagccgctctggaattcgaggatggtatgtacgcaaacctgggtatcggaatcccgttgctggcttcaaatttcatctctccttctatgacagtgcatctgcattctgagaatggcattctgggtttgggaccatttccaactgaggacgaagtcgacgctgatctcatcaatgcagggaagcagaccgtcaccgttttgcctggcggatgtttcttcgccagtgatgattcattcgccatgattagggggggacatattcaactgaccatgctgggagcaatgcaggtcagcaagtatggtgacctagctaattggatgattccaggcaaaaaagtcaaaggtatggggggagccatggatctcgttagttcgcagaaaacccgggtagttgtgaccatgcagcactgcacgaaggataacaccccaaagatcatggagaaatgtacgatgccattaaccggaaagcgctgtgttgataggataataacggagaaagccgtattcgacgtgcatcggaaaaaggagctgacactccgggagctgtgggagggccttaccgtagatgatattaagaagtctactggttgcgcgtttgctgtgtcaccaaatctcaggcctatgcaacaggtggcaccctag

SEQ ID NO: 48115 - DNA, 798 bp, Artificial Sequence
  Description of Artificial Sequence: Synthetic coding sequence
atggcggctctgcggttactagcctccgtgttagggagaggggtgcctgcgggtggctccgggctagccctgagccagggctgtgccagatgcttcgccacatctcctcgtctgagagccaagttttacgccgacccggtggaaatggtgaaagatatatctgacggagcaacggttatgattggaggatttgggttatgcggaatccccgagaacctgattgctgctctgttaagaactcgcgtcaaggacctgcaggtggtatcaagcaatgtaggcgtcgaagactttggcctgggactcttgctcgcagcgaggcaagtccgccgtattgtatgtagttacgtgggcgagaatacactatgcgagtcccagtacctcgcaggcgagcttgaattggaactgacaccacagggtactttggcagagcgtatccgtgcaggcggagctggagtgccggctttttacacacctacaggctatgggaccttggttcaggagggtggagcaccgatccggtacacaccagatggccacctggcactgatgagccagccgagggaggtgagggaatttaacggcgaccactttctgctggagcgagccatccgagcagactttgcattagtgaaagggtggaaagcagatagggctgggaatgtcgtgttcagaaggagcgctcgcaattttaatgtgcccatgtgcaaagcagcggacgtgacagcagtcgaggttgaggagatagttgaagtgggagctagcccccagaagaccagtaccttccttacatttatgtag

SEQ ID NO: 48116 - DNA, 984 bp, Artificial Sequence
  Description of Artificial Sequence: Synthetic coding sequence
atgcttggccctcaagtgtggtcatctgtcaggcaaggactctcccggtctttgagccgaaatgtgggtgtttgggccagtggcgaagggaagaaggtggacatagctggcatttacccacctgtcacaaccccatttacagcaactgctgaggtggactacggtaaactggaggagaatttacataagcttggcacatttcccttccggggttttgtagtgcagggatccaacggcgagtttccattcctgacaagctccgaaaggctggaggtagttagccgagtcaggcaggccatgccaaaaaatcgtctgttactcgcaggctctggatgcgagtcgacgcaggcaactgtggagatgactgtgtccatggcccaggtgggggctgatgcagccatggtggtgactccttgttattataggggcaggatgagtagcgctgcacttatccaccattacacaaaagtcgcagatctgagtccaatcccggtggtgctgtactcagtccccgctaacaccggactggacctccccgtagatgcagtggtgacgctgagtcagcaccccaacatagtgggtatgaaggacagtggcggagatgtgactagaataggtttgattgttcacaaaacacgtaagcaagatttccaagtactggccggatccgccggattcctcatggcatcatatgccctcggcgcagttggcggtgtatgcgcccttgctaacgtgttaggagctcaggtctgtcaattggaacggctatgttgtacagggcaatgggaggatgcccagaaactacagcaccgtctgatcgagcctaacgctgctgtgacgcgcagattcggcatcccagggctgaaaaagatcatggactggtttgggtattacggtggtccctgtagagctccattgcaggagctcagcccagccgaagaggaggccttgaggatggactttacatctaacgggtggctgtag

SEQ ID NO: 48117 - DNA, 495 bp, Artificial Sequence
  Description of Artificial Sequence: Synthetic coding sequence
atgctaggacctcaagtgtggagtagcgtccgtcaggggctctcacgcagcctttcaaggaatgtcggcgtgtgggcaagtggagaagggaagaaggtggacatagcaggaatatacccaccagtgactactccgtttaccgccaccgccgaggtggattacggcaaactggaggagaatctgcataagttgggaactttcccctttcggggtgcggtaggcggtgtgtgtgccctcgccaacgtcttgggtgctcaggtttgccaactcgagcggctctgctgcacaggccaatgggaagatgcccagaaactgcagcaccggctgattgagcccaatgcagcggtgacccggagattcggcattcccggattaaagaagattatggactggttcggctactatggcggtccctgcagagctcccctgcaggagctctcacctgcagaagaagaggctttgcggatggacttcacatctaacgggtggttgtag

SEQ ID NO: 48118 - DNA, 612 bp, Artificial Sequence
  Description of Artificial Sequence: Synthetic coding sequence
atggctgccgctgccgtgtcctcggccaagaggtcactgcgtggcgagcttaagcaaaggctgagagccatgtccgccgaggagcgcctgcgtcagtctagggttctgagtcagaaggtgatcgcccactcggagtaccaaaagtccaaacggattagtattttcctgagtatgcaggatgaaatcgagaccgaggagatcatcaaagatatatttcagcggggaaaaatatgtttcatccctaggtaccgatttcaatctaaccatatggatatggtcaggatcgaatcccccgaagaaatttccctgttgcctaagacaagctggaacatccctcaaccaggagagggcgacgtgcgagaggaggccctgtctaccgggggtctggatcttatcttcatgccagggcttggattcgacaaacatggtaacagactggggcgtgggaaaggttattacgatgcctatctgaagaggtgtcttcagcaccaggaagtgaaaccttacactctggccctggcctttaaggagcagatctgtcttcaggtccctgtgaatgaaaacgatatgaaggtggatgaagtgctttacgaagattcttccactgcatag

SEQ ID NO: 48119 - DNA, 1392 bp, Artificial Sequence
  Description of Artificial Sequence: Synthetic coding sequence
atgcatcggtcattcctccaggctcgaagatctcgcaacacaactaggcctgctttgcttcgtctgtcagactatctgctaaccaactatcggaaaggggttcggccagttagagactggagaaagccaaccacagtgtcgatcgatgtcattgtatacgccattctgaacgtggacgagaagaaccaggtcctaaccacctacatctggtatcgccagtactggaccgacgaatttctccagtggaaccccgaagacttcgataatattacgaagctctcaattcccacagacagcatctgggtgccagacatcctgattaacgaattcgtggatgtcgggaagtccccgaatatcccttatgtatacatcaggcaccagggcgaggttcagaactataagccccttcaggttgtgaccgcctgcagtctagatatctataatttcccgttcgacgtacagaactgctcgctgaccttcacttcatggctccacactatccaggatataaacatcagtctatggaggctccctgagaaggtgaagtcagacaggagtgtgtttatgaaccagggcgaatgggagctccttggtgtgctaccttactttcgggaatttagtatggaaagcagtaattactacgccgagatgaagttttacgtggtcatccgtcgcagacctctgttctacgtggtctctctccttctgccgtcaatctttctcatggtaatggatattgtgggcttttacttgccgcctaacagcggagagcgagtgtcatttaagatcactctgttgttggggtattcagtttttctaatcatcgtgtctgatacactgcccgctacagctattggcacgccattaatcggggtttacttcgtcgtctgtatggcactgctagtaattagcctggccgaaactatcttcatagttcggttagtgcacaaacaagatttacagcagcccgtacctgcctggctgagacatcttgtcctggagcggatagcttggttgctgtgtctccgggagcagagcaccagtcaacggcctccagcaactagtcaagctacaaagactgatgattgcagtgctatgggaaaccattgcagccatatgggaggaccacaggattttgagaaaagccctagagaccgttgcagcccgcctccaccaccgcgtgaagcaagtctggccgtatgtggcctgctgcaagagctctctagcatcagacaatttttagagaagagagacgagatcagggaggtggcgagagactggctccgcgtcggcagtgttctggataagctcctgttccatatctacttgctggcagtcctagcttatagcatcaccctggttatgctctggagcatctggcagtatgcctag

SEQ ID NO: 48120 - DNA, 1551 bp, Artificial Sequence
  Description of Artificial Sequence: Synthetic coding sequence
atgctgggcaaactggctatgctgctttgggtacagcaggctctgcttgccctgctgctaccaacactgctggcccagggtgaagctagaaggtctcgaaatacaactaggcccgctttgttgagattgtctgattacctgctaaccaactatagaaaaggcgtacgaccggtgcgggactggagaaagcccactacggtgtccatcgatgtgattgtgtatgccatcttgaacgtcgacgagaagaaccaagtgctcaccacgtacatatggtatcgtcagtactggacagacgagttcctacagtggaacccagaagacttcgataatattactaaactctctatcccaacagattcaatatgggtgccagatatattgatcaacgaatttgtagatgtaggcaagtcgccaaacatcccttatgtgtacattagacatcagggcgaagtccagaattataagcccctgcaggtggttactgcatgttccctggatatctacaattttccattcgatgtgcagaactgcagtctaacattcacaagttggctccacacaatccaggacatcaacatcagcctgtggcggctccctgagaaagtcaagtccgataggagcgtctttatgaatcagggagaatgggagctgctgggtgtattgccctattttcgggaattttctatggagagttctaactattacgcagagatgaaattttatgtcgtcatccgtcgcagaccattgttttacgttgttagcctactactgccatctatctttttgatggttatggacattgtaggattctatctgcctccaaacagcggggaacgcgtgtctttcaagatcaccttgttgctgggttattccgtttttttgatcatcgtcagtgacaccctgccagccacagcgattggtacccccctcatcggaaaggcccctccagggtcgagggcgcagagcggggaaaaacctgccccatcccaccttctccatgtctctcttgcttcagctctgggctgtacaggtgtctacttcgttgtctgtatggctttgctggttatcagcctggccgaaactatttttatagtgagactggtccataagcaggatttacaacaaccggtccctgcgtggcttagacacctggtgttggaacggatcgcctggttactgtgcctacgcgagcagagcacatcccagcggcctccagcaacaagccaagctacaaagacagacgattgctccgccatgggcaaccactgcagccatatggggggaccgcaggattttgaaaagtcacccagagatcggtgtagcccccctccccctcctcgggaggccagcctcgccgtctgcggacttctccaggaactctctagcataagacaattcctggagaaacgggacgagattagggaagttgccagagattggctcagggtggggtcagttttggataagcttctgttccacatttatcttctcgctgttctggcctacagtatcacactggtcatgctgtggagtatctggcaatatgcatag

SEQ ID NO: 48121 - DNA, 1455 bp, Artificial Sequence
  Description of Artificial Sequence: Synthetic coding sequence
atgctggggaagctggctatgctgctctgggtccaacaggccttattggcactgcttctgccgacactcctggctcagggagaagcacgacggagtcgaaatactacgagaccagccctccttcgattgagtgactatctactcactaattaccggaagggggtgagaccagtgagagactggagaaagcccactacagtgtctattgatgtaatcgtttatgctattctgaatgtggacgagaaaaatcaagtgctaacaacatatatttggtaccggcagtattggaccgatgaatttttgcagtggaatcccgaagattttgacaatatcaccaagttatccattcccacggacagcatctgggttcccgatatcctgatcaacgagttcgtggacgtgggcaaaagcccaaatatcccgtacgtgtatatccgacatcagggagaggtgcagaactataaacccctgcaggtagttaccgcgtgcagcttagatatatataactttccttttgacgttcaaaactgttccctgacgttcacaagttggctccacaccatacaggatatcaatatttccctgtggagattacctgagaaggtcaaaagcgatcggtcagtgtttatgaaccaaggggagtgggaactgcttggggtgcttccctactttagggagttcagcatggaaagttctaattactacgcagaaatgaagttctacgtagtgattcggcgtcgcccactgttttacgtcgtttctctcctactcccctccatcttcctgatggttatggacatcgtgggtttttacctcccccctaattccggtgaacgcgtgagtttcaaaattacactcctcctcggatactctgtctttttaatcattgtgagtgatacactgccagccaccgccattgggactccactgattggagtgtatttcgtcgtctgtatggctctgctggtgatcagcctagccgagacaattttcatcgtccggctggtgcacaaacaggacctccagcagcctgtccctgcttggttgaggcatcttgtgttggagagaatcgcatggctgttatgcctgagagaacagtctaccagccagaggcctcccgctacttctcaggcgactaagactgatgactgttctgccatgggtaatcactgcagtcatatgggaggccctcaggacttcgaaaagtcaccccgagaccgctgctccccgcctccccctccacgggaggcatcattggccgtgtgtggcctgttacaggaactgagctccatacgacagttcctagaaaagagagacgaaatcagggaagtggccagagactggctgagggtgggctctgttctcgacaagcttctgttccacatttacctgctggcagttttggcctactcgattactctggtgatgctttggagcatctggcagtatgcatag

SEQ ID NO: 48122 - DNA, 1437 bp, Artificial Sequence
  Description of Artificial Sequence: Synthetic coding sequence
atgctcctctgggtacagcaggctctgcttgccctgctattacctacgctgctcgctcaaggtgaagccaggaggtcccgaaacaccactcgccctgctctactccgactaagtgattacctcctcaccaactaccggaagggagtaagacccgtgagggactggcggaagcccactacagtatctatagacgtgatcgtctatgccattttaaacgtagatgagaagaatcaggtcctgacgacctatatctggtataggcaatattggacagatgaattcctgcagtggaacccggaggattttgataacatcacaaaactttcaatcccaacagatagcatctgggtgccggatattttaataaatgagttcgtggatgtgggaaaaagccccaacatcccttacgtctatattaggcaccaaggtgaggtccagaattacaagcctctgcaggtcgtgacagcttgctccttggacatctacaactttcctttcgatgtccagaattgttccctgacctttacctcatggctccacactattcaggatatcaacataagtctctggcgattacctgagaaagtgaagtccgatagatccgtgtttatgaatcagggtgaatgggagctgctgggcgtccttccctactttcgcgagttttctatggagagcagcaactattatgctgaaatgaaattctatgtggtgatccggagaagaccgctcttctatgtcgtgagtctgttactcccttccattttcctgatggtgatggatatagtaggattctacttgccaccaaactctggcgaacgggtgtcattcaaaatcaccttacttctgggctatagcgtgttcctgatcatcgtctccgacacccttcctgcaacagctataggcacacctctgatcggtgtgtatttcgtcgtctgcatggcgctgctcgtaatcagtcttgctgaaaccattttcatcgtgcgactggtacacaagcaagacttgcaacaacctgtccccgcttggctcagacacctcgtgcttgaaaggatagcctggctgctttgtttgagggaacagtccacgagccaaagaccccctgctacaagccaagccacaaagactgacgattgtagcgctatgggaaatcattgtagccatatgggcggtccccaggattttgaaaagtctccgagagaccggtgtagtcctcctccaccacccagagaggcgagtcttgcagtgtgtggactattacaagaactgtcttctatccgccagtttttagagaaacgcgacgagatccgagaagtggcacgggattggcttcgagttggcagcgtcctggacaaattgctgttccacatttatttgcttgctgttctggcttactccatcacccttgtaatgctctggtccatatggcagtacgcttag

SEQ ID NO: 48123 - DNA, 1533 bp, Artificial Sequence
  Description of Artificial Sequence: Synthetic coding sequence
atgctgctgtgggtgcaacaggcactgctcgcactgttgttgcctacccttcttgcacagggcgaggccagacgctctagaaacaccaccaggcctgccctgctgcggctgagcgattacctcctgaccaattacaggaagggggtcagacctgtacgtgactggcggaaacctaccacggtgtctatcgacgtaatagtttatgccatcctgaacgtggatgagaagaatcaggttctgacaacctatatctggtaccgccagtattggacagatgagtttctccagtggaatcccgaagactttgataacataactaagctgtccatcccgaccgattctatttgggtcccggacatactcattaatgagtttgtggacgtcggaaagagtcccaatatcccgtacgtgtacattcggcaccagggggaggtgcagaactataagcccttgcaagtagtgacagcctgcagcctcgacatttacaactttccctttgacgtgcaaaactgcagtctgaccttcacttcttggttgcacacaatccaagatattaacatctctctatggaggctgcccgaaaaagtgaagtctgacaggtcagtatttatgaaccagggggagtgggagctgctgggcgtgctaccctacttccgcgagttttccatggagtcatcaaattactacgctgagatgaaattctacgtggtgattcggagaagaccactgttttatgtcgtttccctgctgctgccatccatctttcttatggtcatggacattgtgggcttctaccttcccccaaatagcggtgaaagggtgtcttttaaaattaccctactgcttggatatagcgtttttctgatcatcgtgtcagatacgctccctgcgaccgcgataggtacccctcttataggtaaggccccacccggaagcagggcacagtctggcgaaaaacctgcgccatcccacttactgcatgtctcgctagcttctgctttgggttgcacgggtgtctacttcgttgtttgtatggctctcctagtgatcagtctggccgagacgatattcatcgtgagactggttcataagcaggatctacagcagcctgtgcctgcttggctgcgccatttggtgctcgaacggatcgcttggttgctctgtctacgagaacagtcaacgagccagagaccgccagctacctctcaggcaactaaaaccgatgattgcagtgctatgggcaatcactgctcccatatgggcggaccacaggactttgagaagtctccaagggacaggtgtagtcctccgcctccaccaagagaagcatctctggccgtgtgcgggctgctccaggaactatcctctatccgccagttcctagaaaaaagggacgaaatcagggaggtggcgcgagactggctgagagttggtagtgtgcttgataaactgttgttccacatctacctgctggccgttcttgcctactctataaccttggtcatgctgtggtctatctggcaatatgcctag

SEQ ID NO: 48124 - DNA, 717 bp, Artificial Sequence
  Description of Artificial Sequence: Synthetic coding sequence
atgctgctttgggttcaacaggctttattagccctcttattgcccacgctcttggcccagggcgaagcccgtcggagtcggaatacaacccgacccgcactgctgcgcctgagtgactatctgttaaccaactatcgtaaaggcgtgcgcccagtaagagactggcgcaaacctactacagtttctatcgacgtgatcgtgtatgccatcttaaacgtagacgagaaaaatcaggtgctgactacttatatctggtataggcagtactggactgacgagttcctccagtggaaccctgaggacttcgacaatattacgaaattatctattcccacagattcgatctgggtgccggacattctgattaacgaattcgtcgatgtgggcaaatctccaaatattccctatgtgtacattcgccaccagggtgaagtgcagaattataagcccctccaggtggttactgcatgttcactggatatctacaacttcccgttcgatgtgcagaactgctctctcacgttcacaagctggctgcacacgtcagggcatccacctgcggcacccctgctatgtggccagcctgcaactgcgcaacatctgcctcacggtcatgggcaccggggactcctgcccgctccacagcaatggagagagggcctctttcaagattacacaccccctggcctcctggggcttcctgatcataggttctag

SEQ ID NO: 48125 - DNA, 669 bp, Artificial Sequence
  Description of Artificial Sequence: Synthetic coding sequence
atggtgatggatatagtcgggttctaccttcccccaaactctggggaacgtgtctcctttaaaatcactctgctccttggatacagtgtgtttctgatcatagtgtctgacaccctaccagctacggcaattggtacacctctgatcggagtttatttcgtggtgtgcatggcactcctagttatcagtctggcggaaaccatcttcatagtgaggttagtgcataagcaggacctgcagcaacctgttcccgcatggctacgtcatctggtgctcgagcgcatagcttggctgctctgtctcagagagcagagcacctcccagaggccgcctgccacatcacaagctacgaaaacagatgactgcagtgccatggggaatcattgttcccatatgggaggccctcaggacttcgagaagagtccccgagatcggtgttcaccacctccccctccgagagaggcttctctcgcggtgtgcgggctgcttcaagagctgtcgtctatccgccagtttttggaaaaacgcgatgaaattcgggaagtagctagagattggctgcgggtcggtagtgtgctcgataaactcctgtttcacatctaccttcttgcagtgctagcatactccatcaccctcgtgatgctgtggtcaatctggcaatatgcgtag

SEQ ID NO: 48126 - DNA, 5349 bp, Artificial Sequence
  Description of Artificial Sequence: Synthetic coding sequence
atgggtgctggtagttccacggagcagaggtcccccgagcaaccacctgaaggctccagtacccccgcagaacctgaaccatcgggcggaggcccttctgctgaagccgctcctgataccactgcagatcccgctatcgcagcctctgatccagccaccaagctgctccagaaaaacggccagctgagcactattaatggtgtggccgaacaggacgagctttcgctgcaggaaggcgacctcaacggtcaaaaaggggcattaaacggccagggagcactcaatagtcaagaggaggaagaagttattgtcaccgaggtgggccagagagacagcgaggacgtgagcaagcgcgatagtgacaaagagatggcaactaaaagcgccgtggtccatgatattactgatgacgggcaggaagaaacccccgaaattatagagcagatccccagttccgagagcaatctggaggagctgacgcaacctaccgaaagccaggcaaacgacattgggttcaagaaggtttttaagttcgtcggctttaagtttacagtgaagaaagacaaaaccgaaaagcctgatacagtgcagctcctgacagtgaagaaggatgagggtgaaggcgcagcgggtgccggagaccataaggatccatctcttggggctggagaagccgcatcgaaggagtccgaaccaaagcaaagcactgagaagccagaagaaactctgaagcgggagcaaagccatgctgagatctctcctccggctgagtcaggccaggccgtggaggagtgtaaggaagaaggcgaggagaaacaggagaaggaaccctctaaatctgcggaatcccctacgtcaccggtgactagtgaaacagggagcactttcaaaaagttcttcacgcaggggtgggcgggatggcgtaagaaaacttcattcaggaagccgaaagaggacgaggtggaagcctctgaaaagaagaaggagcaggaaccagagaaggtggacaccgaagaggatgggaaggctgaggtggcatctgagaaactgaccgcttcagaacaggcgcatcctcaggaaccggcagaaagcgcacacgaacctagacttagcgctgagtacgaaaaagtcgagctacccagcgaggagcaggtctcaggaagccaaggccctagcgaagagaaacccgcacccttggcaaccgaagtattcgatgagaagatcgaggtgcaccaggaggaagtggtggctgaggtgcatgtgtcaacagtcgaggagcgaaccgaagagcagaagacggaggtggaggagacagctgggtcagttccagctgaggagctcgtcgaaatggatgcggagccgcaggaagcagagccagccaaagagctcgtgaaactcaaagaaacttgtgtctctggtgaagatcccacccagggagcagatttgagtccagacgaaaaggtgctttctaagccaccagagggcgtcgtgagtgaggtcgaaatgctctcctcccaggagcgtatgaaagtgcagggcagccccctcaagaagctgttcaccagcaccggtttaaaaaagttgtccggaaaaaagcagaaagggaaacgcggtggtggcgacgaagagtccggggagcatacccaggtgccggcagattcgccagattcccaggaagagcaaaaaggagaatcttccgcctccagtccagaggaacccgaggaaatcacgtgcttggaaaaagggctggccgaggttcagcaggatggggaggccgaagaaggcgctactagcgatggtgagaaaaaaagggaaggcgtcactccttgggcgtcattcaaaaagatggtcacacctaagaagcgggtgagaagacccagtgagtctgacaaggaagacgaactggataaagtgaaatcagccactctctcttccaccgagtctacagctagtgagatgcaggaggaaatgaaggggtccgtggaagaacctaaacctgaagaacccaaaaggaaggtggacacctccgtgtcatgggaagccctgatctgcgttggttcgtctaagaagcgggcaaggaggggaagctcatccgacgaggaaggcggacctaaagccatggggggtgaccaccagaaggccgatgaagcagggaaggacaaagagacagggaccgatggcattcttgcagggtcccaggagcacgatcccggtcaggggtcgtcgtccccagagcaggccggatcccccactgaaggcgagggagtgtccacttgggagtcatttaagcggctggttacaccccgaaaaaagtccaagtctaaactggaagagaaatctgaggacagtattgctggttcaggtgtggagcatagcactccagataccgaacctgggaaagaggaaagctgggtctccataaaaaaattcatccctggtcggaggaaaaagcggcctgacggtaaacaggagcaagcccctgtggaggatgccggaccaaccggcgcaaatgaagatgactcggatgttcctgctgttgtgccactttcagaatatgatgccgtcgagagggagaagatggaagcgcagcaagcccaaaagagcgccgagcagcctgagcagaaggccgctactgaggtcagcaaagaactgagtgagtcccaggtgcacatgatggccgctgctgttgccgacggtacccgagctgccaccatcatcgaggagagatccccatcttggatttccgcaagtgtcacagaacctctggagcaggtggaggccgaggccgcacttctgaccgaggaagtactcgaaagggaggtaattgcagaggaagagccccctactgtcacggaacccctgcccgaaaaccgcgaagccagaggtgacacagtggtgagtgaggctgagctcacaccagaggcagtcacagccgctgaaacagcgggtccactgggggctgaggagggaaccgaggccagtgctgctgaggaaaccaccgagatggtttctgctgtttcgcagctcaccgactcccccgatacaaccgaggaagctacaccagttcaggaagtcgaggggggtgtccctgatatcgaggagcaggagcgcaggacccaggaagtcctgcaggccgtggctgaaaaagttaaggaggagtcacagctgcctggaacgggcggacctgaggacgtgctgcagccggtgcagcgagccgaagccgaaaggcctgaggagcaggcagaggcttccggcctgaaaaaagagaccgatgtggtcctgaaagtagatgcccaggaggccaaaaccgaaccctttacccagggcaaagtggtgggccagacaactcccgaaagcttcgaaaaggccccacaggtaacagaatccattgagagcagcgagcttgttacaacttgccaagctgagaccctagctggggtcaagagtcaggaaatggtcatggagcaggccattccccctgactcagtggaaacacccacggattccgaaacagacggctctacaccggttgccgactttgatgcaccaggtaccacccaaaaggacgagattgtggaaattcacgaggaaaacgaagtcgcaagcggaacacagtcagggggaactgaggccgaggctgttccagcgcagaaggaacgaccccctgcccctagctcttttgtctttcaagaagaaaccaaagagcagagtaaaatggaggacacccttgagcataccgataaggaagtgtccgttgagacagtgtcaatcctaagtaaaactgagggtacacaggaagcggatcagtatgctgatgaaaagaccaaggatgtcccgttcttcgagggcctggagggcagcattgacactgggatcaccgtgagcagggaaaaagtcacagaagtagcgctgaaaggagagggcacggaagaggccgagtgcaagaaggacgacgccctcgaactccagtcccatgctaagagtcctccttctcccgtcgaacgtgagatggttgtgcaagtagaaagagagaagacggaagcagagcccacacatgtgaacgaggagaaactggaacacgagacagctgtgactgtgagcgaagaggtgagtaaacaactgttgcagacagttaacgttcccataattgacggcgctaaagaagtgtcctctctcgaagggagccctcctccatgcctgggccaggaagaagctgtatgcaccaaaattcaagttcagtcaagcgaagccagcttcactcttaccgccgcagccgaagaagaaaaagtgctgggggagacagcgaacattctggaaacgggggagaccctggaacccgctggcgcacacctggtcctggaggaaaagtcttccgagaaaaatgaagacttcgcagcgcatccaggagaagacgcggtgcccacaggacccgactgtcaggccaagtctactcccgtaatcgtgtcggccactacaaagaaagggttgtctagcgatctggagggagaaaagacaacctctctcaagtggaagagcgacgaggtggacgaacaggtggcttgccaggaagtgaaggtgagcgtggctattgaagacctcgaaccagaaaacgggatcctggagctggagaccaaaagctcaaagctcgtacagaacatcattcagacggccgtcgaccagttcgttcggacggaggaaacagcaacagaaatgctgacgtctgagttacaaacccaggcacacgttattaaggccgatagccaagacgccggacaagagaccgaaaaggaaggggaggaaccccaggcctctgcccaggacgaaaccccgataacaagcgcaaaggaagagtccgaatcaactgccgttgggcaggcccattccgacatcagcaaagatatgagcgaggcctctgagaagacaatgactgttgaggtggagggatctaccgtcaacgatcagcagttggaggaggtggtcttgccgtcggaagaggagggcggaggtgcaggcacgaagtccgtacccgaagacgacgggcacgctctgctagccgagcgcattgagaagtcactagtcgagccaaaggaagatgaaaagggcgacgatgtcgatgacccagagaatcagaactcggcccttgccgataccgatgcaagcggaggtctgacgaaggagtctcctgacaccaacgggcctaagcagaaggaaaaggaggacgctcaagaggtcgaactgcaggagggtaaagtacactccgaatcggataaagcaataactccacaggctcaagaggaactgcaaaaacaggagcgtgaatccgctaaatctgagttaacagagtcataa

SEQ ID NO: 48127 - DNA, 5054 bp, Artificial Sequence
  Description of Artificial Sequence: Synthetic coding sequence
atgttgggaactataacaatcacagtcgggcaaagggacagcgaagatgttagcaagcgggattctgataaggaaatggccactaagtctgccgtcgttcacgacatcactgatgatggacaggaggagacccccgagatcatagaacagattccctccagcgagtcgaacctcgaagaattaacccagccgaccgagagccaggccaatgatatcgggttcaagaaggtctttaagttcgtgggctttaagtttactgtgaaaaaagataaaaccgaaaaaccggataccgttcagcttttgacggtcaagaaggatgagggggaaggggctgccggtgctggggatcataaagacccaagcttgggcgcaggcgaggcggcatccaaggaaagcgagcccaaacaatcaacagaaaaacccgaggaaactctaaagcgggaacagtcccacgcagagatttcacctcccgcagagtccggtcaggcagtggaagagtgcaaggaggagggggaagaaaagcaagaaaaggagccttccaagagtgcagaaagccccacttcacccgtgacttcagagaccggctcaaccttcaagaagttctttacgcaagggtgggctggatggcggaaaaagacatcatttagaaagccaaaagaggatgaggtggaagccagcgagaaaaaaaaggaacaggagccagagaaagtggataccgaagaggacggaaaggccgaggtggcctccgagaaattgaccgcctctgaacaggcccacccacaggaaccggcagagtcagcccatgaacctagactgtccgctgagtatgaaaaagtggagctgcctagcgaagaacaggtgtcgggcagtcagggaccatcggaagaaaaaccagccccacttgcgactgaagtctttgacgaaaagattgaagtacatcaagaagaagtggtcgccgaggtccatgtcagtacggtcgaagaacgcactgaagaacaaaaaacagaagtggaagaaactgccggtagtgttcccgctgaggaacttgtggagatggatgcagaaccccaggaggcggagcctgctaaagagctggtgaaattgaaggagacatgcgtgagtggtgaagaccccacacagggtgctgacctaagcccagacgagaaggtgctttctaaacccccagagggtgtagttagtgaggtggaaatgcttagttcccaggagcgaatgaaggttcagggctcccctcttaagaagctcttcacatccactggactgaaaaaactcagtggaaaaaaacagaagggcaaacgcggtgggggagatgaagagtctggtgagcatactcaagtccctgccgactcacctgattctcaggaagaacagaagggcgaaagctccgcttcgtcaccagaagagcctgaagaaatcacctgcctggaaaagggtctggccgaggtgcagcaggatggcgaggccgaagagggcgctacaagcgatggcgaaaaaaagagagagggcgtgactccgtgggcctcattcaaaaagatggtgacacctaagaagagagtccgtaggcccagcgagagcgataaggaggacgagctggataaggtcaagagcgccacccttagttcaactgagtcaactgcttccgagatgcaggaagaaatgaaaggatcagtcgaggaaccaaagccagaggagccaaagagaaaggttgacacctccgttagctgggaggcattaatttgcgtcgggtcatcgaaaaagagggcgaggagggggtcatccagcgacgaagagggcggacccaaggccatgggtggcgatcaccagaaagccgatgaggctggtaaagataaggaaactggcaccgacggaatattggccggatcccaagaacatgacccaggacagggctcatcatctccagagcaggccggatccccaactgaaggtgaaggcgtgtcaacctgggaatcttttaagagacttgttacacccaggaagaaatctaaaagcaaattagaagaaaaatcagaagactcgattgcagggtcgggcgtcgagcatagtactccagacacagaaccgggaaaggaggaatcctgggtctctatcaagaagtttataccaggaaggagaaagaagaggccagacgggaaacaagaacaggctcccgtggaggacgcaggccctaccggagcaaacgaggacgactcagacgtcccagcagtggtacctctgtccgaatacgacgcggtggaacgagagaagatggaggcccaacaggctcagaagagcgctgagcagccagagcagaaggctgccacggaggtcagcaaggagcttagcgagtcccaggtgcatatgatggccgcagcagtggcagacggcacccgcgctgccaccatcatcgaagagagatctcccagttggatttctgcttctgttaccgagcctctggagcaggtggaggctgaggccgctctcctaacagaagaagtgttggagagagaagtgatcgcagaggaggagcctcccacagtgaccgaacccctgcctgaaaatcgggaggctcgtggagacacggtggtcagtgaggcagagcttactcctgaggccgtgacagcggctgagacagctggtcccctgggtgccgaggagggcaccgaagcctcagccgcagaggagacaaccgagatggtgtccgcagtgagccagctcacggactcccccgatacgacggaggaggccacccccgtacaggaggtagaggggggtgttcccgatattgaggaacaggagcggaggacacaggaggttttacaggcagtggccgagaaggtcaaggaagagagccagctgcccggaaccggcggtcccgaggatgttctccagccggtgcagcgtgccgaggcagaacgacctgaggagcaggctgaggcatcagggttgaaaaaagaaactgatgtagtactgaaggtagatgctcaagaggcaaagacggaacccttcacccagggtaaggtcgtgggccagacaaccccagagtcttttgaaaaagccccacaggtgactgagtctattgaatcctcagagttagtgactacttgtcaggcggaaaccctcgccggagtgaaatcgcaagagatggtgatggaacaggctataccgccagactctgttgagacgcccaccgactctgagactgatggttccacacccgtggctgattttgatgcccctggcaccactcagaaggacgaaattgtcgagattcacgaggagaatgaggtggcctcagggacccagtccggcggaaccgaggccgaggctgtgcccgcacagaaagagcgcccaccagcgccttccagttttgtgttccaagaggagaccaaggagcagagtaaaatggaggatacactggagcataccgacaaagaagtgtccgtggaaaccgtgagcatcctgagcaaaacagaagggactcaggaggcagaccagtatgctgatgaaaagactaaagacgtgccattttttgaaggcctcgagggttccattgataccggcatcacagtgtcgagggagaaagtcactgaggtagccctcaagggcgagggaaccgaagaagcggaatgcaaaaaggacgacgctctggagctgcagagtcatgcgaagagccccccaagccctgtggagcgagaaatggtggtgcaagtcgagcgagagaagacagaggctgagccaacccacgttaacgaggagaaactggaacacgaaaccgcagttaccgtctctgaagaggtcagcaagcagttacttcagaccgtgaacgtgcctattatagacggcgcaaaagaggtatcatccttggaggggagccccccaccttgtcttggccaggaggaggccgtttgcaccaagatccaggtccaatcatcagaggcctcctttacccttactgctgcagcagaagaggagaaggtccttggggagactgcaaatatcctagagaccggggaaaccctggaacctgcgggagcacacctggtgctagaggagaaaagctctgaaaagaacgaggatttcgctgcgcacccaggggaagacgccgtgcctactggtcccgactgtcaagcgaagagcacccccgtgatcgttagcgccacgacaaaaaagggcctgagcagtgacttggaaggagagaaaactactagcttgaagtggaagagcgatgaagttgatgaacaggtcgcctgccaagaggtgaaagtctcggtcgctatagaagatttagaacctgaaaacgggatccttgagttagaaactaaatcttccaagctcgtgcagaacatcattcagaccgccgttgaccagttcgtccggacagaggaaaccgctacagagatgcttacaagtgaactacaaacacaggcacatgttatcaaggctgactcacaggacgctggccaagagacagagaaagagggggaggaaccacaagcctctgcacaggacgagacccctataactagcgctaaggaggagagtgagagtaccgctgtcggtcaagctcacagtgatatcagcaaggacatgtctgaagccagtgaaaagactatgacggtggaagttgaggggtcaaccgtgaacgaccagcaactggaggaggtggtgctaccgtcagaagaggaggggggtggtgctggcaccaagtcagtgccagaagacgatggacatgccctcctagctgagcggatcgagaaatcgcttgtagaacctaaggaggatgagaaaggtgatgacgtggacgatcccgagaaccagaatagcgccctggccgacaccgatgcctccggcggactgaccaaagagtcccccgataccaacgggcctaagcaaaaagaaaaggaagacgcccaggaagtggagttgcaggaaggcaaagttcacagcgagtcggacaaggccatcaccccccaggcccaggaggagcttcaaaagcaagaaagagagagcgccaaatctgagctcaccgaatctta

SEQ ID NO: 48128 - DNA, 5033 bp, Artificial Sequence
  Description of Artificial Sequence: Synthetic coding sequence
atggtcggacaaagggactcagaagacgtctctaaaagagacagcgacaaggaaatggcgactaagtcggcagtggtgcacgatattactgatgatggtcaggaggaaacacccgagatcattgagcagatcccatcctcagagagcaacttggaagaactcactcagcctacggaatctcaggccaatgatataggattcaagaaggtcttcaagttcgtgggcttcaagtttactgtgaagaaagacaaaactgaaaagccagacaccgtccagttgctcactgtcaagaaggacgaaggagagggagccgctggggcaggtgaccacaaggacccaagcttgggcgctggggaggccgctagtaaagaatccgaacctaagcagtcgacagagaaacctgaggaaacattaaagagagagcagagccatgcagagatctctccaccggcagaatccggtcaggcagtggaagagtgtaaggaagaaggggaggagaagcaggaaaaagaaccttccaagagcgcagagagtcctacgtcccccgttacctctgagacaggttccacttttaagaaattctttacccaggggtgggccggatggcggaagaaaacctcattcaggaagccaaaggaggacgaggttgaagcgtccgaaaagaaaaaagaacaggagcctgaaaaggtcgataccgaggaggacggaaaggctgaggtagcctctgaaaaactcactgccagtgagcaggcgcacccgcaggaaccagctgagtctgcccatgagcctagactgtctgccgagtatgagaaggttgaactcccttctgaggagcaagtcagcggcagccagggcccatccgaggagaagccagcacctctggcaaccgaagtgtttgatgagaaaatcgaggtccaccaggaggaggtcgtggccgaggtacacgttagcaccgtggaagaaagaactgaggagcagaaaacagaggtggaggagaccgcgggatcggtacccgctgaggagctggtggagatggatgctgaacctcaggaggccgagcctgccaaagagctggtcaaacttaaggagacttgcgtgtccggtgaggaccccacgcagggggctgacctgagtcccgacgagaaagtcctgtctaagcctcccgaaggggtagtctctgaagtggaaatgctctcctctcaagagcgaatgaaggtccagggcagcccgcttaaaaaactcttcacatctacgggcctcaagaagttgagcgggaaaaagcagaaaggcaagagggggggaggcgatgaagagagcggggaacacacccaggtgcctgctgacagtccagattcccaggaggagcagaagggcgaaagtagcgcttcatcacccgaggaaccagaagagattacctgccttgagaaagggctggctgaggtgcagcaggatggggaagccgaagagggagccacttcagacggtgaaaagaaacgggagggagtcacaccctgggcttcttttaaaaagatggttactccaaaaaaacgggtgagacgtccaagcgagagcgacaaagaggacgagctggacaaggtaaagagcgccaccctctcctcaactgagtccaccgcatctgagatgcaagaggaaatgaagggaagcgttgaggaacccaagcctgaggaacctaagcgcaaggtggatacttctgtgtcttgggaggcattgatttgcgtcggtagtagtaaaaaacgcgcaaggcgcggatcaagctctgacgaggaggggggacccaaggccatgggcggagaccatcagaaagcagatgaggccggtaaagataaggagaccggcacggacggcatccttgccggaagtcaggaacacgaccccggtcagggttcctccagccccgagcaagccggtagccctaccgagggtgagggcgtttctacttgggagtcatttaagagactggtcacccctagaaagaagagcaaatccaaactcgaagaaaagtccgaagactccattgcaggctcaggcgttgagcacagtactcccgatacagagcccggaaaagaagaatcatgggtctcaattaagaaatttatccctggtaggcggaagaaacgccctgatggtaaacaagagcaagcaccagtggaagacgctgggccaaccggagcaaacgaagacgattcggacgtgccggctgtggtgcccctgagtgagtacgacgctgtggaacgtgaaaaaatggaggctcagcaggcccaaaagtccgccgagcagccagaacaaaaggctgcaacagaggtgagcaaggagctgagcgagagccaagtccatatgatggctgccgcagtggccgacggaacccgggcagccacgatcatcgaggagcggagtccatcctggatttccgcgtctgtgaccgaaccgttggagcaggtggaggcagaggccgctctgctgacggaggaagttttggagcgggaagtaattgcagaagaggagcctcccactgtgactgagcctctgcctgagaaccgggaagcccgtggcgacacagtcgtgagcgaggccgaacttacacctgaggccgtcacagctgccgagaccgctgggccactgggggctgaggaagggactgaggcttctgccgcagaggagaccaccgagatggtgtccgctgtgtctcagttgacagacagcccagacaccactgaagaagctactccagttcaggaagtggagggaggcgtgcctgacattgaggagcaggaaaggcgtacacaggaggtgttgcaggccgtggccgagaaggtgaaagaagaaagccagctgcccggtactggcggaccagaggacgtgctgcagccggtacagagagccgaagcagagcgcccagaggaacaggccgaggcgtccggcctgaagaaagaaacagatgtggttctgaaggttgatgcacaggaggccaaaacagagcccttcacacaaggaaaggtcgtcggacaaaccacaccagagagttttgagaaggccccacaggtgactgaatcgatcgagtcctccgaacttgttaccacctgtcaggctgaaacattagccggagtaaagtcgcaagaaatggtgatggaacaagcaattcctccagattcagtggaaacacctacagattctgagaccgatggctctacccccgttgctgacttcgacgcgccaggaactactcagaaggacgaaattgtggaaattcacgaagagaacgaagtggcctccggaacccagtcagggggaacagaagccgaggctgtgcctgcccagaaggagcgcccacccgcacccagtagttttgtcttccaggaggaaaccaaggagcagtcaaagatggaggatacattggagcatacagacaaagaggtcagtgtcgagactgttagtatcttgtccaaaacagaaggaacccaagaagcagatcaatacgctgacgagaaaaccaaggatgtacctttctttgaggggctggaaggaagcattgacaccgggatcactgtttctagagagaaggtgacggaggtagccctcaaaggcgaaggcacagaagaggccgagtgtaagaaggacgatgccctcgaattacaaagccacgccaaatcacccccatcacccgtggagagagagatggtggtacaggttgagcgggagaagaccgaggcagaacctacccacgtgaatgaagaaaagctagagcacgagaccgccgtgacagtgagcgaggaggtgagtaaacagcttcttcaaactgtgaacgtgcccataattgacggcgctaaggaagtatcctctttagagggcagccccccaccgtgtctggggcaagaggaggctgtatgcactaaaatccaggtgcaaagctctgaggcgagctttactctgactgctgcggctgaggaagaaaaagttctcggggagactgccaatattctcgaaaccggagagactctggagcccgctggggcacacctcgtgctggaagaaaaaagcagtgaaaaaaatgaagattttgccgctcatcctggagaggacgcagttccgacaggtccagactgccaggctaagtccactccagtgattgtatccgctacaacaaagaaaggcctttcatcagatctcgagggagagaagacaaccagcttgaagtggaaatcggatgaggttgatgagcaggtggcttgccaggaggttaaggttagtgttgctatcgaggaccttgaacctgagaacgggatccttgaactcgaaaccaagtcctctaagcttgttcagaacatcatccaaactgctgtggaccagtttgtgcgaactgaggaaaccgcaactgagatgctgacatccgagttacagacgcaggcccacgtgataaaagcggactcacaagacgccggacaagagacagagaaggagggggaggagccccaggccagcgcacaagacgagacgcccatcaccagcgccaaagaagaaagtgaatccactgccgtgggacaagcgcatagcgacattagcaaggacatgagcgaggcatccgaaaagactatgaccgtcgaggtcgagggcagcactgtgaatgatcagcagcttgaggaggtggtgctgccctccgaggaagagggcggaggcgctggcacaaagtccgtgcctgaggatgatggccacgccctattggcagagagaatcgagaaatccctcgtggagccaaaggaggacgagaaaggtgatgatgtggacgatccagagaatcagaactctgccctggcagacaccgatgcctcaggcggactgaccaaagagagccccgacaccaacggtccaaaacaaaaagagaaagaagatgcccaagaggtggaattgcaggagggcaaggtgcacagcgagtctgataaagctattacaccccaagcacaggaagaactgcagaagcaggaaagagaatccgctaaatccgagctgacagagagcta

SEQ ID NO: 48129 - DNA, 5348 bp, Artificial Sequence
  Description of Artificial Sequence: Synthetic coding sequence
atgggagcagggagtagtacagagcagcgctcacctgaacagccgcctgagggaagctctacccccgcagagccggagccctcaggcggtggcccatccgcggaagcggctcctgataccactgctgatcccgctattgccgcatctgaccccgcaactaaactgttgcagaaaaacgggcagctctctaccattaacggcgtcgcagagcaggacgaactgtcactccaggaaggggaccttaatggccagaagggggctttaaatgggcaaggcgcactgaattcccaggaggaagaggaggtcatcgttactgaggtgggtcaaagagactcggaagacgtaagcaagcgagacagtgataaagagatggctacaaaaagtgctgtcgtgcacgatatcactgatgatggccaagaagaaacccctgaaataatcgagcagattccctcaagtgaaagtaatctggaggagcttactcaacccacagaaagccaagcaaatgacatcggattcaaaaaggtgttcaaatttgttgggttcaaatttaccgtgaaaaaggataagacggaaaagcctgacacagtgcagctactgactgtcaaaaaggatgagggggagggggcagccggagccggagaccacaaagatccatcattaggagctggagaggccgcttcaaaagaaagcgagcctaagcagtcgaccgagaaacccgaggaaaccctgaagagagagcagtcccacgctgaaatttcccctcccgctgaaagcggacaggccgttgaggagtgcaaggaggagggggaagaaaagcaggaaaaggagccatcaaagagcgcggagagccccacgtcacccgtcacatctgagactggctccacattcaagaaattctttacccagggttgggccggatggcgcaagaaaactagctttaggaagcctaaggaagatgaagtagaagcgagcgagaaaaagaaggaacaggaacccgagaaagtcgacaccgaggaggacgggaaggccgaagtggcatccgaaaaattaactgccagtgagcaggcccacccgcaggagcccgctgaatctgcgcacgaacctcggctgtcagctgagtatgaaaaggtggaactcccttccgaagagcaggtgtccggctcacagggtccttcagaagagaagcctgcacccttggctacggaggtttttgacgaaaagattgaagtgcatcaggaagaggttgtggcggaagtgcatgtgtcaaccgttgaggaacgaacagaggaacagaaaacagaagtggaagagacagccggatccgtgcctgccgaagaacttgtggaaatggacgccgaaccgcaagaggccgaaccggctaaggagctggtgaaactgaaggagacatgcgttagcggagaggaccccacccagggcgctgatctgtcacccgatgaaaaagtgctaagcaaacccccagaaggagtggtttcagaagtcgaaatgctgtctagccaggagaggatgaaggtacagggatctccactcaaaaaactctttacgtctacaggactaaagaagttgtccgggaagaagcagaagggtaaacgcggaggcggtgacgaggaaagtggtgagcacacgcaggttccagctgatagcccggactcacaagaggaacagaagggtgagtcctccgcttccagtcccgaagagcctgaagagattacctgtctcgaaaagggactcgcagaagtccagcaggacggagaagcggaggagggggctacaagcgacggagaaaaaaagcgagaaggcgtcactccctgggcttcattcaaaaaaatggtgacccctaagaaaagggtcagacgcccttcggaaagcgacaaagaagacgagcttgacaaagtcaagagcgctacactgtcatctaccgaaagcactgcatcagagatgcaggaggagatgaagggctcggtcgaagagcccaaaccagaggagccaaagaggaaagttgatacctccgtctcgtgggaggcgctgatctgtgtggggagtagtaagaagcgggctagaaggggtagctcctcggacgaagaagggggacccaaggctatgggcggagaccatcaaaaggctgacgaggcagggaaggataaagaaacaggaactgacggcattttggcagggagtcaggagcacgatcctggccagggtagttcatcacctgaacaggccggttctcctactgaaggtgaaggagtttccacatgggaaagcttcaaaaggctggtgactcctagaaagaagtctaagtcaaagctcgaggagaaatcagaggattccatagccggtagtggcgtggagcactctacccctgacactgagccagggaaggaagaaagctgggtaagtatcaagaagtttatcccagggaggagaaaaaagcgaccagatggaaaacaggagcaagcgcctgtggaagatgccggtccaacaggtgctaacgaggacgatagtgacgtgcctgccgtggtgcctctgagtgagtacgatgcggtggaacgcgagaaaatggaagcacagcaagcccaaaaatcagcagagcagcctgaacagaaagcggcaaccgaggtgtccaaggagctctcggagtcccaggtgcacatgatggcggctgcagtcgccgatgggaccagggcggctacaattatcgaggaaagatcaccaagctggattagcgcctccgtcactgagcccctcgaacaggtcgaggcagaggcggctctgctcaccgaggaggtgttggagagggaggtgatcgccgaagaggagccccctacggtcaccgaacctttaccggaaaatcgggaggccaggggtgacacagtggtatccgaggccgagttgacacccgaagcagtaacagccgctgagactgctggacctttgggcgcagaggaggggaccgaagccagcgccgctgaagagacaactgagatggtgtcagccgtctctcagctgaccgacagccctgatactactgaagaagctacaccggttcaggaggtggagggaggagtcccggatatagaggaacaggaaaggaggacacaggaggtgctccaagccgtggctgaaaaagtgaaggaggagtcgcagctccccggtaccggtggtcccgaagatgtactccagcccgtccagcgcgctgaggccgagcgtcctgaggaacaggcggaggcctccgggctgaaaaaggagacagacgttgtgctcaaagtggacgcgcaggaagccaaaacagaaccttttacccagggcaaggtggtgggtcaaactacgccagagtccttcgagaaagctccccaggtgaccgaaagtattgagagtagcgaactggtgaccacctgtcaagccgagaccctggccggagttaaaagtcaggaaatggtgatggaacaggccattcctccggactctgttgaaacgcccactgatagcgagacggatggatcaactccagtggctgacttcgatgctccaggtactacacaaaaggacgaaattgtcgagattcacgaggagaacgaggtggcctccggcactcagagtggaggcaccgaagccgaggcagttcccgcacagaaggaaaggccacctgcccctagtagcttcgtgtttcaggaagagactaaagagcaatccaagatggaggatacccttgaacacactgataaagaggtgtcagtggagaccgtgtccatcctgtccaaaaccgagggcacacaggaggccgaccagtacgctgatgagaaaactaaagacgtgccatttttcgagggcctggaggggtccattgacacagggataacagtgagtcgagagaaggtgaccgaggtagcacttaagggtgagggaacggaggaggccgagtgcaagaaggacgacgctctggagctacagagtcacgccaaaagccccccatcccccgtggaaagggaaatggttgtgcaggtcgagagagagaaaaccgaggccgaaccgactcacgttaatgaggaaaagctcgagcatgaaacagccgttacagtgtcggaggaagtgtcgaaacagttgctgcaaactgttaacgtgccaatcatcgatggcgcaaaagaagtatcttcactggagggcagccccccaccatgcctaggccaggaggaagctgtgtgcacaaaaattcaggtccagtcaagtgaggcttcattcactctcactgctgcggctgaggaagagaaagtgcttggtgaaaccgcaaacatactggaaaccggcgaaaccctcgaacccgcaggcgcacaccttgtacttgaagagaagtcaagcgagaaaaatgaggacttcgccgctcatccgggtgaagacgcggtgcccacaggaccggactgccaggctaagagcacccccgtgattgttagtgccacaactaagaaaggactgtcctctgacctcgagggcgaaaaaactacatctctcaaatggaagtccgatgaagtagacgagcaggtagcttgtcaagaggtaaaagtgagcgtggccatagaggacctcgagcctgagaatggaatacttgagctggaaactaagagttccaagctagtgcaaaatatcattcagaccgccgttgatcagtttgtgagaacagaagaaactgccacagagatgcttactagcgagctacagacacaggctcacgtgattaaggcagactcccaagatgctggtcaggaaaccgagaaagagggcgaggaaccccaagccagtgcccaagatgagacccccataacaagcgctaaagaagagagtgaatcgacggccgtgggtcaggcacactccgatatctcaaaagacatgtcggaggctagtgaaaagacgatgactgtcgaggtggagggcagcaccgtgaacgatcaacaactcgaagaggtcgttctgccttccgaagaggaaggaggcggagctggcacaaagagcgtccccgaagacgacggacacgcactcctggccgaacggattgagaagtccctggttgagcctaaagaagacgagaagggggacgatgtcgacgaccctgaaaatcagaactctgccctggccgataccgatgcctctgggggactaacgaaagaaagtcccgatacaaatggacccaagcaaaaggagaaagaagatgcccaggaagtggagctccaggaaggtaaggtacatagcgagagtgacaaagccataaccccgcaggcccaagaagagctgcagaagcaggagagggagagcgcaaagagcgagctgaccgagtctta

SEQ ID NO: 48130 - DNA, 1284 bp, Artificial Sequence
  Description of Artificial Sequence: Synthetic coding sequence
atggaaacgaccattagtgagattcacgtggaaaataaggatgaaaagcgtagcgctgaggggtctccaggagcagagcggcagaaggagaaggcgtccatgctctgcttcaagagaaggaaaaaagctgccaaggctttaaagccaaaggccggtagcgaggccgctgatgttgcacggaaatgtccccaggaagccggagcttctgatcaaccagaacccactcggggagcctgggcctctctcaagcgattggtgacaagacggaagagatctgagagctcgaagcagcaaaagccacttgagggggagatgcagccagctatcaacgccgaggatgctgacctctccaagaaaaaggctaagtcccgattaaagatcccgtgtattaagtttcctaggggtcccaagcgaagcaaccactccaagattatcgaagatagcgattgtagcattaaagtccaggaagaggctgagatcctggacattcaaacgcagacacctttaaacgatcaggccaccaaagctaagtccactcaggatttgagtgagggaattagcaggaaagatggcgacgaagtatgtgagtccaacgtgagtaactccactacatccggtgagaaggttatcagtgtcgagttaggcctggataatggccacagcgccattcagacgggtaccctgattctggaagaaatcgagaccattaaggagaagcaagacgtccagccacagcaggccagccccctggaaacctctgagaccgatcaccaacaacctgtgctttcagatgtacctccgctgcccgcaatccctgaccagcaaattgttgaggaagcatccaactctacccttgaaagcgccccaaacggaaaagattacgagtcaacagagatcgtcgccgaggaaaccaaaccaaaagatactgaactgtcccaggagagtgatttcaaagagaatgggatcaccgaagagaaatctaagtccgaggagagcaagcgaatggaaccgattgccataattatcaccgacaccgaaattagtgagttcgatgtgacaaaaagcaagaatgtgcccaagcagttcctcatttctgccgagaatgaacaggtcggggtgtttgctaatgataatggctttgaggacaggacatctgagcaatacgagactctattgattgaaaccgcctctagtcttgtaaaaaatgcgatccaactgagcatcgaacagttggtaaatgaaatggcttccgacgacaataaaattaataacctgttgcagtag

SEQ ID NO: 48131 - DNA, 1284 bp, Artificial Sequence
  Description of Artificial Sequence: Synthetic coding sequence
atggaaaccaccatcagcgagattcacgtagagaacaaggatgagaagcggtctgcagagggtagcccaggcgctgaacgacagaaggaaaaggcctcaatgctgtgtttcaaacgcagaaaaaaggcagccaaggcactgaagcccaaagccggttctgaagccgcagacgttgcacggaagtgcccacaagaagccggagcctcggatcagcctgaaccaactaggggagcctgggcctccctgaaacgcctggtcactcgtaggaaacggagtgaatcttccaaacagcaaaagccattggagggtgagatgcagcctgctattaatgccgaggacgctgatctttctaaaaagaaggctaaaagccggcttaagattccttgtatcaagtttccaagagggcctaaaagaagcaaccactccaaaattattgaggattctgactgcagcatcaaagtgcaagaggaggcagaaattcttgatatccagacccagactcctctgaatgatcaggcgacaaaggctaaatctacacaggatctttctgaaggcatctctagaaaagatggtgatgaggtttgcgagtcaaatgtaagtaactccaccactagcggtgagaaggttattagcgttgagctaggactcgataacggacattctgctatccagacgggcacattaatactggaagagatagaaaccataaaagagaagcaggacgtgcagcctcaacaggcaagccccctagagacaagtgaaaccgaccatcagcagcccgtgctcagtgacgtgccacctctccccgctataccggaccagcagatcgtggaggaggcatccaatagcacacttgaatcggcccctaacggcaaagactacgaaagtactgagatagtcgctgaggagaccaagcccaaagataccgagcttagccaggaaagcgatttcaaagagaacggtatcacggaagagaagtcgaagtccgaagagagcaagcggatggaacccattgcaattatcatcacagacactgagataagtgagtttgacgtgacgaaatctaaaaacgttccgaagcagtttcttatctccgccgagaacgaacaggtgggtgtattcgccaacgacaatggcttcgaggaccgcaccagtgaacagtacgagacattactgattgagactgcctcgtcactcgtgaagaacgccatccagctctccatcgagcaactggtgaatgaaatggcaagcgatgataataaaatcaataatctgcttcagtag

SEQ ID NO: 48132 - DNA, 6960 bp, Artificial Sequence
  Description of Artificial Sequence: Synthetic coding sequence
atgcttactatgtccgtgacgctttctccattgcggtcccaagacctggaccccatggcgacggatgctagtcctatggccattaatatgacgccaaccgtagagcagggagagggtgaggaggccatgaaggacatggattccgaccagcagtacgagaaaccgccaccattgcacactggtgcagattggaaaattgtactgcacttgcccgagattgaaacatggctacgaatgacgagcgaacgggtcagggatcttacatattctgttcagcaggatagcgacagtaagcacgttgatgtgcacctggtgcagctgaaagacatttgcgaagacatttcggatcatgtcgagcagatccatgccctcctggaaacagaattctctctcaaactgcttagttactccgttaacgttatcgtggatatccacgcggtgcaattgttgtggcaccagctgagagtgtcagttctcgtgctcagggagaggatcttgcagggccttcaggacgctaacggaaactacacccgacagaccgatattctgcaggctttttctgaggaaacgaaggaagggaggcttgactctctaactgaagtggacgactccggccaactaacgatcaaatgttcccagaactacttgtcactggactgcggaataaccgcctttgagctatccgactattctccttccgaagatctgctctccgggctcggggacatgaccagcagtcaggtgaagaccaagcctttcgactcctggtcatatagcgaaatggagaaagagtttcctgagctgatccgctcagtgggcctattgacggtcgccgcagattctatctccacaaatgggtctgaggccgtcacagaggaagttagtcaggtatctctctctgtggacgacaagggagggtgcgaagaggataacgccagcgccgtagaggagcagccaggcctcacactgggagtctctagctcttcaggtgaggccctaaccaatgccgcacaaccttcctcagagaccgtccaacaggaatcaagttcatcatctcaccacgacgctaaaaaccaacaaccggttccatgtgaaaacgccacaccaaagagaacaatccgggactgttttaactataatgaggacagcccaactcagccaacactccccaagcggggtctattcttaaaagaagagacattcaaaaatgacctcaaaggaaacggcggaaaaaggcagatggtcgatctgaagccagaaatgtcccgaagcaccccttccttagtggacccaccagaccgttctaagctttgcttggtcttgcagagctcataccccaactcaccaagcgctgctagccagtcctacgagtgtctgcacaaggtcggtaatggaaacttagagaataccgtgaagttccacattaaagagatttcaagctccctcgggcgtctcaatgactgttacaaggagaagtcccgcctgaagaaaccgcataagacaagcgaagaggttcctccctgtagaaccccaaagaggggcacaggaagcggcaaacaagcaaagaacaccaagagctccgccgttccaaacggagagctttcttacaccagtaaggctattgaagggccacagactaactcagctagcacctctagtctggagccctgcaaccagcgttcctggaacgctaaactgcagcttcagtcagaaacatccagcagccccgcttttacacagtccagtgagtcttccgttgggtctgacaacatcatgtccccggtgccgctgctgtccaagcacaagagtaagaagggccaggctagctctccgtctcatgttacaaggaacggtgaggtggtagaagcttggtatgggtccgacgaatacctcgcactaccgagccaccttaaacagactgaagtattggccctgaagctggagaatttgacaaagttgctccctcagaagcccaggggtgaaacaattcaaaacatcgatgactgggaactcagcgagatgaacagtgacagcgaaatatatccaacctaccacgtcaagaaaaaacacacaagactgggcagagtgtccccttcctccagctccgacatcgcatcttctctaggagagtccatagaatctgggcctctgtcggacatcctgtctgacgaagagagcagcatgccattggcaggtatgaagaaatacgcggatgaaaaatcagaacgggctagctcttccgagaaaaacgaatctcattccgccacaaagtccgccctgatacagaaactaatgcaagatatccaacatcaggacaactacgaagccatctgggaaaagatcgaggggtttgtaaataaattagacgagttcatccagtggttgaatgaggcaatggagactaccgagaactggaccccccctaaggccgagatggatgatctgaagttgtaccttgaaacccacctttccttcaaattgaacgtagactctcattgtgctttgaaagaagccgttgaggaggagggccatcaactcctggagctgatcgcatcacacaaggccggtctcaaagatatgctcaggatgattgccagtcagtggaaggaattacagcgccagattaaaaggcaacactcctggatactccgtgctttggatacaatcaaggcagagattttggccacggatgtctctgtggaggatgaagaaggaaccggatccccaaaggccgaggtgcagctttgttacctggaggcccagagagacgccgtcgaacagatgagtctgaaactatacagcgaacagtacacatcgtcctccaaacgtaaggaagagttcgccgatatgagcaaagtccatagtgtcggcagcaacggcctgctggatttcgactcagagtaccaggaattatgggattggctgattgatatggaaagcctggtgatggatagccatgatttgatgatgagcgaagagcagcagcagcatctgtacaaaaggtattccgtcgaaatgtccatcagacatcttaaaaagactgaacttttgagtaaggtagaagctttgaaaaaaggaggcgtgttgctccctaatgacctattggagaaagtcgattcaataaacgagaagtgggagctcctggggaagaccttgggagagaaaattcaggacacgatggccggtcattcaggaagctcaccacgagatctgcttagtccggaatccggctctctggtgcggcagttggaagtgagaattaaggaacttaaagggtggctgcgggatacagaactatttattttcaacagttgccttcgccaggaaaaggaaggaactatgaacactgagaaacaactgcagtacttcaagagcttgtgtagggagattaaacagcgccgtcggggagtcgccagtatcttgcgtctttgccagcacctgctggatgaccgagagacttgtaatcttaatgcagatcatcagcctatgcagctgatcatcgtgaatctggagcgcaggtgggaagccattgtaatgcaagccgtgcagtggcagacacgcctacagaaaaaaatgggtaaagagtcagagactttgaacgtcatcgatcccggacttatggatctgaacgggatgtctgaggatgctttggaatgggatgaaatggacatttctaacaagctcatctccctgaatgaggagagcaatgacctggatcaggagttgcagccagtgatcccatccctgaagctcggcgagaccagtaacgaagatcccggttacgatgaggaggctgataatcatggaggatcccagtacgcatctaatatcacggctccctcctccccgcatatataccaagtttactcattgcacaacgtcgaactatatgaagataaccatatgccctttttgaagaacaatccaaaagtcaccggcatgactcagcccaatgtactcacgaaaagcttgtcaaaggattcatccttcagcagtacgaagagtctgccggacttgctcgggggatcgaacttagtgaagccttgcgcctgccatggtggcgacatgagtcagaatagcggctccgaaagcggcatcgtatccgagggcgatactgagacaaccactaacagcgaaatgtgcctcctcaatgccgtcgatggatcaccctccaatctcgaaacagagcacctagacccacaaatgggcgatgccgtgaacgttttaaagcagaagtttactgatgagggggaatctattaagctcccgaactcctcccaaagctctatcagcccagtggggtgcgtgaacggcaaagtgggtgatctgaatagcattaccaagcacacacccgattgcctgggagaggaattgcaggggaagcacgacgtttttaccttttacgattactcctacctgcaggggtcaaagctgaagttgcctatgattatgaagcagtctcaaagcgagaaagcccatgtggaggatcccctgctccgcggattttacttcgacaagaagagctgtaaaagcaagcatcaaaccaccgagcttcagccagacgttccaccccatgaacggattctggcatccgctagccacgaaatggacaggataagctacaagagcggaaacatcgagaaaacctttactggcatgcagaacgccaagcagcttagcttgttgagccacagctcttctatcgaatcactcagtcccggtggcgaccttttcgggctcggaattttcaagaatgggtcagactccctgcagcgctcaacgagcctcgagtcctggctgacaagttataaatctaacgaggatttgttctcctgccactcctccggcgatatctcagtttccagcggctcagtgggagaattgagcaaaaggacactcgacctcctgaatcgcctggagaacattcagagccctagcgagcagaaaatcaagagaagtgtatcagacattaccctacagtcatccagccaaaagatgagcttcacgggtcaaatgagtcttgacattgcatctagtatcaatgaagattctgccgcttctttgaccgagctgtcatcatcagatgaactgtccctttgctctgaggatatcgtacttcacaagaataagatcccagagtcaaacgcgtcattccgaaagcggctaactcgttcagtggccgacgagagcgatgtgaatgtgtccatgatcgtgaacgtaagctgtacctcagcatgcacagatgacgaggacgacagtgacctgctctcttcatcaacgcttaccttgaccgaggaagagctgtgtataaaggacgaggacgatgactcttctatcgctaccgacgatgaaatatacgaggactgcacgctgatgagcggtctagattatatcaaaaacgagcttcaaacctggatacgtcccaaactcagtctgactcgcgacaagaagcggtgtaatgtgagtgacgagatgaaaggaagcaaagatatatccagctccgagatgaccaatcctagtgatacgttaaacattgagacactgctaaatgggtctgtgaagagggtgtcagaaaacaacgggaacggcaagaattcttcccatacacatgaactcggaactaaacgcgagaataagaagacgatattcaaggtgaacaaagatccttacgtagccgacatggaaaatggtaatatagagggcatccccgagcggcaaaaaggaaaaccgaacgtgaccagcaaggtgagtgagaatttaggttctcatgggaaggaaatctccgagtcagagcattgtaagtgcaaggctcttatggactcactcgacgactccaacaccgcagggaaagaattcgtaagccaggacgtgagacatttacctaaaaagtgccccaatcatcatcacttcgaaaaccagtccaccgccagtactccgaccgaaaaatctttctcggaactcgccttggagactcggttcaacaaccggcaggattctgacgcactcaagtcttctgacgatgcacccagcatggcgggtaagtccgcaggatgctgcctggctttagagcagaacggtacagaggaaaacgcatcaatctcaaatatctcctgctgtaactgtgaacctgatgtctttcaccagaaagatgcagaggattgctccgtgcacaactttgtgaaagagatcatagacatggccagcaccgccttgaagagtaaatcgcagcctgagaatgaagtcgcagcacctaccagcctgactcaaattaaagagaaagtattggagcatagtcaccggcctatacagctgcggaaaggcgacttttatagctacctctcactgtccagccatgattcagattgcggtgaagttactaattacattgaagaaaaatcctctactcccctgccactggatactacagattccggccttgatgacaaagaggacattgagtgcttttttgaagcttgcgtagaaggcgattccgacggcgaggagccatgcttttcgtctgccccacctaacgagtccgctgtgccttctgaggctgcaatgccactgcaggccaccgcctgtagttccgagttctcagactcctctctgtctgccgatgacgcagacaccgtcgcattgtcctccccgagtagccaggagcgtgccgaagtcgggaaagaagtgaacggcctgccgcagacaagttccggctgcgctgaaaacttagagtttaccccgagcaagctagatagcgagaaggagtccagtggcaagcctggcgagagtggcatgcctgaggagcacaatgctgccagcgcaaaatcaaaggtccaggatctgtctctcaaggccaatcagccaaccgataaagccgcactgcaccccagccctaaaactcttacatgcgaggagaatctcctcaacttgcacgagaaacgccataggaatatgcatagataa

SEQ ID NO: 48133 - DNA, 327 bp, Artificial Sequence
  Description of Artificial Sequence: Synthetic coding sequence
atgctgaccatgtcggtgacactcagtcctctgcggtcacaggacctagaccctatggctaccgatgcttcccctatggcaatcaacatgacgcccacagtagaacagggcgagggggaagaagccatgaaggacatggactccgatcaacagtacgaaaagccacctccactacataccggcgcagactggaagattgtgttgcatctgcccgagattgagacctggcttagaatgacatctgagagggtccgtgatctgacgtattctgtgcagcaggattcagactcgaaacatgtggatgtgcacctggtgcaactgaagtag

SEQ ID NO: 48134 - DNA, 246 bp, Artificial Sequence
  Description of Artificial Sequence: Synthetic coding sequence
atgggccagctgtgctgctttcccttcagtagagacgaggggaagatctctgagaagaacggaggtgagcccgacgacgcagaactagtgcgtcttagtaagcgtcttgttgagaatgcagtactgaaggcagttcaacaatatctggaagagactcagaacaaaaacaagcctggggagggtagctcagtaaagaccgaggccgcagaccagaacggaaatgataatgagaataataggaaatag

SEQ ID NO: 48135 - DNA, 981 bp, Artificial Sequence
  Description of Artificial Sequence: Synthetic coding sequence
atgtcagaggaatttgaagccaatacgatggatagcctggtcgatatgcctttcgctacagtggatattcaagacgattgtggaattactgatgagccacagatcaacctgaagcggtctcaggagaatgaatgggtgaagtcggaccaagtgaagaagagaaagaagaagcgcaaagattaccagcctaattactttttgtcgatcccgataacaaacaaggagatcataaagggtataaagatcctccagaacgctattattcagcaggacgagcgactggctaaagccatggtgtcagacgggtccttccatatcacactcctcgtgatgcagctactcaacgaagacgaggtgaacattgggatcgatgcactgttagagctgaaaccatttatcgaagagctgcttcagggtaagcatcttaccctcccttttcagggcatcgggacctttggtaaccaggtgggcttcgtcaagttagcagagggagatcacgttaatagtttactggagatcgccgagactgcaaataggacctttcaggaaaagggtattcttgtcggagagtctaggagctttaaaccccacttaacattcatgaaattatccaagagcccgtggctgagaaagaatggcgtgaaaaagattgaccctgatctgtatgaaaaatttattagccatagatttggggaagagatcctctacaggatcgatctctgttctatgttgaagaagaaacagagcaatggctattatcactgcgaaagttccattgtcatcggagaaaagaacggcggagagcctgacgacgccgagctagtgagactgtccaaacgcctagtggagaacgcggtgctgaaggccgtgcagcaatacttagaagaaacacagaacaagaataagcccggtgaggggtctagcgtcaagaccgaagcggctgatcagaacgggaatgacaatgagaataaccgcaagtag

SEQ ID NO: 48136 - DNA, 1047 bp, Artificial Sequence
  Description of Artificial Sequence: Synthetic coding sequence
atggagcgcccagaggccggaggtattaatagcaacgaatgtgagaacgttagccgcaagaagaagatgagtgaggagttcgaagctaatacgatggactctttggtcgacatgcccttcgcgacggtggatatccaggacgattgtggcattacagatgaaccacaaattaatctgaagcgctcccaggagaacgagtgggtgaaatcagaccaagtgaagaagaggaagaagaagaggaaagactatcagcctaattacttcctctcgatcccaataactaacaaggagatcattaagggtattaaaattctacaaaatgcaatcatccagcaagatgaaaggctggccaaggcaatggtatcagacggtagtttccacattacgttattggtcatgcagttattgaacgaagacgaagtgaacatcgggattgacgcactgctcgaacttaaaccattcattgaggaactgctgcaaggtaaacatctgacactgccgtttcagggtatcggaacattcggtaaccaagttggcttcgtcaagctggcagaaggggaccatgtcaattccctgctggaaatagccgagacggctaataggacctttcaggagaagggtatcctggtgggggaatcaaggtcatttaagcctcacctcacctttatgaaactcagtaagagcccttggttaaggaagaatggagtgaagaagattgaccccgacttgtacgaaaagtttatctcacaccggttcggtgaggagattctctatcggattgacctgtgcagcatgttgaagaaaaaacaatcaaacggctattaccactgcgagtcatctatagtgattggcgaaaaaaacggaggtgagcccgacgacgcagagctggttaggctaagtaaaagactcgtggaaaacgcagtattaaaggctgtgcagcagtatctcgaagagacgcagaacaaaaataagccaggcgaagggtcttcagtgaagacagaagcggctgaccagaacggcaacgataatgaaaataatcggaagtag

SEQ ID NO: 48137 - DNA, 315 bp, Artificial Sequence
  Description of Artificial Sequence: Synthetic coding sequence
atggggcaactgtgttgcttccccttctcacgggacgaaggcaaaataagtgaactcgagtcttcttcctctgcagtcttgcaacggtactcgaaggacattccttcgtggtcatcaggagagaaaaatggcggagagcctgatgatgctgaacttgtgcgtcttagcaagagattggtcgagaacgctgtcctaaaggcagttcaacaatatctggaggaaacacagaataagaataagccaggcgaggggagctccgtcaaaacggaagcagccgaccaaaatggcaatgacaacgagaacaacagaaagtag

SEQ ID NO: 48138 - DNA, 684 bp, Artificial Sequence
  Description of Artificial Sequence: Synthetic coding sequence
atggccccagattatggcgtcatgggcatgcagggagctggcggatacgacagcacaatgccttatggttgcgggagaagtcaacctaggatgcgggatcgagaccggcctaagcggcgtggctttgatagatttggcccagacggtacgggacgaaaaagaaagcagttccaattatacgaagaacctgacacgaagctggcacgggtggatagcgaaggagacttcagtgaaaacgacgacgcagccggagacttcaggagcggcgacgaagaattcaaaggagaggacgagctttgcgactcaggacgccagcggggtgagaaagaggatgaggacgaagatgtgaaaaagcgcagagaaaaacaacgaagacgggacagaacgagagaccgggctgcagatagaatacagttcgcctgtagtgtgtgtaaattcaggtcttttgatgatgaagaaattcagaaacacctgcagagtaaattccataaggaaacactgaggtttatttccaccaaactcccagataaaacagttgaattcttacaggagtacatagtgaacagaaacaagaagattgagaagcgtcgacaagagttgatggagaaagaaactgcaaagccaaaaccagacccctttaaaggcgaactgtctagccaagacgagtgtttccctggatggtag

SEQ ID NO: 48139 - DNA, 2079 bp, Artificial Sequence
  Description of Artificial Sequence: Synthetic coding sequence
atggaccagggttacgggggatacggagcctggtcagcgggacccgctaatacccagggagcttacggaaccggggtggcctcgtggcagggctacgaaaactacaattactatggcgctcagaacaccagcgtgacgacaggcgcaacttatagctatggcccagcgagttgggaagcagcaaaggcaaatgatggaggcctggccgctggggctcccgcaatgcacatggccagctacgggccagagccttgtacggacaatagcgactccctcatcgccaaaattaaccaacgactcgacatgatgagtaaggaaggtgggaggggcggttctggtggcggaggtgagggcatccaggatcgggaaagttcatttcgcttccagccattcgaaagttacgattctcgcccttgcttgcccgagcataacccgtacaggcctagctactcatatgattacgaatttgacttgggcagcgatcggaacgggtcgttcggcggacagtatagcgagtgtcgggaccccgcaagagagcgcggatcactcgatggtttcatgcggggaagaggccagggaagattccaggatcgatctaatcctgggacttttatgcgcagcgacccatttgtgccaccagctgcctcctccgaaccactaagcaccccgtggaatgagctgaactatgttggtggacgcggactcgggggtccctccccatcccgaccccctccatctttattcagtcagagcatggcccctgactacggggtgatgggcatgcagggtgcaggtgggtacgatagcactatgccttatggttgcggtcgttcgcagcctaggatgcgggacagagatcggcctaagaggaggggctttgacaggtttgggcctgacggcacaggaaggaaaagaaagcagttccagttatacgaggagccagacactaagctggctagagtagacagcgagggtgatttctcagagaacgacgatgcagccggtgactttagatctggtgatgaagagtttaaaggcgaggatgaactatgtgacagcgggaggcagcggggagagaaggaagacgaagatgaggatgtcaaaaagagaagagaaaagcaaaggcggcgagaccgcaccagagaccgagccgctgacagaatccagttcgcctgctccgtctgtaagttcagaagcttcgatgacgaagaaattcaaaaacatctgcaatcaaagttccataaagaaacactaaggtttatctctacgaagctcccagataagaccgtggagttcctccaggagtatatcgtgaacagaaataagaaaatcgaaaaaagaagacaagagcttatggagaaagaaactgcaaaaccaaagccagacccattcaagggcatcgggcaagagcacttttttaagaagattgaagcagcgcactgcctcgcctgcgacatgcttatacccgctcaaccccaactgctgcagagacatctccacagcgtagatcataatcataacagacgattagctgcggaacagtttaagaagacatctctccatgtagcgaaatcagtgttgaacaaccgtcacatcgtcaagatgcttgagaagtatctgaagggcgaggacccgttcacgtcggaaaccgtcgacccggagatggagggggacgacaatctgggcggagaggacaaaaaggagacaccagaggaggttgccgcagatgtgctggctgaggtaattacggcggctgttagggcagttgacggagagggggcacctgccccagagagtagcggcgagcccgcagaggatgaaggacccaccgataccgccgaagcaggctctgatccccaggccgagcagctgcttgaggagcaagtgccctgcgggactgcccacgagaagggcgtccctaaagctcgatcagaagctgcagaggccggtaatggcgctgagacaatggccgcagaagctgagagtgctcagacccgggtagccccagctcctgcagcagcagacgcggaagttgagcagactgacgccgagtccaaggacgcagttcctacggagtag

SEQ ID NO: 48140 - DNA, 1881 bp, Artificial Sequence
  Description of Artificial Sequence: Synthetic coding sequence
atggtggccccttggcgggtctctgttagggtgtgccttagtcatcttcgatgcttcgaactgaggcagggtctctctctcctccggccaagtgaatgccccagggacgcaagattatgttggcttctactgggcacacttcccaaagtcgtctccttatgcggagacgttggggagggggctccagacgtcctgtcccggagaagagttcgatgtagcggtgccgctggcgcaggtcctgcagagagtttgccacgggcaggtccattgggcggagtattcctacatctacgactgtggctgcgggcaggcgcacttctcgtgaagttttttcccttgctgctgctgtaccccctgacttacctcgccccatccgtttccacattgtggctccacctgctgctcaaggccacagaaacttcaggccctacctacatcaaactgggccagtgggcgtcaacgaggcgggacctgttctcggaggctttttgtgctcagttctcaaaactgcacgtacgcgttaccccacacccttggacacacactgagcggtttctacgacaggcattcggcgatgactggggcagcatactgtcattcgaaaacagagaacccgtgggaagtggatgcgttgcgcaggtgtacaaagcttatgccaataccgcctttctagagaccgattccgttcagcgcctcggcagagcatcatgcctgcctcccttctcccataccggcgcagtgggtggacttagagaactttttggctatttagggaatggaaggaaaccgcctgaaaacttggcagaccagtcgttcctcgaacggctccttctgccaaaagccgacctggtgggctctaacgctggggtttctcgggctcaggttccagggcaccagccagaagcaaccaatctaatatccgtggcagtgaaagtcttacaccctggtttactggctcaggttcacatggatcttttattgatgaagatcggctcgagagtcctcggagttcttcccggtatcaagtggctgagcctgccagaaattgtggaagaatttgaaaagctgatggtacaacagattgatcttcgatatgaagcccaaaacctggaacactttcaggtcaactttcgcaatgtgaaggcagtgaagtttccgacacctctccggccttttgtgaccagggaggtcctggtggaaacatatgaggagtccgtccccgttagtagttatcagcaggcaggcatacccgtagacctgaagcgtaagattgcaaggctcgggatcaacatgctgcttaaaatgatcttcgtggacaacttcgtgcacgccgacctccatcccggtaacattctggtccagggggcaaatggcctgtcctcttcccaagaggctcagctccagcaggcagatatctgcgacacacttgtcgtagctgtgccgagctccctctgcccgctaagactagtgctactagacgcgggaatagttgctgagctgcaagcaccggacctgcgaaacttccgggctgtcttcatggccgtagttatggggcagggccagagagtggcagagctgatcctgcatcacgcccgtgcatccgagtgccgcgacgtggaagggttcaagacagaaatggctatgttagttacccaagcgagaaagaataccataactttggagaaactgcatgttagctccttactgagctccgtgttcaagcttctcatgacacataaggttaagctcgaatcaaattttgcgagcattgtgtttgccatcatggtgctggagggactcggcagaagtctcgatccaaaattagacattctcgaagcagccagaccttttttactgacgggcccagtgtgccccccttag

SEQ ID NO: 48141 - DNA, 1512 bp, Artificial Sequence
  Description of Artificial Sequence: Synthetic coding sequence
atgtggctgaaggtcggcggactgcttaggggcactgggggacagttgggccagacagtcgggtggccttgcggggctctgggaccgggaccacatcggtggggaccatgcggtggaagttgggcccagaagttctaccaggatggaccgggtagaggcttgggggaggaggatatccgcagagccagagaagcgaggccccgaaaaacgcctcggcctcagttgtccgatcgctcacgggagcgcaaggtgccagcttcaagaatttctagattagctaactttggcggactcgcagtcggcctcggcttaggagttcttgccgagatggcgaagaaatcaatgcctggaggtaggctccagagcgataattcctttatctccccccagctgcagcatatctttgagcgcgtccgtcagtccgccgactttatgcctcgctggcagatgctgcgcgtccttgaggaagaactcggtagggattggcaggcaaaggtggcatccctggaagaggtcccatttgcggctgcttcgataggccaggtccaccaggggttactacgcgacggaactgaggtggccgtgaagatccagtatcccggaattgcccagtctattcagagtgatgttcagaacctgctggccgtgctgaaaatgtctgctgcgcttccggcagggctattcgccgagcagtctctgcaagcgttgcagcaagagctagcctgggagtgtgattaccgccgagaagcagcatgcgcacaaaattttaggcagctgctggctaatgatccattctttcgggttcctgcggtggtgaaggagctctgtactacacgggtcctgggcatggaactcgccggtggcgtgcctctcgaccagtgccaaggactgagtcaggacttgcgcaatcagatttgtttccagctccttacactttgcctgcgggagctgtttgaatttagattcatgcagaccgaccccaattgggccaactttctttacgatgcctcttcacaccaagtgacccttctggacttcggggcaagccgagagtttgggacagagttcactgatcactacattgaagtggtgaaggctgctgccgatggagaccgcgattgcgtgcttcagaagtctcgggatcttaagtttctgactggattcgaaactaaggctttcagtgacgctcacgttgaggctgtcatgatcctgggcgagccctttgccacccaggggccatatgactttggttctggcgaaaccgccaggcgaatccaggatctcattcctgtgctattgcggcatcgcctgtgtccaccccctgaagaaacatacgccctgcaccgaaagttggcaggggctttcttggcgtgtgctcacctgcgagcccacatcgcttgccgagatctctttcaagacacatatcacagatattgggctagccgccagccggatgcagctaccgcagggtctcttcccaccaaaggcgactcctgggtggaccccagctag

SEQ ID NO: 48142 - DNA, 1635 bp, Artificial Sequence
  Description of Artificial Sequence: Synthetic coding sequence
atgtggttgaaagtggggggactcctgagaggaaccggtggacaactgggccagacagttggctggccatgcggggctctcggacccggtcctcatagatggggaccgtgcggcggaagctgggcccagaaattctatcaagatggtccaggtcggggactgggagaggaggacatccgccgtgctagggaagcccgacctagaaaaacacctaggccacagctcagtgaccgatctcgggagcgaaaggtccccgcatcccgcatctccagactggctaactttgggggactcgccgtgggactgggtttgggagtccttgctgaaatggctaaaaaatcaatgcctgggggaaggttacagtccgagggaggcagcggcttagactctagccctttcttaagcgaggctaacgctgaaagaatcgtgcagacgctctgtactgttaggggggctgccctgaaggtcggacaaatgctttccatccaggataacagttttatttcacctcaattgcaacatatctttgagcgcgtccgccagtccgcggatttcatgccccgatggcagatgttgcgagtgctggaggaggagcttgggcgtgactggcaggctaaggttgccagtctcgaggaggtaccattcgcagctgcgtctattggccaggtccatcaggggctgctccgagatggtaccgaggtggccgtcaagatccaatatcccggaatagctcaaagcatacaatctgacgtacagaatctgctcgccgtcctgaaaatgtccgccgcacttccagcaggattgtttgccgaacagtctttgcaggccctccagcaggagctggcttgggaatgtgattatagacgtgaggctgcttgtgctcagaattttcgtcagctgctcgcaaacgatccattctttagggtcccagcagtggtaaaggaactgtgcactacacgagttctggggatggaactggctggcggagttccattggaccagtgtcagggcctgagtcaggacttgcggaatcaaatttgtttccaattgctgaccctgtgccttcgagagttgttcgagtttaggttcatgcagaccgacccaaattgggctaactttctgtatgatgcctcgagccatcaagtgactctgttggactttggcgcatcccgggaatttgggactgagtttacggatcattacatcgaagtggtaaaggcagcagctgatggagaccgcgactgcgtgttacagaaaagcagggatctcaaatttctcactggcttcgagactaaggcattctccgacgcccacgtcgaagcagtcatgatcttaggcgaaccatttgccacccagggaccatacgactttggctccggggaaacagcacgtaggattcaggacctaattcccgtgctcctgcgccataggttgtgcccacctccagaagagacctatgctctccaccgtaagctagctggcgctttcttggcgtgtgctcaccttcgcgctcacatcgcatgcagagacctgtttcaggacacataccatcgctattgggcgagtaggcagcctgacgcagctaccgcaggctcattgcccaccaagggcgatagctgggttgacccatcttag

SEQ ID NO: 48143 - DNA, 1512 bp, Artificial Sequence
  Description of Artificial Sequence: Synthetic coding sequence
atgtggctgaaagtcggcggactgcttagaggaacaggtggacagctggggcaaacagtaggctggccatgtggcgcactcggcccagggccacacaggtggggcccttgtggcggttcatgggcacaaaagttttatcaggacggacctggccgtggtctcggcgaagaggacatccggagggcgagggaagccagaccacggaagacaccacggcctcagttgagcgacagatcacgggagaggaaggtgcccgcttcccgcatctctcggttggccaattttggtgggctggccgtgggcctcgggttgggggtgttggcagaaatggccaagaaaagcatgccaggcggtcggcttcagagcgataatagcttcatatcaccgcagctgcagcacatattcgagagggtgcggcaaagcgccgacttcatgccaaggtggcaaatgttgcgtgtgttagaggaagagttaggaagggactggcaggcaaaagtggcttctctggaagaggtcccctttgcagctgccagtattgggcaagtccaccaggggctgctgcgagacgggaccgaggttgcggtgaagatacaataccctggcattgcccagagtatccagtcagacgtgcaaaatctgctagctgtgttaaaaatgtcggcggcactgccagctggactgtttgcggagcaatccctgcaagctctacaacaagagctggcctgggaatgcgattacagaagggaagccgcttgtgctcagaacttcagacagttactggccaacgaccccttctttcgagtccctgcagtagttaaagaattgtgtactaccagagttctgggaatggagcttgccggaggggttcccctcgatcagtgccagggactgtcccaggatctgcgtaatcagatctgcttccaactgctaacactctgtcttcgcgagctgttcgagttccggttcatgcaaacagatcctaactgggccaactttctctatgatgccagctcacaccaggtgacgctactggacttcggagcctcccgcgagttcggtacggagttcaccgaccactatattgaagtggtgaaagccgctgctgacggtgacagggactgcgtgctgcaaaagtcccgggatctgaaatttcttactggtttcgaaaccaaggcctttagcgacgcccacgtagaagccgtcatgattctcggggagccattcgccacccagggaccctacgactttggatcgggcgagaccgcacgcaggattcaagatctgatccccgtactgttgcgccaccgcctctgtcctccaccggaagaaacttacgcactccatcgaaagctggctggggcttttcttgcctgcgcccacctgcgcgctcacatcgcctgtcgagaccttttccaggacacatatcacaggtattgggcttcgcgccagcctgatgcagctaccgctggctcattgcccacgaagggggactcctgggtggatccttcctag

SEQ ID NO: 48144 - DNA, 1743 bp, Artificial Sequence
  Description of Artificial Sequence: Synthetic coding sequence
atgtggaggccagtacaactctgccactttcacagcgcattgcttcatagaagacagaagccatggcccagcccagccgtgtttttcaggcgcaacgtgcgcggactccctcccagatttagctctcctacaccattgtggagaaaggtcctctctactgctgtggtaggggctcctctgctgctgggcgctaggtacgttatggctgaggcccgagagaaacgcaggatgcggctggtagtcgatgggatgggccgattcggaaggagcctcaaagtgggcctgcagatctctttagactactggtggtgcactaacgtggtgctcaggggtgtagaggaaaacagcccaggctatctggaggtcatgtccgcctgccaccaaagagcggctgatgcactggttgcaggggcaatttctaatggaggtctgtacgtgaaattaggccagggcctttgttcattcaatcacttactccctcccgagtataccagaactcttagggtcctagaagaccgggcactgaaacgaggatttcaggaagtggacgagctttttctggaagactttcaagcacttccccacgagcttttccaggaatttgattaccagcccatcgccgctgccagtcttgcccaagtgcatagagccaaactacacgatggaaccagcgtagcagtaaaggtacagtatattgatctgcgcgataggttcgatggagatatccatacactcgaactgttgttacggctggttgaagtgatgcacccatcattcggcttttcctgggtgctacaggatctgaaggggactctagcccaggagctggatttcgaaaacgaaggacggaatgccgagaggtgcgccagggagctggcgcactttccttacgtcgtggtgcccagggtgcattgggataaaagttctaaacgtgtgcttaccgccgacttctgcgccggatgcaaagttaacgacgttgaagccattcggagtcagggtctggccgttcacgacatcgcagaaaagctgatcaaggccttcgccgaacagatcttctatactgggtttatccactccgacccgcaccctggaaatgtcctcgtgagaaaaggcccagatggtaaagctgagctcgtcttgctggaccacggcctgtatcaattcctggaagaaaaggatagagccgctttatgccaactttggagagcgataatcctacgggatgatgcagccatgagggcccacgctgccgcactaggtgtccaagattatttactgtttgccgaaatgctcatgcagagacctgtacggctgggccagttatgggggagccacctcttaagccgggaggaggcagcttatatggtggacatggcccgagagcggtttgaagcggttatggcggtgctgcgagaactgccgagacccatgctcctggtgttacgcaacattaacacagtgcgcgctatcaacgtggcgctcggggcacctgtcgatcgctactttttgatggccaaaagggccgtccggggttggagcagactggccggagccacttacaggggcgtgtatggtactagcctcctacgtcacgccaaagtcgtatgggagatgctgaagtttgaagttgccttacggttagagaccctggctatgcggcttactgctctcctggcacgggctctggtgcacctgtcactggtccctccggctgaagaattataccagtacttggaaacctag

SEQ ID NO: 48145 - DNA, 921 bp, Artificial Sequence
  Description of Artificial Sequence: Synthetic coding sequence
atggccgtcgccaggctcgctgctgtggctgcctgggttccgtgccgtagctggggttgggccgctgtccctttcggacctcatcggggtctgagcgtcctgctggcacggatcccacaaagggcacctcgctggctgccggcatgtagacagaaaacttccttgagtttcctgaaccgtcctgatttaccaaacttggcctacaagaagctgaagggaaagtcgcccggtataatctttattcctggatatctcagttatatgaatggcactaaggctctagcaattgaggagttttgcaaatctttggggcacgcgtgtattcggtttgactacagtggggtgggatctagcgatggaaactctgaagaaagcaccctgggcaagtggagaaaagatgtcctaagtatcatcgacgacctagccgacgggcctcagattctggtgggaagcagcctcggtggatggctgatgcttcacgccgctatcgcacgcccagaaaaggtagtcgcattgatcggcgtcgcaaccgccgcagatactctggtgactaagttcaatcagctgccagtcgagctgaaaaaagaggtggaaatgaagggagtatggtccatgccgtccaagtacagtgaggagggggtctataacgtgcagtattcatttattaaggaagcagaacatcactgcctcttacactcgccgatccccgtaaactgccctatcaggttgcttcatggaatgaaggatgatatcgtcccatggcacacctccatgcaggtggcggacagagttctcagcactgatgtggacgtcatcctgcgtaaacactctgatcaccgaatgagagagaaggccgacatccaactgctggtgtatacgatcgatgacttgatcgataagctatccacgatcgtcaattag

SEQ ID NO: 48146 - DNA, 450 bp, Artificial Sequence
  Description of Artificial Sequence: Synthetic coding sequence
atgctacatgctgcgattgccaggccagagaaagtggtggcgttaattggagttgcaacagcagcggatactctggtcactaaattcaaccagcttcctgtcgaactgaaaaaggaggtggagatgaaaggcgtgtggtctatgccaagtaagtattctgaggagggcgtatacaacgtgcagtacagtttcattaaggaggccgaacaccattgtctactccacagcccaatcccagtgaattgtcctattcgcttacttcacggcatgaaagacgatatcgtgccatggcacaccagtatgcaggtcgccgatagagtgctgagtaccgacgtagacgtaatcctgcggaagcattcagaccacagaatgcgggagaaggccgacatccagctactcgtgtatacaatcgacgatttgatcgataagctgagtaccatcgtaaactag

SEQ ID NO: 48147 - DNA, 1407 bp, Artificial Sequence
  Description of Artificial Sequence: Synthetic coding sequence
atggctgcatcctccaacagctccctgagcggttcatccgtgagctccgatgccgaggaataccagccgcctatctggaagagctatttgtatcagctgcagcaggaggcccctagacccaaacgaatcatttgtcccagggaagttgaaaataggccaaaatattacgggagggagttccatgggattatttccagagaacaagccgatgaactgctaggtggggttgaaggggcttacatcctgcgagaatctcagcgccaacccggatgctatacccttgcactacggtttggcaatcagaccctgaattaccgtttgttccacgacggcaaacacttcgtcggagaaaagcggttcgagtcaattcatgatctcgtgacagacggcctgattacgttatatatagagaccaaagccgcagaatatatatcaaagatgacaactaaccccatctacgaacacattggttatgcaactcttctccgcgagaaagtgtccaggagactctcccggtctaaaaacgagccacggaagaccaacgtaacacacgaggaacacacagctgtggaaaagattagtagtctggttagacgggctgcccttacccacaatgataatcacttcaactacgaaaaaactcataattttaaggtgcatacatttagagggcctcattggtgtgaatactgtgcaaactttatgtggggcctcattgcccagggtgtgcggtgtagtgactgcgggcttaacgtgcacaagcagtgctctaagcatgtgcctaatgactgccaacctgacttgaaaagaatcaagaaagtgtactgctgcgacctcacaaccctggtcaaagcccataacacacagagaccgatggttgttgatatctgcattagagaaatcgaagcacgcggactgaaaagtgaaggactttacagagtctccggatttaccgaacacatcgaagacgtaaagatggcctttgaccgagacggcgagaaggccgatatctccgctaacgtctatccggatattaacatcattaccggggctctgaagctctacttccgggatctgccaatcccagttattacttacgacacgtactcgaagttcatcgatgctgcgaagatttctaatgcagacgaaagattggaagctgtacatgaggtcctaatgcttctgccacctgcgcactatgagacactcaggtacctaatgatacaccttaaaaaggttaccatgaatgagaaggacaattttatgaacgctgagaaccttggaatagtctttggcccaaccttaatgcgacccccagaagattccactttgactacacttcatgatatgagataccagaagctgatcgtgcagatcctaatcgaaaatgaggatgtcctgttctag

SEQ ID NO: 48148 - DNA, 438 bp, Artificial Sequence
  Description of Artificial Sequence: Synthetic coding sequence
atgcgcgcagggcagcagctggcgtcaatgcttcggtggactagagcctggcgtctgccccgagaaggcctcggtccccacggaccctccttcgccagagtgccggtggccccatcctcgagttccggcggacggggaggcgctgagccacgcctgttagatggcgaagccgcattgccagccgtcgtgtttttgcacgggctgtttggtagcaaaacaaattttaacagcatcgcaaagattctcgcccagcagaccgggaggagagtactcactgttgacgcccgtaaccatggagactctccacattctcctgacatgagctacgaaatcatgtctcaagatttgcagccagcacctcaccttggtactgagggcctgcggcaggctctgtgtggacatgaggtcctgcagggatggagtgatttgcgactctag

SEQ ID NO: 48149 - DNA, 777 bp, Artificial Sequence
  Description of Artificial Sequence: Synthetic coding sequence
atgcgggcagggcagcagctcgcctcgatgcttcggtggaccagggcatggagactgcccagggaaggactagggcctcatggcccatctttcgccagagtgccagtggcacctagcagctcttccgggggtcgcggaggcgctgagccacgccctctgccattgtcatatagactgctggatggagaggctgcacttcctgccgttgtgtttctgcatggtcttttcggcagcaagacgaacttcaacagcatcgccaaaatactggctcagcagacaggccgtcgggtgctcacagtggacgcacggaaccatggcgattctcctcattcacccgatatgtcttatgagatcatgtcacaagacctgcaggacctgcttccccagcttgggctcgtgccctgtgtggttgttgggcactcaatgggaggaaagacagccatgctcctggccttgcaaagagatatggccgtaaggcagcatctgctgacaaatctcgtggaagttgacggtagatttgtctggcgcgtgaatctggacgctcttacccaacacttagacaaaatccttgcctttcctcagcgtcaggagtcctatctaggtccaacccttttcctcttgggtggcaactctcagtttgtccatccaagccatcatcccgaaattatgagactttttcccagagcacaaatgcaaactgtgcctaatgccggacactggatacatgctgatcggcctcaggatttcattgctgcgatccgcggatttctggtgtag

SEQ ID NO: 48150 - DNA, 927 bp, Artificial Sequence
  Description of Artificial Sequence: Synthetic coding sequence
atgagagcaggccagcagctcgctagcatgttgcgctggacgagggcctggagactgcctcgtgaggggctgggcccacatgggccatcatttgccagagtgccggttgccccaagtagttcttccggaggccgtggcggagcggagcccaggctgctggatggggaagcagctctacccgcagtggtgtttctgcacggactgtttggctctaagaccaatttcaattctatcgcgaagatcctagctcagcagactgggcgacgggttctgaccgtcgacgcgaggaaccatggtgattccccccactccccagatatgtcctacgagattatgagccaggacctgcaggacctgttgccgcagctcgggttggtgccgtgtgttgttgtgggacactccatgggcggaaaaaccgcaatgttgttggcactacagagaccagaactggttgagcggctgatcgctgtcgatatcagccctgtggaaagcacaggggttagccacttcgctacttatgtcgctgcgatgcgtgcaatcaacattgcagacgaattacccagatccagagcaagaaagttagctgacgagcagctgtccagcgtgatccaagatatggctgtcaggcaacatcttctgacgaatctggtagaggtggacggaagatttgtctggagagtcaacctagacgcattgacacagcatctcgataagattctggcctttcctcagagacaggagagctacctgggaccaacgctgtttcttctggggggtaactcacagttcgtacatccttctcaccacccggaaattatgcgactgttccccagggcacaaatgcaaacagtgcctaatgcaggccactggattcacgcagacaggccgcaggacttcattgccgctatcagaggatttctggtctag

SEQ ID NO: 48151 - DNA, 1014 bp, Artificial Sequence
  Description of Artificial Sequence: Synthetic coding sequence
atggaaaaatcgtggatgctgtggaattttgttgaacgatggcttatcgctctggcaagctggagttgggccctgtgccgtatctctcttttgccgctgatcgttactttccacctgtacgggggtatcatactgcttctgttgatatttatcagtattgcaggtatcctttacaagttccaggatgtactcctttactttccagaacagccgagttcatcgcggctgtacgtccctatgcctaccggcatcccacacgagaacatttttattcgaacaaaggacgggattcgtcttaacctgatcttgatccgctacacaggcgataattcaccctatagccctacgatcatctatttccacggcaatgccggaaatattggacacaggctgcctaacgctctgctgatgttggtgaacctgaaggtgaacttactgctggttgactatagagggtacggcaaaagcgagggggaggcgtccgaagaaggcctgtatctggactcagaagcggtccttgattacgtaatgacacgcccagatctggataagacgaaaatatttctcttcggtaggtccctgggcggagccgttgcaatccatctggccagcgaaaactcgcaccgcattagcgcaatcatggtggagaataccttcttgagtattccacatatggcgagtacgctattctctttttttcctatgcgatacctgcccttgtggtgctacaaaaataaattcttatcatacaggaagatatcccagtgccgcatgccctcgctattcatttcaggcctcagtgatcagcttataccccctgtgatgatgaagcagctgtacgagctctcgccctcccgaacaaaacgcctggccattttcccagatggcacccacaatgacacctggcagtgccaggggtactttactgccttggagcaatttatcaaggaagttgtcaagagccatagccctgaagaaatggccaaaacctcctctaacgtgaccattatttag

SEQ ID NO: 48152 - DNA, 816 bp, Artificial Sequence
  Description of Artificial Sequence: Synthetic coding sequence
atggtgggcgctctctgcgggtgctggttccgacttgggggagcccgacccttaattcccctgggcccaactgtcgtacagacctccatgtcccgctctcaggtcgcacttcttgggctctcccttctcctcatgcttttactgtacgtgggtttacctgggcctccggaacagacctcttgcttgtggggggatcctaatgtcactgtcctcgccggtctaaccccaggaaatagtccaattttctacagagaagtgctaccattgaaccaagctcatagagtcgaagtggttctcctgcacggcaaagcatttaacagccacacctgggaacagttagggaccctgcaactgctatcccagcgcggttatcgcgctgttgcccttgatctgcccggattcggcaatagtgcaccttctaaggaggcaagtacagaagccggtagagccgctctactggaacgcgcactgcgggatcttgaggttcagaacgctgttctggtgtccccatccctgagcggtcattatgcccttcctttcctcatgcgaggtcaccatcaattgcacggctttgtgccgatcgctcctacaagcacacagaactatacacaggagcagttctgggcagtgaaaacacctaccctgatcctgtacggggagctggatcacatcctggccagggaaagtctcaggcagcttcgccacctgccaaatcactccgtggtaaagcttaggaacgccggtcacgcttgttatctgcacaagcctcaagatttccacctggtgctgcttgcctttctcgatcatttgccttag

SEQ ID NO: 48153 - DNA, 690 bp, Artificial Sequence
  Description of Artificial Sequence: Synthetic coding sequence
atgttactgctctacgtgggcctgccgggtccacccgaacaaacgagttgcctgtggggcgaccccaacgtgacagttcttgcaggactgacacccggtaactccccaatcttttaccgagaggtcctgccactcaaccaggcgcaccgcgtcgaagtcgtcctcctgcatgggaaggcatttaacagccatacttgggagcagctcgggactcttcagctgctgtcccagcgtggctatagggccgttgccctggatttgcctgtccctggctcgagcaactctccggctagcgcatcgcctgtggccgagatcaccgaaaactcattttgggcagtgctggtgagggacctggaagttcagaatgcagtcctcgtctccccctcactgtctggccactacgctctaccatttctgatgcggggtcaccatcagttacatggcttcgtgccaatcgcaccaaccagcacccagaactacacccaggaacagttctgggccgtgaagacacctaccctcatcttgtatggtgaattagaccacatcctggctcgcgaatcactgcggcaactccggcacttacctaaccatagcgttgtcaaacttcgcaatgctggacatgcttgctacctgcacaagccacaggattttcacctggtcctccttgcctttttagatcatttaccttag

SEQ ID NO: 48154 - DNA, 618 bp, Artificial Sequence
  Description of Artificial Sequence: Synthetic coding sequence
atgctgttgctgtacgttggcttaccaggccctcctgagcagaccagctgcctgtggggcgacccaaatgtaacggttcttgcaggcctgactcccggtaactcacctatcttttaccgagaggttctgcctctgaaccaggcccacagggtggaagttgtcctcctccatgggaaggcatttaactcccatacctgggagcagctgggcaccctgcaactgctttcccaacgtgggtaccgtgctgtggctcttgatttgcctgtgcctggtagctctaacagcccggcttctgcgtccccagtggctgagattactggctttgtgttcctgatgtgcgcgtcagcctcgggccctcagttgttccccccactctggcctatcgccccaacatctacccaaaattatacacaggagcagttctgggctgttaagaccccaactttgattctgtatggcgaactagaccacatactcgccagagagagcctcaggcagttgagacacctgccaaaccacagcgtcgtgaagctaagaaacgccggacacgcctgttacctgcacaagccacaggattttcacctagtgctgctggcctttctcgaccatctcccatag

SEQ ID NO: 48155 - DNA, 465 bp, Artificial Sequence
  Description of Artificial Sequence: Synthetic coding sequence
atgctccttctttatgtcggattaccaggccctccagagcagaccagttgtctgtggggagaccccaacgttacagtcctggcaggactgacgcctggcaacagcccaattttctaccgcgaagtactgcccctcaaccaggcacaccgggtcgaggtggtgctgttgcacggtaaggccttcaatagccatacctgggaacagctggggaccctgcaactcctgtcccagaggggataccgggcagtcgctctggaccttcccgtactgggcttcggcaacagcgcaccttcaaaggaagcttctaccgaagccggacgcgcagcactgctcgagcgcgctctgagggacctggaggtccagaacgcggtgctggtgagcccctcactcagcggtcactatgccctccccttccttatgagaggccaccaccagcttcatgggttcgttcccatcgcaccctag

SEQ ID NO: 48156 - DNA, 1014 bp, Artificial Sequence
  Description of Artificial Sequence: Synthetic coding sequence
atggaccttgatgtggtgaatatgttcgtcatagccggtgggaccctcgccattcccatcttggcctttgtcgcttcctttctcctctggccttccgccttgattcgaatttattactggtattggcgtcggactctaggcatgcaggtgcggtatgttcatcacgaggattaccagttttgttacagttttagagggaggcccggtcataaaccatctatcctgatgctccacggttttagcgcgcataaggacatgtggctgtcagttgttaagtttctgccgaagaacctgcatttggtctgtgtcgacatgcccggtcacgaaggcacaactcggtcttcgctggatgacctgagtattgatggacaggtcaagcgcattcatcagtttgtggagtgcctgaaactgaacaagaagccatttcacctggtgggtacgagtatgggtgggcaggtcgccggtgtgtatgctgcatactacccgtcggacgtgtcttccctgtgcttggtatgtcccgctggcctccaatattcaaccgacaatcagttcgtgcagcggctgaaggaattgcaaggctcagcagcagttgaaaagatacccctgataccttccacccctgaagagatgtcggaaatgctccaactctgtagttacgtgagatttaaagttcctcaacagattttgcaaggcttggtcgatgtccgcattcctcataacaatttctacagaaaattatttctggaaattgtttcagaaaaatccaggtactcactgcaccaaaacatggacaaaatcaaagtcccaactcagatcatttgggggaagcaggatcaagtgttagatgtgtcaggagccgacatgctggcaaagagcatcgctaattgtcaggtcgagctccttgaaaactgcggacattccgtggtgatggagaggccaaggaaaacagccaagttgattattgatttcctcgcttccgtacataacaccgataataacaaaaagctcgactag

SEQ ID NO: 48157 - DNA, 678 bp, Artificial Sequence
  Description of Artificial Sequence: Synthetic coding sequence
atggatctcgatgtcgtgaacatgtttgtgatagccggtgggaccttagccatccccatccttgcgtttgtggcttcgtttctcttgtggccatccgccctgattcgcatctactattggtactggcggagaacccttggcatgcaggtccggtacgtgcatcacgaggattatcaattctgttatagctttcggggtagaccgggtcacaaaccatcaattctgatgctccatggcttctccgcccataaagatatgtggttgagcgtggtgaagtttctccccaagaatctgcatcttgtatgcgtcgatatgcccggtcatgaaggtaccacacgaagctctctggacgaccttagcattgacggccaggtgaagagaatccatcagtttgttgagtgcctcaagctcaacaaaaagcccttccacctggtgggcacctctatgggcggtcaggtcgctggtgtgtacgccgcttactacccaagcgacgtgtcctctctgtgtcttgtctgtcctgccggacttcagtacagtactgataaccaattcgttcagcgtctaaaggaattgcagggctctgccgctgttgagaaaattcccctgatcccttcaacgcccgaggaaatgagcgagatgctgcagctgtgcagctatgtgaggtttaaagtgccttag

SEQ ID NO: 48158 - DNA, 1014 bp, Artificial Sequence
  Description of Artificial Sequence: Synthetic coding sequence
atggacttagatgtggtgaacatgtttgtgattgccggagggacgctcgccattcctatcctggccttcgttgcctctttcctactttggccaagtgccctgattcggatctactactggtactggagacgaacactgggcatgcaggtaagatacgtgcaccacgaagactatcaattttgttattcattccgcggaagaccaggtcataaaccttccattctgatgctgcatgggttctcagctcataaggatatgtggttgtccgttgtgaaattcctgcccaaaaatctgcacctcgtatgcgtggacatgcctggacacgagggaacgacaagaagctcactcgatgatctgtcaatcgacgggcaggtgaagcggatacatcaatttgtcgaatgcctcaagctcaacaagaagccatttcatttggtgggaactagcatgggcggacaagtggctggcgtgtatgcagcgtactaccccagtgatgtgagctcgttgtgcctggtgtgcccggcaggtctccagtactctactgataaccagttcgtgcagagattaaaagaactccagggctccgctgccgttgaaaagattcctttgattccttctactccagaagagatgtcggagatgctgcaactgtgcagttatgttcgttttaaagtgccccaacagattttgcaggggctggttgatgtgagaattcctcacaataatttctaccggaagctgtttcttgaaattgtctccgaaaaaagcagatactcattgcatcagaatatggacaagataaaggttccgacccaaataatttggggcaaacaggaccaggtgcttgatgtatccggggcagatatgctggctaaaagcatcgccaattgccaggtagaacttctggaaaattgtggccatagcgtggtcatggaacgaccaagaaagacagctaagctgatcattgacttcctggcaagcgtccacaatacggacaacaacaaaaagctcgactag

SEQ ID NO: 48159 - DNA, 522 bp, Artificial Sequence
  Description of Artificial Sequence: Synthetic coding sequence
atggatctggatgtggtaaacatgtttgttatcgcaggtggcacacttgcgattcccatcctagctttcgtcgcaagtttcctgctatggcccagcgcactcatcagaatctactactggtattggcgacgcactctcggcatgcaggtgcggtacgtgcatcatgaagactaccagttctgttactcgttcaggggacgaccaggtcacaagccctcaattcttatgcttcatggattctctgcccacaaggatatgtggctcagcgtcgtgaaattcttgcccaaaaatcttcatttggtgtgcgtggatatgccaggtcatgaaggaacaacccggtcatctctcgatgacctaagtatcgatggccaggtcaaacgcattcaccagtttgtagagtgcctcaaacttaacaagaaaccatttcaccttgtggggacgagtatgggtggtcaggtagcgggagtgtacgccgcttactatccctctgacgtctcaagtctgtgcctggtctgtccgtag

SEQ ID NO: 48160 - DNA, 957 bp, Artificial Sequence
  Description of Artificial Sequence: Synthetic coding sequence
atggatctggatgtagtcaatatgtttgttatcgctggcggaacccttgccatacccattctggcgttcgtggctagcttcttgctgtggccgagtgcgctgatccggatctactactggtactggcgcaggactctcggaatgcaagttaggtacgtccatcacgaggactatcaattctgctacagttttaggggcaggccaggacataaaccatccatcctaatgctgcatggattttccgcccacaaggacatgtggctcagtgtggtgaagtttctgcccaagaatctgcacctcgtatgcgtagatatgcctggccacgaaggcactacacgttccagtttggacgatcttagcatcgacgggcaagtcaagagaatacaccagtttgtcgaatgtctgaaactgaataaaaaaccctttcatcttgtgggaactagtatgggcggacaagtcgccggagtgtatgcggcttattacccctctgacgtgtcctctctgtgtcttgtgtgccccgcaggtcttcagtactcaacagacaaccagttcgtgcagcgattgaaggagctccagggcagcgccgctgtcgagaaaatccctctgatccccagcacccccgaagaaatgtctgagatgttacaattgtgctcatacgtccggtttaaggtgccacagcagattttacaggggctggtggacgttcggataccacacaacaacttctaccggaaactctttctggaaattgtgagcgaaaaatcacgatactcattgcaccagaatatggataaaataaaagtgccaacacagatcatctgggggaaacaagaccaggtgttggacgtatctggagccgacgtggggcaagttaactgtcaattgcctggtggggcttcagggaagctttgggccctcagctctgacggtaaaccgggtcgacagccatcgtcctag

SEQ ID NO: 48161 - DNA, 1194 bp, Artificial Sequence
  Description of Artificial Sequence: Synthetic coding sequence
atggcactgctgaggggtgtctttgtggtggccgcaaagcgaacccccttcggagcatacggaggcctgttaaaagattttactgcaaccgatttaagtgagttcgcagcaaaagcagcactcagcgcgggaaaagtctcaccagagaccgtggacagcgtcatcatgggcaatgtactgcagtcctccagtgacgcgatctatttggctagacacgtgggattgagagtgggcattcccaaggaaaccccagctctgacaatcaacaggttatgtggatctggcttccaatcgatcgtgaacggttgtcaggaaatctgcgtaaaagaggcagaagttgtcctctgtggcggaacggaatctatgtcgcaggctccctattgcgttaggaatgtacggttcgggacgaagctggggtccgacattaagctcgaagatagcctctgggttagcttgacggaccagcacgtgcagcttcctatggctatgacagccgagaatttggccgttaagcacaagatctctcgggaagagtgcgacaagtatgcattacagtcacagcagcgttggaaagccgcaaatgatgcaggctattttaacgatgagatggcccctattgaagtaaaaaccaagaagggaaagcagacgatgcaggtggatgaacacgccagaccacagaccacactggagcaactgcagaaactgcctcccgtgttcaagaaggatgggaccgtgacggcgggaaatgcctctggcgttgctgacggggctggggcagtgatcatcgcctctgaggacgcggtgaaaaaacataacttcacacctttggcccgtatcgtgggctacttcgtgtccggctgtgatccaagcattatggggattgggccagtgccagcgattagtggggctctgaagaaggccggactgagcctcaaagacatggatttggttgaagtgaatgaagccttcgccccacagtacttggccgtagaaagatcactcgatctggacatcagcaagacgaatgtaaacggaggcgcaatagcactggggcatcctctcggcggatcaggttctcggatcaccgcgcacctggtccacgagctgcggagaagaggcggaaaatacgcggtcggttccgcatgtatcggcggtggccagggaatcgcagtgataatccagagtaccgcttag

SEQ ID NO: 48162 - DNA, 378 bp, Artificial Sequence
  Description of Artificial Sequence: Synthetic coding sequence
atgcctgggcgacacgtctctagggtgcgggctctctacaaaagggtcttacagcttcacagagtcttgcctccggaccttaaatccctgggagatcagtatgttaaagacgagttccgaaggcataaaactgtcgggagcgatgaagcacaacgctttttacaggagtgggaagtgtatgctactgcccttctgcaacaggccaatgagaacaggcagaacagcactgggaaggcgtgttttggaacatttcttcccgaggaaaaattgaatgacttcagagacgagcagatcggccagctgcaggagcttatgcaagaggccaccaagcccaacagacagttttcgattagcgagtccatgaagccgaagttttag

SEQ ID NO: 48163 - DNA, 1605 bp, Artificial Sequence
  Description of Artificial Sequence: Synthetic coding sequence
atgtttcaatttcatgctggatcatgggaaagttggtgctgctgttgtctcatccccgctgatcgcccatgggacaggggccagcactggcaattggagatggcggatactcgctctgtccatgagacacgctttgaggccgctgttaaagtgatacagtcactgccgaaaaatggcagtttccagccgaccaatgaaatgatgcttaaattttactccttctacaagcaggcaaccgaaggtccgtgcaaactgtcccgccctggcttttgggacccgatcggacgctataagtgggacgcgtggagttcactgggcgatatgaccaaggaagaagcaatgatcgcctacgtggaggagatgaaaaagattattgagaccatgccaatgaccgagaaggttgaagaactgttgcgtgtcatcggacctttctatgaaattgttgaggataagaaatcaggccgtagctctgatataactagtgtgaggctcgagaagatttctaagtgtctggaggatttggggaacgtcctgacctccacacctaatgcaaagacagtgaatgggaaagccgagtcatctgattctggcgcagagtccgaagaggaagaagcccaggaagaggtgaagggcgctgagcaatctgacaatgataagaagatgatgaagaagtcagccgatcacaagaacttagaggtcattgttaccaatggctacgataaagacgggtttgttcaggatattcaaaacgatattcatgcctccagcagccttaacggcagaagcacggaggaagtgaaaccaattgatgagaatctgggtcagacgggtaagtcagccgtttgtatccaccaggatataaatgatgaccacgttgaggacgtcacggggatccaacacctgacctctgattcagattctgaagtgtattgcgacagcatggagcagttcggtcaagaagaaagccttgactcattcacttctaacaatgggcctttccaatactatctcggcggacactcatctcagccaatggaaaattcgggattcagggaagacatccaggtgcctcctggaaatgggaatattggtaacatgcaggtggttgccgtggagggaaagggcgaagtgaagcatggaggagaggatggcagaaacaatagcggcgcacctcatagagagaaacgcggaggtgagacagatgagttttctaatgtcagaaggggcagaggacatcgcatgcagcacctgtccgaagggacaaaaggcaggcaggtaggctcaggcggtgacggcgagcgctgggggtcagacagagggagccgagggtccctgaacgagcaaatcgccctggtgctcatgcggctccaggaggatatgcagaatgtgctgcagcggctccagaagctcgaaacactgactgccctgcaggccaagtcttcaacctctaccctgcagactgcacctcagccaacttcgcaacgccctagttggtggcctttcgaaatgtcacctggcgttcttacatttgcaataatctggccattcattgcccagtggctagtatacctttactaccaacgcagacgccgaaaactgaattag

SEQ ID NO: 48164 - DNA, 1596 bp, Artificial Sequence
  Description of Artificial Sequence: Synthetic coding sequence
ttccacgctggctcgtgggaatcttggtgctgctgttgtctaatcccggcagataggccttgggatcggggtcagcattggcagcttgagatggccgacacccgctccgtccatgagacccgtttcgaagcagcagttaaggtgattcaaagtttgcctaaaaatggcagcttccagcccacgaacgaaatgatgctcaagttctatagcttttacaaacaagctactgaggggccatgcaagctctcccgcccagggttttgggaccctattggacgctacaagtgggacgcctggagcagcctcggggacatgacaaaggaggaggccatgatcgcatacgtggaggagatgaagaagatcatcgagaccatgccaatgaccgaaaaagtggaggaactgttgcgcgtcataggacccttttatgaaatcgtagaagacaagaaaagtggaagatcttccgatatcacttccgtgagactggagaagatatccaagtgtctagaggaccttgggaatgtgctgaccagtacacccaatgccaagactgtcaatggtaaagcagagagtagcgactcgggcgctgagagtgaggaggaagaggcccaagaagaagtgaagggagccgagcagtctgacaacgataaaaagatgatgaagaagagcgcggaccataaaaatttggaggtgattgtaacaaacggatatgataaagatggattcgtgcaggacatccagaacgatatccacgcctcatcttcactcaatggtagatcaacagaggaagtgaaacctatagacgaaaatttgggacagacaggaaagtcagctgtgtgcatacaccaggacatcaacgatgaccacgtcgaggatgtgacaggcatccagcatctgactagcgattctgattccgaggtctactgtgactcaatggaacagtttggccaggaggaatccctggacagttttacctctaacaatggtccctttcagtactacctcggcggtcacagcagccagcccatggagaactccggttttcgggaagatatacaggtgcctcctggcaacggaaacatcggtaacatgcaggttgtagcggtggagggcaagggagaggtcaagcacgggggtgaagacgggagaaacaacagcggagcaccacacagagagaagcgaggaggggaaacggatgagttctccaacgtccgcagaggcaggggtcaccgcatgcagcatctgagcgaaggcactaaggggagacaggtgggttctggtggtgatggagagaggtggggctccgacaggggatcacggggttcgctcaatgagcagattgccttggtgttaatgaggctccaagaagacatgcagaacgtgctgcagcgactccagaagcttgagactcttacggccctgcaggccaagtcctccacctcgacactgcagaccgctcctcagccaaccagccagcgtcccagttggtggccctttgagatgagccctggtgtcctgaccttcgcaatcatctggccgtttattgcacaatggctggtctacttgtactaccaaagacgcaggcgcaaattgaactag

SEQ ID NO: 48165 - DNA, 1047 bp, Artificial Sequence
  Description of Artificial Sequence: Synthetic coding sequence
atgaccaaagaagaagccatgatcgcctacgtcgaggaaatgaaaaagatcattgagaccatgcctatgacagagaaagtcgaggaactgctgcgcgtgatcggaccattttacgagatagtggaagataaaaaatcggggaggagctcggatatcactagtgacctcggaaatgtccttacttccacacctaacgcaaagaccgttaatggcaaggcagagagtagcgattctggagccgagagcgaggaagaagaagctcaagaagaagtaaagggggcagagcagagtgataatgatatcaatgacgatcacgtcgaggacgtcacagggattcaacatctgaccagcgacagtgactccgaagtgtattgtgactccatggaacagttcgggcaggaggaatcactcgacagctttacttctaacaatggccctttccagtattacctgggcggacacagcagccaacctatggagaacagtggcttccgtgaggacatacaagtgccccctggcaacggcaatatcggcaacatgcaggtggtggcagtagaagggaaaggcgaggtgaagcacgggggagaagatggcagaaacaactccggcgcacctcaccgagaaaagcgtggaggcgaaacagacgagttttcaaacgtacgccgaggacgtggtcatcgaatgcaacatctctccgaaggtacaaagggacggcaagtgggttccgggggtgatggagaaagatggggatcggaccggggttctcgtggatcattaaacgagcagattgctttggtgctgatgaggctacaagaagacatgcagaatgtgttacagcgattacagaaacttgaaaccctgaccgcactgcaagctaagagctccacaagtaccctccagactgcaccacagccaacatcacaacgccctagttggtggccatttgagatgtcaccaggggtgcttaccttcgcgataatctggcccttcatagctcaatggctggtgtatttgtactaccagagacggcgaagaaagctgaattag

SEQ ID NO: 48166 - DNA, 1251 bp, Artificial Sequence
  Description of Artificial Sequence: Synthetic coding sequence
atgacaaaggaggaggctatgatcgcttatgtggaggagatgaagaaaataatcgagacgatgccgatgaccgaaaaagtagaagagctcttaagagttatcggccctttttatgagattgtggaagataagaaaagcggccgaagctctgatattacatctgatctgggcaacgtgctcacctctacaccgaacgctaagacagtgaacgggaaggcagagtcgtcagactcaggagctgagtctgaggaagaagaggctcaggaggaagttaagggagctgaacagtctgataatgataaaaagatgatgaagaagtcagcagaccacaagaaccttgaggtaattgttaccaacggttatgataaagacggcttcgtccaggacatccagaacgacatccatgcctcctcaagtcttaacggacggtctactgaagaagttaagcccatagatgagaacttaggccagacgggaaagagtgccgtgtgtattcatcaggatattaacgacgaccatgtggaggatgtcacaggtattcagcacctcaccagcgacagcgattctgaggtgtattgcgacagcatggagcagtttggccaggaggagtctttggactcattcacatccaacaacggaccattccagtactatctaggtggccactctagccaacccatggagaacagcgggttcagggaagacatacaggtgcctccaggcaacggtaacatcgggaatatgcaggttgttgccgtagagggtaagggcgaggtgaaacatgggggtgaggatggtcggaacaactcaggggctccccacagggagaagaggggaggagagaccgacgagttcagcaacgtgcgtcgcggacgtggccaccggatgcagcacctgtccgaaggaacgaaaggcagacaggtgggctcaggcggagatggggagaggtggggctccgatcgcggaagtcgcggttctctcaacgagcagatcgctctggtgctaatgcgcctgcaggaggatatgcagaacgtcctgcagagactccagaaattggaaaccctaactgccttgcaggctaaaagcagcacctccacactgcagaccgcccctcagccaaccagtcagcggccatcttggtggcccttcgaaatgtctcccggagtacttacctttgctatcatctggcctttcatagctcaatggctggtctacctgtactatcagcgcaggcggcgaaaactcaactag

SEQ ID NO: 48167 - DNA, 1473 bp, Artificial Sequence
  Description of Artificial Sequence: Synthetic coding sequence
atggccgatacgaggtctgttcacgagaccagatttgaggctgccgtgaaggtgattcagtcgttgcctaaaaatgggagctttcagcccacaaatgagatgatgcttaagttttactctttttacaagcaagctactgagggaccatgtaaactgagtagacccggtttttgggatcctatcgggcgttacaaatgggacgcctggtcctccctgggagacatgacaaaagaagaggccatgattgcatacgtggaggagatgaagaaaatcattgaaaccatgcccatgacagaaaaagtggaagagctactacgggtgataggccctttttatgagatcgtcgaggacaagaaatccggacgctcgagtgacatcacatccgacttgggaaacgtccttacctccacaccaaatgctaagacagtaaatggcaaggccgaatcgagcgatagcggcgctgaaagcgaagaagaggaagcccaggaggaggtcaagggggctgagcaaagtgacaatgacaagaaaatgatgaagaagagtgcggaccataaaaatttagaagtgatcgtgacgaatggttacgacaaggacggcttcgtccaggatatccagaacgacatccacgccagttcttctttgaacggcagaagcaccgaggaggttaagccgatcgacgagaacttgggacagacgggcaagtcagcggtttgtatccaccaggacataaatgacgaccatgtggaagatgtgaccggcatccagcacctaaccagcgattctgatagcgaggtctattgtgacagtatggagcagttcggccaggaagagagcctggacagtttcacttccaataacgggcctttccagtattacttaggtgggcacagttctcagccgatggaaaattcgggttttagggaagacatacaggtccccccaggcaacgggaacatcggtaatatgcaggttgtggccgtggaaggtaaaggggaagtaaaacatggcggtgaggatggaagaaataacagtggagctccccatagagaaaaacgcggtggtgagactgacgagttttcgaatgtgcgacggggtcgtggacaccggatgcagcacctgtccgagggaacaaaggggagacaagtcgggtctggcggtgatggagagcggtggggtagcgacagggggtcacggggaagtcttaatgaacagatagccctggtgctaatgaggttgcaggaggatatgcaaaatgtgctgcagcgcctgcaaaagctggaaacacttacagcactgcaagccaagagtagtacgtctaccttgcaaacagcccctcagcctacatcgcagcggccttcatggtggcccttcgagatgtctcctggcgtgctcactttcgctataatttggccatttatcgcccaatggctggtctatctatactaccaaagaaggcgtagaaagcttaattag

SEQ ID NO: 48168 - DNA, 1578 bp, Artificial Sequence
  Description of Artificial Sequence: Synthetic coding sequence
atgctgttcctgtcatttcatgcaggttcctgggagtcatggtgttgctgctgcctgattccagccgacaggccctgggatcgcggacagcattggcagcttgaaatggccgatacgcgctctgtacacgagacccggttcgaggcagctgttaaagtgattcaatccctgcctaagaatggcagtttccagccaactaatgaaatgatgcttaaattttatagcttttacaagcaggccacggagggcccttgcaagttatcacggccagggttttgggatcctatcggcaggtataagtgggacgcttggtcctccctaggagacatgactaaagaagaagctatgattgcatatgtggaggagatgaagaagatcatcgagacaatgccgatgaccgagaaggtggaagaactcctgagggtgataggacctttttacgaaattgtagaggataaaaaaagcggtaggagttctgacatcacatctgatctgggaaatgtcttaactagcacacccaatgctaagactgtgaatggtaaagcggagtcatctgacagtggggctgagagtgaagaggaggaagcccaggaggaggtcaagggtgcagaacagtctgataatgacaagaagatgatgaagaagtctgccgatcacaagaatctggaggtcattgtgaccaatgggtatgataaggacgggttcgtacaggatattcagaacgacattcacgccagctcctctttaaacgggcgttcaaccgaggaggtcaaacccatcgacgaaaacctaggccagactggaaagagtgcggtgtgcatccatcaggatataaacgatgaccacgttgaggatgtgactggaatacagcatctcaccagcgacagtgactcagaagtgtattgtgattctatggaacaattcggccaggaggaatcccttgacagtttcacttctaataatggtccttttcagtactacctgggcggacactcttcacaacctatggaaaactcagggtttcgggaggatatccaggtgccacccggtaacggcaatatcggtaatatgcaggtagtcgcggtggaaggcaagggggaggtaaaacacggaggtgaagacggcaggaataactccggggctccgcaccgggaaaagcgtgggggagagactgatgagtttagtaatgtgaggaggggaagaggtcaccggatgcagcacctttcagaaggcaccaaaggtcgtcaagtgggttctggcggtgacggagagcgctggggatctgatagaggatcacgcggatccctcaacgagcagattgccttagtcctgatgagactgcaggaggacatgcagaatgtgcttcagagactgcagaaattggaaaccctgacagccctccaagctaagtcttccaccagcactttacagacagctccacagcccacgagccagaggcccagctggtggccttttgagatgagtcccggagtactaacatttgcgatcatctggccatttatagctcaatggctcgtgtacctctattaccagaggagacggcgtaagctcaactag

SEQ ID NO: 48169 - DNA, 756 bp, Artificial Sequence
  Description of Artificial Sequence: Synthetic coding sequence
atggctgatacacggagcgtgcatgagaccagattcgaggctgctgtaaaagtgatccaatcgctgcctaagaacggctctttccagccaacaaacgagatgatgttgaaattttattcgttctacaaacaggccacagaaggtccatgcaaactctcacggccaggattctgggacccaatcggacgctacaaatgggacgcttggtcctccctgggagacatgactaaagaagaggcaatgatcgcttatgtggaagaaatgaaaaaaatcatcgagactatgccaatgactgaaaaagtggaggaacttctaagagtgataggacctttctatgaaatcgtggaagataagaagagtgggcgttcgagtgacatcacctcggtgcgactagagaagatctccaagtgtcttgaggatctggggaatgtcctcacatcaacgcctaacgccaagacggtcaatggaaaggccgaatcttccgatagcggcgctgagtccgaagaggaagaggcccaggaggaagttaaaggagcagagcagtcagacaatgataagaagatgatgaagaagtctgcagatcacaaaaaccttgaggtcatcgtgactaatggctacgacaaagatggattcgtacaggacatacaaaacgacattcacgcgtcttcatctctgaatggcaggagtacggaggaagtaaaacccattgatgagaatctggggcagacaggaaagagcgccgtatgtatacactag

SEQ ID NO: 48170 - DNA, 885 bp, Artificial Sequence
  Description of Artificial Sequence: Synthetic coding sequence
atgcctgggcctcctctgtccagcgctagacacgcgttacctcttggatcctgggagtcctggtgttgttgctgcctgattcctgccgaccgaccttgggatagaggacagcactggcagcttgagatggcagacactcgttctgtgcacgagactaggtttgaggccgcagtgaaggtgatacagtctctgccaaaaaacggttcatttcaacctactaatgagatgatgctgaaattttactcattttacaaacaggccacagagggcccttgcaagttgtctcgaccaggtttctgggaccccattggcaggtacaagtgggatgcgtggtctagtcttggggatatgaccaaggaagaggccatgatagcatatgtggaggaaatgaaaaagataatcgaaactatgcctatgacggaaaaggtggaagaattacttagggtcattggcccattttacgagattgtagaggataagaagtctggtaggagtagtgacatcacatccgtccgtctcgagaaaataagtaaatgcctggaggacctggggaatgtcctcactagcaccccaaatgccaagaccgtgaatggcaaggcagaaagctcagattcaggcgcagaaagtgaagaagaagaagcgcaagaagaggtgaaaggggcagagcaatccgacaacgataagaaaatgatgaaaaagagcgccgaccataaaaatctggaagtaattgttaccaatggctatgacaaggacggattcgtacaggatattcagaacgatatccatgcatcatctagcctgaacggcagatccacagaggaagtaaagcctattgacgagaatctgggacaaactggaaagagcgccgtctgcattcatcagtag

SEQ ID NO: 48171 - DNA, 987 bp, Artificial Sequence
  Description of Artificial Sequence: Synthetic coding sequence
atggcccactccaagcagccttcacatttccagtctttgatgctcctgcaatggcccctgtcctatctcgctatcttctggattcttcagcccctcttcgtgtaccttttatttacctctctgtggccactaccagtcctctacttcgcttggctatttttagattggaaaaccccagagagagggggacgacggtccgcatgggtgcgcaattggtgcgtttggactcacatccgggattactttcctatcacaatccttaaaactaaagatcttagccccgaacacaattacctaatgggcgtgcaccctcatggtctgttgacattcggggcattttgtaatttctgcaccgaagcaactggattcagtaagaccttccccggtataaccccccacctcgcgacactgagttggttttttaagatacctttcgttcgcgagtatctgatggctaaaggggtgtgttctgtttcccaacctgctattaattacctgctgtcgcatggcactgggaacctcgtaggcatagtcgtgggcggagtgggtgaggcactccagtcagtgccaaatactacaacacttattttacagaagaggaaaggctttgtcagaacagccctgcaacatggagctcacttggttcctacctttaccttcggggagactgaggtgtatgatcaagtgttatttcacaaagattcccgcatgtacaagttccagtcctgtttcagacgaatctttggcttttactgttgtgtattttatggccagagtttttgtcagggctctactggtctcctgccttattccaggcctatcgtgacagtggtgggagagccactgcccctcccacaaatcgaaaagccatcacaggaaatggtggacaagtaccatgccctgtacatggacgcgctacacaagctctttgaccaacataaaactcattatggttgcagtgagacccagaaacttttttttttgtag

SEQ ID NO: 48172 - DNA, 1002 bp, Artificial Sequence
  Description of Artificial Sequence: Synthetic coding sequence
atgttgcttccttctaagaaggacctgaagacagcgctcgacgtgttcgctgtgtttcaatggtcctttagcgccctgctgatcaccacgaccgtgatcgccgttaatttgtaccttgtcgtcttcacaccttactggccagtgacagtcctgatacttacctggcttgccttcgattggaaaactccccaacggggtgggcgtaggtttacctgcgtgcgccactggcgcttgtggaaacactattcagactacttccctttgaaactgctgaagacccacgacatttgtccttcaagaaattacatcctggtctgccacccccatggcctatttgcacacggctggtttgggcactttgccacagaagcttcaggcttcagtaagattttcccaggaataaccccatacatcctcactttaggagccttcttctggatgcctttcctgcgcgaatatgtgatgtccacaggcgcttgcagtgtgtctcgttcgtctattgattttttgctgactcataagggcactgggaacatggtgatagttgtcatcgggggactagccgagtgccgctacagcctccccggaagtagtaccctggtgctgaagaaccggtcggggttcgttcggatggcactccagcatggcgtgcccctgatccccgcttacgcgttcggggaaaccgacctttatgaccagcatatcttcacacctggtggtttcgtcaacagatttcagaaatggttccagagcatggttcatatctacccttgcgcattttacggacgcggattcactaaaaactcatggggccttctgccctacagcagaccggtgacaacaattgtcggcgagccactgcctatgccaaagatcgagaaccccagccaggagattgtggccaagtaccatactttatacatcgatgctctcagaaagctgtttgatcagcataagactaagtttggcatatctgagacccaggaactggagataatttag

SEQ ID NO: 48173 - DNA, 2220 bp, Artificial Sequence
  Description of Artificial Sequence: Synthetic coding sequence
atgtttcttctgctggccctcctcactgaacttggtaggctgcaggctcacgaaggcagtgaggggatttttctccatgtgaccgtcccaagaaaaataaagagtaacgactcagaagtaagcgaacggaaaatgatttatattatcaccatagacggacagccatacactttacacctgggcaagcagagcttccttcctcagaactttcttgtgtacacatacaacgaaactgggagcctccattcagtgtcaccatacttcatgatgcactgtcattaccagggatacgcggcagaattcccaaacagctttgtcaccctctcaatttgttcaggcctaagaggctttcttcagttcgaaaatatctcttacgggatcgaaccagttgagagttccgccaggtttgaacatataatctaccaaatgaagaacaatgacccaaacgtctccattttggccgtcaattattctcatatctggcagaaggaccaaccttataaggtgcctctgaatagtcagatcaagaatcttagtaaactgttaccgcaataccttgagatctacatcattgtcgagaaggctctgtacgattacatgggaagtgaaatgatggccgtgactcagaagatcgttcaggtcatcggactggtcaatacaatgttcacccaatttaaactgacagtcatcctttccagtttagagctgtggagtaatgaaaatcaaatctcgacaagcggggatgcagacgatatcctccagcgctttttggcctggaaaagagactaccttatcctacgtcctcacgacatagcatatctcttggtgtatcgcaagcacccaaaatacgtgggcgctactttcccaggtactgtttgcaacaagagctacgatgccggtatagccatgtaccctgacgcaattggactggaaggattttccgtcattatagcacaacttctcggattaaatgttgggctgacctacgacgacattacccaatgcttttgccttagggcaacctgcatcatgaaccacgaggctgtgagcgcgtccggtcggaagattttcagcaactgtagtatgcatgactaccggtacttcgtgtcaaagtttgagaccaaatgtctacaaaaattgagtaatttacagcccctacatcagaatcagcccgtctgtgggaacgggatcctggagtccaacgaggaatgtgattgtgggaataaaaacgagtgccagtttaaaaaatgctgtgattataacacatgtaagctgaaaggttcagtcaaatgcggaagcggtccctgctgtaccagcaagtgcgaactctctatcgccggaaccccatgccgaaaaagcattgatccagagtgtgattttaccgagtactgtaacggaactagtagcaactgcgtgcctgatacctacgcgttaaacgggagactgtgtaaactgggtaccgcttactgttataacggccagtgccaaactactgataatcaatgcgccaaaattttcggtaagggcgcacagggagctccctttgcctgttttaaggaggtgaattcattgcatgagcggagcgaaaactgtgggttcaagaattcgcagccactgccatgtgagagaaaggacgtcctctgcggaaagctcgcttgcgtccaaccccataagaacgcgaataagagcgacgcccaaagcactgtctactcatacattcaagatcatgtctgtgtgagcattgctacaggcagttccatgcgcagtgatggtacagataatgcctatgttgctgacggtacaatgtgtggtcccgagatgtactgtgtcaacaaaacatgtaggaaagtacacttgatgggctacaactgcaatgcaaccaccaaatgtaagggtaaagggatctgcaacaactttggaaattgccagtgctttccaggtcatcgtccccctgattgtaaatttcagttcggctcacctgggggttccattgatgacggaaacttccagaaaagcggcgacttctatacagagaaaggatataacacccactggaataattggtttatcctttccttctgtatcttcttgcccttcttcatcgttttcacaactgttatctttaaaagaaacgaaatctctaaatcatgtaaccgggagaacgcggagtacaatagaaattcttcggtggtgtctgagtctgacgatgtcggtcattag

SEQ ID NO: 48174 - DNA, 2148 bp, Artificial Sequence
  Description of Artificial Sequence: Synthetic coding sequence
atgttcctcctgttggcactgctgaccgagctggggcgactgcaagctcacgaaggtagcgaaggcatctttttacatgttacagtccctaggaagattaaaagtaacgatagtgaggtgagtgagaggaagatgatctatattatcacaattgacggtcagccctacaccttgcacttaggcaaacagtcttttctgccacagaacttcctggtgtacacatataatgaaactgggagcctgcactctgtatccccgtacttcatgatgcattgtcactatcaggggtatgcagccgaattccccaactcatttgtcaccctctcaatttgttccggactgagaggctttctgcagttcgagaatatttcctacggcatcgagccagtggagtcaagcgcacggttcgagcacataatttatcaaatgaaaaataatgaccccaacgtgagcatcctcgccgtgaattattcacacatatggcagaaggaccagccttacaaagtgccattaaattctcagataaagaatctgtccaagctgctgcctcagtacctggaaatttacatcatcgttgagaaggccctcatgttcactcagttcaaactgacagtcattctgtctagcctggagttgtggtcaaacgagaaccaaattagcacatcaggagacgcggacgacattctccagcgttttctcgcatggaaacgggactatcttattttgcgccctcacgatatcgcttacctcctcgtgtatcgaaaacaccccaaatacgtgggcgcaacatttcccggaaccgtctgcaataaatcttacgacgctgggattgcaatgtatcccgatgccatcggactcgaagggttttctgtgatcatcgcccaactcttaggccttaatgtgggcctcacctatgacgacatcacccagtgtttttgcctgcgagcaacctgtattatgaatcacgaggcagtatcagcatctggtcggaaaatctttagcaactgctccatgcatgattatagatattttgtgtcaaaattcgagaccaagtgtctgcagaagttgagcaacttgcagccattgcaccaaaaccaaccagtgtgtggaaacggaatacttgagagcaacgaggagtgtgactgtggcaacaaaaacgagtgtcaattcaaaaagtgctgtgattacaacacctgtaagcttaaaggttcagtgaagtgtggctccggaccctgttgcacatcgaaatgcgagctgagcattgcaggcacaccttgtagaaagtccatcgatcctgaatgtgacttcaccgaatactgtaatggaaccagtagtaattgcgtgcctgatacctacgccttgaatggaaggctgtgtaaattgggcactgcttactgttacaacggtcagtgccagacaaccgataaccagtgtgctaaaatcttcggcaagggggcacaaggagctcccttcgcatgtttcaaggaggtgaacagcctccatgagaggagtgagaattgtgggtttaaaaactcccaaccgttaccctgcgaaagaaaggacgtactatgcgggaagcttgcatgcgtgcagccccataaaaatgccaataaatccgacgcccagtccaccgtgtattcgtatatccaggatcatgtttgcgtctccatcgcaaccggaagctctatgcggagtgacggcaccgataacgcatacgtggccgacggtaccatgtgcgggcctgagatgtattgcgtaaacaaaacctgccgcaaagtgcatctgatgggctacaattgtaatgcgactacaaaatgcaagggcaaaggcatttgcaacaactttggtaactgccagtgttttccaggacatcggccacctgactgcaagttccagttcggatccccaggaggttctatcgatgatgggaactttcagaaaagcggcgacttctacacagaaaaaggatacaacacccattggaacaactggttcatcctgtccttctgcattttccttccatttttcattgtgttcacgaccgtgattttcaaaagaaatgaaatctcaaaatcctgcaaccgggagaacgccgaatacaaccgcaacagtagtgttgtcagtgaatccgacgacgtcgggcattag

SEQ ID NO: 48175 - DNA, 462 bp, Artificial Sequence
  Description of Artificial Sequence: Synthetic coding sequence
atgcggagcgatggaacggataatgcctatgtcgcagacggcacaatgtgcggacccgagatgtattgtgtcaataagacatgtaggaaggttcacctgatgggttataactgtaacgccaccactaagtgtaaaggcaaagggatctgtaacaacttcggtaattgtcagtgttttcctggccaccggcctccagactgtaagtttcaattcggctctccgggtggaagcattgacgacggcaacttccagaagtctggcgacttctacaccgagaaaggctataacacccactggaataattggtttattctgtccttctgtatcttcttgccattcttcatcgtttttactaccgttattttcaaaagaaatgagatatctaaaagttgtaatcgtgagaacgcagagtataacagaaacagtagcgttgtctctgagagtgatgacgtaggccactag

SEQ ID NO: 48176 - DNA, 549 bp, Artificial Sequence
  Description of Artificial Sequence: Synthetic coding sequence
atgttcctgctgctggcacttctcactgagctcgggaggctgcaagctcacgagggaagcgagggaatcttcctccacgtgacagtgccacggaagatcaaatctaatgattccgaggtgagtgagaggaagatgatctacattattaccattgacggccagccctatacattgcacttgggtaaacagagttttctgccgcaaaattttttggtctacacctacaatgagactgggagtctgcactccgtctcaccatacttcatgatgcattgtcactatcaaggatacgccgcagaatttcctaactcttttgttactctgtcaatctgctcaggactacgcggttttctgcagttcgagaatatttcttatggtattgagcctgtcgagtcgagtgctaggttcgagcacattatataccaaatgaaaaataatgatcccaacgtgtcaatcctcgctgtcaactatagtcatatctggcagaaggaccagccctacaaagtccctctgaattcgcaggtgaccgttatcattttaatgttatag

SEQ ID NO: 48177 - DNA, 2364 bp, Artificial Sequence
  Description of Artificial Sequence: Synthetic coding sequence
atgttccgattgtggttgcttctcgctggcctgtgtggtctgctcgcctcaaggcccggttttcagaattctctacttcagattgtcattcccgaaaaaatacagaccaacaccaatgactcttccgagattgaatacgagcaaataagctacataataccaatcgacgaaaaactgtacactgtacatctgaagcagcgctattttctagctgataatttcatgatctacctgtataatcagggctccatgaacacctactcaagcgacattcaaacacagtgttactaccaagggaatatcgaagggtatccggatagcatggtcaccctctccacttgctctggcctacggggaattctccagtttgagaacgtgtcttacggcatcgagcctctcgagtccgctgtggaatttcagcacgttctgtataaactgaagaatgaggataacgatattgccattttcattgaccgttctctcaaggaacagccaatggacgataatatatttatctctgagaagagtgagcccgctgtgcctgacttgttcccgctgtatcttgagatgcatatagtcgtggacaagacactgtacgattattgggggtcagatagtatgattgtaaccaacaaggtgatcgaaatcgtgggccttgctaattcgatgtttactcagtttaaagttactatcgtgctgtctagtctggaactttggagcgacgaaaacaaaatttctaccgtgggagaagccgatgagcttcttcaaaagtttcttgaatggaagcaaagctacctgaatttgcgtccgcacgacatagcctacttgttgatctacatggattacccacgctatctgggagccgtcttcccgggaacaatgtgtatcacccgctattcggctggagtggctctgtaccccaaggagatcacacttgaggctttcgcagtgatcgtcactcagatgttggccctttcactcggcatctcttacgacgatcctaagaagtgtcagtgttcagaaagcacctgcataatgaaccctgaggttgtccagagtaacggggtgaagacattttcgagttgttctctcaggagtttccagaatttcattagcaatgtcggagttaagtgcctccagaataagcctcaaatgcagaaaaagtcccccaaaccagtctgcggaaatgggcgattagaaggcaatgaaatttgcgactgtggcacggaggcccagtgtggtcctgctagttgctgcgacttccggacatgtgttctcaaggatggggcaaagtgttataaggggctgtgctgcaaagattgccagattctgcagtccggagttgaatgtagacccaaggcccaccccgaatgcgacattgccgaaaattgcaacggtacgagtcccgagtgtggaccggacataacactcattaatggattgagctgcaagaataacaagtttatctgctatgacggcgattgtcatgacctggatgcaaggtgtgagagcgtatttggcaaagggagtaggaacgcacccttcgcctgttacgaagagatccaatctcaatctgaccggttcggaaattgtggacgcgatcgcaataataagtacgtgttctgtggctggagaaatctgatctgcggcagactcgtttgtacctatcccacgagaaaaccattccatcaggaaaatggagacgtaatctacgcgttcgtacgagatagcgtgtgcataaccgtagattacaagctgccaaggacagtgccggatcccctagctgtgaaaaatggtagccagtgtgatatcggaagggtgtgtgtgaaccgagaatgtgtggaatctcgcatcataaaagcaagcgcgcacgtgtgcagtcagcaatgttccggccatggagtgtgtgattctaggaacaagtgccactgttcccctggctacaaacccccaaactgccagatccggtcaaaagggttttccatctttccagaggaggacatgggcagcataatggagagggcgtcagggaagactgagaatacttggcttctggggtttttaatcgcattgcctatactgatcgtcacaacagccatcgtccttgctcgaaagcagctgaagaaatggttcgccaaagaagaggagtttcctagctccgaatccaaaagcgaggggtcaacccagacatatgcgtcccagagttcttccgaaggcagtacacagacctacgctagtcagaccaggtcggagtcctcatcccaggccgatacgagcaagtcgaagagcgaggattctgccgaagcatacacttctcgaagcaagtcgcaggacagcacgcagacccagtcatcttctaactag

SEQ ID NO: 48178 - DNA, 837 bp, Artificial Sequence
  Description of Artificial Sequence: Synthetic coding sequence
tttcgcaacctactaaacaacgtgtccctgtgccacccaggatggtcggcagttgcacagtcctggctcacagccacaagtgcaagtcaggttcaggtcattcttctcccccatccgcctaattgctggttggggctgcaggagcagatttcctatattataccgatcgacgagaaactgtataccgtccacttgaaacagcggtatttcttggcagataactttatgatctatctgtataaccagggctcgatgaacacttattcttctgacatccagactcagtgctattatcagggaaacatcgaaggctacccggacagcatggtgaccctgagcacatgttctggcctgcgagggattctgcagtttgaaaatgttagctacggcattgagccattggagagtgctgttgagttccaacatgtgctgtacaagctgaagaacgaggacaatgatattgccatctttattgacagaagtctgaaggaacagccgatggatgataatatttttatctccgaaaagagtgaacccgctgtgccggacctttttcctctgtatcttgagatgcatattgtcgtggacaaaactctgtatgactattggggctccgattcaatgattgtcacgaataaagtgatcgagattgtgggattggccaactctatgttcactcagtttaaggtaactatagtactgtccagcctggaattgtggtctgacgagaacaagatctctactgtcggcgaggcggatgaactcttgcagaagttcctggaatggaagcagagttacctgaacctgcgaccgcacgatattgcatatctgctgtag

SEQ ID NO: 48179 - DNA, 2358 bp, Artificial Sequence
  Description of Artificial Sequence: Synthetic coding sequence
atggtggtaccatctctcaaactgcaggatctgatcgaggagattcgaggcgcaaagacgcaggcccaagagcgggaggtgatccaaaaggagtgcgcccacattcgagcctcttttcgggacggcgatccagtccatagacacagacagctggcaaagctgctgtatgtacacatgctggggtatccggctcacttcggtcagatggagtgtctgaaactgatagctagtagcaggttcaccgacaagagggttgggtacctgggcgctatgcttctattggacgaaaggcatgatgcccatttacttataacaaattcaataaagaatgacctttcacagggcatccaacccgtacagggtcttgccctgtgtactctgtccaccatgggctctgccgaaatgtgtcgcgatttagccccagaagttgagaaactgttgctgcaacccagtccatacgtacgaaagaaagccatcttgacagcagtacacatgataagaaaagtccccgagctgtcgtctgtttttctcccgccttgcgcgcagctactccacgagaggcaccatggcattctactcggaaccattactttaatcactgagctgtgcgagcggagccccgcagccttaagacactttcgcaaagtggtgccacagctcgttcacatcttgaggactctggtaacaatgggctattctaccgagcattccatcagcggagtgagcgacccatttttacaggtccaaatcctacgactgctgcggatccttggccgaaatcacgaagaatcctccgagacaatgaacgacctgctcgcccaggttgccaccaatactgacacatccaggaacgcaggtaatgctgtactgttcgagactgtcctcaccattatggacatccgctcggccgctggcttgagagtactcgccgttaacatcctgggacgcttcttgctcaactccgaccgcaatattagatacgtggccctcacgtccctgcttcggctcgttcaaagcgatcatagtgctgtccagaggcacagacccacagtggtcgaatgcctgcgagagaccgatgcttcccttagtagacgagccctggaactttccctggccctagtgaacagctcaaatgtgcgagcaatgatgcaggagctccaagcgttcctggagtcatgccctccggacctccgcgcagactgcgcctcgggaattctcctggctgccgagcggttcgctcccacgaaacgatggcacattgacacaattcttcacgtactcacaactgcagggacacacgtccgtgacgatgccgtcgcaaatcttacacaactgatcggcggagcccaggagctgcacgcatactccgtgaggcgcctgtataacgccttagcagaggatatctcacagcagcccctggtccaggtggccgcttggtgcataggcgaatacggggatttgcttctagcaggcaactgcgaagagatagagccattacaagtggacgaggaggaggtgcttgcactgctcgaaaaagtgctgcaatcacacatgtcactgcccgctacgaggggctacgcactgactgcgttaatgaagctgagtacacgtctgtgcggagacaacaataggatcaggcaggttgttagtatctacggatcctgtctcgacgtcgagttgcaacagcgggctgtggaatacgacaccttattccgcaagtacgatcacatgcgtgccgctatcctggaaaaaatgcctttggtggaaagggacggtcctcaggccgacgaagaagcaaaggaaagtaaggaggcagctcagttatcagaggccgcacccgtgccgaccgagcctcaagcctcacagcttttagacttactcgacctactcgatggggcttctggagatgtacagcaccctccacaccttgacccgtctcccggtggggcactggtccacctcctggacctgccctgcgtacccccacctccagctcctatcccggatcttaaagttttcgagagagaaggtgttcagctcaatctgagtttcattcgccctccagagaacccagcactccttcttatcaccataacagccaccaacttcagcgaaggcgatgtcacacattttatctgccaggcagccgtacccaagtctttgcagctgcagctgcaggcaccttctgggaacaccgtacctgccagaggcggtcttcctatcacccagttattccgcatcttgaatccaaataaggccccactgcgcttgaaactaaggcttacctatgaccacttccaccagtcagtacaggaaattttcgaagtaaacaatcttcccgtcgaatcttggcagtag

SEQ ID NO: 48180 - DNA, 2358 bp, Artificial Sequence
  Description of Artificial Sequence: Synthetic coding sequence
atggtcgttcccagtttaaaattacaggatctgattgaggagatccggggagctaagactcaagcccaggaaagagaggtcatccagaaagagtgtgctcatatacgagcaagcttccgagacggggacccagtgcaccgtcatcggcagttggccaaattgctgtatgtccacatgctgggatatccggctcactttgggcagatggagtgccttaagctcatcgcaagcagcagattcaccgacaaaagagtgggctacttaggggctatgttactattagatgaacggcacgacgctcatcttctaattacaaatagcatcaaaaatgacctgtctcaaggcatacagcctgttcaggggctcgcgctttgtacactgtctacaatgggctctgccgagatgtgtcgcgatttagcgcctgaagtggaaaagctcctgctgcagccctccccctacgttaggaagaaggcgatccttaccgccgtacacatgatacgaaaggttcctgagttgtctagcgtgttcctgccaccctgcgcccagttacttcatgaacggcaccatggtatactcctcgggaccataacgttaattacggaactgtgtgaacgctctcccgctgccttaaggcatttccgaaaagtggtaccccagctggtgcatatcttgcgtactctggtcacaatgggttattctaccgagcactcgatttctggcgtgtctgacccattccttcaggttcagatactgagattacttcgcattctcggcaggaaccacgaggaaagttcagagactatgaatgacctccttgcacaggtggcaaccaatactgacaccagccgcaatgctggcaatgcagttctctttgaaacggtgttgaccatcatggacatcaggagcgctgctgggctgcgggttctggcggtaaacatcctggggaggtttttgctgaattcagaccggaatattaggtatgtcgcactgacctctctgcttcgactggtacagagcgatcacagtgccgtacagagacatcgacctacagtggtcgagtgcctgagggagactgatgccagcctatcacggagggcactcgagctcagtctggcactagtgaactcttcgaacgtgagagctatgatgcaggaacttcaggcttttctcgaaagctgcccccctgacttgcgcgcagattgcgctagcgggattctgctggccgcagagcggttcgccccaactaagcgctggcacattgacaccatccttcatgtactgactaccgcgggtactcatgtcagggacgacgcagtggcgaatcttacacagttgatcggcggagcccaggaattgcacgcgtattcggtccggcgtctctacaacgctctcgccgaggacatttctcagcagcccctggtgcaagtggccgcatggtgcatcggagagtatggcgacctccttttggccggaaattgtgaggagatagagccattgcaagtggatgaagaggaggttctggccctgctggaaaaggtgctgcaatcacatatgtcgctacccgctacccgtggatatgctctgaccgctcttatgaagctctctacccggctttgcggtgacaacaatcgcattcggcaggtggtgagtatctacggaagctgcctggacgtagagttgcaacagagagcagtggagtacgatacactttttcgtaagtacgaccacatgcgagcagccatcttggagaagatgcccctggtagagagggatggccctcaggccgacgaagaggccaaagaaagtaaggaagcagcccagctttcagaggctgcccctgtccctactgagccccaggcttcacagttactggatcttctggacctgttagatggggcttccggcgacgtgcagcatccgcctcacctggatcctagtcctggcggagcattggtgcatttgctcgacctgccctgcgtcccacctccacccgctccaatcccagatttgaaggtcttcgaaagggagggtgtgcagctcaacctctcctttatcaggcccccagagaacccagccttattgctcatcacaatcactgctacaaatttcagtgagggcgatgtaacacacttcatttgccaggcggctgtcccaaaaagccttcagctgcaattacaggccccttctgggaatactgtgccagccagaggtggactaccgatcactcagctgttccggattttgaacccaaacaaggctcccctgcggctgaaattgcggctgacatacgaccacttccaccagtcggtccaggaaatttttgaggtgaacaatctgccagtggagtcttggcagtag

SEQ ID NO: 48181 - DNA, 1923 bp, Artificial Sequence
  Description of Artificial Sequence: Synthetic coding sequence
atggacagacgtatagagaaccggatgggtacccccgctcaccgcaggagggtagtccacacacataggcatactcgcaatcggctctcatgtccatggccccctccattcacatccccgactctcacccccggaattctcctgggtacaatcaccttgatcactgagctgtgtgagcgatcaccagctgctttacggcattttaggaaggttgtgccgcagctggtccacattctgcgaacactcgtgactatggggtacagcaccgagcactcaatttccggggtctcggacccatttttacaagtgcagattctacggctcttaagaattctgggtagaaatcacgaagagtcctctgagactatgaacgacctccttgctcaggtcgccaccaacactgacaccagcaggaacgccggtaacgctgtgttgttcgagacagtgctcacaatcatggatatccggtccgccgcaggattgcgcgtgctcgccgtgaatattctcgggaggtttctactaaacagcgatagaaacattagatacgtagccttaacaagcttattgaggttggtacagagcgatcatagcgcggtacagcgtcatcgacccacggtggttgaatgcctgagggagactgacgcatctctgtccaggcgcgctctagaactgtccctggcgctggtaaacagcagtaatgtgagagccatgatgcaggaactgcaagccttcctggagtcctgtcccccagatttgcgtgctgactgcgcaagcggtattctgctggccgcagaacgcttcgcacccaccaagcgctggcatatcgacaccatcctgcatgtcctgactacagccggaacacacgtgcgagacgacgccgtcgccaatttgactcagctgattggcggagcccaggagctgcatgcctactcggtgcggagactttacaatgccttggccgaggatatttcgcagcagccactggtacaagtcgccgcttggtgcatcggtgagtatggggatctcctgctggccggaaactgcgaagagattgaacccctccaggtggatgaggaggaggtgctagcgttactggagaaagtcctacagagtcatatgtcattgcccgctacgcgcggttacgcacttactgccctcatgaagctgagtacgcgtctctgcggagacaacaatcgcatccgtcaggttgtgtctatctacggctcttgtttagatgttgaactgcagcagcgtgcagtagagtacgatactctgtttcgtaagtatgaccatatgcgagccgctatattggaaaaaatgcccttggtggagagggatggcccacaggccgacgaagaagccaaggaatctaaggaggctgcccagttgtccgaggccgcacctgttccgacagagcctcaggctagccagctgctggatcttctcgacttactggacggcgcatcgggcgatgtacaacatccaccccatctggacccctcccctggcggagcactcgtacatttgttagatttgccctgtgtccctccccctccagcacccatcccagaccttaaggttttcgaaagggagggggttcagcttaatctgagcttcattagaccacctgagaaccccgctctgctgttgattaccatcacagcaacaaatttcagcgagggggacgtgacccacttcatctgccaagctgcagtccctaagagcctgcagctgcagctacaggcgccatccggaaacacagtcccagcgaggggcggactaccaatcactcagcttttcaggatattgaaccccaacaaggcacccctgaggctgaaacttcgtctcacctacgatcattttcaccagtcggtgcaagaaatatttgaggtaaacaacctgccagttgagtcttggcaatag

SEQ ID NO: 48182 - DNA, 1665 bp, Artificial Sequence
  Description of Artificial Sequence: Synthetic coding sequence
atgagcgtgacaatggtggtgccacagctggtgcacatcctgcgaactctggtcaccatgggttacagtaccgagcactctatatccggcgtttccgatccttttttgcaggtgcagatcctccggctgcttaggattcttggaagaaatcacgaggagtcaagtgaaacgatgaacgacctgacagtgcttacgattatggacatccggtctgctgcgggtcttagggtgttagccgtcaatattctgggtaggttcctgttgaacagcgaccgcaatattagatacgttgccctgacttccctcttacgcctcgtacagagtgaccactccgccgttcaacgccacaggcctaccgtggttgagtgccttcgtgagacagacgccagcctctcacgacgagctttggaactgagtctggcgctggtaaactctagcaatgttcgcgctatgatgcaggagcttcaggcgtttttggaatcatgtcctccagatcttcgggctgattgcgccagcggaatcctcttggccgctgagcggttcgcgccaacgaagcggtggcatatcgacaccatactccatgtgctaactaccgcaggcacacacgtgcgagatgatgcagtcgcaaacctgactcagctgattggtggcgctcaagagttgcatgcttactcagttcgaagactgtacaatgctctcgccgaagatatctcgcagcagcctttagtccaggtggcggcttggtgtatcggtgaatatggggacctcttacttgctggaaactgtgaggagatcgaacccctgcaggttgatgaggaggaggttcttgctttactggagaaagtgcttcagtcgcacatgagcctccctgcaactcgcggatatgccctgaccgccctcatgaagctcagcaccaggctgtgcggagataacaataggatccgccaggtcgtgtctatttacggcagttgcttggacgtggagttacagcagcgtgccgtagaatacgataccctttttcggaagtacgatcacatgagggcagccattctcgaaaaaatgccattagtcgaacgcgacggcccacaggccgacgaggaagccaaggagtccaaagaggctgctcagctgagcgaggcggctcctgtcccgacagagccgcaagcctcgcagttacttgacctgcttgatctccttgacggggcatccggggacgtacagcacccaccacacttggatcctagcccgggaggggcacttgttcaccttctggacttaccttgtgtgcccccaccaccagcccctatccccgacctcaaagtgttcgagcgtgagggtgtgcagctgaatctctcatttatcaggcccccagaaaaccccgctctgctcctcatcaccatcacagctacaaacttctccgagggcgacgtcacccacttcatttgtcaggctgccgtcccaaagtcccttcagctgcagctgcaggcgccaagcggtaacacggtacctgcacgcggaggtctgcccatcacccaactgttcagaattctgaatccaaacaaagctccgctccgcctgaaactgcgcctcacctacgatcattttcatcagtcggtccaggagatcttcgaagtcaataacctaccagtggagagttggcagtag

SEQ ID NO: 48183 - DNA, 414 bp, Artificial Sequence
  Description of Artificial Sequence: Synthetic coding sequence
atggtggtgccctccctaaaactccaagacctcatagaggaaattcgcggtgccaagacccaggcccaggagagagaggtgatccagaaagagtgcgcccacatccgggcttccttcagagacggggatcctgtgcacaggcatcgccaattagccaaacttctgtatgtgcacatgctgggatacccagcgcatttcggccagatggagtgcctcaaattgatcgcctcctctcggttcacggataagcgggtggggtacttaggcgcaatgctgctgctggatgagcggcacgatgcgcacctcctgattaccaacagcatcaaaaatgacctgagtcaagggattcaaccagtgcagggtctggctctttgcaccttatctacaatgggctcggctgagatgtgtaggtag

SEQ ID NO: 48184 - DNA, 603 bp, Artificial Sequence
  Description of Artificial Sequence: Synthetic coding sequence
atggttgtcccatcgctgaagctacaggatctgattgaagagatccggggagcgaaaacacaagctcaggaaagagaggtgattcagaaagagtgcgcccacattcgggcaagtttcagagatggcgacccggtccataggcaccggcaactggccaagctcctctacgtgcacatgttaggctacccggctcacttcgggcagatggagtgcctgaagctgatcgcatcgtcccgctttaccgataagagggtaggatacttgggagccatgctgctgttggatgagaggcacgacgcccatttgctgattacaaactcaattaagaatgacttgagccaggggattcagcctgtacaggggctggcactttgcaccctgtccaccatggggtcagcagaaatgtgtagggatctggctcccgaagttgaaaaactactgcttcagccctctccatacgtgcgtaagaaagccattctgactgccgtacatatgattcggaaagtacccgaactgtcgtccgtgtttctaccaccttgtgctcagctgctgcacgagagacatcatggcatcttactcggcactataactttaatcacctag

SEQ ID NO: 48185 - DNA, 465 bp, Artificial Sequence
  Description of Artificial Sequence: Synthetic coding sequence
atgattcacttcattctgcttttttccagacagggtaaattgcgtttacagaaatggtacatcaccctcccagacaaagaacgcaagaagattacacgtgaaatagtgcagatcatactctcaaggggacatcgcacctccagttttgtcgattggaaagaactgaaactggtctacaagaggtatgcgagcttatatttttgttgtgctatcgaaaatcaggacaacgaactattaaccctggagatcgtgcaccgctatgtggaactgctagacaaatacttcggaaacgtgtgcgagttagatataatctttaatttcgaaaaagcttactttatactggacgaattcattatcggcggagagatccaggagacaagcaaaaagattgctgtgaaggccatcgaggattccgacatgctgcaagaaacaatggaagaatacatgaataagcctaccttctag

SEQ ID NO: 48186 - DNA, 315 bp, Artificial Sequence
  Description of Artificial Sequence: Synthetic coding sequence
atgatccactttattctgctgtttagtcggcagggaaaattgcgcctgcagaagtggtacataacattgccggacaaggagagaaagaaaataaccagagagatcgtacagataatcctttctaggggccaccggacatcctcctttgtggattggaaagagctgaagttagtttacaaacgatacgcctccctttacttctgttgtgccatcgaaaatcaggataacgagctactgacactggaaatagttcaccgctacgtggaactactagataagtacttcggcaatacctggccctttgcacgcgcatag

SEQ ID NO: 48187 - DNA, 495 bp, Artificial Sequence
  Description of Artificial Sequence: Synthetic coding sequence
atgatacacttcatactactgttttcgaggcagggtaagctacgcctccagaagtggtatataaccttaccggacaaggagagaaaaaaaattactcgggaaattgtgcagattatactctctagggggcacagaacgagtagctttgtagattggaaagagctgaagctggtctataaacggtatgcatccctgtatttctgttgtgccatagagaatcaagacaatgagttactgacactggagatcgtgcatcgctacgtggagctcctagacaagtactttggaaatgtgtgcgaactggacattatttttaattttgaaaaggcatactttattctcgatgaatttataatcggtggggagattcaggaaactagcaagaagattgctgtaaaggctattgaggacagcgatatgctccaggagaatagattgagccctagaggtagagactgttccgagcctcgttcctgtcactgtaccctggcatag

SEQ ID NO: 48188 - DNA, 465 bp, Artificial Sequence
  Description of Artificial Sequence: Synthetic coding sequence
atgattcacttcatccttttgttcagcagacaaggaaaattacggctccagaagtggtacataactctgccagataaggaaagaaaaaaaatcacgcgtgaaattgttcagatcatcctgtcccggggtcaccgaactagctcatttgtcgattggaaggagctaaagctggtttacaagaggtatgccagcctgtatttctgctgcgcgatcgagaaccaagataatgaattgctgaccttggaaatcgtgcacaggtatgtggaactactcgacaagtatttcggtaatgtgtgcgaattggacatcatattcaattttgaaaaagcctacttcattttagatgaattcattattggtggcgagatccaggaaacgtctaagaagattgccgtgaaggctatcgaggactctgacatgctgcaggaggtctccacagtgagccagactatgggggagcggtag

SEQ ID NO: 48189 - DNA, 3249 bp, Artificial Sequence
  Description of Artificial Sequence: Synthetic coding sequence
atgtccgccgcacctgcctactccgaggataagggcggtagcgccggacctggcgagcccgagtacggtcatgacccggcaagcggagggatcttcagcagcgactataagaggcatgacgacctgaaagaaatgttagacacgaataaggactccctgaagctagaggcaatgaagaggattgtcgctatgatcgccaggggaaaaaacgcctccgatttgttccctgcagtagtgaagaacgtagcctgcaagaatatagaggtaaaaaaattggtctatgtatacctcgtacgttatgctgaagaacagcaggatttggccctccttagtattagtactttccagcgcggactcaaggatcccaaccagcttattagagccagcgccctgcgcgtgttgtcatccatacgcgttcctataattgtgcctatcatgatgttggcgattaaagaggctgcttctgacatgtccccttatgtgaggaaaacagctgcccatgccatccctaagctttatagcctagactcagaccagaaagaccagttaatcgaggttatcgagaagctattggccgacaaaacaacgttggttgctggatctgtggtaatggcctttgaggaggtgtgcccagaaagaatagatctgatccataaaaactacaggaagctttgcaatttgctgatagacgttgaagagtggggtcaagtggtgattattagtatgctgaccaggtacgctcgcacacagttcctgtccccaactcaaaacgaatccctgttagaggagaatgctgagaaggccttttacgggagtgaggaggatgaggcgaagggggctggcagcgaggaaacagccgctgcagcggctcccagtagaaagccttacgtaatggatcctgaccatcgactgcttctcaggaacaccaaaccgctgttgcagtcgcgatcagccgcagtcgtgatggctgtggcccagctatactttcacctggcgccaaaagctgaagtgggagtcatcgccaaggccctggttcggctgctgcggtctcactcagaggtccagtatgtcgtactccagaacgtagcaaccatgtcaatcaagcgcaggggcatgttcgaaccatatcttaagagcttctacattcgatctacagaccctactcagatcaaaatcctgaagctcgaggtattgaccaacctggccaacgaaaccaatatccctaccgttttacgcgaatttcaaacctatattaggagcatggataaggattttgtcgcagctaccatccaggctattggcaggtgtgccactaacatcggccgagtgagggatacttgcctgaatggattagtgcagttacttagcaatcgggacgagctggtggtagctgagtctgtagtcgtcataaagaagttgctgcagatgcaaccggctcagcacggagagatcatcaaacacctcgctaagttaacggacaatatccaagtgcctatggctagagcttccatcctctggttgattggcgaatactgtgagcacgtgcccagaatcgcccctgatgtgttgaggaaaatggcgaagagtttcactgcagaggaggacattgtgaaactccaggtgataaatctggcagctaaactgtacctcactaattctaagcagactaagctcttgacccagtatgtgttatctttggcgaagtacgaccagaattatgacatacgtgaccgcgctcggttcactagacaattaattgtgccttctgagcagggcggtgcattatctagacatgccaagaaactgtttttggccccaaaaccggctcccgtattggagtcttcctttaaagaccgcgaccatttccagttgggttccctctcccacctcctcaatgcgaaggcaaccggctaccaggaattgcctgactggccggaagaggcacccgacccctccgttcggaatgtcgaagtgccggagtggaccaaatgcagcaacagggaaaaacgcaaagagaaagaaaagccattctactcagattcggaaggggaatctggacctactgagagcgccgacagtgacccagaaagcgaatccgagtctgacagcaagtccagcagcgagtctggatccggcgaatctagttctgagagcgataatgaggaccaggacgaggacgaagagaaggggagagggtctgagtccgaacagagtgaagaagacgggaaacggaaaacaaaaaagaaagtgcctgagcggaaaggcgaggcaagttcaagtgacgaagggagcgacagttcatcttcctcgtccgagagtgagatgacctctgagtcagaagaggagcaactagaaccggcttcctggtcccgaaaaacaccaccatcctccaaatctgctcctgccactaaggagatctcactcctggatctggaggatttcactcccccatcagtccagcccgtcagcccccctgccattgtttcaacctcccttgctgcagacctggaggggctcacgctgactgatagcaccctggtgccatccctcctcagccctgtatctggggtcggcaggcaagagcttctacaccgtgtcgccggagagggactggctgtggattataccttctcacgccaacccttctctggcgacccacacatggtatctgtacacattcactttagcaactccagcgacacgcccattaagggactacacgtgggcacccccaaactcccggcaggaatctcaatacaggaattcccagagatcgagtcattagctcctggcgagtccgccaccgccgttatgggaattaacttctgcgattcaactcaggcggctaatttccaactgtgcacccagacaagacaattttacgtgagtattcaaccacctgtgggtgaactgatggcacctgtgtttatgtccgagaacgagtttaaaaaagagcagggcaagctaatggggatgaatgaaatcacggagaagctgatgttgccggacacctgtcggtcagatcacatcgttgtgcagaaggtgacagccacagctaatctcggacgggtgccctgcggcacttctgacgaataccggtttgccggtcgtacactgacggggggttcattggtactgctgaccttggatgctcggccagcaggcgctgcacagctcaccgttaactccgaaaagatggtcataggtacaatgttggtgaaagacgtgatccaggcactgacccagtag

SEQ ID NO: 48190 - DNA, 3153 bp, Artificial Sequence
  Description of Artificial Sequence: Synthetic coding sequence
atgtctgccgctccagcctattctgaggacaaaggcggaagtgctggaccgggtgagccagaatacggccatgatcccgcatccggtggcatcttctcttcagactacaaacggcatgatgatcttaaggaaatgctagataccaataaagatagcctgaaactggaggccatgaaacggattgttgccatgatcgctaggggaaaaaacgcatcagacttattcccggctgtggtcaagaatgtggcatgcaaaaacatcgaggaccctaatcagttaattcgcgcttctgcactcagagttctctctagcatcagagtgcccattatcgtgccgatcatgatgctggctataaaggaagccgcttccgacatgtcaccatacgtacggaaaaccgctgcccatgctattcctaaactgtactccttggattctgatcaaaaggatcagttgatcgaggtgattgaaaaactattagctgacaaaactacgctggtggccggttctgtcgtcatggctttcgaagaggtgtgtccggaacggatagatctcatccacaaaaactatcggaagctgtgtaatctcctgatcgacgttgaggaatggggccaggtagtgataatcagcatgttgactcgttacgcaaggacccagttcctctcccctactcagaacgaatcactcctggaagaaaatgctgaaaaggccttctatggatctgaggaggatgaggctaaaggcgctggcagcgaggagaccgccgcagctgccgcaccatccagaaaaccctacgtcatggaccccgaccaccgcctacttctgcgaaatacaaagcccctgctccagtcaagaagcgcagctgtggttatggcagttgcacaattgtattttcatctggcgccaaaggctgaggttggagtgattgccaaggcgctcgtccgcctcctccggtcccattctgaagtgcaatacgttgtgctgcaaaacgttgctacgatgtccatcaagcgcagaggcatgttcgagccatacctcaaaagtttctatatacggtcaaccgatcctactcagatcaaaatactcaaattggaagtgttgacgaatttggccaatgaaacgaacatccctaccgtgctgagagaattccagacatatataaggagcatggacaaagattttgtggcagctacgatccaggcaatcggacgttgtgccactaatattggaagggtgcgggacacatgcctcaatggcctcgttcagctcctgtcaaatagagacgagctcgtggttgctgaatcagttgtggtgattaaaaaattgctccaaatgcaacctgctcagcatggcgaaatcataaaacatctggccaagttgacagacaatattcaggttcctatggctagggcatccatcttgtggctcattggcgaatactgcgagcacgttccccgaattgcacctgatgttctccgaaaaatggctaaatcattcaccgcagaggaagacatcgtgaagttgcaagtcatcaacctcgccgctaagctatacctaacaaactctaaacagacaaagctcctgacacagtacgttctgtctttagccaagtatgatcaaaactatgatatacgggatcgcgcaaggttcacccgtcaattaattgtcccaagcgaacaggggggagccttgagccgtcatgccaagaaacttttccttgcgcctaagccagccccagttttagagagctcttttaaggatcgagatcatttccagctgggctcgctgagtcacctcctgaatgctaaggccacgggctatcaggagttaccagattggcccgaggaagctcccgacccttccgtgagaaatgtcgaagttcctgaatggacaaagtgctctaaccgcgagaagagaaaggagaaagaaaagcccttctactcagactccgaaggcgaatccggccctacagaatcagccgattctgatccggaaagcgaaagtgagtccgactctaaatcgtcatcggaatctggatccggagaatcgagctccgaatcagacaatgaggaccaggatgaggacgaagaaaagggacggggtagcgagagtgagcagagcgaagaagacggcaaaagaaaaactaaaaagaaagtaccggagagaaaaggggaggcgtcatctagcgacgaagggtccgattccagctcctctagttcggagagcgagatgacatcagagagtgaggaagaacagctcgaacctgctagttggtctcggaaaactccacctagctccaaatctgcgccagccactaaagaaatttccctgttagacctggaagactttacgcctccctccgtacagccagttagtcctcccgcaatcgtcagtacaagtctcgcagccgatctcgaggggctcacccttaccgactctacattggtaccatcactgctttcaccagtgtctggcgtgggcaggcaggagctcctgcaccgggtagccggagagggcctggcagtcgactataccttctctcgccagcccttcagtggagatccccatatggtgtccgtccatattcacttcagcaacagtagcgataccccaatcaaaggactgcatgttggtaccccaaagctccccgcaggtatttccattcaagagtttccagaaatcgaatctttggctcccggagaatctgctaccgcagtaatggggatcaacttctgtgattcaacacaggccgcaaatttccaactgtgcactcagacacgacagttctacgtcagcatacagccacctgttggagagctgatggcccctgtttttatgagtgagaatgaatttaagaaagagcaaggtaaactcatggggatgaacgagatcaccgagaagcttatgttgcctgatacctgcagatccgaccacatagtggtgcagaaggtgactgctacagctaatttggggagggtaccatgcggcactagcgacgagtataggttcgccggaagaactctgaccggaggaagcctggtgttactcacactcgacgcaagaccagcaggcgctgctcagctcaccgttaattcagagaaaatggtgattggcactatgctcgttaaggatgttattcaggctctgacccagtag

SEQ ID NO: 48191 - DNA, 3306 bp, Artificial Sequence
  Description of Artificial Sequence: Synthetic coding sequence
atgtctgccgcaccagcctactccgaagataagggtggctccgctgggccaggggagccagaatacggacacgatccagcttcgggaggaattttttccagcgattacaaacggcatgacgacttgaaggaaatgctagataccaacaaagactctctgaaactagaagccatgaaacgtatagtggctatgattgcgcgtggaaaaaacgcatctgatttattcccagccgtggtcaaaaacgtggcctgtaaaaacattgaggtgaagaaactggtttatgtatatctcgtgcgctacgccgaggagcagcaggatctcgccctcctttccatatccactttccagcgaggtctgaaggatcccaaccaactgattcgagcctcagcgctgagagtcctgagctccatcagagtaccaataatcgtgccaatcatgatgttagccataaaggaggccgcatccgatatgtcaccgtacgtccgcaagaccgctgcccacgccattcccaaactttatagtttggattcagatcagaaggaccaactcattgaagtcattgaaaagctgctggccgacaagaccacattggtcgcgggatctgtcgttatggccttcgaagaggtttgtcctgaaaggattgacttgatccataagaactataggaaactatgtaacctattgattgatgtggaggagtggggtcaggttgtgattatctcgatgctgacacgatacgccagaacacaatttctctctcctacccagaatgagagcctgctggaggagaatgcagaaaaagccttctatgggtctgaagaggacgaagccaaaggcgctgggagcgaagagactgcggctgctgccgcaccatccagaaagccatacgtgatggatccagaccacaggttgctgctgcgcaacacaaaacccctgttacagtcccgcagcgctgccgttgtaatggccgtcgcacaactatattttcacctcgctcccaaggctgaggtgggtgtgatagcaaaagctctggtgcgcctcctacgcagccatagcgaagtccagtacgttgtgctccagaacgtggctactatgtccattaagcgcagggggatgtttgagccttacctgaagtcgttctatattagaagcactgatccaacacagatcaaaatacttaagcttgaggttctaacaaatttagccaacgagacgaacatcccaacagtcctccgggaatttcagacctacattagatctatggataaagacttcgtcgcggctactattcaagccattgggaggtgcgctaccaacatcgggagggtgcgagatacatgtctcaacggcctagtgcagctactcagtaatagggacgagctggtggttgcagagtctgttgttgtcatcaagaagttgctgcagatgcagcctgcccaacatggcgagatcataaagcacctcgctaagctaaccgacaacattcaggtcccaatggcacgggcatcaatcttgtggctcataggtgaatactgcgaacatgtccctcggatagcgcctgatgtgctccgcaaaatggccaagagttttacggccgaggaagacattgtgaagctccaggtaattaacctggccgctaaactttacctcaccaattcaaaacagacgaagctcctcacgcagtacgtactgtctctcgccaagtacgatcaaaactatgatatccgcgaccgcgctaggttcaccaggcaactgatcgtaccatcagaacagggcggtgcattatcgcggcacgccaagaagctgtttctggctccaaagcctgctcccgtgctggagagctctttcaaggatagagaccattttcaactgggctctttgtcccacctcctgaatgccaaggccactgggtatcaggagctgcccgactggcctgaagaagcacccgatccatccgttaggaatgtggaggaggaagatctctccttaatagaaactcacgtggggctcctgggggagtatactgaggtcccagagtggaccaaatgttccaatcgcgaaaaacgcaaggagaaggagaaacctttctacagcgacagtgaaggtgagagtggccctacagagagcgccgactccgatcccgaaagcgagagtgaatcagattccaagagttcgagtgagtctggctctggggagtcgagtagcgagtctgacaacgaggaccaggacgaggatgaagagaaggggagggggtctgaaagtgagcagtcggaggaagacggaaaaaggaagaccaagaaaaaggtccccgaacggaaaggagaggcatcgtcctcagatgaggggagcgatagtagttcaagcagctctgaaagcgagatgacctccgagagcgaggaggaacaactcgaaccagcctcatggtccaggaaaacccccccttcctcaaagagcgcaccggctaccaaagagatttccttgctggacctcgaagatttcacccctccctcagtacaacctgtttcgccccctgcgatcgtcagtacatcccttgcagcagatctcgaaggcctgactttgaccgactctaccctggtccctagcctgcttagcccagtgagtggcgtgggcaggcaggagctcttgcaccgggtggccggtgaaggcctagctgttgattacaccttttcccgccaacctttctctggtgacccccatatggtgtccgtacacattcacttctcaaacagctcagacacgcccattaaaggtttacatgtaggcactccaaaactgccagcgggtattagtattcaggagttccctgaaattgaatctcttgcaccaggcgagtctgcaactgcggtgatgggcataaacttttgcgatagtacacaagcagcgaattttcagctgtgcacccagactcgccagttttacgtctccattcaacctccagtgggcgagctgatggcccctgtgttcatgtcggaaaatgagttcaaaaaggaacaaggcaagctgatgggtatgaatgagatcaccgaaaaacttatgctccctgacacatgcagatcagatcatattgttgttcagaaggtcactgccaccgctaacctcggtagggtgccatgcggaaccagcgatgagtaccggtttgctggaaggacacttactggtggctcccttgtgctgcttaccctggatgcaagacccgctggggctgctcagttaacagtcaacagcgagaagatggtgatcggcaccatgcttgttaaggacgtcatacaggccctcactcagtag

SEQ ID NO: 48192 - DNA, 3066 bp, Artificial Sequence
  Description of Artificial Sequence: Synthetic coding sequence
atggccctgaagatggtcaaaggttccatcgataggatgtttgacaagaatctacaggatttggtccggggtatacgtaatcataaagaggatgaggccaaatacattagccagtgtatcgatgaaattaaacaggagctgaagcaggataatatcgccgtcaaagcaaatgccgtgtgcaaactcacctacctgcagatgttggggtacgatattagctgggccgcttttaatatcattgaggtcatgtctgcatcaaagtttacttttaaacggattggttacctggcggcaagtcaatcctttcatgaaggcaccgacgtcattatgcttaccacgaatcagatccgtaaggatttaagtagtcccagtcagtatgacacaggggtcgcgctgaccggactctcttgctttgtgacacctgacttggctcgggacctcgccaatgacataatgacactgatgtctcacaccaagccgtacatccgtaaaaaggcagttcttatcatgtataaggtcttcttgaagtacccagagtcgctccggcctgcttttccccgactaaaggaaaagctcgaagaccctgacccaggtgtgcaaagcgcagccgtgaatgtcatctgtgagctcgcaagaaggaacccaaagaattatctgtcccttgcgcctctgttcttcaaactgatgaccagttccaccaataactgggtgttgattaagatcatcaaattattcggcgctctcacgcctctggaacctcggctcggcaagaaactgatcgaacccctgaccaacttgatccactccacaagtgctatgagccttctgtacgagtgtgttaataccgttatagcggttcttattagcctctctagcggcatgcctaatcacagcgcctcaatccaattgtgtgtccagaagctccgaattctaattgaggactctgaccagaacctaaagtatttgggactgctcgccatgtctaagatcctgaaaacgcaccctaaatcagtccaatctcacaaagatctcattcttcaatgtctggatgataaggatgagtccatcagactgcgcgctctcgatctgctgtatggtatggtctctaagaaaaacctgatggagatcgtcaaaaagcttatgactcacgtggacaaagctgaggggaccacatatcgggatgagctgctcaccaagatcattgatatttgcagccaaagcaactatcagtatataactaattttgagtggtatatttcaatcttggtggaactgactagactagagggtactcgccacgggcacctcattgcggctcaaatgctcgatgttgccatcagggtcaaagccataaggaaatttgctgttagccaaatgagtgctctgctggacagcgcccatctgctagctagtagtacccagagaaacggaatatgtgaggtgctgtacgccgctgcatggatctgtggcgaattttccgaacacctacaagaaccacaccacactctggaggctatgctgcggcctagggtcacaacactgccaggtcacatccaggccgtgtacgtccagaacgtcgtaaagctatatgcctcaatactacagcagaaggaacaggcaggcgaagccgaaggggctcaggcagtaacccagcttatggtcgaccggctgccacagttcgtgcagtccgcggatctggaggtacaggaaagggcatcctgtatcctccagctggtgaagcacatacagaagttgcaggcgaaggatgtgccagtggctgaggaagtctccgccctcttcgctggagaattaaatcccgtggcccctaaagcccaaaagaaggtccccgtgccagagggtctcgatctggacgcctggattaatgagcccctgtcagattccgagtctgaagacgagagacctagagccgtgtttcacgaggaagagcagaggcggcctaagcaccgtccttccgaagctgacgaagaagagctggcccgacggagagaggctaggaagcaggagcaggcgaataatcccttctatatcaaaagttcccctagtcctcagaagcggtaccaagatacgcctggagtggaacatattcctgtcgtgcagattgacctgtccgttccactaaaagtgcctggtctgcccatgagcgaccagtacgtcaagctagaggaggagcggaggcaccgacagaaattggagaaagacaagcggagaaagaagcgaaaagagaaagaagagcgcacaaagggaaagaagaagagtaaaaaacagccacccggatccgaagaggccgcaggtgagccagtgcagaatggtgcaccagaggaagagcagctgccaccagaatcaagctactctttactcgcagaaaactcctatgtaaaaatgacctgcgacattcggggttcattacaggaggactctcaggtaaccgtggccatcgttctcgaaaatcggtcttcatccatcctgaaaggtatggagctgtctgtgttagactccctgaacgcgaggatggctagacctcaaggctctagcgtgcatgatggcgtgcctgttccttttcaattgcccccaggcgtatccaatgaagcccaatatgtgttcaccatccagagcatcgtgatggcccagaagttgaagggcaccttaagctttattgctaaaaatgatgaaggcgctacccacgaaaaactggattttaggctgcacttttcctgtagttcttaccttatcacaactccttgctactccgatgccttcgccaagcttttagaatcaggggacttgtcaatgagcagcattaaggtcgacggaatcaggatgtcctttcagaacctgctcgctaagatatgtttccaccaccacttcagcgtggtggagagggtggactcatgcgcctctatgtactctcggagtattcagggccatcatgtgtgcctgttagtgaaaaaaggcgagaattcagtctcggtcgatggaaagtgctcggattccaccctgttgtcaaatttacttgaagaaatgaaagccactttggccaaatgctag

SEQ ID NO: 48193 - DNA, 3462 bp, Artificial Sequence
  Description of Artificial Sequence: Synthetic coding sequence
atggctctcaagatggtgaaggggtctattgaccgcatgtttgataagaacctccaggatctggtgcgtggcatccgcaatcataaagaagatgaggccaaatatatctcacagtgtatagacgagattaaacaggagctgaagcaggataatattgcagtgaaggccaacgcagtgtgcaagctgacttatctacaaatgttaggatatgacattagctgggccgctttcaatatcattgaagtgatgtctgcatccaagtttacctttaaacgaattggatacctggctgctagccagagcttccacgagggcacagacgttataatgctgacgacgaatcagataagaaaagatctctcctccccatcccagtacgacaccggcgtcgctttaacaggactgtcatgcttcgtcacgcctgatctggcccgtgacctcgccaacgacataatgaccctgatgagccacactaaaccgtacataaggaagaaggctgttctcattatgtacaaagtgtttctgaaatatcccgaaagcctgagacctgcttttcctaggctgaaagagaagctcgaggaccccgatcctggcgtacagagcgcagccgtgaacgttatctgcgaactggcaagacggaacccaaaaaattacctgtccctcgcccctcttttttttaaactgatgaccagctccaccaacaattgggttctgattaagataattaaattgtttggggcactgaccccgctcgagccgcgattggggaaaaagctgatcgaaccacttaccaatcttattcattctacgagtgccatgtcattgctttacgagtgtgtaaatactgttatagccgttttgattagcctgagttctggcatgcctaaccatagtgcatccattcaactatgcgttcaaaaattgagaatactgatcgaggactctgatcagaacctgaaatacctgggcctgctagccatgagcaagatactgaagactcaccccaaatctgttcagtctcacaaagatttgatccttcagtgtttggacgataaggatgagagcatccggctcagggccctagatctgctttacggtatggttagtaaaaaaaatcttatggagatagtcaaaaaacttatgactcatgtggacaaggccgaaggaacaacctaccgagatgaattactaacaaaaattatcgacatctgttcacagtcgaattaccagtatattactaacttcgagtggtacatttccatactggtggaattaactcggctcgaagggaccaggcatggacacctgatagcggcacagatgttggacgtggccatccgggtgaaagcgatacgcaaatttgccgtcagccaaatgtcggcgctgctagattccgctcatctgctcgcctcctccacccagagaaatggcatttgtgaggtcctttacgccgcagcctggatctgcggggagtttagcgagcacttgcaggagccacaccatacattggaagccatgcttagacccagggtgactacgcttcccggtcacattcaggccgtatacgtgcagaatgtggttaaactttatgctagtatcttgcagcagaaggagcaggctggtgaggccgagggagcacaggctgttacacaattaatggtggatagactgccccagttcgtccaatctgctgatttagaagtacaggaaagagcctcctgcattttgcaactggtcaagcatatccagaaactgcaggctaaggacgtgccagtggcggaggaggtcagtgctctgttcgcgggagaactgaatcctgtagcaccgaaggctcaaaagaaggtccctgtgccggaaggtctagacttagatgcatggattaacgaacctctcagcgactcagagtcagaagacgagaggcctagagccgtattccatgaggaagagcagcgaaggccgaaacatcgcccaagtgaggccgatgaggaggaactcgctaggaggagagaagcacggaagcaggagcaggctaataaccccttttatattaagagctccccctctccccaaaagcggtaccaggatacacccggtgtcgaacacatacccgtcgtgcagatcgacctttccgtgccgctgaaagtgcctggactgcctatgtcagaccagtatgtgaaactggaggaagagagaaggcaccgtcagaaacttgagaaggataagcgaagaaagaaacgcaaggagaaggagaagaaggggaagcggaggcactccagtttacccacagagagcgatgaggatatcgcgccagcccaacaggtagatatagtgacagaggagatgcctgagaacgctctcccttctgatgaagacgacaaggatccaaatgacccctatcgcgctttggacattgacctcgacaagccgctggctgactctgaaaaactacccatacaaaagcaccgaaacactgaaaccagcaagtcacctgaaaaggatgtgccaatggtggagaaaaagtctaaaaagcccaagaagaaggaaaagaagcacaaggagaaagagcgtgataaagaaaaaaaaaaggagaaggaaaaaaagaaaagtcctaaacctaaaaaaaagaaacaccggaaggagaaggaggagcgaaccaaggggaagaagaaatctaaaaagcagccacccggatcagaggaggccgcaggcgaacctgtgcagaatggcgctcctgaagaggaacagctgccaccagaaagttcctatagcttattggctgagaactcctacgttaagatgacctgtgatatcagggggagtctccaggaggattcacaggtgaccgtcgccatagtcctggagaatcgcagtagctctattttaaaggggatggaattaagcgtgctggattctcttaatgcacgcatggctcgccctcagggttctagtgtgcacgatggagtgccagtgcctttccaactgccacctggggtaagcaatgaggcccagtacgtattcacaattcaatccatagtgatggctcagaagctgaaaggcactctctccttcattgccaagaacgacgagggagctacccacgaaaaactcgactttcgcctgcacttcagctgctctagttatctgattaccaccccctgttacagtgacgctttcgccaagctacttgaatcaggggatctgtcaatgtcctccattaaggtggacggaatcaggatgtccttccagaatcttctggccaagatctgtttccatcatcatttttccgtagtagaaagagtggattcctgcgcttcaatgtatagccgatctattcaagggcaccacgtttgtttgttagtcaaaaagggggagaattccgtctctgtagacgggaagtgctctgactccaccctgctgtccaacctgctggaggaaatgaaggctactctcgctaagtgttag

SEQ ID NO: 48194 - DNA, 2955 bp, Artificial Sequence
  Description of Artificial Sequence: Synthetic coding sequence
atggccctgaagatggttaagggtagtatcgataggatgtttgataagaacctgcaagatctggtaagaggtatacgcaaccataaagaggacgaagcgaaatatatatcccagtgcattgacgagataaagcaggagctgaagcaagataacatcgccgtgaaggctaatgccgtgtgtaagctcacatacctgcagatgctgggatacgacatcagctgggccgcttttaatatcatcgaggtgatgtcggcttcaaaattcacctttaagcggatcggatatttggctgcctctcaaagtttccatgagggaacagacgtgatcatgctgacgactaaccagatcctcttgattagcctgtcgagtgggatgcctaaccattcagcaagcatacaattgtgcgtgcaaaaactgaggatcctgatagaggactcagaccagaatcttaagtacctgggcttgctagccatgtctaaaatcctgaaaactcacccaaaatctgtgcagagtcataaagacttaattctgcagtgtctcgatgataaagacgagtcgataagattgcgcgcactggatctgctgtacggtatggtttccaaaaagaacctgatggagatcgtcaagaagctcatgacacacgtggacaaggccgagggaaccacttaccgggacgagcttttgacaaagattatagacatttgctcgcagtctaactaccagtatatcaccaatttcgaatggtacattagcattctcgttgagctaacgcgcttagaggggacccggcacggtcatttaattgcagcgcagatgctcgacgtagcaatacgggttaaggccattcgcaagttcgcagtgtcccagatgtcagccttacttgactccgcgcacttactcgcctcgtcaactcaacggaacggcatctgtgaggttctgtacgctgcagcctggatttgcggggaatttagcgaacatctccaagaaccccaccatacactggaggcaatgttaagacccagggtcacaacactgcccggacacatccaggccgtgtatgtgcagaatgtggtgaagttatatgctagtatcctgcaacagaaagagcaggccggagaggcggagggggctcaagcggttactcagctcatggtcgaccgcctgccccaatttgtgcagtcagcagatctggaagtacaggagcgggcttcctgcattctccagctggtgaaacacatccaaaagctgcaggcaaaggatgtgcctgtggctgaggaagtgagtgctcttttcgctggggaactgaaccccgtggcccctaaagcacaaaagaaagtccccgtcccggagggtctagacctggacgcctggataaatgagcccctgagcgactccgaatctgaagatgaacggccaagagcggtatttcacgaagaagagcagcgccgtccgaagcacaggccttccgaggccgatgaggaagagttggcccgaagacgggaggcccgaaaacaagagcaggctaataaccctttctatattaaatcatcaccttccccacagaaacggtaccaagacacccccggagtggagcacattcccgtcgtgcagatcgatctcagcgtgcccctcaaggtgccagggctgcctatgtctgatcagtatgtcaagttggaggaggagagacggcacagacaaaagctcgaaaaagacaagcgaaggaaaaagagaaaggagaaggaaaagaagggaaaaaggcggcattcaagcctgcctaccgaatcagatgaggacatcgctccggcacagcaggtggatattgtgaccgaagaaatgccagaaaatgccttgccttctgatgaggacgacaaggatcccaatgatccttatagggcactggatatcgatctggacaagccactagcagattccgaaaaattgcctattcagaagcaccggaataccgagacatcaaaatcccccgagaaggacgtgcccatggttgagaaaaagtctaagaagccgaagaagaaagaaaaaaagcacaaagaaaaagaacgcgacaaagagaagaagaaagaaaaagaaaagaagaagtcacccaaacccaaaaagaagaagcatcggaaagagaaagaggagagaaccaaaggtaagaaaaaatctaaaaagcagccaccaggcagtgaggaagccgctggggagccagtgcaaaacggggctccagaggaagaacaattgcccccagagagctcctattcattactggccgaaaatagctatgtgaaaatgacgtgcgatatcaggggttccttgcaagaggattctcaggtgacggtggctatcgtattagaaaatcgatctagctccattttaaagggtatggagttatcagtgctggattcgctcaatgcacgaatggcccgaccccagggttcatccgttcacgatggagtgccggtgcccttccaattaccgcctggcgttagtaatgaagctcaatacgtctttactatacagtctatcgtgatggctcagaaactgaaaggtacactttcttttattgcaaaaaacgacgaaggagcaacacacgaaaagttagacttcaggcttcatttttcttgttcctcctacctcattacaactccctgctatagcgatgcttttgccaagctcctggaaagcggtgatttgtctatgagttccatcaaggtggacggcattaggatgtcctttcagaatttactggccaaaatttgttttcatcaccatttcagtgtagtggagcgggtggattcctgcgcctccatgtattcacgatcaatacagggacaccatgtctgcctcttagttaagaagggcgaaaattctgtttcagtcgatggaaagtgcagcgatagcaccctgttgtcaaatctgcttgaagaaatgaaagctactttggcaaagtgttag

SEQ ID NO: 48195 - DNA, 3648 bp, Artificial Sequence
  Description of Artificial Sequence: Synthetic coding sequence
atggccctgaaaatggtgaaaggctccattgatcgaatgttcgacaagaacctgcaggatttggtgcgcggaatccgcaatcacaaagaggatgaggcaaagtacatttcacagtgcattgatgagattaagcaggagctcaaacaggacaacattgccgtgaaagccaacgctgtgtgtaagctgacatatcttcagatgctggggtacgacatttcttgggcagctttcaacataattgaagttatgtcggcctctaagttcacctttaagaggattggttacctggctgcctcccaaagcttccatgaagggaccgacgtgattatgttaaccactaatcagatccgcaaggacctgtcaagcccgtcccagtatgatacaggtgtggcgctcacgggactatcatgttttgtgacccctgacttggcacgggatttggccaatgatattatgacattgatgtcccacacaaaaccttatatcaggaagaaagcggtgttaatcatgtacaaggtcttcctaaagtatcccgagagtttgaggcccgcttttccacggctcaaggagaagctggaggatcccgatccaggggtccagtctgcggcagtgaatgtcatctgtgagctggcaaggaggaaccccaagaactacctgtcacttgctcctctgttctttaaactcatgaccagcagtacaaacaactgggtgttgatcaagataattaaattgtttggcgctctgactcccttggaaccacggctggggaaaaaactcatagaacccctgacgaatttaatccactctacaagcgccatgtctttactctacgaatgtgtgaacacggtgatcgcagttctcatatccctgtcaagcggtatgcctaaccacagtgcgagtattcaactgtgcgttcaaaagctccgtatactgatagaagactcagaccaaaatctgaaatacttgggtctgctcgctatgagcaaaatcctcaaaacgcatcccaagagcgtgcagtcacacaaagacctgatcttacagtgcctggatgacaaggatgagagcattcgcctacgggctctcgatctcctgtatgggatggtgtctaagaagaatctcatggaaattgtgaagaaattaatgacccatgttgacaaggcggaaggaaccacctacagggacgagctgctgacgaaaattattgacatttgttcgcagagcaattatcaatacatcacaaatttcgagtggtacatctccatactggtagaattaacgaggctcgagggtacacggcacggtcatctcatcgcagcacagatgctagatgtcgcgattagggtaaaagccatacgaaaatttgccgtcagccaaatgagtgcattactcgacagcgcccatttactggcctctagcacccagagaaacggtatctgcgaggtgctgtatgccgcagcttggatatgcggtgaattcagcgaacaccttcaggaaccccatcacactctcgaagcaatgctgcggccaagggtgactaccctgcctggacacatccaagcagtgtacgtgcagaatgtggttaagctgtacgcttcaatccttcagcagaaggagcaggccggtgaagccgagggcgctcaggccgtgacacaactcatggtagaccgtttgccgcagttcgtgcagtccgccgatctggaggtgcaggaacgagcttcttgtatcctccagctcgtaaaacacattcagaagctacaagccaaagacgttccagtagccgaagaagttagtgctctcttcgccggagaactaaacccggtggctcccaaagctcaaaagaaggtgcctgttccggaggggctggatctggatgcctggattaatgagccactctcagacagcgaaagcgaagacgaaagacctagagcggtatttcacgaagaagagcagcgacggcctaaacaccgccctagcgaggccgacgaggaggaactggcccgtcgtagagaagcgagaaagcaggagcaggcaaataaccccttttatattaagtcttccccgagtccgcagaagaggtatcaggatacacccggagtggagcatatacccgtcgtccagatcgatttgtccgtaccactaaaggtgccgggattacctatgagcgatcagtatgtgaagctggaagaggagaggaggcaccgtcaaaagctggaaaaggataaacggaggaagaagcgcaaggagaaagagaagaagggcaaacgcagacattcgagtctgcccactgaaagtgacgaagatatcgctccagcccagcaagtggacatcgttacagaagagatgccggaaaacgccctgcccagcgacgaggatgacaaggatccaaacgacccatatcgagctcttgacatagacctggataaacctctcgcagattcagaaaaactgccaatccagaaacaccggaatacggaaacatcgaagagtcctgagaaggacgtgccgatggttgagaaaaaaagcaaaaaacctaaaaaaaaagaaaaaaagcataaagaaaaagagagggacaaggagaaaaagaaagagaaagaaaagaaggccgaggatctggatttttggctgtccactaccccacctcctgccccagcaccggctccagcccctgtgccatccacaggtgagcttagcgtcaataccgtcacaactcccaaggacgagtgtgaggatgcaaagacagaggcccaaggcgaagaggacgatgccgaagggcaggaccaggacaaaaagtctccaaagcccaagaaaaagaagcatcggaaggaaaaggaggaacggaccaaaggcaagaagaagagcaagaagcagcccccaggaagtgaggaggccgcaggggaaccagttcagaacggcgcacccgaggaagagcagctacccccagaatcatcctatagccttctggctgagaatagttacgtgaagatgacctgcgatatcaggggctcattgcaggaagactcccaggtgacagtggcaatcgttctggagaacagaagctcgagcattttgaaaggcatggagctatcggtgctggactccctcaatgcacgcatggccaggccccagggttcttcggtgcatgacggagtgcctgtgccatttcagctcccccctggtgtgtcgaatgaagcccaatacgtgttcactattcagagtattgtaatggcacaaaaactcaaaggcactctgagctttatagcaaaaaatgatgagggggcaacacacgaaaaattggacttccgcctccactttagctgcagtagctacctgattaccaccccttgttacagcgatgcgtttgcaaagctgcttgaatcaggcgacctcagtatgtcttcgatcaaagttgacggcataaggatgtcttttcaaaacttgttggccaagatttgttttcaccatcacttttctgtcgtagagagggtggacagctgtgccagcatgtattcgagatctattcaggggcaccatgtatgcctactggtcaaaaagggcgagaattctgtgagcgtggacggaaagtgcagtgacagcacactcctcagtaatttactggaggagatgaaagcaacgttggcaaagtgttag

SEQ ID NO: 48196 - DNA, 3339 bp, Artificial Sequence
  Description of Artificial Sequence: Synthetic coding sequence
atggccctcaaaatggtcaagggttccattgaccgcatgttcgataagaatctgcaagaccttgtgcggggaatcagaaaccataaagaggatgaggccaagtatattagtcagtgcattgacgaaatcaaacaggaattgaagcaggacaacattgctgttaaggccaacgccgtttgcaaattgacatacctccaaatgctgggctacgacattagctgggctgccttcaatatcattgaggtgatgtccgcatccaagttcacattcaaacggattgggtaccttgctgcgagtcaaagcttccatgaggggacagacgtcatcatgctcactactaaccaaattcgaaaggatttaagctcccctagccaatatgatacaggagtcgccctaacggggctgagctgtttcgttacccctgatttggcccgtgacttggcaaacgatattatgacattgatgtcccacacaaaaccatacatcagaaaaaaagccaaattaatcgaacccctcacgaatctcatccactctactagcgctatgtctttgctgtatgaatgtgtgaacacagtgatcgcggttttaatctcccttagttctgggatgcctaatcattccgcctccatccagctctgtgtgcagaaattgaggatcctaatcgaggattccgaccagaaccttaaatatctgggtcttctggccatgagcaagatcctgaaaacccacccaaagagcgtacagtcccataaggacctaatcctgcaatgtctcgatgataaagacgaatctatccgattgcgggcactggacctgctttatggtatggtgagcaagaagaatcttatggagatcgttaaaaagcttatgacgcacgttgataaagcagagggaaccacttatcgggacgagttgttgacaaaaattatagacatttgctcccagtccaactaccagtacatcacaaatttcgagtggtatatctccatcctcgttgagctcacccggctggaggggacaagacacggccacctaattgccgctcagatgttggacgtggccattcgagtaaaggccatccggaagtttgctgtgtctcaaatgagtgcactcctagattcagctcatctcctcgcttcatcaacacagcgcaatggcatatgcgaagtattatacgccgcagcctggatctgcggtgagtttagtgaacatcttcaggagcctcatcatactctggaggccatgctgagacctcgggtcaccactttgccaggtcacatacaggcagtttatgtgcaaaatgtagtaaagctctatgcgagcattctgcagcagaaggaacaggccggagaggcagaaggggctcaggcagtcacgcagttgatggtagaccgcctgccccaattcgtgcagagcgctgacctagaggtgcaggagcgcgctagctgcattctccagttggtgaagcacatccagaaacttcaggcaaaggatgtgcctgtggctgaggaagtgtccgcactgttcgcaggcgaactcaacccggtcgcccctaaggctcaaaagaaagttccagtgccagaaggtctggatctggacgcttggatcaatgagccgctctctgatagcgaaagcgaggatgagcgccctagagctgtgtttcatgaagaggagcagaggaggcctaagcaccggccatccgaagctgatgaagaagagctggctcgtaggcgcgaggccagaaagcaggagcaagccaacaatcccttttacatcaagagcagtcctagtcctcagaaaagatatcaggatacgcccggagtagagcacattccggtcgtgcagatcgacctgtctgttccacttaaggtccccggactccctatgtccgaccagtatgtgaagctagaggaagagcgacggcatcggcagaaactggaaaaggataaaagacggaaaaagcgcaaagagaaggaaaaaaagggcaagaggcgacattcttctctcccgacagagagtgacgaggatatcgcccctgctcagcaagttgatatcgtgacagaagaaatgccagaaaatgctctgcccagtgacgaagacgacaaggacccaaatgatccatacagagcactggatatagatctcgacaaacctctggctgattccgagaagctacccatacagaagcaccggaatacggaaaccagcaagtctcctgagaaggatgtacccatggtggagaaaaaatcgaaaaagcccaagaaaaaggagaagaagcacaaagagaaggagagggacaaggaaaaaaagaaagagaaggagaaaaaggcggaggacctggacttttggttaagtactactccacctcccgctcctgctccagcacccgctcccgttccaagcacagacgagtgcgaagatgctaaaactgaggctcagggcgaggaagatgacgcagagggtcaggatcaggataagaaaagtcctaagcccaagaagaagaagcacagaaaagaaaaagaagagcggacaaaaggaaaaaaaaagtcaaagaagcagccacctggctctgaggaagctgctggagagcccgtgcagaatggggcacctgaggaggagcagcttccccctgaatcttcctactcactcctggctgagaactcctacgtaaagatgacatgcgatatacggggaagcctacaggaggattctcaagtaaccgtggccattgtgctcgagaataggagttccagtatactgaagggaatggagttgtccgtcctggactccctaaacgctcggatggcgcgtccacagggaagctctgtccacgacggggttcctgtgcctttccagctccccccaggggtctctaacgaggctcagtatgtgtttacaatacagtccatcgtgatggcgcaaaagttgaagggcacactgtccttcatcgccaagaatgacgaaggtgccacgcacgaaaagttggacttccgtttgcattttagctgctctagctacctgatcaccacgccatgttactcagacgccttcgccaaactattggagtctggcgatttgagtatgtccagtattaaagtcgatggcattcgtatgtctttccagaatctgctagccaagatatgcttccaccaccacttttccgtggtcgaaagagttgactcctgcgctagcatgtacagcaggagcatccaaggtcatcacgtgtgcctcctcgtaaagaagggcgagaacagtgtcagtgtggacggcaagtgctcagactccactctgcttagtaatcttctggaagaaatgaaagccaccctagccaagtgctag

SEQ ID NO: 48197 - DNA, 1257 bp, Artificial Sequence
  Description of Artificial Sequence: Synthetic coding sequence
atgattcactccctattccttataaactgcagtggcgacatcttccttgagaagcattggaaaagcgtggtatcccagtccgtgtgcgattatttctttgaggctcaagagaaagctgcagacgtggaaaatgtgcctcctgtcatctctactccccatcattatctcatttcaatctatcgagacaaattgttcttcgtctccgtgatccagaccgaggtaccccctctctttgtcattgagttcctgcaccgcgtggcagacaccttccaggactattttggcgaatgctcagaggctgcaataaaagacaatgtggtgatcgtctatgaacttcttgaggaaatgctggacaatggttttcctttagcaaccgagtccaacattctcaaggagctcattaagccacctactatcctcaggtcagtggttaacagcataacgggctctagcaacgtaggtgacactctacctaccggacagttgagtaatatcccctggagacgggctggagtcaagtacaccaacaacgaagcctatttcgatgttgtggaagagattgacgccatcatcgacaagagcgggagtacagtgtttgccgagatccagggtgttatcgacgcatgtatcaagctaagcgggatgcccgacctgtcattatccttcatgaacccaaggctcttggatgacgtgagctttcacccttgcatcagatttaaacgatgggagtccgagcgtgtattgagctttattcctcccgatggaaatttccgactgatctcatatcgtgtgagctcccagaacctcgtagcgattcccgtttacgtgaaacactctatttcctttaaggagaatagttcctgtgggagattcgacataacgatcggccctaagcagaacatgggcaagactatcgagggaatcaccgtgacggtgcacatgcccaaggtggtgctgaatatgaacttgactcctactcagggatcatatactttcgatcccgtcactaaggtgctgacctgggacgtagggaaaatcactccacaaaagttaccaagcctcaaaggactggtcaatctgcagtcaggcgcaccaaagccagaggaaaaccctagtctaaatatccagttcaagatccagcagcttgcaatctctggcttaaaggtgaaccggctcgatatgtacggcgagaaatataagccctttaaaggtgtaaagtatgtgaccaaagccggtaagtttcaggtgcgaacatag

SEQ ID NO: 48198 - DNA, 1257 bp, Artificial Sequence
  Description of Artificial Sequence: Synthetic coding sequence
atgatacacagcctgttccttataaattgtagtggtgatatttttctcgaaaaacattggaaaagcgtcgtcagtcaatcggtctgcgattacttctttgaggcccaggaaaaggccgctgatgtcgagaatgtcccaccagtgataagtactccccaccattacttgatcagcatttatagagataagttgttctttgtcagtgtcattcagaccgaggttcctcccctgtttgttatcgagtttctacaccgcgtggccgacaccttccaggactattttggtgaatgttccgaggccgcaattaaagacaacgtcgttattgtgtacgaactgttggaagagatgcttgataatgggtttccccttgcaacagagtccaacatcttaaaggagttgatcaaacccccaaccatcctccgcagtgtggtgaactccatcacaggatcctctaatgttggcgatacgctgcccactggccagctgtctaatattccatggcgccgtgccggtgtgaagtataccaataacgaggcgtactttgacgttgtagaggagatcgatgcaatcattgacaagagcggcagcacagtttttgctgagattcagggggtcatagacgcttgcatcaagctgagcggtatgcccgacctgtcactgtctttcatgaatcctagactgttggacgatgtgagctttcatccatgtatcaggttcaagaggtgggagagcgaaagggtcctgagcttcattccacccgatggcaacttccgtctgattagttatcgcgtctccagccagaatctggtcgccatccccgtatacgtcaaacacagtattagctttaaggaaaactcttcatgcggtcgttttgacattactataggcccaaagcagaacatgggaaagacaatagagggaattaccgtaactgtccacatgccaaaggtggtgctcaatatgaatctcacccccacgcagggatcatacacctttgatcctgtcacaaaggtcctgacctgggacgtggggaagattactccacaaaaactaccctctctcaagggacttgtcaatctccagtctggggcacctaagccagaggagaacccctcactgaatattcaatttaaaatacagcagttggccatcagtggccttaaggttaataggttggacatgtacggagagaaatataaacctttcaagggcgtaaagtacgtcactaaagctggtaagttccaagtcaggacttag

SEQ ID NO: 48199 - DNA, 1257 bp, Artificial Sequence
  Description of Artificial Sequence: Synthetic coding sequence
atgatacacagcctcttccttataaattcatcaggagatattttcttggagaagcactggaaaagcgtggttagccgttccgtatgtgactatttcttcgaagcacaggagagggctacagaggcagagaatgttccacccgtgattcctactcctcaccactacctactgtcagtatacaggcacaaaattttttttgtggccgttattcaaactgaggtgcctccgttgttcgtgattgaatttctccacagagtggtggacactttccaagactattttggtgtgtgcagcgagcctgtgatcaaagacaatgtggtggtggtgtacgaggtcctggaggagatgctggacaatggctttcctttagcaacagaaagtaatattctcaaggaacttattaaaccacctaccatcctccgcaccgtggtgaataccatcacaggcagtacaaatgtgggcgaccaattgccaaccggacaattaagcgttgttccttggcgaagaaccggagttaaatataccaacaacgaggcctacttcgatgtaattgaggagatcgatgcgatcatcgacaagtccggctccacaatcaccgccgagatccagggagtgatcgatgcctgcgtgaaattaacaggtatgcccgatcttacactgtccttcatgaacccacgattactggatgatgttagcttccatccttgcgttaggtttaaacgctgggagtccgagcgtatcctgtcattcatcccccctgatggtaatttccggctactgtcttaccacgtctcagctcagaatctcgtggctatccccgtttacgtcaaacataacattagcttcagagatagttcctccctgggccgatttgaaattactgttggacccaagcaaactatggggaaaacaatcgaaggagtcaccgtcacttcacaaatgccgaagggtgtgttgaacatgtccctgacaccttctcagggcactcacacattcgaccccgtcacaaaaatgctgagctgggatgtaggtaagattaacccccagaagctcccctctctgaaagggacaatgagtctccaggcaggcgcaagcaagcccgacgagaaccccaccataaacttgcagttcaaaatacagcagctcgccatcagtggcctgaaagtcaacagactggatatgtatggcgagaagtataagccctttaagggaatcaagtacatgactaaagcgggaaaattccaggtccgtacatag

SEQ ID NO: 48200 - DNA, 1257 bp, Artificial Sequence
  Description of Artificial Sequence: Synthetic coding sequence
atgatccattcactgttcctaatcaacagtagtggagacatctttctggaaaaacactggaagtcagtggtctctcgaagcgtctgtgattacttcttcgaggcgcaagaaagagccactgaagccgaaaatgttccccctgtcatccctactcctcaccattacctgctctctgtttaccggcacaagattttcttcgtggcagtgatccagactgaagttcctccactcttcgtcatcgagttcctccaccgcgtggtagacacattccaagactatttcggggtctgtagcgaaccggttataaaggacaatgtcgtggtcgtatatgaagtgctggaggagatgctcgacaacggatttcctctggccacagagtccaacatcctgaaggagctgattaagccgccaaccatcttacgaacggtcgtcaacaccataactgggtcaacaaatgtgggtgatcagctgcccactgggcagttgagtgtagtgccttggagaaggacgggggtcaagtacacaaacaatgaagcctactttgatgtgatcgaagagattgacgctatcatcgataaaagcgggtccacgataactgccgagatacagggggtgatcgatgcttgcgtgaagctaacaggaatgcccgacctaaccctttcgtttatgaatcctcgcttgctggatgacgtaagttttcacccgtgtgtcagatttaagaggtgggaatcagagcgcattctgtccttcatcccacccgacgggaattttagattactttcataccatgtgtcagctcagaatttggttgcaatccctgtgtatgtgaaacacaatatcagttttcgagactccagctctctgggccgatttgagattactgtgggaccaaaacagacaatgggtaaaaccatcgaaggcgtaactgtgacatcccagatgcccaaaggtgtcctcaacatgtccctaaccccatcccagggcacccacactttcgaccccgtcactaagatgctgagttgggacgtaggcaaaatcaatcctcaaaagttgccctctttgaaagggaccatgtcactccaggcaggtgcaagtaagccagatgaaaatccgacaatcaacctccagtttaagatccagcagctcgccatcagtggactcaaagtgaataggcttgacatgtacggcgagaagtacaagccttttaagggtattaaatacatgaccaaggctggtaagtttcaggtgcgcacgtag

SEQ ID NO: 48201 - DNA, 33 bp, Artificial Sequence
  Description of Artificial Sequence: Synthetic coding sequence
atgattcactcacttttcctgataaactcttag

SEQ ID NO: 48202 - DNA, 1257 bp, Artificial Sequence
  Description of Artificial Sequence: Synthetic coding sequence
atgattcactccctgttcctcatcaactctagcggggatatctttctggaaaagcactggaagtccgttgtatcacggtccgtctgcgactattttttcgaagcgcaggagagagcaaccgaagccgagaatgtaccacctgtcatcccaaccccgcaccactatctcctgtctgtctataggcacaaaattttctttgtggctgttatccagacggaggtacctccactctttgtgattgagttcttacatcgcgtcgtggataccttccaggactacttcggtgtctgttcagagccagtcataaaggacaatgtagttgtggtttacgaagtcctggaagagatgttggataacgggttccctcttgccacagaatcgaatatcctgaaagaacttattaaacctcctacgattcttaggactgtcgtgaacacgattaccggctctacaaacgtgggggaccagctgcccaccggacagctgagcgtggtgccctggaggaggacaggagtaaaatacacgaataatgaggcctatttcgacgtgatcgaggaaattgacgccattatagataaatcagggagtacaattacagctgagatccagggtgtcattgatgcctgtgtgaagctaactggcatgcccgacctgaccctaagctttatgaatcctagactcttggacgacgtttcattccacccgtgcgtccgcttcaaacgttgggaatcagaaaggattttgtcattcatcccacccgatggaaacttccgcctgctgtcatatcacgtgagtgcccaaaatcttgttgccatacccgtgtacgtgaaacacaacatcagcttccgtgattcctcctctttgggccgttttgagattactgtgggaccgaaacagactatgggcaagactatagaaggcgttactgtgacttcccagatgcccaagggagtgctaaatatgtccctgactccctcccagggaacacatacctttgatcctgttaccaagatgctgagttgggacgtgggcaagatcaacccacagaagctcccaagcttaaaggggacgatgtctctgcaggcaggcgcttccaaacctgacgagaatcctactatcaatttgcagtttaagattcaacagcttgcaatctctggactgaaggtgaacaggctcgacatgtatggcgagaagtacaagcctttcaagggcatcaagtatatgacaaaggctggtaaattccaagttaggacatag

SEQ ID NO: 48203 - DNA, 420 bp, Artificial Sequence
  Description of Artificial Sequence: Synthetic coding sequence
atgattcactctctgttcctcatcaacagctcaggggacatttttcttgagaagcactggaagtcagttgtttcacgcagtgtttgtgactactttttcgaggcccaagaacgcgctacggaggctgagaatgtgccccctgtgatcccaacgccacaccattatcttctttcagtttacaggcataaaatcttcttcgttgctgttattcagactgaagtgccccctctgtttgtcatcgagttcctgcatcgcgtcgttgatacatttcaagactattttggagtttgctctgagccagttatcaaagataacgtcgtggtcgtgtacgaggtactcgaagaaatgctagataatgggtttccactcgccaccgagtcaaacatactcaaagagttaattaagccccctacgatctag

SEQ ID NO: 48204 - DNA, 822 bp, Artificial Sequence
  Description of Artificial Sequence: Synthetic coding sequence
atgattcatagtctcttcttaattaactcatctggagatatctttcttgagaagcattggaagtccgtggttagccgtagtgtatgcgattatttttttgaggctcaagagagggccaccgaagctgagaatgtaccacctgtgatcccaaccccacaccactatctactttcagtgtatcgacacaagatttttttcgtcgcggtgatccagacagaggttcctcccctgttcgtaatcgaattcctccaccgggtcgtggataccttccaagactattttggcgtatgtagtgagccagttatcaaagataacgtcgttgttgtctatgaagtgctcgaagagatgctggataacggatttccattagcaactgagagcaatatactgaaagagcttatcaaacctccaactatcctgcgcacagttgtgaataccattactggaagcactaacgttggagaccaactgccaactggccaactgagcgtggtgccctggagaaggacaggtgtcaagtatacaaataacgaagcttacttcgacgtaatcgaggagatcgatgctatcatcgataaaagtggcagcaccatcaccgccgagatacagggcgtgatcgacgcttgtgtaaagctaacgggcatgccagacctgactctgtcatttatgaatccaaggttgctggacgacgttagcttccacccatgcgtccggtttaagcggtgggaatctgaaaggattttgagttttatcccccctgacggaaatttcagactgctgtcctaccacgtctctgcccaaaagtgctgtctcggaatgtag

SEQ ID NO: 48205 - DNA, 582 bp, Artificial Sequence
  Description of Artificial Sequence: Synthetic coding sequence
atgatacaggccatcttagtattcaataatcatggcaaaccacgcctcgtgcggttctaccaacggtttccagaagaaattcaacagcagatcgttagggaaacatttcatctagttttgaaacgggacgacaatatatgcaattttctggaaggcggatcacttatcgggggaagtgattataaattgatttaccgccactatgcaaccttatactttgttttttgcgtggattcttcagagtccgagctgggcattcttgatttgattcaggtgttcgtggaaactctggacaagtgctttgagaatgtgtgtgaattggatctgattttccacatggataaagttcattacattcttcaggaggtggttatgggcggtatggtgctggagactaatatgaatgagattgtggcgcagatcgaagcacagaacagactggaaaagtctgaaggaggactttctgctgcccctgctcgtgcagtttccgccgtgaaaaacatcaacctgccagagatacctagaaatatcaatattggagacctcaatatcaaagtaccaaacctcagccagttcgtatag

SEQ ID NO: 48206 - DNA, 375 bp, Artificial Sequence
  Description of Artificial Sequence: Synthetic coding sequence
atgattcaggcaatactggttttcaataatcacgggaaacccagacttgtgaggttttatcagagattccctgaggaaatacagcagcagattgtgagggagacttttcatctggtcctgaagcgcgatgacaacatatgtaacttcctggaaggagggagtttaatcggcggaagtgactataaactgatctaccggcactacgccactctctactttgtgttttgtgtcgatagctctgagtccgaactcggcattctcgatctgatccaactaaagaaacgggaacgaaagaagagtcagtgcaacactctgcagaccggaaccctggcgctctgggagcaaggcccagacatacggacgcgcaggctgtag

SEQ ID NO: 48207 - DNA, 375 bp, Artificial Sequence
  Description of Artificial Sequence: Synthetic coding sequence
atgatccaagccatcttagtgtttaacaaccacgggaagccacgccttgtgcggttctatcagcgatttcctgaggagattcagcagcagatcgtccgcgaaacgttccacctcgtactgaaacgcgacgataacatctgtaacttcctcgagggcggaagcctgattgggggtagcgactacaaactcatttatagacattacgccaccctgtacttcgttttctgcgttgactcttccgaaagcgaactgggcatccttgacctgatccaattgaagaagcgggagaggaaaaagagccaatgtaatactctgcagacagggaccctggctctgtgggagcaggggccagatatcaggacccgccgtctgtag

SEQ ID NO: 48208 - DNA, 1506 bp, Artificial Sequence
  Description of Artificial Sequence: Synthetic coding sequence
atgccagctgctatgctaccatacgcatgcgtccttgtcttgctgggtgcacacaccgccccagctgccggtgaggctggtgggtcttgcttgaggtgggagccacactgccagcagcctctcccagatcgcgtcccttcgaccgctatcctccccccacgcctgaacggtccctggatctcaaccgggtgcgaagttcgtcccggaccagagtttctgacaagagcctatacgttttatccaagtcgcctgtttcgggctcaccaattctactacgaagaccctttttgtggagagccagctcactctcttctggttaaaggcaaagtccggttgcgaagagcttcttgggtgacccggggtgctaccgaagctgactatcacctgcacaaggtaggcatcgtgttccactctcgacgcgcacttgttgatgtgaccggtcgactgaatcagaccagagcaggtagggattgcgctcggcgtttgccccctgctagagcttggcttcccggtgctctttatgaacttagatcagcaagagctcagggtgactgtttggaggccctgggcctgacaatgcacgagctgagcctcgtccgtgttcagaggcgacttcagccgcagcctcgggcaagtccacgcctggtggaagagctttatttgggcgatatacataccgatcctgccgaaaggagacactatagacccacggggtatcaacgaccactccagtcagccctccaccacgtgcagccctgccctgcctgcgggctgattgccagaagtgatgttcaccaccccccagtgcttccccctccgctggccctccctcttcacttgggaggttggtgggtaagcagcgggtgcgaggtgcggcctgcggttttgttcctcacccgcctctttacgttccacggccactcacggagttgggaagggtattatcaccacttctctgacccagcatgtcgccagccaacctttactgtgtatgcggctggacgctatacaaggggcacacccagcactcgcgttcgaggcggtaccgagctcgtgttcgaagtcactagggctcacgtcacccctatggatcaggtgactacagctatgctgaatttcagtgaacccagtagctgcgggggagccggtgcctggtctatgggcaccgagagagatgtgacagccacaaatggctgcctacctctaggcattcgcctgcctcacgtggaatatgagctgtttaagatggaacaagacccactcggtcagtcgctcctttttattgggcagcgtccgaccgacgggtccagtcccgacacacctgaaaaacggccaacctcgtatcaggccccacttgtgctctgtcacggggaggctccagacttcagccgtcccccacagcacaggccatcactgcagaagcatccaagcactggcggactgcacattgctccatttccactcctcccacttgtgctcgggttggcattcctgcactggctgtag

SEQ ID NO: 48209 - DNA, 1539 bp, Artificial Sequence
  Description of Artificial Sequence: Synthetic coding sequence
atggccgagaatagtggcccaggcgtgcgccctcccggatgggaggcccagatcaatattatatctaccagattggccctggctcacactgcgccagccgcaggcgaagccggtggctcctgcttacgctgggaaccccattgccagcagcccctgccagacagggtcccttcgactgccatcctgcctcccaggctgaatggaccctggatctctaccggttgcgaagtgaggccgggtcccgagtttcttaccagggcctatacattttatccttctagactgttccgggctcaccagttctactatgaggaccctttctgtggggagcccgcacattccctgctcgtaaagggcaaagtgaggcttcggcgtgcctcctgggtgacacggggagcgacagaagctgattatcatttgcacaaagtcgggatcgtcttccatagccgcagggccctcgtggacgtgacagggagattgaatcagactagggcgggtcgcgattgtgccaggagactcccaccggcacgagcatggctacccggagccctctacgagcttaggagtgccagagcacagggtgattgtttagaagcactgggcctgactatgcacgagctttccctggttagggttcaacggaggcttcaaccacagccacgagcctctcccaggctagtagaggaactctacctcggagacattcacacagaccctgcagaacggaggcactatcgtcctaccggctatcagaggcccctccaatcagcactccaccatgtccagccctgccccgcatgcgggttaattgcaaggagtgacgtccatcaccctccagtcctgccaccacctcttgcacttccattgcacctcggtggctggtgggtctccagcgggtgcgaagtgcgtcccgctgtgctattcctcactcggttgtttacttttcacggacactcaagatcctgggagggctactaccaccacttcagtgaccctgcatgcaggcagccaacgtttaccgtctacgccgcaggacggtacaccagaggaactccctcaacacgcgtgagaggagggacagaacttgtgttcgaggtgacaagagcgcatgtaacccccatggatcaggtcacaactgccatgctgaacttttcggagccttcaagttgtggcggagccggagcctggagtatgggcactgagcgcgatgtgacagcaacaaacggatgtcttccattgggcatacggcttcctcacgtcgagtatgagttattcaaaatggagcaggacccattggggcagagtttgttatttattggccaaaggcctaccgacggatctagccctgacacccctgagaagcgacctacatcctatcaggctccgctagtactgtgccacggagaggctccggactttagccgccctccccagcataggccgagccttcagaagcacccctctaccgggggactacatatcgctcccttccctcttcttcctttagtgcttggactggctttcctacactggttgtag

SEQ ID NO: 48210 - DNA, 1452 bp, Artificial Sequence
  Description of Artificial Sequence: Synthetic coding sequence
atgcaggaattcacaaaattcccaaccaaaacgggcagaagatccctcagtcggtcaattagccagagttccaccgactcttatagttcggcggcatcctatacggactcatccgatgacgaagtgtctcctcgagagaagcaacaaactaacagcaaaggatctagcaatttctgtgttaagaacattaaacaggctgagtttgggagacgagagattgaaattgcagagcaggatatgtctgccctgataagcctaaggaaaagggcccagggggaaaagcctctggccggagcaaaaattgtgggctgtacccacattaccgcacaaaccgccgtgctgatcgagaccctgtgtgctctgggcgcacagtgccggtggagcgcctgcaacatctactccacccagaatgaggttgctgctgcacttgccgaggctggagtggccgtcttcgcatggaagggtgagtctgaagacgatttctggtggtgcattgatagatgcgttaacatggatggatggcaggccaatatgatactggacgatggaggggacctgacccactgggtctataagaagtatccgaacgtattcaaaaagatccgcggaatagtcgaggaaagtgtgaccggcgtacatagactctatcagctcagcaaagcaggaaaactgtgcgtgcccgctatgaacgtcaatgattctgttaccaagcaaaaatttgacaatctttattgctgcagggaatccattcttgacggattgaagcggacgacagatgtgatgtttggtggcaaacaggtcgtcgtatgcggatatggcgaagtggggaaaggttgttgcgctgccctcaaggcattgggcgctattgtctacatcacagagatcgaccctatatgcgccctgcaagcctgtatggacggcttcagggtagtgaagctgaatgaggtgataagacaagttgacgttgtcatcacctgcaccgggaacaagaatgtcgtgacccgggagcacctggataggatgaagaattcttgcattgtttgtaacatggggcactcaaacaccgagatcgacgtcacctcactgcgaaccccagaactcacctgggagcgggtgcgctctcaggtagaccatgtgatttggcctgacggtaaacgggttgtccttttagccgaggggagattgctaaacctaagttgctccactgtccccactttcgtcctgagcataaccgcaactacccaggcactcgccctgatcgagttgtacaacgccccagagggccgttataagcaggatgtgtacctgctcccgaaaaagatggatgagtatgtcgccagcctccatctgcctagttttgacgcccacctgacagagcttaccgatgatcaggccaaatatctcggcctcaataagaatggcccattcaagcccaactattaccgatattag

SEQ ID NO: 48211 - DNA, 1593 bp, Artificial Sequence
  Description of Artificial Sequence: Synthetic coding sequence
atgtccatgccggacgcgatgccactgcccggagttggcgaagaactaaaacaggctaaggaaattgaagatgcagagaagtattcatttatggcaacagtgacgaaggctcccaagaaacagatccagttcgctgacgatatgcaagagttcacgaaattcccaacgaagaccggcagacggtccttgtctcggtccatatctcagtcttccactgacagttattcctccgccgcaagttacactgacagttccgacgacgaagtgtccccaagggagaaacagcagacgaactcaaagggaagttccaatttctgtgtcaaaaatatcaagcaagcagagttcggcagaagagagattgaaatcgccgaacaggacatgagcgcattgataagcttgcgaaagcgggctcagggcgagaaaccacttgccggtgccaagattgtgggctgcactcatatcacagcacaaaccgccgtgctgatagagaccctgtgcgccctgggcgctcaatgtagatggtccgcatgtaatatttactctacccaaaatgaagttgccgcagctcttgccgaagcaggcgttgctgtgttcgcctggaaaggtgaaagtgaggacgacttttggtggtgcatagatcgttgtgtgaatatggatggttggcaggcaaacatgatactggacgacggcggagacctcacacattgggtctacaagaagtatcctaacgtctttaagaaaatccgcggtatcgtcgaggagagtgtcacaggggtgcaccggctttatcagttgagcaaggccggaaagctctgtgtgccggctatgaatgtgaacgattctgtcaccaaacaaaagtttgataatctgtactgttgccgcgaatccatactcgatggtttaaagcggaccaccgatgtcatgtttggtggaaagcaggttgtcgtttgcgggtatggagaggtgggaaaaggatgctgcgccgctctgaaggcccttggcgctatcgtctacataacagaaatagatcccatctgtgccctgcaggcctgcatggatggctttagagtggtgaaactcaacgaggtcattcgccaggtggatgttgtaataacctgcactggcaacaaaaacgttgtgactagggaacatctggaccgcatgaaaaattcctgcatcgtatgcaatatggggcattccaacactgaaatagacgttacctccttgcgcaccccagaactgacgtgggagagggtgagatcgcaggtcgaccacgtcatatggcccgacgggaagagggtggttctgctggccgaaggcagattgctcaacctgtcctgttctaccgtgcccacattcgtactgtccataactgcaacgacacaggcactagccctaatcgagttgtacaacgctccagaggggcgatacaagcaggatgtgtacctgctgcccaagaagatggacgagtatgtcgcctctctccatctgcccagttttgatgcgcatctgacggaactcacagacgaccaggcaaagtaccttggtctcaacaaaaatggcccttttaaaccaaattactacagatactag

SEQ ID NO: 48212 - DNA, 1452 bp, Artificial Sequence
  Description of Artificial Sequence: Synthetic coding sequence
atgcaggagtttaccaaattccctaccaagaccgggaggagatccctcagcagatccatcagtcagagctcaaccgacagctactcatcagccgcttcttacacagattcaagcgatgatgaggtgtccccacgcgagaaacagcagacaaattcaaagggtagctctaacttctgcgtaaagaatattaaacaggccgagttcgggaggagagagattgagatcgccgagcaggatatgagcgctttaatcagtctaaggaaacgcgcacaaggcgaaaagcctcttgcaggtgctaagattgtgggctgcacacatatcaccgcacagactgcagtcctgattgagacactttgtgccttaggggcacagtgccggtggtcagcatgcaatatttacagtacccagaatgaggttgcagcagccctggctgaggccggagtggcagtctttgcttggaagggagagagcgaggatgacttctggtggtgcattgacaggtgcgtgaacatggacgggtggcaggccaatatgatccttgacgacggcggtgacctcacccattgggtgtacaaaaaatatccaaatgtgtttaaaaaaattagagggatagttgaggagtcagtgaccggagtacatcgactgtaccaactcagtaaagccggaaaattatgcgtcccagccatgaacgtgaatgatagcgtgaccaagcagaagttcgacaacctctactgttgccgcgaaagtattctggatggtctgaagcgtacaaccgatgttatgtttggcggtaaacaggtggttgtgtgcggctatggtgaagtcggaaaaggatgctgtgccgctcttaaggccctgggggcaatcgtctacattactgagattgatcctatttgtgctttgcaggcctgcatggatggttttcgggtggtgaagcttaacgaggtgatcagacaagtggatgttgtcataacttgtaccggaaacaaaaacgttgttacccgcgaacacctcgacagaatgaagaatagctgtatcgtctgcaacatgggccattctaatacagagattgatgttacttcactgaggaccccagaactgacttgggaaagagtgagaagccaggtggaccacgtgatctggccagacggcaagagagtggtgctgctggcggagggcagattattgaatttgtcctgcagtacagtccctacattcgttctaagcatcaccgccacaacacaggcactggccttaatagaactgtacaacgccccagagggccgatataagcaagatgtctatttacttccgaaaaagatggacgagtacgtagcatctttgcacctaccttcatttgacgcccacctcaccgaactcaccgacgatcaggccaagtacctggggctgaataagaacggtccgtttaaacctaactattataggtactag

SEQ ID NO: 48213 - DNA, 1119 bp, Artificial Sequence
  Description of Artificial Sequence: Synthetic coding sequence
tttgtgttcaaagcttatatgtatctgaacgaaggacagaaacttctgaagaccctgaagaaagataaatcctggagtcaaacgttcgaatctgccacgttttatagcctcaagggggaagtgtgtttcaacatgggccagatcgttctggcaaaaaaaatgttgagaaaagccctgaaactgcttaatcggatctttccctacaacttgatttctttatttttgcacattcacgttgaaaagaaccgacattttcactatgtgaacaggcaggcgcaggaatccccacctccagggaaaaaaaggttggcccagttgtatagacagacagtgtgcctgtcactgctgtggcggatctacagttatagttatctattccactgcaaatattatgcccacctggccgtgatgatgcagatgaacaccgctctagagactcagaactgctttcagattatcaaggcctaccttgattactcactctatcaccacctcgccggatacaaaggggtgtggtttaagtacgaggtgatggcaatggagcacatatttaatctgccgctaaaaggcgagggaatcgagattgtcgcatacgtggccgagaccctggtgtttaacaagcttatcatgggccacctcgacctggccatagagctgggatccagagcactacagatgtgggcccttttacagaatcccaatagacattaccaaagcctctgccgtttgtcaaggtgcctgttgttgaattcgcgctatccacagctcatccaagtgcttggccgtctttgggagctgtctgtgacccaggaacatatcttttctaaggccttcttttatttcgtgtgcctggacatcctactgtacagcggctttgtgtatcggacattcgaagagtgtcttgagtttatccaccagtacgagaataaccgaatcctgaagtttcactcaggcctactgctagggctctatagttccgtggccatttgggaatgcgaggccggagtgggtcgaagactgcataccagccgagatcccggtatgcccgactttcggaatggaacaacctttactaatttccctatagagctcaagattttttgccaagaggagccctag

SEQ ID NO: 48214 - DNA, 4557 bp, Artificial Sequence
  Description of Artificial Sequence: Synthetic coding sequence
atgtccttgagcgaaggcgatgcgctgctggcactgtggagagtggagagaaagcagctcaaaaacatcatcactgtggtgatcaagtgttctcttgaaattcacggcctatttgagactcaggaatgggaagaagggttagacatccgcgtaaagattggattggctgcaggacacatcagcatgctggtgtttggcgacgagacacactcccatttcttagtgataggtcaggctgtggatgatgtgcgcctcgcccaaaatatggctcagatgaatgatgtgattctctccccgaactgctggcagttgtgtgaccgaagtatgattgagattgagtcagtgccagaccagagagccgtgaaggtgaatttcctaaagccccctcccaacttcaactttgacgagttctttacaaaatgcactacctttatgcattattacccatccggtgagcacaagaacctcctgaggctagcctgtacactaaagcctgatccggagctagaaatgtctctgcagaagtatgttatggagagtatactgaagcagattgacaataaacagcttcagggatacttgtccgaactgagacccgtcactatcgtctttgttaatctgatgttcgaagatcaggacaaggcagaagaaattggcccagcgatccaggacgcatacatgcacatcacatctgtgcttaagatcttccagggccagatcaacaaggtgttcatgtttgataaaggatgtagcttcctgtgcgtctttggcttccctggagaaaaggttcctgacgagctgacccacgctcttgagtgcgctatggacatttttgacttttgctcacaggtgcataaaatccagacggtctccatcggggtcgcatctggaattgtcttttgcggtatcgtgggacataccgtgcgacacgaatacaccgtgatcgggcagaaagtgaatctcgccgctcgcatgatgatgtactaccctggtatcgttacctgcgattctgtcacctacaatggtagtaaccttcctgcatatttcttcaaagagctgcccaagaaggtcatgaaaggcgtagccgattctggacctctttaccaatactggggcagaactgagaaagtgatgttcggcatggcgtgtcttatctgcaatagaaaggaagattatcctctgctgggtcggaacaaagaaattaactactttatgtacaccatgaagaagtttcttataagcaatagttctcaggtcctgatgtacgaaggtctgcccggttatggcaaaagccagatcctcatgaagatcgagtacctggctcaaggcaagaaccaccggattattgccattagcctgaacaagatctcatttcaccagacattttacacaattcagatgttcatggccaatgtcttgggcttggatacttgtaaacattataaggaaagacagactaatctccgcaacaaggtgatgaccctgcttgacgagaagttttactgtctgttgaatgatatcttccacgtccagtttccaatctctagagaaataagccggatgtcgactcttaagaagcagaaacagctggagattctgtttatgaaaatcctcaagctgatcgttaaggaggagcgcatcatcttcatcatcgacgaagcgcagttcgttgacagcacttcgtggagatttatggaaaaactcatcaggaccctgcctatctttataattatgtcgctatgtccctttgtaaacattccttgcgctgctgccagagccgtcatcaaaaatagaaacaccacttacatcgtgatcggcgctgtgcagcccaacgatatttccaataagatttgccttgatttaaatgtctcgtgcattagcaaggagctcgactcctacctgggggaggggtcctgcggcatcccattttattgtgaggagctgctgaaaaatctggagcaccacgaggtgctggtgttccagcagactgagagtgaagaaaagacaaacagaacatggaacaatctgttcaagtactccatcaaactgaccgaaaagctgaatatggtgacactccacagcgacaaagaatcggaagaggtgtgccatctaacctcaggcgtccgactcaagaacctttcaccacccacctccttgaaagaaattagcctcatacagctcgactcaatgcgcctaagccaccagatgctggtccggtgcgctgcaataattggcttaacgtttaccacggagctgttgttcgaaattttgccctgctggaacatgaagatgatgataaagacgctggcgacacttgtggagagtaatattttctattgtttcaggaacggaaaggagcttcagaaggctctgaagcaaaatgatcctagctttgaggtgcactaccgttccctgtctctcaaaccatccgaaggaatggatcatggagaggaagagcaactgcgtgagctggaaaatgaggtgatcgaatgccaccgcattcgattttgtaacccaatgatgcagaagacagcctatgagctgtggcttaaagatcaacggaaggccatgcacttgaagtgtgcacgattcctggaggaggatgcgcatcggtgtgatcactgcagaggtcgagattttatcccatatcaccacttcactgtgaatatccgcctcaatgcattggacatggacgccatcaaaaaaatggctatgtcgcatgggtttaaaaccgaagagaagctgatcttgtctaattctgaaatcccagaaaccagtgctttcttccccgagaaccgctcgcccgaagaaatcagggagaagatcctgaatttcttcgatcacgtgttaactaagatgaaaacgtccgacgaggacatcatcccactggagtcctgccagtgcgaagagattctcgagattgttattcttcctctagcacaccacttcttggcgcttggagagaatgataaggccttgtactacttcctagagatcgcaagcgcttacctgattttctgtgacaattacatggcctacatgtacctgaatgagggccagaagcttctaaagacgctcaagaaagacaagtcctggtcccagacattcgagtctgcaacgttctacagcctgaagggtgaggtgtgttttaacatgggacagatagtactggccaagaagatgctgcgcaaggccttaaaattgttgaataggatctttccatataatcttatctctctatttttgcacatacatgtcgagaaaaaccgacattttcattacgtgaatagacaggcccaggagtcgcctccaccgggaaagaaaaggctggctcagctgtaccgacagaccgtctgcttatccctactttggcgcatatattcctacagttatcttttccactgtaagtactacgctcaccttgcagtcatgatgcaaatgaacaccgccctcgaaacgcagaactgtttccagattatcaaggcttacttggactactctctctaccaccacctggccggttataagggagtgtggttcaagtatgaggtcatggctatggaacacatctttaacctgcccctcaagggggaagggatagagatcgtggcatatgtagcagagactctggtgtttaataagctaattatggggcaccttgacttggctatcgaactcggcagccgcgcacttcaaatgtgggcgctgcttcagaacccaaatcgccactaccaatccttgtgcagactgtcccgttgtctgctgctgaattcccgttatccccagctgatccaagtgctgggcagactgtgggagctgtctgtgacacaggaacatattttttccaaggccttcttttactttgtttgccttgacatcctgctctattccggctttgtgtaccggacatttgaggaatgcctagagtttatacaccaatatgaaaacaatagaatcttaaagttccatagtggactattgttgggcctgtatagcagcgttgctatatggtatgccaggctgcaggagtgggacaatttctacaagttctctaaccgggctaagaaccttctcccacgcaggacaatgaccctaacctactacgacgggatcagtagatacatggagggccaggtgctgcatctgcaaaagcagataaaagagcaaagcgagaacgcccaggcatctggcgaggagctgctcaagaatctcgagaacctggtggcacagaataccaccggtccggtgttctgtccacgtctttatcatctgatggcctacgtttgtattttgatgggtgacgggcagaagtgcggactgtttctcaataccgcgctgaggctgagcgaaactcaaggcaacattcttgagaaatgttggcttaatatgaacaaggaatcctggtactcaaccagcgaactgaaggaagaccaatggttacagacaatcctgtccctccctagctgggaaaaaatagtggcagggcgagtgaacatacaagatttgcagaaaaataaatttctgatgcgtgcgaatacagttgacaaccatttttag

SEQ ID NO: 48215 - DNA, 4833 bp, Artificial Sequence
  Description of Artificial Sequence: Synthetic coding sequence
atgaatacacccaaggaggaattccaggattggccaatagtgaggattgcagcccacctgcctgacctgatcgtttatggacacttttccccagagcgtccttttatggattatttcgatggagtgcttatgtttgtggatatttctggcttcacagccatgactgaaaaattcagcagcgccatgtacatggaccgcggtgccgaacaattggttgaaatcctcaactaccacatctcagccatcgtagaaaaggtgctgatttttgggggtgatatcctgaaatttgctggagacgctttactagcattgtggcgtgttgagcggaagcaactgaagaacatcattacggtggtgatcaaatgttctctggaaatacacggcttatttgagactcaggagtgggaagagggtctggatattagggtgaagatcgggcttgctgccggacacatctccatgctggtctttggggacgaaactcattcacacttcctcgttatcggccaagctgtggacgacgtacggctggcccagaatatggcccaaatgaatgatgtgatcctgtcccccaattgttggcaactgtgcgatagatctatgatcgaaattgaatccgtcccagaccagagagccgttaaggtgaatttcctcaaacctccccctaattttaatttcgacgagttcttcacaaagtgcacaacattcatgcattattatccttcgggggaacataaaaacctgttgagactggcatgtaccctcaaaccggacccggagctggagatgtctctgcagaaatacgtcatggagtccatactaaagcagatagataataaacagttacaggggtatttgtcagagctgcgcccagtgactatcgtttttgtaaatctgatgtttgaggatcaagacaaagcagaggagatcggaccggcaatccaggatgcctacatgcacattaccagtgtgctcaagatcttccaggggcagattaacaaagtttttatgtttgataaagggtgttcttttctatgcgtgttcgggttcccgggagagaaagttcccgacgagttgactcacgccctcgagtgtgccatggacattttcgatttttgctctcaggtccacaaaatccaaacggtgtctatcggagtggcctctggcattgtgttctgcggaatcgttggtcacactgtcaggcatgagtacactgtgattgggcagaaggtgaatctggccgctcgcatgatgatgtactaccctgggatcgtaacctgcgacagcgtgacctacaatgggtccaacttaccagcctatttctttaaggagctccctaaaaaggtaatgaagggggttgccgacagtggacctttgtatcagtactggggaagaaccgaaaaggtgatgtttggtatggcttgccttatttgcaatcgcaaggaggattatccccttttgggccgtaataaggagatcaattactttatgtacactatgaaaaagtttcttatctctaactcctctcaggtattaatgtacgaaggcctgccgggatacggcaagagtcagatcttgatgaagattgaatacctggctcagggcaaaaaccaccgcataattgctatatcgctaaacaagatatcttttcaccagacattttacaccattcagatgtttatggctaacgtactgggactcgacacatgtaagcattataaagagcgacagacaaaccttagaaataaagtgatgaccctcctcgacgagaaattttactgtctgcttaacgacatcttccacgtccagttccccatctccagggagatctcacgaatgagcactctcaagaagcagaagcagctcgagatcctattcatgaagatccttaagcttattgtcaaggaagagagaataatttttataattgacgaagcacaatttgtagactctacctcttggcgcttcatggaaaaactcatccgaacactccccatcttcataataatgtccctgtgccctttcgtcaacattccgtgcgcggcagcaagggccgtgattaagaacagaaatactacgtacatcgtgatcggagccgtgcagccaaatgatattagtaataaaatctgcctggacctcaacgtttcctgcatctctaaggagctggattcttaccttggcgagggcagctgtggaatccccttttactgtgaagagctgttaaaaaacctggaacaccacgaggtgctggttttccaacagactgagagtgaagaaaagactaaccgcacctggaacaatctgttcaagtattctataaaattgaccgagaagctgaatatggtaaccctccacagcgacaaggaaagcgaagaggtgtgtcatctgacgagcggcgtgaggttgaagaatttgagtccccctacctctctcaaggagatcagcctgatccaactggactccatgagactgtctcatcaaatgttagtgcgctgcgctgccatcataggattgacctttacgactgagttacttttcgaaatcttaccctgttggaacatgaaaatgatgataaaaaccctggccactctggtggagtccaacatcttctattgcttcagaaacgggaaggagctccagaaggccctgaagcaaaacgacccctcctttgaagttcattaccggtcccttagcctcaagcctagcgaaggaatggatcacggcgaagaggagcaattgagagaactggagaatgaagttatagagtgtcatcgcatacggttctgtaatcctatgatgcagaaaaccgcttatgagctgtggctgaaagaccagagaaaggcaatgcatctaaagtgcgccagatttttggaggaggacgcccaccgctgcgaccactgtagaggaagagacttcattccgtaccaccactttacagttaacattcggctcaacgccctcgatatggatgcgattaagaagatggccatgtcacatggatttaagacagaagaaaagttgatcctgtccaacagcgaaatccctgagacatcagccttttttcctgaaaacaggtcacccgaagagattcgggaaaagatcctgaacttcttcgatcatgtgctgactaagatgaagacgtccgatgaggacatcatccctctagagagttgtcagtgtgaggaaatcttagaaatcgttatcttgcctttagcccatcactttctggccctgggagaaaatgacaaagccctgtattattttctggagattgccagtgcatacttaatcttctgcgacaactacatggcatatatgtatctaaatgaaggccagaaactgttgaaaactctgaagaaggataaatcgtggtctcagacttttgagagtgcaacattctatagcctgaaaggagaagtgtgctttaatatgggacaaatcgtcctggccaagaagatgcttcggaaagccctgaagctgctgaataggattttcccatataaccttatatcccttttcttacacatccatgtggagaaaaataggcatttccattacgtgaaccgacaagctcaggaaagtccaccaccaggcaaaaagcgattggcccaactgtaccggcagactgtttgcctttctctactgtggaggatctatagctatagttacctgtttcattgcaaatactatgcccacctggcggtgatgatgcagatgaacacggccctggaaacacagaattgcttccagatcattaaggcgtaccttgattacagtttgtatcaccatctcgcgggttacaaaggtgtctggtttaaatacgaagttatggcaatggagcacatctttaacctgcctctgaagggcgagggtattgaaattgtggcttacgtggccgagacactcgtctttaataagctgatcatgggtcacttggatctggcaatcgaactgggtagtagggccctgcagatgtgggccctgttgcagaatcctaataggcactaccagtccctgtgtcgtctgagtcgctgcctactgcttaattccagatatcctcaactgattcaagtgctagggagactgtgggaactctcggtcacccaagagcatatattttcgaaagcattcttttactttgtctgtctggacattctgttgtattcaggttttgtgtacagaactttcgaagagtgcctcgagtttattcaccagtatgaaaacaaccgcatcttaaaatttcacagtggcctgctgctgggcctgtactccagcgttgccatatggtacgctagattgcaggaatgggataatttttataaattcagcaaccgggcaaaaaatcttctcccaagacgaactatgactctgacttactatgacggcatttcccgatacatggagggccaagtgctgcatcttcagaagcagattaaagaacagtctgagaatgcccaggcatctggcgaagagctcctgaagaatttagaaaatctcgtcgctcaaaacacaaccgggcctgtgttctgccccaggctctatcacttgatggcctacgtatgtatcctgatgggcgatggtcagaagtgcggattattcttgaatactgctctgcgcctcagcgagacccagggtaatatcctcgaaaagtgctggctgaatatgaacaaagagtcgtggtacagcacgtccgagctcaaggaggaccaatggctgcagaccattctatctttaccgtcatgggagaagattgtggctgggagagtgaatatacaggatctccagaaaaacaagtttctcatgcgcgcaaacaccgtggacaatcacttctag

SEQ ID NO: 48216 - DNA, 4374 bp, Artificial Sequence
  Description of Artificial Sequence: Synthetic coding sequence
atgctggtgttcggagacgaaacacattcacacttcctcgtaattggacaggctgttgatgatgttcgcctggctcaaaacatggctcagatgaatgacgtcatcctatctcccaactgctggcagctgtgcgacagaagtatgatagagatcgagtccgttcccgaccagcgcgcagtcaaggttaattttctaaaaccgcctcctaacttcaatttcgacgagttcttcaccaagtgtacaacttttatgcattactaccctagcggagaacataagaacctgctgcgactggcttgtaccctgaagcctgacccagagttagagatgtcattgcagaagtatgttatggagagcattctgaagcaaatcgataataaacagctgcagggttacctttccgagctgcgtcctgtgacaatagtttttgtaaatcttatgttcgaggaccaggataaggccgaggagatcggccctgcaatacaggacgcctacatgcatataacttcagtcctgaagatcttccaggggcagatcaataaagtattcatgttcgataagggttgttcttttctctgcgtgtttggattccctggcgagaaggttcctgatgagcttacccatgcacttgagtgtgccatggatatctttgacttttgtagccaggtgcataaaattcagacggtgtctatcggagtggccagcgggattgtgttctgcggaatagtcggccatactgtgcggcacgagtacactgtcatcggccagaaagttaacctggccgctcgaatgatgatgtattaccctgggattgtaacttgcgatagcgtgacctataacggctctaacctgccagcgtacttctttaaggagctcccgaaaaaagtcatgaagggcgtggcagactccggtccgctgtaccagtactggggccgtaccgaaaaggtgatgttcgggatggcttgcctcatatgcaatcgcaaggaggactacccactgttgggtcgtaacaaagaaatcaattattttatgtacaccatgaaaaaatttctcatctcaaatagctcccaggttctgatgtacgagggcttgcctggatacgggaaaagtcagatattaatgaagattgaataccttgcccaggggaagaatcaccgaattatagcaatctccctgaataaaatctccttccatcagactttttacaccatacagatgttcatggctaatgtgctgggactggacacatgcaaacattataaggaacggcaaaccaatctgcgcaataaggtgatgactctgctcgatgaaaagttttattgcttattaaacgatattttccatgttcagttcccaatctcacgtgagataagcagaatgagcactcttaaaaaacagaaacagctggagatcctctttatgaagatactcaagcttatcgtgaaagaagaaagaattatcttcattatcgatgaagcccagttcgtggatagtacaagctggcgatttatggagaaattgatccgcactcttccgattttcatcataatgagcctgtgcccctttgttaacattccctgtgccgctgctagagccgtaatcaaaaatcggaatacaacgtatatagtaattggcgctgtgcagcccaacgacatatcaaacaaaatctgtctcgacctcaacgtgtcttgtatctcaaaggaactcgacagttacctgggggaaggcagctgcggcatccctttttactgtgaggaattactgaagaatcttgaacatcatgaggtattggtgttccagcagactgagtctgaggaaaaaactaatagaacctggaacaatctgttcaaatattccattaaactcacagaaaaactcaacatggtgacactgcactccgataaagaatcggaggaggtatgtcacctgacttccggggtgagactgaaaaacttgagtccgcctacatcattgaaggaaataagcctcatccagctggacagcatgcggctctctcaccagatgcttgttcgctgcgcggctatcatcggccttaccttcacaactgagctcctttttgaaatattgccttgttggaacatgaagatgatgattaaaactctcgcaaccctggtcgagtcaaacatcttctactgcttccgcaacggaaaagaactacaaaaagctttaaagcagaatgacccttccttcgaagttcactatcgatcactgagccttaagccttcagagggcatggaccatggagaggaggaacagcttagagagctggaaaatgaggtcattgagtgccatagaattcgattctgcaacccaatgatgcagaagaccgcctatgagttgtggctgaaagaccagagaaaggcaatgcaccttaaatgcgctaggttcctcgaagaggacgctcacaggtgcgaccactgcaggggacgagacttcataccctaccatcactttacagtgaacatacgcctgaacgctctggatatggacgcaattaaaaagatggccatgtcccatggctttaagacagaggaaaaacttattttatcaaactcagaaattccagagaccagcgccttcttccctgaaaatcgctctcccgaagaaattagggaaaagattctaaacttctttgatcacgtcctgacaaaaatgaagaccagcgatgaggacataattccactggaatcatgtcagtgtgaagagattctggagattgtcattctgcctctcgcccaccacttcctggctctcggcgaaaatgataaggcgctctactatttcctagagatcgcgtccgcctatctaatcttttgcgataactacatggcttacatgtatctgaacgagggccagaagctattgaaaaccctcaagaaagataagagttggtcacagacgtttgaatcagcgaccttttattccttgaaaggagaggtttgttttaatatgggacaaatagtgctggctaagaagatgctgagaaaagctctcaaattacttaacagaattttcccttacaacctcatatctctctttcttcacatccacgttgagaagaaccgacatttccactatgtgaatcgccaggcacaggaatcgccaccccctgggaagaaacgactggcccagctttacaggcagaccgtttgtctttcactgctgtggaggatctactcctactcctatctgttccactgcaagtactacgcacatcttgctgttatgatgcaaatgaacaccgctctcgagacccagaattgtttccagatcatcaaggcctatcttgactattcactgtaccatcacttggccggttacaagggagtttggttcaaatacgaggtgatggccatggaacacatcttcaaccttcccttgaagggagaaggaattgaaatcgtggcttacgttgctgagacactggtctttaataaactcatcatgggccacctagatttggccatcgaactgggaagccgggctctccagatgtgggccttgctacagaatccgaacaggcattaccagagcttatgccggctttcccggtgcctgttacttaactcaaggtacccacaattaattcaggtcctcggacgcctttgggagctgtcagtgacgcaggagcacatattttccaaagccttcttctatttcgtctgtctggacatcctgctgtactccgggtttgtctaccggacctttgaagagtgtctggagtttattcaccagtatgagaacaatcgaattctgaaattccactctgggttgctgctcgggctatattcttcagtggctatttggtacgcgcgtttgcaggaatgggataatttttacaaattttcaaatagagccaaaaacctcttgccaagaagaactatgactctgacttattacgacggcatttccagatatatggaggggcaggttcttcacctgcagaagcagatcaaagagcagagcgagaatgcgcaagcgtctggggaggagttgttaaagaatcttgaaaatctagtggctcagaacaccacgggtccagtcttttgccctcggctctaccaccttatggcctatgtgtgtatcctgatgggggatggacagaaatgcggcctgttcctaaatactgctctgcgcctgagcgaaacacagggcaacatcctggaaaagtgttggctgaacatgaataaagaatcctggtactccactagcgaacttaaggaggatcagtggctgcagacgatacttagtctccccagttgggaaaaaattgtcgccggaagggtgaatatccaggacctgcagaaaaataagttcttaatgcgggctaataccgtggacaaccatttttag

SEQ ID NO: 48217 - DNA, 672 bp, Artificial Sequence
  Description of Artificial Sequence: Synthetic coding sequence
atggctagtaaattgcttagagccgtgatcctggggcctccgggttcgggtaagggaacggtgtgtcagcggatcgcacagaactttggattacagcacctgtctagtggacactttttacgagagaatataaaggcatccaccgaagttggggagatggctaaacagtatatagagaagagtctgctggtccctgaccatgtgataacccgccttatgatgagtgagttggaaaatcgcaggggacagcactggctcctggatggatttccgagaacccttgggcaggccgaagccttggataaaatctgcgaagttgatctggtaatttcattgaatatcccattcgagaccctgaaggatcgcctgtctcgacgctggattcatcccccaagtggcagagtatacaacctggattttaaccctcctcatgtccacggaatcgacgacgtgaccggagagcctctagttcagcaggaagatgataagcctgaggcagtggcggcaaggctccggcagtacaaggacgttgcaaagccagtaatcgagctctacaagagtcggggagttttgcaccagttttccgggacagaaacgaacaaaatctggccttatgtctacacactattctccaataaaattacgcccatccagtcaaaggaggcctactag

SEQ ID NO: 48218 - DNA, 672 bp, Artificial Sequence
  Description of Artificial Sequence: Synthetic coding sequence
atggccagtaaactgctgcgagccgtgattctagggcctccaggatccggaaaaggcactgtgtgccagagaatagcccaaaacttcggactgcagcacctttccagcggacattttctgcgtgagaatataaaagcaagtacggaagtgggggaaatggcaaagcaatacattgaaaagagtctcctggttcccgaccatgtgattacacggttgatgatgtccgaactcgagaatcgccgaggccagcactggttgctggacggcttccccaggactctggggcaagccgaggccctagataaaatatgtgaagtcgacttggtcattagcctaaatattccgttcgagaccctgaaggacagactgagcaggcgatggatacaccccccaagcggcagagtgtacaacctggattttaacccaccacacgtgcatgggatcgacgacgttactggtgagccactggtgcagcaggaggacgataaaccggaggctgtggccgctcgcctgcgccaatacaaagatgtggccaagcccgtgattgagctgtacaaatcaagaggggtgctgcatcagttttcaggtaccgaaacaaacaaaatctggccttacgtttacacactgttctccaacaaaatcacgcccattcagtccaaagaagcatactag

SEQ ID NO: 48219 - DNA, 672 bp, Artificial Sequence
  Description of Artificial Sequence: Synthetic coding sequence
atggcctcaaagctgttgcgggctgtgatcctgggcccacctggttcaggtaagggcacagtgtgtcagagaatagcacaaaacttcggtcttcaacatttgagcagcggccatttccttagggaaaacatcaaggcttcgaccgaggtcggagagatggcaaaacaatatattgagaaatccttgctcgtgcctgaccatgtgatcactcggctcatgatgtcggagctcgagaaccgcagaggtcaacactggttattagacggatttccacggactttggggcaggctgaggccttggataagatttgcgaggtcgatcttgtgatttcacttaatatccccttcgagacactcaaagacaggctgagcaggaggtggattcaccccccatcagggagggtctacaatctggactttaaccctcctcacgtccatggcattgatgatgttactggcgagcccttggtccagcaggaggatgataagccagaagcagtcgctgcacggctgcggcaatacaaagatgtcgctaagccagtcatagagctttataaatcccgcggagtgctacatcagttctcaggtactgaaaccaacaagatttggccctatgtgtacaccctgttctcaaataaaatcacccctatccagtccaaagaggcttattag

SEQ ID NO: 48220 - DNA, 1482 bp, Artificial Sequence
  Description of Artificial Sequence: Synthetic coding sequence
atgcatccacaccgcgacccccgaggcctgtggctgctgctcccctccctgagtttgctcttatttgaagtggctcgggctggtcgggctgtggtgtcctgccctgccgcttgcctttgtgcgtctaacatactgtcctgctcgaagcaacaactccccaacgtgccacatagcctgcctagttacacggccctgttggaccttagccacaacaatctgtcccggcttagagcggagtggacaccaaccaggctgacacaattacattctcttttgcttagccataaccacctcaactttatatcctctgaagcattcagcccagtgcccaaccttcgctatttagatcttagcagtaaccagctgaggaccctcgacgaatttctgttctctgacttacaggtcttggaggtgttgttgctatataacaatcacattatggcggttgataggtgcgcgtttgacgacatggctcaactgcagaagctgtacttgtctcagaaccagatctcaaggtttccactggagcttgtgaaggagggagctaagctaccaaagcttaccttgctcgacttatcatctaacaagctgaagaacctcccactccctgacctccagaagttacccgcatggatcaaaaatggcctgtatttgcataacaatcccctgaactgtgactgcgaattgtatcagctgttttcacactggcagtacagacagttgtcatccgtgatggacttccaggaagacctctattgcatgaactctaagaaactccataatgtgttcaatctctcgtttctcaactgcggcgagtacaaggagcgggcttgggaagcacacctgggagatacactgattattaaatgtgacacaaagcagcagggaatgacgaaggtctgggtcaccccgtccaacgagcgcgtcctcgatgaggtgacgaatgggaccgtctctgtgagtaaagatgggtctctcctctttcaacaggttcaagtcgaggatggtggcgtgtatacttgctatgccatgggtgaaacattcaacgagaccctaagcgtggagctgaaagtccacaattttacattacatggacaccacgacacccttaacactgcatatacgacactagttgggtgcattctcagcgtagtactcgttctgatctacctctacttgaccccctgcagatgttggtgccgtggcgtggagaagccaagctcacaccagggtgatagtttaagctcttctatgctgagtaccacaccgaatcacgacccgatggcgggtggtgataaagacgacgggttcgatcggagggtggccttcttggagcccgcaggccctggccagggccaaaacggaaaattgaaaccgggtaatacgttgccagtccccgaggccacgggtaagggacagaggcgaatgtctgatccagaatccgtgtcatctgtgttttctgacactccgattgtggtatag

SEQ ID NO: 48221 - DNA, 1482 bp, Artificial Sequence
  Description of Artificial Sequence: Synthetic coding sequence
atgcacccccatagagatccacggggactgtggctcctgcttccatcacttagccttctgctgtttgaggtcgcaagagctgggagagctgtggtttcatgccccgcagcatgcctttgcgcaagcaatatactgtcttgtagtaagcagcagctgcctaacgttccgcatagtctgccctcttacaccgcactgttggacctgtcccacaataacctgtcaaggctgagagccgagtggacacctacacggctcacccagctccattccttgctccttagtcacaaccatttaaatttcatctcaagcgaagccttctctccggtgccaaaccttaggtacctggatctgtcttccaatcaattgagaactctggacgaattcctgttttcggacttacaggttctggaggtgctgctattgtacaataatcacataatggccgtggaccgatgcgccttcgatgatatggcacaactgcagaagctttacctgtcccaaaaccagatctctaggtttccacttgagttggtgaaagaaggcgctaagctgccaaaactgactctgctcgatctctcttctaataagttaaaaaatcttcctctacccgacttgcagaaacttccagcctggattaagaacggcttgtatttgcacaataatcccctcaattgcgattgtgagctgtatcagctgttttcacactggcagtatcgtcaactgagttccgtgatggatttccaggaagatttgtactgtatgaacagcaaaaaacttcataatgtttttaatctgagttttcttaactgtggtgagtacaaggagagagcttgggaggcacatctcggcgacaccctgatcatcaaatgcgacactaagcagcagggcatgacgaaggtgtgggtgacaccttctaacgagcgcgtgctggacgaagtgaccaacggtacagtgtccgtatctaaagacggctctcttctcttccagcaagttcaagtggaggacggcggagtctatacctgctacgccatgggagaaacattcaatgagaccctgagtgtggagttgaaagtgcacaacttcaccctgcatgggcaccacgatacattaaacacagcttacactactctggtcggctgcattttgtcagtggtgctagtgctgatctatctgtatctgacaccttgccgatgctggtgtcggggagtggagaaacccagtagccaccagggcgactccctgtcatcctcaatgctatctaccacccccaatcatgaccctatggccggaggcgacaaagacgatggctttgaccgccgtgttgcttttctggagcccgcaggtcccggtcaaggccagaatggcaaacttaaacccggaaacaccctcccagtgccggaggccacgggaaaaggccagagaagaatgagtgacccagaaagcgttagttctgtgttcagcgatactccgatcgtcgtctag

SEQ ID NO: 48222 - DNA, 1569 bp, Artificial Sequence
  Description of Artificial Sequence: Synthetic coding sequence
atgagcctccgcgttcacacgctcccaacattgctcggggctgtggtgagacctggctgccgggaacttttatgtctgttgatgatcactgtgacggttggaccaggcgcatcaggagtctgtcccaccgcctgtatttgcgccaccgatatcgtgagttgtaccaataaaaatctttccaaggtgcctggcaatctgttccggcttattaagagactcgacctttcgtataatcgtataggccttctagattccgagtggattcctgtctcgtttgctaaactgaacaccctcatcctacgccacaataacataacttcaatttccactggctccttctcaacaacccctaaccttaaatgccttgacctaagctccaacaaactcaaaaccgtgaagaatgcggtgtttcaggagctgaaagtccttgaagtgctgctgctgtataacaatcacatcagctacctcgacccttccgcctttgggggtctgtctcaattgcagaagctgtatctatcagggaatttcctaactcagtttcccatggacttatacgtgggcagatttaaactggccgaactgatgtttttagatgtatcttacaatcggatacctagtatgccaatgcaccatatcaaccttgtgcctgggaagcagctgagaggaatctacttacatggaaaccccttcgtttgcgattgctctctctactcgctcctggtcttctggtaccgcagacactttagctcagtcatggactttaaaaatgattacacctgtcgtctgtggagcgatagccgtcattcccgtcaggtgctgcttctgcaggactcctttatgaattgtagcgactcgattatcaatggctccttccgggctttgggcttcatacatgaagcacaggtgggtgagcgccttatggttcattgcgactccaaaactggaaacgcgaacaccgactttatttgggtgggtccagacaatcggctgctggagcccgacaaagagatggagaatttttacgtgttccataacggtagtctcgtcatcgaaagtccccgtttcgaagacgccggtgtttatagctgcatcgccatgaataagcagagattgctcaacgagaccgtggatgtcaccatcaatgtgtctaacttcacagtgagtcgctctcacgcccatgaagcattcaacaccgccttcacaacgctagccgcttgcgtagccagtattgttcttgtgctgctgtatctttacctgaccccctgcccttgtaaatgcaagacgaaaaggcagaagaacatgctgcaccagagcaacgcccacagttctatcctgtctcccggaccagccagcgacgcttccgccgacgaacgtaaggccggagctggcaaacgcgttgttttcctggaaccactaaaagacacggcggctgggcagaacggcaaggttcggttgtttcctagcgaagccgtcatcgccgagggcatccttaagtccactcggggaaagtctgactccgattccgtgaattccgtgttctcggacacccccttcgttgccagtacttag

SEQ ID NO: 48223 - DNA, 1569 bp, Artificial Sequence
  Description of Artificial Sequence: Synthetic coding sequence
atgtctctgcgcgtgcacaccctgccaacactcctgggcgcagtggttcggcctggttgccgggaactgctgtgcctcctgatgattaccgtgacagtgggcccaggggcaagcggcgtatgcccgacagcttgcatttgcgcgaccgacattgtctcctgcacgaacaaaaacctgagcaaagtacctgggaacctgttcaggctcataaagcggctggatttatcttacaataggatcggactccttgatagtgagtggatcccagtgagcttcgctaagcttaacacattgatcttaaggcataacaatataacaagcatttccactggctcatttagtaccacgccgaatcttaagtgtctggacctgagcagcaacaagctcaaaactgtcaagaacgccgtttttcaggagctgaaagtgctcgaggtgctgctcctatataacaatcacatcagctacttagacccatctgcatttggcggattatcgcagctccaaaaactctacctctctggtaatttccttacacaattcccaatggacttgtacgtcggtaggttcaaactcgcagagcttatgtttcttgacgtatcctacaaccggatcccctccatgcccatgcatcacattaatctcgtgcccggaaagcaactgaggggaatttatctgcacggcaaccccttcgtttgcgactgctcgctgtattcactgctggttttttggtaccgtagacacttctcaagtgtgatggatttcaagaatgattacacatgcaggctttggtcagatagccgacattcaagacaggtgctcttgctgcaggacagctttatgaattgttccgattctattatcaacgggagctttcgcgctctcgggttcattcacgaggcccaagtaggggaacggcttatggtgcattgtgattctaagactggaaacgcgaacactgacttcatctgggtgggacccgataaccggctgcttgagccagataaagagatggaaaacttctatgtctttcataacggcagtttggttatcgagagcccccgatttgaagacgctggtgtgtattcttgcatcgcaatgaataaacagcgcttgcttaacgagactgtggatgtgactattaatgtgtcaaattttacagtcagccgctctcacgcccacgaagccttcaacaccgcatttacgacccttgcggcttgtgtcgcgagtatagtgctggtgcttctgtacctgtacctgactccctgcccctgtaaatgcaagaccaagcgacagaaaaacatgctgcatcagagtaacgctcactcctctatcctgtctcccggaccagcatcagacgcaagtgccgacgaacggaaagcgggtgcaggcaagcgagtggtgttcttagagcccttgaaggacacggctgcgggacaaaatggcaaagtacgacttttcccaagtgaggcagttatcgccgaaggaatactaaagagtactcgtggcaagtcggattccgatagcgtgaactctgtcttcagcgacacaccattcgtggccagtacatag

SEQ ID NO: 48224 - DNA, 1569 bp, Artificial Sequence
  Description of Artificial Sequence: Synthetic coding sequence
atgagtctcagggtacatactctccctacccttctcggcgctgtcgtgcgccctggctgtagagaactgctctgccttctcatgattaccgtgactgtgggccctggcgcatcaggtgtgtgtccaacagcttgcatttgtgccaccgatatagtgagctgtaccaataaaaacttaagcaaggtacctggcaacctcttccgcttaatcaaacgattagaccttagctataaccggatcggcctgttggacagcgaatggattccagtctctttcgccaagctgaacactctgatactgcgacataacaacatcacctccatatctaccgggagcttttcaaccacacctaaccttaagtgtctggacctttcctctaataaactgaagaccgtcaagaacgcagtgttccaggagctgaaagtgttggaggtgttgctgctgtataataatcacattagctatctggatcccagtgcatttggaggcctgtctcagctgcagaaactgtacctttctggtaacttcctcacacagtttccgatggacctttatgtgggccgatttaaactggccgaactgatgttcctggatgtgtcctataaccgcataccttctatgcctatgcatcatataaacctcgttcccggaaaacaactgcggggaatctatctgcacggcaatcccttcgtgtgtgactgctccctctatagcctgctggtgttttggtatcggagacacttctcttcagtcatggacttcaagaatgattacacttgtagactctggtcagactcgcgccatagtcgtcaggtgctacttctgcaggattcatttatgaactgcagcgactcaattattaacggcagctttcgtgcactcgggtttatacacgaggcgcaagttggggagaggctgatggtccactgcgacagtaaaacaggaaatgctaacaccgattttatttgggtgggccctgacaaccgattgcttgagcctgacaaagaaatggaaaatttctacgtgtttcataacgggtctctggtcattgagagccctcgttttgaagacgctggcgtgtactcatgcatcgctatgaataaacagaggctcctcaacgagaccgtagacgtcacaatcaacgtcagcaactttaccgtcagtcggtctcacgcgcatgaggccttcaatactgcttttaccacactggctgcctgtgtggcttcaatagtgctggttttactctacctctacctcaccccgtgtccttgcaaatgtaagaccaaaaggcaaaagaatatgttacatcagtcaaatgcccactccagcatcctgtcccccggtcccgcatcagacgccagcgccgacgagcgaaaggctggcgctggcaagagagtggtcttccttgaacctctgaaggatactgctgccggacaaaacgggaaagtgaggctattcccgagtgaggccgtgatcgccgaaggtatcctcaagtccacccggggaaaaagcgactccgatagcgtgaattctgttttttccgacaccccatttgtcgccagtacctag

SEQ ID NO: 48225 - DNA, 1569 bp, Artificial Sequence
  Description of Artificial Sequence: Synthetic coding sequence
atgagcctgcgcgtacataccctgcctaccctcctgggagcagttgtgaggcccggttgcagggaactgctctgcttattgatgatcaccgtcaccgtgggcccaggagcatctggcgtctgccccacagcatgcatttgtgccacagatatcgtgtcatgtacaaacaaaaacttaagcaaggtgcctgggaacctgttcagactgataaagagacttgacttatcctacaacagaatcggtctgctggactctgagtggatcccggttagtttcgctaaactcaatactcttatattgagacacaataacatcacgtctatcagtaccgggtcattctcaaccacgcccaatcttaaatgtcttgacctgtcaagcaataaattgaaaactgtaaaaaacgctgtatttcaagaattgaaggtcttggaagtcctacttctgtacaataaccacatttcttacctcgaccctagcgcctttgggggactatctcaactgcagaaattatatctcagtgggaacttcttgacgcagttcccaatggacctctatgttggacggttcaaactagctgagctaatgttcctggacgtcagctataatagaatcccaagtatgcccatgcaccacatcaatctggtccctgggaagcaactacgtggcatctacctgcacgggaacccatttgtatgtgactgctccctctactcattgttggttttttggtacagaaggcactttagtagtgttatggactttaagaacgattacacatgccgcctctggtctgattcacgccattcacgtcaggttttactcctgcaagacagcttcatgaattgttctgactccataatcaacggtagcttccgtgccttggggtttatccacgaggcacaggttggtgagagactcatggttcactgcgatagtaaaacaggaaacgccaacacggactttatctgggtggggcctgataatcgccttttggaacctgataaagagatggagaatttttatgtctttcataacggtagtctggtcatcgagtcccctcggttcgaggatgccggtgtgtacagttgtatcgctatgaataagcagcggctcctgaatgaaacagtggatgttacgatcaatgtgtccaattttacagttagcaggtcacatgcacacgaggcatttaacactgcatttacaaccctcgctgcctgcgttgcctcgatcgtgctagtcctcctctacctgtacttaaccccctgcccgtgtaaatgcaagaccaagcggcaaaaaaatatgctacatcagagcaatgcgcattcctcgatcctttcaccaggcccagcctccgatgcaagcgccgacgagcggaaggcgggagctggcaagcgagttgtctttctagaaccactgaaagataccgcagcaggacagaatggcaaggttcgccttttcccaagtgaagccgttattgctgaaggcatcctgaagtccacaaggggcaagagcgattctgactctgtaaactctgtgttcagtgacacaccctttgtcgctagcacatag

SEQ ID NO: 48226 - DNA, 1515 bp, Artificial Sequence
  Description of Artificial Sequence: Synthetic coding sequence
atgacatggctggtgctgttagggacactactctgcatgcttagggtgggcctgggcactcccgactcagagggattcccgcctagggcgctgcacaactgcccatacaaatgcatatgtgcagctgacctcctgtcttgtaccggcctgggactgcaggacgttcctgcagaacttcccgcagccaccgccgacctcgacctgagccacaatgccctccagaggctgcgaccgggttggcttgcgcctctgttccagctgagggccctgcatctggaccataacgaactggatgccctcggccgaggggtcttcgtaaacgcctccggccttcgactacttgacctgtcttctaacaccctacgggcacttggaaggcacgaccttgacggacttggcgctcttgagaaactcctcctgtttaacaacagactggtacacttggacgaacacgctttccacgggttgagggctctcagccacttgtacctgggttgcaacgaacttgcctccttctccttcgaccacttgcacggcctgagtgctacgcacctgcttaccctcgatcttagttccaatcgattgggtcatatcagtgtaccagagctggcagccctgcccgcttttttgaagaatggattgtatttgcacaataatcctctaccctgcgactgtagactgtatcatttgctgcagagatggcatcagaggggcctttcagcagtgagagattttgccagggagtacgtctgccttgcttttaaggtccccgcatcaagagtgcgttttttccagcactccagggttttcgagaactgttcctcagcgcctgcgctaggcctcgaaaggcctgaagagcatctctacgctctggtcggccgatctctgcggctgtactgtaacacgtctgtgcctgctatgcggattgcatgggttagtcctcaacaagagctcctgagagcccctggatctagagacgggtccattgctgttctggcggatgggagtttagcaataggcaacgtccaggaacagcatgctgggttgtttgtgtgccttgccacaggtccgcgactccaccataaccagactcatgaatacaatgtgtccgtgcactttcctcgtcccgaaccagaggcattcaacaccggcttcacaactctccttgggtgcgcagtgggtctcgtcctggtactgctgtatctgttcgctccaccttgcaggtgttgccggagggcatgccgctgccggagatggccccagacaccaagccccctccaggagctgagtgcacagtcttcagtgttgtccactaccccccctgacgcaccctcaagaaaggcctccgtgcataaacatgtggtcttcctggaacctggcagaagaggcttgaacggcagagtgcaactggccgtcgcggaagaatttgatctgtacaacccaggcggactccagctgaaagctggatctgagagcgcaagtagcattggatccgaaggaccaatgacaacctag

SEQ ID NO: 48227 - DNA, 1515 bp, Artificial Sequence
  Description of Artificial Sequence: Synthetic coding sequence
atgacctggcttgtgctcttgggtactctgctctgtatgttaagagttgggctcggaacacctgactctgaagggtttccccctcgggcactgcataattgtccgtataaatgtatttgcgcagctgatttactgtcctgcacaggtctgggcttgcaggacgttcccgcagaattgcccgctgcaacggctgacctagatctgagccacaatgccctgcaaaggctgcggcctggctggctagctccgttatttcagcttagggcactgcacctggatcacaatgagttggacgcccttggcaggggtgtgtttgtgaatgcgtctggcctacgtttgttggatttgtccagcaacacactgcgggcactgggcaggcacgatctggatggccttggggctctcgagaagttactgctttttaataaccgcttggtgcacctagatgagcatgcattccacgggctgcgggctctgtcacacctatatcttggatgtaacgagctggcaagctttagtttcgatcacctacacgggttgagtgccacccatcttctaaccctcgatttgtcatccaataggctcggtcacatcagcgtgcccgagttggccgcactccccgcttttctgaagaacggactttacttacataataacccactgccctgtgattgcagactctaccacctcctgcagcggtggcaccagcggggacttagcgctgtcagggactttgcacgggaatatgtctgcctggctttcaaggtgcctgcctcccgggttcggttttttcagcacagtcgggtcttcgagaactgcagtagcgcccctgctttgggtttggagcggcctgaggagcatttgtatgctctcgtgggcaggagtctgcgactgtactgcaacacttcagttccagctatgagaatcgcttgggtgtcccctcagcaggaactgcttcgcgctcccggatcacgcgacggatccatagcagttctggctgacggctcacttgcgatcggaaacgtccaggagcagcacgcgggactgtttgtgtgcttagccaccggaccacgcctgcaccataatcagactcacgagtacaatgtcagtgtccatttccctcgtccagaacctgaagccttcaatactggattcacaacattgctgggctgcgccgttggcttggtgttagtactgctctatctttttgccccaccatgcaggtgctgccggagagcttgccgctgcagaagatggcctcagaccccatcccccttacaagaactatctgctcagtcgagtgtactctcgaccacaccacctgatgccccttcaagaaaggctagcgtccacaaacacgtggtgttccttgagccagggaggagaggattaaatggaagggttcaactagccgtagctgaggaattcgatctctacaatcctggcggacttcagttgaaggctggaagtgaatccgcttccagtatcggaagcgaagggccaatgaccacttag

SEQ ID NO: 48228 - DNA, 1224 bp, Artificial Sequence
  Description of Artificial Sequence: Synthetic coding sequence
atgaccacgagcggagcactttttccttcccttgtgcccggatctcgcggagcaagtaacaagtaccttgttgaattcagggcaggtaaaatgtccctgaaaggcaccacagtgacaccggataaacggaagggacttgtgtacatccagcaaaccgacgattccctgattcacttctgttggaaagaccgcacaagcggcaatgtcgaagatgacctgatcatatttccagatgactgcgaatttaaacgtgtaccacagtgtcccagtgggagagtgtacgttttaaaatttaaggccggaagcaaaagactatttttctggatgcaagaaccgaaaaccgaccaggatgaggagcattgccggaaggttaatgagtacctgaacaacccccctatgccgggagcccttggagcctcaggatcttccggccatgaactttccgccctagggggagagggaggactacagtctctactaggcaacatgtcacattcccagctcatgcagttaatcggtccggcaggtcttggtggtctcggcggactgggggctctcactggcccaggattggcaagtcttctgggcagttctgggccacctggcagctcgagctcatcctcatcccggagtcagtctgcagctgttaccccctcctctacaactagctcaacaagggccacacccgctccatctgctccagctgcagcttccgccacatccccctcccctgcccctagttccggtaacggcgcttccactgctgcctcccctacacagccaatccagttatccgatcttcagagcattctagctaccatgaacgtccccgcaggtcctgccggaggccagcaggtggacttggcgagcgtgctgacaccagagatcatggctcccatcctcgccaatgcagacgtccaagagaggctgctcccttacttacctagcggcgaatccctgcctcagactgccgatgagatacagaataccctcacctctccccagttccagcaggccctgggcatgttctctgcagccctggcttccggacagctcggcccactgatgtgtcagtttggcttacctgccgaggccgttgaggcagccaataaaggtgacgttgaagcattcgccaaggccatgcagaacaatgctaaaccagagcagaaagagggtgataccaaggacaagaaggatgaggaagaagatatgtcccttgactag

SEQ ID NO: 48229 - DNA, 954 bp, Artificial Sequence
  Description of Artificial Sequence: Synthetic coding sequence
atgacaactagcggcgctttgttcccttctttggtccccggtagccgaggcgcaagtaacaaatatctggttgagtttcgcgctggtaaaatgtccctcaagggaactaccgtgacccccgacaaacggaaaggactcgtctacatccagcaaaccgatgattctttgattcacttctgttggaaagacaggactagcggcaatgtggaagacgacctgatcattttcccagacgactgtgaatttaagcgcgtgcctcagtgtccttccggcagggtatatgtgttaaagtttaaggcgggatctaagcgcctgttcttctggatgcaggaaccaaaaactgaccaagacgaagaacattgtagaaaagtcaacgagtatttgaacaatccacctatgcccggtgctctgggcgcttccggttcatctggacatgaactttccgcccttggggcaggaggccttggagctctgacggggccaggattagcctccctactggggtcaagcggaccccctgggagctcctcgagtagcagtggtgcgctgtcactgcgctcttccaggtcacagtcagccgcagtgactcctagtagcaccacatcctcaacgagggccacccccgcaccctcagctcccgctgctgcatctgccacctcaccctcgcccgcaccgtcctcggggaacggagcttccactgcggctagtcccactcagccaatccagcttagcgatctgcagtctatcctggccacaatgaatgttccagccggacctgccggagggcaacaggtggatctcgcctccgtacttacccctgaaattatggccccaatccttgcaaatgccgacgtgcaagagcgcctgttaccatatttacccagcggagaaagcctgccacagacagccgatgaaatccagaatacactcacaagccctcagtttcagcagtag

SEQ ID NO: 48230 - DNA, 243 bp, Artificial Sequence
  Description of Artificial Sequence: Synthetic coding sequence
atgaagtatcccttaatgccacttgtcaacgatctgactttcagcttcctggtgttctggttctgccttccggtggggctgcttctgctgctcatcatctggctcagattcctcctctcccaggatagtgaagaaaatgacagctcagtgtgcttagactgggagccctggtccaaaggcccagctgaattctgttggaaaggtacactgcacggtcaggagaaagagcgcccatgttggtag

SEQ ID NO: 48231 - DNA, 579 bp, Artificial Sequence
  Description of Artificial Sequence: Synthetic coding sequence
atgcctctcgtaaacgatctcaccttctcttttctcgtcttttggttttgcttgcctgttggactcctgctgctgctgatcatttggcttcgcttcctgctctctcaggattccgaagagaacgattcaagtgtgtgcttagattgggagccctggtcaaagggacccgctgagttttgctggaaggggaccctgcacggacaggagaaggaaaggccctgttgcctggttttcttagagtcagctggacagtggcaatggcagaagtggatgggagagacttgccagggcggaaaacgaaccctcgctacagtagtcccaccctggaacccccaactgatctcttcgagtgacagacatgtcaaagcctctcgcggtccaagtcccagccctgcctcacagatgacaagcagccctgcaggttctaggtcctctttgggtggacacggaagcagcgagcaggcccacggagagaagctcgccaacctcattcagagaggtttaaaggctggtctgggacgccgagtatgggtacacatcaaagaggccagggtcttcccataccctggggatccctag

SEQ ID NO: 48232 - DNA, 1026 bp, Artificial Sequence
  Description of Artificial Sequence: Synthetic coding sequence
atgaccgacggcatcctcggaaaggcagcgacaatggagattcctattcatggaaatggcgaggcgagacagctacctgaagacgacggtctggagcaggatctgcagcaggtgatggtatctggtccaaacctgaatgaaaccagtattgtgtccggcggatatggtggaagcggcgatggactgatccccactggctcaggcagacatcctagccatagtacaactccgagcggccctggggacgaggtcgcccgtggcatcgcaggcgaaaaattcgacattgtgaaaaaatgggggataaacacatataagtgtacaaagcagctgttgtccgagagattcgggaggggctcccgcaccgtcgatctcgaacttgaactacagatcgaattactgagagaaacaaaacggaagtacgagtcagtgctacagctcggtcgcgcactaacagcacacctgtactccctgttacagacccagcacgcactcggggacgcgttcgctgacctgtctcagaagtcccctgagcttcaggaggaattcggctataatgccgagacacagaagcttctgtgcaagaatggcgagacactcctcggagccgtcaacttctttgtgagttctatcaatacgctggtgactaagactatggaagataccctgatgactgtgaagcagtacgaggctgcacgtctggagtacgatgcgtatagaacggacctcgaagaactgagtctgggcccaagggatgctggtacgagaggcagattagagtccgcccaggccactttccaggcacatcgggacaagtatgagaaattgcggggtgatgttgcaattaaactgaagttcctagaggagaacaagataaaggtgatgcataaacaattactcttgttccataacgctgtttcagcttacttcgccggaaatcagaagcagctggaacagacactgcagcagttcaatattaagctcaggccaccaggcgctgaaaagccatcttggttggaagagcagtag

SEQ ID NO: 48233 - DNA, 1026 bp, Artificial Sequence
  Description of Artificial Sequence: Synthetic coding sequence
atgacagacggaatcctgggcaaggcagctacaatggaaatcccgatccatggtaatggagaggctcggcaactgcccgaagatgatggtctcgagcaggacttgcagcaggtgatggtgtctgggccaaatctcaatgaaacctctattgtgagtggcggttatggagggagcggcgacggactcattcccactggatccggccgacatcccagtcatagcaccacaccgtcgggccctggggacgaagtagccagggggatagcaggtgaaaagttcgacattgttaagaagtggggaatcaacacgtataagtgcacaaagcaacttctgagcgagcggttcggacggggttcgagaaccgtcgacctggaactggaactccagatcgagcttctgcgtgagactaagcggaaatacgagtcggtgctgcaactgggcagggcactgactgctcatctatacagtctccttcagacccaacacgcactgggtgatgcattcgccgatttgtcccaaaaaagccctgaacttcaggaggagttcgggtacaacgctgaaacccagaaactgctctgtaagaatggggagactctgctgggggcagtcaacttttttgtatcaagtattaacaccctggtgacaaagactatggaggacacactcatgacagtcaaacaatatgaagcagccaggctggagtatgacgcatataggaccgacctggaggaactatccctagggccacgcgacgccggaacgaggggcaggctcgagtcagctcaggccacctttcaggcccatcgcgataagtacgaaaagctgcgcggagacgtggccatcaagttaaagttccttgaggaaaacaagatcaaagttatgcacaagcagctgttattgtttcataatgccgtctccgcctattttgctgggaatcagaagcagctcgagcagactctacagcaattcaacataaaactgaggcctcccggagccgaaaaacccagctggctcgaagagcagtag

SEQ ID NO: 48234 - DNA, 912 bp, Artificial Sequence
  Description of Artificial Sequence: Synthetic coding sequence
atggtcagtgggccaaacctgaatgagacatcaatcgtgtctggcggttacggcggttcaggggatggtctgatacctaccggctcaggtaggcatcccagccattctaccactcccagcgggcctggcgatgaggttgccagaggcatcgctggtgagaaatttgatatagtgaaaaagtggggcataaacacctataagtgcacaaaacaacttctctccgagcggttcggtcgcggtagtcggacagtggatttagagcttgaactgcaaattgagctgcttcgtgaaaccaagcggaaatacgaaagtgtactccaacttgggcgagcacttacagcgcacctctattctctgctgcagactcaacacgctctcggtgacgccttcgctgatctgagtcagaaatcaccagagttgcaagaggaattcggatataacgccgagactcagaagctgctttgcaaaaatggggaaacattgttgggagctgttaactttttcgtctcctccattaacacgttggtgaccaagactatggaggacaccctaatgacggtcaaacagtatgaagctgccaggctggaatacgatgcataccgtacagacctcgaggaactgagcctgggccctcgggatgcgggtactaggggtcgattagagtctgcccaagctacattccaagcccatcgcgacaagtatgaaaagttgcgcggagatgtggctatcaagctgaaattcctagaggaaaacaaaatcaaagtgatgcataagcagctgctgctattccataatgccgtgtctgcatacttcgctgggaatcagaaacaacttgagcagactctgcagcagtttaatattaaattgagacctcctggagcggaaaaaccaagttggcttgaagagcagtag

SEQ ID NO: 48235 - DNA, 771 bp, Artificial Sequence
  Description of Artificial Sequence: Synthetic coding sequence
atgaaacctgcactttgtctggttgcaatgggtgctctggtcatggattcgtcacctcagtgtactaagcagctgctctccgaaagattcggccgtggtagcagaacagtggatctggaactggaacttcagatagagttgctgcgtgaaaccaaaagaaagtatgagagcgtgctccaactagggagggctttaaccgcacatttatatagcctcctgcagacccagcatgccctgggagatgcttttgcagacctatctcaaaaaagccctgagctgcaggaagagtttggctataacgctgagacccaaaagctgctatgcaaaaatggggaaactttactgggcgcagttaacttcttcgtttcctcgatcaatactctggtaaccaagactatggaggacactctgatgactgttaaacagtatgaggcagccagactggaatacgacgcatatcggacagatctggaggagctctccttagggcctcgagatgctggtactaggggcagattagaaagcgcccaggccacgtttcaggcccatcgggacaagtacgagaaactaaggggcgacgtagccattaaactgaagttcctggaggaaaacaagataaaagtcatgcacaagcagcttctgctgtttcacaatgccgtcagcgcctattttgcaggaaaccagaagcagctggaacagaccctgcagcagtttaacataaaactgaggccccctggagccgaaaagcctagctggctggaagagcagtag

SEQ ID NO: 48236 - DNA, 378 bp, Artificial Sequence
  Description of Artificial Sequence: Synthetic coding sequence
atgggcaacatctttgagaagttgttcaagtctttgttagggaagaaaaagatgcgcattttaatcttaagcctggacaccgcagggaagactacaatactctacaaactaaagctcggtgaaacggtgcctgctgtgccaaccgttgggttctgcgtggagacagtggagtacaaaaataatacattcgccgtgtgggatgtcggatcccacttcaagattaggccattgtggcagcactttttccagaacacgaaagagctgtctgcgagccagttcgcgcagttcatcaagaaactatgtggtgtgactggcactaacgacgaagcatcgcccggaagtcttacctcttatccttctcacctgctggatagatag

SEQ ID NO: 48237 - DNA, 534 bp, Artificial Sequence
  Description of Artificial Sequence: Synthetic coding sequence
atgggtaacatctttgagaaacttttcaagtccctccttggtaaaaagaaaatgcgaatactcatcctttctctggacaccgccggtaaaaccactatcctgtacaagctcaaactgggcgagaccgtaccggcagttcctacagtcggtttctgtgttgaaacagtagaatacaagaataacacattcgctgtgtgggacgtcgggtctcactttaagatccgcccactatggcagcacttcttccagaatactaaaggtgcacgcagccctggatctacgcaccaggggtctctggcctctggtgtactcccaatcaaatgcagtcacgtcgagttcggtatgtggaaggggggacgctctcatccgttcctaccccacagttcacggtgtgccggatcaggaggtcaacttgatagtatcctgccccaccaatcccccgcttgggggccatggggctgtaaagatctctcgtccggctttcctagtttcttaacatccagcattctttggaagtccgccgtggtcaaatag

SEQ ID NO: 48238 - DNA, 612 bp, Artificial Sequence
  Description of Artificial Sequence: Synthetic coding sequence
atgggtaatatctttgagaaattgttcaagtctttgctgggaaagaagaaaatgaggatcctcatcctttctttggatacagccggaaagaccacaatcctgtacaagttgaagttgggtgagacagtgcctgccgtcccaaccgtcgggttttgcgtcgaaacagtggagtacaaaaataacacgttcgccgtgtgggacgtgggttcgcatttcaagatccgccctctctggcagcatttcttccaaaacaccaagggagcaaggtcccccggatccactcaccagggctcactggcttcaggtgttctcccaatcaagtgttcacatgttgagttcggaatgtggaaaggcggtcggagccatccatttcttcctcatagctcgaggtgtgccggatccggtggacagttggattccatcctcccgcatcagagtcctgcgtgggggccatggggctgcaaagacctgtcttctggctttccaagctttttgactagttctatcctttggaaatccgcagtcagttatcagctgccctcacttcacaattcatcgcggaattacgctggcagtccagcccaaatgatgcggcacctgctcgaagcctag

SEQ ID NO: 48239 - DNA, 393 bp, Artificial Sequence
  Description of Artificial Sequence: Synthetic coding sequence
ggcgcacggagtcccggtagtactcaccagggtagcctggcctctggtgtgctaccaattaagtgctctcatgtggaattcgggatgtggaaggggggacgatcacaccctttcctcccgcatagtagtcggtgtgctgggagcggaggtcagttagatagtatcttaccccatcagtcacccgcttggggcccttggggctgcaaagatctcagctccggcttccctagctttctcacaagcagcatcctttggaaatccgctgttgtgagagagccgcatatcagccctcatcaggcaccaccatacaaaacttcagattgcattaccgcaatatcctttccagtctgtactatccatcaggagattatgcggggacacaggcacaaatag

SEQ ID NO: 48240 - DNA, 378 bp, Artificial Sequence
  Description of Artificial Sequence: Synthetic coding sequence
atggggaatatcttcgaaaaactgttcaagtctctcctgggcaagaaaaagatgagaatcctcatactttctctcgataccgctgggaagacaaccattctgtacaagctaaaacttggggagaccgtcccagcagtccctaccgtgggtttctgtgtggaaactgtggagtataagaacaatacattcgcagtgtgggacgttggaagtcacttcaagatccgaccactgtggcagcacttcttccagaacacaaaggagctcagcgcaagccaatttgcgcaattcatcaaaaaactctgcggggtgactggaaccaacgatgaagcctcccccggtagcctgaccagttatccctcgcaccttctggaccggtag

SEQ ID NO: 48241 - DNA, 378 bp, Artificial Sequence
  Description of Artificial Sequence: Synthetic coding sequence
atgggcaatattttcgagaagctgtttaagtcactgcttgggaagaaaaaaatgcggattctcattctgtctctggatacggccggaaaaacaacaatcttatataagcttaagctgggagagaccgtccccgcagtgcctaccgtcggcttctgcgtagagactgtggagtacaaaaataatacatttgcagtttgggacgtcggatctcattttaagatccgcccattgtggcagcacttttttcagaacaccaaggaattatccgccagtcagttcgcccagtttattaagaagttgtgcggcgtcacgggaacaaatgatgaagcctcaccgggatcacttacctcctatcccagccatctgttggaccgctag

SEQ ID NO: 48242 - DNA, 393 bp, Artificial Sequence
  Description of Artificial Sequence: Synthetic coding sequence
ggggctcggtccccgggaagtacccaccaggggagtctcgctagtggagtgctccccatcaagtgctcgcacgtcgagtttggaatgtggaagggaggaaggtcacatccgttcctgcctcacagctctcggtgcgcagggtctggtggacaactcgactccatcctcccacaccagtcccctgcctggggcccttggggatgcaaggacttatcatctggattcccatcatttctgacctcttctattctgtggaaatcggccgtggtacgcgaaccccatatttctcctcaccaggcccctccgtataaaactagtgattgcataaccgcaatatcctttccggtttgtaccatccatcaggagatcatgcgtggacactggcacaaatag

SEQ ID NO: 48243 - DNA, 534 bp, Artificial Sequence
  Description of Artificial Sequence: Synthetic coding sequence
atgggaaatatcttcgaaaaactcttcaagtcactgctggggaaaaagaaaatgcgcatcttaattctgagcctcgacacagccggaaagaccaccattttgtacaagcttaagctgggggagacagtgcccgctgtgcccaccgtgggattctgcgtggagacggtggagtacaagaataacactttcgccgtgtgggacgtgggttcccacttcaaaattcgtcccttgtggcagcacttttttcagaatacgaagggggcacggtcccctggctctactcaccagggaagtctggccagcggggttctccccatcaaatgctctcatgtggaattcggtatgtggaagggcggtcgatcccacccgttcctgccgcactcatcccggtgcgctggctccggcggtcagctcgatagcattttgccacaccaatctcccgcatgggggccatggggctgcaaagacctctcatccgggtttccaagtttcctgacctcaagcatcctgtggaagtcagccgttgtgaagtag

SEQ ID NO: 48244 - DNA, 612 bp, Artificial Sequence
  Description of Artificial Sequence: Synthetic coding sequence
atgggaaatatcttcgagaagctgttcaagtcactgctaggcaagaaaaaaatgcgcatcttaattctgagcctggacaccgccggaaagacgacaattctgtacaagctgaagctgggggaaacagtgcctgccgtgcccacagtcggattttgcgtcgaaacagttgagtacaagaataatacattcgccgtttgggatgtgggctctcatttcaaaatacgaccactttggcagcatttctttcagaacactaaaggagccagatcaccagggagcacccaccaagggtcactggcatctggcgtgcttccaatcaagtgttcccacgtcgaatttggcatgtggaagggtggacgatcccaccctttcctgcctcacagcagtcgttgtgctggctccggtggacaactcgattctatcctcccccatcagagccctgcctggggcccttggggctgcaaagatctgtcttcaggctttcccagttttttgacatccagcatcctgtggaagtccgctgtatcctaccagctgccatctctgcacaattccagtagaaattacgctgggtctcttgcccaaatgatgagacacttgctggaagcctag

SEQ ID NO: 48245 - DNA, 378 bp, Artificial Sequence
  Description of Artificial Sequence: Synthetic coding sequence
atgggcaacatatttgagaagctgtttaagtccctcctagggaagaagaaaatgaggattctgattctttccttggatactgccggaaaaacaacaattctgtacaaactaaaactgggggagacggtgcctgcagtgccaacggtgggattttgcgtggagacagtggaatacaaaaacaacactttcgcagtgtgggatgttggttcccactttaagattaggcccctgtggcagcatttcttccaaaatactaaagagctcagtgcctcacagtttgcgcagttcataaaaaagctctgtggagtcaccgggacaaatgatgaagctagccccggatcccttacttcctacccatcccacctactggaccggtag

SEQ ID NO: 48246 - DNA, 534 bp, Artificial Sequence
  Description of Artificial Sequence: Synthetic coding sequence
atggggaatatattcgagaagctgttcaaatctctgctaggaaaaaaaaagatgcgcatacttatcctaagtcttgatacggccggaaaaaccacaattctgtacaagctgaagctcggagaaaccgtacccgctgtgcccactgtgggattttgtgtggagacggtagagtataaaaataatacctttgctgtgtgggatgtgggatctcactttaagatccggcctctatggcagcatttcttccagaacaccaagggagccaggtcccccggtagcacacaccaaggctctctggccagcggcgtgttgcccataaagtgcagtcatgtggaattcggtatgtggaaaggtgggcgttcacatccttttctcccccattctagcaggtgcgctggcagtggcggtcagctcgatagcattctccctcatcagagtcccgcatggggaccgtggggttgcaaggatcttagctccgggttccccagcttcttgacttcgagcatcctgtggaaaagtgccgtcgtgaagtag

SEQ ID NO: 48247 - DNA, 330 bp, Artificial Sequence
  Description of Artificial Sequence: Synthetic coding sequence
gcacggagtcctgggtccacacaccagggttcattagcatctggcgtacttcctatcaaatgttctcacgtcgaattcgggatgtggaagggcggacgatcccacccgttcctgccccattcctcacgctgcgctgggagcggcggacagctggactccatcctgccacaccagtccccggcatggggcccatggggatgtaaagatctctctagcgggttcccctcttttctgacttccagcattctatggaagtcggcagtcgtgagagaaccccatatttctcctcatcaagctcccccatacaagacatctgactgtataacctag

SEQ ID NO: 48248 - DNA, 603 bp, Artificial Sequence
  Description of Artificial Sequence: Synthetic coding sequence
atgggcaatgggctctctgatcagacctccattctctccaatctaccctccttccaatctttccatatcgtgatcttgggtctggactgcgccggaaagactactgtattatatcgactacagtttaacgaattcgttaataccgtacccacgaagggcttcaatacagagaaaattaaggtgacactgggcaatagcaaaactgtaaccttccatttctgggacgtgggtggacaggagaagctccggccactatggaaatcttatacccgatgcaccgatggcatagtgttcgttgtggatagcgtagacgtggaaagaatggaagaagctaagacggagctgcacaagattactcggatttctgagaatcagggggtgcccgtcctgatcgtggccaacaagcaggacctgcgaaatagtctttcccttagtgagatcgaaaagctgctggcaatgggcgagttatcctcctcaacaccctggcacttgcagcctacctgtgcaatcataggagatgggttgaaggaggggcttgaaaaactccacgacatgatcatcaaacgccgaaaaatgctgcgacagcagaaaaagaagaggtag

SEQ ID NO: 48249 - DNA, 603 bp, Artificial Sequence
  Description of Artificial Sequence: Synthetic coding sequence
atgggtaatggcctgagcgaccagacaagtatcctctcgaacctgccaagcttccagtccttccacatcgtaattctgggacttgactgtgccggtaagaccaccgttctctaccggttgcaattcaacgagttcgtcaatactgtacctacaaagggcttcaataccgaaaagattaaggtaaccttgggaaacagcaagacagtgactttccacttttgggacgtgggaggccaggaaaaattgagacctctttggaaaagctacacgaggtgcaccgacggtatcgtttttgtcgtggacagtgttgacgtcgagcgaatggaggaggctaaaactgagctgcacaaaatcacccgtatctcagaaaaccagggcgtcccggtgctgatagtcgccaataagcaggatttgcgcaacagtctgtcgctcagtgagatcgaaaagctcctcgcgatgggtgagctgagttcttctactccatggcacctccaaccgacatgtgccatcattggtgacgggttaaaagagggactcgaaaagttgcatgatatgatcatcaaacgcaggaaaatgctgcgacagcagaagaagaagaggtag

SEQ ID NO: 48250 - DNA, 603 bp, Artificial Sequence
  Description of Artificial Sequence: Synthetic coding sequence
atgggcaacgggctttctgaccaaacatcaattctttccaaccttccttcgttccagagttttcatatcgtgattttgggactagactgcgctggcaagaccacggtactatatagactccagttcaacgaatttgttaataccgtgcctacgaagggatttaatacggagaagataaaggtcacattgggcaactctaaaaccgttactttccacttttgggacgtcggaggtcaggagaagctgaggcctctgtggaagagttacaccaggtgtacagatggcatcgtctttgttgttgatagtgtggacgttgagcgcatggaggaggcgaaaacagaacttcacaagattacacgtattagcgagaatcagggggtcccagtccttatcgtcgcaaacaagcaagatttaaggaattcattaagtctatctgagatagagaaattgttggctatgggagaactttcttcgtccaccccgtggcacctacaaccaacctgtgctattatcggcgacggattgaaagaggggctcgaaaagctccacgacatgatcatcaagagacggaagatgttgaggcagcagaaaaaaaagcgatag

SEQ ID NO: 48251 - DNA, 603 bp, Artificial Sequence
  Description of Artificial Sequence: Synthetic coding sequence
atgggaaatgggctcagtgatcagacaagcattcttagcaacctcccttcttttcagagttttcacatcgtgattcttggactcgattgcgccggaaagactaccgtcctctacagattgcagttcaatgagttcgtcaacaccgttcccaccaaaggctttaacaccgaaaagataaaggttaccctcgggaattctaaaaccgtaacctttcacttctgggacgtgggtggtcaggaaaaacttcgacccttgtggaagagttacacgagatgcaccgatggaatagtcttcgtcgttgactccgtcgatgtggagcggatggaagaggccaagacagagttgcataaaattactcgtatctctgaaaatcaaggcgtccccgtcctcattgtcgctaacaaacaggatctgcggaattccctgtcgctctctgaaattgaaaaattgctggctatgggcgagctcagcagtagcacaccctggcacctccagccaacatgtgcgataattggcgatggcctgaaagagggactcgaaaaacttcacgacatgattatcaaaaggcgtaagatgctgagacagcagaagaagaagcggtag

SEQ ID NO: 48252 - DNA, 603 bp, Artificial Sequence
  Description of Artificial Sequence: Synthetic coding sequence
atgggtaacggcctctctgaccagacctccatcctttcaaatttgccatctttccagagtttccatattgtcatcctgggtcttgactgcgccggtaaaaccacagttctgtaccgactgcagtttaacgaattcgtgaacacggttcccactaaagggtttaacacagagaaaatcaaagttactctgggaaactctaaaactgttacctttcacttctgggacgttggcggtcaggagaagctgaggcccctctggaaatcttacacaagatgcaccgatgggattgtatttgttgtagactcagtcgatgtggaacgtatggaggaggcaaaaaccgaactgcacaaaattaccagaatcagtgagaaccagggagtccccgtccttattgtcgcaaataaacaggatttgaggaactctctgtcactttccgaaatcgagaagctgctcgccatgggcgagctgtccagttctaccccctggcatttacagccaacatgcgcaatcatcggcgacgggcttaaggaaggcttggagaagttacatgacatgataataaaacggaggaagatgctaaggcagcagaaaaagaagaggtag

SEQ ID NO: 48253 - DNA, 156 bp, Artificial Sequence
  Description of Artificial Sequence: Synthetic coding sequence
atgggtaacggactgagtgatcaaaccagcatcctttctaatctgccatctttccaatcttttcacattgttatactgggcttagattgtgccggaaaaaccaccgtgctatacaggctacaatttaacgagtttgtgaacaccgtgccaacctag

SEQ ID NO: 48254 - DNA, 606 bp, Artificial Sequence
  Description of Artificial Sequence: Synthetic coding sequence
atgggaaacattagcagcaacatttctgcgttccaatctctgcatatcgtcatgcttggtctggactcagctggcaaaacgacagtgctttatcgcttgaaatttaacgaattcgtaaacacggtgcctaccatcgggtttaatacagagaagatcaagctatcaaacgggactgccaaagggatctcctgtcatttctgggacgttggaggacaggaaaagctccggccactatggaagagctatagccggtgcacggacggcatcatctatgtcgtggactccgtcgatgtagatcgcctcgaggaggccaaaaccgagcttcataaagtgaccaaattcgcagagaaccaagggaccccactcctggttattgctaataaacaggacctccccaaatctctgccagtggcagaaatagagaagcaactggctcttcacgagctcattcctgccacaacctaccatgtccagcctgcttgcgccattatcggagagggactcaccgaagggatggataagctgtacgaaatgattctgaaaaggagaaagagtcttaaacagaaaaagaaaaggaccggcgacctccggagttgcgaagtctag

SEQ ID NO: 48255 - DNA, 579 bp, Artificial Sequence
  Description of Artificial Sequence: Synthetic coding sequence
atggggaatattagctcaaatatatccgcttttcagtcactccatatcgtgatgctgggccttgattctgccggaaaaaccaccgtcctctatcgcctgaagttcaacgagtttgttaacaccgtcccgaccatcggtttcaatacggaaaaaataaagttgagtaatggcacagcgaaaggaatttcttgccatttttgggacgtaggtggccaggaaaagctgcgcccactgtggaaatcctacagccggtgcactgatggcattatttacgtcgtagatagcgtggacgtcgatagattagaggaggccaagaccgagctacacaaggtcaccaaattcgcggagaatcaaggaacgccccttttagtgatcgcaaacaaacaggatcttcctaagtctttaccagtcgccgaaatagagaagcagttggccctccacgagctcattccagcgacgacttaccatgtacaacccgcatgtgcaatcattggggaaggcctgacagaggggatggacaagttgtacgagatgatcttaaagcggagaaaatcactcaaacagaaaaaaaaaagatag

SEQ ID NO: 48256 - DNA, 612 bp, Artificial Sequence
  Description of Artificial Sequence: Synthetic coding sequence
atggctgaaggagacaatcgcagcaccaatctgcttgcagctgagacggcctctcttgaggagcagctgcagggctggggtgaggtgatgttgatggccgacaaagtgctcaggtgggaaagggcctggttccctccggcaatcatgggcgtagtttctctggtgtttcttataatatactacctggacccatctgtcttatctggcgtttcttgttttgtgatgtttctttgcctggccgactacttagtgccaattcttgctccacggatattcggcagtaataaatggaccactgaacagcagcagcggttccacgaaatatgctcaaacctggtcaagacaaggcgcagagcggtcggatggtggaagcgcctgttcaccctcaaagaagagaagcctaaaatgtacttcatgacaatgatagtgtctctggctgctgtcgcttgggttggacagcaggtccacaatttacttcttacatatcttatcgtgacatccctactgctcctgcctggcctgaaccaacatggaataatattgaaatacattggaatggccaaacgtgagatcaataagctgctcaagcaaaaggagaagaagaacgaatag

SEQ ID NO: 48257 - DNA, 468 bp, Artificial Sequence
  Description of Artificial Sequence: Synthetic coding sequence
atgggtgttgtgtcgctggtttttcttatcatttattacctggatccttctgtcctgtctggggtatcttgctttgtcatgttcctgtgtctcgccgactatttggtgcccattctagcccctcggatcttcggcagtaacaagtggaccactgaacaacagcagcgctttcacgagatctgcagtaacctggttaagacacggaggcgtgccgttggctggtggaaacggctctttaccttgaaagaggagaaaccgaaaatgtatttcatgactatgattgtatccctggctgctgtagcttgggtcggccagcaggtgcacaatttacttctgacctacttgatcgtcacttctctactactgctgcccggtttaaaccagcacggaattatactaaaatatatcgggatggccaagcgggagatcaataagctgctgaaacagaaagagaaaaagaatgaatag

SEQ ID NO: 48258 - DNA, 525 bp, Artificial Sequence
  Description of Artificial Sequence: Synthetic coding sequence
atgttaatggccgacaaggtcctgcggtgggagcgcgcatggttccctcctgctatcatgggagtggtgtcgttggtattcctgatcatctactatcttgatccctctgtgctgagtggcgtgagctgctttgtgatgttcctgtgtctggcagattacttagttcctattctggcgcctcggatcttcggatccaacaagtggacgaccgaacagcagcagcggtttcatgagatttgctctaacctcgtaaagacacgccgaagggccgtgggctggtggaaaaggttgttcacactcaaagaggagaaacctaaaatgtattttatgaccatgattgtgagcctggccgctgtcgcttgggttggccagcaggttcacaacctcctgctgacctatctcattgtgacctcactgttacttttaccaggattgaaccagcacgggatcatcttaaagtacatcggtatggcaaaaagagaaattaataagctgctgaagcagaaagaaaaaaagaatgagtag

SEQ ID NO: 48259 - DNA, 561 bp, Artificial Sequence
  Description of Artificial Sequence: Synthetic coding sequence
atgatcgcgttgtttaataaactcttagattggtttaaagccctcttctggaaggaagagatggagctgaccctggtaggcttacagtattctgggaagaccacgtttgtcaatgtgattgcttccggacagttcaacgaagacatgatcccgaccgttgggtttaatatgcggaaaatcacaaagggcaatgtcacaatcaagctgtgggatataggtggccagccaaggttccgaagtatgtgggagaggtactgccggggagtatccgcaatagtgtatatggtggatgctgctgaccaggagaagatcgaagcctctaagaatgagttacataatctcttagacaagccacagttgcaaggcattccggtactcgtcttagggaataagcgggacttaccaggcgctttggatgaaaaagagctaattgagaaaatgaatctatctgctattcaggaccgggagatttgttgctattcaattagctgcaaagaaaaggataatatcgacatcactctgcagtggttgattcagcacagcaaatcacggaggtcttag

SEQ ID NO: 48260 - DNA, 561 bp, Artificial Sequence
  Description of Artificial Sequence: Synthetic coding sequence
atgttggcactgatatcacgacttcttgattggttccggtctctcttttggaaagaagagatggagctaacacttgtcgggttacaatactctggcaagaccacctttgtgaatgtaatagcttctgggcagttctcagaagatatgatcccaacagttggttttaatatgaggaaggtgacaaaggggaatgttaccataaagatctgggatattggtggtcaaccccgatttagaagcatgtgggaacggtactgcagaggcgttaacgccattgtctatatgatagacgccgcagatcgggagaaaatcgaagcgtcacggaatgaactgcacaaccttctggataaaccccagctgcaggggattcccgtgctggtgcttgggaataaaagggatctgcccaacgcactcgacgagaaacaactgatcgaaaagatgaacctgtccgccatccaggacagagagatttgctgctactccatatcctgcaaggagaaggacaacatagacatcacactccagtggcttatccagcacagcaaatctcgtagatcatag

SEQ ID NO: 48261 - DNA, 492 bp, Artificial Sequence
  Description of Artificial Sequence: Synthetic coding sequence
atgctggcactgattagtcggctcctagattggtttcggtcattgttctggaaggaggaaatggagctcacgttggtgggcctccagtattctggcaagaccacattcgtgaatgtcatcgccagcggtcaattttctgaggacatgattcccaccgtgggattcaatatgcgtaaagttaccaaaggcaatgttactattaagatttgggatattggagggcagcctcgattccgttccatgtgggaacgctattgcagaggtgtcaatgcaattgtctatatgattgatgctgccgacagggaaaagatagaggctagcagaaacgaacttcataatttgctcgacaagcctcagctgcaaggcatccctatttcacacttttctggactgttttccatccagaacttggaggaagccgaggcctccccagaagtgttccagtcctttttggccatcatactggagcttctgtcagttccacttaagtag

SEQ ID NO: 48262 - DNA, 717 bp, Artificial Sequence
  Description of Artificial Sequence: Synthetic coding sequence
atgatcaggtcggcctcctgggtgtggttgttgcctcctgccggtgttagaccttgcagggcaggggctcctcgcagtcggtggcgcgtgcgggctgaagccagatcatgtggatctagacctagcagcaggcccttctccttgccggctgccattatgttagcactgatctccaggcttctggactggttccgttcactattctggaaggaggagatggagcttacgctggtcggactgcagtacagcggcaagaccactttcgtcaatgttatcgcaagcggtcagttcagtgaggatatgattccaaccgtcggattcaacatgagaaaggtcaccaaggggaatgtgacaatcaaaatctgggacataggaggtcaaccaaggtttcgctcaatgtgggagcgatactgccgtggagtaaatgccatcgtttatatgatcgacgccgcagatcgggaaaaaattgaggcttctagaaatgaactgcacaacctcttagacaaaccacagctgcaggggataccagtcctggtgctgggtaataaacgtgaccttccgaatgccctggatgagaagcaactgattgagaagatgaacctgagcgcgattcaagaccgcgagatctgctgttactccatcagctgcaaagagaaagataatattgacatcaccctacaatggttgattcaacatagcaagagccggagaagttag

SEQ ID NO: 48263 - DNA, 681 bp, Artificial Sequence
  Description of Artificial Sequence: Synthetic coding sequence
atgagcttcgcagagtctggttggaggagcgctcttaggcggcgtggccctgggactccaggacccgtggctaggccctcctactcatcctttacgcaaggtgattcctggggggagggtgaagtagatgaggaagaggggtgcgatcaagtggcccgagacctgcgcgcagagttttccgcgggagcctggtccgagccgcgaaagcgcagcgtgcttccgcctgatgggaacggaagtcctgtgttgcctgataagcggaacggaatcttccctgcagccgcaggatcacgggcacagccacggcgatggcccgtgcaagtgctatcgatactttgctcactgctttttgccatcctgctggcttttttgctggcaatcgcctatctgatcgtgaaggagctgcatgccgagaacctaaaaaacgaagacgacgtggacacaggcttacttgggttctggacattgctcatcatatcactaacggcaggcttttcctgttgttccttttcttggaccgttacctattttgattctttcgagccagggatgttcccgcctactcccctgtccccagccagatttaagaagcttaccgggcactctttccacatgggatactcaatggcaatactgaacggcatagtggcggctctgacagtggcctggtgcctgatgtag

SEQ ID NO: 48264 - DNA, 3492 bp, Artificial Sequence
  Description of Artificial Sequence: Synthetic coding sequence
atgaaccgcgaagaccggaacgttctgcgcatgaaagagcgcgagaggagaaatcaagaaattcagcagggcgaggacgccttcccaccgtcttcccctctcttcgcggaaccttacaaagttaccagtaaagaagacaaattgtcctctcgcatccagtctatgctcggcaattacgatgagatgaaggacttcattggcgaccgcagtatccctaagctggtggcaattcctaaacccactgtcccgccttctgccgatgagaaatccaaccccaactttttcgaacagcgacacggtggatcccatcagagttctaaatggacacctgtcggcccagccccttccacgtctcagtctcagaagagaagcagtggcctgcagtccggacacagcagtcagagaacgtctgcaggctcttcaagcggcacaaattcctcaggccaaaggcatgacagggaaagttataacaactctggttctagttctcggaaaaaaggacagcatggatccgagcactcaaaatctagatcgtcaagtccgggaaaaccccaggctgtgtcttctttaaatagctcacactctcggtcgcatgggaatgaccaccactcaaaggagcaccagaggtcgaagagccctagagacccagatgctaattgggattctccttcaagggtccctttcagctcaggccagcacagcacccagtctttccctccgtccctgatgtctaagtctaactccatgcttcaaaagccaacggcctatgtgcgaccgatggatggacaggagtccatggaaccaaagctgtcatcggagcactattcttcacagagccacggtaattccatgaccgaactgaagccctcaagcaaagcccaccttacaaaattaaaaatccctagccagcctcttgatgcctctgcctccggggatgtctcatgcgttgacgagatcctcaaagaaatgacccacagctggcctcccccacttacagcaatccacacgccctgcaaaacggagccttctaagtttccattccccaccaaggaaagtcagcaatcaaacttcggcactggcgagcaaaagcgatacaatcctagtaagacatctaacggacaccagtctaaatcaatgctgaaggacgatttaaagttgagctcctctgaagacagcgacggagagcaggactgcgacaaaactatgcctcggagcactcccggttcaaatagtgaaccctcccatcataacagcgaaggcgcagataattcaagagatgattctagtagccacagcggcagcgaatccagctcaggctctgattccgagagcgagagtagctcttccgactctgaggccaacgagccttcccagtcagcctcccctgaaccagagccaccccctaccaacaagtggcagctggacaattggctgaataaggtcaatccccacaaagtttcccccgcaagctccgttgactctaacattccatcaagccagggttataaaaaagaaggacgggaacagggcaccggaaattcttacacagacacctcgggtccaaaagaaacgagctctgcgaccccaggacgagacagtaagactattcagaaagggtctgaatccggcagaggaagacagaagtcccccgctcaaagtgacagcaccacccagcgccgtactgtgggcaaaaaacagccgaaaaaggccgagaaggctgccgcagaagagccacggggagggctgaaaatcgaaagcgaaaccccagtagacttggcaagctcaatgcctagctcccgccacaaagccgctacaaaaggcagtagaaaacctaacataaagaaggaaagtaagagctccccaaggccaaccgcggaaaaaaagaaatataaatctacatctaagagttcccagaagagccgtgagatcatcgagacagatacatcatccagtgactctgatgaaagcgagtccctacccccatcgtcccagacgccaaagtatcctgagagcaatcggaccccagttaagccgtcttccgtggaagaagaagactccttcttccgtcaacgtatgttttctcccatggaagagaaggaattactttcacccttgtccgagccggacgatagatacccactgatcgtgaaaattgacttgaacttactcacccgaattcctggtaagccatacaaggagactgaaccacctaaaggggagaagaaaaacgtgcctgagaagcacacgagagaagcccagaaacaggcgagcgaaaaagtgagtaacaagggcaagagaaagcacaagaacgaagacgataacagggcctccgaatccaaaaagccaaaaacagaagacaaaaatagtgctgggcataagccctccagtaatagggagtcttctaaacaatcggccgctaaggagaaagacctcctgccttccccggcagggcctgtcccctctaaagatccaaaaacagagcacggctcccgtaaaaggacaatctctcagtctagctccctcaagtcgtcaagcaactcgaacaaagaaacctcaggctcctcaaaaaattcgagcagcacatctaaacaaaagaaaacagaaggaaagacctcttcttcttccaaggaagtcaaggagaaagcgccatctagtagctccaactgtccccctagcgctccaactctggacagcagcaaacctaggaggaccaagctggtgtttgacgatcggaattattccgcagatcactatctgcaagaggctaaaaaacttaaacataatgccgatgcgctgagcgaccgctttgaaaaagccgtgtattatctggatgcggttgtttctttcatcgaatgtgggaacgccctggagaaaaatgcccaggagtctaaaagccccttccccatgtattcggaaactgtggacttgataaaatatacaatgaaactgaaaaattacctggcacccgacgctactgctgcagacaagcggcttaccgtgttgtgcttgaggtgtgagtccctgctgtatcttaggctgtttaaactgaagaaagagaacgcattgaaatattcaaagacacttaccgagcatctgaaaaacagctacaataattcccaagccccttcccccggacttggaagcaaagccgtggggatgccctcccccgtgtccccaaaattgagccccggtaactcaggtaactattcgagtggggcaagcagcgccagcgcctccgggagcagcgtgaccataccccagaagattcaccaaatggctgcttcttatgtccaagtgactagtaactttctctatgcaaccgagatttgggatcaggcggaacagttgtcgaaagagcagaaggagttctttgccgaacttgataaggtgatgggacccctgatcttcaatgcatcaatcatgactgatctagtgcggtatacacggcaggggttacattggcttcggcaagacgctaagttgatctcgtag

SEQ ID NO: 48265 - DNA, 447 bp, Artificial Sequence
  Description of Artificial Sequence: Synthetic coding sequence
atgaaccgagaagacaggaatgtactccgcatgaaggaacgcgagaggaggaaccaggagattcaacagggagaagatgcttttcccccaagtagtccgctgttcgctgaaccctataaagtgacgtcaaaggaggataaactctcttcccggatacaaagcatgctcggtaattatgatgagatgaaggactttatcggcgacaggtccattcccaagctagttgccatcccgaaacctactgtcccccctagcgccgacgaaaagagtaaccctaacttcttcgagcaacgccacgggggttcccaccagtccagtaaatggacgccggtagggccagctccgtcaacctcacaaagccagaagcggtctagcggactgcagagcgggcactcatctcaaaggacctcagctggcagcagctctgggacaaatagtagtggttag

SEQ ID NO: 48266 - DNA, 1059 bp, Artificial Sequence
  Description of Artificial Sequence: Synthetic coding sequence
atgttacggttgctagccagcggctgcgcaaggggcccagggccaggcgtgggtgcgaggccggcagccggtctcttccatcccggaaggagacagtcccggcaggcttctgatgctcccagaaatcagcctccatcccctgaattcgtcgcccgaccagttggcgtttgtagcatgatgagactgcctgtgcagacttccccggagggcctcgacgcggcttttattggagtgccgctcgacacgggaacctctaaccggcctggggcacgattcgggcctagacgcattagagaagagtcagttatgcttggtacagtaaacccctccactggagctctccctttccagtcactgatggtcgcggacttgggagatgtaaatgtgaacctgtataacttgcaggacagctgcaggcggatccaggaagcgtacgagaagattgtggctgccggttgtatccccttaacattgggtggcgatcatactattacgtatcctatcttgcaggctatggctaagaaacacggacccgtcggcctgctacatgttgacgcacatacagatactacagataaagcccttggcgagaagttataccatggagcgccttttcgaaggtgcgttgacgaagggctcctcgactgtaagcgcgtcgtacagatcggcattagaggatccagcacaacattagatccttacagatataatcggagtcaaggatttcgcgtggttctggccgaggattgctggatgaaatcgctggtgccccttatgggcgaagttaggcagcaaatgggaggaaaacctatttatatcagctttgacattgatgctctcgacccagcatatgcccctgggacaggtacgccggagatcgccggtctaacaccgtcccaagctttagagataattcgtgggtgccagggcttgaacgtgatggggtgcgacctcgtcgaggtgtcacccccttacgacctttccggtaacactgctctgttggctgccaatctactcttcgaaatgctttgcgctctgccaaaagtcactaccgtgtag

SEQ ID NO: 48267 - DNA, 1617 bp, Artificial Sequence
  Description of Artificial Sequence: Synthetic coding sequence
atggagcggttgggtgagaaggctagcagattgcttgaaaaatttggaaggaggaaaggagagtcctcgcgttctggctccgacggtacacctggtccaggcaagggcagattgagtgggctgggagggccacgcaaatcgggaccacgcggtgccacaggcggacctggggacgagccactagagcccgcaagagagcagggatcattagatgcagagcggaaccagagagggtcttttgaggctccccgatatgaaggatcctttccagctggccctcctcccaccagagcactgcccctgccgcaaagtctgccccctgactttagattagaacccacagcccctgctctcagccctaggtcaagttttgcctcctcatctgccagcgacgcctcgaagcctagtagtcccagggggtcactgttgctggatggtgctggtgccggaggtgcgggaggttccagaccctgctctaataggacatctggtatcagcatgggttacgatcagagacacgggagccctttgcccgctggtccgtgtttgttcggacccccattggctggtgcccctgcaggctactcccccggtggcgttccttccgcctatcccgagctgcatgctgctctcgacagactgtatgctcagcgacctgctgggttcggctgtcaggagtcccgtcactcctaccctccagcattggggtcccccggagccctggctggtgccggagtcggcgcagccggtccccttgagcggagaggcgctcagcccggaagacatagtgtcaccggttatggtgattgcgccgtgggtgccaggtaccaggatgagctgactgccctactgagattgaccgtgggaacaggtgggagagaggcgggagcaagaggagagccctctgggatcgagccttctggactggaggagccaccaggaccttttgtgcctgaagctgcaagggccaggatgcgggaaccagaggcgagggaagactacttcggaacgtgtatcaagtgtaacaagggtatttacgggcagagcaacgcgtgccaggcgctcgacagtctgtatcacacccaatgcttcgtgtgttgtagttgcggcagaaccctccggtgcaaggccttttactcagtcaatggtagtgtgtactgcgaagaggactacctcttctccggtttccaggaggctgctgagaagtgctgcgtctgcggacacctgattcttgagaagattcttcaggccatgggaaaatcttatcacccgggatgctttcgctgcatcgtgtgtaataagtgtttggatggaatcccctttactgtcgattttagcaaccaagtctattgtgtgactgattatcataagaattacgctccaaagtgcgctgcttgtggacaacctatcttacccagcgaagggtgtgaggatatcgtaagggttataagcatggaccgagactaccattttgaatgctaccactgtgaggattgtcgcatgcaactctctgacgaggaaggctgttgttgttttccattggatgggcatctgttgtgccacggctgccacatgcagcgcctgaacgccagacaaccacctgccaactacatttag

SEQ ID NO: 48268 - DNA, 1617 bp, Artificial Sequence
  Description of Artificial Sequence: Synthetic coding sequence
atggagcgcctgggggaaaaagctagcagactcctcgagaaatttggtcggaggaagggagagagttcacgctcaggtagtgacggaacaccaggtcccggaaagggaaggctctccgggttaggcggtccaagaaagagtggcccacgaggagccactggtgggccaggggacgagccccttgagcctgccagagaacaggggagcctcgacgccgagcggaaccagcggggatctttcgaggccccaagatacgaaggaagctttccagccggacctcctcccacccgcgcactgcccttgcctcagtctctccctccggatttccgcctcgagcccacggctcccgcactctcaccccgtagcagcttcgctagctcttcggcctccgatgcctccaaacctagctctccacggggaagtctcttgctggatggagccggagctggaggagcgggaggcagtcgaccgtgctccaaccgcaccagtggcatcagtatgggctatgaccagcgacatgggtccccactgcccgcaggtccctgtctctttggccctccactagcaggagcccctgccggttacagtccaggaggtgtgccctctgcttaccctgagcttcacgctgcactcgacagactttatgcacagagaccggcaggattcgggtgtcaggaaagcagacactcatatcctcccgctctcgggtctcccggtgcgttagcgggagccggtgtgggagctgctggacctcttgaacgcagaggagctcagccagggaggcactcggtaactggatacggcgattgtgccgtgggcgctagataccaggacgaactgactgccctattgcggctgaccgtgggtaccggaggccgagaggccggtgcgcgtggcgagccctcgggcatcgagcctagcggactcgaggaacccccagggccttttgtgccggaggcagcacgggctcgcatgcgcgaaccagaggctagagaggactattttggcacctgcatcaaatgtaacaagggcatctatgggcagtcaaatgcctgtcaggcactcgactctctgtaccacacacagtgcttcgtgtgctgcagttgcggtagaaccctgcgttgcaaggccttctattctgttaacgggtccgtatactgtgaagaggattacctcttttccggctttcaagaagcggcagagaagtgttgcgtgtgtggccacctcatattggagaagatccttcaagccatggggaagagctaccatccgggttgcttccgctgtatcgtttgtaataaatgcctggatggaattccctttacggtggactttagcaaccaagtgtactgcgtcacagattaccacaaaaattacgctcccaaatgtgcggcttgcggtcaacctatcctgccgtctgaagggtgtgaagatattgtgagggtgatttctatggaccgtgactatcacttcgagtgctaccactgtgaggactgtcgcatgcaactgtcggacgaggaaggctgctgctgtttcccattggatggacaccttttatgccatgggtgccatatgcaaagattgaacgccagacaacctcccgctaactacatctag

SEQ ID NO: 48269 - DNA, 366 bp, Artificial Sequence
  Description of Artificial Sequence: Synthetic coding sequence
atgggaaaatcatatcaccctggttgttttcgttgcatcgtgtgcaacaagtgcctggacggcattcctttcacagtggatttttctaaccaagtgtactgtgttacagactaccacaagaattatgcgccaaaatgcgctgcctgtgggcagcctatcctgccatcagagggttgcgaggacatagttagagtgatttctatggaccgtgactaccatttcgaatgctatcattgtgaggattgccggatgcagctcagtgacgaagagggctgctgctgttttcccctcgacggccatctgctatgccatggttgtcacatgcagcggctcaatgccaggcagccacctgctaactacatctag

SEQ ID NO: 48270 - DNA, 243 bp, Artificial Sequence
  Description of Artificial Sequence: Synthetic coding sequence
atgggcaaatcttatcacccaggctgtttccgatgcatcgtctgtaacaaatgtctggatggcattccctttaccgtagactttagcaatcaggtgtactgcgtaactgactatcataagaactacgcccctaaatgtgccgcatgcggacagcctatattgccttctgaaggctgcgaagacatcgtcagagtcattagtatggacagggactaccactttgagtgctaccattgcgagtag

SEQ ID NO: 48271 - DNA, 198 bp, Artificial Sequence
  Description of Artificial Sequence: Synthetic coding sequence
atggggaagtcataccacccgggttgcttccggtgtatcgtgtgtaacaagtgcctggatgggatcccgttcacagtcgatttctcaaatcaggtctactgtgtgacagattatcataagaactacgccccaaagtgtgcagcttgtgggcagccaatcctgccaagtgagggctgtgaagacatcgtcagagtgtag

SEQ ID NO: 48272 - DNA, 243 bp, Artificial Sequence
  Description of Artificial Sequence: Synthetic coding sequence
atggggaaaagttatcatccaggttgcttccgctgcattgtgtgtaataagtgcctagacggcatcccatttactgtggacttttctaatcaagtgtactgcgtgacagactaccacaagaactacgcgccaaagtgtgcggcatgcggacaacctattctcccttcagagggatgcgaggacatcgttcgagtcatttctatggacagggactaccactttgagtgttaccattgcgagtag

SEQ ID NO: 48273 - DNA, 309 bp, Artificial Sequence
  Description of Artificial Sequence: Synthetic coding sequence
atggccaatacccagctggatcatctgcactatacgaccgagttcacacgcaatgacctgctcattatctgcaaaaagttcaatttgatgttgatggacgaagatatcatttccttgctggccatatttataaagatgtgcctgtggttgtggaagcagtttcttaagcgcggatcaaaatgcagtgagaccagcgaattgttagagaaagtcaaactgcagcttgctttcaccgcctataaatacgtagatatctgctttccagagcagatggcttactccagatacattaggtggtatattcattag

SEQ ID NO: 48274 - DNA, 1500 bp, Artificial Sequence
  Description of Artificial Sequence: Synthetic coding sequence
atgtgtgaactgtattccaaacgggacaccctgggactccggaaaaaacatataggcccttcttgtaaagtgttttttgcttctgaccccattaagatcgtgcgggctcagcggcagtacatgttcgatgaaaacggtgagcagtatcttgactgtattaacaatgtggcacacgttggccactgtcatcctggcgttgttaaagccgcactgaagcagatggaactcctcaatacaaactccaggttccttcacgacaatatcgtggaatacgcgaagaggctctcagccaccttaccagagaagctgtccgtttgctacttcacgaactccgggagtgaagcaaatgacctggctctacgtctggctaggcagtttcggggacatcaggacgtgataactctcgaccatgcctaccatggccacctgtccagtctgattgaaattagcccctacaagttccagaaagggaaagatgttaagaaagaattcgtgcatgtggcacctactccagacacgtatcggggtaaatatcgcgaggaccacgccgattccgccagcgcctacgcagatgaggtgaagaagattattgaggatgcacacaacagtgggagaaagatcgcagcgttcatcgcagagtccatgcagagctgtgggggtcagattataccacccgcaggctatttccaaaaagttgctgagtatgttcatggtgctgggggagtcttcattgctgatgaggtccaggtgggttttggcagagtcggcaagcacttctggtcattccagatgtatggggaggatttcgtccccgatatagtgaccatgggcaagcccatgggcaacgggcaccccgtggcttgcgtagtgaccaccaaggagatcgccgaggccttctccagtagcgggatggagtactttaatacgtacggcggtaatcctgtaagctgcgctgttggtcttgcagtattggatatcattgagaatgaggacctgcagggcaacgccaaaagagtggggaattacctcacagaactcctcaaaaagcagaaagccaagcacacactcataggcgacatacgcggaattgggttatttatcgggatagacctggttaaggaccatctcaaacgcacacccgctacagctgaagctcagcacatcatttacaaaatgaaggagaagcgtgtgttgcttagcgcagacgggccacatagaaacgtactgaaaattaaaccaccaatgtgcttcacggaagaggatgccaaattcatggtcgaccagctcgatagaatactaactgtgctagaagaagctatggggacaaaaaccgagtctgttacctccgaaaatacaccatgtaagactaaaatgctgaaagaggcccatatcgagctgctgagagattccactacagatagtaaagagaatccaagccggaaacggaatggaatgtgcactgacacacacagtcttctttctaagcgcctcaagacatag

SEQ ID NO: 48275 - DNA, 1482 bp, Artificial Sequence
  Description of Artificial Sequence: Synthetic coding sequence
atgtgcgagctatactcaaaaagggatactctggggctcaggaaaaagcatatcgggccttcctgtaaggtgttctttgctagcgaccctatcaagatagtgcgagcccagagacagtacatgtttgacgagaacggagaacaataccttgattgtatcaacaatgtagcccatggggttgttaaggctgcactgaagcagatggagttgctgaacaccaattcacgcttcctgcacgataacatcgtcgagtatgctaaacggctcagcgcgacgctcccggaaaagctcagcgtgtgctatttcacgaactctggttctgaagctaatgatctggcgctcaggctagcacgccaatttcgcggacaccaagacgtcataacgctggaccatgcctaccacggtcatctcagtagtttgatcgaaatcagcccgtacaagttccagaaaggtaaggatgttaaaaaggagttcgtacacgtagcaccaacaccagacacctaccggggaaaatatcgcgaagaccacgcagactctgcctccgcctacgcagacgaggtgaaaaagattattgaagacgcccacaattcaggtaggaaaatagccgcttttatcgccgagagcatgcagagttgcgggggacagataatccctccggctggatattttcagaaggtcgccgaatacgttcatggcgcaggcggagtgtttatcgcggatgaggtgcaggtcgggtttgggcgtgttggcaagcacttttggagtttccagatgtatggggaagattttgtgcccgacattgtaacaatgggcaaacccatgggcaatggtcaccctgtggcttgcgtggtaacaactaaggagattgccgaggccttttccagtagcggtatggaatattttaacacatacgggggaaatccagtctcatgcgcagtcgggctggctgtcctcgatattatcgaaaatgaagatctgcaggggaatgcaaaacgcgtgggaaactatctgaccgagttgctgaagaagcagaaggctaagcacacactgattggagacatcagggggatagggctgttcattggtatcgacctggtgaaggaccacctgaaacgaaccccagctactgccgaagctcagcacattatctacaagatgaaggaaaaacgggtactgctgtccgccgacggaccacatcggaacgtgctcaaaattaaacctcctatgtgtttcacggaggaggacgccaaatttatggtggatcagctcgaccgaatcctcaccgttcttgaagaagctatgggtacaaaaaccgaaagtgtgactagtgagaacactccgtgtaagaccaagatgctcaaggaagcacatatagaactgctgcgggacagcacgacagattcaaaagaaaatccttccagaaagagaaacgggatgtgtacagatacccatagtttattgagtaaacggcttaagacctag

SEQ ID NO: 48276 - DNA, 1326 bp, Artificial Sequence
  Description of Artificial Sequence: Synthetic coding sequence
atgggccattgccatcctggcgtcgtcaaggctgccctcaagcagatggaactccttaacaccaactctcgttttctccatgataatattgttgagtacgccaagaggcttagcgccactcttccagagaaactgagcgtctgttatttcaccaacagcggcagcgaagctaatgacttggcactcagactggccagacagttccgaggacaccaggatgtgatcacactggaccatgcttatcacggacatctgtcatcacttattgaaattagcccctacaaatttcagaaaggcaaggacgtgaaaaaggaattcgtccacgtggccccaacacctgatacatacagagggaagtaccgcgaagaccatgcagatagtgcatctgcttacgccgacgaggtaaagaagatcattgaagatgcccataattctggccgaaaaatcgccgcatttattgctgagagtatgcagagttgtggcggacagatcatccctcccgctggatatttccagaaagtggcagagtatgtgcacggggctggcggagtgttcatagctgacgaagtgcaagtcggatttggacgtgtgggcaagcacttttggtcgttccagatgtatggtgaggatttcgttcctgatatcgtgaccatgggcaagccaatgggcaacggtcatccagtggcttgtgtggtaacaacaaaagaaattgctgaggccttttcttccagtgggatggagtatttcaatacttacgggggaaaccccgtcagttgtgctgtcgggctggccgttctggacattatcgaaaatgaggacctccagggcaatgccaagagggtcggcaactatcttacagagctgcttaagaagcaaaaagctaaacacacactgattggagatattaggggcatcggcctgtttattggaattgaccttgtaaaagaccatctcaaacggaccccagcaactgccgaggcccaacatattatctataagatgaaggaaaagagggttttgctgagtgcagacgggcctcaccgcaacgtgctcaaaattaaacctcccatgtgcttcacagaggaggatgcaaaattcatggtcgatcagctggatcgtatactcacggtgcttgaagaagctatgggaacgaagacagaatctgtgactagcgagaatactccgtgtaagaccaagatgctgaaggaagcccacattgagctactgcgggatagtacgaccgactccaaagaaaacccctctaggaaaagaaacggtatgtgcaccgacacacactcgttgctgagcaagcggttgaagacatag

SEQ ID NO: 48277 - DNA, 1353 bp, Artificial Sequence
  Description of Artificial Sequence: Synthetic coding sequence
atggcagctgatcagagacctaaggctgacactttggctttgcgccagcgcctcatctcttctagctgcagactgttcttccctgaggatcccgtgaagattgttagggcgcaaggacagtacatgtatgatgagcagggtgcagagtatattgactgtatttcaaacgtcgcccatgtggggcactgccatccactcgttgtgcaggctgcgcacgagcagaaccaagtgctgaacactaacagccgatacctgcatgacaatattgtcgattatgcccagcgcctgtctgagacacttccagaacagttgtgcgttttttactttctgaactcaggctccgaggctaacgacctagcactgagactggctcggcactacacaggacaccaagatgttgtcgtcctcgaccatgcctatcatggtcatctgagttctctaatcgacattagtccctacaagttccgcaatctcgacggccagaaagagtgggtgcacgttgccccactccctgatacctacagaggcccttatcgcgaggaccatcccaaccctgctatggcttatgcaaatgaagttaaaagagtggtgagctcagcacaggagaaaggaaggaagattgcagcttttttcgctgaaagtttgccaagcgtgggcggacagatcatacctccagcaggttatttttcgcaggtcgccgagcacatccgtaaggcgggaggcgtctttgtggctgatgaaattcaggtgggtttcggcagagtgggtaagcatttctgggcgtttcagctgcagggcaaggattttgttcccgatattgtcacgatggggaaaagcatcggcaatggccatcctgtggcgtgtgtggccgctacacagccagtggccagagcgtttgaggccaccggcgtggagtactttaatactttcggaggttctccagtcagttgcgctgttgggcttgctgtgcttaatgtgctggagaaagagcagttgcaagatcacgccactagcgttggctccttcctcatgcaattgttaggccagcaaaaaatcaaacaccctatcgtgggcgacgtgagaggggtgggtctgttcattggagtcgacctcataaaggacgaggcgactcgcaccccagcgacagaggaggccgcatacctcgtatctcgacttaaggagaactacgtactgctctccactgacggtcctgggaggaatatactgaaatttaagccacccatgtgtttcagtttagataatgcaagacaagtggttgcaaagttggacgccatactgaccgacatggaggagaaagtgagaagttgtgaaaccctccgtctgcaaccttag

SEQ ID NO: 48278 - DNA, 519 bp, Artificial Sequence
  Description of Artificial Sequence: Synthetic coding sequence
atgatatactcatgctgcattttcgtttattgcatgttcgagtgtttcaaaattaagaattcagtcaattatcaccttctttttacgctggtactgtttagcctgattgtgactaccgtgtacctgaaagtcaaggaacctatttttcaccaggtaatgtatggaatgttagtgttcaccttggtcctgcggagtatctatatagtgacatgggtgtatccttggttacggggtctggggtatacttctctgggtattttccttttgggtttcctgttctggaatattgataatattttctgtgagtcactccgaaattttcgtaagaaggttccaccaatcataggcatcacaactcagttccatgcatggtggcatatcctgaccggcctgggttcttatctgcacattcttttcagcctttacacgcgtactctctacctgcgctataggccaaaggtcaaatttctgtttggcatatggccagtgatcctcttcgagccgcttaggaaacactag

SEQ ID NO: 48279 - DNA, 804 bp, Artificial Sequence
  Description of Artificial Sequence: Synthetic coding sequence
atggcgccagctgcggatcgggagggttattggggtcccactaccagcactcttgactggtgcgaggagaattactccgtgacatggtacatcgctgagttttggaatacagtgagtaatctgattatgattatccctccgatgtttggtgctgtgcagagtgtcagagacggactagagaagcgctatatcgcttcatacctcgcgctgaccgttgtggggatgggttcttggtgctttcatatgactctgaaatacgaaatgcagctgctagatgagttgcctatgatatacagctgctgtatcttcgtgtactgtatgttcgagtgcttcaaaattaaaaactcggttaattaccaccttctctttacactggtgttgttcagcttgatcgtcactacagtgtatctgaaggtaaaggagcctatttttcaccaggtgatgtatgggatgctcgtctttacgctcgtgcttcgttccatctacatcgtgacctgggtgtacccatggttaagggggctcggttacacatcccttggcatattccttttgggcttcctgttctggaatatagacaatattttttgcgaatcactccgcaactttcgtaaaaaggtgccacctattataggcatcactacccagtttcacgcatggtggcatattcttaccgggctgggcagctaccttcatatactcttctcgttatatacacgtactctgtacttgagatatcgccctaaagtgaaatttctttttgggatttggccagtcattttgtttgaacctctccgtaagcactag

SEQ ID NO: 48280 - DNA, 693 bp, Artificial Sequence
  Description of Artificial Sequence: Synthetic coding sequence
atggccccagctgcagatagagagggttattgggggcctacgacttccactctcgactggtgtgaggagaactacagtgttacctggtatatcgctgaatttcttgtgggtatgggttcttggtgcttccacatgactctcaaatacgagatgcagctgctagacgagctgcccatgatctactcatgctgcatctttgtgtattgtatgtttgagtgttttaagatcaagaactctgtgaactaccatcttttgtttacgctcgtactcttttcactgatcgttaccactgtctatctgaaagtgaaggaacccatctttcaccaggtgatgtatggcatgctcgtgttcaccctagttttgcgcagcatctatatcgtcacatgggtgtacccatggctgcgcggtctgggatacacaagtctgggaatatttcttctgggttttctgttctggaatattgataatatattttgcgaaagtctgcgcaattttaggaagaaggtgcccccaatcattggcattacaacacagtttcacgcctggtggcacatcctgacgggcttggggagttacttgcatatcctgttctcactgtacaccaggaccctttatctccgctaccggccaaaagtaaagtttctgtttgggatctggcctgtcatattattcgagccgcttcgcaaacattag

SEQ ID NO: 48281 - DNA, 678 bp, Artificial Sequence
  Description of Artificial Sequence: Synthetic coding sequence
atgatcattccgcctatgtttggtgcagttcagagcgtccgggacggcctagaaaagcgttatatcgctagttatcttgccctcactgtggtgggtatgggcagctggtgcttccacatgaccctgaagtacgagatgcagttacttgatgagctgcccatgatctactcctgttgcatctttgtctactgtatgtttgagtgctttaagataaagaattctgtcaactaccacctgctcttcacgctggttttgttcagcctgattgtcaccactgtatacctcaaggtgaaagagcctattttccatcaggtgatgtacggaatgctcgtgttcacattggtgctgcgcagcatctacatagtgacctgggtgtatccatggctgcgcggtctgggctacacttctttggggattttcctgcttggatttctcttctggaatatagataatatcttctgtgagtctctgcggaacttcagaaagaaagtgccaccaataattgggattactactcagttccacgcctggtggcacattctcactgggctgggttcttaccttcacatcttgtttagcttgtatacacggacgctgtacctgaggtaccggccaaaagttaaattcttatttgggatctggccggtcatcctgttcgagccccttcgtaagcattag

SEQ ID NO: 48282 - DNA, 405 bp, Artificial Sequence
  Description of Artificial Sequence: Synthetic coding sequence
atggctcagtccagattgattggcacctccaccagccaggtgatgtatggtatgttagtgtttaccctggtgcttcggtccatttacattgtgacctgggtctacccttggctgaggggactagggtacacttccctgggtatttttctcctgggcttccttttctggaacatcgacaatattttttgcgagagtttaaggaactttcggaaaaaagtccccccaataatcggtattacaactcaattccatgcctggtggcacatcttgacgggactaggctcgtatttgcatatcctcttcagtctctacacacgtaccctgtacttaaggtaccgaccgaaggtcaaatttctcttcgggatctggccagttattctgttcgagcccctgcgaaaacattag

SEQ ID NO: 48283 - DNA, 453 bp, Artificial Sequence
  Description of Artificial Sequence: Synthetic coding sequence
atgtctggagagctgtccaaccgcttccagggagggaaagccttcggtttgcttaaggctcggcaggaacgtcgcctcgcagagattaacagggaattcctgtgtgatcagaaatatagcgacgaggaaaacttgcctgagaagctgacagcattcaaagagaaatacatggagttcgatctgaataacgaaggcgagatcgacctgatgagtctgaagaggatgatggagaaactgggagttcctaagacccacctagagatgaagaaaatgatttcggaggtcaccgggggagtctccgataccatctcttatagggatttcgtgaatatgatgttaggtaagcgttctgccgttctgaaacttgtgatgatgtttgaagggaaggcaaacgaaagctcccccaagcctgtcggcccacctccggagagggatatcgccagcctgccttag

SEQ ID NO: 48284 - DNA, 309 bp, Artificial Sequence
  Description of Artificial Sequence: Synthetic coding sequence
atgtctggcgagctaagcaatcggttccaggggggtaaggcattcggcttgctgaaagctaggcaagagcgcagattagcagagataaacagggagtttctgtgtgatcagaagtactcagatgaagaaaacttacctgagaagctcacggcttttaaagaaaaatatatggagtttgatctcaataacgaaggagaaattgatctgatgtcattgaagaggatgatggaaaaactgggggtgccaaaaactcatcttgaaatgaagaagatgatttccgaggttaccggcggtagccacgacgtgtag

SEQ ID NO: 48285 - DNA, 285 bp, Artificial Sequence
  Description of Artificial Sequence: Synthetic coding sequence
atggagttcgacttaaacaatgaaggggagattgacctgatgagccttaagcgtatgatggaaaagttgggcgtccccaaaacgcacctagaaatgaagaagatgattagtgaggttacaggaggtgtgtctgatacaatcagctaccgcgatttcgtgaatatgatgctgggcaaacggtctgccgtccttaaactggttatgatgttcgagggcaaggccaatgagagcagcccaaaacctgttggaccgccacccgaacgagatatcgcctctttaccttag

SEQ ID NO: 48286 - DNA, 429 bp, Artificial Sequence
  Description of Artificial Sequence: Synthetic coding sequence
atgagcggagagctgtcaaaccggtttcagggcggaaaagcctttggtctgcttaaagccagacaggagcggagactcgccgaaattaacagagaatttctttgcgaccagaaatactccgatgaggaaaacctgccagagaagttgaccgctttcaaggagaagtatatggagttcgacttgatgagcctgaaacggatgatggagaagcttggcgtgcctaagacccacctggaaatgaaaaaaatgatatccgaagtgactggcggtgttagtgacacaatttcgtatcgggatttcgttaatatgatgcttggcaagcggtcggccgtgctgaaactggtgatgatgttcgagggtaaggctaatgagagcagcccaaagccagtaggaccccctcctgaacgagatatcgcgtccctgccctag

SEQ ID NO: 48287 - DNA, 531 bp, Artificial Sequence
  Description of Artificial Sequence: Synthetic coding sequence
atgagtggcgagctcagcaatagatttcaggggggtaaggcgttcggactgttgaaggcccgacaggaaagaaggctcgcagagatcaaccggtactgtgcaggaagagaaccccaacttcagcggatatcatgttcacagcactcgtgcctgcttgctcttttattccaagaatttctctgtgatcaaaagtactctgatgaggagaatttacccgagaaactgacggcattcaaggagaagtatatggaattcgatctgaacaatgaaggcgagatcgatctgatgtcattgaaaagaatgatggagaaattgggtgttccaaaaactcacctcgagatgaagaaaatgatttcagaagtgacgggcggtgtatctgacaccatctcttacagagattttgtcaacatgatgctggggaagcggagtgctgtgcttaaactcgtcatgatgtttgaaggcaaggccaatgagagtagccctaagcctgtcggtcctcctcccgagagggacattgccagccttccctag

SEQ ID NO: 48288 - DNA, 468 bp, Artificial Sequence
  Description of Artificial Sequence: Synthetic coding sequence
atggccagtaagatggtaatttctgcacacccaaaaatcctgttgcagctgatccagaaggataaacctggagggccaggagcacgcgtaagacagaaagtgctcgaagaatttctgtgcgaccagaagtattctgatgaagagaatttgcccgaaaagctgaccgcttttaaagagaagtatatggagttcgatctgaataacgaaggcgagatagatctgatgtccctgaagcggatgatggagaaactcggcgttcccaaaacccacctcgaaatgaagaagatgatttccgaggtgaccggaggtgtaagcgataccatttcctaccgcgatttcgtgaatatgatgctgggtaagcgatcagcagtactgaagctggtgatgatgtttgagggaaaggcaaatgaatccagccccaagcctgtcggcccaccacctgaaagagacattgctagcttaccctag

SEQ ID NO: 48289 - DNA, 1023 bp, Artificial Sequence
  Description of Artificial Sequence: Synthetic coding sequence
atgcgcaaggaactgcagctcagtctgagtgtgacacttctcctggtgtgtggttttctgtatcagttcacgctgaaatcatcatgcctattctgcctgccatctttcaaatcccaccagggactggaagctctactctcacatagacgtggaatcgtgtttctggaaactagcgagcggatggagccacctcatttagtatcatgttctgtcgagtccgccgctaaaatctacccagagtggcctgttgttttcttcatgaagggcctcacagatagcacaccaatgccatcaaattccacctatcccgctttctccttcctctccgctatagacaatgtgtttctgtttcccctcgatatgaagcggcttctggaggacactccattgttctcttggtacaaccagatcaacgcaagcgccgagcgcaattggctccacatctcaagtgatgcttcccggctggctatcatatggaaatacggaggcatttatatggataccgacgtgatatcaatccgacctatcccagaggagaattttctcgccgctcaggcctcacgatactcttcaaatgggattttcgggttcctaccccatcacccttttctttgggagtgtatggagaattttgtcgagcattacaacagtgccatctgggggaaccagggaccagagctgatgacccgaatgctgagagtttggtgcaagttagaagattttcaggaggtctctgatctgagatgtcttaacatttccttcctgcatcctcagcgcttctacccgattagctaccgtgagtggcggagatattacgaagtgtgggacacggagccatcattcaatgtgtcttatgctctgcacctgtggaatcatatgaatcaagaaggacgcgctgtcattcgcggatctaacaccctagtggaaaatttatacaggaagcactgccccagaacatatagagacctgataaaaggacccgaaggctctgtgacgggcgagctcggaccaggcaataaatag

SEQ ID NO: 48290 - DNA, 1518 bp, Artificial Sequence
  Description of Artificial Sequence: Synthetic coding sequence
atggagcagaccgagaaaagcaaggtgtacgctgaaaacgggctactggaaaaaattaaactgtgtctgagtaaaaagccgcttccatctcctactgaaaggaagaaatttgaccacgattttgcaatttccaccagcttccatggcatccacaacatcgttcagaatcgctctaagatcagaagagttctgtggctggtggtggtcttggggagtgtaagcttggttacttggcagatttacattcgactgctaaactatttcacatggccgactacaacctcaattgaagtgcagtacgtggagaagatggagtttcctgccgttacattctgcaatctgaaccggttccagaccgatgcggtggccaagttcggtgtcatcttcttcctgtggcatatcgttagtaaggtgttacatttgcaggaaataaccgctaactctaccgggtctagagaagcaactgattttgcagcctctcatcaaaacttcagcatcgtcgaattcattaggaacaaagggttttatctgaataactcgactctgctcgactgtgaatttttcgggaaaccatgctccccaaaagattttgctcacgttttcacggagtatggcaattgctttacttttaaccacggcgaaacactccaggccaagcgcaaagtgtcagtcagcggcaggggcctgtcacttttattcaacgtgaatcaagaggcgtttactgacaacccagcactgggattcgtcgacgctggaattatttttgtcatccactcccccaaaaaggtgccccagtttgatggtctgggcctcctgtccccagtgggcatgcatgcgcgagtcacaatacgtcaagtgaaaacggtgcaccaggaatatccctggggcgaatgcaatcctaatattaagttacagaattttagcagttatagcaccagtgggtgcctgaaggagtgcaaagcccagcacataaagaaacaatgcggttgcgtacccttcttgctgcctggatacggaatcgaatgtgacctgcagaagtacttctcctgtgttagcccagtgctagatcacatcgagttcaaggatctctgcaccgtgggtactcataactcctcatgcccagtctcgtgcgaagaaattgaatatccagcaactatctcttactcgagtttcccttctcagaaggcgctaaagtatctaagcaagaagttgaaccaaagcaggaaatacattagagaaaacttggtgaagatcgagatcaattacagcgacctgaactacaaaatcacgcaacagcagaaagcagtttcagtgagtgagttgctggccgatttaggcggacaacttggattattctgcggggcaagcctcatcacaattatcgagataattgagtatctgttcacgaatttttattggatttgcattttcttcctcctgaagatctccgagatgactcagtggactccaccccctcagaaccacctcggcaacaagaatcggatcgaggagtgctag

SEQ ID NO: 48291 - DNA, 2973 bp, Artificial Sequence
  Description of Artificial Sequence: Synthetic coding sequence
atgggacctccctcatctagtggattttacgtctctcgggcagtggccttgctgctggctggcttggtggctgctctgttgctagccctcgctgtgctcgctgcactatacgggcattgtgagagggtgcctcccagcgagctcccagggctcagagaccttgaggctgaaagctctcctccactgcgacagaaacctactcccacccctaaaccgagcagcgctagggaactggctgttacaaccaccccctcaaactggaggcctccaggtccctgggaccagttgagactgcccccatggcttgtaccacttcattacgatctcgagctctggccccagcttaggcccgatgaactgccggcaggttccctaccattcaccggaagggtcaacatcaccgtgcggtgcactgtcgcaacatcacgactgctcctccactctctgttccaggattgtgagagagctgaagtcagaggtccattgagccctgggaccggaaacgcaaccgttgggagggtcccagtggatgacgtgtggtttgctttggacactgaatacatggtgcttgagctcagtgaaccgctcaagccaggaagctcctatgaactgcagctctcattctccggcctggtgaaggaggatcttagggagggacttttcctgaatgtgtacactgatcaaggcgagcggagagcccttctcgcatcccagctcgagccaactttcgcgcgttacgtctttccgtgctttgatgaacccgcactgaaagctactttcaatatcactatgatacaccacccgtcctatgtggctttgtccaacatgcctaaactgggacaatccgagaaggaggacgtgaatggcagtaagtggactgtgaccacattcagcacaactccacacatgcccacgtatctagtggcctttgttatttgcgattacgatcatgtcaaccgaaccgagcggggaaaggagattcgcatttgggcacggaaagacgctatagcaaatggttctgccgattttgctctcaatatcactggcccaatcttttcattcctggaagacctatttaacatcagttattccctgcctaagacggatattatagccctgcctagtttcgataatcatgctatggagaactggggcctcatgatctttgatgagtcgggactgttactcgagccaaaagatcagcttaccgaaaaaaagactctgatttcctacgtcgttagtcatgaaataggtcatcagtggttcggtaatttggtaaccatgaactggtggaacaacatctggctgaacgagggctttgccagttattttgagttcgaagttatcaattacttcaaccctaaactcccacggaatgagattttctttagtaacatcttgcataacatcctgcgagaggaccatgcacttgttacgcgcgcagtagctatgaaggttgagaattttaaaacaagtgaaattcaggagctgttcgatatctttacttatagtaaaggtgcgtccatggctagaatgctcagctgttttctaaatgagcacctgtttgttagtgcgctgaagtcttacctgaaaacattctcatactcaaatgccgagcaagacgacctttggaggcatttccaaatggcgatcgacgatcagagcacggtcattctgccagctactatcaaaaacattatggattcatggacccaccagtctgggtttccagtgatcactctaaatgtaagcacgggggtgatgaaacaggaacctttctatctggagaacattaagaatcggacccttctgactagtaacgatacttggatcgtcccaattctgtggatcaaaaacggcaccactcaaccactagtctggctggaccagagttcaaaggtcttccccgaaatgcaggtgtccgactccgaccatgactgggtcattctgaacctaaatatgacgggctattatcgcgtgaattacgataagctcggctggaaaaaactcaatcagcaacttgaaaaggatccaaaagccatccccgtaatccaccgcctgcagctgatagatgatgcgttttccctgtccaaaaataattatatcgaaatcgagaccgccctagagttgacaaagtacctggctgaggaggatgagatcattgtctggcacactgtgcttgtgaacctcgttacacgggaccttgtctcagaggtcaacatctacgacatatactccttgctgaaacgatatcttctcaaaaggttgaacctgatctggaatatctattccaccatcattcgggagaacgtcttggccctgcaggatgactatctcgcactcatcagtctggaaaaactattcgtgacagcttgctggttggggcttgaggactgccttcaactgtccaaggagctattcgccaaatgggtggaccaccccgaaaacgagatcccttacccgatcaaggatgtggtcctgtgttacgggatagccctaggttccgataaagaatgggatattctgctgaacacttacaccaacacgaccaacaaagaggaaaaaattcaactggcgtacgccatgtcgtgctctaaggatccctggattctcaatcggtatatggagtatgccatcagcaccagtcctttcacaagtaatgagacaaatatcatcgaggtcgtggcttcctctgaagttggcaggtacgttgccaaggacttcctagtgaataactggcaggccgtgagtaagagatacggtacacaatctttgattaatctaatatacactataggaagaaccgtaaccaccgacctgcagattgtggagctgcagcagttcttctctaatatgcttgaggaacatcaacgcattcgcgtgcacgcaaacctgcaaaccatcaaaaacgaaaatctcaaaaataagaaactatccgctcgcatagccgcatggctgcgtcgcaacacttag

SEQ ID NO: 48292 - DNA, 2940 bp, Artificial Sequence
  Description of Artificial Sequence: Synthetic coding sequence
atggggcctccaagctcctctgggttttatgtaagtagggccgtggcactcctccttgctggtttagtggcagccttgctgttggcactagccgtactggcagccctatacgggcactgtgagagagtgccacctagtgaactgccagggttgagagatctggaagcagaatccagtccccctctgagacagaaacctaccccaacgcccaagccttcctcagctagagaactcgccgtcaccacaacaccttctaactggcgcccacctggaccctgggaccagctgaggttgcccccttggttggttccactccactatgatctggaactctggccgcagcttcgtcctgatgaattaccggcaggctccttaccctttaccggccgagttaatatcacagtcagatgtactgtggccacatcacgtctcctgttgcattccctcttcctttcccccggtacaggtaacgccactgtgggtcgagtgcctgtcgatgacgtatggtttgctttggatacggagtacatggtgctggagttgagcgaaccgttgaagccgggtagttcgtacgagctgcaacttagctttagcgggttggtgaaggaggacctgcgcgaggggctgttcctgaatgtgtataccgaccagggcgagcgccgagcgcttctggccagccagttggagcccactttcgcccgatacgtatttccgtgctttgatgagcccgcacttaaggcaacgtttaatattaccatgattcaccatccaagttacgtggcactgtccaacatgcccaagctaggccagagtgagaaggaggacgtcaacggatctaagtggacagtaaccactttcagcaccaccccccacatgcctacttatttggtcgcctttgtgatctgcgattatgatcacgtgaacagaaccgagcggggaaaagagatacggatctgggcacgcaaagacgcgattgcaaatggaagcgctgactttgcgctgaatattacagggccaatctttagttttctggaggatctattcaacatcagctattcgttaccgaagacagatattatcgctcttccctcctttgataatcacgccatggaaaactggggcctcatgatttttgatgagtccggcctcctcctcgagcctaaggaccagttgaccgagaagaaaacgttgattagctacgtcgtgtcacatgagatcggccaccagtggttcggaaacctcgtcactatgaattggtggaacaatatttggctcaacgagggattcgcaagttatttcgagttcgaggtcatcaattactttaaccccaaactgccccgaaatgagatcttcttctcgaacatcctgcacaatattcttagagaggaccatgctcttgtgacaagggcagttgcaatgaaggtcgagaacttcaagacgagcgagatccaggaactgttcgatatctttacatactctaagggggcatcgatggccaggatgctttcctgttttcttaatgagcatctcttcgtgtctgcgctgaagtcttacttgaagacattcagctactctaatgcggagcaggatgatctatggagacactttcagatggctattgatgatcagagtactgtgattctgccggcaactataaagaatattatggactcttggacccaccagtccgggtttccagtgattactctcaacgtttctaccggagtaatgaagcaggagccattttaccttgaaaacatcaagaatagaacgctgctaacatccaacgatacatggattgtccccattttgtggattaaaaacggcactactcagccactcgtgtggctcgaccaaagcagtaaggtttttccagaaatgcaggtttccgatagcgatcacgactgggtgattcttaaccttaacatgaccgggtattatagggtcaattacgacaaactgggttggaaaaagctgaaccagcaactcgagaaggacccaaaggccatacccgtgatccatcgattgcagctgatagacgatgctttcagcctgagcaagaacaactatatagagattgagaccgctctggaactgacaaagtacctcgccgaggaggacgagatcatagtgtggcatacagtactggttaatctcgtgacaagagacctggtcagtgaagtcaatatatacgatatctatagcctcttgaaaagatacctgcttaaacggctgaacctcatctggaatatatacagtacaattatacgcgaaaacgtgctagcgctgcaagatgattacctggcccttatctcgttggagaagttgttcgtcactgcgtgttggctggggcttgaggattgtctgcaactctccaaggagctcttcgctaagtgggtagatcatcctgaaaatgagatcccctacccaatcaaagatgttgtcttgtgctacgggatcgcacttggatccgacaaggaatgggacattctcctcaatacttacacaaataccaccaacaaggaagagaagattcagctggcctacgcaatgagctgtagcaaggacccatggattttaaatagatacatggagtacgctatctccacctccccctttaccagcaacgagacaaacataatcgaggttgttgccagtagcgaggttggacgatatgtagccaaagactttctggtcaacaattggcaagctgtgtcaaaaaggtacgggacgcaatccctcatcaacttgatctacaccattgggcgtaccgtcactacagatcttcagattgtcgagttacaacagttcttctccaatatgcttgaggagcatcagaggataagagtgcacgccaatttacagactatcaaaaatgaaaacctgaagaataagaaactttctgccaggatcgcagcctggctccgtagaaacacgtag

SEQ ID NO: 48293 - DNA, 681 bp, Artificial Sequence
  Description of Artificial Sequence: Synthetic coding sequence
atgaaggtagagaatttcaagacctctgagatccaggagctctttgacatatttacatactctaagggcgcttccatggctcgaatgctgtcgtgctttctaaacgaacatttattcgtgtctgcacttaaaagctacctgaaaacctttagttacagcaacgccgaacaggacgacctgtggcgacacttccagatggcaatcgatgaccagtctaccgtgatcttgcccgctaccattaagaacattatggacagctggacacaccagagcggtttcccagtaattacattgaatgtttcgactggcgtcatgaagcaggaaccattctaccttgagaacattaaaaatcgaactttgttgacctcaaatgatacatggatcgtgccaattctttggatcaagaacggaactacccagccactggtttggctggaccaatcttcaaaggttttccccgagatgcaggtaagtgactcagatcatgactgggtgattctgaatttgaacatgactggatattatcgagtgaattacgataaattgggctggaaaaaactgaatcagcagctggagaaggaccctaaggcaattcccgtaatccatcgcctccagctgatcgacgacgcctttagtttgtccaacctccaggactttggtcatctaaaggttccaaattag

SEQ ID NO: 48294 - DNA, 519 bp, Artificial Sequence
  Description of Artificial Sequence: Synthetic coding sequence
atgggggaaagctccgaggatatcgatcaaatgttttctacgttgctaggtgagatggatttgctgacccagtctctgggtgtggatacactgcctccccctgatcctaatccaccaagagccgagttcaattatagcgtcggattcaaggacctgaacgaatccctgaacgccctagaagatcaggacttggacgccttgatggcagatctggtcgccgatatcagtgaggccgagcagcggacaatacaggcccagaaagagagtctgcagaatcagcaccactctgcaagcctccaggcctcaatatttagcggggctgcttctttgggatatggaacgaacgtcgccgctacgggtatttctcagtacgaagatgacctcccgcctcctccagctgacccagtgctggacctgcctctcccccctccccctccagagccgctgagtcaggtatccatgtgggaccagcgatggcaggatcaccaacctttattgccgatcactgatgtcccatag

SEQ ID NO: 48295 - DNA, 2001 bp, Artificial Sequence
  Description of Artificial Sequence: Synthetic coding sequence
atgggggaatcgtcagaagacatcgaccagatgttttcaactctccttggtgagatggacttgttgacccaaagtctgggtgtcgacactctcccaccacctgatcccaatcccccacgggctgagtttaactacagtgttggcttcaaggaccttaacgaatccctaaacgctttagaagatcaggatctggacgcactgatggctgacctcgtggccgatattagtgaagcagagcagcgtactatacaagctcaaaaagagagcctccaaaaccagcatcatagcgcgtctctgcaggcctccattttctcgggagccgcatccttggggtatggcaccaatgtagcagctaccggcatctcccaatacgaggacgacttgccgccaccaccagcggatcccgtccttgaccttccactgcccccacctcccccagagccactgtcacaggaggaggaagaggcccaggcaaaggccgacaagatcaagctagccctcgaaaagttgaaggaagctaaggtgaaaaagctggtggttaaggtgcatatgaatgacaacagcactaaaagcctgatggtagatgaacgacagttagccagggatgtgcttgataacctgttcgagaagacccactgtgattgtaacgtggactggtgtctttacgaaatttacccagaactgcagatcgaacgtttctttgaagatcacgagaatgtggttgaagtcctgtcggactggacacgtgacaccgagaacaaaatcttattcctggagaaggaagaaaagtacgccgtgttcaagaatccgcaaaacttttacctggacaacaggggcaaaaaggagtccaaagaaaccaatgagaagatgaatgccaagaacaaggagtctcttcttgaagaaagcttctgtggaacctcgatcatcgtacccgagctggagggtgctctgtacctaaaagaagatggcaagaaatcgtggaaaaggcgctattttctgttgcgagcctcaggcatttactacgtgcccaaggggaaaaccaagacaagcagggacctggcctgttttatacagttcgagaacgtgaacatctactacgggacacaacataaaatgaaatacaaagctcctacagattattgcttcgtgctgaaacatcctcagatccaaaaggagtcccagtacatcaaatacctgtgctgcgacgacacacggactttaaatcagtgggtgatgggtatacgcattgccaagtacggcaagacactttacgacaattaccagagggctgtggctaaggcgggtctagccagccgatggaccaatctgggaaccgtcaacgcagctgcccctgcacagccttcaaccggcccaaagaccggtacgacgcagcccaacggccagattccacaggcaacccactccgtgagcgcagtcctgcaagaagcccaaagacatgccgaaaccagcaaggataagaagcctgcactgggcaatcatcacgaccccgctgtgcccagggcccctcatgcgcctaagtcaagtttgcctccccctccacccgtcaggaggtcatccgacacgagcggatcgccagccacacctttgaaggcaaaggggacagggggagggggtctgccagcccctcctgatgactttctgccccctcccccaccgcctcccccactggacgatcccgaactccccccaccaccacctgattttatggagccacctcctgacttcgtcccacctcctcctcccagctacgccggtattgccggaagtgaactgccaccaccccctcccccacctcctgctccagcacccgcacccgtgcctgatagcgcacgccctcctcctgctgtcgcaaaaaggccacccgtcccacctaaacgccaggaaaatcctggacacccgggtggagccggaggcggtgaacaggattttatgtcagacctgatgaaggcccttcagaagaagcggggaaacgtcagttag

SEQ ID NO: 48296 - DNA, 1908 bp, Artificial Sequence
  Description of Artificial Sequence: Synthetic coding sequence
atgggagagtctagcgaggacatcgaccagatgtttagtacactcctcggagagatggacctgctgacccagagcctgggtgtggacactcttcctcccccagatcctaacccacccagggccgagttcaactactcagtggggttcaaagatctgaacgagagcctgaatgccttagaggaccaagatttggatgccctgatggccgacttggtcgcagacatatccgaagctgagcagaggaccatacaggcccaaaaagaaagtctgcaaaatcaacaccatagcgccagcctgcaggcctctatcttctccggggcagcgtccctgggctacgggacaaacgtggcagctaccggtatctcccaatatgaagacgatctgccccctccacctgccgacccggttttagacttgccattacccccaccaccccctgagcccctgtcacaggaagaagaagaagcccaagccaaggcagacaaaatcaagcttgccctcgagaagctgaaggaggctaaggtgaaaaagctcgtggtgaaagtgcatatgaatgataactcaacaaagtctcttatggtggatgagagacaacttgccagggatgtgctggataatctattcgaaaaaacccactgcgattgcaacgtcgattggtgtctatatgaaatttaccccgaactccagattgagcgcttcttcgaagaccacgagaacgtcgtcgaggttttgtccgattggaccagggataccgagaataagattctgtttttggaaaaggaagagaagtatgccgtgtttaaaaacccccagaacttttacctggacaatagaggaaaaaaggaatctaaagaaacaaatgagaaaatgaacgccaagaacaaagagtccctgcttgaggagagtttctgcggtacgagcattatcgtgccagagcttgaaggcgctttgtatctgaaagaagatggtaaaaaatcttggaaaagacgatacttccttctgagagcgtcaggtatttattacgtacccaaaggcaagacaaaaaccagccgagatctggcctgctttatacagttcgagaatgtgaacatttattatggaacccagcacaaaatgaagtacaaagcaccaacagattactgtttcgtgctgaagcacccacagatacagaaggagtcgcagtatatcaaatacctgtgctgtgatgatacacgaactctgaatcagtgggttatgggaattaggatagctaagtatggaaagacactctatgataactatcaacgtgcagttgccaaggctgggctggcttccaggtggaccaatctgggtaccgtgaatgccgcagctcccgctcaaccaagtaccgggcctaaaaccggtaccacgcagcccaatggccaaatcccccaggctacccactctgtatccgccgtgttacaggaggcccagaggcacgccgaaacctctaaagacaagaaaccggcactcgggaatcaccacgatccagccgtgccccgtgctccacatgctcctaaaagtagccttcccccaccgcctcccgtgcgcaggagttccgacactagcgggagtccggcaacccccctgaaggccaaaggcactggcggagggggattgccggctgctcgcgcaagggctcggccaaggcctcggctgcgccaggccgcacctagaggtggccaagaggcttcatgtgctcctcaggaggcccgagagccaagggctccacgaaggtctagacgccgtggcgctaggttccatgtgagaccccacgagagctttgctaaggaggaaaggcagagggtcttaggtaccggaatgatgagtgtgcccgagggagaggcctctctcactcctagtgcaggattcgcctcgagactgccttag

SEQ ID NO: 48297 - DNA, 738 bp, Artificial Sequence
  Description of Artificial Sequence: Synthetic coding sequence
atggctctagtgccgtgtcaagtgctgagaatggccatacttttaagctattgctcaatcctgtgcaactacaaagcaatcgaaatgcctagccaccagacatatggcggatcctggaagttcctgaccttcattgaccttgtaatacaggcggtgttcttcggtatatgcgttttgaccgatttgagcagcctattgacaagaggtagtggcaaccaagaacaagaacggcagctcaaaaagcttatcagtctgcgggattggatgcttgccgtgctagcatttccggtgggcgtgttcgtcgtggctgttttctggataatctacgcctatgaccgggaaatgatctatcccaaacttctggacaacttcattccgggatggctgaatcacggcatgcacaccaccgtcttgccattcatccttattgaaatgaggacttcacaccaccaatacccctcccgctcctctggcttgaccgccatctgcacgttcagcgtgggatacatactctgggtgtgctgggtacaccatgtcacaggcatgtgggtgtatccattcctggaacacatcggaccaggcgctagaattatctttttcggatcaactactatcttgatgaactttctttatctgctaggggaggtgctgaacaattacatttgggacacacagaaaaaacccccatcctggcaagacatgaagattaagttcatgtaccttggcccatcatcctag

SEQ ID NO: 48298 - DNA, 561 bp, Artificial Sequence
  Description of Artificial Sequence: Synthetic coding sequence
atggccctggtgccatgtcaagtcttgaggatggccatcctgttgtcctattgctccattctgtgcaattataaagcaatcgagatgccctcacatcaaacttatgggggatcctggaagtttctaacttttatagacctgttcgtggtagcagtgttctggatcatttatgcctatgatagagaaatgatttatcccaagctgctggacaactttatccctgggtggcttaaccatggtatgcacaccaccgtgctgccgttcatcctgatcgagatgcgcacatcacaccaccagtatcccagccggtcctccggcctgactgccatctgtacatttagcgtggggtacattttgtgggtctgttgggttcaccatgttacgggaatgtgggtatatccctttctggagcacatcggtccgggagctcggatcatattcttcggaagtaccactattctcatgaacttcctgtaccttcttggtgaggtgctcaataactacatatgggacacccagaagtccatggaggaggagaaggaaaagccaaaactcgagtag

SEQ ID NO: 48299 - DNA, 717 bp, Artificial Sequence
  Description of Artificial Sequence: Synthetic coding sequence
atggctctggttccctgccaggttctgcggatggccattctgctctcttactgctcaatcctgtgcaattacaaggcaatcgagatgccctctcaccagacatatgggggttcttggaagtttctcacattcatcgacctagtcatccaagccgttttcttcggaatctgtgtcttgacagatcttagctccctgcttacaagaggctcaggtaaccaggagcaagagcggcaactcaagaagctgatctcactgagagactggatgctggctgtgctggcttttccagtgggggtgttcgtcgtggcagttttttggataatatacgcgtatgaccgggaaatgatttaccccaaactgttagataactttattcccggatggcttaaccacggaatgcacacgacggtgctgccattcatattgatagagatgcggaccagccatcaccagtatccaagccgttccagtgggttgacagctatctgcactttcagcgtgggctatatcctgtgggtgtgctgggtgcaccacgtcacaggaatgtgggtctatcctttcttagagcacatagggcctggcgctaggattatcttttttgggagcacgacaattttgatgaacttcctgtatcttcttggcgaagttctgaataactatatctgggatacacagaaatctatggaagaggaaaaggaaaaaccaaagctagagtag

SEQ ID NO: 48300 - DNA, 144 bp, Artificial Sequence
  Description of Artificial Sequence: Synthetic coding sequence
atggccctcgtgccgtgccaggtgctcaggatggccatactgctctcctactgctctattttgtgtaactataaggccatcgaaatgccatctcatcagacatacggcggatcatggaaatttctaacatttattgacctttag

SEQ ID NO: 48301 - DNA, 405 bp, Artificial Sequence
  Description of Artificial Sequence: Synthetic coding sequence
atggcactggtgccgtgccaagttctgcgtatggctatccttctctcgtattgctctatactgtgcaattataaagctattgaaatgcccagccaccagacctatgggggatcttggaaatttctgacattcatagacctggtgatccaggccgtgttcttcggaatttgcgtcctgaccgacctctcttctttattgacgcgaggaagcggaaaccaagaacaggaacgtcaacttaagaagctcatctctctacgcgattggatgctcgcagtgctggcctttcccgttggtgtctttgtcgtcgccgtgttctggatcatttacgcctatgacagggagatgatttaccctaagctgttagataattttattccaggttggcttaaccacgggatgttgtag

SEQ ID NO: 48302 - DNA, 579 bp, Artificial Sequence
  Description of Artificial Sequence: Synthetic coding sequence
atgaccaaggtgttgagaatggcaatcttactgtcatactgttccattctctgtaattataaggccatcgagatgccaagtcaccagacttacggcggaagctggaaatttctgacttttattgacttggttatccaggcagtgttcttcggtatctgtgtcctgaccgatctgagctccctactgacacgcggatctgggaatcaggaacaggagaggcagttaaagaagcttatcagccttagggattggatgttggccgtgctcgcctttccagtgggagtgtttgttgtcgctgtgttctggattatttacgcatacgacagggagatgatatacccaaaactcctggacaactttatccctgggtggctgaatcatggtatgcataccactgtgttaccttttatactgattgaaatgagaacatctcaccaccagtacccctcccggtccagcggattgactgcaatttgcaccttcagtgtcggatacatcttatgggtttgttgggtccaccacgtgacgggtatgtgggtgtacccctttttagagcacatcggtccaggagccagatag

SEQ ID NO: 48303 - DNA, 705 bp, Artificial Sequence
  Description of Artificial Sequence: Synthetic coding sequence
atgacaaaggtcttgcgaatggcaattctcctctcttactgtagcattctgtgcaattacaaggctatcgaaatgccatcccaccagacttacggaggaagctggaaattccttaccttcatcgacctggttatacaggccgtgtttttcggaatatgtgtgctgaccgacttgtccagtcttctgaccaggggtagtggaaatcaggagcaggagcggcagctgaagaagctaatatcccttcgggattggatgttagccgttttagcattccccgtgggagtgtttgttgttgcagtgttctggattatatatgcgtatgatcgggaaatgatctacccaaagctcctggacaacttcatcccgggttggctgaatcatggcatgcacaccaccgtattgccgtttatcttgatagaaatgcggacatctcatcaccagtaccctagtaggtctagcggactgaccgccatctgcacttttagcgtgggctatatcctctgggtgtgttgggtccaccacgtaactggcatgtgggtctacccgtttctggagcatatcggccctggggcacggattatattcttcgggtcaaccactatcctcatgaattttttgtacctcctcggagaagtactaaataactacatctgggacactcaaaagtcaatggaagaagaaaaagagaagcccaagctggagtag

SEQ ID NO: 48304 - DNA, 375 bp, Artificial Sequence
  Description of Artificial Sequence: Synthetic coding sequence
atggctctggtgccttgccaggtgttgcggatggctattctgcttagctattgttccatcctgtgtaactacaaggcaatcgagatgcctagtcatcagacatacggtggtagctggaaattcctgactttcatcgacctttttgttgtagccgtcttttggattatatatgcttatgaccgcgagatgatctacccaaagctgcttgacaatttcattcccggttggttgaatcacgggatgcatacaactgttctgcccttcattctgattgagatgcgaacctcccaccaccagtacccctctaggtccagcggactgactgccatttgtacattctccgtgggttacatcctctgggtatgctgggtatag

SEQ ID NO: 48305 - DNA, 417 bp, Artificial Sequence
  Description of Artificial Sequence: Synthetic coding sequence
atgctggctgtcctggcgttcccagtaggggtatttgtggtcgctgtcttttggattatctacgcttatgatcgggagatgatttatcctaagctgctggacaattttattccgggatggctgaatcatggcatgcatactacagtcctgccatttatcctcatcgaaatgcgtaccagccaccaccagtacccaagcagatccagtgggctcactgcaatatgtacatttagtgtggggtacatcctctgggtctgttgggtgcatcatgtgaccggtatgtgggtttatcctttcttggaacacataggcccaggggctcgcatcatattttttggttccaccacgattcttatgaattttctttacttactgggagaggttctgaataactacatttgggatacacagaagtag

SEQ ID NO: 48306 - DNA, 1305 bp, Artificial Sequence
  Description of Artificial Sequence: Synthetic coding sequence
atggagtccgaatctgagagtggcgcagccgctgatacgcctcctctcgaaacactcagcttccatggtgacgaggaaattattgaggtggtggaactcgatcctggccctccagacccggacgacttggcacaggaaatggaggatgtggattttgaggaggaagaggaggaagagggcaatgaggaaggatgggtgcttgaaccgcaggagggcgtggtaggcagcatggaagggcctgacgattccgaagtgacattcgccttgcactccgcttctgtcttttgtgtctccctggaccccaagaccaatactctcgcggttacaggaggggaggacgataaggcgttcgtgtggcgattaagcgacggagaacttttgttcgagtgcgcaggacataaagattctgtcacatgtgccggatttagccacgatagtactctggtcgcaactggtgatatgtccggccttctgaaggtgtggcaggtggataccaaagaagaggtctggtctttcgaagctggagatctcgagtggatggaatggcatccaagagcacccgtactcttggcaggcaccgctgacgggaacacatggatgtggaaagtgcccaacggcgattgcaaaaccttccagggaccaaactgccccgcaacttgtggccgtgttctcccggatggaaagcgggcagttgtgggttacgaggacggtaccattcgtatctgggatttaaagcagggaagtcctattcacgtgttgaaaggcacggagggtcaccagggaccactgacctgtgtggccgctaaccaagacggatctttaatcttaaccggctctgtggactgccaagccaaactggtatcggcaacaaccgggaaggttgtgggggtgttccggcctgaaaccgttgcatcccaaccatcacttggcgagggggaggaatctgaaagtaattccgtggagtcgctgggcttttgtagtgtcatgccacttgccgcagtggggtacctggacggaactcttgccatctatgatctcgccacccagactttgagacaccaatgtcagcaccaatccggcatcgtgcaactactctgggaggccggtacagctgttgtgtacacttgctcacttgatggaattgtcagactctgggacgcccgaaccggtaggctgctgacagactatcgtggtcataccgctgagatactggatttcgcactgtcaaaggatgcctctctggtggttacaacgtcaggggaccacaaggccaaggtcttctgtgttcagcgccctgaccgttag

SEQ ID NO: 48307 - DNA, 2721 bp, Artificial Sequence
  Description of Artificial Sequence: Synthetic coding sequence
atgtggcgggctaagctgcgcagaggaacttgtgagccggcagtaaaagttgaagaccctctgtgtaacttccattccccaaatttcctcaggatttccgaagtggagatgcgcggaagtgaggatgccgctgcaggtacagtcctgcagcggctcatacaggagcagctcagatatggaactccaaccgagaacatgaaccttctggccatccagcaccaggccaccgggtctgctgggccagcacatccgaccaacaacttctcctccacagagaacctgacacaggaggacccacagatggtctatcagtctgctaggcaggaacctcagggccaggagcaccaggtggataacaccgtaatggagaagcaggtcaggtccacccaacctcagcaaaataacgaagaactgcctacgtacgaagaggctaaagcccaaagtcagttcttcagaggtcagcaacagcagcagcagcagcagggcgcagtgggccacggatactacatggccggagggacatcacaaaagagtagaactgagggacgcccaactgtaaaccgggcaaattccgggcaggcacacaaggacgaggcgctgaaggaacttaaacaagggcatgtgaggtccctgtccgagcgaatcatgcagctgtcactggaacgtaatggtgcaaaacaacacttgccagggtccggtaacgggaaggggtttaaggtggggggaggaccatctccagcgcagcccgctgggaaggtattggacccccgagggccacctccagaatatccatttaagacgaagcaaatgatgtccccagtgagtaaaactcaagaacacggccttttctatggtgaccagcacccgggaatgttacacgagatggttaaaccctatcccgctcctcagcctgttagaaccgatgtagcagtgctcagatatcaacctcctcccgagtacggtgttacctcccgcccttgtcagctgcctttccctagtaccatgcagcagcactcacctatgagcagtcaaacttcaagtgccagcggacccctccacagcgtctctctccctttgcctcttcccatggccttgggcgctcctcagccacccccagctgcctccccatctcagcagttgggacctgatgccttcgccatcgtggagcgggcacagcagatggtggagatccttaccgaagagaaccgagtccttcaccaagagttacagggctactacgataacgcagataagctgcacaagtttgaaaaggagctgcaacgcatctctgaggcatacgagagccttgtgaaatctacaacaaagcgcgagtccctggataaggccatgaggaataagttggagggcgaaattagacgtctgcatgacttcaatcgagacttacgcgatcggctggaaactgcaaaccggcagttgtccagccgcgagtacgaaggacatgaagataaggccgctgaaggccactacgcctcacagaataaggagtttctcaaagaaaaggagaaactggaaatggagttggcagctgtgagaactgcatccgaagaccataggagacacatcgaaattctggatcaggcactcagcaacgcacaggccagggtgattaagctcgaggaggagctcagggagaagcaggcttacgtagaaaaggtggagaagctgcagcaagctctgacacagctccaatctgcatgcgagaagagagaacaaatggagcgacgcctgcggacctggctcgagcgcgagctggatgctcttaggacccagcagaagcacggtaatgggcaacccgctaatatgcctgagtataacgcgccagcacttctggaactcgtacgtgaaaaggaagagaggatcctggctcttgaagcagacatgaccaagtgggaacaaaaatatctggaagaatctactattaggcacttcgctatgaatgctgcagctactgccgcagcggagagagacactactattattaaccacagtaggaacggaagttacggcgagtcgtctctagaagcccacatatggcaggaggaagaggaggtagttcaagccaatcgacgctgccaggacatggagtataccataaagaatctgcatgctaaaatcatcgagaaagatgccatgatcaaggtgctccaacaacggtctcgaaaggatgctgggaagacggacagctccagccttaggccggctcggtcggtgccctcgattgccgctgccaccggaacccactctagacagacctccctgaccagttctcaacttgctgaagagaagaaagaagagaaaacctggaagggcagcatcggtttgttgttaggcaaagagcaccatgaacacgcgtccgctccactgcttccaccccctccaacctctgcccttagcagcatcgcctcaaccaccgccgcaagctccgcgcacgcaaagaccggatctaaggactcctccactcagaccgataagtctgctgagttgttctggccctccatggcttccctgccatctcgtggtaggctgtctacgacacccgcacattcccctgtgttgaaacatccagctgccaaggggactgcagaaaagctggaaaattctccaggtcacggtaagtccccagatcaccggggaagggtttcatctctgctgcacaaaccagagttccccgacggggagatgatggaggtgcttatatag

SEQ ID NO: 48308 - DNA, 1632 bp, Artificial Sequence
  Description of Artificial Sequence: Synthetic coding sequence
atgtggcgggcaaaactgagacgtggcacatgtgaacccgcagtcaaaggttctcctagcgcctgttattctccctcttcaccagtgcaggtcttggaagatagcacttacttctccccagatttccaattgtactctggtaggcacgagacctccgcactgactgtagaggccacaagtagtatccgagagaaggttgtcgaggacccgctgtgtaattttcactcccccaactttctaaggatttcagaagtagaaatgcgtggcagcgaggatgccgcagctggaaccgtgctgcagcgcctgatccaagaacagcttcggtacggaacacctactgagaatatgaatcttctggcaattcaacaccaggcaacaggcagtgcgggacccgctcatcccactaacaacttttcctctacagagaacctcacacaggaggaccctcagatggtgtaccagagcgcccgacaggagcctcagggccaggaacatcaggtcgataacaccgtcatggagaagcaggtgcgcagcactcagccacagcagaataatgaagaactccctacctacgaggaagctaaagcccagtctcagtttttccggggacagcagcagcagcaacagcagcagggagctgtgggccacgggtattatatggcgggaggtacaagccagaaaagtaggactgaagggcgacctaccgttaaccgcgcaaactctggtcaggctcacaaagatgaggccctgaaggagctgaaacaaggtcacgtgcgtagtctgagcgaacgtattatgcaactttcactcgagagaaacggggcaaagcagcatttgcccggatctggtaacgggaaggggtttaaagttggcggagggcctagccccgctcagccagctggcaaagtgctcgatccccgtggtccacctcctgagtatcctttcaagacaaaacagatgatgtcacctgtaagcaagacgcaggagcatggattgttctacggagaccagcacccgggaatgttgcacgagatggtgaagccttatcctgcaccccaaccagtcaggaccgatgtcgctgtcctccggtatcagccaccacctgaatatggggtgacatcccgaccttgtcagctcccttttccatcaactatgcagcagcactcgccgatgaactttcgcacctccctcacctcctcccaacttgccgaggagaagaaagaagagaagacttggaaaggttctattggcctcctgctgggtaaagagcaccatgagcatgctagcgcgccactgttgcccccacctccgacatccgcactgtcctctattgccagcacgactgcggcttcttctgcacacgcaaagacgggcagcaaggactcgtccacacagacagataagtcggcagagctgttctggccatcgatggcaagcctgcccagtcggggtcgtctgtccaccaccccagctcactcacctgttctcaagcaccctgccgcaaaagggaccgctgagaagcttgagaattcaccaggccacgggaagtcaccggatcatagaggtagggtatcaagcctgctgcacaaacctgaattccccgacggagagatgatggaagtgttaatatag

SEQ ID NO: 48309 - DNA, 2871 bp, Artificial Sequence
  Description of Artificial Sequence: Synthetic coding sequence
atgtggagagcaaagctaaggagaggcacatgcgagccagccgtgaagggatctcccagtgcctgttatagcccaagtagccctgtccaggtgctcgaggatagcacctacttctcaccggatttccagctttactccggaaggcatgagactagcgcgctgacagtagaggctaccagctcaatcagagagaaagtcgtggaggatcccctgtgcaacttccactcccctaactttcttcgaatatccgaggtggaaatgagaggttccgaagatgcagccgctggcaccgtgctccagcgcctgattcaggaacaactgagatatgggactcccactgagaatatgaatctcttggctatccagcatcaagcaaccggctctgccggacccgctcaccccacaaataacttctcatccaccgagaacctaacacaggaagaccctcagatggtgtaccagtccgcacgccaagagcctcaaggccaagagcatcaggtggacaatactgtgatggaaaaacaagtgcggagcacccagccccagcagaataatgaggagctgcccacttacgaagaggccaaggcacagagccaatttttccgaggacagcagcaacagcagcagcaacaaggagctgtcgggcacggttattatatggcgggaggaacgtcccaaaaatcacggacagaagggagacctacagtaaacagggccaacagtggtcaggcccataaagacgaagctcttaaggagctcaaacaagggcacgtgcgctccctctcggagagaatcatgcagctgtccctagagaggaatggagctaagcagcatcttcccggatctggaaacggaaaggggttcaaggtgggcggtgggccatcaccggctcagccagctgggaaagtgcttgaccccaggggtcctcccccagaatacccatttaagaccaaacagatgatgtccccggtgagcaaaacacaggagcacggtctgttctacggagaccagcaccctggcatgctgcacgagatggtaaagccttatcccgcaccccagcctgttcgaactgatgtagctgtcttaagataccagcctccccctgaatatggagtcaccagccgcccatgtcaactacccttcccatcaactatgcagcagcacagtcctatgtcttcccagacctctagtgctagtgggcctctccactctgtctcactccctctgcctcttccaatggccttgggcgctccacaacctcccccagccgcatctccctctcaacagctaggtcctgatgccttcgctattgtggagcgggctcagcagatggttgaaattctgaccgaggagaaccgcgttttgcatcaggagctgcagggctactacgataacgctgacaagctccacaaatttgaaaaggagctgcagaggatatcggaagcatatgaatcactagttaagtcaactacgaaacgcgagtctctcgataaggccatgcgcaataagctggagggggaaatccggcgactccatgattttaatcgtgacctgagggacaggctcgaaacagctaatagacagttatcatctagagagtatgaggggcacgaggacaaggctgccgagggccattacgcctcccaaaataaggagtttctcaaagaaaaggaaaaattggaaatggaactggcagcagtccgtaccgcatccgaggatcataggaggcacatcgagatattggaccaagctcttagcaacgcccaagcgagagtaatcaagctcgaggaggaacttagggaaaaacaggcctatgtcgaaaaggtggagaagctccagcaggcactcacccagcttcaatcggcctgtgaaaagcgggaacagatggaaaggagactacgtacttggctggagagggaattggatgctttacgcacccagcagaaacacgggaatgggcagccagcaaacatgccagagtacaacgctccggcacttcttgagctggttagggagaaagaggagcgcatcttggctctcgaggccgatatgacgaaatgggagcagaaatacctggaggaaagcactatcaggcactttgccatgaatgcagccgctactgctgccgctgagcgcgatacaaccataatcaatcactctaggaacggctcatatggagagagttctctggaggcccacatctggcaggaggaagaggaggtagtacaggctaatcggaggtgtcaagacatggagtatactattaaaaatctgcacgccaaaataattgagaaggatgctatgataaaagtgctgcaacagcggagcaggaaagatgccggaaagacggactccagcagtctgaggccagctcgcagcgtgcctagcatcgccgcagccaccggcacacatagccgacagaccagtctgacttctagtcagcttgccgaagagaagaaggaggaaaagacctggaagggatcaatagggctgttattaggcaaggaacaccacgaacatgcttccgcgcctcttctgcctccaccaccaacaagcgctctgagctctattgccagcaccactgccgctagttctgcacacgccaaaactgggagcaaggattcaagtacccagacagataaatcagctgaactcttttggccgagcatggcttctctcccatcacgagggcgtctcagcactacgcccgctcacagccctgtgttaaagcacccagctgccaagggaaccgccgagaagctagagaatagtcccggacacgggaagagtccggaccacaggggtcgagtctcttccctgttgcacaagcctgagttccccgacggtgagatgatggaggttctcatctag

SEQ ID NO: 48310 - DNA, 1836 bp, Artificial Sequence
  Description of Artificial Sequence: Synthetic coding sequence
acgagccacgatcggttgatgtggcgggcaaaattaaggagaggcacctgtgaacccgctgtaaaagggtcaccaagtgcttgttactctccatccagccccgtacaggtcctggaggattccacgtattttagcccggacttccagctgtatagcgggaggcacgaaacttcagccctgacggtggaggctacaagcagcattcgcgaaaaagtggtggaagaccctctgtgcaacttccactccccgaacttcctgagaatcagcgaagttgaaatgcgcggttctgaagatgccgcagcagggaccgtcctgcaaagattgatccaggaacagttacgctatggtactccgaccgagaacatgaacttgttggcaatccagcatcaggctacagggagcgccggacccgcacatcctactaacaacttctcttcaacagaaaatttgactcaggaggatccccagatggtctaccaaagcgctcgacaggagccgcaggggcaggagcaccaggttgacaatacagttatggagaaacaagttagatccacacaaccccagcagaacaacgaagagcttcccacatatgaggaagcaaaagcccagtctcagtttttccggggtcagcaacagcagcaacagcaacagggcgcagtcggacacgggtactacatggccggaggaacatcccagaagtccaggaccgagggaagaccaaccgtcaacagggctaacagcgggcaggcccataaggacgaggcactaaaagaattaaagcagggccatgtgcgcagcctgagtgagagaatcatgcagttgagcctagagcgaaacggtgccaagcagcatctcccaggctcgggcaacggcaagggctttaaagtggggggtggccctagccctgcccagcccgcaggcaaagtgctggaccctagggggccaccaccagagtatccgtttaagaccaagcagatgatgtcccccgtttcgaaaacacaggagcacggattgttttatggagaccagcaccccggtatgctacatgaaatggtgaagccctacccagctcctcagcctgtgcgaacagatgtcgccgtgctccgctaccagcctccaccagaatacggcgtaacttcaagaccttgccaactgcctttcccgtccacaatgcagcagcattcccctatgagctcgcagacaagctccgcgagcggcccacttcacagcgtgtcactgcccctgcctcttccaatggccctcggggcacctcagcctccgccagccgcaagccctagtcagcaattgggccctgatgcgttcgctatcgtcgaacgcgctcagcagatggtcgagatcctgactgaggagaaccgcgtgttacaccaagagctacagggctactacgataacgccgataaacttcacaagtttgagaaggagctgcagaggattagtgaagcctacgagtctttagttaagagcacgaccaagcgggagtccttggataaagccatgaggaacaagctagagggcgaaatccgccgactgcatgattttaatagggacctgcgtgacagactggaaacagccaaccgtcagctaagctcccgcgaatacgagggacacgaggacaaagccgcagaaggtcattacgcaagccagaataaggagttcctaaaagagaaagaaaagctcgaaatggagttagccgcagtaaggactgcctctgaggaccatagacggcatatagagatcttggaccaggcgctgagcaatgcccaggctaggcaccaggccggtcgaggagtcacaagggaggcgagcatatgctag

SEQ ID NO: 48311 - DNA, 2343 bp, Artificial Sequence
  Description of Artificial Sequence: Synthetic coding sequence
atgcggacactggaggacagcagcggtacagtgcttcacagacttatccaggagcagctgcgctacggaaatctgaccgaaacccgaactcttctcgcaatccaacagcaggcacttagggggggagccggaacgggcggaaccggcagccctcaggccagcttagagatcctcgccccagaggatagccaggtccttcagcaggccacacgacaggaaccacaggggcaagaacatcaagggggtgagaatcatctggccgaaaataccctgtatcgcctttgcccccagccttccaaaggggaggagctgcctacatacgaagaggcaaaggcacacagccagtattacgctgcccagcaggccggtaccaggccccacgctggcgacagagacccacggggagcacccggtggttcaagaaggcaggacgaggccctgcgggaactacggcatggccatgttcggagcctctccgagcggcttctgcagctctcactggagcgcaacggcgcacgagctccgagtcacatgagcagctcccatagttttccgcaactcgcaagaaaccagcagggtcccccactgcgcggacccccagccgagggcccagaaagtcgaggtccccctccacaatacccacacgtggtgctagcccatgagacaaccaccgctgtgacagacccaagatacagagctcgcggaagtccccacttccagcacgctgaggtgcggatcctgcaagctcaggtgcctccagttttccttcaacagcagcaacagtatcagtacctgcaacagtctcaggaacaccctcctcccccacatcccgcagcactgggtcacgggccactgtccagcctcagtcctcctgccgtcgagggacccgtgtctgcccaagcaagctccgctaccagcggctcagcccacctggcccagatggaggctgtgttgcgagaaaatgccaggttgcagagggataatgaacgcttacagcgcgagttagaaagtagtgcagagaaagcaggaagaatagagaagcttgagagcgaaatacagcgactcagcgaggcacacgagagtctcacacgagcctcatctaagcgcgaggcactggaaaaaactatgcgcaataagatggatagcgagatgcgtcgtcttcaggactttaatagagacctgcgtgaaagactggagagtgcaaataggcgcctcgcctcaaagacacaggaggcccaggccggttcacaggatatggtggctaagctgctagctcagagctacgaacagcagcaggaacaggagaagctggaacgagagatggcactcttacgcggagccatcgaggatcagagaagaagggccgaacttctggagcaagccctcggaaacgcacaaggcagagcagcacgggctgaggaggaactacgcaagaagcaggcctacgtagaaaaagtcgaacgcctgcagcaggccctgggccagttgcaagcagcgtgcgagaaaagggagcagttagaactgagactaaggacacgcctcgaacaggagttgaaggccttgcgtgctcagcagcgccaagctggcgcaccaggcggatcatcaggcagtggcggaagtcctgaacttagcgccctcaggctaagcgaacagctccgtgaaaaagaggaacagatcttggccttggaagctgacatgaccaagtgggagcagaagtatttggaagagagggctatgagacagtttgcgatggatgccgcagcgaccgccgcagcgcagcgggatacaacacttattaggcatagcccgcagccctcacctagtagttcatttaacgaaggcctgctgactgggggtcacaggcaccaagaaatggagtctcgcctgaaagtgctgcatgcccagattctcgaaaaagacgccgtgattaaggtgctccagcagaggtcgagaagggacccgggtaaggcaattcagggcagtcttcgtccagctaagagcgtcccttcagtgttcgcagctgcagctgcaggcacacaaggctggcaggggcttagctcttcagagagacagactgccgacgctccagctagattgaccactgcagacagggcacccaccgaagaaccggtggttaccgctcctcccgcagcacacgccaagcacggctcccgggatggtagcacgcagacagaaggcccacccgactcaacctccacttgcctgcctcctgagcccgattccttactgggatgtagctcatctcagcgggcagcgagcttggacagcgtcgcgacttcaagggtgcaagacctcagcgacatggtggagattttgatctag

SEQ ID NO: 48312 - DNA, 2340 bp, Artificial Sequence
  Description of Artificial Sequence: Synthetic coding sequence
atgcggacgctggaggactcatctggcaccgtgctgcacagactgatccaggagcaattaagatatggcaatctaactgaaactaggacgcttctggctattcagcagcaagccctgcggggtggcgctgggaccgggggaaccgggagccctcaggctagcctggagattctagcacctgaagacagccaggtgctgcaacaggcgacacggcaggagccacagggccaggagcaccaggggggtgagaatcacctggccgaaaatactctatatcgtttgtgtccgcagccatccaagggggaagaactgcccacctatgaagaagctaaagcccactctcagtactatgcagcacaacaagcaggaacacggcctcacgccggagacagagaccccaggggcgctcccggtggatccagaagacaggatgaggctctgagagagctgagacacggacacgttcgcagcctctccgagaggttactacagctgagcctagagcgaaatggtgccagagcgccaagccacatgagcagctcccactccttccctcaactcgcacggaatcaacagggccctccgctgagggggccacctgccgagggtcctgaatctagaggcccaccgccacagtatccccacgtcgtgctggcccatgaaaccaccaccgctgtgaccgacccaagatacagagctaggggcagtccccacttccagcacgcagaggttcgaattctgcaggcccaggtgccacctgtctttctgcagcaacagcaacagtaccaatacctccagcagtcccaggagcatcctcccccaccccacccagccgcactgggccatggacctttgagcagcctgtctccaccggcagtcgaaggccctgtttcggcccaagcttcctctgcaactagcgggagtgctcatctagcccagatggaagcagtactcagagaaaatgccagactgcagcgcgataatgagcggttgcagagagaactggaatccagtgccgaaaaagccggacggatcgagaagctcgaaagtgaaatacaaagattgagcgaggcgcacgagtccctgactcgggcatcgtctaagcgggaagctctggagaagacgatgcgaaacaaaatggattctgagatgcgcagactacaagatttcaacagagacttgagggagcgtctggagtctgccaatcgcaggttggcctcaaaaactcaggaggctcaagccggttcccaggatatggtggccaagttattggcccagtcctacgagcagcagcaggagcaggagaagctcgagcgcgaaatggctctactgcgcggtgccatcgaggatcagagaagacgggcagaactactggaacaggccttggggaacgctcagggacgcgctgccagggctgaggaagagcttcgaaaaaaacaggcttatgtggagaaggttgaacgcctgcagcaagcgttgggacagctccaagcagcatgtgaaaagcgcgagcagctggagcttcgactgagaacaaggttggaacaggaactgaaagcgcttcgtgctcaacagagacaggcgggagctcccggtggttcaagcggctcaggcggtagccccgagctgtctgccttgcgtctgtccgaacagctgcgtgaaaaggaggaacagatcctggctctcgaggcagacatgacaaagtgggaacaaaaatatttggaggagagagcaatgcggcagttcgcaatggatgccgcagccactgccgctgcacagcgcgatactacgctaatcaggcatagcccccaaccttcccccagttcatcgtttaacgaagggctgttgaccggagggcatcggcaccaggagatggaaagccggttgaaggttctccacgcccagatccttgaaaaggatgctgttattaaggtcttgcagcagaggtctagacgggaccctgggaaggcaatccagggctctttgaggccagccaagtctgtgccctctgtctttgctgccgctgcagctggcacccagggttggcagggcctcagttctagcgaacgacagacagccgacgccccagccagactgaccacagacagggcccctacagaggagccggtagtcaccgccccaccagctgcccacgccaagcatgggagccgtgacggctctacgcagaccgaggggcctcctgactccacatctacctgtctgccacctgaaccagacagtctacttggatgttcgtccagtcagagggcagcctctctggattcagtcgctaccagtcgggtacaggacctgtcagacatggtggagattctgatttag

SEQ ID NO: 48313 - DNA, 102 bp, Artificial Sequence
  Description of Artificial Sequence: Synthetic coding sequence
atgaggacgctcgaggacagtagcggcactgtgctgcatcgcctgattcaggagcagctgaggtatggcaacttgactgagacccggacgttattggcctag

SEQ ID NO: 48314 - DNA, 456 bp, Artificial Sequence
  Description of Artificial Sequence: Synthetic coding sequence
atgaggacactagaggacagtagcggcactgtacttcaccgcctcatacaggagcaactgcggtatgggaacttgaccgaaactcgcaccctgctggctattcagcagcaggcgctgcgcggaggggcaggaactggcggaaccgggtccccgcaggcctctcttgagatcctggcgccagaggattcacaagtgttgcagcaagcgaccaggcaggagcctcaaggacaagagcatcagggaggcgaaaatcacctggccgagaatacgctctataggctgtgcccgcagccatccaagggcgaggaactcccgacctatgaggaagctaaagcgcacagtcagtattacgctgcccaacaggccggaactaggccccacgcaggagacagggaccctcggggagcccctgggggaagcaggaggcaggatgaggctctcagggaacttcggtag

SEQ ID NO: 48315 - DNA, 435 bp, Artificial Sequence
  Description of Artificial Sequence: Synthetic coding sequence
atgagaaccctggaggacagcagcggcaccgtcctgcaccgacttatacaggagcagctgcgctacggtaatttaacggagactcgcaccctactggccattcagcagcaagctctcaggggaggcgcaggtaccggcggaacaggatcaccgcaggcaagcctcgaaatcttagccccagaagacagccaggtgctgcagcaagccacacgccaggaaccccagggccaggaacatcagggaggagagaaccaccttgctgagaacacactgtatcggctgtgtccccagccgtcaaagggggaggagttaccaacttacgaggaggcaaaggctcatagccagtactacgctgctcaacaagcaggaacgaggccccacgcaggcgaccgcgatcccagaggcgcacctggcggaagtagacgacaggattag

SEQ ID NO: 48316 - DNA, 384 bp, Artificial Sequence
  Description of Artificial Sequence: Synthetic coding sequence
atgcgaacactagaagacagtagcgggacagtattgcacaggttgatccaggagcaactgcgatacggcaatcttacagaaactagaaccctgctggcaatacagcagcaggccctgcggggaggcgctgggaccgggggtacaggatcgccacaggcatccctcgagattctggcacccgaagactcacaagtgctgcagcaggccacccgacaagagccacagggacaagaacatcaagggggagaaaaccatcttgctgaaaatactttgtatcggctctgcccacagcctagtaaaggggaggagctgcctacgtacgaggaggcaaaggcgcattcacagtactacgccgcacagcaggcgggaacccgtcctcactag

SEQ ID NO: 48317 - DNA, 597 bp, Artificial Sequence
  Description of Artificial Sequence: Synthetic coding sequence
atgagaacacttgaggatagttcgggaacagtgctccaccgcttaatacaggagcagctcagatacgggaaccttacagaaacccggacgttgctggcaatccagcagcaggcactacgcggtggagcaggaacgggtggaacaggttccccccaggcatctctggagatcttagctccagaagacagccaagttctgcaacaagccacacgccaagagccccagggccaggagcaccagggaggagagaaccacctcgcagaaaacacactctaccgcctatgcccgcagccatcaaaaggagaagagttacctacgtacgaagaggcaaaagcccactcacaatattatgccgctcaacaggccggtactcgccctcacgccggtgatcgcgatccacgtggtgcacctggaggatcccggagacaggacgaggccctgagggagcttcgccacgggcatgtaagatcgctgtccgagcgcctgctgcaattgtctctcgaaagaaacggtgcccgagccccaagccacatgagttccagtcactcttttccccaattggccagaaaccagcaggggccaccgcttcgcggatag

SEQ ID NO: 48318 - DNA, 2334 bp, Artificial Sequence
  Description of Artificial Sequence: Synthetic coding sequence
atgagaactcttgaggattcttctggaaccgtcctgcaccgcctgatacaggaacagttgaggtacggtaatttgaccgagacacgtaccctgctggcaatccagcagcaagccctgcgaggaggagcgggaacaggcggaaccggctcgcctcaggccagcctggagatcctggccccagaagattcccaagtcctccagcaggccactcggcaggagcctcagggacaggagcaccagggcggtgagaatcacctggccgaaaataccctatacaggctttgtcctcagccttcaaaaggggaagaactgcctacctacgaggaagctaaggcgcatagccagtactatgccgctcagcaggcaggcacgagaccccacgctggggaccgggatccgcgaggggcaccagggggaagccgacgacaggacgaggccctgagggagctgcgccacgggcacgttcggagcttatccgagaggcttctgcagctgtccctggaacggaacggagctcgggcaccttctcacatgagtagctctcacagtttccctcagcttgcccgtaatcagcagggtcctccactacgtggcccacccgctgaaggcccagagagccgtgggccaccccctcagtatccacatgtcgtgctggcccacgagaccaccactgcagtgactgaccccaggtatcgcgctaggggtagcccgcattttcaacacgctgaggttcgaatcctccaggctcaagtccctcctgtgttcctgcagcagcagcagcagtatcaatacctgcagcagagccaggaacatccacctcctccacaccctgctgccctgggccatggtcctctgagcagtctgtcacctcctgcagtggaaggaccggttagcgctcaagccagcagcgccacaagcggcagtgcccacctggctcagatggaggctgtcctccgcgagaatgcgagattacagagggataatgaacgcctgcagcgggaactggaaagttccgcagagaaagcaggacgaattgaaaaactggagtctgagatccagcggctgagtgaagcacacgagtctctgacccgcgcttcatcaaagagagaggcactggaaaaaacgatgcggaataagatggactccgagatgagacgtcttcaagactttaatagagatctgagggagcggctcgagtctgccaatcggaggcttgcctcgaaaacccaggaggcccaagccggaagtcaggatatggttgccaagctcctggcccagtcctatgagcagcagcaggaacaggagaagctggaacgtgagatggcgctgctgaggggcgctattgaggaccagagaaggagggcggaactcctggagcaggctctggggaatgctcaggggagagccgcaagggcagaggaggaactacggaaaaagcaagcctatgtggaaaaggtagagaggctacaacaggcactcggtcaactccaggccgcttgcgagaagagggaacagttagagctgcggcttcggactcgcctggaacaggaactgaaagcgcttagggcccagcaggccggtgcccctggcggttcatccggttccgggggatcgccagagctgtccgctctgcggctgagcgagcagcttcgtgagaaggaggagcaaatcttggcgctagaggccgacatgactaagtgggaacagaagtacctggaagaaagggcaatgagacagttcgcaatggacgccgctgccactgcggctgctcagcgagataccacgctgatccgacatagtcctcagccttctccaagttcgtcctttaatgagggtcttctgactggaggccaccggcaccaggagatggaatcccgactcaaggtcctgcatgcacagatcttggagaaggatgctgtgattaaggtgctgcagcagcggagtcgaagggacccaggtaaggctatccaaggcagtttgcgccctgctaagtcagtgccgtccgttttcgcagctgccgcagctggaacgcaggggtggcagggcctatcatcttccgagagacagaccgccgacgctcctgcccgactcaccactgaccgggcacctaccgaggaacctgtggtgaccgcacctcccgcagcccatgccaagcatgggagccgcgacggtagcacccaaacagagggccctccggattcaacaagcacttgcctccccccagagcctgacagccttctggggtgcagctcaagccaacgggctgccagcctggacagtgtggcgacctctcgggtccaggatttaagcgatatggttgaaatactaatatag

SEQ ID NO: 48319 - DNA, 2514 bp, Artificial Sequence
  Description of Artificial Sequence: Synthetic coding sequence
atgaccggtcgaaaagccagtggtggcacaccatgcacattgcggaagggcgctcctattattactcttgggaagaactggaccgagagactagccgctggagattcagtgggatgctcaggagctcgatgtcataggccgttgagtcgccagttgtgcgcttcccagcgtagtatgagaacactcgaggatagttctggcacagtgcttcatcggctcatccaggagcagctgagatacggaaacctgactgagaccaggacactcttagcgatccagcaacaggccctccggggaggcgcaggtaccggtggcactggatcaccccaggcctctctggaaatcctggcaccagaagacagccaggtcctgcagcaggctacgcgacaggagccgcagggacaggaacaccagggcggagagaatcacctcgcagaaaacaccctctaccggttgtgcccgcaaccaagcaaaggagaggaactgcccacatacgaagaagctaaggcgcattcccagtattatgctgctcagcaagctggaaccaggccacatgccggagaccgcgatcccagaggcgcacctggcggtagcaggcgccaggacgaggcactgagggagcttcgccacggtcacgtgcgatctctgagcgagagattactacagctctctctcgagcggaacggggctcgcgcacccagccatatgtcttcctctcacagtttcccgcagctggctcggaatcagcagggcccaccccttcggggtcccccagctgagggacctgaaagcagaggtccgcctccacagtaccctcacgtggtgctagctcatgaaacaaccacagccgtcacagatcctcgctatagggcccgagggagtccacacttccagcacgcagaagtacgtatcctccaagctcaggtcccccctgtctttctccagcagcagcagcagtatcagtacttacagcagtcccaggaacaccctccaccccctcaccctgcagctttaggccatggccctctctccagtctgtcacccccagcagtcgagggtcctgtgtcggcccaggcatcatcggcaacatctggcagcgcgcatctcgcacagatggaggccgtgctgagggaaaacgccaggctgcagagagacaatgagagattgcagagggagcttgaatctagcgccgagaaggcgggacgtatcgagaagctggaatcggagattcaacgattatctgaagcccatgaaagcctcactcgtgctagttctaagcgtgaggccctagagaaaactatgcggaacaaaatggactctgaaatgcggagactgcaggactttaaccgggacctgcgagagcgcctcgaatccgccaacaggagactagcgtctaagacccaagaggcacaggccggaagccaggacatggtggcaaagctgctggcccagagttatgagcaacagcaggagcaggaaaagctggaaagagaaatggccctgcttcggggagccatagaggatcagcggagacgtgccgagctgctggaacaggctctcggcaacgcacaaggacgtgcagcgagggctgaagaagagctgcgaaaaaaacaagcatacgtggagaaggtggaacgcctccagcaggctctgggtcagctgcaggccgcttgtgagaaaagggagcagctggagctccggttgcgcacccgactggagcaggagctaaaggctctgcgggctcagcaacgccaggctggtgccccaggtggctcttccgggtccggcggaagtcctgagttatcggctcttagattatcagaacagctccgggaaaaagaggaacagatcctggctcttgaggcggacatgaccaaatgggagcaaaagtatttagaagaacgcgcaatgagacagtttgcaatggacgccgctgcgacagcagctgcgcagagagacactacgttgattcggcattcaccccagccgtcaccgtcctccagctttaacgaaggccttctcaccgggggtcatcgacaccaggagatggaaagccgtcttaaagtactccatgcacaaatactggaaaaagatgccgttattaaagtgctccagcagcggtcaaggagggaccccggaaaagccattcaggggagtctaagacccgctaagtctgtcccgtctgtctttgccgctgcagccgctgggacccaaggctggcaggggctgtccagtagtgaaagacagactgcagacgcccctgctcgccttaccacagatcgagcccctacggaagaacctgtggtgaccgctccaccagccgctcacgccaaacacggatccagagacggcagtacccaaaccgaaggccctcccgacagcactagtacatgtttacccccagaacctgacagcctcctaggctgctcgtctagtcagcgcgcagctagcttagacagtgtggctacttccagggtgcaggatctttcggacatggtggagattcttatatag

SEQ ID NO: 48320 - DNA, 372 bp, Artificial Sequence
  Description of Artificial Sequence: Synthetic coding sequence
atgcggactctagaagacagctcaggcaccgtactgcacagacttatccaggaacaactcagatacggaaatctgacggaaacacgcactctgttggcaatccagcagcaggccctgagaggaggagccggaaccggcggtaccggcagtccacaggcaagcctggagattttggcgccagaggattcacaagttctccaacaggctacgcgccaggagccacaggggcaggagcatcagggcggtgagaaccacctggccgaaaacacattgtatagactctgcccccagccaagcaagggggaggaactgccaacatacgaagaagctaaggctcattctcagtattatgccgcacagcaagcaggctag

SEQ ID NO: 48321 - DNA, 480 bp, Artificial Sequence
  Description of Artificial Sequence: Synthetic coding sequence
atggaactgccggcagtgaacctgaaggtgatcctattgggccactggctattgaccacttgggggtgtatagtcttcagtgggtcctatgcctgggccaatttcactattctggcgttaggcgtctgggccgtggcacagcgcgatagcatagatgcaatcagcatgttcctcggagggctgcttgccactatttttttggacattgtgcatattagtatcttttatccccgagtaagtttgaccgacacaggaaggtttggagtgggtatggctattctctcgctccttcttaaacccctgtcttgctgttttgtctatcatatgtaccgggagcgaggcggtgagctcttagtacataccggattcttggggtcttctcaggatcgatccgcctaccaaaccatagatagtgccgaggcccctgccgatccgttcgcagtaccagagggtcgctcacaagatgctagaggttactag

SEQ ID NO: 48322 - DNA, 459 bp, Artificial Sequence
  Description of Artificial Sequence: Synthetic coding sequence
atggaactgcctgctgtcaatctgaaggtgatcctactagggcattggctgctgactacctggggttgcatcgtgttttctggctcctacgcttgggccaattttacaattctggcactgggagtttgggccgtggcccagagagattctattgacgccatctccatgtttctgggaggcctcctggcgaccatcttcctcgacattgtgcacatatcaatattctatcccagggtttccctcacagatactggccgttttggagtcggaatggccatcctgagtctgcttttaaagcccctcagctgctgctttgtttaccacatgtacagagaacgcggtggcttcctggggagcagtcaggacaggtctgcctaccagactattgactccgcggaggcgccagcagacccttttgccgttccagagggacggagtcaagacgcccgaggatactag

SEQ ID NO: 48323 - DNA, 336 bp, Artificial Sequence
  Description of Artificial Sequence: Synthetic coding sequence
atggaactgccggcagtaaacctgaagggactgcactgtattctacgactgctctgtttggggcagttacatcatccgggactggggagggtgggatgcggctctgccggactgcatcgtcgccataagcacgtgagcgggtggctggccggtcaccatctgcctggccatagagctcaccagcaccttctgcctgcagggcagcctcatgggcacggcccactgtggcggggacacggacatcctcaattagcggcacaggcagcacttctgctcttgcgacttccccatgtgccgggtgctcggggatttccctgggtctttagtggcccttag

SEQ ID NO: 48324 - DNA, 444 bp, Artificial Sequence
  Description of Artificial Sequence: Synthetic coding sequence
atggaacttcccgcagtcaacctgaaggtgatcctgcttgggcattggctcctaactacatgcttttggagacattttagtgctaagccccgtcttgagaccatcgaattgacgtgtgcactttgcaagcttcgatctgctgctcacagagcaacagccggtctccactgcatcctgcggctcttgtgcctggggcaacttcatcaccccggtctaggacgcgtgggttgtgggtccgccggactgcatcgtcgccacaagcatgtgtctgggtggctcgctgggcaccacctgcccggacaccgcgctcaccaacatctgctgcccgctggacagccccacggccatgggcctctctggaggggtcacgggcatccccagctagccgcacaggccgctctcctgttactgagactcccccatgtacccggtgccagaggttag

SEQ ID NO: 48325 - DNA, 468 bp, Artificial Sequence
  Description of Artificial Sequence: Synthetic coding sequence
atggaactgccagcggtcaacctgaaggtcatcctgctggggcactggctgctcacaacatgtttctggagacatttctccgctaaacccaggctcgagacgatcgaactcacttgtgctctgtgtaaactgcgctccgccgctcatcgtgccactgctgggcttcattgcattctcaggcttctgtgtctcgggcagcttcaccatccgggattaggtcgtgtggggtgtggctctgccggactgcaccggagacataaacatgtcagcggctggctggctggccatcacctgccaggtcacagggcccaccagcatcttctccccgcaggccagcctcacggccatggccctttgtggcgtggtcacggtcacccacagctggccgcacaggccgcacttctgctcctgcgcctacctcacgtccccggagcaagaggattcccatgggtgttttcaggaccatag

SEQ ID NO: 48326 - DNA, 2406 bp, Artificial Sequence
  Description of Artificial Sequence: Synthetic coding sequence
atgaagtatgctgaaaacatcatgctgaaactgaccttttcaaccactcaaattcagcaatatgaaaacgtgttcatctttgagacagggtactggctcacgaatgccattaaatacaaccaggactaccttgatatctgcacataccaacgcctgcagcagcgcctgtacttgcaaaagaagatcattcaaaagcactttgaaaaaaagaaagacattcgcagaggaatcggttacctcaaacttatatgcttcttgattcccttccttctgagcttaaaaaagaagatgaaggtgccttacctttcaagtctcctgcagccctttagcgatgataaggtaaagacagagcgtgagctacccccttttatctacggtagggattttaaatgtcagaactttcactataaggagaaccaatattttcatgtgcacggcggtatcgaatttgacatctctacacccagcatagaaaacgctctagaagactttcagaagaacctggagaaaattcgtgattgtgcagcgaacactttcatcgaggactccgggtacaaggaatattacagcattcctgtgatggagttccatggcaagtcttattacgtgatttactttgaactagagacattttaccagcagctgtacaagacccaatggtggggcgcaatcaacgagatcgtgaataatcttaggctgaagaggctgcccctcaccgacgctcaactccacgagcagtttaagaaaaaactcggatttaagagagccatgaagtgcaagagcatcccgttcggtatgaagtctgcagtggaacggggtctgtcagcggtgttccatacattttcccggaaaaccagctccagtacaattaatgtgagcgacgaggccggttataccattttccatcacgccgcactgcataaccgagtgtctatcatctgtcagctgtgtaacgcaaacttcaaagttaaccagcggcgatttgtcacattctcccagggaccgacacctcttcacctggccgctcaagcttgttcactggagactacagtctgcctactatgttctaaagccgactataccctgagcgagaagagaggctggatgccaatccactttgctgccttctatgataacgtctgtataatcatcgcgttatgtcggaaagacccttccctcttggaggctgaggccaccgcagaaaaccagtgcacccctctcctccttgccgcaacctctggagcactcgatacaattcagtacctcttttctattggggcaaattggaggaagaccgacattaagggtaataacatcattcatttgtccgtgctcacctttcatacggaggttctcaaatacatcatcaagctgaatattcctgagctgccagtctggaaaacattggtggagatgctacagtgtgagtcatacaagcgcaggatgatggctgttatgtcattagaggtgatttgtcttgccaatgatcaatactggagatgcattttggatgccggtactatcccggctcttatcaatttgctgaagtccagcaagatcaagttacaatgcaagacagtaggactgttgtcaaacatctcgactcacaagagcgccgtgcatgctcttgttgaggccggaggtataccgtctcttattaatctgctcgtgtgtgatgagccagaggtgcattctcgctgtgcagtcattctatacgatatagcccagtgtgaaaataaggatgtcatcgctaagtacaacggcatcccatctctgattaacctcctgaacttgaatattgagaacgtgctcgtaaatgtcatgaattgtattcgcgttttatgcattggaaacgagaataatcagcgggctgtgagggaacacaaggggctgccatatctcattcggttcttgtcgtccgattcaggcctattcaatctcttcctcaactccttcgaagacgttctgaaggccgtaagctcagccgctatcgccgaggtggggagagacaacaaagaaattcaggatgctatcgccatggagggagcaatccctcccctcgtggccctgttcaagggcaaacagatatctgtccagatgaaaggcgcaatggctgtcgagtccctcgcctctcataatgcgttaatccagaaggccttcctagaaaagtctcttaccaaatatctgctgaagcttctgaaggcctttcagattgatgtgaaggaacagggtgcagtagcgctgtgggcactcgccggacagaccctgaagcaacagaaatacatggctgagcagatcggatactcattcattatcaacatgctcctgagtccaagcgctaagatgcagtatgtgggctacctcctgaagtcccgcctctgtattaatactttttgtctgcagtag

SEQ ID NO: 48327 - DNA, 4305 bp, Artificial Sequence
  Description of Artificial Sequence: Synthetic coding sequence
atgctgaggctccccaagaaaggcctgcctagattcgagcaggttcaggatgaggacacttacctggagaacttagcaatccagaggaatgcaagtgcgttttttgagaaatacgaccggtcagagatccaagagctactgactacagccctggtgtcatggcttagtgcgaaggaggacgtacggagtcaggtagatctgccttgtggtattatgtctcagatgaataacgtcggcttttctacggccatcctgctcacgcctgtcgatcccaccgccttgcttgactaccgggaggtccaccagatgatcagagaattggccattgggatctattgtttaaatcagattccatctatcagtctagaagctaattatgaccagtcctctagttgccagctgccacccgcatattatgataccagaatcgggcagattctcatcaatatcgactatatgcttaaggcactctggcacgggatttatatgccaaaggagaaaagagccaggttcagtgaactttggcgcgctatcatggatatcgacccggacggcaaaccacaaactaataaggatattttcagtgagtttagcagtgcaggattgactgacatcactaaagaccccgatttcaatgagatctatgacgaggacgtcaacgaggatccgacgtatgaccccaactcccccgaagaaacggctgtgtttatgaagtatgccgagaatattatgctgaagctcacttttagcacaacccaaatccaacagtacgaaaacgtttttatcttcgaaacaggctactggcttactaatgctatcaaatacaaccaggactatctggacatctgcacataccagagactacagcagcggctctatcttcaaaagaagattatacagaagcacttcgaaaaaaagaaagacattaggaggggtatcggataccttaagctgatttgcttcctgattcccttcctcctcagcctgaagaagaagatgaaagtcccttacttatcaagcctcctgcaacccttcagcgacgataaagtaaaaacagaaagagaactgcccccatttatctatggcagagatttcaagtgccagaatttccattacaaagagaaccagtatttccatgtccacggcggaattgagtttgacatctctaccccaagcatcgagaatgccctggaggattttcaaaaaaatctcgagaagattcgggactgtgcagcaaataccttcatcgaggactctggatataaggagtactactctattccagtgatggagtttcacgggaagtcatattatgttatatacttcgaactggagaccttctaccagcagctgtacaaaactcagtggtggggcgctattaacgaaatcgtgaacaacctgaggcttaagcggttgcccttgacagatgcacagctgcacgagcagtttaaaaagaaactcggcttcaagcgagccatgaagtgcaagtcaatcccgttcggcatgaagtccgcagtggaacgcggtctttccgctgtgtttcacaccttctcaaggaaaacatcaagctctaccataaatgtcagcgacgaggctgggtatacaatttttcaccatgctgcactgcataacagggtctcgattatttgccaactgtgcaatgctaattttaaggtgaaccaaagaagatttgtgactttcagccagggacctacccccctccatttagccgcacaggcttgtagcctggaaactaccgtttgcctgctgtgctcaaaggcagattacacgttaagtgagaagagaggatggatgccgatccactttgctgccttttacgataacgtgtgcattatcatagcactgtgtcgcaaagacccatcacttttagaggcggaagcgaccgccgagaaccagtgcacacccttgctgttagcagccactagtggtgcgctcgataccatccagtacctcttctccatcggtgcaaactggcgcaagacagatatcaagggaaacaatatcatccacctgtcggttttaactttccatactgaggtgctaaaatacatcatcaagctcaacattccagagctccctgtatggaaaacattagtggagatgcttcagtgtgagtcctacaaacgcagaatgatggcagtcatgtctctcgaagtgatctgtctggctaatgaccaatattggcgttgtatcctcgacgctggaacaattccagcattgatcaacctcctcaaaagctccaaaataaagctgcaatgtaagactgtaggactactcagtaacatcagcactcacaaaagtgccgtgcacgcccttgtcgaagccggtgggattccatcactaatcaatttactggtgtgtgatgaacctgaagtacacagtcgctgtgctgtgatcctctacgacatcgcccagtgcgagaacaaggatgtcatcgccaagtataacggaatccccagtcttatcaaccttttaaaccttaatatcgagaatgtgttagtcaatgtcatgaattgcataagggtgctttgtataggaaatgaaaacaaccagcgggctgtccgtgagcacaaaggcctgccatatcttattaggttcctctctagcgactccgatgtgctcaaagctgtcagctccgctgccatcgctgaggtggggagggataacaaggagatccaggatgcaatcgcgatggaaggtgcgatccctccgctggtggcattatttaagggcaagcagatcagcgtgcaaatgaaaggtgctatggcggtggagtccttggcatcccacaatgccctcatccaaaaagctttcctggagaagtctctgaccaagtatctactaaaactgctaaaagcttttcaaatcgacgtcaaagagcagggggcagtcgctttgtgggccctcgcaggacagactttaaagcaacagaaatacatggccgagcaaattgggtattcttttattattaatatgttactcagccccagtgcaaaaatgcagtatgtcggcggtgaagctgtgatagcactctccaaagacagccgtatgcatcagaatcagatctgtgagggtaatggtatcgcgccactggtgagactgctccgcattagcaccattgctgagggcaccctgctctcagtaatccgcgctgtggggtctatctgtatcggagttgctcacacatctaatccagtgtcgcaacagttggtggtggacgagaatgccttccccgtgttgatacagctgctacggaatcatccaagcccaaacattaaagttgaagtggcgttttccctcgcctgcattgtgctggggaatgacgtgctgcagaaggacctgcatgagaatgagggattcgagtatgcagacgttctgtacctgttgcattccacagagaaggatatctgtcttcgggctggttatgccctaaccctgttcgccttcaacaaccgctttcagcagtatctcattctggagagcggcatcatgacaatttcaatttttgaaaggttcctggaatctacagtagaaacagagaaagctatggccgcttttcagatcgtggtgctggcaaaggtgattcgcgatatggaccatatcacgttgtccgctagaggcgtgactatcttagtggattccttgtattccgtgcagacctcaaccatcgtcctcaccggaaatctgatcgcgagccttgctcatagtagagcgggtattccagaagcttttactaccttaggcacgatacagaggctgtgctaccacttatacagcggcatcgaggaggtgcgggctgcatgtagttccgctctgggctacctgacctataatgccaatgcgtttagaatactgcttaaagaatgtcgcaacaagccgaatcagtttattcgaataaaaaataacatctcccgcgatgcctcaatcaatccagcatttctaaaagagttccagatgcagcaaaccctggtgggcctcccatcgctgtccctcgaaaaaaatggaggaccgtccatcatccctatctttaagagaggaaaagagcaccggcgaaagttgaagccaaaaattcagccgaaggattctcttaccctgctgcccccagtaaccaattttatggggctgttcaaagccactaagaagactaaggacagccacaatattttttcatttagctctactatcacctccgatataaccaacgtctctagacccaggatcgtctgcctcaaccagttaggcaaacatgtccagaaggccaaccctgagccagctgaaggctag

SEQ ID NO: 48328 - DNA, 1080 bp, Artificial Sequence
  Description of Artificial Sequence: Synthetic coding sequence
atgaaaggagcgatggctgtcgaatcccttgcttctcacaacgcattaatacagaaagcctttctcgaaaagagcttaacaaaatatctgctcaaacttttgaaggcatttcagattgacgtaaaggaacaaggggcagtcgcactgtgggctctggccggacagacgttgaaacagcagaagtacatggcggaacagataggttattcatttatcatcaacatgctgctttcgcctagtgcaaaaatgcaatatgtgggaggtgaagctgtgatcgccctgagtaaagattccagaatgcaccaaaatcagatctgcgaagggaacggcattgcaccactcgtgaggttacttaggatctctaccatagcggagggcacacttctgagtgtcatcagagcagtaggttccatctgcataggtgtggcccacacctctaatcccgtgtcgcagcagttggtggtagacgagaatgcctttcctgttttgattcaattgctgaggaatcacccctcacctaacatcaaagttgaagtggcattcagcctggcctgcattgtgcttgggaatgatgtactgcagaaggatctccacgaaaacgagggatttgagtatgccgatgtgctttatttgttgcacagcacagagaaagatatctgtttacgcgcagggtatgctctgactctgttcgctttcaataatcgattccagcagtacctgatcctcgagtcagggatcatgactattagcatttttgagcgtttcctggagtcaaccgtggagaccgagaaagccatggctgcttttcagattgtcgtactggcgaaggtcattcgtgatatggaccacatcactcttagcgctcggggagtgaccatactggtggattcactgtattccgtacagacctccactatcgtgctcaccgggaatctgattgcctctttagcccactcaagagctggaataccagaagccttcactacactcgggacgatccagagactgtgttatcatctttatagtggcatcgaggaatctggagaagagtggcggacaattcacaactcgtacctctag

SEQ ID NO: 48329 - DNA, 4092 bp, Artificial Sequence
  Description of Artificial Sequence: Synthetic coding sequence
atgagtcagatgaacaacgttggcttttccaccgccattttgcttactcccgtggacccaactgccctccttgattaccgcgaggttcaccaaatgatacgggagctggccattggaatctactgcctcaaccagatccctagcattagcctggaggcaaactatgatcagagctccagctgccagttgcccccagcctactacgacaccagaattgggcagattctgataaatatagattacatgttgaaggccctatggcacgggatctacatgcctaaggaaaaacgggctcgattcagtgagctctggcgcgctataatggatattgatccggatggtaagccccaaacaaataaggacatttttagcgaattcagtagcgccggtctaaccgatataactaaggacccagactttaatgagatctatgatgaggacgtcaacgaggatcccacatatgaccccaattcaccagaagagactgctgtttttatgaaatacgccgagaatattatgctcaaactgaccttctcgactactcagattcagcagtacgaaaatgtctttatctttgagaccggctattggctgactaatgctatcaaatacaatcaggactacctggacatttgtacatatcagcgcttacagcagagactgtacttgcaaaagaagatcatccaaaagcactttgaaaagaagaaggatattaggcgcggtattggatatctcaagcttatctgctttctgattccatttctcctctccctcaaaaagaaaatgaaggtgccttacctatcaagtttgctacagcctttctcagacgataaagtaaagacggagcgggaactgcccccatttatctatggcagggatttcaagtgccagaactttcattacaaggagaaccagtactttcacgtgcacgggggaatcgagttcgacatctcaacacctagtatcgagaatgccctggaagacttccagaagaatctcgagaagatcagagactgtgcagcaaatacctttatcgaggattccggttataaggaatactacagcataccggtaatggagtttcacgggaaatcttactatgttatctattttgaactcgagaccttctaccaacagttgtataaaacccagtggtggggggctatcaacgagatagttaacaatctgcggttaaaacgcctgccactaaccgacgctcagttgcatgaacagtttaagaagaagttgggcttcaagcgggcaatgaagtgcaagtccattccgttcgggatgaagtctgccgtggagagaggccttagcgccgtgtttcacaccttttccaggaagacatcttccagcactatcaacgtaagcgacgaggccggttacacaatctttcatcatgccgcactgcataatagagtctctattatctgccagctgtgcaatgcaaacttcaaggtgaaccagcgccgttttgtaacattctcacagggccctaccccactgcatctcgctgcacaggcttgcagtttagagaccactgtgtgcctgctgtgttcaaaagccgactataccttgagtgagaagcgtggttggatgccaatccacttcgcagccttctacgacaacgtgtgcattatcattgccctctgcaggaaagacccatcactacttgaggctgaggctaccgctgagaatcagtgtacgcctctgctactggccgcaacctctggggctctggacacgatccaatacctgttcagtattggtgcgaattggcggaaaacggacattaaaggaaataatataatccatctttctgtgttgacattccacactgaggtgctgaagtacattataaaattgaatatccctgagctgccagtgtggaaaaccctggttgagatgctgcagtgtgagtcttataagaggagaatgatggccgtgatgagtcttgaggtgatctgtcttgctaatgatcaatattggcggtgtatattggatgcaggcacaattccagcactgattaacctgttgaagtcatctaagatcaaactgcagtgcaaaacagtcggcctcctgtccaacattagcactcataaaagcgctgtccacgccttggtcgaagcgggtggcattccctccttgataaacctactggtctgtgacgaacctgaagtacacagcagatgcgccgtgatcctttacgacatagcccagtgtgaaaataaggacgtcatcgcaaaatataatggcatcccctctctgatcaatctactcaaccttaacatcgagaatgtcttggttaatgtgatgaactgtatccgcgtgctctgcatcggcaatgaaaacaatcagcgcgctgtgcgagagcacaagggcttgccatacctcatcagattcctgagtagcgactctgacgtgctgaaggccgtctcaagtgctgccatcgccgaggtggggagggataataaggagatccaggacgccatcgccatggaaggtgccattccccctttggtcgccctcttcaagggcaagcagatcagtgtgcagatgaaaggggctatggctgtggagtccttagcctcccataacgctctgattcagaaggcctttttagaaaagagtcttacaaaatacctgcttaagctgttaaaggcttttcagatcgatgtgaaggaacagggagcggttgctctctgggcccttgccggtcagacattgaaacagcagaagtacatggcggagcaaattggctactcttttatcatcaacatgctattatccccatctgccaagatgcagtatgtgggcggtgaggccgtcatcgccttgagcaaagattctaggatgcaccagaaccagatctgcgaggggaatggcatagccccactcgttaggttactcagaattagtaccatagccgagggaacgctgctctctgtaatccgggcagtgggctctatctgtattggggtggcacacacaagcaaccccgtgagccagcagctggtggtggatgagaacgcattccccgttcttattcagctcctcaggaatcacccaagcccaaatattaaagttgaagttgccttttcgctggcgtgcatcgttctagggaatgacgttctgcagaaggacctacacgagaacgaaggtttcgagtacgctgacgtcttgtatctcttgcactctaccgagaaggatatttgcttaagagcaggctacgcgctgactctgttcgcttttaacaaccgctttcagcaatacttgattctggagagtgggatcatgactatttccatattcgaaagatttctggagagtaccgtcgagacggaaaaggctatggctgcctttcaaatcgtggtcctggctaaggtgatcagagacatggaccacattacattgtcagctcgcggagtgaccattctagtggattctctttactcggttcaaacatcgacaatagttttaacaggcaatcttattgcctccttagcccatagtagggccggaatccctgaagccttcacgacgctggggacaatccagagactctgttaccatctgtattccggtattgaagaggtcagggccgcatgttcttctgccctcggatatctcacgtataatgccaacgcatttcggatccttttaaaggagtgccgtaataaacctaatcagttcatcaggatcaagaataatataagcagggatgcttccatcaatcccgcattcctgaaggagttccagatgcagcagaccctggtgggcctgcccagtctgagcctggagaaaaacgggggtccctcaatcatccccatctttaagcggggtaaagagcatagacggaagctgaaaccaaaaattcagccaaaggattctctaaccttgctgccaccagtcaccaactttatggggttgtttaaagccaccaagaaaactaaggattctcataacatcttctcttttagttccacaattaccagcgacatcactaatgtttcaagacctagaattgtttgcctgaaccaactggggaagcatgtgcagaaagccaaccctgaacccgcagaaggatag

SEQ ID NO: 48330 - DNA, 3243 bp, Artificial Sequence
  Description of Artificial Sequence: Synthetic coding sequence
atgctgcgtctgccaaagaagggcctcccacggttcgagcaagttcaggatgaggacacttacctcgagaatttagctatccagagaaacgcctccgcattctttgaaaagtatgatcggtcagagatccaggaactgctgaccactgccctcgtgtcatggctgagtgcaaaggaagacgtaagatcccaagtagaccttccctgcgggatcatgtcccagatgaacaacgtcggcttcagtacagctattcttttgactccagtcgatccaacagcgctgttggattatagagaggttcatcagatgataagggagctcgccatcggaatttactgccttaatcagataccatccatctctctagaagccaattatgaccagagtagttcctgccagctccctcctgcatactacgacacacggattgggcagatcctgatcaatattgactacatgttgaaagccttatggcacggcatatacatgcctaaagaaaaaagggccaggttttctgagctgtggcgcgcaatcatggatatagacccagacggaaagccccagacaaataaggatatattctctgagttctcttccgctgggttaaccgatatcacgaaagatcctgacttcaacgagatttatgacgaagatgttaacgaggatcccacttatgatcccaatagtcccgaagagactgcggtctttatgaaatatgccgaaaacataatgctgaaactcactttttccaccactcagattcagcagtacgagaatgtgttcatcttcgaaactgggtattggctcaccaacgcaatcaagtataatcaggattacctggatatctgcacatatcagcggcttcagcagcgactgtatctccagaagaagattatccagaagcattttgaaaaaaaaaaagacattcgaagagggatcgggtatttgaaactgatctgttttctcatccccttcctcctctctttgaagaaaaagatgaaggttccatacctttcttccctgttgcagcctttttcagatgataaagtgaaaaccgagcgagagctgccgccttttatctacgggagggacttcaaatgtcagaactttcattacaaagagaaccagtatttccatgtccacgggggaattgaatttgatatctccacacccagtattgaaaacgctctggaggacttccagaaaaacctggagaagattcgcgattgtgcagccaatacctttatcgaggatagtgggtataaagagtactattctatccccgtgatggaattccacggcaaaagctattatgtaatctattttgagcttgagactttttatcagcagctgtacaaaacacaatggtggggagccattaacgaaatcgttaataaccttaggctgaagaggctacccttgaccgacgctcagctccatgagcaatttaaaaagaagctgggatttaaacgggctatgaagtgcaagtctatcccattcggcatgaaatccgctgtggagcggggattgtccgcggtatttcacacttttagcagaaaaacctcgtcatccaccatcaatgtatccgacgaggcaggttatactatcttccatcacgctgcacttcataaccgggtcagcatcatatgccagttgtgcaatgccaattttaaggttaaccagagaagattcgtgacgttttcccagggtccaaccccgttgcatctggccgctcaggcctgctctcttgagacaaccgtatgcttgctgtgctcaaaggctgactatacattatccgaaaaaaggggctggatgcctattcacttcgccgctttttatgacaatgtgtgtattatcattgctctttgtagaaaggacccctcattgttggaagctgaggcaactgcagagaaccaatgtactcccctgttgctggcagcaacctccggggctctagatactatccaatacctattctctataggcgctaactggcgcaaaacggatatcaaaggcaacaatatcattcacctctctgtactcacctttcacacagaggtgttgaagtacatcattaaactgaacattccagaacttccagtatggaaaaccctggttgagatgctccagtgcgagtcttataaacgaagaatgatggcagtgatgtctcttgaagtgatttgtttagccaatgaccagtactggcgctgtatccttgatgcaggcacaatccctgccttgattaacttgttgaaaagctccaagatcaagcttcagtgcaagactgtcggactcctcagtaacatatccactcataaatcagcagttcatgccctggtcgaggcgggaggaataccttccttgattaatttactggtctgcgacgagccagaagtacattccaggtgtgctgtgattctgtacgatatcgcccagtgtgaaaacaaggacgtaatagcaaagtacaatgggatccctagtttgattaaccttctcaatctgaatattgagaacgtgctggtgaatgttatgaattgcatccgtgtgctttgcataggcaacgagaataatcagagggcggtacgggaacataaaggcctcccctatctgatcagattcctctccagcgattctgatgtcctcaaagcagttagttctgcggctatcgctgaagtgggacgcgataataaggagatccaggatgccattgcaatggaaggtgctatccctcccctcgtggctctgttcaaaggaaaacaaatctcggttcagatgaaaggtgcaatggccgtggagtcactggcatcccacaacgcattgatacagaaagcttttcttgagaaaagtctgaccaagtacctgctcaagcttctcaaggcgttccaaatcgacgtaaaggaacagggggcagtcgctctgtgggccctcgccggtcagacgttaaagcagcagaaatatatggcggagcagattggatactctttcattattaacatgctgctatccccttcagcaaagatgcagtacgtcgggggagaagctgtgatcgcacttagcaaagactcgagaatgcaccagaaccagatctgtgagggaaatggaattgcaccactggtgcgactgctccgcatcagtacaatcgccgagggtacgctattgtccgtgatcagagctgtggggtccatttgcataggctaccttctgaagagcagattatgcatcaacacattctgtctccagtag

SEQ ID NO: 48331 - DNA, 4305 bp, Artificial Sequence
  Description of Artificial Sequence: Synthetic coding sequence
atgctacgcctccctaaaaaaggcctgcccagattcgagcaggtccaggatgaggacacgtatttggaaaaccttgccattcagaggaatgcttctgcttttttcgaaaagtacgaccgctctgagatccaggaattgctgaccaccgccctggtgagttggctcagcgccaaggaggatgtgcgctcccaggtcgacctgccctgtggaattatgagtcagatgaacaacgttggtttttctaccgccatactgcttacaccggtcgacccgactgcattgctggattaccgcgaggtgcatcaaatgatcagggagcttgctatcggtatctactgcctgaaccagatccccagtattagcctggaggccaattacgatcagtcatcatcttgccagttgcccccagcttactacgacacaagaatcggccagatcctgatcaatattgattacatgctcaaggccctgtggcatggtatctatatgccgaaggagaaacgagcacgcttctccgagctttggagagccattatggacatcgaccctgatgggaaaccacagaccaataaggatatcttcagcgagtttagcagcgccggacttacagacatcaccaaggaccccgactttaacgaaatatatgacgaagatgtgaatgaggaccccacctacgaccctaactcccctgaagaaacagccgtgttcatgaagtatgcggagaatattatgctgaagctgactttttctaccacccaaatccagcagtatgagaacgtcttcatcttcgaaacaggctattggctcacaaatgcaattaagtacaaccaggactatcttgatatctgtacatatcagcgactccagcaacggctgtacttgcagaaaaagattattcaaaagcactttgagaaaaagaaagatatccgcaggggcatcggctacctgaaattaatttgctttctcataccgttcctgctaagcctcaagaagaaaatgaaggtgccatatctctctagtctgctccagcctttctccgacgacaaagtgaagactgagcgggagctccctccttttatttatggtagggattttaagtgccagaactttcactacaaggaaaatcagtactttcacgtccacggtggaatcgagtttgacatctccaccccctccatcgaaaatgcactagaggactttcagaagaaccttgagaagatcagggactgtgcggcaaacacatttatcgaggactctggctacaaagagtactattccattccggtgatggaatttcacggcaaatcctactatgtcatctatttcgagctcgagacattttatcagcagctctacaagacacaatggtggggagcgattaacgagattgtgaataatcttaggcttaagagattgcccttgacagatgcccagctgcacgaacaattcaagaagaagttaggattcaagcgagccatgaaatgtaaaagcatcccctttgggatgaagtccgccgttgagcgcggactgagcgcggtgttccatacattttccagaaagacgtcctcttctaccatcaacgtcagtgacgaagccggatataccatctttcatcacgctgcgctccacaatcgtgtgtcaattatatgccagctgtgtaacgctaactttaaggttaaccagcgtcgatttgtgaccttttctcagggccctacaccactccacctcgccgcacaagcctgttcgctggagaccactgtgtgcctcctgtgttccaaggcagattatactttaagtgaaaagcggggatggatgcccattcactttgcggctttttatgataacgtgtgtatcatcattgcactgtgtcgcaaagatccaagtttacttgaagctgaggctacagcggaaaaccagtgcaccccactccttctcgcagccacctcaggtgcccttgatacaattcagtatttattcagcattggagctaactggcggaaaaccgacatcaagggaaataatattatccatctatctgttctgacgtttcacacagaggttttgaaatatatcattaagttaaacatcccagagctgcctgtgtggaagacactggtggaaatgttgcagtgcgagagctacaaacggagaatgatggcagtgatgtctctagaggttatctgcctcgccaacgatcagtactggcgctgtattttggatgcgggtacaattcccgctttaattaacctgctcaaaagtagtaaaattaaactgcaatgtaaaaccgtgggcctgctgtccaacataagtactcacaagagcgctgtgcacgcattggtggaggctggtgggattccatcactgatcaacttgctcgtgtgtgacgagcctgaggtccatagtcgctgtgctgttatcctgtacgacattgctcagtgcgaaaacaaggatgtgattgccaaatacaacggcatacctagcttgattaacctgttgaacctgaatatcgaaaacgtactcgtgaacgttatgaactgcattagagtgctctgcatcgggaacgagaacaaccaaagagctgtgagagagcacaagggcctcccataccttatccgctttcttagcagcgactctgatgtgctgaaggccgtgtcctctgccgctattgcggaggtcggcagagacaacaaggaaatccaagatgccatagccatggagggcgctattccaccgctcgtcgctctttttaagggaaagcagataagtgtgcaaatgaaaggcgcaatggcggtcgagtccctggcatcgcataacgctctgatacagaaggctttccttgaaaagagcctcacaaaatatttgctgaagcttttaaaagcatttcaaatcgatgttaaggagcagggtgccgttgctctctgggctttggcgggacagacactgaagcaacagaagtatatggctgagcagattgggtactcattcatcatcaacatgctgctgtcgccgagcgctaaaatgcagtatgtggggggagaagccgtcatcgctttgtccaaggactctagaatgcaccagaatcagatttgcgagggcaacggtatcgcccctctagtgagactactgaggatctctacaatcgctgagggcacactgctgtccgttatcagagctgttggatccatttgtataggtgtggcgcatacttctaacccagtaagtcaacagctcgtcgtcgatgaaaatgcttttccagttctcatccagctcctgcgcaaccatcctagtccaaatatcaaagtagaagtggccttcagcctggcttgtatcgtgctgggtaatgacgtgctccagaaggatctccatgagaatgaagggttcgaatatgccgacgtcctgtacctgctccacagcactgagaaagacatctgcctgagagccggttacgccctgaccctttttgcattcaataatcgattccagcagtaccttatccttgaaagcggcatcatgaccattagtattttcgaacgcttcctggaatctactgtggaaactgaaaaagctatggccgcttttcaaatcgtggtgcttgctaaagtgattagggatatggaccacattaccctgtctgccagaggtgtaactatacttgtcgactccctttacagtgtgcaaacgtctaccattgttttgaccggcaatcttatcgcaagcttggcgcatagccgcgcaggcattcctgaggccttcactaccctgggtaccatccagaggctttgctaccacctgtactctggcatcgaggaagtgcgggctgcatgtagctcagctttgggctatttgacgtacaacgcaaacgcattccggattctacttaaagaatgccgcaataagcctaaccagttcatccggattaaaaacaatattagccgggatgctagtataaatcctgcattcctgaaagagttccagatgcagcaaacactcgtgggtttgcccagccttagcctggagaaaaacggtggccctagcatcattccaatatttaaaaggggcaaagaacataggagaaaactcaagcccaagatccagccgaaagatagcctgacactccttcctcctgtgacgaactttatgggactattcaaagccacaaaaaagacaaaagatagtcataatatattcagcttctccagtaccattacgagcgacataacaaacgtcagtcgcccacgaatcgtatgcctcaaccagcttggaaaacatgtgcagaaggccaatcctgagcctgccgagggttag

SEQ ID NO: 48332 - DNA, 3513 bp, Artificial Sequence
  Description of Artificial Sequence: Synthetic coding sequence
atggccgaggaggaggttgccaaactcgagaagcatctaatgcttctgcggcaggagtatgtcaagctccagaaaaaattagccgaaacagagaaacgttgcgccctccttgccgctcaagcaaacaaggaatcttcttccgagtcctttatatcaaggctgctggcgatcgtcgccgatctatacgagcaggagcagtattctgaccttaagattaaggtgggcgaccgccacatttcagcccataaattcgttttagcagctcgttccgacagttggtctcttgcaaaccttagtagcactaaggaactcgacctgtcagacgctaacccagaagtgacgatgactatgctgcggtggatctacactgacgaactggagttccgcgaagatgacgtatttctcacagagttgatgaagctagcaaatcgatttcagttacagcttctacgagagcgttgcgaaaagggtgtgatgtcacttgtgaatgttagaaattgtatcagattttaccaaacagcagaagagctcaatgcctcaacccttatgaactactgcgccgaaattatcgcatcacattgggacgatctacggaaggaggacttcagttcaatgtcggcgcagctcttgtacaaaatgatcaaaagcaaaaccgagtatcccttgcacaaagccattaaggtggagagagaagatgtggtgtttctatatcttatcgaaatggatagccagctccccggtaagctgaatgaggcagaccacaacggcgacctggcccttgatctggccctttcccgaagattggagtctatcgcaaccaccctggtgtctcataaagccgatgtagacatggtggataagagcggctggtctctgctgcataagggcatacagaggggagatctctttgccgcaacttttcttatcaagaatggggcttttgttaacgccgctaccttgggcgcacaggagacaccactccatttggttgccctgtattcctcaaaaaaacacagcgccgacgtgatgagcgaaatggcacagattgccgaggccctcctgcaggcaggtgctaatccgaacatgcaggatagcaaggggcgaaccccccttcacgtgtcaatcatggcaggtaacgagtacgtcttctcacagctgctgcagtgcaaacaactagacctcgagctgaaggatcacgaaggcagcacagcactgtggctcgccgtgcagcacataacagtgagctccgatcagtctgtcaacccgtttgaggacgtgccggttgtgaatggcacaagcttcgacgagaacagttttgcagctcgtctgattcaacgagggtctcacacagatgcacccgacactgccaccgggaactgcctgctgcagcgagctgctggggcaggcaacgaggctgcagctctgtttcttgctactaacggcgctcacgtgaatcaccgcaataagtggggggagaccccccttcataccgcatgtcgacacggacttgccaacctcacagctgaattgctgcagcagggcgcaaacccaaacttgcaaacagaggaagcactccccttgcccaaggaggcggcttcactgacctctctcgcagattcagtccacctacagaccccactgcatatggccatagcctacaaccaccctgacgtggtctccgtgatacttgagcagaaagcaaacgctctgcacgccacaaacaatctccagatcatcccagatttctccctcaaagactctcgagaccagaccgtcttgggcctggccctgtggactggtatgcataccatcgcggctcaactgttaggtagcggagctgcgattaacgacaccatgtcggatggccaaacactcctccacatggctattcagaggcaagatagcaagtctgctcttttccttctggagcaccaggccgacatcaacgtttcgcgaacacaggacggagagaccgcactgcagctggccattaggaaccagctcccgctagtggtggacgctatctgtactcgcggagccgatatgtccgtccccgatgagaaaggcaaccctcccctctggttggcattggcgaacaacctggaagacattgcctctacattagtccggcacggctgtgacgcgacctgctgggggcctggacctggtggttgcttacagaccttgctgcaccgggctatagacgaaaataacgaaccaacagcgtgttttctaatccggtctgggtgtgatgtcaacagcccaaggcagcccggtgccaacggagagggagaggaggaagccagagacggacaaactcctctgcatctggccgctagctggggcctggaagaaacagtccagtgcctgctggaattcggtgcgaacgtcaacgcgcaagatgcggaaggtagaacaccgatccacgttgccatttccagccaacatggtgttatcatccagctgttagtcagtcatcccgatatacaccttaatgtgagggatcgtcagggactgaccccattcgcgtgcgctatgacctttaaaaataacaagtccgcagaagcaatcctgaaacgcgagtcgggagcggctgagcaagttgacaacaaaggaaggaattttctacatgttgcagtgcagaattctgacattgaaagcgtgctgtttctcattagcgtgcatgctaacgtgaacagtagagtgcaagacgcgagtaagctgactcctctccaccttgctgtgcaagcgggatctgagatcatcgttcgaaaccttcttctcgctggagccaaagtcaacgagctgacaaagcacaggcagactgccctgcacttggccgcacagcaggatctgccaacaatctgctccgtacttctggagaatggtgtggacttcgcggctgtagatgaaaacggtaataacgccctacatctagcagtaatgcacgggagactcaataacattagagtgttgttgaccgaatgcacagtggatgcggaagctttcaacctgcggggacagagccccttacatattctgggtcaatatgggaaggagaatgccgctgcaatttttgaccttttcctggagtgtatgcccggttatcccctggacaagcccgatgccgatggctctactgtcttactcctggcctatatgaaaggaaacgccaatctctgtcgcgcaatcgttaggagtggagcaagattgggggtcaacaataatcagggagtgaatatattcaactaccaagtggcaaccaaacagctgctcttccgactcctggatatgttgagcaaggagcccccatggtgcgatgggagttactgctatgaatgtaccgcaaggtttggcgttactaccagaaagcaccactgtagacactgtggacgcctgctctgccacaaatgcagtacaaaagagatacccatcattaaattcgatctgaataaacctgtcagggtgtgtaatatctgctttgacgtgctcactctgggtggcgtgagttag

SEQ ID NO: 48333 - DNA, 1464 bp, Artificial Sequence
  Description of Artificial Sequence: Synthetic coding sequence
atggctgaagaagaagttgctaaacttgagaagcacctgatgctgctgcggcaagagtacgtgaaactgcagaagaagctggccgagaccgagaagcgctgcgccctcttggccgctcaggcgaacaaggagagctccagcgagtcgttcatctccaggctgctggcaatagttgcagatctgtacgagcaggagcagtatagcgatctcaagatcaaagttggagaccggcatattagtgctcacaaatttgtactggcagcccgttctgactcctggagtctcgcgaatctgtcatccaccaaggaactggacttgtccgacgcaaacccagaggtgacaatgactatgttgcgatggatctatacggatgagctcgaattccgagaagacgacgtgtttctgacggaattgatgaagctggccaacaggtttcagctgcaactgttaagggagcgatgtgagaagggtgtgatgtcattggtaaatgttcgcaactgcatccgtttttatcagacagccgaggaactcaatgcaagtacgcttatgaattattgcgccgagatcatcgcgtcccactgggacgatctgcggaaggaggacttcagtagcatgtcagctcagcttctatataagatgataaaatctaaaactgagtatcccttgcacaaagcaatcaaagtcgaaagagaagatgtcgttttcctgtacctgatcgagatggattctcagctaccaggcaagctaaacgaagctgatcataatggcgatttggctcttgacctggcactgtcacgtaggttggaatctatcgctactactttagtttctcacaaagcggacgtggacatggtggacaagtctggatggtccttactgcataaagggattcagaggggcgatctgttcgcagcaacttttcttattaagaacggtgccttcgtcaatgcagctacactcggagcacaggagaccccgctgcacctcgtcgcattgtattcgagcaagaaacactccgccgatgtgatgtcggagatggcacagattgccgaggccctgctgcaagccggtgcaaacccaaatatgcaggatagtaaaggtagaacccctctccacgtgagcattatggccggtaatgagtacgtcttttcccagctgctgcagtgcaagcaactcgatctggagctgaaagatcatgaagggagtacagctttatggctcgccgtgcagcacattacagtatcatcagaccagtccgtgaatcccttcgaagatgttccagtggtgaacggaaccagctttgacgaaaattctttcgccgctaggctcatccaacggggttctcataccgacgctcccgacacagctaccggtaaggccagagctagccggaggggcgatgccggagtgtgcagacgacaggagatggcatgcaagtgtctgcaccctaagttccggaactag

SEQ ID NO: 48334 - DNA, 3336 bp, Artificial Sequence
  Description of Artificial Sequence: Synthetic coding sequence
atgtctagctgtcggagaagttggagacgacagaggtcagcggctctatcttggctgaggcggcagacgaggcgggcagccgcttcaccatcttctgctgtttgctggcctagttggcagactagtaccagccggtccagcaccgacgcgaatcctgaggtaaccatgactatgcttcgttggatctacaccgacgagctggagttccgcgaggacgacgtatttctgactgagctgatgaagctggctaataggttccagctccagttgctccgcgagcgctgcgaaaagggcgtgatgagcctggtgaacgtgaggaattgtattaggttctaccagacagcagaagaactgaatgcctcaacgctgatgaactactgcgccgaaataattgcctcccattgggacgatctgagaaaggaggatttttccagcatgtctgcgcaattattgtacaaaatgatcaaaagcaaaacagagtacccactccacaaagctatcaaggttgaaagagaggacgtggtattcttatatctgatcgaaatggactcacaactgcccggaaaactgaatgaagcagatcacaatggtgacctggccctggatctggcactgagtagaagattggaaagcattgcaaccacacttgtttcccacaaagccgatgtggacatggtggataaaagcggctggagcttgctgcacaaaggaatccagaggggcgatctgttcgccgcaacattcttgattaagaacggcgcatttgtgaacgcagccaccctcggtgcacaggaaaccccgctgcacctggttgcgctctatagcagtaaaaagcactccgcagacgtgatgagcgagatggcccaaatagctgaggccctgctgcaggctggtgcgaaccctaatatgcaggatagcaagggtagaactcccctgcacgtctctattatggctggaaacgaatacgtgttttctcagctgctgcagtgtaaacagttagacctggagctgaaggatcatgagggctctactgccctgtggttggccgtgcagcacatcacagtgtcatccgatcagagcgtgaacccatttgaggacgttcctgtcgtgaatggcacctcctttgatgaaaatagcttcgccgctagactcattcagcgcggatcccacactgacgctccggacacagctacaggcaactgtcttcttcagcgtgcagcgggagctggaaatgaggctgccgcactctttctagctacaaacggcgctcacgtaaatcaccgcaacaagtggggagaaacgcctctgcacactgcatgcagacatgggctggccaaccttacggccgagctgttgcagcagggggctaaccccaaccttcagaccgaagaggctctgcctctgccaaaggaggcggctagtttgactagtctggccgatagcgtccatttgcaaacacctctgcatatggctatagcgtataatcaccccgatgtcgtgtcagtaattctggagcagaaggctaacgctttgcacgccacaaacaatctccagataattcccgacttctctctgaaggacagtcgtgaccagactgttttgggccttgccctctggacaggtatgcacaccatagccgctcaattgctggggtcaggagctgctataaatgataccatgtccgatggccagaccctgctgcacatggctatccagcgtcaagatagcaaaagcgctctgttcctcctagaacatcaagctgacattaatgtgagccgaacccaggacggagaaaccgctctgcagctggcaatcagaaaccaactgccgcttgttgtggacgctatctgcacccgtggggctgatatgagcgtgcccgacgagaagggcaacccacccttgtggttagccttggctaacaacctggaggacattgctagcacattggtgcgacatggctgtgatgccacatgctggggcccaggacctggtggttgccttcagaccctactccatcgggcaatcgatgagaataacgagcccaccgcttgtttcctcattcggagcggctgtgatgtgaattctcccaggcagcctggcgctaatggagaaggcgaggaggaggcgagagacgggcaaactccactgcacctggctgcatcctgggggctggaagagaccgtccagtgcctcctcgagttcggcgctaatgtcaacgcgcaggatgccgagggcagaactccaatccatgtcgccatttctagccagcatggggttatcatacagctactggtctcccatccggacattcatctgaatgtgagagatcgccagggactgacacctttcgcttgcgccatgacgttcaaaaacaataagagcgccgaggccattttgaaacgcgaaagtggggctgctgaacaggtggataacaagggacggaactttctccacgtcgctgtgcaaaactctgatatcgagtcagtgctgttcctgatcagtgtccatgccaatgttaatagccgagtccaagacgcatctaaactgacgcctctgcacctggccgttcaggcaggctcagaaatcatcgtccgaaatctcctgctggcaggggcaaaagtgaatgagcttacaaagcaccggcagaccgctctccacctggccgctcagcaagacctgcctacaatatgctccgtgctgctggagaacggagttgacttcgctgctgtagatgagaacggcaacaatgcactgcacctggccgtgatgcatggacggttgaataatatcagggtgctgttaactgagtgtacggtggatgccgaggcgtttaatcttagaggccagtccccgctgcacatcctagggcagtacgggaaagagaatgccgctgcgatcttcgacctgttcttggaatgtatgccaggataccccctcgacaagcccgatgcagatgggtctaccgtattactcttggcctatatgaaagggaacgctaacctatgtcgcgcaatcgtgaggtccggcgcaagactgggagtgaataacaatcaaggggtcaacattttcaattatcaggtggccacaaaacagctgctgtttagactcctggatatgttaagcaaggaacccccatggtgcgatggtagttattgctatgaatgtacagctcggtttggagtgacaactcggaaacatcattgtaggcactgcgggagattgctttgtcataaatgctcaaccaaggaaatccctataattaagttcgacctgaacaagcccgtcagggtgtgcaatatctgcttcgacgtgctgaccctgggtggcgtgtcctag

SEQ ID NO: 48335 - DNA, 3513 bp, Artificial Sequence
  Description of Artificial Sequence: Synthetic coding sequence
atggctgaagaagaagtggctaagctggagaagcaccttatgttgttgaggcaagagtacgtgaagctgcagaaaaagctggctgagacagagaaaaggtgcgccctcttggctgcccaagcaaataaagaaagcagttctgagagctttattagccgtctgctcgcaattgtggccgatctttatgagcaggaacagtattctgatctcaaaatcaaggtcggagaccggcatatcagcgcccacaagtttgtactggctgctcgaagcgattcttggagtcttgcaaatttatccagtaccaaggagctggatctctcagatgctaaccctgaggtgacaatgaccatgctgcggtggatttataccgatgaactcgaattccgggaggacgatgtcttcctgaccgaactcatgaagctggctaaccggttccagctccagctgcttcgcgaacgttgtgaaaagggcgtgatgtcgttggtgaatgtccgaaactgcatcaggttctaccagaccgcagaagaactgaacgctagcactctcatgaactactgtgccgagatcatcgcctcacattgggatgatcttcgaaaggaagacttctcaagtatgagcgcacagcttctctataagatgattaagagcaaaaccgaataccccttgcataaagccatcaaggtcgagcgcgaagatgtggttttcctctacctgattgagatggattcccagctgcccggaaagcttaacgaggccgatcacaacggagatctcgcccttgatctggcgctgtcacgtcgccttgagagcatcgccactacacttgtaagccacaaagcagatgttgatatggtcgacaagagtggatggtctttgctccataaggggattcaaaggggtgacctcttcgcggcaactttcttgataaaaaacggcgcattcgtcaacgccgctaccttgggcgctcaggagacccccctccatctggtggcactgtattcatccaaaaaacactctgctgacgtgatgagtgagatggcacagattgctgaggcgctcttacaggcaggggctaatcctaatatgcaagactccaagggacgcacaccactgcacgtctctattatggcgggaaacgagtatgtcttcagccagctgctacaatgtaagcaacttgaccttgagctgaaggatcacgagggctccacagcactgtggttagccgttcagcatattaccgtgtcctcagaccaaagcgttaacccctttgaggacgttcctgtggtgaatggtaccagttttgatgagaatagcttcgctgcgaggctgatccaaagaggctcacataccgatgcccctgacaccgcaacaggcaactgcttgcttcagcgcgcagccggagccggaaacgaggccgctgccctgtttctggctactaacggcgctcacgtgaaccaccgtaacaagtggggagagactccattgcacactgcgtgtcgtcatggactcgctaacctcaccgccgagttgcttcagcagggggctaacccaaatttgcaaaccgaagaagcattgccacttccgaaggaggccgcttccttgactagtctggccgactcagtgcatctgcagacacccctgcatatggccattgcttacaaccatcccgacgttgtaagcgtcattctggagcagaaggccaatgccctgcacgccacgaacaacctgcaaatcatccccgatttctcgttaaaggactcacgggatcagaccgtactcggcttagctttatggacaggcatgcacactatcgcggcacagctcttgggatccggagccgcaattaacgatactatgagcgacggacagaccctgttgcacatggccatacagcgtcaggactccaagtcggcgctgttcctcctggaacaccaggcagacataaatgtctcccgcacccaagacggagaaacagcgttgcagctggctatacgaaatcaactgccactcgtcgttgacgccatctgcaccagaggggcagacatgagcgttccagacgagaaagggaatcctcccttatggctggctttggccaacaatcttgaagatatcgccagtaccctggtgcggcatggatgtgatgcaacgtgctggggcccaggaccaggcggttgcctgcagacattgctccaccgcgctattgacgaaaataacgaaccaacagcttgtttcctcattagaagtggctgcgacgtgaactcacccaggcagccgggtgctaacggcgaaggggaggaggaagcacgggacgggcagacccctctgcacctggctgcaagctggggtttggaagaaaccgtgcagtgtctgctcgaattcggagcaaatgtgaatgctcaggatgctgaagggcgaacacccatacacgttgcaatctcctcccagcacggcgtgatcattcaacttcttgtcagtcacccagatatccacctgaacgtccgagatcggcagggactcacaccctttgcatgtgcaatgacatttaagaacaacaagtctgccgaggccattcttaagagggagtcaggggctgccgaacaagtggataacaagggccgtaatttccttcatgttgccgtacagaacagtgacatcgaaagcgtgttatttctgatatccgtgcacgcaaacgtcaattctcgagtgcaagacgcatccaaactgactccactgcatctggccgtgcaagctggatctgaaataattgtcaggaacctgctgttagctggagctaaggtgaatgaactcacaaagcatagacaaaccgctctgcatctggccgctcagcaggacctccccaccatttgcagtgtcctcctggagaacggtgttgattttgcagcggtggatgagaacgggaataacgcactgcatctggccgttatgcacggtcggctgaacaacatcagggtcctgcttactgaatgcactgtagacgccgaagcattcaatttgcgcggtcagagtccattgcatattttgggccagtacgggaaggagaatgctgctgctattttcgatcttttcttagagtgtatgcccggatatcctctagacaagcccgacgcagatggttcaactgtgctattactggcctacatgaaagggaacgctaacctatgcagggccatcgtccggagtggggcaaggctgggtgtgaacaataaccagggcgtcaacatttttaattatcaagtggccaccaaacagcttctgtttcgcctactggatatgttatcgaaggagcccccatggtgcgatggctcttactgctacgagtgtaccgctagatttggcgtaaccacacggaagcaccactgcaggcactgcgggcgattgctgtgccacaaatgttctactaaggagattccaatcattaaattcgacttgaataaacccgtaagggtgtgcaatatttgtttcgatgttctcacgctgggtggtgtgtcttag

SEQ ID NO: 48336 - DNA, 2472 bp, Artificial Sequence
  Description of Artificial Sequence: Synthetic coding sequence
atgaagctgtttggcttcggctcaaggcgcggacagaccgctcaaggatcaattgaccacgtgtacacggggagcgggtaccggatccgagactcagagctgcagaaaattcaccgcgctgccgtgaagggagacgccgctgaggtggagcgatgtctagcaagacggagcggggacttagacgccctggataagcagcacagaaccgctctccatttggcttgcacaagtgggcacgtgcaggttgtgaccttgctcgtcaacagaaagtgtcagatcgacgtgtgcgacaaagaaaaccgtaccccactcattcaggccgttcattgccaagaggaagcatgtgcagtaatcttgctcgaacatggcgctaaccccaatttgaaagatatctacggcaacactgccctgcattatgccgtgtattctgaatccacgagcctcgcagaaaagcttctgtcccatggcgcacatattgaggctttggataaggataacaacacgcccctgctgttcgccataatctgcaaaaaggagaagatggttgagtttctactgaaaaaaaaggcatctagccacgcggttgacaggcttcggaggtccgcccttatgctggcagtgtattacgactctcccggaatcgtgaacatcctgctcaaacagaacattgacgttttcgctcaggacatgtgtggcagggacgctgaagactatgcgatttctcatcaccttactaaaatccaacagcaaatactggagcacaaaaagaaaattctaaaaaaagagaaatccgacgtgggatcatccgacgagtcggcagtgagcatttttcatgaactgcgtgtagactctctgcctgcatcagacgacaaggacttgaatgttgcaaccaagcagtgtgttccagaaaaggtttctgagcccttgccgggatcaagccacgagaagggaaaccggatcgtcaatgggcagggtgaaggcccacctgcaaaacaccccagtctgaagccctcgaccgaggtagaagaccctgcggttaagggggctgtgcagcgcaagaatgtgcagaccctcagagctgagcaggcactccccgttgcctccgaagaggaacaggagcggcatgagcgatcagaaaagaagcaacctcaagtgaaggagggtaacaataccaacaaatctgaaaagatccaactcagcgagaacatatgtgactccacatctagcgccgctgcgggtcgactaacgcaacagcgtaaaattgggaagacctatccgcaacagtttcctaaaaagttgaaggaggagcatgatcggtgcacattaaaacaggagaacgaagaaaagaccaatgtgaacatgctctacaaaaaaaaccgcgaggaacttgagcgtaaggagaagcagtacaagaaggaagtggaagccaagcagctggaaccaaccgtgcagtctttggagatgaaaagcaagacagcgagaaatacaccaaattgggactttcacaaccatgaggaaatgaaaggactgatggacgagaactgcatcctgaaagctgatattgccatcctgcggcaagagatttgcaccatgaagaacgataatctggaaaaggaaaataagtacctcaaagatattaagatcgtgaaagaaactaatgccgctctagaaaaatatatcaaactcaatgaggagatgataaccgaaacggcgtttcgctatcagcaggagctcaacgacctgaaggcggaaaatactcgtctgaacgccgaactgctgaaggagaaagagagcaaaaaacggctggaagctgatatagaatcataccagtcgagacttgccgcagccataagcaagcactcggaatccgttaaaaccgagcggaacctaaagctggcattggaacgcaccagagatgtgtctgtgcaggttgaaatgagcagcgctatatccaaagtcaaagcagaaaacgagtttttgaccgaacagctgtctgagacccagattaagttcaacgcgttaaaggataagttccggaaaacgcgagactccctgcgcaagaaaagcttagcactggagacagtgcagaatgaccttagtcagacacagcaacaaacacaggagatgaaagaaatgtatcagaacgcggaggctaaagtgaataattcaactgggaaatggaactgtgtagaggagcgaatatgccatctgcagcgggaaaacgcctggcttgtgcagcagctggacgacgtgcaccagaaagaagatcacaaagagatcgtgactaacatccagcggggtttcattgaatctggcaagaaggatctggtccttgaggaaaaatccaaaaagctgatgaatgaatgcgaccacctgaaagaatctctgttccaatatgagcgcgaaaaaaccgagggcgttgtgtccattaaggaggacaaatatttccagacatcgcgaaaaacaatctag

SEQ ID NO: 48337 - DNA, 1359 bp, Artificial Sequence
  Description of Artificial Sequence: Synthetic coding sequence
atgaaggtccaacctagcgtgacctgtgtggcatcctggggaggaattgtgcatttagaggcctttggcgatcccgtgatcgtgctgaggggcgcatgggcggtgccacgcgtggactgtcttatcgatactcttagaaccccgaacgcctcctgtatgcgaaaagggacacacctgctagtgccatgtctggaagaagaggaactagctcttcatcgtcgcagactggacatgagtgaagcgttgccctgccccggtaaagaaaccccaacacctggctgccgtctcggcgcactttattgggcttgtgtccacaacgatccaacccaactccaggccattctggacggcggagtgagccccgaagaggccacgcaggtagacagcaatggcagaactggccttatggtggcctgctaccacggcttccagagcgtcgttgccttactgtcccactgccccttcctagacgtgaaccagcaggataagggtggtgataccgctttaatgcttgccgctcaagcgggtcacgtccctctggtgtccctgctacttaactactatgtgggtttagacctggaacggagggatcagagagggctcaccgctctgatgaaggctgccatgaggaatagatgcgccgacttgactgctgtagatcccgtgcggggaaagacagctctggagtgggctgtgctgaccgactcctttgatacagtttggcggattcgccagctgttacggaggcctcaggtggaacaactcagccagcactataagcctgagtggcccgctctttccggcctggtcgcacaagcccaagcccaggctcaggtggccccttccctgctcgaaagactgcaggctaccttgtcattgcccttcgcacctagcccgcaggagggcggagtgctggaccacctggtcacagcaacgactagtctggcctccccatttgtcacgaccgcgtgtcacacgctttgccctgatcatccgcctagcctgggcactaggagtaagagtgtcccagagctgcttggaaccgctccaccccctccacttgtaccccagtcccctcccggatcgccccagcgttctccgtgggtgtttgttccgtaccaaagcccccaagggatccttagcaagtgtctccaatggctccaacctcgggacagtacatccccacggcctcaggtgcccaagatactcttaagcaaagcgtcctcatcatcccaccagtgtcagcccaagccctctcctagcggacaccagtctttggcacttcctctctggcgataccaggagttgcgcatcgagaagcggaaacaagaagaggaagccaggatggctcagaagtag

SEQ ID NO: 48338 - DNA, 687 bp, Artificial Sequence
  Description of Artificial Sequence: Synthetic coding sequence
atgagctacgttttcgtgaacgactcctcccaaactaacgtccccctcctgcaggcctgtatcgatggagatttcaactatagcaagagattgttggagtccggtttcgaccctaatataagagattcccgcggtagaactggattgcacctcgctgccgcaaggggcaacgtggacatctgtcagctgttgcacaaatttggggcagatcttctggccacagattaccagggaaatactgcgctgcatctatgcggccacgtggacaccattcagttcctggtgagtaacggtctaaagatcgacatctgcaatcatcaaggagccacaccattggttcttgcaaagcgtagaggcgttaataaagatgtgattcggctgctggagtcattagaggagcaggaagttaaggggtttaaccgcggaacccattctaaactggagactatgcagactgcagaaagtgagtctgccatggagtcacactccctgcttaatcccaatctgcagcagggcgagggcgtgctttcttcatttaggactacgtggcaggagtttgtcgaggacctcggattttggcgcgttctcctgctcattttcgtcattgctcttctgagccttggcatagcgtactacgtttcgggtgtgcttcctttcgtagaaaatcaacccgaacttgttcactag

SEQ ID NO: 48339 - DNA, 588 bp, Artificial Sequence
  Description of Artificial Sequence: Synthetic coding sequence
atgagctacgtctttgtgaatgacagctcacagactaatgtacccctgctgcaggcatgtatagacggagactttaattatagtaaaaggctgctggagtcgggatttgacccgaacatccgggactcaaggggccgaaccggccttcatctcgcagccgcacggggtaatgtggacatctgtcaactcctacacaaattcggcgctgacctgcttgccacagactaccaggggaacaccgctttgcacctgtgcggccacgtggatactattcagtttctagtgtctaatggactgaagatcgatatttgtaaccatcagggggctacacctctggtcctcgccaaaagacgaggggtaaacaaagacgtgatccggctgctggaaagcctggaggagcaggaagttaagggttttaaccgaggcactcattccaagttagagacgatgcaaacggccgagagcgagtcagcaatggagtcccattccctccttaaccccaatcttcaacagggcgagggcgtgttgtcgagcttccgtaccacctggcaggaatttgtcgaggacctcggcttttggcgagtctag

SEQ ID NO: 48340 - DNA, 687 bp, Artificial Sequence
  Description of Artificial Sequence: Synthetic coding sequence
atgagttatgtcttcgtcaatgattcatctcagaccaacgtgccattgctccaggcctgcatagacggagacttcaattactctaaacggctgctggagagcgggtttgaccctaatattcgcgacagtaggggcagaaccggcctccatttggctgcggcacgaggcaatgtcgacatttgccagctgttacataagtttggagcagatctgctggctaccgactaccaaggcaacaccgccctccatctctgtgggcacgtggacactatccagttcttagtctctaacggcttgaagatagacatatgtaaccaccagggggcaacacccctagtcctggcaaaacggcgtggcgtaaacaaagatgtgatccggctattggaatcactggaagaacaggaggtgaagggattcaatagagggacccattctaagctggaaactatgcaaaccgcagaatccgagtcagccatggaaagccatagcctgctgaatccaaacctgcagcagggcgaaggagtgctgagcagttttagaaccacctggcaggaattcgtggaggatctcggcttttggagagtgctcctgctgattttcgttatcgcactgctctctctcgggatagcttactacgtctccggtgtgctgccatttgtagaaaatcaacctgagctagtccattag

SEQ ID NO: 48341 - DNA, 687 bp, Artificial Sequence
  Description of Artificial Sequence: Synthetic coding sequence
atgtcttatgtttttgttaatgatagcagccagaccaacgtcccgttgctccaggcctgtatagatggcgactttaattacagcaagcgcctccttgagagtggttttgatcccaatattcgcgattccaggggcaggacaggcctccatttggcagccgcacgcggtaacgtggacatttgtcagctgctgcacaagtttggtgctgatctcctggccactgactatcaggggaataccgcactacacctgtgcggccacgtggacactattcagttcttggtgtcaaatggcctgaagattgacatctgcaaccatcagggggctactccactggtcctggctaagaggcggggagtgaataaggacgttatccgtcttctggaaagtctggaggagcaagaggtgaagggcttcaacagaggtacccactccaaactggaaaccatgcagaccgctgaaagtgagtctgcaatggaaagccattcccttctgaatcctaatttgcaacagggggaaggggtcctctcctcttttagaactacatggcaagaattcgtggaagacctaggtttctggagggtcttgctgctcattttcgtaattgccctgctcagcttaggcatcgcttattatgtatcaggagttttgcccttcgtcgaaaatcagcccgagttagttcattag

SEQ ID NO: 48342 - DNA, 699 bp, Artificial Sequence
  Description of Artificial Sequence: Synthetic coding sequence
atgagctacgtgttcgttaatgactcaagccagacaaacgtgcctctcctacaagcatgtatcgatggcgacttcaactactccaagcgactactggagagcgggtttgacccaaatatccgagatagtaggggccgtacgggcctccaccttgctgccgcacgtggcaacgtcgacatttgccagcttttacataagtttggtgccgacctgttagccacggattaccagggaaatactgcgttgcatctgtgcggccacgtggacactatccaatttctagtgagcaatggactcaagatagatatttgcaaccatcaaggcgcaactcctctagttctggccaaaagaagaggggtcaacaaagacgtcatccgcttactggaaagcttggaggaacaggaggtaaagggatttaatagggggacacattcaaaattggaaaccatgcagactgctgaatctgaatccgccatggaatctcacagcttgttgaaccccaacttgcagcagggcgagggtgtgttgagctcctttaggactacctggcaggaattcgtggaagatttgggattctggagggtcctgttgctcatctttgttattgccctcctttctctaggcatcgcatattatagacggactttaagactcggatccttcgccagacaagacagaagccgcatccaggccatctag

SEQ ID NO: 48343 - DNA, 249 bp, Artificial Sequence
  Description of Artificial Sequence: Synthetic coding sequence
atgagttatgttttcgttaatgacagttcccagactaatgtgccactgctgcaggcctgcatagatggggatttcaattattcaaaacgcctgcttgaatctggcttcgaccccaacattcgtgatagtcgtgggaggactggtctgcatctggctgcggctcggggtaatgtcgacatatgccagctactgcataaatttggcgctgacctcctggcgacagactatcagggaaacactgccctatag

SEQ ID NO: 48344 - DNA, 261 bp, Artificial Sequence
  Description of Artificial Sequence: Synthetic coding sequence
atgtcttacgtcttcgttaacgacagtagtcaaacaaacgtgccgcttctccaagcctgcatcgacggtgattttaactacagcaagcggctgctcgagtccggctttgatcccaacatccgcgacagcaggggcaggacagggctccatctggccgctgcacgagggaacgtagatatctgtcagctgcttcataagttcggagctgacctgcttgccaccgattatcagggcaatacagccctacacctctgcgggtag

SEQ ID NO: 48345 - DNA, 312 bp, Artificial Sequence
  Description of Artificial Sequence: Synthetic coding sequence
atgtcatatgtgttcgttaacgatagcagccagaccaatgtccctctgctccaagcatgcatcgacggagactttaactactcaaaacgcctcctggagagtggctttgacccgaacatcagagattctcggggacgcactgggctgcatctcgctgctgcaagggggaacgtggacatatgtcagcttctccacaaattcggtgccgatctcctcgctacggattaccagggcaatactgctctgcacctctgcgggcacgtggacactattcaattcctcgtgagtaatggattgaagatcgacatctag

SEQ ID NO: 48346 - DNA, 1074 bp, Artificial Sequence
  Description of Artificial Sequence: Synthetic coding sequence
atgggcaacaggcacagccaaagctacacactgagtgaggggagtcagcaacttcctaagggcgactcacagcccagtacagtcgtccagccattgtcccatcccagtagaaacggcgaacccgaagcaccacagccagctaaggcgtcttccccacagggctttgacgtggatcgggatgcaaaaaagttgaataaggcctgcaagggaatgggaacgaatgaggcggcaatcatcgagattctgtccggtcgcaccagcgatgagagacagcagattaaacagaaatataaggcgacctacggtaaggagctggaggaagtactcaagtccgaactctctggcaactttgaaaagactgcactggcgctgctggatcggccatcagaatacgcagcgcgacagctccagaaagccatgaagggcctgggaacagatgagagcgtactgattgaggtgttatgtacccgcactaataaagagatcatagccattaaagaggcataccagcggctgttcgatcgctctctcgaatccgacgttaaaggcgacacatccggaaacctgaaaaaaatcttggttagccttctacaggccaataggaatgagggcgatgacgtggacaaggatctagccggacaagacgcaaaagacttgtatgatgcaggcgaaggacgctggggtactgacgaactggcctttaacgaagtcctggcaaagcggtcgtataagcaattacgcgctacctttcaggcctatcagattctgatcgggaaggatatagaagaggccatagaggaggagacatccggcgacctacaaaaagcttatctgaccctggtaaggtgcgctcaagactgcgaagattattttgctgagcgactctacaaatccatgaaaggagcagggaccgatgaagaaacactgattcggatagtagtcacacgcgcagaggtcgacctgcaggggatcaaagcgaagttccaagagaagtaccagaagagtctgtccgacatggttcgtagcgacacaagcggagacttcagaaaactgttagtggcgcttctgcactag

SEQ ID NO: 48347 - DNA, 951 bp, Artificial Sequence
  Description of Artificial Sequence: Synthetic coding sequence
atggggaacagacacgccaaagcctcgtcgcctcaaggatttgatgtcgatcgagatgctaaaaagctcaataaagcctgcaaaggcatggggacgaacgaggccgcaattattgagattctcagtggaaggacaagcgacgaaagacagcaaattaagcagaagtacaaggctacttatggtaaagaactggaagaggtgctcaaaagcgagctgtctggcaacttcgaaaaaacagctctggcccttctagaccgcccttccgagtacgccgcaaggcaactgcagaaagccatgaagggactggggacggacgagtccgtgctaatcgaggttctgtgtacgcggacaaacaaggagatcatcgcaatcaaagaagcctatcagcggctatttgataggtccttggagagcgatgtgaagggagataccagtggaaatctcaagaaaattctcgtttctcttctacaggccaacaggaacgagggagatgacgtggacaaggatcttgcaggccaggacgctaaagatttgtacgacgctggagagggacgttggggcacagacgagctggcgttcaatgaagtcttggccaaaagatcttacaaacaactgcgcgcaacctttcaggcttaccagatactgataggaaaggatattgaagaagctatcgaagaagagacgtcaggtgacttgcagaaagcttaccttacccttgttcggtgtgcccaggactgtgaggattactttgcggagagactctataagagcatgaaaggcgctggcacggatgaagagacactgattcggatagttgtaacgagggccgaggtggacctgcaggggatcaaggccaagttccaggaaaaataccaaaaaagcctgtctgacatggtgaggtccgacacatccggtgattttaggaaacttcttgtcgcgctgctgcattag

SEQ ID NO: 48348 - DNA, 2946 bp, Artificial Sequence
  Description of Artificial Sequence: Synthetic coding sequence
atggtccaccactccggaagtatccagtcatttaagcaacagaaaggcatgaacatatctaagagtgaaattacgaaagagacctctctgaaacctagtcggagaagcctgccttgcttggcccagagctacgcctattccaagagcctgtctcagagtactagcctgttccagagcactgaatcagagagccaggccccaacatctattactctcatttctactgacaaggctgaacaagttaatacagaagaaaataagaacgacagcgtgcttcggtgctcattcgccgacctgagtgacttctgcctggcgctgggcaaagataaggactatacagacgagagtgagcacgctacctacgatcgcagccggctgatcaatgatttcgttataaaagataaatccgagttcaagactaaactgagtaaaaatgacatgaactacattgcttcatccgggccactttttaaggacggtaagaagagaatagactacattctggtgtacaggaagactaacattcagtacgataaaagaaacacctttgaaaagaaccttcgggctgaggggctgatgctcgagaaagaaccagcaatcgcttctcccgatataatgtttatcaaaatacacatcccttgggacacgctttgcaaatatgcagaacgcctgaacatccgaatgccctttaggaagaagtgttactatacagacggtcgaagcaaatctatgggacgaatgcagacgtacttcagaaggattaagaactggatggctcagaacccaatggtgttggacaagtcagcatttcccgatctggaggaaagtgattgttacaccgggccttttagccgcgctaggattcaccatttcattataaacaacaaagatacatttttctctaatgcaacaagaagtaggattgtgtatcacatgctcgaacgaacgaagtatgagaatggcataagcaaggtgggcatccgaaagctcatcaataatgggtcctatatcgccgcattccctcctcatgaaggggcatataaatcatctcagccaattaagacccatgggcctcaaaacaaccgacacctcctatacgagcgatgggcccgatggggcatgtggtacaagcaccagcccctcgatctgattcggctatactttggggagaaaatcggactctactttgcatggcttggctggtacactggtatgttgattcctgctgctatcgtggggctttgcgtctttttttacggtctgttcaccatgaataactcacaggtgagtcaggagatatgcaaagcaactgaagttttcatgtgcccgctttgcgataagaactgttcccttcagcgtctcaatgactcttgtatctacgcaaaggttacttacctgttcgataacggagggactgtctttttcgctatcttcatggccatatgggcgaccgtcttcctggagttctggaagaggaggcgctctatcctgacttacacgtgggatctcatcgagtgggaggaggaagaggaaacgctaaggccccagttcgaagcaaaatattacaagatggaaatcgtgaatccgatcacgggcaagcccgaaccgcatcaacccagttcagacaaagtgacaaggctgctcgtgtcagttagtggaatcttctttatgatctccctcgtgattaccgctgtcttcggggtcgtggtctaccggctcgtggtgatggagcagtttgctagcttcaagtggaattttattaagcaatactggcagttcgctacatccgccgcagccgtgtgcatcaacttcatcattatcatgctgctgaatctggcctacgagaagatcgcgtacctgttgacaaacctggagtaccccaggaccgagagtgagtgggagaatagcttcgcactgaagatgtttctctttcagtttgttaatcttaatagctccatattctatattgcgttctttctcggacgattcgtcgggcatcctgggaagtacaataagctcttcgaccggtggcggctggaggagtgccaccccagcgggtgtctgattgacctctgccttcaaatgggggtgattatgtttctgaagcaaatttggaacaacttcatggagctcggctatcctttgatccagaattggtggagtaggcacaagattaagcgaggtattcatgatgcatcaatcccccagtgggagaacgattggaatctacaaccaatgaacttgcacgggctaatggatgagtacttggaaatggtgttgcagttcggcttcacaactatcttcgtcgcggcattccctctggcacctctgttggcactcctgaataacataatcgaaatccgactcgatgcctataaatttgtgacccagtggcgacgcccactcccagctcgtgccaccgacattgggatctggctcgggatactagagggaattggaatcctggcggtcatcacaaatgccttcgtcattgcaatcacctctgattatataccacggttcgtgtatgagtacaaatatgggccatgcgcaaatcatgttgaaccatcggaaaattgtctaaaaggctacgtgaataactccctttctttctttgacctctcggagctgggaatgggtaagtccgggtactgccggtatagagactaccgcggtcccccatggtcctccaaaccatatgaattcacactgcaatactggcacattctggcagcccgtctggccttcatcattgtgttcgagcacctggtttttggcatcaaatccttcatagcctaccttattcccgatgtgccaaaagggctgcacgaccgtatcaggcgagagaagtatctagtacaggagatgatgtatgaggctgagctggaacatttgcagcagcagcggcgtaaaagcgggcagcccgtccaccatgagtggccctag

SEQ ID NO: 48349 - DNA, 2898 bp, Artificial Sequence
  Description of Artificial Sequence: Synthetic coding sequence
atgaatatctctaagagcgagatcaccaaagaaacatcactgaaaccatcccgacgatccctgccctgcctggcacagagctacgcatactccaaatcactcagtcagagtacaagcttatttcagtccactgagagcgaaagtcaagcccctacatctatcaccctgatctcaactgacaaggcagagcaagtgaacaccgaagaaaacaaaaacgattctgtgctcagatgtagtttcgccgatctttcagatttctgtctggcgctgggaaaggacaaggactataccgatgaatccgagcacgccacctacgaccgctcgaggttaatcaacgattttgtgattaaagacaagagcgaattcaaaactaaactttccaagaacgatatgaactatatagcttcgtcaggaccattatttaaagacggcaagaaacggattgattacatccttgtttatcgcaaaactaatattcagtacgataaaagaaacacttttgaaaagaatctcagagccgagggcttgatgctggaaaaagaacctgcaatcgccagcccagacattatgtttattaaaattcatatcccctgggacacactgtgcaagtacgctgagcgcctcaacattcggatgccctttagaaaaaagtgctactatacagacggaaggtccaagtcaatgggcaggatgcagacttatttccgcaggatcaaaaattggatggcgcagaaccccatggtgcttgacaagtcagcgtttcctgacttagaagagtctgactgttatacaggaccgtttagtagggcacgaatccatcacttcatcattaataataaggacaccttcttcagtaatgctactagatcccgaatagtgtaccacatgctggaaaggaccaagtacgagaacggcattagcaaagtagggatcagaaagctgattaataacggttcgtatatcgccgcttttcctcctcatgaaggagcttataaatctagccagcctattaagacccacggacctcagaataacaggcacttactttacgagaggtgggcccgttgggggatgtggtataaacatcaacccctagatctgatccggttgtactttggggaaaagatcgggttgtatttcgcttggctgggatggtacactggtatgctgattcccgctgccatcgtgggactgtgcgtttttttttacggcctgttcaccatgaacaactcacaggtcagccaagagatttgtaaggctaccgaagtgttcatgtgtccactctgtgataagaattgctcactacaacggctgaatgattcttgcatctatgcaaaagtcacctatctgttcgataatgggggaacagtgttcttcgccattttcatggcaatctgggctacagtgttcctggagttttggaagaggaggcggtctatactaacatatacatgggaccttattgagtgggaggaggaggaagaaacgctcagaccccaattcgaggcgaaatattacaagatggaaattgtaaacccaatcacaggcaagcccgagcctcaccagccctcgagtgacaaagtgacccgactgcttgtgagcgtgtcggggatcttcttcatgatctctctggtcatcacggcagtctttggtgtggtggtgtacagactggtggttatggagcagttcgcctctttcaagtggaacttcattaaacagtactggcaattcgcaacctctgccgctgccgtgtgtattaactttattatcatcatgctactaaacctggcttatgaaaaaatcgcttacttgctcaccaaccttgaatacccgaggacggaatccgaatgggaaaattctttcgcacttaagatgtttctgtttcaattcgtgaacctgaatagctctatcttctatatcgcgtttttcttgggtagattcgtcggccatcccggtaagtacaacaagcttttcgacaggtggcgtctcgaagaatgccatccttcaggatgcctgattgacctgtgtctgcagatgggtgttataatgtttctgaaacagatttggaacaatttcatggagttgggctaccccctgattcagaactggtggagccgccacaaaatcaagagaggaatccacgatgcctctataccccagtgggagaacgactggaacctccagcctatgaacttgcatggtctcatggatgaatatctcgaaatggtactccaattcggatttacgaccatatttgtcgccgcttttccactggcccctttgctggccctccttaacaatataattgaaattcggctcgacgcctacaagttcgtcactcaatggcgcaggccactcccagcgagggctactgacatcgggatttggcttggtattcttgaggggataggcatcctggctgtgatcaccaatgctttcgtgatcgctataacgtccgactatatcccaaggttcgtctacgaatacaaatatgggccttgcgcaaatcatgtcgagccctccgagaactgtctcaagggctacgttaacaactctctgagcttttttgaccttagtgagctggggatgggaaagagtgggtactgccggtaccgggactacagaggcccaccatggtctagcaaaccttacgagtttaccttgcaatattggcacattctagccgcacgtctggcctttattatcgtgttcgagcatctcgtgttcggaatcaaaagcttcatcgcctacctcatccctgacgttccgaaagggctgcatgacagaattcgcagagagaagtatcttgttcaggaaatgatgtacgaggcagaattggaacatctgcagcagcagcgtagaaaatccggtcagccggttcaccatgagtggccatag

SEQ ID NO: 48350 - DNA, 2508 bp, Artificial Sequence
  Description of Artificial Sequence: Synthetic coding sequence
atgaattatatcgccagcagcggacccctctttaaagacgggaagaagagaatcgattacatacttgtgtacagaaaaaccaacatccaatatgataaacgcaacactttcgagaagaatctgagggcagaagggctgatgctcgagaaagagcctgccatcgcctcgcccgatataatgttcattaagattcacattccttgggatactctgtgcaaatacgctgaacggcttaatatcagaatgccattccgcaagaaatgttattataccgatggaaggtctaaatctatgggacgtatgcagacgtatttcagacggatcaaaaattggatggcacaaaaccccatggttctggacaaaagcgcattcccagatctggaggagtccgactgctatactggcccattcagcagagccaggattcaccatttcatcattaacaacaaggatacattcttcagtaacgctactcgttcccgaatcgtgtaccatatgctggaaaggacgaagtacgaaaatggcatcagcaaggtcggcataaggaagctcattaataacgggtcgtacattgccgcattcccgcctcacgagggtgcatataagagcagccagccaattaaaacccacggccctcagaataacagacatctgctctatgagaggtgggctagatggggaatgtggtataagcatcagccgcttgatcttattagattgtacttcggcgagaaaatcgggctatacttcgcgtggcttggctggtacaccggcatgttgatcccagcagctatagttggactgtgtgtatttttctacggtctgttcacaatgaacaactcacaggtatcacaagagatctgcaaagccacagaagtctttatgtgtcctctctgcgacaaaaactgtagtctgcagaggctgaatgatagctgtatctacgccaaggttacttacctttttgacaatggaggtacagtattcttcgctatttttatggccatatgggctaccgtgtttctggagttctggaagagaagacgttctattctcacatatacttgggatttgattgagtgggaagaagaagaggaaacattacggcctcagttcgaagcaaaatactataaaatggagattgtcaaccctatcactggaaaacctgaacctcaccaaccttccagtgataaggtaacccgtctcctagttagtgtgtcaggcatcttctttatgattagtctggtgataacggctgtgtttggggtcgtggtctaccgattggtggtgatggaacagtttgcctcttttaagtggaatttcatcaagcagtactggcagtttgccaccagcgccgctgccgtgtgcatcaatttcattataataatgctgctgaatctggcttatgaaaagatcgcttacctgctgacgaacctcgaatatcctaggacagaaagcgagtgggagaattcttttgccctgaagatgtttcttttccagttcgtgaaccttaactcaagtatcttctatatcgccttttttttaggcagattcgttggtcatccgggaaaatataacaaactgtttgaccgatggaggttagaagagtgccacccatccgggtgccttatcgacctgtgcctccagatgggcgtgataatgtttcttaaacagatctggaataattttatggaactgggctatcccctgatacaaaactggtggagcagacataaaattaagcggggtatccacgacgcttcgatcccccagtgggaaaatgattggaatctgcagccaatgaacctgcatggcttgatggatgagtatctcgaaatggtcctccagttcggctttaccactatattcgtggccgctttccctctggctcccctcctagcgttgcttaataacattattgagatcagactcgacgcctataaattcgtcacacagtggcgacgaccgcttcctgcacgtgcgacggacatcggaatttggttaggcatactcgagggtataggcatcctcgccgtgattacaaatgcatttgtgatagcaatcacaagcgactacatccctcgcttcgtgtatgaatacaagtacggaccatgtgcaaatcacgtcgaaccttccgagaactgtctaaaagggtacgtgaacaatagcctatctttttttgacctgtcggagctgggtatgggaaagtcgggatactgccgttacagggactaccgtgggcctccttggtctagtaagccatacgaattcactctgcagtactggcacatcctggctgccaggttggccttcattattgtgttcgaacatcttgtctttggcataaagtcattcatcgcatatctcattccagacgtgcctaaaggcctccacgaccggatccgtagggagaaatacttagtacaggagatgatgtatgaggcagaactcgaacatcttcagcaacagagaaggaaatctgggcagcccgttcaccacgagtggccctag

SEQ ID NO: 48351 - DNA, 2898 bp, Artificial Sequence
  Description of Artificial Sequence: Synthetic coding sequence
atgaatattagcaagtcagagatcactaaagaaaccagtttgaagcccagcaggcggtccctcccctgtctagcccagtcttatgcctactctaaatctctgagtcagagcacaagtcttttccagtcaacggaatccgaatcacaggccccaacaagcatcaccctgatcagcacggacaaggccgagcaggttaacacggaggagaacaagaacgactccgtgctgcggtgcagctttgcggatttgtctgacttttgcctagctctgggtaaagacaaagattataccgatgaaagtgagcacgccacctatgatagatcgcggcttatcaacgacttcgtgattaaagataaaagtgaattcaagacaaagctgtccaagaacgacatgaactatattgcctctagcgggccacttttcaaagacggcaagaagcgtatcgattatatcctggtgtaccgaaagacgaatattcaatatgataaacgaaacaccttcgagaaaaatttgagggccgaaggtctgatgttggagaaggaacccgctatcgcgagccccgacatcatgttcatcaagatccatataccttgggatacgctgtgtaaatacgcagaacggctgaacatccgcatgccctttcggaagaaatgttattataccgacggtagaagtaagtctatgggacggatgcagacttacttcagaagaatcaagaattggatggcccaaaatccaatggtgcttgacaagtctgccttcccagatctggaggagtccgactgctacaccggacccttctctagagcacggatacatcacttcattatcaacaacaaggatactttttttagcaacgcaacacgatcccgcatcgtgtatcacatgctcgaacgcacaaagtacgagaacgggatctctaaagtgggaatccgtaaactgatcaataacggttcatacatcgcggcattccccccacacgaaggcgcttataagtcttcccagcctattaaaacccatgggccacagaataacagacatctgttgtacgagcggtgggccagatgggggatgtggtataaacaccaacctctcgatctgattcgactgtacttcggcgagaaaatcggcttgtatttcgcctggctgggatggtacactgggatgctgattcccgctgccatcgttggtttgtgtgttttcttttatgggctttttacaatgaataacagccaggtgagccaggaaatttgtaaagcaaccgaagtgttcatgtgtcctttgtgcgacaagaattgctccttgcagcgcttaaatgatagctgcatttatgcaaaggtgacatatttattcgacaatggaggcacagtgttctttgcaatctttatggctatatgggctaccgtatttctggaattttggaagagaaggcgaagcatactgacatatacttgggacctcattgagtgggaggaagaggaggagacgctgaggccccagttcgaagcaaaatactataagatggagatcgtaaatcccatcacgggtaagccagagcctcaccagccttcttcagacaaggtgactcggttacttgtctccgtgtctggcatcttttttatgatcagccttgtgattactgccgtttttggagtagttgtgtatagactagtggtcatggagcaattcgcaagcttcaaatggaactttataaaacagtactggcaatttgctacctctgccgctgcagtgtgcattaatttcattatcatcatgttgcttaacctggcctacgagaagatagcttacctactcacaaacctcgagtatcccagaactgaatctgaatgggaaaacagctttgccctgaagatgttcctgttccagttcgtgaacctcaacagctccatattctacatcgcctttttcctcggcagattcgtcggacaccctggaaaatataacaaacttttcgacagatggcggctggaagaatgccatccaagcggttgtctgatcgatctctgtctccagatgggtgtgattatgtttctgaagcaaatttggaacaattttatggaactcgggtacccgctaatccaaaattggtggtcccggcacaaaatcaagcgaggcatccatgatgcaagtattccccaatgggagaacgactggaatcttcagccaatgaatctccatggcctcatggacgagtacctggagatggtgttgcagtttggattcacaaccatcttcgtggccgcattccctcttgcaccactcttggcgctgctcaacaacatcatcgagattcgccttgacgcctacaaattcgtgacacagtggagacgtcctcttccggcacgggctacagacattggcatctggcttgggatcctggaaggaatcggcatcctggcggtgatcaccaatgccttcgtgattgccatcacatccgactatatccccagatttgtttatgaatataaatacggcccttgtgccaatcacgttgagccaagcgagaactgtctgaaaggatatgtcaataactcacttagtttttttgatctctcagaacttggcatgggtaagtccggatattgtaggtatagggattatcgcggtcctccctggagtagcaagccttatgaatttactctgcaatattggcatattctggccgcacgtcttgccttcatcatagtgttcgaacacttggtttttggtattaaatcttttatagcgtacctgatccccgacgtgccaaaagggctgcacgatcgcatacggcgagagaaatacctcgtgcaggagatgatgtacgaagctgagctggagcacttacaacagcagaggcgcaaaagtggacaacctgttcatcacgaatggccctag

SEQ ID NO: 48352 - DNA, 2652 bp, Artificial Sequence
  Description of Artificial Sequence: Synthetic coding sequence
atgagaccgggacccaataagccttatcctagccacagcaacattttcgcctatcacagctcagccttgggcaaagataaggattacacagatgaaagtgagcatgccacctacgacagatcaaggctgattaatgattttgttatcaaggataagtcagagttcaaaactaaactcagcaagaatgacatgaattacattgcaagctccggtcctctctttaaggatggtaagaaacggatagactatattctggtgtacaggaaaaccaacatccagtatgacaaacgcaacacctttgaaaagaatttgcgcgctgagggtctgatgctggaaaaggagcccgcaatcgccagtcccgacattatgtttataaagatccacattccgtgggataccttgtgcaagtacgctgagaggctgaacattcgaatgcctttcaggatgcagacctattttcgtcgcatcaagaattggatggcccagaatcctatggtcctcgataagtccgcattccctgatcttgaagaaagcgattgttacacaggacccttctcgagagcaagaatccaccatttcatcattaataacaaagacacgttcttctcaaacgctacccggagtcggattgtgtaccacatgctggagagaacaaaatacgagaacggaattagtaaagtgggcatccgcaagttgatcaacaatggaagctatatcgctgcttttcctcctcatgaaggggcatacaaaagcagccagccaattaagacacacggacctcagaacaatcggcacctgttgtatgagcgatgggccaggtgggggatgtggtacaaacatcagccccttgacttgatacggctgtatttcggggaaaaaataggtctctacttcgcttggctaggctggtataccggcatgttgatcccagccgcaattgttgggctgtgtgtattcttctacggactgttcactatgaataatagccaggtaagtcaggagatttgtaaggccactgaggtctttatgtgtccgctatgcgacaaaaactgttcgctccagcggctgaatgatagctgcatctatgccaaggtgacatacttgtttgataatggcggaacggtgttcttcgctatttttatggcgatctgggccacggttttcctggaattttggaagcgtcgacgtagtattctaacttacacatgggacttgatcgaatgggaggaggaggaagaaaccctgagaccccagtttgaggccaaatactacaagatggagatcgtaaatccaataactggaaaaccggagccacatcagcccagttctgataaggtgacgaggctgctagtgagcgtttccgggatctttttcatgatttctctggttatcaccgctgttttcggggtagtcgtatatcgtctggtcgtgatggagcagttcgcgtctttcaagtggaattttatcaagcagtattggcaattcgctacctccgcggcagccgtgtgcataaactttattattataatgctactgaacctggcatatgaaaagattgcttacctattgacaaatctcgagtacccgaggaccgaatcagagtgggagaatagcttcgccctcaaaatgttcctgtttcagttcgttaatcttaactcctccatcttctacatcgcgttctttctgggcaggttcgttgggcaccctggcaaatataacaagttatttgataggtggaggctcgaggaatgccacccttcaggctgtctaatcgacctttgcctccagatgggtgtgataatgtttctgaagcagatttggaacaatttcatggaactcggctaccctctgatccagaactggtggagtagacacaagataaaacgcggaatacacgacgcaagtatcccccagtgggagaatgattggaatttacagcccatgaatctccacggcctaatggacgaatatctggagatggttctgcaatttggctttacaaccatcttcgtggcggcattccctcttgcacccctgctcgcattactgaacaatatcattgaaattcgcctggacgcatacaaatttgtgactcagtggaggcgtccactgcctgccagagcgacagacattggcatttggttgggaattctagaaggcataggcatcctggctgtaattactaacgctttcgtaattgcaataaccagcgactatattccaagatttgtgtacgaatataagtacggaccatgtgcaaaccacgttgaaccctctgagaattgtctgaaggggtatgtgaacaactccctgtctttctttgatctgtcagagctaggtatgggaaaatcaggatattgtcgttatcgcgactaccgagggccaccatggagttcgaagccttatgagttcacacttcagtactggcacattctggctgccagactggcctttattatcgtctttgagcacttagtgttcgggattaaatcttttattgcctatttgattcccgacgtacccaaaggcctgcacgatagaattagaagagagaaatatttagtccaagaaatgatgtatgaggctgagttagagcatctccaacaacaaaggcggaaaagcggtcagcccgtacaccacgaatggccatag

SEQ ID NO: 48353 - DNA, 1428 bp, Artificial Sequence
  Description of Artificial Sequence: Synthetic coding sequence
atggcagtgtgggccaccgtgttcctggagttctggaagaggaggagagcagtgatcgcctatgattgggacctgatcgattgggaggaggaggagatatgcgtggtcatcgctgctgtctttggcatagtgatctatcgggtggtgacagtgagcacctttgccgcttttaagtgggctctgatcagaaacaacagccaggtggccacaacaggcacagctgtctgtatcaatttttgcatcattatgctcctcaatgtcttgtacgagaaagtggcactcctgttaactaatctcgagcaaccaaggacggaaagtgagtgggaaaatagcttcacgttgaagatgttcctgtttcagttcgtcaacctaaattcatctacattctatatcgcattcttcttaggacggtttaccggtcatcctggagcttatttaaggctgatcaaccgatggcggttggaggaatgtcacccgtccggctgcctaatcgatctgtgcatgcagatgggaataattatggttttgaagcagacctggaataattttatggagctagggtatccacttatccagaactggtggacgcgaaggaaggttaggcaggaacacggccctgaaagaaaaatctcctttccgcagtgggagaaagattacaatttgcagccaatgaacgcctatggtttattcgacgagtacctcgaaatgattctgcagtttggttttaccaccatattcgtcgccgcattccccctggctccgctcctcgccctacttaataacatcattgaaattaggttagacgcctataaatttgtaacacaatggcggaggccgttggcatccagggctaaagatattggaatatggtacgggatcttggaagggatcggaattctgtctgtaattactaacgcgtttgtgatcgctattacctcagactttatcccccgactagtgtatgcttacaaatacgggccttgtgcaggacagggcgaagccggacagaagtgtatggttggatatgtaaacgctagtctgagcgtgttccgcataagcgactttgagaaccgttctgagcctgagagcgatggaagtgagttttcgggaaccccattaaagtactgtcgctaccgcgattaccgggatccgcctcattccttggtcccttatggctacacactgcaattctggcatgtactcgccgctcggctggcgtttataatcgtgtttgaacatctggttttctgtatcaaacaccttatatcctacctaatcccggatctaccaaaggacctccgcgaccgtatgaggcgggagaaataccttatccaagagatgatgtacgaagctgagcttgaaagactccagaaagaaaggaaagagagaaaaaaaaacggcaaagcccatcataacgagtggccttag

SEQ ID NO: 48354 - DNA, 2868 bp, Artificial Sequence
  Description of Artificial Sequence: Synthetic coding sequence
atggaggccagtagcagcgggataaccaacggaaagactaaagtgttccacccagaaggcggtgtggacctgcaaggctaccagctagacatgcagattctccctgacggacccaagtccgatgtagatttctccgaaatcctgaacgcgattcaggagatggccaaggatgtcaacatccttttcgatgaacttgaggcagtctcatcaccttgtaaggacgacgactctctgctgcatcctggtaatctcacttcaaccagcgacgatgcttcccggctggaggccggaggggaaaccgtgccagagcgcaacaagtccaatggcttgtattttcgggatggcaaatgtcgaatcgactatattctcgtatacagaaagagtaatccccagaccgagaagagagaggtgttcgagcggaatattcgcgctgaggggctccagatggaaaaagaatccagtctgatcaattcagacattatctttgtgaagctgcacgccccatgggaggttctcgggaggtatgcggagcaaatgaatgttaggatgcccttcaggcgcaagatctattaccttcccagaagatataaatttatgagccgtatagacaaacagataagcaggttcaggagatggctgccaaaaaaacccatgcgactggacaaggaaacactgcctgacctggaagaaaacgactgctacacggcgcctttcagtcagcaaaggattcatcattttattattcataataaggaaacattttttaataatgccacacgaagtcgtattgtccatcatatcctccagagaattaaatatgaagaaggtaagaacaaaattggtttaaataggctgctgacaaacggatcatacgaggctgctttcccactccatgagggcagttaccggtccaaaaatagtattcggacccatggcgcagaaaaccaccggcatctactgtatgaatgctgggctagctggggcgtgtggtataaataccagccactcgacctggtgagaagatatttcggggagaaaattggtctgtattttgcatggttgggatggtatacaggaatgctctttcctgctgcttttattggactctttgtgtttctgtatggcgtgacaacactggatcatagccaggtttcgaaggaagtctgccaggcaaccgatataatcatgtgcccagtatgcgataagtactgcccattcatgcggctgtcagatagttgcgtctatgccaaggttacacacctattcgataatggcgcaaccgtcttctttgctgtcttcatggccgtctgggcaaccgtatttctcgaattttggaagagacgcagagccgtgatcgcctacgactgggacctgatcgactgggaagaggaggaagaggagattcgaccccagttcgaggctaaatattccaaaaaggaacggatgaaccctatatccgggaagcctgaaccctaccaggcgtttacagacaaatgttctcgccttattgtttctgcttccggcattttctttatgatctgtgtggtcatcgcggcagtgttcggcatcgtgatttacagggtggtcacagtctccacttttgccgcattcaagtgggcccttatccggaataactcgcaggtggcaacaactggcaccgctgtgtgcattaacttctgcatcataatgttgctgaacgtcctctacgaaaaagtcgcactcctacttaccaacctcgagcaaccacgaaccgagtcagagtgggaaaacagttttacactcaagatgttcctattccagttcgtcaatcttaacagcagcacgttctacatcgctttctttcttggcagatttacaggacatcccggtgcttatctacgactcatcaacaggtggaggctcgaagaatgccatccctctggctgtctcatcgacctctgtatgcagatgggcattatcatggtcttaaagcaaacctggaacaattttatggagttgggctatccattgatacagaactggtggaccaggcggaaagttcgtcaagaacacggcccagagcggaaaattagcttcccccaatgggaaaaggactataacctccaaccaatgaacgcatacggcctcttcgacgagtatcttgaaatgattctgcagtttggatttaccaccatttttgtggcggctttccccttagcaccgctcctcgccctgcttaataatataatagagatacggctagatgcctacaagtttgtgacgcagtggaggaggccacttgcatcccgtgccaaggacatcggaatctggtacggcattctggaggggattggcattctgagcgtgataacaaatgcatttgtaattgccatcactagtgatttcatccccaggctggtgtacgcttataagtatggaccgtgtgcagggcaaggcgaggccggacagaaatgtatggtagggtatgtaaacgcatccctttccgtcttccgtatatctgactttgagaatcggtcggaacctgaatctgacggctcagagttctcagggactccacttaagtactgtagatacagagattaccgagaccccccacatagtctcgtgccttacgggtatactttacagttctggcacgtgttggctgcccgactggcattcatcatcgtcttcgagcacctggtgttttgtattaagcacctcatctcctatcttatcccagacctgcccaaggacctgcgcgacaggatgcgcagagagaaatacttaattcaggaaatgatgtatgaggcggaactggaacgactgcaaaaggagaggaaagaacggaaaaagaacggaaaagctcatcataacgagtggccttag

SEQ ID NO: 48355 - DNA, 2763 bp, Artificial Sequence
  Description of Artificial Sequence: Synthetic coding sequence
atggaggctagcagctcgggaataaccaatggcaaaactaaagtgtttcacccggtggccaaagatgtgaacatcctcttcgatgagctggaggccgtctctagtccctgtaaggatgatgattccctgctccaccctgggaatcttacctccacaagcgacgacgcgtctcggcttgaagcaggaggtgaaaccgttccagagaggaataaaagcaacggattatattttcgcgatgggaagtgcagaattgattacattctggtatataggaagtcgaatccccaaacagaaaagcgggaagtgtttgagcggaatattcgggctgaaggtttgcaaatggagaaagaaagttccctgattaactccgatatcatattcgttaagctgcatgccccttgggaggttctgggacgctatgccgaacagatgaacgtccgcatgccatttagaagaaagatctactacttgccaagacgatacaagttcatgagcagaatagacaaacagatttcaagattcagacgctggctgcccaagaagcccatgcgtctcgacaaggaaactctacccgacttggaagaaaacgattgctacacagccccattttcacagcagcggatccatcactttatcatccacaataaggagacattcttcaataacgccaccagatctaggattgtccaccatattctgcagcggatcaaatacgaggagggtaagaataagattggtctgaataggctgctgacgaatggctcttacgaggctgcttttccgttacacgagggttcctaccggagcaaaaactcaatcagaacacacggggcagaaaatcatagacacttgctttacgagtgttgggcaagttggggtgtgtggtataaataccagccgctagacctggtgcgcagatatttcggcgaaaaaatcggtctttacttcgcatggctgggatggtacactggtatgctgtttcctgcggcttttattggcctgttcgtcttcctatacggtgttaccacacttgaccattcacaagtttctaaagaggtgtgccaggctaccgacattattatgtgcccagtgtgcgacaaatactgcccctttatgcgactgtctgactcatgcgtgtacgctaaagtgacgcatctctttgataacggcgctacagtgttttttgccgtgttcatggctgtttgggccactgtgttcctagaattctggaagagaagaagggccgtgatcgcttatgactgggaccttatagactgggaggaagaagaagaagaaatccggccacagtttgaggctaagtattcaaagaaggagcggatgaaccccattagcggtaaaccagagccttatcaggcctttaccgacaaatgctccagactgatagtgtccgcatccggcatattttttatgatctgcgtagtgattgccgcagtgtttggcatcgtgatctaccgggtggtcacagtgagtacttttgcggctttcaaatgggccctgatccgaaataactcccaggtggcaacgacaggtaccgccgtgtgtatcaatttctgcatcataatgctgctgaatgtgctgtatgaaaaggtggccctgctattgactaacctggagcaacccagaaccgagtccgagtgggagaacagctttacactgaagatgtttctcttccagtttgtgaatttaaactcctcaaccttttatattgccttttttctcggtagatttactgggcatccaggagcatacctcagattgattaacagatggcgcctggaagagtgtcaccctagcggatgtttgattgatctgtgtatgcagatgggcatcattatggtgctcaaacagacctggaacaactttatggagctgggatatcccctgatccaaaactggtggacccgaagaaaggtgcggcaggaacacgggcctgagcggaaaatatctttcccacaatgggagaaagattataaccttcagcccatgaacgcgtatgggctcttcgatgagtaccttgagatgatccttcaattcggcttcacaacgatttttgtggcagctttccctctcgctcctctactggccttactgaacaatatcattgagatacggctcgatgcttacaagttcgtgacacagtggagaagaccgctggcttcccgagctaaggacatcggcatctggtacggcatattggaagggatcggaatactgagcgtgattaccaatgcgttcgtgattgcaattacttctgacttcattcccagactggtgtatgcctacaaatatgggccatgcgccggacagggagaggccggacagaagtgcatggtcgggtatgttaatgccagtctctccgtcttccggatatccgattttgagaacaggagcgaacccgagtccgacggctcagaattctcgggaactccccttaaatactgcaggtatcgggactacagagacccaccccattcacttgttccctacggctatactctgcagttttggcacgttcttgccgctaggctggccttcatcattgtcttcgaacacttagtattttgcatcaagcatctgatttcttaccttatccccgatctccccaaggacctccgcgaccgaatgcgcagggagaagtacttaatccaggagatgatgtacgaagccgagctcgagcgcctgcagaaagagagaaaagagaggaagaaaaatggcaaagcacaccataatgagtggccctag

SEQ ID NO: 48356 - DNA, 1071 bp, Artificial Sequence
  Description of Artificial Sequence: Synthetic coding sequence
atggcaagcctgacagcttacgacaaggacgtttcaagtggatcctacaatctgtccagcgcaaccacagggtcatactatagttgcgtttcgcagatcaccatagggtatgacgttgccggtccagtcgccattgggctgacacactggaagaacccctatgtccaggggcgtccaacactcccctccgacctcccactgtttgtgtccaaagatgccggtatccctgtctaccacagatccttcacgagaaagacagatcaggccacacctctttcatgccctgcctctctgagtatcaccccagttcctagctatagcagctcctcccaggaaaccttgtcacaagacactactgggttgtctctgtctatccatggtgccgagaagcgcctgcagatccaccagcgcaggtctgtggccagccgcccagctagcaggcggagattgccggtagtcaggcatagctctctccctcccggtagacgcagtatcaaaatggaagcctcttcaagcggaattacgaacggcaagacaaaagtttttcaccccgaggggggagtcgacctccaaggctatcagctggacatgcagatcctgcctgacgggccaaaatctgatgtagatttttcagaaatacttaacgctatccaggagatggccaaggacgttaatatacttttcgatgaactggaggctgtgtctagtccttgtaaggacgacgactcgttgcttcatccaggcaatttgacgtcaacatccgacgacgcatcacgattggaagcgggaggggaaacagtcccggagcggaataagtccaacggattgtacttccgtgacggaaaatgtcgcatcgattacattttggtttacaggaagtctaatccccagactgagaagcgcgaagtcttcgagagaaatatccgcgctgaaggactgcagatggaaaaagaatctagtctcataaactccgacatcatcttcgttaagctgcatgctccatgggaggtgctgggcagatacgctgagcagatgaatgtccggatgcctttctccagtaactgtaactag

SEQ ID NO: 48357 - DNA, 36 bp, Artificial Sequence
  Description of Artificial Sequence: Synthetic coding sequence
atggaagccagctcttcaggtattacgaacggatag

SEQ ID NO: 48358 - DNA, 1428 bp, Artificial Sequence
  Description of Artificial Sequence: Synthetic coding sequence
atggcagtatgggcaaccgtttttcttgaattttggaaacgcaggcgggctgtaatcgcctatgattgggacctgatcgactgggaggaggaggaaatctgcgtagtgattgccgcagtattcgggattgtcatctaccgggttgtgaccgtgagcacttttgctgcatttaaatgggccctgatccggaataattcccaggtggccacaacaggaactgctgtctgtatcaatttctgcattataatgctgcttaatgtgctctacgagaaggtagctctgcttctgaccaacttggaacagccacggaccgaaagcgagtgggagaatagcttcacgctgaagatgtttctgtttcagtttgtgaatctgaactcttccacgttctacatcgcattttttcttggacggttcaccggtcatccaggcgcatatctgagactgatcaatcgctggagattggaagaatgccaccctagcggctgcttaattgacctttgcatgcagatgggcattattatggttttgaagcagacttggaacaattttatggaactcggataccccctaatccaaaattggtggacgcggcgtaaggttcgccaggaacacggccctgagaggaaaatcagtttccctcaatgggagaaagactataacctccagccaatgaacgcgtatgggctgttcgatgagtacctggagatgatactccagttcggctttacaaccatctttgtcgctgccttccctctggcccctcttctggccctgctgaacaacatcatcgagatcaggctggacgcatacaagttcgtaacgcaatggaggaggcctctggcctctcgggcaaaggatattgggatatggtacggaatcctcgaggggattggaatcctgtcagtaattaccaatgccttcgtgatcgccatcacgtccgacttcataccgaggctcgtatatgcatataaatatggcccttgcgcaggtcagggcgaggccggacagaagtgtatggtgggctatgtgaatgcatctctatcagtgtttaggataagtgatttcgaaaaccgttctgaaccggagagcgacggcagcgagttctcaggtactccactgaagtactgccgctaccgagattaccgcgatcccccacactctctcgtaccctatggctacaccctccaattttggcatgttctggccgcaaggctggcctttatcatagtgtttgagcacctagtcttctgtattaaacatctcatctcctatttaatccctgacctgccaaaagacttgcgtgatcggatgaggagagaaaagtacctcatccaagagatgatgtatgaggccgagttggaacggctgcagaaggagcggaaagaacgaaagaagaatgggaaagcgcaccacaacgagtggccctag

SEQ ID NO: 48359 - DNA, 2802 bp, Artificial Sequence
  Description of Artificial Sequence: Synthetic coding sequence
atgcgtatggccgctacagcctgggcagggctgcagggacctcctctgccgaccctgtgtccagctgtgcggacaggcctctactgtcgcgaccaggcacacgccgagaggtgggcaatgacatctgaaacttcatccggctcacactgtgcacgaagtcgcatgctcagaagaagagcccaggaggaagactctactgtgctcatcgacgtgtctccgcctgaggcagaaaaacgtggatcttacgggagcactgcccatgccagcgagcctggaggccagcaggccgcagcatgccgagcaggctctcccgcaaagcctagaatagccgactttgttttggtctgggaagaggaccttaagctagaccggcagcaggattccgcagctagagatagaacagacatgcaccgaacatggcgcgagacgtttctggacaatttgcgggctgccggtctgtgtgtcgatcagcaagatgtgcaggacggaaatacaacagtgcactatgcgctgttatccgcttcttgggccgtgctgtgttactatgccgaagatctcaggctgaagctgcccctgcaggaactacccaatcaggctagtaactggtccgctggcttactggcatggctggggatccctaacgtactccttgaggtagtgccagatgtccctcccgaatactacagctgccgtttccgggtgaataaactgcccagattcctcggtagcgataatcaggacacgttcttcacaagcactaagcgccatcagatcctcttcgaaatcctcgcgaagaccccctacgggcacgaaaaaaaaaatttattaggtatccatcagctgctggcagaaggggtgctgtcagctgcatttccgcttcatgatggaccctttaaaaccccacctgaaggacctcaagctcctcgcctgaaccagcggcaggtactgttccaacactgggctagatggggtaaatggaacaagtaccagccactggatcatgtgcgacgatactttggcgagaaggtggcgttatattttgcatggctgggattctataccggatggctacttccagccgcagtcgttggcaccctggtctttctggtcggctgttttctggtattcagtgacatccccacccaagaactttgcggatccaaagactcatttgaaatgtgccccctctgtctcgattgtcctttctggttgctgagttccgcatgcgcgctggctcaggccggtaggttgttcgaccacggtggcacagtgtttttcagcttgttcatggccctctgggccgtgctactactggaatattggaaaaggaaatctgctactctggcgtatcggtgggattgttcagactatgaagacacagaggagcggccaaggccacagttcgctgcctctgccccaatgaccgctcctaatccaatcaccggggaggacgaaccatactttcccgaacggtccagggcgcgacgaatgcttgctgggagcgtggtaatcgttgtgatggtcgctgtagttgtgatgtgtttggtgtcaattatcctatatagagcaattatggcaatagtagtcagcagatcaggcaacaccctacttgcagcttgggccagtagaatagcaagtctgaccggatccgtggtgaacctggtcttcattttgatactatctaagatttacgttagtttggctcatgtactcacccgctgggaaatgcaccggacccagacaaaatttgaagatgcttttacactaaaggtgttcatcttccagtttgtcaacttctattcctctcctgtgtacattgcattcttcaagggacgcttcgtgggttatcccggtaattaccatacactctttggtgtgcgcaatgaggaatgtgccgcaggaggctgcctgattgagttggcgcaggagttactcgtcattatggtgggcaagcaggtgatcaataacatgcaggaagttttgatccctaagttgaaaggatggtggcagaagtttcgcctgcggtcaaaaaaacggaaagcaggcgcatccgcaggagcctcgcagggtccttgggaagacgactatgagctggtcccctgcgagggcctgtttgatgaatatctggagatggtgcttcagttcggcttcgttacaatcttcgtagccgcatgtccactcgcacccttgtttgcactgttaaataattgggtcgaaatcagacttgatgccagaaagttcgtgtgcgagtaccggcgacccgtcgcggaacgtgctcaggatatcggcatctggttccacatcctcgctggcctgactcacctggcagtgatttcgaatgcctttctccttgccttcagttctgatttccttcctcgcgcttattaccgttggaccagggcacacgaccttcgcggatttctcaacttcacactggctagagcaccgtcatccttcgctgccgctcataaccggacttgccggtaccgggctttcagagacgacgacggtcactattctcagacatactggaatctcttggccatacgattagcatttgtcattgtttttgagcacgtggttttcagtgtgggacggcttctggacctcctggtgcccgacatacccgaaagtgtcgagatcaaagtaaagagggaatactaccttgccaagcaagccctcgctgaaaacgaggtgcttttcggcacaaacggaacaaaagatgagcaaccagagggcagcgaactgtcgagtcactggactccctttacagttccaaaggcctctcaactccagcagtag

SEQ ID NO: 48360 - DNA, 2652 bp, Artificial Sequence
  Description of Artificial Sequence: Synthetic coding sequence
atgaggatggctgcaacagcctgggccggtctccaggggccaccactgccaaccctgtgtcctgctgttcggaccggcctgtactgccgcgaccaggcacatgccgaacgctgggctatgacatcggagaccagtagcggaagccactgtgcaagatccaggatgctccgcagaagggcccaggaagaggattcgaccgtgttaatcgatgtttcccctcccgaagctgaaaagcgcggatcctatggctcaacggctcatgcaagtgagcctggtggtcagcaggcagcagcctgtagagctgggtcccctgcaaagccccgaattgacttcgtcctcgtgtgggaggaagacctgaagttggatcgccagcaagatagtgccgcacgcgacaggacagatatgcacaggacctggagagagactttcctggataacttgagggctgcaggtctgtgcgtggaccagcaagatgtgcaggacggcaacacaaccgtccactacgccttgctgtccgcaagttgggccgttctgtgttactacgcagaggacctacggctgaagctcccgcttcaggagttgccaaatcaggcctccaactggagtgcaggactcctggcctggctgggaattccaaacgtactcctggaagttgtaccggacgtacccccagaatattacagctgcagattccgcgttaataagctgccaagatttcttggatccgacaaccaggacaccttcttcacatccactaaacggcatcagattttgtttgaaatactggcaaagacaccctatggtcacgagaaaaagaacctgctcggaatccaccaattattagcagaaggcgtgttgagcgcagcatttccactacacgacggcccatttaaaacccctcccgaggggcctcaagccccaaggttaaatcagaggcaggtattattccagcactgggcccgttgggggaagtggaacaagtaccagccactcgaccacgttcggaggtactttggtgagaaagttgctctctattttgcatggctaggattctacacaggatggctgctacccgctgccgtggtcggcaccctggtctttttggtgggctgctttttagtcttctccgatatccctactcaggagttgtgcggctctaaggacagcttcgagatgtgcccactctgcttggattgcccgttctggctactgtcttctgcctgcgctctggcacaggccggaaggctgttcgatcacgggggtaccgtcttctttagcctctttatggccctgtgggcagtcctactgttagagtactggaagaggaagtccgctactctcgcctatagatgggactgtagcgactacgaggatacggaagaaagacctcgcccacaattcgctgcctccgcccctatgacagctcctaaccccatcacaggagaagacgaaccttacttccctgaaaggtccagagctcgaagaatgctggccggttccgtggtcattgtcgtcatggttgctgtggtcgtgatgtgcctcgtaagtattatactctatcgggcaatcatggcaattgttgtaagtaggagcggcaacactcttctggcagcatgggcttctcgtatcgcttccttgaccggttcagttgtgaatctcgtcttcatactgatcctgtcaaaaatctatgtgtctctcgcccacgtactcacccgctgggagatgcatcgcacccagacgaagttcgaggatgcgttcacactgaaagtgttcattttccaatttgtgaacttctactcctcgcccgtctatatcgccttcttcaaaggacgtttcgttggatatcccggaaactatcacactctgttcggtgtcagaaatgaggaatgtgcagccggaggttgccttatcgaactcgcgcaggagctcctggtaataatggttggaaaacaggtgatcaacaatatgcaggaggttttaataccgaagctcaaggggtggtggcaaaagttccgtctgagatcaaaaaagaggaaagcaggggcatcagccggtgcttcacagggcccatgggaggatgattacgagctggttccatgcgaaggactgttcgacgagtacctcgagatggtcttacaatttggtttcgtaactatttttgtcgctgcgtgccccctggcccctttgtttgcattgctaaataattgggtggaaatcaggttggacgctagaaagtttgtgtgtgaatataggcggccagtggccgagcgtgctcaggacataggcatatggtttcatatactcgctgggcttacacacttggcggtgatcagcaacgcgtttctgcttgccttcagttccgattttctgccaagggcctactataggtggacaagagcacatgacttgcggggtttcctcaatttcactttagccagggccccaagctcctttgccgcagcccacaatcgcacctgtcgctatcgcgctttcagggatgatgacggccactattcccaaacctactggaatctgctcgccatcaggctagctttcgttatcgtattcgaggtagccgaggccccagctgggtcgccaatccacggtatgcgccctcgtccctgcgcattgcccaattcaagtacctggtag

SEQ ID NO: 48361 - DNA, 540 bp, Artificial Sequence
  Description of Artificial Sequence: Synthetic coding sequence
atgcggatggctgcgaccgcatgggctggcctccaaggaccgccactgccaacattgtgccctgcagtccggactgggctgtactgtcgagatcaggcccatgccgaacgctgggctatgaccagtgaaacatcaagcggctctcattgcgctaggtcgagaatgctccgcaggcgagcacaggaggaagacagcacagttctcattgacgtcagccctcctgaggctgagaagcggggatcatatggcagtaccgctcatgcttccgagcctggaggacagcaggccgctgcctgccgcgctgggtcaccggcaaaaccccgaattgacttcgttctggtgtgggaagaggacttaaagcttgacagacagcaggactccgcagcaagagaccggaccgacatgcaccggacatggcgcgaaacattcctcgataatcttcgcgctgcaggcctctgcgtcgaccaggtcaggggcggatgccatgggcagggcccaaggccatgcattcactcggtgactcacgatctggcagcttag

SEQ ID NO: 48362 - DNA, 3699 bp, Artificial Sequence
  Description of Artificial Sequence: Synthetic coding sequence
atggcggaggcggctagcggggctggcggtacaagcctggagggggaacggggtaagcggccacctccggaaggtgaaccagcagccccagccagtggtgtactcgataaattgttcggtaagagactgcttcaggccggtcggtacctggtgagccacaaggcctggatgaaaacagtgcccactgaaaactgcgacgtgttaatgacattccccgacactaccgacgatcatacactgctgtggctcttaaaccacatccgggtgggcattccggagctcattgtgcaggtccgacatcaccgacacaccagagcctacgcctttttcgtgacagcaacctatgagtccctccttaggggcgcagatgagctggggttgcgtaaagctgtcaaagccgagttcggaggcggaactaggggtttttcctgtgaggaagatttcatctacgaaaacgtggaatctgaactccgattttttactagccaggaaagacaaagcatcatcagattttggctccagaatcttcgtgcgaagcaaggtgaggctttgcataacgtccgtttcctcgaggatcagccaattattccggaactggctgcaaggggcataatccagcaagtatttcccgtgcacgagcagagaatcctgaatcggctgatgaaaagctgggttcaagctgtgtgtgaaaatcagccattggatgatatttgtgactattttggagtgaaaatcgccatgtacttcgcgtggcttggattttatacttccgctatggtgtatcctgccgtgtttgggtccgtgctgtacacgttcactgaggcagatcagacgtcacgggacgtttcctgcgtcgtttttgccctctttaatgtgatttggagcaccctttttctggaggagtggaagcggaggggagcggagttggcctacaaatggggtacactagactcacctggggaagctgtcgaggaacctcggcctcagtttcgcggagtgcggcgtatttcccccatcactcgggcagaagagttttactatccgccatggaaaaggctgctgttccaactcctggttagccttccactgtgcttagcctgcttggtctgcgtgttcctgcttatgttgggatgctttcagctccaggagctggtcctgagcgtgaaaggtttgcccagactggcccgattcctccccaaggtgatgctggcactgctggtgtcagtgtctgcggaaggctacaaaaagctcgcgatatggctaaatgacatggaaaactaccggcttgagtcagcgtacgaaaagcacctgatcattaaggtcgttctgtttcagttcgtaaattcctacctttctcttttctacatagggttctacttgaaagacatggagcgcctgaaggagatgctcgctacgctgctaatcactaggcaatttctgcagaacgtgagggaggtgctccagccccacttatatagaagactgggcagaggtgaacttggccttcgcgcagtctgggagctcgctagggcactgctgggtctcttgtctcttagaaggccggctccacggagattggagccacaggccgatgagggtgggggtggcggtagcggaggcggtggcagacgatgcttgtctggcggatgcggagcgcctgaggaagaggaggaagcagccttagtagagagacggagagcgggtgaaggcggagaggagggcgacggcccaccgggaggcaaagaagaggatgaggacgatgaagaagaagaggacgaggaagaagaagaagacgaagaggagggcgaagaagggggactgctggactgcggattgaggttaaagaaagtcagtttcgcggagcggggagctggaaggagacgtcccggtcccagccccgaagctttgctggaggagggatccccaacgatggttgagaaggggctggagcccggtgtgttcacgcttgccgaggaagatgacgaggcagaaggggcaccgggatcccccgagcgggaacctcctgcaatactctttagacgcgctgggggagagggacgcgatcaggggcctgacgggggacctgaccctgagccgggatcaaacagtgactccacgagacgacagcgtagacagaaccgctcatcttggattgaccctcctgaagaggaacatagcccacagctgacccaggcagagcttgagtcatgcatgaaaaagtacgaggatacattccaggactatcaggagatgtttgtgcagttcggctacgtcgtcctattctcctctgcatttcccctggctgccttgtgcgccttggtgaacaatttaatcgaaattcgttcagacgcattcaaactttgcaccggcttgcaacggccatttgggcagagagtggagagcatcggccaatggcagaaggttatggaggcgatgggggtccttgcgattgttgttaattgctatctgatcggtcagtgcggccagctgcagcgtttatttccttggttgtcacccgaagcagctatagtgtccgttgtggtgttagaacactttgcccttttgttgaaatacctgattcatgtggcaatacccgacatacctgggtgggtcgcagaagagatggccaagctggaataccaacgtagagaagctttcaaacggcacgagcggcaagcccagcaccggtatcagcagcagcagagacgtagacgggaagaggaggaacgtcagcggcacgcagagcaccatgcgcgaagggagcatgacagcgggggaagggaagaggcccgtgctgaaggatcgggcctggacccagccacatcctctgaaaaggcttcggccaaagcgaaggggagcacagccggtggacacggcccagaaagaccgaagcgccctggctcacttctggcccctaataatgttatgaaactgaagcaaatcatcccattgcaaggaaagttccttagtagtggagccactagctccctggccgctgccggagccggagctacaacgcgcccacccccagctcagagtccgaccgggtccgatactcggctgcccgcatttttatcttttaaattcctgaagtcacctgagacacgcagggacagtgagaggtcccacagcccacccaaggccttccacgctggaaagctctttccctttggtggaacaagggcagaaccaggcagcaacggcgcaggaggacaggcacggcctgacggcactcctagctctggttccagtagggtccagcgatccggcccagtcgatgaggctttggccgaagagctagaagctccaagacctgaggaagagggcagcggcacagcattagcaccagtcggtgctcctgccctcagaacaaggcgctcaaggagccctgctccacctccaccgatgccgctcccacgacctcccacccctcccgcagggtgttggcagtgggacggcccttggggttgtggaggggagggcgcagctccaaggcaggcactggcagctgccgagtgtcctccgtgtgccatggccggtccacccccagccccacaaccactgcccggtgatgccagcttttactctttaccgcctcctcccctgccaccaacaagcgatccactggagaccccagcaccttcccccagtccctcgccaagccctcaggcagtttgttggcccagtggatggcactag

SEQ ID NO: 48363 - DNA, 2349 bp, Artificial Sequence
  Description of Artificial Sequence: Synthetic coding sequence
atgcaaggggaagagtcactcaggattctggttgagccggaaggtgactcctttcctttgatggagatttccacgtgtgaaactgaagcttctgagcaatgggattacgtacttgtcgcccagcgtcatacacagcgcgacccgaggcaggcccgacaacaacagtttctcgaggagttacgacgcaaagggtttcacatcaaggtcatacgcgaccaaaaacaggttttcttcggaattagggcagacaactctgtttttggtctctacaggacgttccttcttgagccggaaggtcccgctcctcacgcagagctcgccgctcctactaccatacctgtgacaaccagccttagaatcagaattgtgaattttgttgtcatgaacaataaaacctccgctggggagaccttcgaagacttaatgaaagacggcgtgtttgaggccagattcccgctgcataagggggaagggagactcaaaaagacatgggcaaggtggagacatatgttcagggaacagcccgtagacgaaattcgaaattacttcggggaaaaggtagccttgtactttgtatggctgggctggtatacttacatgttagtccccgcagccctaactggactgttagtgtttctgtccgggtttagcttgttcgaggcttcccagatatctaaggaaatctgcgaggcccatgatatcctgatgtgcccattgggggatcactcacggagataccagcggctcagcgagacatgtaccttcgctaagcttacccatcttttcgataacgacgggaccgtggtatttgcaatttttatggctttatgggcaaccgtgttcctcgagatttggaagcgacagcgcgctagggtggtgctgcactgggatctgtatgtctgggatgaagagcaagaggagatggccttacaacttataaattgcccagactacaagttgaggccctatcagcacagctacttacgaagcactgtaattttggtgctgactctgttgatgatctgcctgatgatcgggatggcccacgtgttggtggtataccgagtgctcgcttctgcgctcttctcttcaagtgctgttcctttcctggaagagcaggtcactactgctgttgtcgttacaggtgcacttgtccattacgtaaccattatcattatgaccaaaattaaccgttgtgtcgctttgaaattgtgcgacttcgagatgccgagaacctttagcgagagagagtctagattcacgattagatttttcacgcttcagttctttacacatttttcctcattgatttacatagcctttatcctaggaagaattaacgggcatcctggaaaatcaactagactggccggtctctggaaactagaagaatgccacgccagcggctgtatgatggacctcttcgtccaaatggctattatcatgggccttaagcagaccctgtcaaactgcgtggagtacctagtgccttgggtgacgcacaagtgccgctcattgagagcctcagaatcgggacacctcccaagagatcccgagttgagggattggagacgaaattacctactgaatccagtcaataccttctctctgttcgatgagttcatggaaatgatgattcaatatggttttacgacgatctttgttgctgcattcccactggcccctctgctggctctgtttagtaatcttgtcgagattaggctggatgccatcaagatggtctggctgcagcgcagactggtaccccgaaaagcaaaagacattggaacatggctgcaagtgctggaaaccatcggcgtacttgctgtgattgctaacggtatggttatcgcatttactagcgaatttattcctagggtggtgtataaatatcggtacagcccatgtctcaaagaaggtaattctactgttgattgtttgaaggggtacgtgaaccactccttgtctgtgttccacactaaggacttccaggatcccgacggaatcgagggtagtgagaacgtgaccctctgcagataccgagattatcgcaatccccctgattacaacttcagcgagcagttctggttcctcttagctattcggttggcattcgtcatcctatttgagcatgttgccctgtgtataaaactcattgctgcgtggttcgtgccggatattccccaatctgtgaagaacaaggtgttggaagtgaaataccagaggctgcgggagaagatgtggcatggaagacaacggctgggtggtgtgggggctggttcaaggcctccaatgcctgctcaccctacccccgcttccatcttcagtgccaggtcaaccgacgtatag

SEQ ID NO: 48364 - DNA, 2592 bp, Artificial Sequence
  Description of Artificial Sequence: Synthetic coding sequence
atgaaaaagttctttgactctcggagagagcaaggcggttcagggctaggaagcggatcatcaggaggaggcggatctacctcaggactgggttctgggtacatcgggcgagtcttcggaataggccgtcagcaagtgacagtagatgaggtcctggccgaaggtggcttcgcgattgtgttcctggtcagaacgtcaaacgggatgaaatgcgccctgaaacgcatgtttgtcaataatgaacacgatctgcaggtgtgtaagagagagattcagataatgcgagacctttctggccataaaaatatcgtcggctacatagattcttcaattaacaatgtttcttcaggagacgtctgggaggtattaatcctcatggatttttgcagaggaggccaggtggtcaatctgatgaaccagcggctccaaaccgggtttacggagaacgaagtgctgcagatattctgtgacacctgcgaggccgtcgccagactccatcagtgcaagacacctatcatccatagggacctgaaggtggagaatattctcctccacgataggggccactacgtgctttgtgactttggcagtgccaccaataagtttcagaatccccagacggaaggagtgaatgctgtggaggacgagattaagaaatacaccactctgtcatatcgcgctccagagatggtgaacctatactctgggaagataataacaaccaaggccgatatttgggccttgggctgcctgctgtataagctgtgttatttcactctgcctttcggagaaagccaagttgcaatctgcgacggaaatttcactatccccgataattccagatattcccaggatatgcactgtctgatcagatacatgctggagccagaccctgacaaacgccctgatatctatcaggttagctattttagcttcaagttgcttaaaaaggagtgccctattccgaacgtgcagaacagccctattcctgcgaagctccccgagcctgttaaagcatcagaagcggctgcgaaaaaaacacagccaaaagcccgtctgactgaccccattccaactactgagacttcaattgcaccaaggcaaaggcctaaggccggtcaaacacagcccaatcccggaattctgcctattcagccggcattgactcctcggaagagggcgaccgtgcagccacctccgcaggccgctggatcgtcaaatcagccaggccttttggcgtctgtgcctcagcccaaacctcaggctcccccttcccagcccctccctcagacacaggccaagcaaccacaggctccaccaactccacaacagaccccttcaactcaagcccaggggctgcctgcacaggctcaggctacgcctcaacaccagcagcaactctttttgaaacagcagcagcagcagcagcagcctccacccgctcaacagcagcctgccggtaccttttaccagcagcagcaggctcagactcagcagttccaggccgttcatcctgctacacagaaacccgcaatcgcccagttcccggtggtctcccagggcggttctcagcagcaattgatgcaaaatttctaccaacagcagcagcagcagcaacagcagcagcagcagcagcaattggccacagcgctgcaccagcaacagcttatgactcagcaagcagcactgcagcaaaagcccacaatggcagccggacagcaaccccagcctcagcctgcagctgctcctcagcccgctcctgcccaagagccagctattcaagcccctgttagacaacagccaaaggtccagactacacctccgccagcagtgcagggtcagaaagtggggtctctgacaccacccagctcgcccaagacccagagagctggacaccgacgcattctcagtgatgtcacccatagtgcggtgttcggagttccagcatctaaatccacgcagttgctccaggcagccgcagccgaggcgtcattgaataaaagcaaatcagcgactaccaccccctctggttcaccgcgtacgagccagcagaacgtgtacaacccttctgagggctccacctggaatccctttgacgacgataattttagtaaactgactgcagaggaactgttgaacaaagacttcgccaaactgggtgaggggaaacaccccgaaaagcttggaggaagtgctgagagcctgatccccggatttcagagcacccagggcgacgcctttgctacaaccagtttctccgccggtacagccgagaagcggaaggggggtcaaactgtggatagcggattgcctttactctctgtatcagatcccttcattcctctccaagtccctgacgccccagagaagctgatcgagggcctcaagtctcctgacacctccctgcttttgccggacctcctgcccatgaccgatccatttggctccacttctgatgctgtgatcggaaaggtcatcataagcgtttcttccgtgatgcatgacatgtgtgcctgtttcaagaatgacaagtacctggtcaaccagtctttgggaaattcaccagcgacacctgaggctaaagcgatttag

SEQ ID NO: 48365 - DNA, 2886 bp, Artificial Sequence
  Description of Artificial Sequence: Synthetic coding sequence
atgaagaagtttttcgatagtaggcgagaacagggcggatctgggcttggcagtggttcctcgggcggaggaggaagcaccagcggccttggctcaggctatattgggcgtgtcttcggaattggacgccagcaggtgacagttgacgaagtcctggcggaaggcggatttgccatcgtgttcctggtgcgcaccagcaacggcatgaagtgcgctctgaaaagaatgttcgtgaataacgagcatgaccttcaggtgtgtaaacgggaaattcaaatcatgagggacttgagtgggcacaaaaacattgtgggctacatagactcctctatcaacaacgtcagctctggagacgtatgggaggttttgatactgatggatttttgcaggggagggcaggtcgtcaatctgatgaatcagaggctccagacagggtttactgagaacgaggttcttcaaatcttttgtgatacttgcgaagccgttgccaggctgcatcaatgtaagacccctatcatccacagggatttgaaggtggagaacatcctgctacacgatcgaggacattacgttctgtgcgactttggcagtgctaccaacaagtttcaaaacccccagactgaaggcgttaacgcagtggaggatgagattaaaaagtataccaccctctcttaccgggctcccgaaatggtgaatttatacagcggtaaaattatcactaccaaagccgatatttgggcactcggttgtcttctatacaaactttgctactttactctgccatttggtgagtcccaggtagcaatttgtgacggcaacttcactatccccgacaattcccgctatagccaggacatgcactgtttaatccggtatatgctggagccagatcctgacaagagacccgatatttaccaggtgagctacttttcattcaaactgctcaagaaggagtgcccaatccccaatgttcagaactcccctatccctgctaaacttcccgaacctgtcaaagcttctgaagccgctgctaagaaaactcaacctaaggctaggttgaccgatccaatcccaactactgaaacctcaattgctcccagacaacggccaaaagccggtcaaacccagcctaacccgggaatacttcctattcagccagcacttactcccaggaaacgagccacagtgcagcctccgccacaggcagcagggtcatctaatcagccaggattgctagcctccgtgccccagcctaagccccaggcaccacctagtcagcctctcccccagactcaggccaagcagccgcaggctcccccaactccccagcagacaccctccacccaagcccagggcctgcccgcacaagcacaagcgaccccccaacatcaacagcagctgttccttaagcaacaacagcagcagcaacagcccccaccggcacagcagcagccggctggcactttctatcagcagcagcaggcgcaaacccaacagtttcaggctgtgcatcctgccacacagaaacccgcaattgcccaattccccgttgtgagccagggcggatcacaacagcagctgatgcaaaatttctatcagcaacagcagcagcaacaacagcagcagcagcagcagcagctggctactgctcttcaccagcagcagttaatgacccaacaagccgctctccagcagaaaccgacgatggcagccggacagcagcctcagccccagcctgcggcagcacctcaaccggcaccagcccaggaaccagctatccaggctcccgtccgccagcagcccaaggtgcaaacaactcctccaccagccgtacaaggccaaaaggtaggcagtctgacgcctccctcttcacctaagacccagcgggctggccaccggagaatcctctccgatgtgacgcatagcgcggtgttcggagtccctgccagtaagagtactcaattgttacaggcggcagccgctgaggcctccctgaacaagagtaagagcgccaccacgacccccagtggaagccctagaacttctcagcagaacgtctacaatccgtccgaggggagcacgtggaaccctttcgacgacgacaacttttctaagctcaccgcagaggaattactgaacaaagactttgccaaactgggcgaaggcaagcaccccgagaagctggggggaagcgccgaatctctgatacccggttttcaaagtactcagggggacgccttcgcgaccacaagcttcagtgcaggaaccgctgagaagcgaaaaggcggtcagaccgtagactcaggactcccactgctgtcagtgagtgatccctttatacccttgcaggtgcctgatgcaccggagaagctaattgaaggattgaagtccccagacacaagcctgctactacctgacttgctgccaatgacggatccatttggaagcacatccgatgccgtcattgaaaaggcagatgtcgccgtggagtcactgattccagggttagaacctcccgtaccccaacgcctcccaagccagacagagtctgttacgagcaataggactgattcattaacgggcgaagacagccttctcgattgctcacttctgagcaaccccaccactgacctgctagaggagttcgcccctaccgccatatcagctccagtgcacaaagcagccgaagactctaaccttatcagcggctttgacgtgcctgaagggagtgataaagtggccgaggatgaattcgatcctattcccgtgctaataacaaaaaatccccaaggtggccattcacgcaatagtagcgggtcatccgaatcttcccttccgaacctagcaaggagcctgcttctggtcgatcaactaatcgatctatag

SEQ ID NO: 48366 - DNA, 1143 bp, Artificial Sequence
  Description of Artificial Sequence: Synthetic coding sequence
atggaggaggggggtgacttcgacaactactacggagccgataaccagtcagaatgtgaatatactgactggaagtccagtggggctctgatcccagccatatacatgctggtgttcctactcggcacgacaggaaacggactagtcctgtggacagttttccggtcctcaagggaaaaaagaaggagtgctgatatcttcatagcctccctggctgtggcagacttgacttttgtcgtcaccctgccattgtgggcaacctacacttatcgagactatgattggccttttggcactttcttttgcaaactcagctcataccttatattcgtgaatatgtatgccagtgtattctgcctaaccgggctatccttcgacagatatttagccattgtcagacctgtggcaaatgccaggctgcgcctgcgcgtgagtggggctgtcgccactgctgttttatgggtgctggccgcattgctcgccatgcccgtgatggttctgcgaacgacgggagacctcgaaaacacaacgaaggtgcagtgttatatggactattcaatggtagcaacagtttcatccgaatgggcctgggaagtcggcttgggcgtctcttctaccactgtgggcttcgtggtcccatttaccatcatgctgacttgctattttttcattgcccagactatcgcaggacacttcaggaaagagcgaatcgagggactgcgcaagaggcggagactgctcagcatcatagtggttcttgtggtcacctttgccctctgctggatgccctatcacctcgtcaagactctgtacatgctgggcagcctgctgcactggccctgcgactttgatttatttctcatgaacatctttccttattgtacctgcatttcttatgttaacagctgcctaaaccctttcctgtatgcgttcttcgatcctcgttttcgacaggcttgcacctctatgctgtgctgcggccagtctagatgtgccggtacatctcacagttcttccggcgaaaaaagcgcctcctattcctctggacactctcaaggaccagggcctaatatgggcaaaggaggcgagcaaatgcacgaaaagtctatcccgtacagccaggaaacgctggttgtggattag

SEQ ID NO: 48367 - DNA, 786 bp, Artificial Sequence
  Description of Artificial Sequence: Synthetic coding sequence
atggaggagggaggagatttcgataactactacggtgcagacaatcaaagcgaatgtgaatataccgattggaaatcctccggtgccctaatccctgctatctatatgctggtcttcctcctcgcaatgcctgtgatggtgttacgcactactggagatctcgagaacaccacaaaagtgcagtgctacatggactacagtatggtcgccacggtgtccagtgagtgggcctgggaagttgggctcggggtgagttcaaccacagtcgggtttgtggtccccttcactataatgctgacatgttacttcttcatcgcacaaactattgccggtcatttccggaaggagcggatcgaaggactgaggaagcgaaggcgcctgctgtccatcatcgtggtgttggtggtaacgttcgcattgtgctggatgccgtaccacctggtaaaaaccttgtatatgctcggcagtttacttcactggccatgtgacttcgatctgttcctgatgaatattttcccatactgtacctgcattagttacgtaaattcctgtctgaatcctttcctgtatgccttcttcgaccctagattccgccaggcatgcacgagtatgctctgctgtggccagagtaggtgtgcaggcacgtcgcactcttccagcggagagaaatcagcatcttactctagcggccacagccagggccctggtccaaatatgggaaagggtggcgagcaaatgcatgaaaagagtatcccttacagccaggagaccctcgttgtggattag

SEQ ID NO: 48368 - DNA, 900 bp, Artificial Sequence
  Description of Artificial Sequence: Synthetic coding sequence
atgctggtgttcttgctgggaacaactggcaatggactcgtgctgtggaccgtcttcagaagtagtagagaaaaacggaggagcgcagacatcttcatcgctagtctggccgtcgcggacttgaccttcgtagtgactctcccactttgggccacatacacataccgtgactatgattggccctttggaactttcttctgcaaactcagcagttatctgattttcgttaacatgtatgcaatgcccgtaatggtgctccgtacaaccggtgatctggagaatactactaaagtgcagtgctacatggattattccatggtggccacagtcagctccgagtgggcgtgggaggttggactcggagtgtcgtccaccacagtgggatttgtggtcccattcactatcatgctgacatgctacttctttattgcccagactatcgcgggtcacttcagaaaggaacgcattgaaggtctccggaagagacgtaggttgctctcaattattgtcgtgctagtggtcactttcgctctctgttggatgccatatcacctcgtgaagaccctgtacatgttgggtagcctgctgcattggccttgtgattttgatctgtttctgatgaatatttttccctactgtacatgtatcagctatgtcaatagctgcctgaatccattcttatacgctttctttgacccgagattcagacaggcctgtacctctatgctctgctgcggccagtccaggtgtgccggaacatctcattcctcttcaggagaaaaaagtgcgtcgtattcttccgggcactcccagggcccagggccaaatatgggcaaaggaggagagcaaatgcacgaaaagtccatcccttactctcaggagaccttggtggtggactag

SEQ ID NO: 48369 - DNA, 621 bp, Artificial Sequence
  Description of Artificial Sequence: Synthetic coding sequence
atgttgccctgcgctgccggagcgagaggacgcggagctatggtggtcttaagagccggaaaaaagacatttctgcctcctctgtgtagagctttcgcatgccgcggttgccagctcgccccagaaagaggcgcagagcgacgagatactgctccgagcggagtgtctaggttctgccctcccaggaaatcctgtcacgattggatcggccctccagataaatattcgaatctccggcctgtgcacttttacattccagagaacgagtctccccttgagcaaaagctgaggaagcttcgccaggagacgcaggagtggaaccagcaattctgggctaatcagaacctcacattcagcaaggagaaagaggaattcatacactcccgactgaaaaccaaaggcctgggcctgcgaacagagtctggccagaaggccacacttaatgccgaagaaatggctgatttttacaaggaattcctcagcaagaatttccagaaacacatgtactataatcgggactggtataaacggaacttcgcaattactttttttatgggcaaggtcgccctggagcgaatctggaacaaactgaagcagaaacagaagaagaggtctaattag

SEQ ID NO: 48370 - DNA, 1122 bp, Artificial Sequence
  Description of Artificial Sequence: Synthetic coding sequence
atgggctctcaggtcagcgtagaatctggcgctctccacgtagtcatagtgggtggcggtttcgggggtatcgcggcagcttcgcagctccaggcactaaacgtccctttcatgttggtcgacatgaaagacagcttccatcacaacgtggccgctctcagagcttcagttgagacagggtttgcaaaaaagacgtttatttcttacagcgtaactttcaaggacaacttccgacaggggctcgtggttggaatcgatctcaagaaccagatggtactgctccagggcggagaggccctgccgttcagtcacctgatcctggctacaggctcaactggcccattcccagggaagttcaacgaggtgagctctcagcaggcagcaatccaggcctacgaagacatggtgaggcaggtccagaggagtaggttcatagtcgtggtgggcggaggctccgccggagtggagatggccgctgagattaagaccgaatacccagaaaaggaggtcacattgatccattctcaggtggctttggctgacaaagagcttctgccatctgttcggcaggaagtcaaagagatcttgctgcggaagggcgtgcagttgctgctgagcgagagagtctctaatctcgaggagctgccgctaaatgagtatcgcgagtacattaaggtacagacagacaaagggactgaggtggctaccaatcttgttatcctttgtacagggataaaaatcaattcttcagcctatagaaaggcattcgagagcagactcgcttcttccggcgcactgagggtaaatgagcatctgcaggtggagggtcacagtaacgtatatgcgattggggactgcgccgacgtgcgcacacctaagatggcctatctggccggactgcatgctaacattgccgtcgctaacatcgtcaacagtgttaagcagcgcccactgcaggcttataagccaggggcacttacattcctactctctatggggaggaacgatggtgtaggtcagatctccggcttttacgtcggccgactgatggtaaggctgaccaaatcaagagatctctttgtcagtacatcatggaagacaatgcgacagagtcctccttag

SEQ ID NO: 48371 - DNA, 1122 bp, Artificial Sequence
  Description of Artificial Sequence: Synthetic coding sequence
atggggagccaagtctcggttgagtctggcgcattgcatgtggttattgtgggagggggtttcggtggtattgccgcagctagtcaactccaggcactcaacgtcccttttatgctcgtagatatgaaggatagcttccaccacaacgtggcagctttacgggctagtgtggagactggtttcgccaagaagacctttatctcttattcagtaacctttaaggacaatttccgacaggggttggtggttggaattgatctcaagaaccaaatggtgttgctgcaaggcggagaagcactgcccttttctcatctgatactggcaactggctctactggtccgtttcccggtaagttcaatgaggtatcatctcagcaagctgcaatacaggcatatgaagatatggttcgccaggtccagcgatcgaggtttatcgtcgtggtgggaggaggaagcgccggagtggagatggccgcagaaataaaaacagaataccctgaaaaggaagtcaccctgattcattctcaggttgctttggctgataaggagctgttaccttctgttcggcaggaggtgaaagaaatcctgctcaggaaaggcgtccagctgctgctttcagagcgggtgtccaatctggaggaattgccactcaacgagtatcgagaatatatcaaagtgcagacagacaagggcacagaggtggccactaatctcgtcattctttgtaccggaattaagatcaatagctccgcttataggaaagccttcgaatctcgactagcaagcagcggcgctctccgcgtcaacgaacacctacaggtcgagggccacagtaacgtgtacgccattggagactgcgcagatgtgcgaacccccaagatggcttacctcgctgggcttcacgctaacatagccgttgccaacatcgttaattctgtgaaacagcggccacttcaagcctataagcccggagcgctcacattcctcttgagcatgggacggaacgacggagtgggacagatatccggattctacgtgggtcgcctgatggtaaggctgactaaaagtcgagacttgttcgtgtccacctcctggaagaccatgcggcagtctcctccctag

SEQ ID NO: 48372 - DNA, 1011 bp, Artificial Sequence
  Description of Artificial Sequence: Synthetic coding sequence
atgggatcccaggtgtcggtcgagtccggggcactgcacgtggtcatcgtcggcggaggatttggaggcattgctgccgcttcccagcttcaggcccttaacgttccctttatgctcgtggatatgaaggattccttccaccacaacgtggccgctctgagggcttcagtagaaacaggattcgcaaaaaagacattcatttcttacagcgtgactttcaaagataactttagacagggcctagttgtggggatcgacctaaagaaccagatggtgctgctgcagggcggagaagtgcagcgctcacgattcattgtcgtggtggggggaggcagcgcaggagtggagatggctgctgagattaagacggaatacccagagaaggaagtgactttgatccattcacaagtggcattggctgacaaagagcttctgccatcagtcaggcaagaggttaaagagattctgctcagaaagggcgttcagctgctcttgacattgctgggggagcgcgtgagcaacttggaagagctcccactcaatgaataccgagagtacatcaaagtgcagactgacaaggggaccgaagtggcgacaaacctggtcatattgtgtactggaatcaagattaattcctctgcctatagaaaggcctttgaatcccgactcgcaagctccggcgctttgcgggttaatgagcacttgcaagtcgaaggccacagcaacgtgtatgcgatcggtgattgcgctgacgtcaggacccccaagatggcttatttagcagggttacatgccaacattgctgtcgctaatattgtcaacagtgtgaaacagcggccactacaggcttataagccgggagcattgacctttctgctgtcaatgggacggaacgacggagttggacagattagcggtttctacgtaggacgcctcatggtccgcctgaccaagtctcgggacctcttcgtgtctacttcgtggaaaacgatgcggcagtcccctccatag

SEQ ID NO: 48373 - DNA, 906 bp, Artificial Sequence
  Description of Artificial Sequence: Synthetic coding sequence
atggtgttcactcaggccccagcagagatcatggggcacttgaggattaggtcactgctcgcacggcaatgcctagccgaatttctcggcgtcttcgtgctgatgctactaactcagggagccgtcgcccaggcagtgaccagcggagagacaaagggcaacttctttacgatgttcctcgcaggctccttggctgtgactatcgccatttacgtcgggggtaatgtatctggcgcacacctcaaccccgcattttccctcgctatgtgtattgttggacgcctcccttgggtaaaacttcctatttatatcctagtgcaactgctttctgccttttgcgcttcaggggctacatatgtcctctaccacgacgctctgcagaattacactggagggaatctcaccgtcaccggtccgaaggaaacagccagtatttttgcgacttatcccgctccttacctgagcctcaataacgggtttttggaccaggtgctggggacagggatgcttatcgtgggcctcctcgctatcttggatcggaggaacaagggcgttccagccggactcgagcccgtcgtggtggggatgctcatcctggccctcggcctgtctatgggggctaattgcggaatccccctcaacccggcaagagacctcggccctcggctttttacatatgtcgcgggatggggtcctgaggtcttttcagccggaaacggctggtggtgggtgccagttgtcgcccctctggtgggcgcaaccgtggggactgccacttatcagctgctcgtagctctgcaccacccggaagggcctgagcctgcccaggatttagtgtctgcccagcataaagcgagtgagctcgagactcctgcttccgcccaaatgcttgaatgtaaactatag

SEQ ID NO: 48374 - DNA, 795 bp, Artificial Sequence
  Description of Artificial Sequence: Synthetic coding sequence
atggtgttcactcaagcacctgctgaaattatgggtcatttgcgcattagaagtttactggcacggcagtgtttagcagagttcctgggtgtatttgtcctcatgctgctgacccagggggctgtcgcccaggcggtgacctctggggagacaaagggaaacttctttacgatgtttctagctggatctctggcggtcactattgccatatacgtggggggaaacgtttcgggcgcacatttgaacccagcctttagtctcgccatgtgcatcgtcggccgactgccgtgggtgaaactgcccatatacatcctggtgcaattgctgtctgccttttgcgctagtggtgctacatacgtgctctaccacgatgctctccagaactacaccggtggtaacctgacagtgacaggccctaaggaaaccgcatcgattttcgccacctaccccgctccatacctaagtctgaataacggatttctggatcaggtgttagggacgggcatgctgattgtggggctgctcgccattttagatagaagaaacaagggggtgcccgcaggccttgagccagtggtggtgggcatgctgatattggcactcgggctgtcgatgggcgcaaattgtggtatacctctaaatcccgctcgggatctggggccacggctcttcacatacgtcgcaggttggggcccagaggtgttccgctgggagactgactcgccaggcgctgggctccattctcctagctcagccaagggatccgtccccggaagcacagccctgtgtttgtag

SEQ ID NO: 48375 - DNA, 1125 bp, Artificial Sequence
  Description of Artificial Sequence: Synthetic coding sequence
atggcaaaagaacgtcgacgtgctgtcctggaactcctgcagaggccgggaaatgcgagatgtgccgactgcggagcccctgatcctgactgggctagctatacactaggggtcttcatctgcctgtcctgttctgggattcaccggaatattccacaggtaagtaaggtcaaaagcgtgcgattggacgcgtgggaggaggctcaggtggagttcatggcatcccacggtaacgacgcggctcgggcacgcttcgaatcaaaggtgccaagcttctactacaggcccacgccaagcgactgtcaactgctgagggaacaatggattcgcgctaaatatgaaaggcaggaattcatataccctgagaaacaagaaccttatagtgccggataccgggagggttttctgtggaagaggggcagggacaatggacagtttctgtctcgcaagtttgtcctgacagaaagggaaggcgctctgaaatacttcaatcgaaacgacgcaaaggagccaaaggctgtgatgaaaatagagcatctgaatgcaacgtttcaacctgcaaaaatcggtcacccccacggtttgcaggtgacctacttaaaggataacagtactcgcaacattttcatatatcatgaggacggcaaggagatcgtagactggttcaatgccttaagggctgcccgttttcattaccttcaggtggcttttccaggggcaggcgacgcggatctggtcccgaagcttagccggaattacctcaaggagggctatatggagaaaactggtcccaaacagaccgagggctttagaaaacggtggttcaccatggatgaccggaggctgatgtactttaaggatcccttggacgccttcgctcggggtgaagtgttcattggctccaaagagtctggttacacagtcctgcatgggttccctccaagtacccaaggtcaccactggcctcacggcattactattgtgaccccagaccggaaattcctcttcgcttgcgagactgaaagtgaccaaagagagtgggtggccgcatttcagaaagcggtggaccggcctatgctcccgcaggaatacgctgtcgaggctcactttaaacacaaaccctag

SEQ ID NO: 48376 - DNA, 909 bp, Artificial Sequence
  Description of Artificial Sequence: Synthetic coding sequence
atggccagtcacggtaacgacgctgccagagcgcgattcgagtctaaagtccctagcttctactataggcccactccttcagattgtcagctcctgcgagaacagtggattagggcaaaatacgaacgccaggagttcatctacccagagaaacaggagccctacagcgccggatatagggagggattcctgtggaaaagagggagggataacgggcagttcctatctaggaaattcgtcctcaccgagcgcgagggggctctcaagtactttaataggaatgacgctaaagagcccaaggctgttatgaaaatcgaacatctcaacgcaacctttcagccagcaaagatcgggcacccacacggcctacaagtaacgtatctcaaagacaactctacacggaatatttttatctatcacgaagatggaaaggagattgtggactggtttaacgccctgagggcggctcgcttccactatttgcaagtagccttccccggtgccggagacgcagatctggtgccgaagctgagcagaaactatctcaaagagggttacatggagaagacgggacccaaacaaaccgagggcttcaggaaaaggtggttcactatggatgacaggcgcctgatgtatttcaaggatccactggacgccttcgccaggggtgaggtctttatcggctcaaaggagagcgggtacaccgtactgcatggctttccaccatcaacacagggccatcattggccgcacggaataactattgtcacacctgaccgaaaatttctgtttgcatgtgagactgaatcagatcagagagaatgggtggccgctttccagaaagcagtagatcgcccaatgctgccccaagaatacgctgttgaggctcatttcaagcacaaaccatag

SEQ ID NO: 48377 - DNA, 603 bp, Artificial Sequence
  Description of Artificial Sequence: Synthetic coding sequence
atgaagattgagcacctcaacgctacttttcagccggctaagattggacatccgcacgggctgcaggtcacctacctgaaagataattctacacggaacatctttatttatcacgaggatggcaaggaaatcgtggattggttcaatgctctccgcgctgctcgatttcattatctccaggtcgcgttccctggcgctggggacgctgatctggtacccaagctttcaagaaattacttgaaagagggctatatggaaaaaaccggacctaaacagactgaggggttccgcaaaaggtggtttaccatggacgataggcgactgatgtactttaaagaccctctggacgcttttgctagaggcgaagtatttatcgggtcgaaggaatccggatacacagtgttacacggcttccctcccagtacccagggtcaccactggccacacgggattaccattgtcactcccgaccggaaatttcttttcgcttgcgagactgagtctgaccagcgtgaatgggtcgcagcctttcagaaggctgtcgacagacccatgctcccacaggagtacgccgtggaggctcattttaaacataagccctag

SEQ ID NO: 48378 - DNA, 783 bp, Artificial Sequence
  Description of Artificial Sequence: Synthetic coding sequence
atggtgcttgcctcactagaattgctcagggaacagtggatccgcgctaagtatgagcgacaggaatttatttaccctgaaaagcaggaaccgtattctgcaggctaccgcgagggatttctatggaagaggggcagggataatggacagtttctcagtcggaagtttgtgctcactgagcgtgaaggtgccctgaaatattttaatcggaacgatgctaagatcggccatccccacggacttcaggttacttacctcaaagacaattcaacaagaaatatttttatttatcacgaggacggaaaagagatagtggattggttcaacgctctccgcgcagccagattccactatctgcaagtggctttccctggggcaggcgacgcagatctggtgcccaaattgagcagaaactatctcaaagaggggtatatggaaaaaaccgggcctaagcagaccgagggctttcgaaagaggtggtttaccatggacgacagacggctgatgtattttaaagaccctctggacgccttcgctcggggagaggtcttcataggcagcaaagagagcggctataccgttcttcacggattcccccctagtacccaggggcaccactggccacacgggatcaccattgtgacacctgatagaaagttcctatttgcttgtgaaactgagagtgatcaaagggagtgggtggcagcctttcagaaggcggtagacaggccaatgttgccccaggagtatgctgtagaagctcattttaagcacaaaccctag

SEQ ID NO: 48379 - DNA, 1158 bp, Artificial Sequence
  Description of Artificial Sequence: Synthetic coding sequence
atgtttcagttcgttttttcaagggtgtattgcattaacccagcaaggcgcaaatggaaggagtttgagaaaatgctaggatgcgccgaagagggacatgccagtctgggaagagaccctgattgggcttcctacacactaggtgtcttcatctgcctgagctgcagtggcatccataggaatatcccccaggtgtccaaggtcaaaagcgtccgcttggacgcctgggaagaggcacaggtggaattcatggctagtcacggaaacgacgccgctagagccagattcgagagtaaagtgccgtctttctactatcggccaacaccttccgattgtcagctattgcgagaacaatggatccgtgcaaagtacgaaagacaggaatttatttatccggagaagcaagagccctactcggccggttatcgggaggggtttctgtggaagagaggacgcgataatggccaatttctgtcccggaaattcgtgctcacagaaagagagggtgccctaaaatactttaatcgcaatgacgccaaagaaccaaaagctgtgatgaagattgaacacctgaacgctaccttccagcctgctaagatcgggcatccccacgggctgcaggttacttacctgaaggataacagcacgagaaacatctttatataccatgaggacggcaaggagatcgtagactggtttaatgctctgcgagccgctagattccactaccttcaggttgctttccccggtgccggagacgccgatctcgtgcctaaactgtcccgcaattacctgaaggagggttacatggaaaagacaggtccaaaacaaaccgagggcttccgtaaaaggtggttcactatggacgaccgccgactgatgtactttaaggacccattggatgcatttgcgagaggcgaagtctttattgggtctaaagagtcgggttatacggtgttgcacggatttcctccctctacacagggtcaccactggccccatggcatcacaattgtaactcctgatagaaaattccttttcgcatgtgagaccgaaagtgatcagcgcgagtgggtggctgctttccagaaggccgtggatagacctatgctgccccaggagtatgctgtggaagcccacttcaagcataagccctag

SEQ ID NO: 48380 - DNA, 1146 bp, Artificial Sequence
  Description of Artificial Sequence: Synthetic coding sequence
atgggcgatcgggagcggaacaaaaagcgcctgctggagctgctgcgagccccagacacgggcaacgcgcactgcgccgactgcggcgcagctgacccggactgggcctcgtataagctgggcatctttatatgcctgaattgctgcggggtgcaccgcaatttccccgatatcagcagagtgaagtccgttaggcttgacttctgggacgattctatcgtggaatttatgatccataacggcaatctgagagtaaaggccaagtttgaggctagagtgccagccttttattatatcccacaggccaatgattgcctggtgcttaaggaacaatggatcagagcaaagtacgagcggagggaatttatggcggatggagagacgattagcctgcccggaaatagggaagggttcctgtggaaaagaggcagggacaacagccagttcctgcgtagaaagttcgttcttctggcgagagaaggcctgctgaagtactttacaaaggagcagggcaaaagcccaaaggctgttattagcatcaaggacctcaacgccacatttcaaaccgagaagatcggccatccccacgggctccagatcacctaccggagggacggtcacacacggaacctgttcgtctatcatgagtctggcaaagagatagtagattggtttaatgcactgagagccgcacggctgcaatatcttaagatggctttccccgagctgccagagagcgagctggtgccgttccttacacgaaactatctcaaacaggggttcatggagaagaccggaccaaagcagaaagaaccattcaaaaagaggtggttcgctcttgattgtcacgaacgcagattgctctattataaaaatccattagacgcttttgagcaaggccaggtgtttctggggaacaaagaacagggatacgaagcttacgaggatcttcccaaaggcatccgcggtaatcgctggaaagctggcctcaccattgttacccctgagcgacgattcgtgttgacctgcccatcagaaaaggagcagcaggaatggcttgaaagccttcggggagtgctgtcatctccattaactcccctgaaccggctgacagcaagcacagaatcagggaggagttctaggtag

SEQ ID NO: 48381 - DNA, 3021 bp, Artificial Sequence
  Description of Artificial Sequence: Synthetic coding sequence
atgcctgaccagatctccgtctcagagttcgtggccgaaacccatgaggattacaaggcaccgactgcttctagcttcacaacaagaacagcccagtgtaggaatacggtcgccgctattgaggaggccctggacgtcgaccggatggtactgtacaaaatgaaaaagtccgttaaagcaattaactcttccgggcttgctcatgttgagaatgaagaacaatacacccaggcacttgagaagttcggcggtaattgcgtctgtcgagacgacccagatctcggctccgcctttctgaagttttctgtgttcactaaagagttaactgccttatttaagaatctgatacaaaatatgaacaacatcatttccttccccctggatagcctgctgaaaggcgatctgaagggtgtcaaaggcgatctcaagaaaccctttgacaaagcctggaaagactatgaaacaaagattacgaagatcgaaaaagagaagaaggaacacgccaaactgcatggaatgattagaaccgagatctccggcgcagagatcgccgaagagatggagaaggaacgtaggttctttcaattacagatgtgtgaatacctgctcaaagtgaatgaaattaagatcaagaaaggcgtcgatctgcttcagaatcttatcaagtacttccacgcacaatgtaacttcttccaggatggactgaaagcggtggagagccttaagccgagcattgaaacactgagtacagacctccataccataaagcaagcccaggacgaggagcgacgccagctgatccaactgagggatatcttgaagagtgcactccaggtggaacagaaggaggattctcagattaggcagtccacggcgtacagtctgcaccagcctcaaggaaacaaggagcatggtactgaaaggaacggcagcctttacaaaaagtccgatggcatcaggaaggtgtggcagaagcgaaagtgctctgtaaagaatggattcctgacaataagtcacggcaccgccaacaggcccccagctaagctgaacctcctcacttgtcaggtgaagaccaacccagaggagaaaaagtgtttcgacttgattagccacgatcggacgtaccatttccaagctgaggatgaacaggagtgtcagatttggatgagtgtgctgcaaaatagcaaggaggaagcattaaacaatgctttcaagggggacgataacacgggggagaacaacattgtacaggagttgaccaaggagataatctccgaggtgcaacggatgactggcaacgacgtctgctgtgattgcggcgcaccagatcccacctggttatccacaaacttgggcattctaacttgtatcgaatgctctggcatccaccgcgagttgggcgtgcactatagtagaatgcagtccctgaccctggacgtgctgggaacctctgagctgctcctggcaaaaaacattggaaatgcgggattcaacgaaatcatggagtgctgtctgcctgccgaagactccgttaagccaaatccaggctccgatatgaacgcgaggaaggattacatcacagccaaatacatcgaaagaagatatgctcgcaagaaacacgcagacaatgccgcaaagctgcatagtctctgtgaggcggtgaagacacgggatatcttcggcctcctccaggcctacgcagacggcgtggaccttacggagaagatacccctggccaacggtcacgagcccgacgaaaccgctttgcacctcgccgtccgcagcgttgaccggacatcactccatattgtcgacttcctcgtccagaattcagggaatctggataagcaaacaggaaaaggcagcactgctctgcattattgttgtctgacagacaatgccgaatgtttgaaactactgctccggggtaaggctagcattgagattgccaacgagtctggggagacacccctcgatattgctaaacgacttaaacatgagcactgcgaagaactcctgacacaagccctgagtggaagattcaattcccatgtccatgtcgaatatgagtggcgcctgcttcatgaggacctcgatgagtctgacgatgacatggatgagaagcttcagccctcaccgaaccggagagaagatcgacccattagtttttatcagctgggctcaaatcaattacagagtaacgccgtgtctcttgcacgcgatgccgctaaccttgcaaaggaaaagcagagagcgtttatgccttccattctgcagaacgaaacatatggcgcactcctatccggaagccccccacccgctcaacctgccgcaccctcaacgacatctgcccctccacttccccctcggaacgtcggcaaggtccaaacagcaagttccgccaatactctgtggaagaccaactcggtcagcgttgatgggggatctagacagcgcagttccagcgacccccctgccgtccaccctcctttgccaccactgcgtgtgactagcacgaaccccctgactcccaccccccctcctcctgttgctaagactccttcagttatggaggccctctcccagccaagcaaacctgctcccccaggcatttctcagataagaccaccgccacttcccccacagccaccatcacgcctacctcagaaaaagccggcaccaggcgctgacaaatctactcctctgacgaataagggtcagcctcgtgggccagtggacttgtccgcgaccgaagccctcggaccactgagtaacgctatggtcctgcagccaccagcccctatgccaaggaaaagccaggccacaaagctgaagcccaagcgggtgaaagccctatataactgtgtcgccgataatccggatgaactgactttttctgagggcgatgttattatcgttgacggagaggaggaccaggaatggtggatcggccacatagatggagaccccggtcgcaagggggctttccccgtgtcatttgtccatttcatagccgactag

SEQ ID NO: 48382 - DNA, 2886 bp, Artificial Sequence
  Description of Artificial Sequence: Synthetic coding sequence
atgcctgatcagattagcgttagcgaatttgtagctgaaacgcatgaggactacaaggcccctacagcatctagcttcacaacacggactgcacagtgcaggaataccgtcgccgctattgaagaggccctcgatgtggaccgcatggttctgtacaagatgaaaaagtccgttaaagccatcaacagctccggcctggctcacgtcgagaacgaggagcagtatacgcaggctttagaaaagtttgggggaaactgtgtgtgtcgagatgaccctgacttgggctccgcgtttctcaaatttagtgtctttactaaggagcttactgccctttttaaaaaccttattcaaaatatgaataacatcataagtttcccactcgactcattactgaagggagacctgaagggcgtgaaaggagatctgaaaaagccttttgacaaagcctggaaggattacgagaccaagattaccaagattgagaaggagaaaaaggagcacgctaagttacatggcatgatccggacagaaatcagcggcgcagagatcgccgaggaaatggaaaaagagagaagattctttcaattacaaatgtgtgaatatctactgaaggtgaacgagattaaaattaagaagggcgtggacttgctacagaatttaatcaagtacttccacgcccagtgtaatttctttcaggatggactgaaagccgtggagtccctgaaaccttcaatagagaccctgtcgaccgatctccacacaattaagcaggcccaagacgaggaaaggcgccagctcattcagctgcgtgacatcctgaagagcgccttgcaggtcgagcagaaggaagacagccagattcgccagtccaccgcctattctctgcaccagccacagggaaataaagagcacggcaccgagagaaacggctcattgtacaagaaatctgatgggattcggaaggtgtggcagaagcggaaatgttctgtcaagaatggatttttgaccattagccatggcactgcaaacagaccacccgcaaagttgaatctgttaacctgtcaggtgaagaccaatcccgaggaaaaaaagtgttttgatctgatcagccatgaccgaacttaccacttccaggccgaagatgagcaagaatgccaaatttggatgtctgtgctccaaaattccaaggaggaagccctaaataacgccttcaaaggcgacgataacacaggagaaaataatatcgttcaggagcttacaaaggagatcatcagcgaagttcaacgcatgaccggaaacgacgtctgctgcgattgcggagctccagatcccacctggctctcaactaatctaggcattctgacatgcatcgagtgcagtggcatccacagagaactgggagtgcactatagtaggatgcaatctctgacactggacgtcctgggcacctccgaactgctgctggccaagaatatcggcaacgctggtttcaatgagatcatggagtgctgcctccccgctgaggactctgtgaaaccaaaccctgggtctgacatgaacgccaggaaggattatattaccgcaaaatatatcgagaggcgttatgcaaggaagaagcacgccgataatgctgccaaattgcattccctgtgtgaggcggtcaagacaagagatatattcggtctcttgcaagcctatgccgatggagtggatctgaccgagaaaataccactcgcaaatggccatgagcctgatgaaactgccctgcacttggccgtgcgcagcgtggataggacctccttgcacatagttgactttctggtccaaaacagcgggaacctggacaagcagacagggaaggggtccacagccttgcattactgttgtctgactgataatgctgaatgcctcaagctcttgcttaggggcaaagcctctatcgaaattgcaaatgagtcaggggagacacccttggacatagcaaagcggttaaagcacgagcattgtgaagaactgctgacacaggccctttccggccgattcaatagtcacgtgcacgtggagtacgaatggcgcctccttcacgaagacctggacgaaagtgacgacgatatggacgagaaactgcagccaagtccaaaccgtcgcgaggaccggccaattagcttttaccagttgggctccaaccagctgcagtctaacgctgtttctctggctagagacgcggcaaacctggccaaagagaaacagcgagccttcatgccatccattctccagaacgagacatacggtgcactactgtccggctctcccccaccggcacagccggctgcaccttcaacaacctcggcacctcctctgccacccaggaatgttggaaaggaccccctgactcctaccccccctccaccggtggccaagactccctcagtgatggaggccctgtcgcagccctcaaagcccgcacctccagggatttcccaaataagaccacctcctctgccaccacaacctcctagtagactaccacagaagaagccggctccaggcgctgacaagtctacgcccctgaccaacaagggccagcccaggggccctgttgatctgtcagccactgaggccctgggaccactgagtaacgcaatggtgctgcaacccccagccccaatgccccgtaagtctcaggcaaccaagctgaagccaaagagggtgaaggcgttgtacaattgcgtggctgataaccctgatgaactgacattcagcgaaggtgatgtcatcattgtggatggtgaagaggatcaggagtggtggataggccacattgacggcgatccagggcgtaagggtgctttccctgtttcctttgtccatttcattgctgactag

SEQ ID NO: 48383 - DNA, 849 bp, Artificial Sequence
  Description of Artificial Sequence: Synthetic coding sequence
atgaatagtagcacttcaaccatgagtgaggaacccgacgccctgagcgtggttaaccagcttagagatctcgcagcggaccctctgaataggcgggcaatcgtgcaagaccagggctgcttgcccggtcttattctctttatggaccatcctaaccctcccgtcgtacacagtgcactgctcgcattgcgctacctggccgaatgccgcgctaacagggagaaaatgaaaggggaattaggcatgatgctctctctgcagaacgtcatccaaaagactaccacccccggagagacgaagcttcttgcctctgagatatatgatatcctccagagctctaacatggccgatggagatagcttcaacgaaatgaactcacgtagaagaaaggcccagttctttcttggtacaacaaacaagcgagcaaaaactgtggtcctgcacatcgacgggctggatgacacctctagaaggaacttatgcgaagaggcactgttaaagattaaaggcgtgatctcctttacttttcaaatggccgttcaacgctgtgtggtgagaatcaggtccgatcttaaggccgaagccctggcttcagccatcgcatccaccaaggtcatgaaagcccagcaagtcgtgaagtcggaaagtggcgaagaaatgctggttccattccaggacacaccagtggaggttgaacagaacactgagctgccagactacctgccagaagatgaatcaccaactaaagaacaagataaggccgtctccagagtcggatcacatcccgaagggggagcctcctggctcagcacagccgctaactttctcagccggtccttttattggtag

SEQ ID NO: 48384 - DNA, 543 bp, Artificial Sequence
  Description of Artificial Sequence: Synthetic coding sequence
atgagtgcttggccatattttatttatggaccaagccagccttccagccgccctttgcgcttcgcttgcagcagcattcttgggagaatgccgtgcaagcagcgtaaggatgaacgccgaacaggatacgacgttgaacttaccaagtgttacacagaaagtcgccgaaatctgtgcgaagaggcattgctgaaaattaagggcgtgatttctttcaccttccagatggccgtacagaggtgtgtagtgcgcatcaggagtgacctgaaagccgaagccctagcgagtgctatcgcgtctacaaaagtgatgaaggcacagcaagtggtgaagagtgagtccggggaggagatgctcgtgccatttcaggacacgccagtcgaggtcgaacagaatacggagctccccgattacctgccggaagacgagtcccccacaaaagaacaggacaaagcggtgagccgcgtcgggagccatcccgaaggaggggcttcctggctgagtactgccgcaaactttctgtctcgaagcttctactggtag

SEQ ID NO: 48385 - DNA, 6872 bp, Artificial Sequence
  Description of Artificial Sequence: Synthetic coding sequence
atgggcaggatacaggaggtggggtgggtgaccgctggcctggtgatctgggcgggaacttgctactacatttataaatttacaaaaggacgggctcaatctgtgcgaacgctagctcgaaatggctcaaccgtgaagatggagacggtggttggtgtgcagagccaaactttggccatcaacgaagctgaaatcaaaactaagcctcaagtcgagattggtgcggagacaggcgcaagaagtggaccacgagctgaagtggaaacgaaggctaccgctatagctatccaccgggcaaacagccaggcaaaggctatggtcggcgctgaaccggagacccaaagcgaatccaaagtggtcgccggtacattggttatgaccgaggctgtcaccctcacggaggtaaaggcaaaagctcgagaggttgcaatgaaggaggccgtgacacagacagatgcagaggcgggaaaaatcgtgaaaaaggaggctgtcacacaaactaaggctaaggcttgggccctggtcgctaagactgaagccaagagagaggccatgacgcaaacaaaggccgagacccatatcctcgccgagaaggaaacagaaattaatagggtcatggtgactcagtcagaaaccttagccgtgccacgagaggtcgcaaaaatgggggctaccaacaaaaccggaatcgtggatgaaaccaaaacacgcgctctggaggagactgtctcagtggctaagacacagtctgaagcccgacctggagcaaccgttgatgctcgcggaaatccaaatggcatgtccagggaggttgcaggggttgacatgaagtcatgtgcccaatcccaggctgtgactaaaatccagggagacgacatgccgggaacgggggttgaggatatgggaaattgtaaaacaatgtcacgggctgagtctggggcagatactcgcgcttcagcccagccgcagattttcgccaagacacagactgaagcaattcctggggcaaaaatcgatgctggtgggaataccaatgcaatgtgcaaggtcggtgccggagccgatgttcgtgcttgtatccagccgcagaccgttgcaaaaaaacaggccgaggtgacctcgggcgctcgggtggacgggagggggaacacaaacgttatttcaaaagctatcacaggtgctgatatgcgggctgctgcgcagccccaggctgtggccagcacccacgcagaggctatgagcgacgccaaggtaaaaaacaggggtaaccccaacgccatgactaaggcaggggctaaagcaaatctgagggctaactcccaggtggaagccctgccagatgcaagagacaagtccaggggcaatcccaacgtcatggctaaggtgggggatggaacagacatgctttcttgtacccaaccacagctagtggcctccgttcaggccgataccctttcagacggcaaaattaaggtgagagggaatgtgaatacgatgccgaaggaaggggctggggtggacatgaaagcccagggaatggcccagtcccaaggcgaagcattaccaaacacacggggaaaggcccgaggcaaagccaaagctaagtgcaaaacaggccctggtatggacatgaagacctgcacccaacctcaggctggggttaagacgccagctgaggcgcttctggattccagagttgacggaagaggcaacccaaatgccacaagcaaagcaggaacaaaagccgaccaacgcgtttgtggtcaaccactggtcgtcgccaacccacagggggaagccctgcccggtgcgaaaaataaagtcaaaggaaatccccacacagtgctgaaggtgggcgcaggcgagggcacaacagactcagcccaaccagaagctgtggttagctttcagggggaagccctgctcggtacgaagaacaaggtgaaaggaaatcctaacgtggtcttaaaagcagaggtaggtgaaggggctatggggaccgctcagttacaaattatggcctcatcaaaaggcgaggcactcctggattcaaaaaacaaggtaaagggcaatagtaacgctgtgtccaaagcaggagccggaacagacactaccggttctgttcagcctcagattgtggcgaatagccagggcgaggtcctgcccggtgccaaaaacaaaatcagaggaaatcctactaccgtacccaacagtggtgtcgggccttatacaacggattctgccagactgcaagccgtggcaaacagtcagggagaggtactgccgggtgctaaaaataaagttaaagcgaatcttaatgcggttagtaaagccgaagccggtatgggagctacaggcagtgtgcagccacaagcagtggccaattctcattgcgaaacactgcctggggcaaagaacaaggtacgtggcaactggaacgcagtgagcaaagcaggggctgggatggatacccgaggctccgcccaaccccaggccgtggccaactcacagggagaagtgctgcctggagccaaaaacaaagtgaaaggaaaccccaacgttgtttcgaaagcaggagctagagaagatactgtggggagtacccagccacaggtgctcgcttcttcacagagggaaacattacccggagcaagaaacaaggttaagggtaattcaaatgttgtgagcaaggccggtgccagagaggacaccatgggatcagcacagccgcaagttgtcgccaacagtcaacgagagactttacctggggcaagaaataaagtgaaaggcaacagtaatgcgatttcaaaggccgaggcaggggctgggatcatgggcagcgtgcaggttcaagtagtggctagcttccagggcgaagtgctgcctggagctaaaaataaggtgagaggcaattccaatgccgtgccaaaggcggaagccggtgcagataccgtgggcagcgcgcagccacaggccgtagccaactctcagagcgaaacgctgctcggagcccgtaataaagtcaagggcaacaccatcgcagtacccaaagcgggaaccggggcagggacaagacactccgcccagccccaaattgtggccggtagtcagggcgagacactgccgggagccagagacaagagcatgtccacatcggaggccgaagctaccgccgaggacgaggcctacgcaaaacccgaagcggaggccatgcctacctcagaatccgagggcggttcaggtacacaggcgtgtcgaaagacacagcctaacatccacgattactactggaatgggattggggtggaggactggatcgctgccgagcggtggatcaagttccgctttcagactatggatggagactgggaaaatagcgtttcctgggccgacgacgaaaatgaggcgagcatcgggtcgtggtccggcgcttccgataaggccggaatcatcaggagttgggccgtggcctgtgacgaaacctccgtgaaaagctgggcgggagccagagccgagaacgtcgttggaatcggaacatgggccagagcaggggagcaggcaagtggcggactgtgggctggaggccagacgtccgaggggacctgggcaggtgataaagcatcaggaggggcttggacaggcgcagagaaccaggcctccgggggaagttgggccctggccggtaaccaggccatcggagaactctgggcagcaggtcaggctagcgacggttcttggcctgggggtcaggcttcgggcgtgagctgggtgggtgaagaagctattggtggaagctggaccggagctgaaaaccaggcatccgaagggagctgggccggagctggcgcagggaacatgagttcggtgtcctattgggccggagtggtggatcaggcgggtggtgggtcttgggccggtacgagtgatcagtccggcggaggctcaaaacccagattcgaagatcaggctagcggcgagggcagctgggccggtgccggaggtcaggctagcggaggctccatgttgggccctgaggatcaatcctcgggcagatcatgggcagacactgctgatcaggcatccggcggaagccgactaggacacgtggatcagtcctcaggtggggcatgggcaggaacattggatcagagcggcggaggctcaaaacctcgattcgagaaccaaactactgaagagggctcgtgggccggagcaggcggtcaggccggtggcggatctaaggtgggacccgaggatcaatccagcggtcggtcgtgggcaaattccggcgaccagatctcaggagggtttctggtcggaattgtagaccaggcaaacgggggatcttggacaggagccggtcatcctgcttctgttggtccaaaacccattttcgaggaccaagtttcaggacgtggcagttgggccgatgctcgcgagcaggtggtgggggattctcggctgggattaagggaccagtcaagcggagactcctgggctgatactggcgaccaggcaagtgggtggttttgtgtgtgtcctggatctcagaccaatggcggttcctggggcggagcttcgggtcaagacgtggggggatcaaggcctggccctactaatcagtccagtgccggtagctgggattctccgggttctcaggtttctggttcttgctggaccggcgcaggcgcagtggatcaggctggcggttgtagcaagcctgggtttgaggaccaggctatcgggggaggattttggccaggcgctggcgaccagaccggaggcggttctcgtcccggttcagaggatcaaagctccggaatcggcagctggggtgtggcaggcggtcaagtgctgggtggagccaggcctggccctgccgaccagtcttccggcggtagctgggccggtacaggcaaccagtcctcaggccgatcttggataggccctggggatcaagccgtggactgcagcaaacctgagtttgaagaccaggcctgtggaggaggcagctgggcaggtgccggatcccaggcctcaggcgaaagctgggccggatcacggccaggtaatgaagccatcggcggtagtagaatgggctcagaggatcaagcgacaggtggatcttgggctcgctctgaagaccaggcctctggtcgctttcaggtgtcgttcgaggtggaggctaacgagggcttctggttcgggcctggcgctgaggctgtgattgggtcctggtgctggaccgaagagaaagcagacatcgtgtccagaccagatgacaaagacgaggccacaactgcatctcggtccggggcaggtgaagaggctatgatttgttcaagaattgaggccgagaataaggcttcatccggatcgtggattcgatccgaagaggtcgcctacatggggtcttgcgtaggcgcagaagctggagccggagctgaagctggcgctggcgcagaggctggcgctggagccggtgcagaggctggcgcagaagccggagctggagcaggcgctggccctggaaccgagagcggagcgggaatttggtcttgggacggggacgcaacgacagtggaaagcagactcggtgccggagaagaagctggcgtcgaaagttggaccctggcaaggaacgttggtgaggacgagctgtcaagggaatcgtcaccagatatcgaggagatctcattaagatcactcttctgggcagagtctgagaatagcaatacatttaggtcgaagtctggaaaggacgccagctttgaaagtggcgctggggacaacacctccattaaagataagttcgaggcagccggaggggtggatataggtagctggttttgcgcaggcaacgaaaacacgagcgaggacaaatccgctccgaaggctaaagccaagaaatcttctgagagccgcggaatctacccttacatggtgcctggagccggtatggggtcctgggacggcgctatgatttggtccgaaacaaaattcgcccaccagtcggaagcatccttcccggttgaagatgaatctagaaaacagacacgcaccggcgaaaaaacacggccatggtcttgtaggtgcaaacacgaggccaacatggatccaagagacttggaaaagctgatctgcatgatcgagatgactgaggacccctccgtccatgagatcgctaacaatgctctttacaattccgccgattactcgtactctcatgaggtggtcaggaatgtcggaggcatcagcgtaattgagagcctgcttaataatccctacccaagtgtccgacagaaagccctgaacgcactcaacaatatcagcgtggctgcagagaatcatagaaaggtaaaaacttacctgaaccaggtgtgtgaggatacagtaacctaccctctgaactccaacgtccagttggctggcctgaggctaatccgacacttgacaatcacctccgaataccagcatatggtcaccaattacatctcagaatttttaaggctcctgactgttggctcaggagaaaccaaggaccacgtgcttggaatgcttttgaatttctccaaaaacccctctatgactaaggacctgctgatcgccaacgccccaacctcgctcatcaatattttcagcaagaaggagaccaaagaaaacatcctgaacgcactgagcctgtttgaaaatatcaactatcacttcaaacgtagagctaaagccttcacacaagataaattctccaagaacagtctttacttcctttttcaacggccaaaggcctgtgcgaagaagttgcgtgcacttgcagcagagtgtaacgatcccgaggtcaaggaaagagtcgagctcctcatatcaaagctcta

SEQ ID NO: 48386 - DNA, 1083 bp, Artificial Sequence
  Description of Artificial Sequence: Synthetic coding sequence
atgtctgctgctggactgaaaattaccggttcaaaggagaccaagcgcagactgctgcttatttctatcgattggtctagggacttaatgaatctgtgtatttatttccgtgtctactgtcaggagaagcaggaagaacgacgggagttgcctcggataataacaggaccccctcctgaagctgccgtggtggccttcgagtggctcaagacttccacattgaccggactgcacccccagcttcctctctctctgcctcaaccagagtgtgctctgccctacctggttcgcgctttctcacgcggagactacatgggcaggatccaagaagttggttgggtcaccgctggtctggtcatatgggccggtacctgctactatatctacaaattcacaaagggcagggcacagagcgtcaggacactcgcacggaatggaagtactgttaaaatggagaccgtggtcggcgtgcaatcacaaaccttggccattaatgaagcagaaattaagaccaagccacaagtggagataggcgctgaaacgggtgcacgcagcgggccacgggctgaggtagagacaaaagcaactgcaatcgctatccatcgcgcaaactcccaggccaaagccatggttggtgctgaacccgagacacagagcgagtcaaaggtagtggccggaacccttgtgatgaccgaagccgtaacactcaccgaagtaaaggccaaggctcgggaggttgcgatgaaggaggctgtaacacagactgacgccgaagccggaaagatagtgaagaaggaagccgtgacccaaactaaagcaaaggcgtgggccctggtggctaagacagaggctaaacgagaggcgatgacccagacaaaggccgaaacccatatccttgccgaaaaggagacagagatcaacagggtgatggtgacccagagtgagaccttagcagtcccgagagaggtcgcgaaaatgggagctacaaataagacaggaatcgtggatgagacaaagactagagccttggaggagacagttctcattcccagggcatttccaagcaagaatgcatcatgttag

SEQ ID NO: 48387 - DNA, 1083 bp, Artificial Sequence
  Description of Artificial Sequence: Synthetic coding sequence
atgtccgcagctgggctcaagataacgggctcaaaggagactaaaaggaggctgctgcttatctcaatcgactggtccagggatttgatgaatttgtgtatctacttcagagtctactgtcaggaaaaacaggaagagagacgggaattgccacgcatcataacgggaccaccgccagaggcagcggtggtcgcatttgagtggttgaagacatcaactttgactggactgcacccccaactcccactgagtttgcctcagcccgaatgtgccctgccgtaccttgtccgggctttctctcgaggcgactacatgggaagaatacaggaggttggctgggtgacggcagggctggtgatttgggctgggacctgttactacatttataagtttactaagggcagagctcaatctgtcaggacgctggcaaggaatggcagtacagtgaaaatggaaacagtagtgggcgtgcaaagtcagacgctcgccatcaacgaagctgaaatcaagaccaaaccccaggttgagatcggtgccgagacaggggcacggtccggacccagggcagaggtggagacgaaggcaaccgcgatagccatccaccgggcaaactcacaggctaaggctatggtcggcgctgagcctgagacccaatctgagagtaaggtggttgccggtaccctggtaatgaccgaggcggtgacacttactgaagttaaagccaaggccagagaagtcgccatgaaagaggcagtcacccagacagatgctgaggccggaaagatcgtgaagaaagaggccgtcacccagaccaaggccaaggcttgggccctggttgctaagacggaggcaaagagggaggctatgacgcagaccaaggcagaaactcacatactcgcggagaaggagaccgagatcaaccgcgtgatggtcactcagtctgagaccctggcggtgccaagagaagttgccaagatgggggctacaaataagaccggtatcgtggatgaaaccaaaacccgcgcactggaggaaaccgtcctgatccctcgcgctttcccctctaagaacgcatcctgctag

SEQ ID NO: 48388 - DNA, 903 bp, Artificial Sequence
  Description of Artificial Sequence: Synthetic coding sequence
atgggcagagcccgagaggttggctggatggccgctggcctaatgatcggcgctggggcatgttactgcgtctacaaactgaccattggccgagatgactcagagaagctggaagaagagggcgaggaggagtgggatgacgaccaagaattggatgaagaagaaccagacatctggttcgacttcgagaccatggccaggccctggacggaggatggcgactggactgagccaggagcgccaggtggcacagaggatagacctagcggcggaggaaaggccaaccgggctcatccaattaagcagcgtccatttccttacgagcacaagaacacttggtctgcccagaactgcaagaacggcagttgcgttctggacctctcaaagtgcctcttcatccagggcaagctcctgttcgccgagccaaaagacgcaggttttccgttcagccaggacatcaactcccatctcgcatcactctctatggcgcgaaacacatccccgacgcctgatccaaccgtccgagaggctctgtgtgctcccgacaacctgaacgccagtattgaatcccaagggcagatcaagatgtatataaatgaggtgtgcagggaaacagtgtcaaggtgctgtaactcctttcttcaacaagccggactcaatctgctaatatccatgacagtcatcaataacatgctcgccaagagtgcaagcgacctgaagttcccactgatttccgagggctccgggtgtgccaaagtgcaggtgttaaaaccactgatggggttaagtgagaagcctgtgttggctggagaacttgtcggcgctcagatgttgttcagtttcatgagcctattcatacgtaatgggaaccgggagatactcctggaaacccccgcaccttag

SEQ ID NO: 48389 - DNA, 903 bp, Artificial Sequence
  Description of Artificial Sequence: Synthetic coding sequence
atgggcagagcgagggaggtgggatggatggctgccggtctaatgatcggcgcaggagcctgttactgtgtatacaagttaacgatcggacgagacgactcagagaagttggaggaagagggagaagaagaatgggatgatgatcaggaactggacgaggaagagcctgacatttggtttgatttcgaaacaatggcacgaccttggaccgaagatggtgactggaccgaaccaggagctccagggggaaccgaagatcggccatccggaggcggaaaggccaacagggcacatccgattaagcaaagacccttcccatacgagcacaagaatacttggtcggcccagaactgtaagaatggttcttgcgtgctcgacctctcgaagtgcttgtttattcagggaaaactcctatttgcggaaccaaaagacgccggattccctttcagccaagacattaacagtcacctggctagcctgtccatggcgagaaataccagtccaacccccgaccctaccgtaagggaggccctatgtgcacctgacaacctgaacgcctcaattgagtctcagggacagattaagatgtacataaatgaggtctgtagagagaccgtgtccagatgttgcaatagttttttgcaacaagctgggctcaacctgttgatctctatgactgtgattaataacatgctggctaaatccgccagtgacctcaaatttccgctcatttcagaaggatcaggttgcgccaaagtacaggtcttaaagccattgatggggctgtcagagaagccagtgctcgcaggagagctggtcggggcacagatgttattttccttcatgtctctttttattagaaacggtaaccgcgaaatcctgctcgaaacgccagccccatag

SEQ ID NO: 48390 - DNA, 903 bp, Artificial Sequence
  Description of Artificial Sequence: Synthetic coding sequence
atgggtagagctcgcgaagtgggctggatggccgcaggacttatgatcggagccggtgcatgttactgcgtctacaaactaaccatcggcagagacgattcggagaagcttgaggaggagggcgaagaggagtgggacgatgaccaggagctggatgaggaagagcctgacatctggtttgacttcgaaacgatggcacgtccttggaccgaagatggtgattggactgagcccggtgcgcctgggggtaccgaagaccgtccctctggcggtggaaaagcaaatagggcgcatcccataaagcagcgtccgtttccatacgagcacaaaaacacctggagtgctcaaaattgcaaaaatggttcttgtgtactggacctaagcaagtgtttattcatccagggaaagctcttgtttgctgaaccaaaagatgcagggttccctttttcccaggatatcaacagtcatttagcaagcctctcaatggccagaaatacaagccctaccccagaccccactgtaagggaggcactttgcgcgcctgataatttgaatgcatccatagaaagccaggggcagatcaaaatgtatattaatgaagtgtgccgtgagactgtctctcggtgctgcaactcctttcttcagcaagcaggcctaaacttactgatttctatgacagtcataaataacatgttagcaaaatctgctagcgacctgaaattcccactgattagtgagggctccggatgcgcaaaggtacaggtgctcaaacctcttatgggcctctccgagaaacctgtgttagcaggtgagctggttggggcacagatgcttttctccttcatgagcctgttcattcgaaacgggaaccgagaaatcctactagaaacgccagctccttag

SEQ ID NO: 48391 - DNA, 1302 bp, Artificial Sequence
  Description of Artificial Sequence: Synthetic coding sequence
atggggagagtccagctttttgagatcagcctgagtcacggcagagtagtgtacagccctggcgagcccttggctggcactgtaagggtgagactcggagcgcctctcccctttagagcgatacgagtgacatgcatcggttcctgtggcgtcagcaataaggctaacgacacagcgtgggtcgtggaagaaggctactttaatagttcactctctcttgcagacaaggggtccctccctgccggagaacactccttccctttccagttcctgctgcccgcaaccgcccctacctcttttgagggaccatttggcaaaattgtgcaccaagtgcgggcagcgatccatacaccacggtttagcaaagatcacaagtgcagtctggttttttatatcttgagtcctcttaatctgaattctattccggatattgaacagcctaatgtcgcctcagctacaaagaaattctcatataagctggtgaagacgggatctgtggtgttgaccgccagtacggatctgcggggatacgtagttgggcaggcccttcagctccatgctgatgtggagaatcagtcagggaaagataccagtccggttgtggcaagcctgctgcagaaagtgagttacaaagcaaaaagatggatacatgacgtcaggaccattgctgaagtggaaggagccggagtgaaggcctggcggagagctcagtggcacgaacagattctggtgcctgccctgccgcaatcagccctgccgggttgctccctcattcatatcgactattacctgcaggtgtcgttaaaagcacctgaagcgaccgtgactctcccagtgtttatcggtaacatcgctgttaaccacgctccggtgtctccgagacctggactaggcctccccccaggggctcctcctcttgtagtgccctcagcccctccccaggaagaggcagaagctgaggccgcagccggaggcccacactttcttgatcctgtatttctcagtaccaaatcacacagccagcgacagcctctcctggctacgctcagtagtgttccaggtgcacccgaaccttgtccccaggacgggtcccccgcatctcatcctttacaccctcctctatgcatatccaccggagccacggtgccatattttgcggagggaagcggcggtcccgttcctaccacgtccaccctcattctgccaccggagtactcttcttggggatacccttatgaagcacctcctagctacgagcagtcatgtggaggcgttgagccgtccctgactcccgaatcctag

SEQ ID NO: 48392 - DNA, 816 bp, Artificial Sequence
  Description of Artificial Sequence: Synthetic coding sequence
atgggaagggtacagctttttgagatatcactctcccacggaagagtggtgtattcccctggcgagccccttgctggaacagtccgggttaggcttggcgctccgctaccatttagagcgattcgcgtcacatgcattggttcctgcggggtcagtaataaggctaacgacactgcctgggtggtggaggaggggtacttcaatagctcgctgtccctggctgacaaagggtcactgcccgctggagagcacagctttccctttcagtttctgctgcccgctacagccccaacaagctttgagggccctttcggaaagattgttcaccaggtgagagctgccatccataccccccgattttccaaagaccataagtgctccctggtattttatatactgtcgcctctgaacctgaactccatcccagatatcgaggctctgcagctgcacgctgacgtggaaaaccagtccggcaaagatacctcccctgttgtcgcttcacttctgcagaaggtctcctataaggccaagcggtggatccacgacgtccggacaatagcagaggtggaaggggcaggggttaaagcctggagaagagcacagtggcacgagcagatcctcgttcccgcattgccacaaagcgctctacctggctgctccctgattcatatagactactatctgcaggtatctctgaaggctcctgaggccaccgtgaccctacctgtctttatcgggaacatcgcagtcaaccatgcgcctgttagcccacggccagggctgggcctgcctcccggagcgcctcctctcgtgtag

SEQ ID NO: 48393 - DNA, 534 bp, Artificial Sequence
  Description of Artificial Sequence: Synthetic coding sequence
atggggagagtgcaattgtttgagatttctttgtctcacggcagagtggtttattcgcccggagaacctcttgccggaactgtgagagtgcggcttggcgcacctttgccattcagagctatcagagtgacatgcatcggctcttgcggcgtttcaaataaggctaacgacaccgcttgggtcgttgaggaagggtatttcaactccagtctgagtctggcagacaaaggatcccttcccgctggagaacactctttcccatttcaatttctgctcccagcaactgctccaacatccttcgagggaccttttggcaaaatcgtccatcaggttagagcagctatccacactccaaggttttcaaaggaccataaatgtagcttggtgttctatattctctccccacttaaccttaattctatacccgatattgaggggtctagtctgcgtactcccgcaaaaccccttcctggcccaccccctaaacagcctaacgtagcctccgcaaccaaaaaattttcttataaactctag

SEQ ID NO: 48394 - DNA, 1224 bp, Artificial Sequence
  Description of Artificial Sequence: Synthetic coding sequence
atggccgtgccctggctagtcctgctcctcgcattacctatcttctttcttggcgtcttcgtttgggccgtgtttgagcatttcctgacgaccgacatccctgctaccctgcagcaccccgctaaactcaggttcctgcattgcatcttcctgtatctcgtgaccttaggcaacattttcgagaaactgggtatttgctcgatgcctaaattcatccgatttctgcatgattctgtccggataaagaaggatcccgaactcgtagttaccgacctgcggttcggaaccatccccgtgcgcctgttccagccaaaagcggcttcttctcgccctagacggggaattatcttctatcacggaggtgccacagtgtttggatcacttgattgctaccacgggctgtgtaattaccttgccagagaaacggagagtgtgttactcatgataggttatcggaagttaccggaccaccacagtccagcactctttcaggactgtatgaacgcttcaatccacttcctgaaggccttggagacctatggggtggatccttcgagggttgtggtctgtggcgagtccgtgggcggagccgcagtagccgctattactcaggctctggtcggtagatcagacctaccgagaatccgcgcacaagtgctgatctatcctgtcgtccaggccttttgcttgcagttacctagttttcagcaaaatcagaacgtgccgctcctctccagaaagttcatggtgacgtcactctgcaattatttagccatcgatctgagctggcgcgatgccatcctgaacggtacctgcgtgcctccagacgtgtggcgcaagtacgagaagtggttatctcccgacaatataccaaaaaaattcaaaaataggggttatcagccctggtcccccggaccatttaatgaggccgcttaccttgaggcaaagcacatgcttgatgtagagaatagcccgctaatagcagacgatgaggtgatcgcccagctccccgaagcgttcttagtgtcatgtgaaaacgacattctgcgggacgatagcctgctctataagaagagactggaggatcaaggggtaagggtgacttggtatcacctgtacgacgggtttcatggctccatcatattttttgacaagaaggccctaagttttccatgctcactgaaaattgtaaacgcggtggtgtcttacattaagggtatctag

SEQ ID NO: 48395 - DNA, 8909 bp, Artificial Sequence
  Description of Artificial Sequence: Synthetic coding sequence
atggatccacgaaacacagcaatgttgggcttgggcagcgattcagagggcttcagccgtaaaagccctagcgcaatttcgacaggaacattggttagcaaaagagaggtggagctggagaaaaatacgaaggaggaagaggatttgcgcaaacgaaacagggaacgcaatatagaggcaggaaaggatgacggcttaactgatgctcagcagcagtttagtgtcaaagaaactaactttagtgaggggaacttgaagctcaagattgggctccaggccaaaaggaccaaaaagccgccaaagaacctggagaattatgtgtgtaggccggcaatcaagaccaccattaagcacccaagaaaagctctcaaatccggtaaaatgactgacgaaaaaaatgagcactgtcctagtaaaagggacccatcaaagctctataagaaagcggatgatgttgccgcaatcgaatgccagagtgaggaggtcatcagactgcatagccagggagagaataacccattatctaaaaagctgagcccggtgcactccgagatggcagattatatcaatgctaccccttccactttactggggtctagagatcccgaccttaaggaccgcgctctattgaatggcggtacttcagtcacagagaagctagcccagctgatcgccacatgccctcccagtaagtcgtctaagacgaagcctaagaagctcggaacaggtactacagccggtctggtcagcaaggacctgataaggaaagcgggtgtcggctcggtggctggaatcatccataaggatctgatcaaaaaacctacaatttcgaccgctgtcggactggtgaccaaggatcctggtaaaaaacctgtgttcaatgccgcagttggtctggtgaacaaagacagcgtcaaaaagctggggacaggaactacagctgtctttatcaataaaaacctgggaaaaaaacctggaaccatcacaactgttgggttattatccaaggactcggggaagaagttaggcatcgggatcgtccctggcttggtccataaggaatctggtaagaaactcgggctaggcactgtcgtgggattggtgaataaagatctagggaagaagctcggtagtacggtcgggttggtggcaaaggattgtgccaaaaaaattgtcgcttctagtgccatgggtctcgtcaacaaagatatcgggaagaaattaatgagctgtcccctggcgggactcattagtaaggacgcaatcaacctgaaggccgaggcactgctcccaacccaggaaccactcaaggctagttgtagtacaaacattaataaccaagagtcacaagagctaagtgaaagcctgaaagactcagcgacaagtaagactttcgagaaaaatgtcgtgcgccagaacaaagagagcatcctcgaaaagttctctgtgcggaaggaaatcataaatcttgagaaggaaatgttcaacgaggggacctgcatccagcaggatagcttcagctcttcggaaaaaggctcttatgaaacttctaaacacgagaagcagccaccagtgtattgcaccagtccagatttcaagatgggaggggctagcgacgtttctacggccaaaagtccattcagcgctgttggcgaaagtaatcttcccagtccaagcccgaccgtgtccgtgaaccccctgacacgatcaccccctgaaacctctagccagctggccccaaacccgctactgctgtcttcgaccactgagcttatagaggaaataagtgagtcggtcggaaaaaatcaattcactagcgagtctacgcacctgaacgtaggtcatcgatcagtaggccactctatttcaatcgaatgcaaaggcatcgacaaggaagtgaatgattccaagacaacccacatcgacatacctcgcatcagctctagtctcgggaagaaaccctctctaacatcagaatcaagcattcatacaatcacaccttctgtggtgaacttcactagtctatttagcaacaagcctttcctgaaactgggcgctgtgtccgccagcgacaagcactgccaagtggccgagtcgctctccacatctctgcagagtaagccactcaagaagcgcaagggcagaaaaccgaggtggaccaaggtcgtcgcccgttctacttgccgctcacccaaaggcctcgaactggaacggtcggagttgttcaaaaatgtttcctgctcctcactgtctaactccaacagtgaacctgccaagtttatgaaaaacatcgggccacctagctttgtggatcacgattttctgaaacgccgtcttcctaaattaagcaagtccaccgcaccaagcctggcactgctcgctgatagcgagaagccttcacacaaaagcttcgccacacataagctgtcgtcatccatgtgcgtctctagtgatctgctgtcagatatttataagccaaaacgcggacgtcccaagagtaaggaaatgccgcagttggagggccctccgaaacggaccctgaagatccccgctagcaaggtgttctctcttcaatcaaaagaggaacaggaacctcccatcctccagcctgaaatagagatccccagctttaagcagggcctgagtgtctcccctttcccgaaaaaacgaggcagaccgaagcgacagatgcgctcacctgtgaagatgaaaccacccgtgctaagtgtggcgccttttgtcgcgacagagtctccatctaaactggaaagtgagtctgataatcaccggtcctcatccgattttttcgaaagcgaggaccaattacaagatcctgatgacctcgatgactcgcaccgaccctccgtgtgcagtatgagtgatctggaaatggaacccgacaagaaaattaccaaacggaacaacggccaactcatgaagaccatcatccgcaagatcaacaagatgaaaactctcaagagaaaaaaactgctgaaccagatcctttcctccagtgtcgagtccagcaataagggcaaggtgcagagcaagctgcacaacactgtgagcagcctggctgcaaccttcggatccaaactcggccaacagatcaacgttagcaagaaaggcacgatatatattggtaagagacgcggacgtaaacccaagacagtcttaaatgggatcctgtctggcagcccgaccagtctagcagtgctcgaacagacagcacaacaggccgctggatccgctttagggcaaatcctgccccctcttctcccaagcagcgcatctagttcagagattttgcccagtccaatctgtagccagtcatcaggtaccagcggaggccagagcccagtttcaagcgatgccggtttcgtcgagcccagctctgttccatatcttcacctccactctcgacagggctccatgatccaaacgctggcaatgaaaaaggcgtccaaaggccgacgccgtttgtctcccccaactctgctgcccaactctccatctcacctgtcggaactgacatccctgaaggaggccactccatcgcccattagtgaaagtcactccgatgaaacaatccccagcgattcagggattggcaccgataacaatagtacctctgacagggctgaaaaattctgcggtcaaaagaaacgacgacattcttttgaacatgtttccctcatcccacctgaaaccagtacagtcctgagctcgctgaaggagaagcataagcacaagtgcaagagacgtaaccacgattacctgagctacgataaaatgaagaggcagaagcgaaagcggaaaaagaagtacccccagctccgtaaccggcaagaccccgattttattgcagaactggaagaattaatttccagacttagcgaaatacgaatcacccataggtcccaccattttatcccaagagatcttctgccaacaatcttcaggataaattttaatagcttttacacgcatccatctttcccactggaccccctgcactacatccggaaaccggacttaaagaagaaaagggggaggccacccaaaatgagagaggctatggcggaaatgcccttcatgcattccctttcttttccactgagctcaaccggcttttatccttcgtatggcatgccgtacagcccctccccattgaccgctgcccctatcggacttggttactacggaagatatccgccaactttatacccaccccctcctagtccctcattcacaacccccttgcccccaccttcatatatgcatgcagggcacctactcctgaaccctgccaagtatcataagaaaaaacacaaattgctaaggcaagaggcgttccttacgacctcccggacccctctgctgtctatgtcaacatacccgagcgtcccccctgaaatggcctacgggtggatggtcgaacataaacaccggcaccggcacaaacatcgggaacacagatctagtgagcagccgcaggtaagtatggatacaggtagcagtcgtagcgtgctcgagtcactcaaaaggtaccgctttggtaaagatgccgtgggagagcggtacaaacacaaagaaaagcatcgctgccacatgtcatgtccacatctgtctccctctaagagtttgatcaacagggaagaacagtgggtgcatcgcgagccaagcgaaagtagtcccttagcccttgggctgcagaccccgttacaaattgattgtagtgagagttccccatccctctcactcggtgggttcacccccaactcagagccagctagttcagatgaacacacaaatctttttacctcagccattggatcttgccgtgtcagcaacccaaactctagcgggaggaaaaaactcacagacagccccggtctgttctcagcgcaggacacaagcctcaacagactgcatagaaaagagtctctgccatccaatgagcgggctgtccagacattagccggtagtcaaccgacgtctgataagccctcccagcgtccctcggaatccacaaactgcagcccaactaggaagcgctcctcgagcgagagcaccagttccacggtgaatggtgttcccagtaggtctccaaggctcgttgcgtctggagacgattcggtcgactccctgcttcagcgtatggttcagaacgaggatcaagagccaatggagaaatccatcgacgccgtgatcgctaccgcctctgcccctccttcttcaagccctgggaggagccactcaaaggacaggacgctgggaaagccggattccttgttggtccctgccgtgacctccgacagttgcaacaattctatctcactgctgagcgagaagttgacgtcctcctgctctccacaccacatcaagaggtcagtagtcgaagccatgcagaggcaggcacgcaaaatgtgcaattatgataagatactagctacaaaaaaaaacctggaccacgtgaacaaaattcttaaggctaaaaagctccagaggcaggccagaacgggtaacaactttgtgaaacggagaccaggtcgtccgagaaaatgcccactgcaagccgtcgtaagcatgcaggcattccaagccgctcagtttgtgaatcctgagctgaacagagatgaggagggggcagctctgcatctgtcccccgataccgttacagacgtcattgaagctgtcgtgcagagcgtgaacctcaatcctgagcataaaaaagggctgaagaggaaagggtggttgctggaagagcagaccagaaagaagcagaagccattaccagaagaagaggaacaagagaataataagagcttcaatgaagcacccgttgagatcccttcgcctagtgaaacaccggctaaaccgtctgaaccggaatccacactgcagccagtactttcattaattcccagagagaagaaaccccctagaccgccaaagaagaagtaccagaaagccggactgtactccgacgtgtacaagaccactgatcccaagagcaggctcatacagttgaaaaaggaaaaattagaatatacacccggagaacatgagtacggtctttttccagcccctattcacgtcgtgtttttcgtgagcggaaagtacctcagacaaaagcgcatcgattttcaactaccttatgatattctctggcaatggaagcacaaccagctctacaaaaagcccgatgtgcccctctataaaaaaattcggtccaacgtgtatgtagacgtgaagccgttgagtggctacgaggccaccacttgtaactgtaagaagcctgacgacgacacccgcaaaggttgcgtagatgattgtttgaatcgcatgatatttgccgagtgctcacccaatacatgcccttgcggagagcagtgctgcaaccagcgtattcagcgacacgagtgggtgcaatgtcttgagcgtttcagggccgaagagaagggatggggaatcaggacaaaagagcctctgaaagccggacaatttattatcgagtacctgggagaggtagtaagcgaacaggagttccgaaatcgcatgatagaacaataccataaccactcagatcactattgcttgaatttggactctggaatggtcatcgactcctatcgcatgggcaacgaagcacgattcattaaccacagctgtgatcctaattgcgagatgcaaaagtggtccgtgaatggggtgtaccgtatcggactctacgccctgaaggatatgcctgccggaactgaactgacctacgattataatttccacagctttaacgtcgagaaacagcagctatgcaaatgtggttttgaaaagtgccgcggaatcatcggcggtaagtctcagagagtcaacggtctgacctcatcaaaaaactctcagcccatggctactcacaagaaatccggcagaagcaaagagaagcgaaaatcaaaacacaagctcaagaagcgcaggggtcacctctctgaagaaccctccgagaatatcaatactcccactagattgacaccgcaactccagatgaaacctatgtccaacagggagcgaaactttgtgctcaaacatcacgtgttccttgttcgcaactgggagaagattcgccagaaacaggaggaagttaaacacaccagtgacaatatccattctgctagcctgtatactcgctggaatggaatctgtcgggacgacggtaatattaagtcggacgtgttcatgacacaattttccgctctacagacggccaggagtgtaaggacccgacgtctggcagccgcagaggagaatatcgaagtggcacgcgcagctcgcttggcgcagatcttcaaggagatctgcgatggcatcattagctataaagactcttcccgacaggcgctggctgcaccgctattgaacctcccgccaaaaaagaaaaacgccgattattatgagaagatctccgaccccctcgacttaattaccatcgaaaagcagattttaacaggatactacaagacagtggaagcttttgatgccgacatgttaaaagtgttccggaatgccgaaaaatactatggcagaaaatcccctgtggggagggatgtatgtagactaagaaaagcttactataatgctcgtcacgaggcgagcgctcaaatcgacgagattgtgggtgagacagcttctgaggccgactccagcgagacttctgtgtctgagaaggagaacggacatgagaaagatgacgacgtgatcagatgtatttgtggtctgtacaaggatgagggactaatgatccaatgtgataaatgcatggtatggcagcattgtgattgtatgggagtgaacagcgatgttgagcattatctttgcgaacaatgcgaccccagaccagttgaccgtgaggtaccaatgatcccaaggcctcactatgcccagccgggttgcgtctatttcatctgtctactgcgcgacgacctcctactgaggcagggcgactgtgtataccttatgagagactctagacgtacacccgacggccacccagtccggcagtcttaccgcttactcagccacattaatcgggataagctggacatatttaggattgagaagctttggaaaaacgaaaaggaagagcgctttgcgttcggccatcactacttccgcccacacgagacacatcattcaccttcccgaagattctaccataacgagttatttcgggtgcctttatatgagatcatcccgctggaagcagtggtcggcacctgctgcgtgctggatctgtacacttattgcaaggggagacccaaaggagtgaaagagcaggacgtgtacatttgtgactatagactcgacaagagtgcccatcttttctacaagattcaccggaatcggtaccccgtgtgtacgaaaccatatgcgttcgaccacttcccgaaaaagctgactccaaagaaggacttcagccctcactacgtgcccgataattacaaaagaaatggcggaagatcgagttggaagagcgaacggagcaagccgcctctgaaagatctggggcaggaagacgacgcattgccactcatcgaagaggttctcgcttcccaagaacaggcagcgaatgaaattccaagtttggaggaacccgaacgggagggcgctacagcaaatgtgtcagaaggggaaaaaaaaactgaggagtcttctcaagagccccaatcgacctgcacccccgaggaacggcgacacaatcagcgcgagaggcttaaccagattttgctgaacctgcttgaaaaaataccaggcaaaaacgcgatcgacgttacctatctgctggaagaaggaagtgggaggaagttgagacgcagaacccttttcatccctgaaaactcctttaggaaata

SEQ ID NO: 48396 - DNA, 8894 bp, Artificial Sequence
  Description of Artificial Sequence: Synthetic coding sequence
atggaccctaggaataccgctatgcttggcctgggaagtgattcagagggattcagccggaaatctccctctgctatcagtaccggtaccctagtctcgaaacgggaagtggagcttgagaagaataccaaggaggaagaagatctcaggaagaggaatcgcgaacggaatatcgaggccggtaaagatgacggcctgaccgatgcacagcaacaattctccgtgaaggaaacaaatttctccgagggtaacctcaagctcaaaattggcttgcaggcaaaaagaaccaagaaaccaccaaagaaccttgaaaattatgtgtgccgccctgccatcaagaccaccatcaaacacccgagaaaagcactaaaatccgggaaaatgacggatgagaaaaatgaacactgcccatcgaaacgcgaccctagcaagctctacaagaaggctgacgatgttgccgcaatcgagtgtcagtctgaagaagtgatccgactgcactcccagggggaaaataaccctttgtccaaaaagctcagccctgtgcattcagaaatggctgactatataaacgccaccccctctacccttcttggatcaagggaccccgacctgaaagaccgagccctactgaatggcggtaccagtgtcacagaaaagctggcgcaactcatcgccacctgcccccctagcaagtctagcaaaacaaaaccgaagaaactcgggaccggcaccacagcagggttagtttctaaggaccttattaggaaggccggagttggctctgtcgcagggattatacacaaggatttaatcaagaagccgacaatcagcacagcagtgggcctggtgaccaaagaccccggtaagaaacccgtctttaacgccgctgttggattggtaaacaaggattccgttaagaagctgggcactggcactactgctgtgttcataaacaagaatctgggaaagaaaccgggaactattacaaccgtaggcctcttgagtaaagattccggcaaaaagcttggtatcggtattgttcccggacttgtacataaagaatcaggcaagaagctcggactcgggacggtcgtggggctagtcaataaggacctgggcaagaaacttggctccacagttgggttagtagcaaaggactgtgccaagaagatagtggcctcttcggcaatgggcctcgtgaacaaggacatcggaaaaaagctcatgagttgcccactggcgggtctcatcagcaaggacgccataaacctcaaggccgaggcactcctaccgacccaggagcccctgaaggcatcgtgctcaaccaacattaataatcaggaaagccaggaactgtctgagtctttaaaggattctgctacctctaaaactttcgaaaagaatgtggtgagacagaataaagagagcatcctggaaaaatttagcgttcgcaaggagattattaatctcgaaaaagagatgtttaacgaagggacctgcatccagcaggacagtttttcaagctcggaaaagggatcatatgagacatcaaaacacgaaaaacagcctcctgtctattgcacctctccagattttaagatgggcggagcgtcagatgtgagtacagcgaaaagccccttctccgccgtgggcgagtcgaaccttccctcaccatctcccactgtctccgttaaccccctcaccagaagccctccagaaacatcaagtcagctcgcgcctaatcccctgcttttgtcttccactactgagctcattgaggaaatctcagaaagtgtcggaaaaaaccaatttactagcgaatctactcaccttaatgtgggccaccgctctgtaggtcatagtatctccatagagtgtaagggaatcgacaaagaagtgaatgactctaagacaacgcacatagatattcccaggatttcctcctcccttggcaagaaacctagtctcacctccgagagcagcatccataccattaccccttccgtagtcaacttcacttctttgttttctaataagccctttttgaaattaggagctgtttccgcatctgataaacactgtcaggtcgccgaaagtttatctactagcctgcaaagtaagccattaaaaaagcgcaaggggagaaagccgaggtggactaaagtggttgctaggtctacatgccggagccctaagggactcgaactcgaacgatctgagctctttaaaaatgtctcatgtagttccctgtcaaattctaattctgaacctgccaaatttatgaagaacattggaccacccagctttgttgaccacgattttctgaaacgccgactgccaaagctgagtaagtcaactgcaccttctctggccttattagcggattccgagaagccatcccacaagtcattcgccacccacaagttatcatcctccatgtgtgtgtcaagcgacttgctatcagatatctacaagcctaagagagggagaccgaaaagtaaggagatgccacaactggaggggccacccaaaagaacgctcaagatccccgcaagcaaggtctttagtttacagtccaaagaagagcaggaacccccaattctccagcccgagatcgaaatcccttccttcaagcaagggttgtccgtttcccccttccccaaaaaacgcggtcgacccaagcggcagatgaggagcccagtgaagatgaagcccccagtactgagtgtggctccattcgtggctaccgagagcccctccaaactcgagagtgagagcgacaaccacaggagttcctccgatttcttcgagtctgaagatcagttgcaggatcctgatgacctggacgacagccacagacccagtgtgtgctcaatgtccgacctagagatggagccggacaaaaagataaccaagcgaaataatggccagctcatgaaaacaatcatccggaaaattaataaaatgaaaacattgaaacgcaaaaaactgctgaaccagattctctcatctagcgtcgagtcatcgaataagggcaaggtgcagtcaaaactccacaacacagtgagcagcctggcagccacctttgggagcaaattgggtcagcagattaacgtttccaaaaaaggaactatttacataggtaaacggaggggcagaaagccaaagaccgtgctcaacgggattctctctggaagtcccacatcactggcagtgctcgaacaaaccgcccagcaggcagccggatcagcattaggccagattcttcctcccctcctgccctcatccgcctcctcctctgagatccttccatcaccaatctgttcccaatcctcgggcactagcgggggacagagtcccgtttcctcagatgccggatttgtggaacctagctccgtcccataccttcatcttcattcacgtcaaggaagcatgatacaaactctggccatgaaaaaggcctctaaggggagaaggcgcctgagccctcccacgcttctgcccaactccccctctcacctgagcgagctcacttctctcaaagaggctactccctctcctatcagtgaatctcacagtgatgagactataccatctgactctggtatcggaaccgataacaacagtacttctgatcgagcggagaagttctgcgggcagaagaagaggaggcattctttcgaacatgtgagtctgataccacctgagacgtccacagtgctgtcaagtctaaaagaaaaacacaagcataagtgtaaaagaagaaatcatgactatctaagctacgataagatgaaacggcagaagaggaaaagaaaaaaaaagtatcctcagttacggaaccggcaggatccagatttcattgccgagttagaggaactcatcagccgcctgagcgaaattcgaattactcataggagtcatcactttattccaagagacctcctgccaacaatctttaggatcaacttcaactctttttacacacacccaagctttccactggatcctcttcactacattagaaaacccgatctgaagaagaaaagaggcagaccgccaaagatgagagaagctatggccgagatgccctttatgcactccctatcttttcccctgtcatccactggattctacccctcgtatggtatgccctacagcccgtcccccctgacagctgcccctatagggctgggatactatgggaggtacccaccgaccctataccctcctcctccgagtccctcattcacaacccctcttccacctccatcatatatgcatgccggacacttgctgttgaacccggctaaatatcacaaaaagaaacacaagctcttaagacaggaggcctttttaaccacaagtaggacccctctgctgagcatgtccacttaccctagtgtgccacccgagatggcttacggttggatggtcgagcataaacatagacacaggcacaaacacagagaacaccgcagctccgaacagcctcaggtgtccatggataccgggtctagcaggagtgtgctggagagcctcaagcggtacagattcggcaaggacgccgtcggagagcgatacaagcacaaagagaaacaccgatgccatatgagttgtcctcacctatctccaagtaagtccctcattaacagagaagagcaatgggttcatagagaacccagtgagtcctcacctctggcactaggtcttcagacccccttgcagatcgattgctctgaatctagcccaagtctgagtctgggcggtttcactcctaacagcgaacccgcatcttcagatgaacatactaatctgtttacttcagccatcgggtcttgtagggtgtccaatccgaatagcagtggcagaaaaaaactgacagattcgcccggactgttcagtgcacaggatacctcactgaacaggctgcatcgtaaggagagccttcctagtaatgagcgagcggtgcaaacactggcagggagccagccaaccagcgacaagccttcacagagaccgagtgaatcaactaattgttctcctacccggaagcgctccagctccgagtctacgagcagtaccgtgaatggcgtgcccagtcggtcgcctaggctggttgccagcggcgacgattctgtggatagcctgttacaaagaatggtccaaaacgaagatcaggagcctatggagaagagtattgatgctgtcatagctactgcgtctgccccaccgagttcatctcctggcagatcacacagtaaggaccgaaccctcggaaagccagacagtctccttgtgcccgctgttacgtctgatagctgcaacaattccattagtctgctgtccgaaaagctgacatcctcctgcagcccacaccacatcaagcgaagtgtcgtcgaagccatgcaaagacaagccaggaagatgtgcaattatgacaagatcctagctaccaagaaaaacctcgaccacgttaataagattctgaaggccaagaagctgcagagacaggcccgaaccggcaacaattttgtcaagagacgaccagggaggccccgaaagtgcccattgcaggctgtggtctccatgcaggctttccaggcagctcaattcgtgaacccagagttgaaccgggatgaagaaggggctgcactgcatctgtcacccgacacagtgactgatgtaattgaggcagtggttcaaagtgttaatttgaatccagagcacaaaaaaggcctgaagcggaaaggttggctgttggaagagcagaccaggaaaaagcagaagccactgccagaagaagaggagcaggagaacaacaaaagcttcaatgaggcacctgtggaaattcctagccccagtgagacccctgcgaagccttccgaaccagagtccactctccagccggtgctgtcgctcatcccacgcgagaaaaaaccccctcggcctcccaaaaaaaagtaccagaaagccggtttatacagtgacgtgtacaaaaccacggatcctaagtccagactcatccagcttaagaaagagaaactggaatacacccccggagaacacgaatacggtctgttcccggctccaatccacgtggggaagtatcttcgtcagaagcggatcgatttccagctgccctacgatattttgtggcaatggaagcacaaccagctatacaagaaacccgacgtgccactttacaagaaaattcgcagtaatgtgtatgtcgatgtaaagccactgtccgggtacgaagctaccacatgtaattgtaagaaaccagatgatgatacaagaaaggggtgtgtggatgattgtctcaaccgtatgatcttcgcagaatgctccccaaacacctgcccatgtggcgaacagtgctgtaaccagcggatccagcggcatgagtgggttcagtgtctcgagcgctttcgcgctgaggaaaagggatggggcatacgtaccaaggagcctttgaaagccggacagttcatcatcgagtatctaggggaggtggtatctgagcaggaattcaggaatagaatgatagaacaatatcacaatcattctgatcactattgcctgaatctggactcggggatggtgattgacagctaccgcatggggaacgaggctagattcatcaatcactcgtgcgacccaaattgcgagatgcagaagtggagcgtgaacggggtgtataggattggcctttatgcactgaaggacatgccggctggcaccgagctgacttacgattacaatttccactccttcaacgtcgaaaaacagcagctttgcaaatgcggatttgagaagtgtcgtggaataatcggcggaaagtcccagcgggtgaatgggttgactagcagcaagaactcccagccaatggccacccataagaaatccggtcgctcgaaagagaaacgtaagtctaagcacaagctaaaaaaacgcaggggtcacctgagcgaggaaccctcggagaacattaataccccgactcggctgacaccgcagctgcaaatgaaacccatgtccaaccgagagcgaaacttcgtgcttaagcaccacgtgtttctggtacgcaactgggaaaaaatccgacaaaaacaagaagaagtgaagcatacaagtgacaatatccatagtgcatcgctgtacacaagatggaacgggatctgtagggacgatggaaacattaaaagcgatgtgtttatgacgcaattcagtgctttgcagacagccagatctgtcagaacccggaggcttgccgctgctgaggagaatatcgaggtggccagagctgctaggttagctcagattttcaaagagatctgtgatggaattatttcctataaggactcatcccgccaggcacttgctgcacctttacttaacctcccaccgaaaaaaaagaacgcagattactatgagaaaatctccgatccgcttgatctgattaccatcgagaagcaaatcctgactgggtattacaagactgtcgaggcttttgatgctgacatgctcaaagtgtttagaaatgcggaaaagtattacggcagaaagtcacccgtgggcagggacgtctgccgcctgcggaaagcctactataatgctcgccacgaagcatccgctcagattgacgagattgtgggggagaccgccagcgaggcggactcttcagagacttccgtctccgagaaagaaaacggccacgagaaagacgatgacgtgatcagatgtatctgtggtctttataaggacgaaggcctgatgatccagtgtgataaatgcatggtctggcagcattgtgattgcatgggcgtgaactcagatgtagaacattacctctgtgaacagtgcgatcctcgccctgttgaccgggaagtgcccatgattcctcgccctcactatgctcagccaggatgcgtgtactttatctgtctcctgagagatgatttactattgcggcagggagattgcgtatatctgatgcgcgactccaggaggacccctgatggccacccagtgagacaaagctacaggttacttagccacatcaatagagacaaactcgatatcttccgtatcgaaaagttgtggaagaatgagaaggaggagagattcgctttcggccaccattacttccgaccccacgagacccaccactcaccctctcgcaggttctaccacaacgagctgtttcgcgtccccttgtatgaaatcatccctcttgaagccgtagtaggaacgtgctgcgtgttggacctgtacacctactgcaagggacggccaaaaggcgttaaggagcaggatgtttacatatgcgactatcggcttgacaaaagcgctcatttattctataagattcacagaaataggtaccctgtatgtacaaagccatacgctttcgaccacttccccaagaagctgacaccaaagaaagacttttccccccattacgttcctgataactataagcggaacggaggcaggtcaagttggaaaagtgagcgctcaaagcccccactgaaggacctcggccaagaagacgatgcgctccccctgatcgaggaagtcctagcctctcaggagcaggcagccaatgagatcccctcattagaagaacccgagcgagagggagccaccgctaacgtgagcgaaggcgaaaaaaagacagaagagtcaagtcaggaaccgcagtctacctgtactcctgaagagcgcagacacaatcagcgtgagcgtctcaaccagatattgctcaacttacttgagaagatcccaggcaaaaatgccattgatgtcacatatttactggaggaaggctcaggcagaaagctgaggagaaggacgttattcatcccagaaaactccttccgcaaata

SEQ ID NO: 48397 - DNA, 864 bp, Artificial Sequence
  Description of Artificial Sequence: Synthetic coding sequence
atggccaaagactttcaggatattcagcagctctcatccgaagagaacgaccacccttttcaccaggggcctcctcccgctcaacctctggcccagcggctgtgttccatggtgtgcttcagcctgctggctttgtcgtttaatatcctgttacttgtggtgatttgtgtgactggttcacagagcgctcaattgcaggcagagttacggtcgcttaaagaagcttttagcaatttctcttcctccacattgactgaagtccaagccatctcaactcatggcggttctgtgggagacaagattaccagcttaggcgctaagttggaaaaacaacagcaagacctcaaagccgaccatgacgctctgctattccatctgaagcattttccagtggatctccgatttgtggcttgccagatggaactgcttcactccaacggatcccagcggacctgttgtcccgtcaactgggtggaacatcaggggtcgtgttattggtttagccacagtggaaaggcctgggcagaagccgagaaatactgccagttggaaaatgctcatttagtggtaattaattcatgggaggagcaaaagttcatcgtccagcacacgaaccctttcaacacatggattggcctcaccgatagcgatggatcttggaagtgggtggatggcaccgattaccgacacaactataaaaactgggccgtgacacagcccgataactggcacgggcacgaactggggggaagcgaagattgtgtcgaggtgcagccggatggacgatggaatgacgatttttgcctgcaggtgtacaggtgggtttgcgaaaaacggcgaaacgctacaggagaagtagcctag

SEQ ID NO: 48398 - DNA, 936 bp, Artificial Sequence
  Description of Artificial Sequence: Synthetic coding sequence
atggctaaggattttcaggatatacagcaattgtcatcagaagagaatgatcatccatttcaccagggcgagggtccagggacgcggcgactgaaccctagacggggaaaccccttcctgaaaggcccaccccctgctcagcctttggcacagcgcctttgttctatggtgtgcttcagtttgctggccctgagtttcaatatcctgttgcttgtggtgatctgtgtgacaggatcccagagcgagggacacggaggcgcacaactgcaagctgaattgagaagcctcaaggaagccttctccaacttcagctcctccacactcactgaggttcaggcaatcagcacccatgggggttctgtgggcgacaaaatcacctccttgggggcaaagctggagaaacagcaacaggacctgaaggccgaccatgatgctctgctgttccatctgaaacatttccccgtggacctccgttttgtcgcttgccagatggaactgctgcacagcaatggctcccaacggacgtgctgtccagtgaattgggtggagcaccagggcagctgttactggttttcacacagcggaaaagcatgggctgaggcggagaaatactgtcagctggagaatgctcacctcgtcgtcatcaactcctgggaagagcagaagtttattgtccagcacacaaaccccttcaatacatggatcggattgaccgattccgatggctcttggaaatgggtcgacgggactgattaccgtcataactacaaaaattgggctgtgactcaacctgacaattggcacggtcatgaactgggtggcagcgaggactgcgtggaggtgcagcctgatggtagatggaacgacgacttttgcttacaggtctaccggtgggtctgtgagaaacgaagaaatgccaccggggaggtggcctag

SEQ ID NO: 48399 - DNA, 936 bp, Artificial Sequence
  Description of Artificial Sequence: Synthetic coding sequence
atggcaaaggattttcaggatatccaacagctcagctccgaagagaacgatcatcctttccaccaaggagaaggaccagggacccggagactgaaccccagaaggggcaatcccttcctgaaaggtcccccacctgctcagcccctcgcccaaaggctctgctcgatggtgtgcttttctttactcgctttgagcttcaacattctcttgctggtggttatctgtgtcactggatctcagagcgagggtcacggcggagcacaactgcaagccgaactgcggtctctcaaggaagctttttctaatttttctagtagtacactgaccgaagttcaagcaatttctactcacggcggtagcgtgggggataaaatcacatctcttggcgcaaagctggaaaaacagcagcaagatctgaaggccgaccatgacgccctactttttcacttgaagcattttccagtggatctccgttttgtcgcctgccagatggagctgctacactccaacggtagccagcggacatgttgccctgtgaactgggtggaacaccaggggtcctgctactggttttcccactctggtaaagcatgggccgaggctgaaaagtactgtcagttggaaaatgcccaccttgtggtgatcaacagttgggaagagcagaaattcatagtacagcacaccaacccattcaacacctggatcgggttgactgactcggatggcagctggaagtgggttgacggcactgactataggcataattataagaattgggcagtcacccagccagacaactggcacggccatgagctgggaggatcggaagattgtgtcgaagttcagcccgatggcaggtggaatgacgatttctgtctgcaggtgtacaggtgggtgtgcgagaagcggaggaatgccacaggcgaggttgcatag

SEQ ID NO: 48400 - DNA, 879 bp, Artificial Sequence
  Description of Artificial Sequence: Synthetic coding sequence
atggccaaggacttccaagacatacaacagctgtcttcggaggagaatgaccacccttttcatcagggccctcccccagctcagccactcgcccagcggctgtgcagtatggtttgctttagtctgttagcattatcctttaatatcctgctactggttgtcatctgtgtcaccgggtctcagagtgagggccatgggggagcacagctgcaggcggaattgcgatcactaaaagaagcgtttagtaatttcagcagctctactctgacagaggtgcaggcgatctcaactcacggcggatctgtgggcgataagatcacctctcttggcgctaaattggagaaacagcagcaggaccttaaagccgaccacgacgccctcttattccaccttaagcatttccccgttgatctgaggtttgttgcctgtcagatggaactgctccacagcaacggcagccagagaacttgctgcccagttaactgggttgagcatcaaggttcatgctattggttcagccacagtggaaaagcatgggcagaagccgagaaatactgccagctggaaaacgctcaccttgtggtcattaactcctgggaagaacagaaattcatcgttcagcacacaaacccctttaatacctggatcggactgacggattctgacgggagttggaagtgggtggacgggaccgactaccggcacaactacaagaattgggctgtaacgcagcccgataactggcatgggcatgagctgggcggatcagaggattgcgtggaggttcagcccgacggccgttggaatgatgacttctgtttgcaggtctaccgctgggtgtgtgagaaaaggagaaatgcaactggcgaagtagcctag

SEQ ID NO: 48401 - DNA, 414 bp, Artificial Sequence
  Description of Artificial Sequence: Synthetic coding sequence
atggcgaaggacttccaggacattcagcagctgtcctctgaagagaatgaccacccatttcaccagggcccaccgccagcccagcctctggcccagagactgtgctcgatggtttgtttttctctattagcactttcgtttaatatactgttgctcgtggtgatctgcgtcacaggtagtcaaagcgcacaattgcaagctgaattgaggtcgttgaaagaggcttttagcaacttcagttcaagcactctgaccgaggtgcaggcaatatctacccacggaggttcggtcggagataaaattacaagcctcggcgcaaagcttgagaagcagcagcaggacctgaaagcaggacagcgtgcgtccggcgtgtgcgcgcatgtgcgggcatgcgtccgggtcagatgtgtgtag

SEQ ID NO: 48402 - DNA, 1422 bp, Artificial Sequence
  Description of Artificial Sequence: Synthetic coding sequence
atggcacagctggaagggtactgtttctctgcggctctttcctgcaccttcctggtgtcttgtctgctctttagtgccttctcgagagccctgcgagaaccatacatggacgaaatctttcacctgccccaggcccagagatactgcgagggccacttctcactgtcccaatgggatcctatgatcaccactctgcctgggttgtatctcgtgagcgtgggagtagttaagcccgcaatatggatcttcgcctggtccgaacatgttgtttgttccattgggatgctgcggttcgttaacctgctgttctccgtggggaacttctatctgctttacctcttatttcacaaagtgcagccacgcaacaaagcggcatcttccatccagcgcgttttgtctaccctcacactggccgtcttcccaaccttatacttttttaatttcctgtactacaccgaagccggatccatgttcttcactctcttcgcctacctgatgtgtctctacggtaaccacaagacatccgcctttctgggattttgcgggttcatgtttaggcagacaaatattatatgggctgtgttctgcgctggcaacgtgatcgcccagaaactcacggaggcgtggaagactgaattacaaaaaaaggaggacaggctcccaccgatcaaggggccatttgcagaatttcgcaagatactgcagtttctgctagcctactcaatgagctttaagaatctgagcatgttattctgtctgacgtggccttatatccttttaggcttccttttctgtgctttcgtagtggtgaacgggggtattgtcattggggatagaagttctcatgaggcctgcttgcattttcctcaattattctatttcttttctttcactttgtttttttccttcccccacttgctgagtccgagcaagataaaaactttcctttcccttgtctggaagcatgggatcctctttctcgtcgtcacattagtcagtgttttcctcgtttggaaattcacgtatgcgcacaagtatttgttagctgacaatcgccattacacattttacgtctggaagcgagtattccaacgctacgcgatacttaagtacttgctcgttcctgcctatatttttgccggttggagtattgccgatagccttaagtctaaaccgatcttttggaacctgatgttctttatttgcttgttcatcgtgattgtgccacagaaacttctcgaattcaggtacttcatcctgccatacgtgatctacagactgaacattactctccctcccacgagccggctggtgtgcgagctatcttgctacgccatcgtgaatttcattacattctacatctttctaaacaagacttttcagtggccgaactcccaggacatacaaagattcatgtggtag

SEQ ID NO: 48403 - DNA, 1173 bp, Artificial Sequence
  Description of Artificial Sequence: Synthetic coding sequence
atgttccccgcacaggcgaaggaaaatgccggattttccgggtgcggaggagataccgaaatcgactggaaggcctatatggcggaggtggaaggggtgatcaacggcacttatgattacacccagctgcaaggcgataccggaccactggtgtatccagccggatttgtatacatattcatgggcctgtactacgccacatcccgtgggaccgacatcagaatggctcagaacatatttgccgttttgtacctggctacattattgctagtgttcctaatttatcatcagacttgtaaagtaccgcctttcgtattcttcttcatgtgctgcgcatcataccgggttcattcaatcttcgttctgaggctatttaacgatccggtggccatggtgctgctgttcttatccattaacctcctcctggcacagagatggggctggggctgttgttttttctcccttgctgtgtccgtcaagatgaatgtgctgctgttcgctccagggctgttatttctgctgctcactcagtttggatttagaggagcactccccaaactgggaatttgtgccggacttcaagtcgttctgggactcccttttctgttagagaatccctctggatacttgtccagatcatttgatctgggcaggcagtttctgtttcactggaccgtgaactggaggtttctccccgaggctctttttctccacagggctttccatttggcactgctgaccgcacacttaacgttactcctgctatttgccctgtgtaggtggcatagaacaggggaaagcattctcagtctgttgagagacccaagcaagaggaaggtcccccctcagccgttgactcccaatcagattgttagtactctgttcacaagcaatttcatcggtatttgcttctcaagaagcctgcactaccaattttatgtgtggtatttccacactttgccctatttactgtgggccatgccagccagatggttgacccacttgctcagactgctggtcctgggactgatagaactcagttggaacacttacccctccacatcatgtagcagcgccgctctgcacatctgccacgcagtgattttactgcagttgtggcttggccctcaaccgttccctaaatccacccagcactccaagaaggcccactag

SEQ ID NO: 48404 - DNA, 975 bp, Artificial Sequence
  Description of Artificial Sequence: Synthetic coding sequence
atggcacccctgctgcttcagctcgcggtgctgggcgctgctttggctgctgcagcccttgtcctgatctcgatcgtggccttcactaccgccacgaaaatgccggctttacaccgccacgaagaggaaaagttctttttgaatgcgaaagggcagaaagagactctgccttcaatctgggatagtcccacgaaacagctctcggttgtcgtgccaagttataatgaggagaaaagactgcccgttatgatggacgaggcattgagctatctggaaaagagacagaagagagatcccgcatttacttatgaggtgattgtagtcgatgacggttccaaggaccagacctctaaggtggcatttaagtactgccagaaatatggttctgacaaggtgcgcgtgattacactcgtgaaaaaccggggtaaggggggtgccatccggatggggatctttagcagtcgaggggaaaagatcctcatggcggatgcagatggcgctaccaaatttcccgacgttgaaaagctcgagaaggggctcaatgatttacagccatggccaaatcagatggctatcgcatgtgggtcccgggcacatctcgagaaagagagcattgctcagagatcatattttaggactctactgatgtacggattccactttctggtgtggtttctctgcgtgaaaggaatccgcgacactcagtgtgggtttaagctgttcacacgcgaagccgcttcccgcactttcagctcactccacgtcgaaaggtgggcattcgacgtcgaactgctatatatcgcgcagttttttaaaatacctatcgccgagatcgccgtcaattggactgaaattgagggcagcaaactcgtgcctttctggagctggctgcagatgggtaaagacctgctattcattaggctgcgctatttgaccggagcttggcggctggaacagacacgcaaaatgaactag

SEQ ID NO: 48405 - DNA, 693 bp, Artificial Sequence
  Description of Artificial Sequence: Synthetic coding sequence
atggcccctttactcctacagctggctgtactgggcgcagccttggccgctgccgcactggttttgatatctatcgtggcctttacaaccgccaccaagatgccagccctacaccgccatgaagaggaaaagttttttctgaacgcgaagggacagaaggagacactccccagcatctgggattccccgacaaagcaactgagtgtggtagtgccatcttataatgaagaaaagagactcccggtgatgatggatgaggcgttgtcataccttgagaaaagacagaagcgtgatcccgcatttacctacgaagttatcgtggtcgatgacggcagcaaggatcagacttccaaggtcgccttcaagtattgtcaaaagtatggctccgacaaggtgcgggtgatcacccttgtaaagaatcgcggaaagggaggggcaatccgaatgggcatctttagctcgaggggagaaaagatcttgatggctgacgctgacggcgctactaaatttcccgacgtggagaaacttgagaagggtctgaacgacctgcaaccctggcccaatcagatggcgatcgcatgcgggagccgcgctcatctggaaaaagaatctatcgctcagcacaagtgttctttcggtggcctcatctcccagccagtctttataggatccattctctatggacgccattag

SEQ ID NO: 48406 - DNA, 885 bp, Artificial Sequence
  Description of Artificial Sequence: Synthetic coding sequence
atggcgccactcttgctccagttagcagtgttaggggcagcactggcagcggcagctttagtgcttattagcatcgtggctttcaccactgccactaagatgcccgcactgcacaggcatgaggaggagaaattttttcttaacgctaaaggacagaaggaaactctccctagcatatgggacagtcctaccaaacagctgtccgtagtggtgccctcatacaatgaggaaaagaggttaccagtgatgatggacgaagccctttcatatttggagaagagacagaagtacggttccgacaaggtcagggtgatcactctggtcaagaaccgtgggaaaggcggtgctattcggatgggcatcttctcctcaaggggggaaaaaatactgatggcagacgccgatggagcaacaaagttccccgacgttgagaaactcgagaagggcctcaacgacctgcagccttggccaaatcagatggccattgcctgcggttcgagggcccacctggaaaaggaaagcattgcacagagaagctatttcagaacactgcttatgtacggctttcatttcctggtatggttcttatgcgtgaagggcatcagggatactcagtgcgggtttaaactctttaccagggaggctgcctcgcgaacattttcttccctgcatgtcgagagatgggcatttgacgttgagctcctatacattgcccaatttttcaagattcctatcgctgagatcgctgtcaactggacagaaatcgaaggcagtaaactcgtgccattttggtcctggctgcagatggggaaggaccttctgttcatccgattacgatatctaaccggcgcttggcggttggagcagactcggaaaatgaactag

SEQ ID NO: 48407 - DNA, 1173 bp, Artificial Sequence
  Description of Artificial Sequence: Synthetic coding sequence
atgaaggaaggtcggggttctttctcagtcgaaaggggacctaggaaagagcgggaaaccgcccagtccggcatgtggaaaggtaacagccccgctggctcccaaggtgctgccatggagggaaccgggggtgaactcggcggtcaaggcaactgggggccagaagacgcgcctgggctgctggccagggcttctctgattatgcttccctggcctcttcccctcgccagttctgcgctcacactgctgtttggcgcactgactagtttatttctttggtattgttatcgtctcggtagccaggacatgcaagctctgggcgcaggaagccgcgcaggaggagtgcgtggcggacccgtagggtgtagtgaggctggcggtccaagccctggtgggcctggggaccctggggaaggcccaagaactgaaggcctagtgtctaggagactgcgggcttacgctcggaggtattcctgggccggaatggggcgagtgcgtagagctgcccaggggggacctggtccgggtagaggtccaggtgtgcttggtattcagcgacccggtttgttgtttctccccgatctgccttccgcgccatttgtgccacgggacgctcagcgccatgacgtcgaactgttggagagctcttttcccgcaattttgcgcgacttcggagcggtcagttgggacttttctggtaccacccctccaccgcgagggtggagccctccactagctcccggatgctatcaattactattgtaccaggctggaagatgccagcccagcaactgccggcgttgcccaggcgcttatagagctctgcggggtttgagaagctttatgtctgcaaacaccttcggcaacgccggttttagtgtcctactcccaggtgctagattggaaggacggtgtgggccaactaatgccagagtgcgctgccatttgggcctcaagatacctccgggttgcgagcttgtagtgggcggagagcctcaatgttgggccgaaggccattgcctgctggtcgacgattcatttctgcataccgttgctcacaatgggtctccggaggatggacccagggtggtgttcatcgtggacctctggcacccaaacgtggctggcgctgaacggcaggctctggacttcgtgtttgctcctgacccttag

SEQ ID NO: 48408 - DNA, 1173 bp, Artificial Sequence
  Description of Artificial Sequence: Synthetic coding sequence
atgaaagaaggaaggggtagcttttctgtggagaggggaccgaggaaagagcgagagactgcccagtctggcatgtggaaggggaatagtcccgcaggttcacagggcgctgcaatggagggtacaggaggcgagctgggaggacaggggaactgggggcctgaagatgctcccggacttttggcacgcgctagtttgattatgctgccctggcccttgccactcgctagctccgccctcacgttactgtttggggcactcacaagcctctttctgtggtactgctaccgcctgggaagtcaggatatgcaggccctgggcgcaggatcgcgagctggcggagtacggggaggtccagtcggatgttcggaagcagggggtccttcacctgggggtcctggggatcctggcgagggacctagaactgaagggctggtctcgaggagactgcgggcttatgcacgcaggtacagttgggccggaatgggacgggtcagaagagccgcacagggcggtcccggaccaggcagaggacctggggtactgggtatccagaggcccggattgctctttttgcctgacttgccctcagcacccttcgtgcctagggatgcacagcgccacgacgtggagctgttggaatcctccttccctgcaatcctgagagacttcggcgctgtctcatgggacttctccgggactacccccccacccagaggctggagtccacctctggcccctggctgttaccagctactgctgtaccaggcgggacggtgccagccttcgaactgcagacgctgtcccggagcctatcgagccctgcgtgggcttcggagtttcatgtctgctaacacctttggcaacgccggattctccgtgctgctgcccggtgctaggctagagggccgatgcggcccaacgaacgccagggtcaggtgtcatcttggactgaagatcccaccaggctgtgaactcgttgtgggtggagagcctcagtgctgggcagagggccactgtctcctagttgatgatagctttcttcacactgtggcgcacaatggctctccagaagacggaccgagggtcgtgtttatcgttgacttatggcaccctaacgtggccggtgctgagaggcaagcactagattttgtgttcgccccagacccttag

SEQ ID NO: 48409 - DNA, 891 bp, Artificial Sequence
  Description of Artificial Sequence: Synthetic coding sequence
atggcccgttgtgagaggctcagaggagcagcgctacgggacgtactagggagggctcagggagtgctgtttgactgcgacggggtgctgtggaacggtgaaagggcagtgcctggagcacctgagttgcttgagagactcgccagggccggaaaggctgctcttttcgtgagtaacaatagtaggcgcgcacgaccagagttggcccttcgattcgcacgcctgggctttggaggtttacgcgctgaacagctgttcagtagcgcactgtgcgcagcccgtctcctgcgccagcggctccctggacctcctgacgccccaggcgctgtcttcgtgttagggggagaggggctcagggccgaactgcgggctgcgggtctaaggctggctggggatccttctgcgggtgacggcgctgctccaagggtgcgtgccgttcttgtcggctatgatgaacatttttcattcgccaagctgagagaagcctgtgcccacttgcgggatcctgaatgtctcttggtcgcgacggacagagatccatggcaccctctgagcgatggtagtaggactccaggtactggcagcctggctgccgcagtggaaactgccagtggccgacaggcactcgtcgtgggtaaaccctctccttacatgttcgagtgcataacagagaattttagcattgatcctgcccgtaccttgatggttggggaccggctagagacggatattctgtttggacacaggtgcggaatgacaacagtgctgaccctgacaggggttagccgtttggaagaagcccaggcatacctcgcggcaggccaacatgacttggtcccacattattacgtagagagcatcgccgacctaacagagggtcttgaggattag

SEQ ID NO: 48410 - DNA, 1506 bp, Artificial Sequence
  Description of Artificial Sequence: Synthetic coding sequence
atgccgtcagcctccgccagcaggaaatctcaggagaaacctcgggaaatcatggacgcagcagaagactacgccaaagagaggtacggcatcagtagtatgattcagtctcaggagaagcctgatcgggtcctggtccgcgtgcgagatctcacaatacagaaagctgatgaggtggtctgggtaagagcaagggttcacaccagtcgggcaaaagggaagcagtgttttctggtgttacggcagcaacagttcaacgttcaagcgcttgtggcagtcggggatcatgcttcaaaacagatggtgaagtttgccgcaaatatcaataaagaatcaattgtcgacgtggaaggagtcgtcagaaaggtgaatcaaaaaattggcagctgcacccagcaggatgtggagctacatgtgcaaaaaatatatgtgatctccctggcagaacctcgattaccactgcagctggatgatgccgtgaggccggaggcagaaggcgaggaggagggtcgagccacagtgaaccaagacacgagactcgataatcgggtgatcgatctgaggacctccacatctcaggccgtcttcagactgcagtccggcatctgccacttattccgcgagactttgattaacaagggattcgttgagatccagacaccaaaaatcatatccgccgctagcgaggggggagcaaatgtatttaccgtgtcatacttcaaaaacaacgcttatctcgctcagagtccgcagctgtacaagcagatgtgtatttgcgccgactttgagaaggtgttcagcatcggccctgtatttcgagccgaggactccaacactcataggcacctgacagaattcgtgggtctcgacattgagatggcgtttaactatcactatcacgaagtgatggaggagattgcggataccatggttcagatattcaagggacttcaggagcgctttcagactgagatccagaccgtgaacaagcagtttccctgtgagccttttaaattcctggagcccaccctcaggctggagtattgcgaggcccttgctatgcttagagaagccggagtagaaatgggagatgaggacgatctctctacacctaacgaaaaactcctgggacacctagtgaaagaaaagtatgacacagatttctatattctcgacaaataccctctggctgtaaggccattctacactatgccggatccccgaaatccaaaacagtcaaacagctacgacatgtttatgcgcggagaggaaatcctctcaggagcccagagaatccacgatccccaactcctcaccgagagggcactgcaccacggaattgatttagagaagatcaaagcctacatcgacagctttagattcggtgcccctcctcatgctgggggtggtataggcctcgagcgggtcacaatgctcttcctgggtctccacaacgtccggcagacgagcatgttccccagggaccccaagcgattgacaccttag

SEQ ID NO: 48411 - DNA, 1206 bp, Artificial Sequence
  Description of Artificial Sequence: Synthetic coding sequence
atggtaaagtttgccgcaaatattaataaggagtccatcgttgatgtagaaggagttgtccgtaaggttaaccagaagatcgggtcttgtacacagcaggacgtggagctgcacgtgcagaagatttacgtaatctcattggccgagccacggcttcctctgcaactggacgacgccgtcagacctgaagcagaaggtgaggaagaggggagagcaaccgtgaatcaggatacccggctggataacagggtgatcgaccttagaacttctacctcacaggccgttttcaggttacagtctggcatctgccatctgttccgtgagacactcataaataaggggtttgtggagatccagactccaaagatcatttctgccgcttccgaggggggtgccaacgtgtttaccgtgagttatttcaaaaataacgcctatctggcccaaagcccgcaactgtacaagcaaatgtgtatctgcgcggactttgagaaagtgttctctatcgggcctgtcttccgggcagaggattccaacacccaccgccacctgaccgagttcgtgggactggatatcgagatggcattcaattatcactatcatgaagtcatggaagagatcgctgataccatggtgcaaatatttaagggtctacaggaacggttccaaacagagatccagactgttaacaaacaattcccctgcgaaccattcaagttcctggagcccacgctgagattagagtattgtgaggccctggccatgctgagggaagctggcgtagaaatgggcgatgaggacgacctgagcacgcccaatgagaagctgctggggcacctggtgaaagagaagtacgacaccgatttctacattctcgataagtacccactggcggtccgcccattctacacgatgcctgatccccgtaaccctaagcaatctaactcctacgatatgtttatgcggggtgaggagatcctatctggagcccagcggatccacgaccctcagctgctcactgagagagctctgcatcatggaattgacctcgagaagataaaagcttacatagattccttcagattcggagctcctccacacgccggtggcggtatcggactggagcgggtgaccatgctcttcctcggcctccataatgtgcgccagacttcaatgtttccgagagacccaaagaggctgaccccatag

SEQ ID NO: 48412 - DNA, 564 bp, Artificial Sequence
  Description of Artificial Sequence: Synthetic coding sequence
atgactagccgtgaacaccaggtgtccctgtgcaattgcgtcccactgcttaggcgcctgttgtgcgacgccccatggcgcaaagccaggccattgcatgccctatctcggtatttccgctcgcgggtgagtccgagtaagatggccgaagagccccagagtgtcctacaactcccaacaagtatcgccgctggtggcgagggcctgaccgacgtcagcccagagacaaccaccccagagcccccatcgagcgctgctgtttctcccggtacagaggagccagccggtgacacaaagaaaaagattgatatcctcttaaaggcagttggggatacccccattatgaagacaaagaagtgggccgttgagcggactcggactatccagggcttaattgattttatcaaaaaatttctgaaactggtcgcaagtgagcaactgtttatctacgttaaccagagctttgccccatccccagaccaggaggttggtacactgtatgaatgtttcggcagcgatggtaaactcgtcctgcattactgcaaatcccaggcgtgggggtag

SEQ ID NO: 48413 - DNA, 225 bp, Artificial Sequence
  Description of Artificial Sequence: Synthetic coding sequence
atggccgaggaaccccagagcgtgctacagctgccaactagcatcgccgctggaggcgaagggctgactgatgtctctcccgagactacaacacctgaacctccaagtagtgcagccgtcagtccgggaaccgaggagcccgcaggtgatactaaaaagaagatttacctctgtgaatccgtcttgtgtagcttccctcgacctaggagctggaattcgctgtag

SEQ ID NO: 48414 - DNA, 423 bp, Artificial Sequence
  Description of Artificial Sequence: Synthetic coding sequence
atggccgaggagcctcagagcgtgcttcaattgcccacatccatcgcagcagggggtgagggccttacggacgtctcccccgagacaaccacccccgagccgccaagctcagccgctgtgagccctggcaccgaggagccggctggagataccaagaaaaaaatcgacatactgctgaaggcagttggcgatacacctattatgaaaactaagaaatgggctgtggaacgcactaggactatccagggtctgatcgatttcattaagaaattcttgaagctggtcgcgagcgaacaactgttcatttacgtaaaccagtcatttgctcctagtcccgaccaggaggtaggcactctatacgagtgtttcggatcagacggcaagctggtccttcactattgtaagagtcaggcttggggatag

SEQ ID NO: 48415 - DNA, 1479 bp, Artificial Sequence
  Description of Artificial Sequence: Synthetic coding sequence
atggcatccccttcagggaagggcgctcgggctctcgaggccccaggttgcggtcctcgtccgcttgccagagacttggtggattcagtggatgacgcagaggggctgtatgtggccgttgagaggtgcccactgtgcaacacgacacgacggaggctgacgtgtgctaaatgcgtgcaatcaggagacttcgtgtattttgacggacgagatagggagcggttcatcgacaagaaggagcgcctgtccaggctgaaaagcaaacaggaggaatttcagaaggaagttttaaaagcaatggaagggaaatggataaccgaccaattaagatggaagatcatgtcatgcaaaatgcgcatcgaacagctgaaacagactatctgtaagggaaatgaagagatggagaagaatagtgagggcttgctgaaaactaaggaaaagaatcagaaactttatagtcgggctcaaagacaccaggagaagaaggagaagatacagaggcacaatcgtaaactgggagacctggtggagaagaaaactatagatctgcgttcccactacgagcgcctggcaaatctcaggcgtagccacatcctggagctgacctcagtcatctttccaatagaagaggtgaagaccggagtccgggaccccgctgatgtgtcctctgagagtgacagtgctatgacatcttctaccgtgtcaaaactggcagaggccaggaggacgacttacttgagcggtaggtgggtgtgtgacgatcacaatggcgatacaagtatttcaatcaccggcccatggatatcactgcctaacaatggagactactcggcctattactcctgggtcgaggagaagaaaaccacccagggcccagatatggagcagtcaaatcctgcgtatacgatttctgcagcactgtgctatgctacacaactggttaacattctgagccacattcttgatgttaacctccccaagaaattgtgcaactctgaattctgcggcgagaacctgagcaagcaaaagtttacgagagcagtcaagaagctcaatgctaatattctctacttgtgtttctctcagcatgttaatctcgaccagctgcaaccactccatactctgcgaaatctgatgtacctggtgagcccctcttctgaacaccttggcagaagcggaccctttgaagtgcgcgctgacttagaggaatcaatggaatttgtagacccaggagtggccggtgaatcagacgaatctggggacgagagggtgtccgatgaagaaactgatctgggaacggattgggagaacctcccgagccctaggttctgcgacatcccttcgcagtcagtggaggtgtctcagagccagagtacccaggcttcccctccaatcgcatcttcttccgcagggggaatgatttcttcagcagccgcatccgtgaccagttggttcaaggcatatactggacacagatag

SEQ ID NO: 48416 - DNA, 828 bp, Artificial Sequence
  Description of Artificial Sequence: Synthetic coding sequence
atgacagatgacaaggacgtgctgcgcgatgtctggtttgggcgaatccctacgtgctttactctgtaccaggatgagatcacggagagagaggcagaaccttactacttgctcctacctcgcgtatcctacctcaccctagtgaccgataaagtaaagaagcactttcagaaagtcatgcgccaggaagacatctctgaaatatggtttgaatatgaagggacgccattgaagtggcattatcccatcggactgctgttcgatctactcgccagctctagcgctctcccctggaacatcaccgtgcatttcaaatcatttcctgagaaggaccttctgcactgcccttccaaagacgccatcgaggcacacttcatgtcatgcatgaaagaagctgatgccctgaagcacaagtcccaagtcattaacgagatgcaaaagaaggatcacaaacaattatggatgggcctacagaatgacagatttgaccagttctgggccatcaaccgaaagttaatggaataccctgctgaagaaaacggatttcgttacattcccttccgtatataccagacaaccaccgaaaggccctttattcagaagctgttccgcccagtcgccgctgacggccagctgcacacacttggagacctactgaaggaggtctgcccaagtgcgattgaccccgaggatggagagaagaagaaccaggtgatgatccatggtatcgagcccatgctggagacaccgcttcagtggttgagtgaacaccttagttatcccgacaacttcctacacatctccatcataccacagcccaccgattag

SEQ ID NO: 48417 - DNA, 276 bp, Artificial Sequence
  Description of Artificial Sequence: Synthetic coding sequence
atgacagacgacaaagatgttcttagggatgtgtggtttggtaggatccccacctgtttcacgctgtaccaggacgaaatcaccgaaagagaggctgaaccatactatacagatctgacctcttttggaccctctatcggcaattcatggaatatcctgcagaagaagatggatttcgtgatttccccgttagaatacatcagacagcgtctcaaagatcttagttttcgatcttgctttgtgctctggctgcagatggactcttgtacacactag

SEQ ID NO: 48418 - DNA, 594 bp, Artificial Sequence
  Description of Artificial Sequence: Synthetic coding sequence
atgcattaccctattggattactttttgacctccttgctagcagctcagctctaccatggaatatcacagttcatttcaagagttttccggagaaagaccttttgcattgccccagtaaggatgctattgaggcacactttatgtcatgcatgaaggaggcagatgcacttaaacacaaatcacaggtcattaatgagatgcagaaaaaggatcacaagcagttatggatgggtctccagaatgaccgctttgatcagttctgggccataaacaggaaactcatggaataccccgctgaggagaacgggttccggtatatcccgttcagaatctaccagaccaccacagaaaggccatttattcagaaactgtttcgccctgtcgctgctgatggtcaactgcacacactgggcgaccttctgaaggaggtctgcccttcagccatagaccccgaagacggggaaaagaagaatcaggtgatgattcatggtattgagcctatgctagagacccctctgcagtggcttagcgagcacctttcttaccccgacaatttccttcacatcagcatcatacctcaacctacggattag

SEQ ID NO: 48419 - DNA, 828 bp, Artificial Sequence
  Description of Artificial Sequence: Synthetic coding sequence
atgacagatgacaaagatgtcctacgggatgtatggtttgggagaatcccaacctgctttaccttgtaccaggacgaaatcacagaaagagaggccgagccctactatctcctcctccccagagtgagctaccttaccctggtaactgataaggtcaaaaagcattttcagaaagtgatgcggcaagaggatatttcagaaatctggttcgagtatgaggggacgcccctcaagtggcactatcccataggcctcttgttcgatctgcttgcatccagttctgcgctcccctggaacatcacagtacacttcaaatcatttcccgagaaggatttgctccactgccccagcaaggacgccattgaagcccattttatgagctgcatgaaggaggccgacgctttgaagcataagtcgcaggtgattaatgaaatgcaaaagaaagatcataaacagctatggatgggccttcaaaatgatagatttgaccagttttgggccatcaatcggaagctgatggaatatcccgcagaggaaaatggattccgctatattccgttccggatctatcaaaccaccaccgagcgacctttcatccagaaactttttaggcctgttgctgccgacgggcagctgcacacgctcggagatcttttgaaagaagtgtgcccatctgccatcgaccctgaggatggggagaagaaaaaccaggtgatgattcacggaattgaaccaatgcttgagacccctctccaatggttgtccgagcacctgtcttaccccgacaacttcctgcacattagcattatacctcagcctacagattag

SEQ ID NO: 48420 - DNA, 384 bp, Artificial Sequence
  Description of Artificial Sequence: Synthetic coding sequence
atgtgctgcgccgtcagcgagcagcgcctcacttgtgcggatcagatgatgccctttggtaagatatcgcagcagttgtgcggtgtcaaaaaactgccctggtcctgtgatagtagatacttttggggttggctgaacgccgtatttaacaaggttgactacgatcggattcgcgacgtgggtcccgatcgggcagcgtctgagtggctgctaaggtgtggggcaatggtccgctatcacggtcaggaacggtggcagaaggattacaatcacttacccacagggcctctggacaaatataaaatccaggcaattgacgctacagattcttgcatcatgtcgatcggcttcgaccacatggagacaagcaacatctgctgttag

SEQ ID NO: 48421 - DNA, 411 bp, Artificial Sequence
  Description of Artificial Sequence: Synthetic coding sequence
atgtgttgcgctgtgtctgaacagagactgacctgcgcggaccagatgatgccttttgggaagatctcccaacagctgtgcggagtgaagaaattaccgtggagctgcgacagtcgatacttctggggatggttgaatgcggttttcaacaaggtagattacgacagaatcagagatgtgggcccagaccgggcagccagcgagtggcttctcaggtgtggtgcgatggtacggtaccacggtcaggagagatggcaaaaggattacaatcaccttccgactgggcctctggacaaatacaagatacaggcaatagacgccaccgattcatgcattatgtctatagggttcgatcacatgggcaactacccaatagtgctcctgatcgagaacgccgatgacctccagtag

SEQ ID NO: 48422 - DNA, 783 bp, Artificial Sequence
  Description of Artificial Sequence: Synthetic coding sequence
atggctgcagttgttgtcgccgctgctggaggcgcagggccagctgttcttcaggtcgctggactgtaccgtgggttatgcgctgtccgatcaagggccctcggtttaggcctcgtgtcacctgctcagctacgggtttttcctgtgagaccaggctcgggacggcctgagggaggtgcagattcctcgggtgttggcgctgaggccgaactccaagcgaatcctttctacgatcgttatcgggacaagatccagctgctacgcaggtctgaccctgctgctttcgagtctcgtctcgagaagcgtagcgaatttaggaaacagccagttggccacagtaggcagggtgatttcattaaatgtgtggagcaaaagactgacgcactaggcaagcagagtgttaatcgaggattcactaaggataaaaccttgtccagcatcttcaacatagagatggtgaaggagaaaaccgcggaagagatcaagcaaatatggcagcagtatttcgcagcaaaggatacggtctatgccgtgatcccagccgagaagtttgaccttatatggaaccgagctcaaagttgtcccactaacgtggcagaagcccagtgcatcgctaatcaagtccagttgttctacgccactgataggaaggagacatatggcctggtcgagacctttaacctaaggcctaatgagttcaaatatatgtcagtcatcgcagagctcgagcagtctggtcttggggcagagctcaaatgtgcccagaatcagaataaaacttag

SEQ ID NO: 48423 - DNA, 987 bp, Artificial Sequence
  Description of Artificial Sequence: Synthetic coding sequence
atggctgctgtcgttgtcgccgctgccggaggcgctggacctgctgtccttcaggtcgcaggtttatatcggggactttgtgcggtccgatctagggcccttggtctaggcctggtttcacctgctcaactgcgagtcttccctgtgaggcccggaagcggtcgaccagaggggggtgctgactctagcggcgtaggtgctgaggccgagctgcaagcaaacccattttacgatcggtacagagataaaatacagcttttgcggagatcagaccctgccgctttcgaatcacggcttgagaagcgcagcgagttccgcaaacagccagtgggtcatagtaggcagggcgattttattaagtgtgtggagcagaagaccgacgccctgggcaaacaaagcgttaaccgtggattcaccaaggacaagaccctcagctccatttttaatattgagatggtgaaagaaaaaacggcggaggagattaagcagatttggcaacagtatttcgctgctaaagacacagtgtatgcagtgatccccgcagagaaattcgatctgatctggaacagagctcaatcctgcccaacattcttgtgcgcgcttccacggagggaaggatacgaatttttcgtgggccagtggacaggaactgagcttcacttcactgccctaataaacatccaaacaagaggtgaggcagctgcaagccagctgattctgtatcactatcccgaactcaaagaggagaaaggcatagtgttaatgacagccgaaatggactcaacttttctgaatgtggccgaagcccagtgcatcgccaaccaagtgcagctgttctatgcaacagatagaaaagagacatatggccttgtggagacgtttaacttgcggccaaatgagtttaagtacatgagcgtgattgccgagctggagcaatcaggactgggtgccgaactgaaatgtgcccaaaaccaaaataagacctag

SEQ ID NO: 48424 - DNA, 723 bp, Artificial Sequence
  Description of Artificial Sequence: Synthetic coding sequence
atgtcagatcccgctgccttcgaaagcagactcgaaaagcgctccgaattccgtaagcagccggtgggacacagccgtcaaggcgactttatcaaatgtgttgaacagaaaacagacgcacttggaaagcagtccgtgaatcgcggtttcactaaggacaagactttgtcaagcatcttcaacattgagatggtaaaggagaagacagcagaggagatcaagcaaatctggcaacaatacttcgctgctaaggataccgtttacgccgtaattcccgctgaaaaatttgatctgatatggaatcgggcacagtcgtgcccgaccttcctgtgcgctctcccacggagagagggatatgagtttttcgtgggacaatggactggtactgagttgcacttcaccgctctgattaatatccagacacgtggggaggcggctgcgtcccagctgattctgtatcattatcccgagttgaaagaagagaagggtattgtcttaatgacagccgagatggattcaacattcctgaatgtagcagaagctcaatgcattgcaaaccaggtgcagcttttctacgctaccgataggaaagagacgtacggtttggtcgagaccttcaatttgcgacccaacgagttcaagtatatgagcgttatcgcagagttagagcagtccgggttgggggcagaactgaagtgcgcacagaaccagaacaagacctag

SEQ ID NO: 48425 - DNA, 534 bp, Artificial Sequence
  Description of Artificial Sequence: Synthetic coding sequence
atggtaaaagagaagactgcagaagaaattaagcaaatctggcagcagtattttgccgcaaaagacactgtgtacgctgtgattccagctgagaagttcgatctgatctggaatcgggcacagagctgcccaacctttttgtgcgcccttccaagaagggagggctacgaattttttgtaggccaatggaccggcacagaactgcatttcactgctcttatcaatatccaaactcgcggtgaggccgcagcgtctcaactcatcctttaccactaccccgagttgaaagaggaaaagggaatcgtgctgatgaccgctgagatggattccacctttctgaatgtagcggaggcccagtgcattgctaaccaggtgcagttattttacgcaactgatagaaaggagacgtacggactcgtggaaacatttaatcttcgtcccaatgaatttaagtacatgagcgtcattgctgagctggagcagtctggattgggtgctgaattgaaatgtgctcagaaccaaaataagacgtag

SEQ ID NO: 48426 - DNA, 138 bp, Artificial Sequence
  Description of Artificial Sequence: Synthetic coding sequence
atgtccgaccccgcagcctttgagtctaggctcgagaaacgaagcgaattccgcaaacagcctgtgggccacagcagacagggcgacttcataaagtgtgtggagcagaaggatggggcacagaacaaactggtctag

SEQ ID NO: 48427 - DNA, 783 bp, Artificial Sequence
  Description of Artificial Sequence: Synthetic coding sequence
atggcagccgtggttgtcgcagctgctggcggtgctggacccgcagtgctgcaggttgccggactatataggggtctctgcgcggtgcggtcccgggctcttgggttaggattagtatctcccgctcagttgcgcgtgttccctgtgagacccggatccgggcgtcctgaggggggtgccgattcgtctggcgtgggggcagaggctgaactgcaggccaatcccttctacgatagatatagggacaaaattcagttactaaggcgctccgatccggcagcattcgagagtcgcctggaaaagagatctgaattccgtaagcaacccgtaggacacagcagacagggggattttattaaatgcgtcgagcagaaaaccgacgcactgggaaagcagagcgtcaatcgtgggttcacgaaggataagacactctcgtcaatctttaatatagagatggtcaaagagaagacagcagaagaaataaagcaaatctggcagcagtacttcgcggctaaagatactgtatacgcggtcataccggctgagaagtttgatttgatctggaaccgagcccaaagctgtccgactaacgtcgctgaggcccagtgcatcgctaaccaggtacagctcttctatgccacggatagaaaggagacctacggtttggtggagaccttcaacctgcggccaaatgaattcaaatatatgtctgttattgcggaactggaacagagcgggttgggggctgagctgaagtgtgcccagaatcaaaataaaacatag

SEQ ID NO: 48428 - DNA, 207 bp, Artificial Sequence
  Description of Artificial Sequence: Synthetic coding sequence
atgccccagctgaatactactgtgtggccaacaatgatcactcccatgttgctgacactgttccttatcacccagctaaaaatgctaaacaccaattaccacctgccccctagtccgaagcctatgaagatgaaaaactataacaaaccttgggagcccaagtggaccaaaatatgctccctgcattccctgccacctcagtcttag

SEQ ID NO: 48429 - DNA, 642 bp, Artificial Sequence
  Description of Artificial Sequence: Synthetic coding sequence
atggcccctgcccagcgcccactgttaccactcctgttactattgctgcccctaccaccccctccctttgccagggccgaggacgccgctcgcgctaacagcgatcgctacgccgtgtattggaatcggagtaatcctcgctttcacgctggagccggtgatgacggtggaggctataccgtcgaggtttcaatcaatgactacttggacatctactgccctcattatggcgcacccctgccacctgccgaacggatggaacactacgtgctctacatggtaaacggggaggggcacgcttcttgcgaccacagacagcggggtttcaagcgatgggagtgcaacagaccggctgcgccaggcggacccctgaaatttagtgaaaagtttcaactttttacccccttctctcttggattcgaatttagaccgggtcatgagtactattatatatccgctacacctcccaacgccgtggatagaccgtgccttcggttaaaggtctatgtgcggccaacaaacgagaccctgtacgaagctcctgaaccaatttttaccagtaataacagctgttccagtccagggggatgcaggctgttcctctcaacgatccctgtactctggacactgctcggcagttag

SEQ ID NO: 48430 - DNA, 507 bp, Artificial Sequence
  Description of Artificial Sequence: Synthetic coding sequence
atgctgccggctgccctgctccgacggccaggcctgggacgcctggttcgacacgctcgggcttacgctgaagctgcagcagcgcctgctgcagcttccggcccaaatcagatgagcttcactttcgccagtccgactcaggtgtttttcaacggggctaacgtgagacaggttgatgttcctacccttactggggcatttggtatactagctgcacatgttccaacactgcaggtattacggccaggactcgtggtggtccacgcagaagacggtaccacaagcaaatacttcgtgagctccggatctattgcagtcaacgcagactccagcgtccagctgctggcggaggaggccgttaccttggacatgctcgatctcggcgctgccaaagccaacctcgagaaggcacaggcagagttagtgggcacggccgacgaggccacccgcgctgagatccagattcgcatcgaagctaatgaggcacttgtgaaggcattggaatag

SEQ ID NO: 48431 - DNA, 156 bp, Artificial Sequence
  Description of Artificial Sequence: Synthetic coding sequence
atggtcgcctactggcggcaggcaggattgtcctacattagatacagtcagatctgtgctaaggttgttcgagatgccctcaagacggaattcaaagccaacgccaagaaaacttctgggaattcagtcaagatcgtaaaagtcaagaaagagtag

SEQ ID NO: 48432 - DNA, 771 bp, Artificial Sequence
  Description of Artificial Sequence: Synthetic coding sequence
atgctttcacgtgtggtgctgtcagctgccgcaactgccgctccctccctgaagaatgctgccttcttgggcccaggggtgcttcaggccacacgcacttttcacacggggcagcctcacctggtgcctgtgccgcctttgcccgagtacgggggaaaggtacgttacggactcataccggaagagttcttccagttcctctatcccaaaaccggggtgacaggaccatacgtgctcggaacgggccttatactgtacgctctgtccaaggaaatctacgtcatctccgcggagacctttacggcactgtcggtgctgggtgtcatggtttacggtattaagaaatatgggccattcgttgcagactttgcagacaagttgaatgagcagaagctcgctcaactcgaggaggccaaacaagcttcaatacagcacattcagaatgctatcgacaccgagaagtctcagcaagccctagtacagaagcgacattacctgtttgacgtccaaaggaataacattgccatggccctggaagtgacgtatcgcgagaggttgtaccgggtgtacaaagaggtgaagaatcgcctggattatcatatcagcgtgcaaaacatgatgcgcagaaaggaacaggagcacatgatcaactgggtggaaaagcacgtcgtgcagagcatctctactcagcaggagaaagaaacgatcgccaagtgcatcgcagatctcaagctgctggcgaagaaggcgcaggcccagcctgtgatgtag

SEQ ID NO: 48433 - DNA, 588 bp, Artificial Sequence
  Description of Artificial Sequence: Synthetic coding sequence
atgttatccagggtcgtactttccgcagccgctacagctggcccttacgtcctgggcaccgggttgatcctgtacgccctgagcaaagagatctacgtgatctctgccgagaccttcacagctctttcagttttaggtgtgatggtatatggtatcaagaaatacggccctttcgtcgcagactttgccgacaagctaaacgaacagaagcttgcgcagctcgaggaggcaaagcaagcttcaatccagcacattcaaaacgcaatcgacacagaaaagtctcagcaagcgctcgtgcagaagcggcactatctgttcgatgtgcagcggaataacatagctatggctctagaggttacttatagagaacggctgtacagggtatacaaagaggtgaagaacaggctggattaccacattagcgtacagaatatgatgaggagaaaggagcaggagcacatgatcaattgggtagagaagcacgtcgtgcagtccattagcacgcagcaggaaaaggaaactattgccaaatgcatcgccgatctgaaactcctcgccaagaaggctcaggcccagcccgtgatgtag

SEQ ID NO: 48434 - DNA, 486 bp, Artificial Sequence
  Description of Artificial Sequence: Synthetic coding sequence
atggccggacggaaactggcccttaaaactatcgattgggttgctttcgcagagataatcccgcagaaccagaaggccatagcttcctctctaaagagttggaacgaaactctgacgtcccggttggcggcacttccagaaaatcctccggctatcgactgggcctactataaggccaacgtggccaaagcagggttggtggacgattttgagaaaaagttcaacgctcttaaagtcccggtgcctgaggacaagtacaccgctcaggtcgacgccgaggagaaggaagatgtaaagtcttgcgccgagtgggtgtcactcagcaaggccagaatcgttgaatatgagaaagagatggaaaagatgaaaaacctgatacccttcgatcaaatgaccatcgaggatctgaatgaagcctttccagagaccaagctcgacaagaagaagtatccgtattggcctcatcagcctatagagaatctttag

SEQ ID NO: 48435 - DNA, 414 bp, Artificial Sequence
  Description of Artificial Sequence: Synthetic coding sequence
atggctggtcgcaagctggccctgaagaccattgactgggtcgctttcgccgaaatcatcccccaaaaccagaaagctattgcctctagcctgaaaagctggaatgaaaccttaacctcacgattagcagcgctgcccgagaaccctcctgcaatcgactgggcttattacaaggccaacgtggcgaaagctggcttagtagacgattttgaaaagaaggttaaatcttgcgccgaatgggtctctctttctaaggcgaggatagtggagtatgagaaagaaatggagaagatgaagaacctgatcccatttgaccagatgaccatcgaggacctgaacgaggcctttcctgaaactaagctggacaagaaaaagtacccttattggcctcaccagcctatagaaaatctttag

SEQ ID NO: 48436 - DNA, 309 bp, Artificial Sequence
  Description of Artificial Sequence: Synthetic coding sequence
atggctggacgtaagctggctctgaagacaattgactgggtagcatttgctgagataattccacaaaaccagaaggctattgcatctagtctgaaaagttggaacgagacgttaacttcccggcttgccgcactgcccgaaaacccacccgctattgattgggcttattataaagccaacgtcgccaaggcaggtctggttgacgattttgagaaaaagttcaatgccttgaaggtgcccgtgcctgaagacaagtacactgcacaggtggatgctgaagagaaagaggataaaaaaaagaagaaatag

SEQ ID NO: 48437 - DNA, 285 bp, Artificial Sequence
  Description of Artificial Sequence: Synthetic coding sequence
atggcatctgtaggtgagtgccctgctccggtccccgttaaagacaagaagctgcttgaggtcaagctaggagaactcccgtcatggatcctcatgagagatttctcgccaagcggcattttcggtgccttccagcgcggttactatagatattataataagtacatcaatgtgaagaagggatccataagcggtattaccatggtgctcgcttgttacgtacttttcagctacagcttttcgtataagcatctcaagcatgaacgtctgagaaagtaccactag

SEQ ID NO: 48438 - DNA, 168 bp, Artificial Sequence
  Description of Artificial Sequence: Synthetic coding sequence
atggcgagcgtcggggagtgtccggcacctgtgccggttaaggataaaaaactgctggaagtcaaattgggggaactccccagctggattctcatgagagacttctcccccagtggaattttcggggctttccagcgcgaacatgagcgactgcgcaagtatcactag

SEQ ID NO: 48439 - DNA, 267 bp, Artificial Sequence
  Description of Artificial Sequence: Synthetic coding sequence
atggcatccgtagtgccggtgaaggataagaagcttctggaagtgaagctcggagagctgccatcatggatcctcatgcgggatttctctccttcgggaatttttggcgcatttcagaggggctactatcgatattacaataagtatatcaacgtcaagaagggaagtatcagtggcatcacaatggtccttgcctgttacgtgctcttctcatacagcttctcttataagcatctcaaacacgaaagacttaggaaatatcactag

SEQ ID NO: 48440 - DNA, 150 bp, Artificial Sequence
  Description of Artificial Sequence: Synthetic coding sequence
atggcttctgttgtgccagtaaaggataaaaaactcctcgaagtaaagctcggagaactgccttcttggatactcatgagggatttctctccgagcggcattttcggagccttccagcgagagcatgagagattgcggaagtatcattag

SEQ ID NO: 48441 - DNA, 267 bp, Artificial Sequence
  Description of Artificial Sequence: Synthetic coding sequence
atgtcaagtaaactccctgtgaaagacaagaagctcctggaggtaaagctcggggagctgccttcttggatcctgatgcgagactttagtccatccggaatttttggcgcattccagagagggtactaccgttactataataagtatatcaacgtgaagaaagggagtatttccggcatcacgatggtcttagcatgttatgtcttattcagctactcgttcagctataaacatcttaagcatgagaggctgaggaagtaccactag

SEQ ID NO: 48442 - DNA, 312 bp, Artificial Sequence
  Description of Artificial Sequence: Synthetic coding sequence
atggctcagttcgtcaggaaccttgtcgagaaaacaccggcactggttaacgccgctgtgacctactccaagccgaggctggctaccttttggtattacgctaaagtggagcttgtgccccctaccccagcagaaatccctcgtgccattcaatctcttaagaagatcgtaaactccgctcagacgggatcattcaagcagctcacagtcaaggaggccgtgctgaatggcctcgttgcaactgaagttttaatgtggttttacgtcggcgaaattatcggcaagagaggtatcatcggttatgacgtctag

SEQ ID NO: 48443 - DNA, 303 bp, Artificial Sequence
  Description of Artificial Sequence: Synthetic coding sequence
atggcccctttcgttcggaaccttgtcgaaaagacacctgcactagttaacgccgctgttacgtaccttaagccacgactggccgcattctggtattacacaactgttgagctggtgcctccaacccctgccgagatccccagagccatccaatctctgaagaaaatcgtcagtagcgcacaaacagggagctttaagcagctgaccgtgaaagaggctctgttaaacggcctggtggctactgaggtgtcaacctggttctacgttagagaaattacgggaaagcgcggtattatcggttag

SEQ ID NO: 48444 - DNA, 648 bp, Artificial Sequence
  Description of Artificial Sequence: Synthetic coding sequence
atgtgttgtgctgtgagtgaacagagacttacatgcgcagaccaaatgatgccattcggaaagattagccaacagctgtgcggggtgaagaagctgccttggtcatgtgatagcaggtacttctggggatggctcaacgcggtattcaataaggtcgactacgatagaattcgggatgtaggccctgacagagctgccagcgagtggctgttgcgatgtggggcaatggtccgatatcacggacaagagcgctggcaaaaggattataaccatctacctactggccctttagataagtacaagatccaggcgattgatgccaccgacagctgcataatgtcaattggcttcgaccacatggaaggcctcgaacacgtagagaagatccgcttgtgtaaatgtcactatatcgaggacgattgtctgttacgactgtcccagttggagaacctacagaagacaattcttgagatggagattatttcatgcggaaatattacggacaagggtatcattgcgcttagacacctgcggaacctgaaatacctgttgctctccgatctcccaggggtgcgggagaaagaaaatttggttcaggccttcaaaacggcccttcccagtctagagttaaagttgcagctgaagtag

SEQ ID NO: 48445 - DNA, 801 bp, Artificial Sequence
  Description of Artificial Sequence: Synthetic coding sequence
atgattcggggatctggggctgaggcatgttccaacgaggacggctgctctgaaaaaggcatgaagggcgttgattatgacaggatcagagacgtgggcccagatagagctgcctccgaatggctgttgaggtgcggcgcaatggtgagataccatggccaagagaggtggcagaaggattataaccatctcccaaccggccctttagataagtacaaaattcaggcgatcgatgctacagatagctgtatcatgagcatcggctttgaccacatggagggtctagaacacgtggagaagattcgcctttgtaagtgccactatatcgaggacgactgcctgttacgcctgagccagctggagaacctccagaagactatactggaaatggagataatttcctgcggaaatatcactgacaaaggcattattgctctgaggcacttgagaaaccttaagtatttactgctctccgatttgcccggagcagggaatcccggaccttgcgttgcctccgggagctcccgcacccgtgccccactcggcttcagagagaggggactgcaggagactgacgtaccaggggctctggtagaccggtcttacgacctaagcccctccgctggaatgaggatgttggagcttaaggccacgacagccatcttgaagagccggtttcagctttctgtaccgggagggtccctgctctttaaacagtctcctgtgggtcattcatccatttccttctggccatacaaagctatcctgaggcagtctagagcaggcgataaccaggaatag

SEQ ID NO: 48446 - DNA, 444 bp, Artificial Sequence
  Description of Artificial Sequence: Synthetic coding sequence
atggccggacggggaaaactgatcgctgtcataggcgatgaggatacggtaacgggctttttactcggtgggattggcgagctgaataagaaccgccacccaaactttctggtggtggaaaaagatacgacaataaacgagatcgaggacacctttagaagcctaggtagtctacctggctctgtagtggaagcaaaccccaaccagcgagatccccctctgtgggatgagatcgatagtaggcagtttctcaaccgcgatgacattgggattatccttatcaaccagtatatcgccgaaatggtgcgccatgctttagatgcccaccaacaaagcattcccgctgtgcttgaaataccaagcaaggaacacccttacgacgccgcaaaagacagcatactaaggcgcgcacgaggaatgttcaccgctgaggatctcaggtag

SEQ ID NO: 48447 - DNA, 321 bp, Artificial Sequence
  Description of Artificial Sequence: Synthetic coding sequence
atggccgtcactgctctggcagcgaggacttggcttggggtgtggggtgtgcggaccatgcaggccagagggtttggcagcgatcagagtgaaaatgtggatcggggagccggatctatcagggaggccggtggtgcattcggaaaaagagagcaggcagaagaggagcgctacttcagggctcagagcagagagcaattggccgcattgaagaagcaccacgaggaggaaattgtacatcataagaaggaaatcgagcggctccagaaagagatcgagagacacaagcagaagatcaagatgcttaagcacgacgattag

SEQ ID NO: 48448 - DNA, 183 bp, Artificial Sequence
  Description of Artificial Sequence: Synthetic coding sequence
atggccgtcacagcactcgcagcccgaacatggcttggggtctggggtgtgagaaccatgcaggctcgaggattcgggtcagatcagtcggagaacgtagaccggggagctgggtcgatccgggaagcgggaggggcatttggtaagagagaacaggcagaggaagaaaggtacttcagatag

SEQ ID NO: 48449 - DNA, 216 bp, Artificial Sequence
  Description of Artificial Sequence: Synthetic coding sequence
atggctgttacagccctcgcagcccgaacatggctcggcgtctggggagttcgcaccatgcaggcccgaggcttcggatccgaccagagtgagaacgttgatagaggcgcaggctctattagggaagccggaggcgcttttggtaagagagagcaagcagaagaggagagatacttcaggcactatcggctgtgctttgagatctctctcggctag

SEQ ID NO: 48450 - DNA, 3261 bp, Artificial Sequence
  Description of Artificial Sequence: Synthetic coding sequence
atggaaaaatgggaggagctcaattcccaccagcctggggaggagtacgatccatctaaagctacctttgtgaaggtcgtccccactcctaacaacggctctacagagctggttgctctgcatagaaacgagggcgaagacggtctcgaggtgctgagctttgagttccagaaaatcaagtatagctatgatgcacttgagaaaaagcagtttctgcctgtcgccttccccgtgggtaatgcgttctcgtattatcaatccaacaggggatttcaagaagacagcgagatcagagccgcagagaaaaaatttggttctaataaggctgagatggtagtgccagacttttcagaattgttcaaggaaagggccacagctccttttttcgtttttcaggtcttctgcgtggggctctggtgtctggacgagtactggtattacagtgtcttcaccctgtctatgctggtcgcgttcgaagcatctctggtgcagcagcagatgcgcaatatgtcggagatcaggaagatggggaataaacctcatatgatacaggtttacaggtcacgtaagtggcgcccaatagcatctgatgaaatcgtgcctggagatattgtgtctatcggcaggtccccccaggagaacctggtgccttgcgacgtactgctgctccgaggcaggtgcattgtcgacgaagcaatgttgacaggagagtctgttccccagatgaaggaaccaattgaggacctgtccccagatcgagtcctggacctgcaggccgatagccggctccacgtgatctttggcggaactaaagtcgtccaacatatccccccacagaaggccactactgggcttaagcctgtcgacagcgggtgcgtggcgtatgtgttgagaacaggtttcaacaccagccaaggcaagctcctcaggacaattctatttggcgtgaaaagggtgactgctaacaacctggagacctttattttcattcttttcctgctggtgtttgcaattgcagctgccgcttacgtctggatagagggaactaaagatccttcaaggaaccgttataaactctttcttgaatgtacactgattctcacaagtgttgtccccccagagctccctatcgaactcagcctggctgtgaacacctcccttatcgccctggcaaagctatatatgtactgtacggagccattccgaatcccttttgctggcaaagttgaagtctgctgcttcgacaaaaccggcaccctgaccagcgatagcctcgtggtcaggggggtggctggactccgggatggcaaagaggttactcccgtcagcagtattccagttgaaactcaccgtgcactcgcctcatgtcacagtcttatgcagctggacgatggcactctggtcggggacccactggagaaagctatgctgacagctgtggattggacattaacaaaagacgagaaagtcttcccgagatcaattaaaacccagggactgaagattcaccagaggttccattttgcctccgccttaaaaaggatgtcagtccttgccagctatgagaaactgggaagcacagacttatgctatatagcagccgtgaaaggcgctcctgagacacttcattctatgttctcccaatgccctccagattatcaccatatccatacggagatctctagggaaggtgccagggtgttggcgctgggctacaaagaattgggccacctgacacaccagcaggctcgggaggtgaagagagaagccctcgaatgctctctgaagttcgttgggtttatcgtcgtcagttgtcccttgaaggcagactctaaagccgtgattagagaaattcagaatgcttcccacagggtggtaatgataaccggagacaacccactgactgcgtgccacgtggcccaggagctgcactttattgaaaaggcccacacattgattttacagccgcctagcgagaaaggacgccagtgtgagtggcggagcatcgatggttcgattgtccttcctctcgccagagggtcccccaaagctctggccctcgagtacgccctgtgccttacgggggatggtctggcacacctgcaagctactgacccacagcagctgctgcggcttatcccccacgtccaggtttttgccagagttgctcccaaacagaaggagttcgtcattacgtcattgaaggagcttggctacgtgacgcttatgtgcggcgatgggacgaacgatgtaggagctcttaagcacgctgatgtcggcgttgctttgctggccaatgcccctgaacgcgtggtagagaggagacggcgacccagagacagcccaactctgagcaatagcggcatccgcgcaacttcaagaaccgccaaacagagaagcggactccctccttctgaagaacagccaacctcccagcgggatcggctgagtcaggttcttcgtgacctcgaagatgagtctacccccattgtgaaactgggagacgccagtatcgccgcaccttttacatccaaactgtcatccatccagtgcatctgtcacgtaatcaagcagggaaggtgtacactcgtcacaactttgcagatgttcaagatactcgccctgaacgctttaatcttagcatactcgcagtctgtgctttacctcgagggcgtgaaattctccgacttccaggccaccctccagggcctgctgctggcgggttgcttcctgttcataagcagatccaagcctctcaagacactctccagagaacgtcccctccccaatatatttaacctgtatactatcctgacggtgatgctgcagttcttcgtgcactttctttccctggtctacctctaccgtgaagcccaagccagaagcccagagaaacaagagcagttcgtcgacctctacaaagaattcgagcccagccttgttaacagtacggtgtatattatggcaatggcaatgcaaatggctacattcgccataaattacaaagggcctccttttatggagagcctgcctgagaataaaccgttagtgtggtcattggcggtgagcctgctcgcaatcataggacttctgctcgggtcctctcctgacttcaattcccagttcggtcttgtagatatacctgttgagtttaaactagtcatagcccaagtactcttgctcgacttttgtctcgctctcctggcagaccgcgtacttcagtttttcctggggactcctaagttgaaggtgccgtcgtag

SEQ ID NO: 48451 - DNA, 3615 bp, Artificial Sequence
  Description of Artificial Sequence: Synthetic coding sequence
atggccgctgccgctgcggtgggaaatgccgtaccttgtggcgctagaccttgcggcgtgagacccgacggacagccaaagcccggtcctcagccacgggcactgctagccgctggcccagcactgatcgctaacggagacgaactcgtggcggcagtctggccctatcgacgcctcgcactcctacgacggctgacagtgctcccattcgcaggcctgctctacccagcctggctcggggctgcagctgcgggatgttgggggtggggaagctcatgggtgcaaatacccgaagccgcactccttgtcctggccaccatctgtctggctcacgcgcttacagtactgagtggacattggagtgtgcatgcacactgtgcgctgacctgcacgcccgagtatgatccttcaaaggccactttcgtcaaggtggtgcctacacctaataatggctccacagagctcgtggcactgcatcgtaacgagggggaggacggacttgaggtcttgtcctttgaatttcagaaaatcaaatacagctacgatgcattggagaagaagcaattccttcctgtagcgttcccagtgggcaatgcttttagttattatcagagcaacaggggatttcaggaagacagtgaaatacgcgcagcagaaaagaaattcggaagcaacaaagctgagatggtggtgcctgactttagcgagctgttcaaagaacgagcaactgctccctttttcgtgttccaagtcttttgtgtcgggctgtggtgcctcgacgagtattggtactattctgtgttcaccctgtccatgctggtcgcttttgaagccagtcttgtgcagcaacagatgaggaatatgagcgagatacggaaaatgggtaacaagcctcatatgattcaggtttaccgcagccgcaaatggaggcccattgcttctgatgaaattgtgccgggagacatcgtgagtattgggcgatctccacaggaaaacctggtgccatgcgacgtgctcttattgcggggtcgatgcatcgtggatgaggccatgcttacaggggagtccgtgcctcagatgaaagaaccaattgaagacctatcgccagatagggttttagacttacaggccgactcccgcctgcatgtcatatttggcggtacgaaagtggtacagcatataccacctcagaaagccaccaccggactcaagccagtagacagcggatgtgtggcttacgtgctccgcaccggctttaatacaagtcaaggcaaactgctgagaactattcttttcggggtgaagcgggtgaccgccaacaatctcgaaacatttatattcatcctgttccttctcgttttcgccatcgctgcggcagcctatgtgtggattgagggcacaaaggacccgagtcgtaataggtataagctctttctggagtgcaccctcatcctgacttccgtggtcccgcctgagctgcccattgaattatctctggctgttaacacatccttgatcgccttggccaagctttacatgtattgtaccgagccttttcgcattcccttcgcaggcaaagtggaagtttgttgcttcgacaaaactggaacattaacctccgattctctggtggttaggggagtggccggtctccgcgacggtaaggaggtgactccagtcagctcaattccagtcgagacacaccgcgctctggcgagttgccattctttaatgcagctggatgacgggactcttgtcggggatcccctggaaaaggcaatgcttaccgccgttgactggacattaacaaaagacgagaaggtgttccccaggagcattaaaacccagggcctaaagatccaccagcggttccatttcgcctccgccctcaagagaatgtccgtcctggcctcctatgagaaactcgggtccacagacctgtgttacattgctgccgtgaagggtgcccctgagactttacacagtatgttttcacaatgtccccctgactatcaccacattcatacagaaatatcaagggagggcgcaagggtgctagcactgggctataaagagttgggccaccttacacaccagcaagcaagagaagtgaaacgtgaggcgctcgagtgttctttgaaattcgtggggttcatcgtggtaagctgcccactgaaggccgacagcaaagccgttattagagaaatccagaacgcgtcacatcgcgttgtcatgattaccggcgataaccctctcaccgcctgccacgtggctcaggagttgcactttattgagaaagcgcacactctcatactgcagccccctagtgaaaaaggacggcagtgtgagtggcggtccatagatgggtctatcgttttgcctcttgcaagagggtcacctaaagcccttgccctcgagtacgcgctgtgtctgaccggcgatgggctcgctcatctgcaggctactgaccctcagcagctgctgaggcttatcccgcacgtgcaggtgttcgcccgagtggctccgaaacagaaggagtttgttataacctcactgaaggaattaggctacgtcacactgatgtgcggggatggaactaatgatgtgggtgcactgaaacacgccgacgttggcgtcgctttgctcgccaatgcaccagagcgagtggtcgaaagaagacgcaggccgagagacagccctaccctcagcaattcaggcattcgggcaacttcaagaactgccaagcaacggtcaggccttcccccatctgaagagcagccgaccagccagcgtgatcgtttgagccaagttctgagagacttggaggacgagtctacgccaatcgtgaagcttggcgacgcttcaattgccgcacccttcacctccaagctctcaagtatccagtgtatttgtcacgttatcaagcagggcagatgcactctggtgacgactctacagatgttcaaaatactcgccctaaatgcccttattctggcttatagccaatcagtcctgtacctcgagggcgtgaagttcagtgactttcaagccactctccaaggactgctgttggctgggtgcttcttgtttatttcccgatctaaacccctcaaaactctcagtcgcgaaaggccactacccaatatttttaatctgtacacaattctcactgtaatgttacagtttttcgtgcatttcctgtccttggtctacctgtatcgcgaagctcaagcccgtagccctgagaaacaggaacaatttgttgacctttataaggagtttgagccttcactggtaaattctacggtctatattatggccatggctatgcagatggccacctttgccattaattataaagggcctcccttcatggagtccctgcccgagaataaacctctggtctggtcattagccgtcagtctgctggcaattataggactcctgcttggttcttccccagattttaatagccagttcggtctcgtggatattcctgtggaattcaagctggtgatcgctcaggtgctcctgcttgacttttgtttggccctgctagccgatcgtgttctacaattcttcctcggcacaccaaagctcaaggtcccatcatag

SEQ ID NO: 48452 - DNA, 3681 bp, Artificial Sequence
  Description of Artificial Sequence: Synthetic coding sequence
atggaccgcgaggaaagaaagacaataaaccagggccaggaagatgagatggaaatttacggatataacttgagcaggtggaaactggcaatcgtgagcttgggcgtcatttgttccggaggattcctgttgttactgttatactggatgcctgagtggcgggtcaaagctacatgtgtccgcgcagctattaaagactgtgaagtcgttttgctgcgcactaccgacgaattcaagatgtggttctgtgctaaaatccgggttctctctcttgagacctaccctgttagctcccccaaatccatgtcaaacaaactgtcgaacggacatgcagtgtgccttatcgagaaccccacggaggagaacaggcaccggatatctaaatatagccagacggagagccagcagatccgttattttacacaccattccgtaaaatatttttggaacgatactattcacaatttcgacttcctcaaggggctggacgaaggagtatcttgtacttctatctacgagaaacatagcgcaggactcacgaagggtatgcacgcctacaggaaattgctatacggtgtaaacgagattgccgtgaaggtaccatccgttttcaaactcctgattaaagaggtgctgaatcccttctacatttttcaattgttctctgttatcctgtggtccacagacgaatactactactacgctctcgccatcgtcgtcatgtcgatcgtttctattgtatctagcctgtattcaatcaggaaacagtacgtcatgctccacgatatggtagctactcatagcaccgtgagagtcagcgtgtgcagggttaacgaggagatagaggaaattttttctaccgaccttgttcccggagatgttatggtgattcccttaaacggcacaattatgccatgcgatgccgtcctgataaatggcacatgtattgtgaatgaaagcatgctcaccggagaatctgtgcccgtcactaagacaaaccttcccaatccgagcgtggacgtgaagggaatcggagacgagctgtacaaccccgaaactcacaaaaggcacacactgttttgcggtaccaccgtcattcagactaggttctacaccggcgagctggtgaaagccatagtggtgaggaccgggttcagcacaagcaagggccagcttgtgcgatccattctttatcctaaaccgacagacttcaaactctacagagatgcgtatttgttcctgctgtgtctggtggctgtcgccggaattgggtttatttacactattatcaattccatcttaaatgaggttcaggttggcgtcataatcatcgagtctctggacatcataactataacggtacctcctgcactacctgccgctatgaccgctggtattgtgtacgcccagcgaaggctgaaaaagatcggaattttttgcatttctcctcagcgaattaacatctgcggtcagcttaatctggtatgtttcgacaagaccggcaccctgaccgaggatggcctcgacctctggggaatccagagagtggaaaatgcgcgatttctgtccccagaagagaacgtttgcaacgagatgttagtcaaatctcagtttgtggcttgcatggccacctgccacagtctaactaagatcgagggagtcctaagcggcgatccactggatctgaaaatgtttgaggccattggttggattctcgaagaggctacagaggaggaaactgcactccataacaggataatgccaactgtggtacgcccacctaaacagttactgcccgagtctacacctgctgggaaccaggaaatggagttatttgaactgcccgcaacttatgaaattggaatcgtgagacagttccctttctccagtgccctccaacggatgagcgtagtcgcccgagtccttggcgacaggaaaatggacgcatatatgaagggggcaccagaggcaatcgctgggttgtgtaagccagagactgtgcccgtggatttccagaatgtgcttgaagactttacgaaacaaggatttcgcgtgattgcactggctcaccgcaagctggagtctaaattaacctggcacaaggtacagaatatatcccgagacgccattgaaaataatatggattttatggggctaattataatgcagaataaactgaagcaggagacacccgctgtgctggaggatctgcacaaagctaatattagaaccgtcatggtaacgggggatagcatgctgactgcggtgtccgtcgctcgtgattgtgggatgatcttgccccaggacaaggtcatcatcgcagaagcccttccgccaaaagacgggaaagttgcaaaaatcaactggcattacgccgacagccttacacagtgcagtcacccttctgccatcgatcctgaagctataccagtgaaactggtgcatgattcactggaggacctgcagatgactaggtaccactttgccatgaatggaaaatcattttctgtaatactcgaacactttcaggatttagttcccaagttgatgctgcacggcactgtttttgcgagaatggcccctgatcagaaaactcagctcatcgaggctctgcagaatgtggactacttcgttggaatgtgcggtgacggagcaaacgattgtggagctcttaagagggctcatggaggcatttccctttcagagctggaagcaagtgtagcttccccctttacgagcaaaacaccgtctatctcgtgtgtacctaatttgattcgggaggggcgagctgccctcattacatctttctgcgtgtttaagtttatggccctgtactctatcattcagtactttagcgttaccctgctgtattccatcctcagcaacctcggagactttcagtttctgttcattgatctcgccatcattctggttgtggtgtttacaatgtctctgaatccggcatggaaggagcttgtcgcgcagagacccccttccgggctcattagcggcgctctgcttttctcagtgctctcccagatcatcatttgcataggatttcagagcctgggtttcttttgggtaaagcagcagccatggtatgaggtgtggcacccaaagagcgatgcatgtaatacaacaggctctggcttctggaatagtagtcacgtcgataatgagaccgagctggacgaacataatatccaaaactacgagaacaccacagtgtttttcatttcctcctttcagtatctgattgtagccattgctttcagcaagggaaagcctttcaggcagccatgctacaaaaattactttttcgtattcagcgtgatctttctatatattttcatcctgtttatcatgctgtatcccgtggccagtgtagaccaagtcctgcaaattgtatgcgtcccctatcaatggagggttactatgttgatcatcgttctcgtgaacgcattcgtaagtattacagttgaggagtcagtggatagatgggggaagtgttgcctgccctgggcattggggtgccggaagaaaacccctaaagctaagtacatgtacctggctcaggagctcctggtggatcccgaatggccacccaaaccacagacaacaacagaagccaaggctttggtgaaagagaatgggtcttgccagatcatcactattacatag

SEQ ID NO: 48453 - DNA, 2151 bp, Artificial Sequence
  Description of Artificial Sequence: Synthetic coding sequence
atggttgcgacccattctaccgtccgggtgagcgtttgccgggtgaatgaggaaatcgaagagatatttagtaccgacttggtgccaggcgatgtcatggtcattcctctcaacggaacaattatgccctgtgatgcggtcctgatcaacggaacctgcatcgtgaatgagagcatgttaacaggagaaagcgttccagtgactaaaaccaatcttcctaaccctagcgtcgacgttaaaggaattggagatgagctgtataatcccgagacgcataagcgccatacattattttgtggaacgacggtgattcagactcggttctacacaggagaactggtgaaagcgatcgtcgttagaacgggattttcaacaagtaagggccagttggtgcgcagcattctgtatcccaagccaacagatttcaagttatatagggatgcttacctcttccttctgtgcctggtcgccgtggctgggattgggtttatttacactatcatcaatagtatcctgaatgaagtgcaagtgggcgtcatcattattgaatccctcgacatcattactatcaccgtccctccagcactgcctgctgcgatgacggctggaatcgtgtatgcgcagcggcgtttgaaaaagatcggtatattttgtatcagtccccagagaatcaatatctgcggacagttgaaccttgtgtgtttcgataagactggcaccctgacagaagatggcttagacctgtggggcatccagagggtagagaatgctaggttcctgagccccgaggaaaacgtatgtaatgaaatgttggtcaagagccaattcgtcgcatgcatggctacctgtcatagtctaactaagattgaaggggtgctgagcggagatcctttagacctgaagatgtttgaggctattggatggattctcgaggaggccacagaagaggagacagccttgcacaacagaatcatgccaacagtggtccgtccgccaaagcagctgctgccggagtctacccctgcgggtaaccaggagatggagctttttgaactcccagcaacttatgagatcgggatcgtccgacagtttccattctcgtcagcccttcagagaatgtctgtggtggcgagagtcttgggggatcgcaaaatggatgcatacatgaaaggagcacctgaagcgatagccggtttgtgtaaaccagagacagtccccgttgacttccagaatgtgctggaggactttaccaaacaagggttccgcgttatcgctctagcacaccgcaagttggagagtaaactcacttggcacaaagtccagaacatctcaagagacgccatcgagaataatatggattttatgggactgatcattatgcaaaacaagctgaaacaggaaacaccagccgtcctcgaagacttgcacaaggctaatatacgcactgttatggtgacaggcgattctatgctgacagctgtttcagtcgctagagactgtggcatgatcctcccacaggacaaagttattattgcagaggccctgccacctaaagacgggaaggtcgccaaaattaactggcactacgccgacagcctgactcaatgttcccacccatcagcgatcgaccccgaagctatacccgtgaagcttgtgcacgattcccttgaagatttgcaaatgacacggtaccactttgctatgaatgggaagtccttcagcgtaattctcgagcactttcaggatctggttccgaagctgatgctgcacggtaccgtttttgccaggatggccccagaccaaaagacacagctgatcgaagcactgcaaaacgtggactatttcgtggggatgtgcggagatggagcaaacgactgcggggctcttaaacgcgctcatggcggtataagcctcagcgagctggaagccagcgtggcatctccttttacttcgaaaactccatccatctcatgcgtgcctaacctaatccgggaagggagagcggctttgatcactagcttttgtgagctggctctgttctccatcgttacatactcccttgaccattttattatttccatcttgatctctaacatgctggtacttttcttctcagattttcacaactgcgcgttttacagcctggtttag

SEQ ID NO: 48454 - DNA, 3681 bp, Artificial Sequence
  Description of Artificial Sequence: Synthetic coding sequence
atggaccgagaagaaagaaagaccattaaccagggacaagaggacgagatggagatttatggctataatctcagcagatggaaactcgccattgtgtccttaggcgtgatctgttcaggcggatttttgttactccttttgtattggatgcctgaatggcgggtaaaggctacctgtgtacgagcagctatcaaagattgcgaggtggtgctgcttcgcacaactgatgagtttaagatgtggttttgtgcaaaaatcagggtgctgtcattagagacctacccagtatcatcccccaagtcaatgtcaaataagctgagcaatggccacgctgtttgcttgatagagaaccctacagaggagaatcggcacaggatctccaaatactctcagaccgagagtcagcagatcagatattttacgcatcatagcgtgaagtacttctggaatgacacaatccacaatttcgatttcctgaaggggcttgatgagggggtgagctgcaccagcatttacgagaaacactcagctgggttgactaaaggcatgcacgcttatagaaagttactgtatggtgttaacgaaatcgccgtcaaggtgccctctgtgtttaagttgttaatcaaggaagtcctgaaccccttttacatattccagctgtttagtgtgattttgtggtctacagatgagtattattattacgccctggccattgtggtgatgtctattgtaagtatcgtctcatcgctttactctatcagaaaacagtacgtgatgctgcacgatatggtggcaacccactctactgtccgggtctcggtttgtcgcgtaaacgaggaaattgaggaaatattttccactgatctcgtgcccggtgacgttatggtcattcctcttaacggaacaataatgccttgcgacgcagtgctaatcaatggcacctgcatcgtaaacgagagtatgctaacaggcgagtcggttcctgtgacgaagaccaatctccccaacccttcagtggacgtaaaaggtattggggatgaactgtataatccagaaactcacaagcggcacacactgttttgcggcaccacagtaattcaaacacggttttacacaggggaactggtgaaggcaatcgtggttcggacaggattctctacctctaaggggcagttggttagaagcattctctacccaaagccaacggacttcaagctttatcgagacgcatacctatttctgctgtgtcttgtggccgtggccggaatcgggtttatatatacgatcattaactccattctgaacgaagtccaggtgggggtgatcatcattgagtccctagacatcattactattacagtgcctccagcactccctgctgcaatgacagcaggaattgtgtatgcccaacgcagactgaagaagatcggcatcttttgtatctctccccagaggattaatatttgcgggcagctaaaccttgtgtgctttgacaagaccggcacgttgacagaagacggactagacctgtgggggatccaaagggtggaaaatgcacgctttctctcgccggaagagaatgtatgcaacgaaatgctggtgaaatcccaattcgtggcctgtatggccacatgtcacagcctaactaagatagagggtgtcctgtctggagatccactcgatttgaaaatgttcgaagcaatcggctggattctagaggaagccaccgaggaagagaccgccctgcacaataggatcatgcccacagtggttagaccccctaaacaactgctgcctgagtccactccagccggaaatcaggaaatggagctgttcgagctgcctgccacttatgagattgggattgtgagacaattccctttctctagcgccctgcagcgtatgagcgtggtcgctcgagtgctgggggatcgcaaaatggacgcctacatgaagggcgcacccgaggctatcgctggcctttgtaaacctgagacagttccggtggactttcagaacgtgcttgaggactttactaagcagggcttccgcgtgatcgctctagcacaccggaaattggagtcaaagttgacatggcataaagtgcagaatatcagtcgcgacgccatcgagaataacatggatttcatgggcctgattatcatgcagaataaactaaaacaagagacgcccgcagtgctggaggatctgcataaggccaacatccgcacagtgatggtgaccggggactcgatgcttaccgctgtgtctgtggctcgggattgtgggatgatcctacctcaggataaagtgatcattgccgaagccttacccccaaaggatgggaaagttgccaaaattaactggcactatgccgattcccttacccagtgttcccatccatcagcaattgatccggaagcaattccagtgaaactggtgcacgactcgttggaagatctccagatgacaaggtaccactttgctatgaacggcaagtcctttagcgttattctcgagcacttccaggacctggtccctaagcttatgctccacgggacagtgttcgctaggatggccccagatcagaaaacgcaactcattgaggcattgcaaaacgtcgactattttgtgggcatgtgtggggatggggcaaacgattgcggcgctttgaagagagcccacggcggaatttccctttctgaactggaagcctcggtagcaagtccattcacctcaaaaaccccctctatttcatgcgtgccaaatctgattagggaaggcagagctgccttaattacgagcttttgcgtcttcaagttcatggccctgtacagcattatccagtatttttccgtgaccctcctttattcaattctctccaatctgggcgatttccaattcctgttcatcgacctcgctatcattctcgtcgtcgtatttaccatgtccctgaaccccgcatggaaggaactcgttgcacaaaggcctccatctggtctgatctcaggtgcgctgctgttttctgtgttatcacagattatcatatgcataggcttccagagtctggggttcttttgggtgaagcaacaaccatggtacgaagtttggcaccccaaaagtgacgcatgtaacacgacaggcagcggtttctggaactcttcacacgtagacaatgaaacagagctggacgagcataacatccagaactacgagaacactactgttttttttatctcctcctttcagtacctgatcgttgccatcgcgttctcgaagggaaaaccattccgccagccttgctacaagaactacttcttcgtattttccgtgatctttctgtatattttcatactcttcatcatgctgtaccctgttgcctcagtggatcaggtactgcagattgtttgcgttccataccaatggcgagtgaccatgctgatcatcgtccttgtgaacgcctttgttagcattacggtcgaggaatccgtggatcgttggggtaagtgctgtttgccctgggccctcggctgtcggaagaagactcctaaggcaaagtacatgtatctggcacaagagttactggtcgatcctgagtggccccctaaaccacaaaccacaacagaagccaaagccttggttaaggagaacggctcttgccagattattactatcacttag

SEQ ID NO: 48455 - DNA, 144 bp, Artificial Sequence
  Description of Artificial Sequence: Synthetic coding sequence
atggacagagaggaaagaaagactataaatcagggccaggaagatgagatggagatatatggctacaacttgagtcgatggaaactagccatcgtgtcactaggcgtaatctgctcaggcggtttccttctccttttactgtag

SEQ ID NO: 48456 - DNA, 312 bp, Artificial Sequence
  Description of Artificial Sequence: Synthetic coding sequence
atggaccgtgaagaaagaaaaacgataaaccaaggacaagaagacgagatggagatctatggctataatttgtctcggtggaagctggccatcgtctccttaggagtgatatgttccgggggattcctgctcctgctgctgtactggatgccagagtggcgcgtaaaggccacctgcgtccgagccgctatcaaagactgcgaggttgtcttgctgcggaccaccgacgaattcaaaatgtggttctgtgctaagattcgcgtcctgagcttggaaacatatcctgtctctagccccaagtctatgtcatag

SEQ ID NO: 48457 - DNA, 1731 bp, Artificial Sequence
  Description of Artificial Sequence: Synthetic coding sequence
atggggcatttcgagaaggggcagcatgctctcctgaacgagggggaggagaacgaaatggagatttttggttatagaacacagggttgtagaaagagcttgtgcttagcagggtctatttttagttttggcattctaccacttgtgttctattggaggcccgcttggcacgtttgggcccactgtgtcccttgttctctgcaggaggccgatactgtgttgctcaggaccaccgatgaatttcagatctacagctggaagaaggtcatatggatatacctgagtgccctgaactctgcctttgggctcactccagatcatccactgatgaccgatgaggaatacatcatcaacagagctattaggaagcccgatttgaaggtgcgatgtattaaagtccagaagatccggtacgtttggaactatctagagggtcaattccaaaagatagggtcactggaggactggctctcatcagccaaaatccatcagaaatttggctccggtctgacccgcgaggaacaggaaatcaggcgtcttatatgtgggcctaacactattgacgtggaggttacccccatttggaaacttctaataaaggaggttcttaacccattttacatctttcagttattttctgtctgcttgtggttttcagaggactacaaagaatatgcctttgccattataatcatgtccattatcagcatttcattgacagtctatgacctgcgagagcagagcgtgaaactacaccatctggtggaaagccacaactcgattacggtgagtgtctgcggccgtaaggcaggcgttcaggaactcgagtccagagtcttagtgccgggtgacttgctcatactgaccggaaataaagtccttatgccctgtgatgcagtcttaatcgaggggtcctgtgtggttgatgaaggcatgcttaccggggaatctataccagtgaccaagacccctttacccaaaatggattcttcagtcccctggaaaacacagagtgaagcagactataagcgacatgtgctgttctgtgggacagaagtcattcaggcaaaagctgcatgttccggaaccgtaagagctgtggtactccaaaccggatttaacactgccaagggggatctggtgcgctctatcctctaccctaaacccgtgaacttccagctgtatcgcgatgccattagatttcttctctgtctagtgggcactgccacaattggcatgatttataccctttgcgtctatgtgctctccggcgaacctcccgaggaagtggttcgcaaggccctggacgtgattactatcgctgtgccacctgctctcccggctgcactgaccacaggcatcatttacgctcagcgtaggttgaaaaagcgaggaattttctgcatctccccgcaacgtattaatgtttgtggccagcttaacctggtgtgtttcgataagacggggacccttacaagggatggccttgacctatggggtgtggtttcctgtgatagaaatggatttcaggaggttcactctttcgcctccggacaggccctgccttggggacccctgtgtgccgcaatggcctcatgtcacagcctgatcctgctcgatgggacaattcagggagaccctttagatctcaagatgttcgaggccactacctgggtgagcttgtgctcaagcgagaatctaaggtcattctttaacgctcgggctacttag

SEQ ID NO: 48458 - DNA, 3591 bp, Artificial Sequence
  Description of Artificial Sequence: Synthetic coding sequence
atggggcacttcgagaaggggcagcacgcactccttaacgagggtgaagaaaacgagatggagatcttcggatatcgaactcaggggtgccgcaaaagcctgtgcctggccggttcaattttctccttcgggattctgcccctggtgttctattggcggccagcctggcacgtgtgggcccactgcgtgccgtgctcactgcaggaggcagataccgtgttgctaaggacaacagacgagtttcaaatttattcctggaagaaagttatatggatatacctgagcgccttgaattctgcatttggccttactcctgatcatccactgatgacggacgaagaatacattatcaatagggctattcgcaaaccagatctgaaagtaaggtgcatcaaagtccagaaaataaggtacgtgtggaattacctcgaagggcagttccagaagattggctccttggaggattggctgtcctctgcaaagattcaccaaaaatttggatctggattgactcgggaagaacaggagattcgcagactcatctgcggccctaacaccatcgatgtggaagttactccgatctggaagctattaattaaagaagtattgaatcccttctatatttttcagctgtttagtgtgtgcctctggttttccgaagactacaaagagtacgcattcgctatcattatcatgtccatcattagcatctcacttacagtctatgacttacgagagcagtccgttaagctgcatcacttagtggaatctcacaactccattactgtcagtgtgtgtggcagaaaggccggagtacaggagttagagtcacgagtcttggtcccaggcgacctgttgatcctgaccggtaataaggttctcatgccatgcgatgccgtgttgatagagggctcttgtgtggtcgacgaaggaatgctcactggggagtcaattccagttacaaaaacccctctgccaaaaatggactctagtgtaccctggaaaacccagtctgaagcggattataagcggcacgtactgttctgcgggaccgaggtgatccaggccaaagctgcgtgctccggaacagtacgcgctgtcgtcctgcagaccggtttcaacactgccaagggagatctcgttcgcagtattctgtaccctaagcccgttaacttccagctctacagagacgcgatcaggttccttctatgtctggtgggcacagctaccattggaatgatatacactctgtgcgtttacgtcctcagtggggagcccccagaggaagtggtgcgaaaagcacttgatgtgatcaccattgcggtgcctcccgcattgccggctgctctgacaacaggaattatttacgctcagcggaggttgaagaaacgtggaatattttgcattagtccacagcgaattaacgtgtgtgggcagttgaacctggtgtgctttgacaaaactggtaccctgaccagggatgggttagatttatggggcgtggtgtcatgtgatagaaatggattccaggaggtccattcattcgcgtctggccaggccctgccgtgggggcctttgtgcgcagcaatggctagttgtcacagtctcatccttcttgacgggacaattcagggcgaccctctagacttaaaaatgttcgaagcaacaacctgggaaatggcgttttctggtgatgacttccacataaagggcgtccctgcccatgcgatggtagtgaaaccctgcagaacagctagtcaggtgcctgtggagggaatcgccattctccaccagtttcccttcagctcagctttacagagaatgactgtgattgttcaggagatggggggagataggctcgcgtttatgaagggggctcctgaaagagtcgcatccttctgccagcccgagacggttcctacatccttcgttagcgaacttcagatctacaccacgcagggattccgggtgatcgcattggcctataaaaaactggaaaatgaccaccacgctaccacattgacacgagagacagtggagagcgaccttatctttctgggcctgctcatcctggaaaatagattaaaggaagaaactaagcccgtactggaggaattgatttcagcacgcatacgcactgtgatgatcacaggcgacaacttacagacagctatcaccgtcgccagaaaatcgggcatggtttcagagtctcagaaggtaatcctcatcgaggctaatgagacaaccggatcatccagcgcaagcatcagctggactcttgtggaggagaagaagcatataatgtatggcaatcaggacaattatataaacataagggacgaggtcagcgacaaggggcgtgagggttcttatcactttgctcttacaggcaagtccttccacgtgatctcccagcacttttctagcctcctccccaaaattctgattaacgggactatctttgctagaatgtcccccggacagaagtcatccctggtggaggagttccagaaattagactatttcgtcggcatgtgtggagacggcgctaatgactgcggggctcttaagatggctcacgttggcatctccctgtcagagcaggaagcatccgtggccagcccgtttacttctaagactcctaacatagagtgcgtaccccacttgattaaagagggcagagcagctctggtaacatccttctgcatgtttaaatacatggcgctctatagcatgattcagtatgtaggtgtacttctgctgtactgggagactaatagcctcagcaactaccagtttttgtttcaagatttggccatcactacgttaatcggtgtcaccatgaacctgaacggcgcttatcctaaactggttcccttccggcctgcaggacggcttatcagccccccactgctgttgagcgttattttcaacatcttactctctctcgccatgcacattgctgggttcatccttgtgcagcggcagccttggtactcagttgagattcatagtgcatgtacggtccaaaacgagagcatctctgaactcaccatgagcccaaccgccccagagaagatggaatccaactcaaccttcacttcttttgagaacactacagtgtggtttctgggcacaattaactgcatcactgtggccctagtgttttctaaggggaagcctttccgccaacccacgtacacaaactatatattcgtgttggttctcattattcagttgggggtgtgtctgttcattctgttcgctgatattcccgaactgtaccgtaggcttgatctcctgtgcacaccagttctgtggagggcatccatcgtgatcatgttgagtctaaatttcatcgtctccctggtcgccgaagaggccgttattgagaatagagcactgtggatgatgatcaagaggtgtttcggctatcagtctaaatcccagtacaggatctggcagcgggatctggccaacgatccttcatggccccctctgaatcagacttcacactcagacatgccggagtgcggacgtggggtttcttactccaatccagtcttcgagagtaacgaagaacagctgtag

SEQ ID NO: 48459 - DNA, 639 bp, Artificial Sequence
  Description of Artificial Sequence: Synthetic coding sequence
atgcatatcgctggattcatcctcgtccagcgccagccatggtacagcgtggagattcacagcgcatgcacggttcagaacgaaagcattagcgagctgaccatgtcccccactgcgccagaaaagatggagagcaatagcaccttcacaagctttgagaacacaacagtgtggtttctggggacaatcaattgcatcacggtggctttggtgttctctaagggcaagccattccgtcagcccacttatactaattacatttttgtgctggttctaattatccagctgggcgtctgcctgtttattttgttcgctgatatccctgagttatacaggcggctcgacctgctctgcactccagtcctctggcgagctagtatagtgattatgctcagcctcaactttatcgtgtccctagtggctgaagaggccgtaatcgagaaccgcgctctctggatgatgatcaaacgctgttttggttaccagtctaagtcacaataccgcatctggcagcgcgatttggccaatgacccctcttggccccctctcaatcagactagccactcggacatgccagaatgtggacgcggagttagctactccaatcccgtattcgagagcaatgaggaacagttatag

SEQ ID NO: 48460 - DNA, 3657 bp, Artificial Sequence
  Description of Artificial Sequence: Synthetic coding sequence
atggaagaaaactcgaaaaaggaccacagagccctgctgaatcagggcgaggaggacgagctggaggtcttcgggtatcgtgaccataacgtccggaaagccttttgtctggtggcctcagttcttacctgtggaggacttcttctggttttttattggagacctcagtggcgcgtgtgggctaattgtatcccatgtccactgcaggaggccgacactgtgcttcttagaaccaccgacgaattccagcgatatatgcgcaaaaaggttttctgtttgtatttgagtacccttaagttccctgtatccaagaagtgggaagagtccctcgtcgccgaccggcattccgtgatcaaccaagcactgatcaagcccgagctcaagttgcggtgcatggaggtgcagaagattcgctatgtttggaacgatctggagaaacgttttcagaaggttgggctgttagaagactcaaacagctgctccgacatacatcagacttttggcttgggtttgacaagtgaagagcaggaggtacgccgactggtgtgcgggccaaacgctatagaggtggaaatccagcccatttggaagttgttagtaaagcaagtgttgaaccctttctatgtgtttcaagcttttacactaactctttggctgagccaaggctatatcgaatactcagtggccatcattattcttaccgttatatcaattgtcttatcggtgtatgacctcagacaacaatccgtgaaactgcataacctcgtagaggatcacaacaaagtccaagtgacaatcatcgtcaaggataaaggactggaggagctcgagtcccgcttactggtcccaggagacatcctcattctgcctggcaaattctccctgccctgtgatgccgtactcattgatggctcgtgtgtggtgaacgagggcatgctaacaggtgaatccatcccagtgacaaagacacccctaccgcagatggagaatacaatgccatggaagtgtcactcacttgaggattatcggaagcacgtgttgttttgcgggacggaagtcattcaagtgaagcctagcggccaaggaccagttagggcggtggtgctgcagacgggttataacacagccaagggggatctggtaaggagcatcctgtacccaagacctctgaatttcaagctgtacagtgatgcatttaagttcatcgtgttcttggcctgtttgggtgtgatgggattcttttatgccttaggcgtgtatatgtaccatggcgtccccccaaaggacacagtgacgatggccctaatcctgctgaccgtaacggtacccccagtgttgccagccgctctgactatcggcaatgtctacgcgcagaagcgcttgaagaaaaaaaagatattctgtattagccctcagcgtattaacatgtgcggtcagattaaccttgtatgctttgataaaactggtacactgactgaagatgggctagacctctgggggactgttcccacagctgacaactgtttccaagaagctcattctttcgcaagcggtcaagctgtgccctggagcccattatgtgccgcaatggcttcctgtcactcacttatcttgcttaacggcaccatccagggagatcctcttgatctcaagatgttcgaggggaccgcttggaagatggaggactgcatcgtggacagttgtaaatttggcacgtcggtgtctaatattatcaagcctggcccaaaagcttccaaatctcctgtggaggcaatcatcaccctttgtcaatttccattcagtagcagcctgcagcgcatgtccgtcatcgcccaactagctggcgaaaaccacttccatgtatacatgaagggggctcccgaaatggtagctaggttttgcagaagcgagaccgtgcccaaaaacttcccgcaggaacttcggtcctacaccgtgcaggggtttagagtgatcgcattggcacacaagaccctgaagatgggcaacctcagtgaggttgagcatctggcacgcgaaaaggtggaatcggaacttacgtttcttggcttgctgataatggagaacagactcaagaaggagacaaagctggtgctgaaagagctctcggaggccaggataagaaccgtcatgattacgggcgataatttacagaccgccataaccgtggccaagaatagcgaaatgatccctccaggatcccaggtcatcattgttgaagcggatgagccagaagaattcgtgcctgcctcggtgacgtggcaactggtcgaaaaccaggaaaccgggccaggcaagaaagagatctacatgcacacaggaaactcttctactccaaggggcgaaggcggatcttgctaccacttcgcaatgagcggaaaatcatatcaggtcatattccaacatttcaacagtttgctgcccaagatactggtcaacggtaccgtatttgcaagaatgagccccggtcaaaaaagtagcctgattgaggagtttcagaagctgaattactacgtggggatgtgtggtgacggtgccaatgattgcggcgctctgaaagccgctcacgcaggaatttcactgtccgagcaggaggccagcgttgcctccccctttacatcaaaaactaccaacatccaatgtgtgccccacctgattcgcgaagggagagctgccctggtgtcgtcattcggagtgtttaagtacctaacaatgtacgggatcattcagtttatttcagccctgctgctctattggcagctgcaactgttcgggaactatcagtacctgatgcaggatgtcgccattacactcatggtctgtttaacaatgtcttctacccacgcttaccctaaactggccccataccgccctgcaggccagcttctgagtccccctttactgctgagcatatttttaaactcttgtttttcgtgcatcgtgcagataagtgcattcctgtatgtgaagcagcagccatggtattgtgaggtataccaatactctgaatgtttcctggcgaatcagtccaacttttctaccaacgtctccctggagcgaaactggaccggcaatgcaacactgatcccaggctccattctgtctttcgaaacgacgaccctctggcctatcacaactatcaattatattaccgtggcgttcattttctccaaaggcaaaccgtttagaaaaccgatttacactaattacattttctctttccttttgctggctgccctgggattgacaatttttatcctgttttccgattttcaggtaatctaccgtggtatggagctgatcccaactatcacttcctggcgggtgctcatactggtggtggccttaactcaattctgtgtcgcattcttcgttgaggattcgattttacagaaccatgagctgtggctgctgatcaagcgagagttcggtttctatagtaagtcacagtatcggacatggcagaaaaaactggcagaagatagcacatggccgccaatcaaccgtacagactattcaggtgacggcaaaaacggcttctacatcaatggaggttatgagtcccatgagcaaattccaaagcgcaagctgaagctgggaggtcagccaacagagcaacacttctgggccagactgtag

SEQ ID NO: 48461 - DNA, 3450 bp, Artificial Sequence
  Description of Artificial Sequence: Synthetic coding sequence
atgcctacaatgcggaggacagttagcgaaatccggtctagagccgaagggtacgagaagacagatgacgtttcagaaaagacctctctcgcggatcaggaagaagttagaaccatcttcattaaccagccacagttaacaaagttctgcaacaaccacgtgtctaccgcgaagtataacatcattacattcctgccacgtttcctctacagccagtttcggcgtgccgcaaactctttcttcctattcattgccctactgcaacaaataccagatgtgtcgcccaccggcaggtatactaccttggttcctttgctgtttatcctcgccgtggcagctattaaagaaattatagaggatatcaagaggcataaagccgacaacgccgttaataaaaagcaaacacaagtgctgagaaatggcgcatgggagatcgtgcactgggaaaaggtgaacgtgggcgacattgttatcattaagggcaaagagtacatccccgcagatacagtgttgttgtcgagcagcgagccacaggctatgtgttacatcgagacatccaacctcgatggcgagactaacttgaaaatacgacagggtctaccagccactagcgacattaaggacgtggactctctgatgagaatctccggtcgtatcgaatgcgaaagtcccaaccgtcacctgtacgacttcgttggaaatattagactagatgggcacggaactgttcccctcggggcagaccagatcctcctgcgaggtgcccaactgaggaacacacaatgggttcatggtattgtcgtttacactggacacgacacaaaactgatgcagaactcaacgtccccgccacttaaactgtctaatgtggagagaatcacaaatgtgcagatactgatcctgttctgcattctcattgccatgtcactagtctgttccgtgggatcagcaatctggaaccgcagacactccggcaaggattggtacctgaacttgaattacgggggagcatctaattttggccttaactttctaacctttatcatcctgtttaacaatctcatccccattagcctgctggtgactctggaggtcgttaaattcacacaggcctactttatcaactgggacctcgatatgcattacgagccaactgacacggctgccatggcaagaacttcaaatctgaacgaggaacttggtcaggtcaagtacatcttcagcgacaagacaggcaccctgacttgtaatgttatgcaatttaagaaatgtaccatagcgggtgtcgcctacggacagaactcccagttcggggatgaaaagaccttttccgattccagcctcctggaaaatctgcaaaacaaccaccccacagcgcctatcatttgtgaattcttaacgatgatggcagtgtgtcatacagccgtcccagagcgggaaggggataagatcatttatcaggcagcctctcccgatgaaggggctctcgtccgggcagcgaagcagcttaacttcgtattcactggcaggactcccgattcagtgattatcgacagcttagggcaggaagaacgttatgagctgctgaacgtgctggaatttacttcggcccgtaaacgaatgtctgtgattgtcagaaccccatccgggaagctgcgcttgtactgcaaaggagcggataccgtcatctatgaccggctcgccgaaacctcaaaatacaaggagattaccctgaaacatttagagcagttcgccacagaggggttgcgtaccctttgcttcgccgtggctgaaatctctgagagcgactttcaggaatggagggcggtgtatcagagggcttccacaagtgtgcagaaccggttactcaagctggaggagtcatacgaactgatcgaaaaaaacctccagctgctcggcgctaccgccatcgaagataaattacaagatcaggtgcccgagactatagagacacttatgaaggcggacattaagatctggatcctcacaggggataagcaggagactgctatcaacatcggtcacagttgcaaactgctcaagaagaacatgggcatgatcgtgataaatgagggctctctcgatgggactcgggaaaccctttcacgacactgtactaccttgggggatgcccttagaaaagagaatgactttgctctcataatcgacgggaaaacattaaaatacgccctgaccttcggggtgagacaatatttcttagacctcgcgctctcctgcaaggccgtgatctgctgcagggttagcccgctccagaagtccgaagttgtggagatggtcaagaagcaggtgaaagtggtcaccctggccattggagatggagccaatgacgttagtatgatccagaccgcccacgttggagtcggaatatccgggaacgagggcctccaggccgctaactcaagtgattactcaattgcacagtttaagtatctgaaaaacctgctcatgatccacggcgcttggaactacaatagagtgagcaagtgcatactgtattgcttctataagaacatcgttttgtacataatcgagatttggtttgctttcgtcaatggattctcgggacaaattcttttcgaaagatggtgcattggactgtacaatgtgatgtttaccgccatgccccctctgactttgggaatattcgaaaggagttgcagaaaagagaacatgttgaagtaccctgaactttacaagaccagccaaaacgccctagattttaacacaaaagtgttttgggtgcattgcctgaatggcctgttccacagcgtgatcttattttggtttccgctcaaagctttgcagtatggcacagcattcggaaacggcaagacttccgattaccttttgttgggcaacttcgtgtacacattcgtagtaatcacagtatgtctgaaggctggcctggaaaccagctactggacctggttcagccatattgccatctggggttctatcgcactgtgggtggtctttttcggcatctactcatcattgtggccagctatccccatggccccagacatgtcaggggaagccgcaatgctcttctctagcggtgtcttttggatgggccttttgtttattccggtagcctcactactgctggatgtggtgtacaaagtaataaaacgcaccgcatttaagacgctggtagatgaggtgcaggagttggaagccaaaagtcaggaccccggtgctgtggtcttgggaaaatctttaaccgaaagagctcagctcctgaaaaatgtgttcaagaaaaaccatgtgaacctttacaggagcgagtctctccagcagaatttgttacatggatacgcattttctcaggatgaaaacggcatcgtttcccagtccgaagtcatccgagcctacgataccaccaagcagcgccctgacgaatggtag

SEQ ID NO: 48462 - DNA, 3495 bp, Artificial Sequence
  Description of Artificial Sequence: Synthetic coding sequence
atgcctacaatgagaaggacagtctccgaaatccggtcccgcgctgaaggctacgagaagaccgacgacgtgtctgaaaaaactagtctggccgaccaggaggaggtgcgcaccatcttcattaaccaaccgcaactgaccaaattctgcaataaccacgtcagtaccgccaaatacaatatcatcacattcctcccgcgttttctgtacagccagttcaggcgtgccgcaaatagtttttttctgtttatcgctcttctccaacagatccccgatgtttctcctacagggaggtatacgactcttgtccccctcttatttattctggccgttgcagccattaaggaaattatcgaggacattaagcgtcacaaggccgacaatgcagtaaataaaaagcaaactcaggtcttgaggaacggggcatgggagatcgttcactgggaaaaagtggctgtgggagaaatcgtgaaggttacaaatggggagcacttacccgcagacctcatcagcctgtcttcatcagagccacaggcaatgtgttacatcgaaacatctaatcttgatggagagaccaacctgaagatccgccagggcctgccagccaccagtgacatcaaggacgttgatagcctgatgcggatctcaggtagaatagaatgtgagagtccaaataggcacctttacgatttcgtcggcaacatccgactggatggtcacgggaccgttccactgggcgcagaccagatcctgctgcgaggggctcagctcaggaatactcaatgggttcacggcatcgtggtttacaccggccacgacaccaaactgatgcagaattcaacatccccgccactgaaactgagcaatgttgagagaatcacaaatgtccagatcctcatactattctgcatcttgatcgccatgtctttagtgtgctctgtcggctccgctatttggaatcgccgacattccggcaaagattggtatttgaacttaaattatgggggtgcaagtaatttcgggctcaacttcctgaccttcattatactgtttaataatcttattcccattagcttactggttacactagaggttgtgaagttcactcaggcctactttatcaattgggatctggacatgcattacgaaccgactgacaccgcggcaatggcccgaaccagtaacctgaacgaggaactcgggcaagtgaaatacatcttctcggataaaaccggcactctgacgtgtaacgtaatgcagttcaagaagtgcaccattgccggagttgcttatgggcatgtcccagagccggaggactatggttgttcgcctgatgagtggcaaaacagtcagtttggtgatgagaagacattcagcgactcttccctactggagaaccttcaaaataatcaccctactgccccaatcatctgtgagttcctgaccatgatggccgtgtgccacacagctgtgccagagcgcgagggcgacaaaatcatctaccaagccgctagcccggatgagggcgcattggtgagggccgcaaaacagcttaacttcgtctttactggccgaacccctgattcagtgattattgactcactcgggcaagaagaaagatatgaattgctgaacgtgctggagttcacatcagccaggaagagaatgagtgttattgttcgtactcctagcggcaagctgcgactgtactgcaagggcgctgacactgtgatctacgataggctcgctgagacctccaaatacaaggaaataacactcaagcatctggagcaatttgcgactgaaggcctccggaccctgtgctttgccgtagctgaaatcagcgaatccgatttccaggaatggcgcgctgtttaccagcgcgcaagcacatctgtacagaatcgcctgctcaagctggaggagagctacgagctgattgaaaaaaacctgcagctgctgggagcgaccgccatcgaagacaaacttcaggatcaggtgcctgaaaccattgaaactctgatgaaagccgacattaagatctggatcttgacaggcgataaacaggaaactgctatcaacatcggccattcctgcaagctgcttaaaaagaatatggggatgatagtgattaacgaaggatcgctcgacgggactagagagacgctttcgaggcattgcaccacacttggagatgctttgcggaaagaaaatgactttgccctcattatcgacggtaaaaccttgaaatacgccctgacatttggggtccgtcagtatttcctggatctcgcactgagctgtaaagcagtcatctgttgcagggtgtcccctttacaaaagtcagaagtggtggagatggtgaaaaagcaggtcaaggtagtaacactggccattggcgatggcgcaaacgacgtgagtatgatccaaaccgctcatgtgggggtgggcatttcaggaaacgaggggttgcaggcagccaactcaagtgattattctattgcccagttcaaatatctgaaaaatctgctgatgatccacggagcctggaactacaaccgggtttctaagtgcattctctactgtttctacaagaatatcgtgttgtacattattgaaatctggttcgccttcgtcaacgggttttctggccagattctgttcgaaaggtggtgtatcggtctgtataatgtcatgtttacagcaatgccacctctgacattagggatattcgaacgctcttgtcggaaggaaaatatgctgaagtaccctgagttgtataagacctcacagaatgccttggattttaacaccaaagtgttttgggtccactgtttgaacgggctatttcattcagtgattcttttttggtttcctcttaaggccttgcagtatgggacagcgtttggcaatggaaaaacaagtgattatctgctgctcgggaattttgtttacacattcgtcgttattacagtctgcttgaaggccggactggagacctcgtattggacatggttctcacacattgctatctggggaagtatagctctttgggtcgtgttttttgggatttacagttctttgtggccggcaatcccaatggcccctgacatgtcaggggaagctgccatgcttttcagcagtggtgtcttttggatgggacttctgttcattcccgtggcttccctcttgctggatgtcgtgtacaaggttatcaaacgaacagcttttaaaacccttgtggacgaagtccaggaactggaggccaagtcccaagatcccggagctgtggttcttggtaagtccttaaccgagcgcgcacagctcttaaagaatgtttttaaaaaaaaccatgtcaacttatacaggagcgaaagcctccagcagaatctgttgcatgggtatgctttttcccaagatgagaatgggattgtctcacagagtgaggtcatacgcgcatacgatacaaccaaacagaggccagatgaatggtag

SEQ ID NO: 48463 - DNA, 3579 bp, Artificial Sequence
  Description of Artificial Sequence: Synthetic coding sequence
atgttttgctcagagaagaaactgagagaggtggagcgcatagtgaaagccaatgatagagaatacaacgaaaaatttcagtatgccgacaacaggatccacacttctaagtacaatatcctgacgttcttgccaatcaatctgttcgaacagtttcagagagtagcaaatgcttatttcctgtgcttgctcatactacaactcatacctgaaataagctcacttacatggttcactacaatcgtgccgttggtcctcgttatcactatgaccgcagtgaaggacgcaaccgatgattactttagacacaagtctgacaaccaggttaacaatcggcaatcagaggtgcttatcaactcaaagctgcagaatgagaagtggatgaatgttaaggttggcgatataatcaagctggagaacaaccagttcgtagccgctgacttactgctgttatctagctcggaaccccatggcctctgctatgttgagacggcggagctggacggcgaaacaaatttgaaggtgcgacatgcgctgtctgttacaagcgaactcggtgccgacatctcgagactcgcagggttcgatggcatagttgtttgtgaagtccctaataataaactggacaagtttatgggaatactgagttggaaagattcaaaacatagcctaaataatgagaagattatattgcgcggatgcattctacggaacaccagttggtgtttcggcatggtgatctttgcagggcctgacaccaaactgatgcagaactccgggaagactaagttcaagaggacatctatcgatcgtttgatgaatacgttagtgttgtggatctttggcttcctgatctgtctgggcatcatcctggccattggtaattcaatctgggaaagtcagacgggcgaccagtttaggaccttcctgttctggaatgagggggaaaaaagttctgtgttctctgggtttttaaccttctggagctatatcattatcttaaatactgttgtaccaatctccctgtatgtcagcgtagaagtgatcagactgggtcattcttattttataaattgggaccgtaaaatgtactactcccggaaggctatccccgcagtggccagaactactactttgaacgaggaactgggacaaatcgagtacatcttctccgataaaaccggtacgctaacccaaaatatcatgacctttaagaggtgcagtataaacggacgcatatacggcgaagtccacgatgacttagaccagaaaacggaaattactcaggagaaagaaccggtggactttagcgtgaagtcccaggccgaccgggagtttcaatttttcgatcaccatctaatggaaagcataaaaatgggcgaccctaaggttcatgagtttctccggttactggcgttgtgccacacggtaatgagcgaggaaaacagcgccggagagttgatttaccaagtacagagtccggacgagggtgcgctggtgacggcggctagaaactttggcttcatcttcaagtctagaacacctgaaaccattaccatcgaggaacttgggacgctggtgacttaccagctgcttgcttttctggactttaacaacacccggaagagaatgagtgtgatagtcaggaacccggagggccagattaaactttattcaaagggagccgataccatcttgttcgagaagctgcacccatcaaatgaagttttacttagtctaacttctgaccatctgtccgagtttgccggagaaggccttaggaccttagccatcgcctatcgagacttggatgataagtatttcaaagagtggcataagatgctggaagatgctaacgcagccactgaggaaagagacgaacgcattgctggactgtacgaggagatcgagagagaccttatgctcttaggggctacagcggtggaagacaaactccaggaaggcgtgattgagactgtgacttcacttagcctggcaaatatcaaaatctgggtccttaccggcgacaaacaggaaactgccatcaatatcgggtacgcctgcaacatgctcactgatgacatgaacgacgtgttcgtgattgctggcaataacgctgtggaggtacgggaggaactgcgtaaggctaaacaaaatctgttcgggcagaacagaaacttttcaaatggccatgtggtttgtgaaaagaagcagcagttagagttagacagtattgtggaagagaccatcaccggcgactacgccctcattattaatgggcactcgctggcacacgccctagagtctgacgttaagaatgacctgctggaactcgcttgcatgtgtaagacagtgatttgttgccgagtcaccccactgcagaaggcgcaagtggttgaattggtcaaaaagtatcggaacgcggtaactttggcaatcggagatggagctaacgacgtgtccatgatcaagtctgcgcacataggagttggcataagcggtcaagaaggtctgcaggccgttctggctagtgactactctttcgcccagtttaggtacctgcaacgactcctgctagtccacggacggtggtcatatttccgcatgtgtaaattcctctgctattttttttacaaaaattttgcttttacactcgtgcacttttggttcggcttcttttgcggattttccgcccagaccgtgtacgaccaatggtttattacactgttcaatatcgtttataccagccttccggtgctggctatggggatatttgatcaagacgtctcagaccagaatagtgtcgattgtccccaactatacaagcccggtcagcttaatcttctgtttaacaaaaggaagttctttatctgtgtcttgcacggcatttacacgtcactagttcttttctttattccttatggcgctttctacaacgtagccggtgaggacgggcagcacatagcggactatcagagtttcgcagtgacaatggcaacatccctcgtcatcgtcgtgtcagttcagatcgcccttgacacaagctactggacttttattaaccatgtgttcatctggggttcaatcgctatatatttctctatactgtttacgatgcattctaacggcatctttggcatctttcctaaccaattcccctttgtaggcaatgctcgccactcccttactcagaagtgtatttggttggtaattctgctgacaaccgtagcttccgtcatgcccgtggtggcctttcgtttcctgaaggtggacctgtatcctacccttagcgaccaaatccggcgatggcaaaaggctcagaagaaagccaggcccccatcaagtagacgtcccaggactaggaggtcctcgtccaggcggtctgggtacgcgttcgctcatcaggagggctatggcgaactgatcactagcggaaaaaacatgcgagccaagaaccctccgcctactagcggtctcgaaaaaacacactataatagcacaagctggattgagaatctttgcaagaagactaccgataccgtgagctcgttctcacaggataagaccgttaagctgtag

SEQ ID NO: 48464 - DNA, 162 bp, Artificial Sequence
  Description of Artificial Sequence: Synthetic coding sequence
atgttctgctctgaaaagaagctccgcgaggtggagcgtattgtaaaggccaatgacagggagtataatgagaagtttcagtacgcagataataggattcatacaagcaagtacaacatcctgacgttcctgcccatcaacctattcgaacagtttcaatag

SEQ ID NO: 48465 - DNA, 3579 bp, Artificial Sequence
  Description of Artificial Sequence: Synthetic coding sequence
atgttttgtagtgagaaaaagctccgcgaagtcgaacgcattgttaaggcaaacgacagagaatataatgagaaattccaatatgccgataaccgaatacacactagcaagtacaatatactcacattcctgcctattaatcttttcgaacagttccagagagtggctaacgcctatttcctttgcttgctcatcttacaattgatccctgaaatctctagcctcacttggtttacaacaattgtgccactcgtccttgtgatcactatgacggccgtgaaggacgccaccgatgactacttccgccacaagagtgacaaccaggttaacaaccggcagtccgaggtgctgataaatagcaagctccagaatgaaaaatggatgaacgtgaaagtaggggacataatcaaactcgaaaacaatcaattcgtggccgcagatctgctgttattgtcctcctcggagccgcacggactctgttacgtggaaactgcggagctggacggcgagacaaatctcaaagttcgtcatgctctctccgtcacgtctgaactaggagccgacatatctcgtttggccggattcgatggcattgtggtgtgcgaggttcccaataacaaactggacaagttcatggggattctgtcatggaaagattctaagcattctctcaataatgaaaagattatcttaagaggatgcattctcagaaatacgtcctggtgttttggaatggttatcttcgcagggccagacaccaaattaatgcagaatagtggcaaaacgaagttcaaacgtacttctatcgacagacttatgaatactctggtcttgtggatctttgggtttttgatatgtcttggcatcatcctggcaatagggaattccatttgggagagccagacaggggatcagtttagaacatttctgttttggaatgagggcgagaagtcatcagtcttctccggatttttgacattctggagttacattatcattctaaacacagtggtccccatctctctgtatgtatccgtggaagtgattaggcttgggcattcatactttattaattgggataggaaaatgtattacagtcgaaaggctattcctgccgttgcacggaccacaactctgaacgaggagctcgggcagatcgagtacatcttcagtgacaaaactggtaccctgacccagaacataatgacattcaagaggtgttcgatcaacggcaggatctacggtgaagtccacgatgaccttgaccagaaaacagagattacccaagaaaaggaaccagtggacttttcggtgaagtcccaggccgaccgcgaattccagttcttcgatcaccatctgatggagtctataaagatgggtgaccctaaggtgcacgagttcctgcgcctgctcgccctttgtcacaccgtgatgtccgaagaaaactcagccggagagctcatctatcaggttcaatctcccgacgagggcgctctagtcacagccgcacggaacttcgggttcatcttcaaaagccggacccctgagacaattacaatcgaggagctggggacacttgttacatatcagctcctggcatttcttgacttcaataatacccggaagcggatgagcgtcatcgtccggaacccggagggacagatcaagttgtacagcaagggtgccgacacgattctgttcgaaaagctgcatccaagcaatgaggttctgctatcccttacctcagaccatctgagcgagtttgctggggaagggctaaggacactggctatcgcatacagagatctggacgataagtatttcaaggaatggcataagatgcttgaggacgcgaatgccgctacagaagagagggacgagcgcattgcagggctgtacgaggagatagagagggatctcatgctgttaggtgcaaccgccgtggaagacaaacttcaagaaggcgttattgagaccgtaacaagtctgagcctggctaatataaagatctgggtgctcaccggcgataagcaggaaaccgctatcaacatcggatacgcttgtaacatgctcaccgatgatatgaacgacgtgttcgtcatcgctggcaataacgctgtggaagtacgtgaagagctgagaaaggcaaaacagaacttattcggacagaatcgcaatttctcaaatggtcacgtggtgtgtgagaagaagcagcagttggagttggactccattgtggaagagactatcaccggcgattacgctttaataattaacggacatagccttgcacatgcgctggaaagcgacgtaaagaacgacctgctggaactggcttgcatgtgtaaaactgtcatttgttgcagggtcacccccctccaaaaagcccaggtggtggaactggttaaaaagtaccgaaacgccgtgaccctggcgattggggacggagcaaacgacgtgtcgatgataaagagcgcgcacatcggtgtggggatatccggacaagaggggctccaggccgtgctggctagtgactatagtttcgcccagttccggtatctgcagcgtctgttgctggtgcatggaagatggtcgtattttcgaatgtgtaaatttctgtgctattttttttacaaaaacttcgctttcaccctggtgcatttctggttcggattcttctgtggcttttccgctcagaccgtgtatgaccaatggttcatcacactctttaatatcgtgtacacttccctgcctgttctggccatgggaatcttcgaccaggacgtgtcggaccagaatagcgtagactgccctcagttgtataaacccggtcagctaaatcttctcttcaacaaacgcaagttcttcatatgcgttctccatgggatttataccagcctcgtcttgttctttatcccatacggtgcattttacaatgttgccggagaggacgggcaacacatagccgactaccaaagtttcgcagttaccatggcaacctccctggtgatcgtggtgtccgtccagatcgctctggacactagttattggaccttcattaatcatgtgttcatttggggttccatcgccatctacttcagtatcctattcactatgcactccaatgggattttcggcatcttccccaatcagtttcctttcgttggaaatgccagacattccctgacacagaaatgcatttggttggtcatattgctaaccacagtcgcatctgttatgcccgtcgtggctttccggtttttgaaagtcgacttgtaccctactctttctgaccagatacggcgatggcagaaggcccagaagaaagcacggccaccgagttctcggagaccccgaacacgacgctcatcttccaggcgctcaggatatgcctttgcacaccaggaaggctatggtgagcttattacatcaggcaagaacatgcgcgctaagaacccccctcccaccagtggtctggagaagactcactacaattctacatcctggatagaaaacctctgtaaaaagacaaccgatacagtgtcttcctttagtcaagacaagacggtcaagttgtag

SEQ ID NO: 48466 - DNA, 2736 bp, Artificial Sequence
  Description of Artificial Sequence: Synthetic coding sequence
atggattctcggcctcgggcaggatgctgcgagtggctgagatgttgtggcggaggagaagctcgcccaaggacagtttggctgggacatccagaaaagagggaccagagatatccaaggaatgtcatcaataatcagaagtataacttctttacattccttcccggagtacttttcaatcagttcaaatattttttcaatttgtacttcctgctactggcgtgctcgcaattcgtgcccgagatgagactaggagcgctctacacctactgggtaccgctggggtttgtccttgccgtaaccgtaatccgcgaggccgttgaggaaataaggtgctatgtgagggataaggaggtgaactcacaggtatacagcagattgactgccagaggaactgttgtgggagtagtgttgtatacagggagagagctgagatctgtgatgaacacatccaatcctagaagtaaaatcggtcttttcgatttggaggtcaattgcttaacgaagattttattcggcgctttggtggtagtgtccttagtaatggtggctctgcaacactttgccggaagatggtatttgcagataatacgctttcttctgctgttcagtaatataatcccgatttccctgcgcgtgaatctcgacatggggaagattgtttactcttgggtcatccggagggactctaagattcccggaactgtggtgcggtcatctacaatccccgaacagttgggaaggataagctatctgctgactgacaagactggcaccctgacccagaatgaaatgatattcaagaggttgcaccttggaaccgtggcatatggtttggatagcatggacgaagttcaatcacacatcttcagcatctatacacagcagagccaggatccacccgctcagaagggtcccacccttaccaccaaagtccgcagaaccatgtcttccagagtgcacgaagcggtgaaggccatcgctttgtgccacaacgttacacctgtttatgagtcaaatggtgtcacagaccaggctgaagccgaaaagcagtacgaagattcctgccgagtgtaccaggcctctagtcctgatgaggtggctctagtacagtggaccgaaagcgtgggactcacccttgtggggagggaccagtcttctatgcagcttcggacccctggtgatcagatcttgaattttacgatcctacagatctttccttttacatatgaaagtaaaagaatgggaatcatagtccgcgatgagtctacaggagaaataactttctacatgaagggcgcagatgttgttatggctggcatagtccagtataatgattggctggaagaggagtgcggcaatatggccagggagggcctgcgggtactggtcgtcgccaagaagagcctggctgaagagcaataccaggatttcgaggcacgttacgtccaggcaaagctgagcgtacacgatcgctcactgaaagtcgcaacggtgattgagagcctggagatggagatggaacttctgtgcttaaccggagtggaagaccagctacaggccgacgtgaggcctactttggaaacactgcgtaacgccggaatcaaggtttggatgctgactggagataaactggagacagccacgtgcaccgcgaagaacgcccacctcgtaactcgaaaccaagatatccacgtcttcagactcgttactaaccgaggcgaagcgcacctggagctgaatgcattcaggcgaaagcatgattgcgctctagtgatctccggagacagcctggaggtgtgcttgaaatattacgaatatgaatttatggagttggcctgtcagtgtcctgctgtggtatgttgccggtgcgctcccactcagaaagcccagatcgtgcgtctcctgcaggagcggacaggaaaactcacctgcgctgtgggggacggtgggaatgacgtctctatgatacaggaatccgactgtggagtcggagtagaaggcaaagaagggaagcaggcttccctggcggcagatttttcaatcacccagtttaaacatctcggacgcctgctgatggtacacggtcgcaacagctacaaaaggagtgctgccctgtctcagtttgtgattcaccgcagtctgtgtatttctacaatgcaggctgtcttctcaagcgtattttacttcgccagcgtgcccttgtaccaaggcttcctcataatcggatattctaccatctacaccatgttcccagtattttcgctagtgcttgacaaggatgtgaaatcagaagttgccatgctgtaccccgagctttacaaagatctgctgaagggcagacctctctcctacaaaacatttctcatctgggtgttaatttctatctatcaaggcagcacgattatgtacggagcactgctcttattcgaatccgaattcgtccacattgtggctatttccttcacctcactcattctgaccgagctgttgatggtcgcgctgactatccaaacctggcattggctcatgactgtggccgagcttctctcgctcgcatgttatatcgcctcactggtttttctgcacgaattcatcgatgtatactttatagccaccctgagttttttgtggaaagtgtctgtcattacccttgtaagttgcctacccctgtacgtgctgaagtacctccgacggaggttttctcccccatcatattctaaactcacgtcctag

SEQ ID NO: 48467 - DNA, 3144 bp, Artificial Sequence
  Description of Artificial Sequence: Synthetic coding sequence
atgaccgataacatccccttgcagcctgtcaggcagaagaagagaatggacagtaggcccagggccggatgttgcgagtggttgagatgctgcggcggtggagaagcaaggcctaggactgtctggttagggcacccggaaaagagagaccagcgctacccaagaaatgtcattaacaaccagaaatataacttctttacctttttgcccggtgtattgttcaaccaatttaaatacttcttcaacctgtactttcttcttctggcctgctcccagtttgtgccagagatgagactcggcgcactgtacacctattgggtacctctgggattcgtgctggcggtgacagtcatccgcgaagctgttgaggagatcagatgctacgtgagggacaaagaggtcaattcccaggtctacagtaggctaaccgcgcgagggactgtcaaagttaagtcatccaatattcaggtaggggacctgattatcgtcgagaaaaatcagcgggtgccggcagacatgattttcctccggacctcagagaagaacgggtcttgttttctcaggacagatcagttggatggagagaccgactggaagctccgcctccctgtcgcgtgcacacaaaggctgccaacagccgcagacctactccagataaggtcctatgtatacgctgaggaaccaaatatcgatatccataactttgtgggcacctttactcgcgaagattctgaccccccaatttccgaatccctgtctatcgaaaacacactctgggcaggcaccgtcgtcgcctcggggaccgtcgttggggtggtgctgtacaccggcagggagcttcgttccgtcatgaatacaagtaatccaaggtcaaaaatcggtctgtttgacctggaagtgaattgcctcactaagattttatttggggcactggtggtggtgagcctcgtaatggtggctctgcaacacttcgccggtcggtggtatctgcaaattattcgttttctgctactctttagcaatattattccaataagcctccgtgtgaacttggatatgggcaagattgtatatagctgggtgatccgccgagattcgaagatcccaggcaccgtcgttcggtcgagcacaatacctgagcagctcggtcgcatcagctatttgctcacagacaagacagggacactgactcaaaacgagatgattttcaagcgactgcacttggggaccgtggcctatgggctggactccatggacgaagtgcagtcccacatcttttccatttatacccaacagagtcaggaccctcccgcacaaaaagggcctaccctgacaacaaaggtgaggagaactatgtcaagccgcgtccatgaagccgttaaagcaatcgctctctgccacaacgtcaccccagtgtatgagtccaatggtgtgaccgaccaggctgaggcggagaaacagtatgaggatagttgcagggtgtaccaagccagttcacccgatgaggttgccttggtacaatggaccgagtccgtcggccttacactggtcgggcgtgatcagagcagcatgcagttacgcacacctggggaccagatactgaatttcaccattttgcagatctttccatttacgtacgaatcaaagcggatggggatcattgttcgcgatgagagcacgggagaaataaccttctacatgaaaggagccgacgtcgtcatggcgggaatagtgcagtataatgactggctagaagaagaatgcggcaatatggccagagaaggactgcgcgtgctcgtggtagcgaaaaaatctttggctgaggagcagtaccaggacttcgaagctcgctacgtgcaggccaaactgtccgtgcacgataggtcactgaaggtggctactgtgattgagtcgctggaaatggaaatggagctgttgtgcctcacaggagtggaagatcaattgcaggcagacgtgcgccctaccctcgaaacgctgcgcaatgctggcataaaggtctggatgcttacaggagacaagttagagaccgcaacatgcaccgctaaaaatgctcatttggtgactagaaatcaggatattcatgttttcagactggtgaccaacagaggagaagctcacctggagctgaacgcttttaggcgaaagcacgattgtgcgctcgtcatctctggagactcattggaggtgtgtctgaagtattatgagtacgagttcatggagctggcatgtcagtgtccagccgttgtatgctgtcgctgtgcgccaacccagaaggcacagatagttaggctgttacaggaacgcacggggaagcttacttgcgccgtcggtgatggcggtaatgatgtgagtatgatacaggagtctgactgtggggtaggggtggagggcaaagagggcaagcaagcctctctagcagccgatttcagcatcacccaattcaagcatcttggtaggctgctgatggtacatgggcgtaactcttataagcgcagtgctgctctgtctcagtttgtgatccaccggagtctctgcatcagcactatgcaggccgtcttcagctcagtgttctattttgcttccgtgccgctgtatcagggattcctcatcatcggttacagtactatttacactatgtttcctgtgtttagcctggtgctggacaaggatgtaaaatccgaagttgccatgctctacccagaactgtacaaggatctgctcaagggcaggcccctttcatataaaactttcctgatttgggtcctgatttccatctatcagggctcaacaatcatgtacggggctctgcttttatttgaatcggagtttgtccacatcgtggctatctcttttacctcactaatcctgacagagctcctaatggtcgccttgactatccagacatggcactggctaatgactgtggctgaacttctgtccctggcctgttacattgcctccctggtattcttgcatgagtttattgatgtttacttcatcgccaccctgtcttttctctggaaggtgtcagtgatcaccttggtatcttgtttacccctctacgttctgaaatacctaagacgccgtttctcacccccatcttactctaaactgacatcttag

SEQ ID NO: 48468 - DNA, 2781 bp, Artificial Sequence
  Description of Artificial Sequence: Synthetic coding sequence
atgacagataatatcccactgcagcctgtccggcaaaagaagagaatggattccagaccgagggctggctgctgtgaatggttacgctgctgtgggggaggagaagctaggcctcgaactgtgtggctgggtcacccagaaaaaagggatcagaggtatccaagaaacgtgatcaataatcaaaaatacaatttcttcaccttccttcccggagtcctgtttaaccaatttaaatatttcttcaacctgtattttctactgctggcgtgctctcaattcgtgccagaaatgagactcggggcactgtatacgtactgggtacccttgggatttgtgctcgctgtgacggtaattagagaggctgtggaggaaatccggtgttacgtgcgcgacaaggaagtcaactctcaggtgtactccaggctgaccgctaggggcacggtcgtaggagtagtgttgtatactggtcgagaattgagatccgtgatgaatacatctaaccccagatctaaaatcggtttgttcgacctggaggtgaattgcctaacaaagatcctgttcggcgcacttgttgtggtaagcttagtgatggtcgcactgcaacatttcgctggccgatggtacctgcaaataataagatttctcctgctgttctccaacataatccctatttcactccgcgttaacctagatatgggcaaaatcgtttactcttgggtgatccggagagactccaaaatcccgggtacagtggtccggtcgtcaacaatcccggagcagttgggtcgcatttcctatctgctgactgacaagaccggcactctgacacagaatgaaatgatcttcaagcgtcttcacctgggaacggttgcgtatggactcgactccatggatgaggtccaaagtcatatcttctcaatttacacccagcaaagccaggatcctccagcccagaagggccctactttaaccaccaaggtccggagaaccatgtcctcgagagtccacgaggccgtcaaggcaatcgcactgtgtcacaacgtgaccccagtttacgagtccaatggcgtaacggaccaggcagaggctgaaaaacagtacgaggacagttgccgcgtttaccaggcgagctcacctgacgaggtggcactggttcagtggaccgaatccgtcggccttactctggtgggtcgtgatcagtcttcaatgcagttgaggacacctggcgatcaaatacttaacttcaccatactacagatctttccctttacttacgagagtaagaggatgggtattatagttagagatgagtctacaggagagattaccttttacatgaagggagcagacgtcgtgatggcaggtattgttcagtataacgactggttggaagaagaatgcggcaacatggcgagggagggccttcgggtactagtggtggctaaaaaatctctcgccgaggaacagtaccaagactttgaggcgcgatatgttcaagccaagctgtccgtccacgatagatcactgaaagttgcaacggtgattgaaagtttggaaatggaaatggaattgctgtgccttacgggcgtggaggatcagctgcaggcagatgtacggccaactctggaaacactgcgcaacgcgggtataaaggtctggatgctcactggtgacaagctggagacagccacttgcacagctaagaacgctcatttagttacccggaaccaagacatacacgtctttcggctggtgactaacagaggagaagctcacttggaactgaacgcgttccgtagaaagcacgactgcgcactggtcatctctggagatagtctggaagtgtgtctgaaatactacgaatatgagttcatggagttagcctgtcaatgccccgcagttgtttgttgccggtgcgctcccacccagaaggcccagatagtgcggttgttacaagagcgcaccggcaagctgacgtgcgccgtgggggatggcggtaacgatgtctccatgatacaggaatcggactgcggggtgggcgtagaaggtaaagaagggaagcaggcctccctggcagccgacttttccatcactcagttcaagcatcttggccgactactcatggttcacggtaggaattcttacaaacgctcggccgcactttcacaattcgtcatccaccggtcactgtgtatttccaccatgcaggccgtattctcgagcgtgttttacttcgccagcgtgccattatatcagggctttctcatcatcggctattctaccatctatacgatgttccccgtattcagtctcgtcttggataaagatgtgaaatccgaggtcgcaatgctgtaccccgagctgtataaggacctcctcaaagggcgacctctctcatataaaacttttctgatttgggtcctgatcagcatttatcagggcagtactattatgtatggcgctctccttttatttgaatccgagttcgtgcacatcgtggcaatttctttcacatctcttatacttaccgagctactgatggtggctctgacaatccagacttggcactggctgatgacggtggccgaactcttgagcctggcctgctatattgcatcactggtcttcctgcatgagtttatcgatgtgtattttattgccaccctatcatttctgtggaaagtgtccgtcataacgttagtctcttgcctacctctttatgttctgaagtacttgcgcaggagattttcacccccttcttacagcaagctgacgtcctag

SEQ ID NO: 48469 - DNA, 4386 bp, Artificial Sequence
  Description of Artificial Sequence: Synthetic coding sequence
atggcgctgtctgtcgacagctcctggcatagatggcagtggcgggtgcgcgacggattccctcactgtccaagtgaaactaccccccttctgagtcctgagaagggcaggcagtcttacaacctgacccagcagagggtggtcttcccaaataattccatctttcatcaagactgggaagaagtgtctcggagataccctgggaatcgaacgtgcaccactaaatacactttgtttacctttcttccgcgaaatttgttcgagcaatttcacagatgggccaacctgtacttcctgtttttggtgatccttaattggatgcctagcatggaggtgtttcaccgagagatcacaatgcttccgttggccatagttctcttcgttattatgattaaagacggaatggaagatttcaaaaggcatcggtttgataaagcaattaattgttctaacattaggatctatgagagaaaggagcaaacttacgtccagaagtgctggaaggatgtgagagttggcgatttcattcagatgaaatgtaatgagatagtgccagccgatatactgctgttgttcagtagtgatccaaatggaatctgccatctagagaccgccagtctggacggcgagacaaacctcaaacagagatgcgtagttaagggcttcagccagcaagaggtccagtttgagccagaactattccataacaccattgtgtgtgaaaagcctaacaaccatctgaataagtttaaaggttacatggaacatccagaccaaacccgtacaggtttcgggtgtgaatctttactcctgaggggatgtactattaggaacacggaaatggcagttgggatcgttatctatgccggacacgaaacaaaagccatgctgaacaacagcggtccgcgatataaacggtcaaagatagagaggcgaatgaacatcgatatatttttctgcataggaattctcatcctcatgtgcttaatcggtgctgtggggcactcaatttggaatggcacttttgaagagcatccaccattcgatgtccccgacgcgaacggtagttttctcccctcagccctcggcggattctacatgttcctgactatgataatcctcttacaggtcctgatccccatttcactttatgtttcgatcgagcttgtcaagctgggccaggtgttcttcctgtctaacgacctggacctatatgatgaggagacagatctctctatccaatgtcgcgctttgaacattgcggaggatctcggtcagatccagtatatctttagtgataaaactgggacgttaacagagaacaagatggtgtttcggaggtgtaccataatgggaagtgagtattcccaccaggaaaacgcgaagcggttggagacacccaaggagttggactctgacggggaagaatggactcagtatcagtgtctttcttttagcgctaggtgggcgcaggatcccgcaactatgcgatcccagaagggcgctcagccattgcggagatcccagagcgctcgggttccaatccaggggcactaccgccaacgcagtatgggccatagggagtcatctcagccacccgtggcattttcttcgtctatcgagaaagatgtgacccccgataagaatctgttgactaaggtacgcgatgctgcgctctggctggaaaccttgtccgacagccgacctgcaaaagcatccctgtcaacgacctcctcgatagctgacttcttcctggcactgacaatctgtaattctgtgatggtttcaactactacggaacccaggcagcgcgttactatcaaacccagtagcaaagcccttggaacctctttggagaagatacaacagctgttccagaagttgaaactgttgtccctgagccagtcattcagctccacagcccctagcgacacggatctaggggaatctctgggggctaatgttgccaccactgattcagacgaacgcgacgatgcaagcgtgtgcagtggcggagactccaccgatgacggtggataccgaagttccatgtgggaccagggggacattctggagtccgggtccggaaccagcctggaagaggccctagaagcccctgccacggacctggcaaggcccgaattttgctatgaagctgagtctccggacgaggctgcactcgtgcatgctgcacacgcctactccttcacccttgtaagccgcacccccgaacaggtgaccgtccggctccctcagggaacttgcctaaccttttctttactgtgtaccttagggtttgacagtgtgcggaagcgaatgtctgttgttgtgcgacatcctctcactggcgagatagtggtatataccaagggcgctgactccgtgattatggacttgctagaggaccctgcatgtgtccccgatatcaacatggaaaaaaagctgaggaaaattcgggctagaactcagaagcacctggatctgtacgccagggacgggctgcggaccctttgcatcgcaaagaaagttgtctcagaggaggactttcgccgatgggcaagtttccgcagggaagccgaagcatcactggacaaccgagatgaactgctcatggaaacagctcaacatttggagaatcaactgactctcctgggagccactggaatagaagaccgcttgcaggaaggagtgcccgacactattgccactttacgggaggcgggaatacagctttgggtcctaacaggggacaagcaggaaaccgccgtgaatatcgcgcatagctgcaggctgttgaaccagaccgacaccgtgtatactataaacacagagaaccaagagacttgcgagtccattctaaactgcgccctcgaagagctgaagcagttccgggaactacagaagccagatagaaagctgtttggcttccgcttgcccagcaagactccaagcataacgagcgaggccgtcgtgcctgaggctggtttggtgattgacggcaaaaccctaaatgctattttccaaggaaaattagagaagaaattccttgagttgacccaatactgtcgatccgttctgtgctgtcgctcaaccccactgcagaaatctatgattgttaaactagtcagagataagctccgagtgatgacactcagcattggtgatggtgccaatgatgtcagcatgattcaggccgcagacatcggcattggaatctccggccaggaggggatgcaagccgtcatgtcgtctgatttcgccatcacccggttcaagcacctaaagaaactgcttctggtgcacgggcactggtgctactctcgcctcgcgcgtatggtggtctattacctctataagaacgtttgttatgtgaacctcctattttggtaccaatttttttgcggtttctcctcttccaccatgatcgactactggcaaatgatattttttaacctgttctttaccagcctgcctcccttggtctttggggtcctcgacaaagacatcagcgcagaaacactgctcgccttgccggagttgtacaaatccggccaaaatagcgagtgctataacctgtccaccttctggataagcatggtagacgcattctatcagtcactgatatgcttctttataccgtatcttgcctacaaggggagcgatatagacgtctttacattcggcactccgatcaacaccatctccctcaccaccatcctgctgcaccaggccatggagatgaaaacatggacaatttttcatggagtggtgctcctgggcagcttcctaatgtactttctggtcagcctcttgtataacgctacttgtgttatctgcaacagtcctacgaacccatattgggtcatggagggccagctgtctaacccaactttctatctggtatgttttcttacacccgttgttgcactgctcccaagatacttcttcctgtctctgcagggcacttgcggcaaatccctgatatccaaggcccagaaaatagacaagctccctcctgataagcgaaacctggaaatacagtcttggagatctcgccagagaccagctcctgtccctgaagtagcccgaccaacacaccacccagtctcctcaattaccggtcaggatttcagcgcttcgaccccgaagagttcaaacccacctaagaggaagcatgttgaagaaagcgttctccatgaacaacgctgtggcactgagtgcatgcgggacgacagttgctctggtgacagctctgcccagttgagctccggagaacatctattggggcctaacagaataatggcgtattctagaggacagactgacatgtgtagatgcagtaagcgaagtagccatcgcagaagccagagctctttaacaatctag

SEQ ID NO: 48470 - DNA, 4281 bp, Artificial Sequence
  Description of Artificial Sequence: Synthetic coding sequence
atgacagaggcacttcaatgggcccgatatcattggcgcagactgattagaggtgctactcgagatgacgatagtggcccatataactatagttccttgctagcatgtggaaggaaaagttctcagacgccaaagctgtcaggcagacatagaatcgttgtgccacatatccagcccttcaaggacgagtacgaaaagttttccggcgcatatgtgaacaaccgtattcgcacgactaagtacaccctgctcaatttcgtacccagaaatttgtttgaacaattccaccgggcagctaatctgtacttcctgtttttagtggtgctcaactgggtgccactggtggaggcctttcagaaggaaatcaccatgctgcccctggtggtggtgcttaccattatcgcaatcaaggatggtctggaggattaccgcaagtacaaaatcgacaagcaaataaataacctgataacgaaggtatattccaggaaagagaagaagtatatagaccggtgctggaaggacgtgactgtcggcgactttatacggctatcctgtaatgaggtgataccagccgatatggtgctgctgttctcaaccgaccctgatgggatctgtcacattgaaacttccggcctggacggcgagagtaaccttaagcagcggcaggtggtgcgcggttacgccgaacaagactctgaagttgatcctgagaagttttcctctcgaatcgaatgcgagagccccaataatgatctctctagatttcggggattcctcgaacatagcaataaagagcgcgtcgggttatccaaggaaaacctgctgctgcgtggctgtacgataaggaacaccgaggctgtggttgggatagtggtctatgcaggccacgagactaaagccatgctcaataattctggcccaagatataagagatccaaactagagcgccgagctaatacagacgtcctgtggtgtgtcatgcttctcgttatcatgtgcctgactggggctgtaggccacggcatatggctctcccgatacgagaagatgcacttctttaatgtgcctgaaccggacggccacattatctcacccttactggcagggttttacatgttctggactatgataattctcctccaagtcctcatcccaattagcctgtacgtctcaattgaaatagtgaagctgggacagatttatttcatccagtctgacgttgatttttacaatgagaaaatggattcaatagtccagtgtagggcattgaatattgctgaggacctcggccagatccagtacctcttttccgacaagacaggcacactcactgaaaacaaaatggtcttccgaagatgttccgttgccggattcgactactgtcacgaagagaacgccagaagacttgagtcttaccaggaggcagtctcggaagacgaggacttcatcgacaccgtttccggctccctgtccaatatggctaagccgcgtgccccatcctgtagaactgtccacaacggtccactcggcaacaagccgtcaaatcatctggctgggtcgtccttcacattgggatccggagagggcgcttcagaagtcccacactcccgacaggccgctttttcatcgcctatagagactgatgttgtgcctgataccagattactagataagttcagtcagataacaccgaggttgttcatgccactggatgaaaccattcagaatccgccaatggaaactctttatattattgatttttttatcgcacttgccatttgtaataccgtggttgtcagcgctcccaaccagcctagacagaagatccgccacccttcattgggaggactcccgattaaatcactggaggagattaaatctctgtttcaacgctggagcgtgaggcggtcctcaagtccctctctcaacagcggcaaagagccaagttccggggttcccaatgcctttgtctctcgacttcctttatttagtcggatgaagcctgcctctcctgtggaggaggaggtgtcccaggtgtgcgagtcacctcagtgttcgtcaagcagtgcttgttgcaccgagaccgagaaacagcacggggatgccggacttctcaacgggaaggcagagtcacttcccggtcagccactggcctgtaatctctgttacgaggccgaaagccctgacgaggccgctctggtgtacgcggctagagcttaccagtgtacactacgcagtcggactcccgaacaggttatggttgacttcgccgcactgggccctctgacgtttcagttgctccacatcttgccctttgactcggtgcgaaagagaatgtccgtggtagtccgccaccccctcagcaaccaggttgtcgtctatactaaaggagcagactctgttattatggagctattaagcgtggcctcccccgatggcgctagcctcgaaaaacagcagatgatagtgcgagagaagacacagaaacacttggatgactatgccaagcaggggctcaggacactttgtatagccaagaaagtcatgtctgataccgaatatgctgaatggctcaggaaccacttcttagctgagacgtccatagacaatagggaagaacttctcctggagagcgctatgcgtttagagaacaagctgactctgttgggagcaacagggatcgaagaccgcctacaagaaggagtgccagaaagcatcgaggcattacacaaggccggtattaagatctggatgctgactggagacaagcaggagactgcagtgaatatagcttatgcctgtaaactgctggaaccagatgacaaactctttattttaaatactcagtccaaagatgcttgtggcatgctgatgagcactatcttaaaggagttacagaaaaaaactcaggccctccctgagcaagtctcgttgagtgaagatctgctccagccgcctgtgccccgagacagtggcctgcgggctgggctgattatcacagggaaaactctggagttcgcattgcaggagtctctgcaaaagcagtttcttgagctgacctcatggtgtcaggctgtcgtgtgctgtcgcgcaacccctctccagaagtccgaggttgtcaaactagtccgtagccatttgcaggtgatgacactggcaatcggggacggggctaatgatgtttcaatgatacaggtcgccgacattgggatcggtgtctcagggcaggagggcatgcaagccgtgatggcgtcagatttcgccgtgtctcagtttaaacatctgtccaaactactcctggtacacggccactggtgctatacaagactgtctaacatgatcctctattttttctataagaacgttgcttacgtcaacctgctgttctggtaccagttcttctgcgggttcagcggcacctctatgactgattactgggtccttattttcttcaacctgttattcacctctgctccgccagtgatttacggggtattggaaaaagatgtatcggccgagacccttatgcagctgcccgagctttataggtcagggcagaaatctgaggcttatctgccccatactttttggatcacactgctcgacgccttctatcagagcttggtatgcttcttcgtcccctattttacgtaccagggcagcgacacagacatcttcgccttcggcaacccactgaatacggcagcgctgttcatagtactcctgcacctggtgattgaatcaaagtcactcacctggattcatctcttagtgattatcggcagcatcctgagttattttcttttcgctatagtgttcggggcaatgtgcgttacatgtaacccgccatccaacccttattggatcatgcaggaacatatgctcgacccagtattttacttggtgtgtatactaactacaagtattgctctgctgccaagattcgtctatagggtgctgcagggatcgctttttccttcgccaattctcagggcgaagcatttcgataggctaacgccagaggaaagaacaaaagcattaaagaaatggcggggtgcgggaaagatgaaccaggttaccagtaagtatgccaaccaatccgcaggtaaatcaggccgaagacctatgcccggaccatcagctgtatttgccatgaagtcagcctcaagctgcgccatcgaacaaggaaacttgtcattatgcgaaactgcgctggatcaaggctattctgagaccaaggccttcgaaatggctggaccatctaagggaaaggagtcttag

SEQ ID NO: 48471 - DNA, 1608 bp, Artificial Sequence
  Description of Artificial Sequence: Synthetic coding sequence
atgacagaagcgctgcagtgggccaggtatcattggaggagacttattagaggagctacccgcgacgacgactctgggccatacaactacagttcactcctggcctgcggacgcaagtcctcccagacccccaagcttagtggtaggcaccgaatagtggtcccacacattcaaccctttaaggacgaatacgagaaattttctggcgcatacgtgaacaatcggattcgaactacaaaatataccctgctgaattttgttcctcggaacctgtttgagcagtttcacagggccgctaatctgtatttcctgttcctggtcgtgctaaactgggtgccacttgtggaggcattccagaaggagataaccatgttgccactggtagtagttttgactatcattgctatcaaagatggcttggaggattaccgtaaatataagatcgacaaacagataaataatctgatcactaaagtatactcccgcaaggagaaaaagtacatagacaggtgttggaaagatgtcaccgtgggcgactttatccgcctgagttgtaacgaggtgattcccgcagatatggtgctccttttctcaactgaccccgatgggatatgccacattgaaacctctggcttagatggagagtctaatctgaagcagagacaagtcgtgcgaggatacgcagagcaggatagcgaggtggatcctgagaaattctcctcgagaattgagtgtgaatcccccaataatgacctcagcagattccgtggatttctggagcactccaacaaagagcgggtgggcctatctaaggagaacctgcttctgagaggatgcacaatacgaaacacggaagcggtggtgggaatcgtggtgtacgcgggacacgaaaccaaagccatgctgaataacagtggccctaggtataaaaggtctaagttggaaagacgcgcaaacactgacgtgctctggtgtgtgatgctcctagttatcatgtgcctgaccggcgctgtaggacacggaatctggctgagcagatatgaaaaaatgcatttctttaacgtgcccgagcctgatgggcacattatttcaccgctcctggccggattctacatgttttggacaatgataatcctccttcaactgggccaaatctactttattcagtccgatgtggacttttacaatgagaagatggattcaatcgtgcagtgccgagcccttaatatcgcggaggatctggggcaaattcaatacctgttctcagacaaaacaggaaccctcacagagaataagatggtatttcgaaggtgttccgtggctgggttcgactattgtcatgaagagaacgcacgtcgactcgaaagttatcaggaagccgtctcagaagacgaggatttcattgacacagtctcaggctccctgagcaatatggctaaacctcgtgccccaagctgcagaaccgtgcataatggccctctgggaaataaaccaagcaaccatcttgctggtagctcgttcacactgggctcaggcgagggtgcctctgaagtgcctcacagtcgacaagccgcattcagctccccgatcgtttccatgaacgcatag

SEQ ID NO: 48472 - DNA, 3399 bp, Artificial Sequence
  Description of Artificial Sequence: Synthetic coding sequence
atgcagatggttcccagtctgccccctgcatcagaatgtgctggtgaggagaagcgcgtgggcacccgtaccgtgttcgtgggcaaccaccccgtttcagaaacagaagcatatatcgctcagcgcttttgcgataatagaatcgtgtcgtccaagtataccctctggaatttcctgcctaagaatctgttcgagcagttccgacggattgccaatttctacttcttgatcatttttttagtgcaggtgacggttgacactcccacatccccagtcaccagtgggctcccgctgttctttgtcatcactgtgacagcaattaaacaaggatatgaggattgtcttcgccatagagccgacaacgaggtgaacaagtctacggtatacataattgagaacgccaagcgagtgcgtaaagagagcgaaaaaatcaaggtgggagatgttgtcgaggttcaggccgacgagacctttccctgtgatttaattttgctgtcgagctgtacaacagacggaacatgttatgtaaccaccgcctcactagacggagaatcgaactgtaagacccattacgcggtccgggataccatcgctctgtgcaccgctgaatctatcgatacactccgggctgccatagaatgtgagcaacctcagccagacttgtacaaattcgttgggagaatcaatatctacagcaattctctagaggccgtggcccgaagcctgggacccgaaaatctcctcctcaaaggagccacactgaaaaatactgaaaaaatctacggcgtggcagtgtatactggcatggaaacaaaaatggccctcaactaccagggcaaatcgcagaagcgctctgctgtggagaagtccattaatgctttccttattgtgtacttgtttatactgctgacgaaggccgctgtttgcacaaccttgaaatacgtatggcagagcacaccatacaacgacgagccctggtataaccaaaaaacccaaaaggagcgagagaccctgaaggtgttgaaaatgtttactgacttcttgtcatttatggtgctgtttaacttcattataccggtgagcatgtatgtgaccgtggaaatgcagaaatttctgggctcatttttcatctcatgggacaaagatttctacgacgaggagatcaacgaaggcgctctcgtgaacacttccgacctgaacgaagagctgggccaggtggattacgtgtttactgacaagaccggaacgcttaccgaaaactcaatggaatttatcgaatgctgtattgatggccataaatacaaaggagtgacccaggaagtggacggactgagccaaaccgatggaacactcacatatttcgacaaggttgacaaaaatagggaagaactctttcttcgtgctctttgtctgtgccacactgtggaaatcaagaccaacgacgcggtcgatggagctaccgagagtgcggagctgacctatatctcttcttctcccgatgagattgctctggtgaaaggagctaagaggtatggcttcacattcttgggtaaccgaaacggatatatgcgtgtggagaatcagagaaaggaaattgaagaatacgaactgttacacaccttaaattttgatgctgtcaggcgacgtatgtctgtgatagtcaaaactcaggagggggatatccttctgttctgtaaaggcgcagattctgccgtgtttcctagagtccagaatcatgaaatcgaattgacaaaagtgcacgttgaaaggaatgccatggacgggtaccgaaccctctgcgtagcattcaaagagatcgctccagacgactacgaaagaataaatcgccagcttatcgaggccaagatggccttacaggatcgggaagaaaagatggagaaagtttttgacgatattgaaacgaatatgaacttgatcggcgcaaccgccgtggaggataagctgcaggaccaggctgccgagacgatagaggcattacatgccgcaggtcttaaggtctgggttcttaccggcgataaaatggagacggctaagagcacctgctatgcttgccgcctgtttcaaacgaacacagagctgctggagttgaccacgaaaactatcgaagaaagtgaaaggaaggaggatcgccttcacgagctgttaatagagtatcggaagaaactgctgcatgaattcccgaagagtactcgctcttttaagaaagcctggaccgagcaccaagagtacggattaattatagacggaagcacgctgtcactgattcttaactcctcacaggacagttcatcgaacaactacaagagcattttccttcagatttgtatgaagtgtacggccgtgttgtgctgccggatggctccactccagaaagcacagattgtaagaatggtgaaaaacctaaaaggcagcccaattacactctccattggagacggtgccaacgacgttagcatgatcctggagtctcatgtgggaattggcataaagggaaaggagggcagacaggcagctaggaatagcgactactctgtccccaagtttaaacatctgaaaaagctgctgttggcgcatggccacctgtactacgtgcgaattgcccatctggtccagtacttcttctacaaaaatttgtgctttatcctgccccagtttttgtaccagttcttttgtggttttagccaacaaccactctatgatgcggcttatcttactatgtacaatatatgcttcactagcctcccaatcctggcatacagtctgctggaacagcacatcaatattgacacccttacctctgacccacgcctgtatatgaagataagtgggaatgccatgctgcagttgggaccatttttgtattggacctttctagcggctttcgagggaactgtctttttcttcggtacctactttctctttcagacagcctccctggaagaaaacggtaaggtgtatggtaattggactttcgggacaatagttttcactgtgctggtcttcacagtgaccctgaagctggccctggacacacggttctggacttggatcaatcatttcgtgatctggggatctttagccttctatgtattcttttcttttttttggggagggatcatctggccctttctcaagcagcagaggatgtactttgtgttcgcacaaatgctatccagcgtgtcaacgtggcttgcaataattttgctgatcttcatctccctgtttccggagatcctgctgatagtgctaaagaacgttcggagacgaagtgctcggcgtaacctgtcctgcaggcgagcctccgattctctctcagcgaggccatctgtgcgccctctcctgctccgcaccttctcggacgaatccaacgtgctgtag

SEQ ID NO: 48473 - DNA, 3327 bp, Artificial Sequence
  Description of Artificial Sequence: Synthetic coding sequence
atgcagatggtgccctctttgcctccagccagcgaatgcgcaggtgaagagaagcgggtcggaacccgcactgtttttgtcggcaaccacccagtcagtgaaaccgaggcttatattgcccagcgattctgtgacaataggattgtgagctcaaagtatacgttatggaatttcctgcccaagaatttgttcgagcaatttcgcagaatcgcgaacttttattttctgataatatttctggtgcaggtgactgtggacactcctacttccccagtgacttctggcctcccactgttcttcgtgataactgtgactgcgattaagcagggttatgaggattgtctgaggcaccgggcagataatgaagtgaacaaaagcaccgtctatatcatagagaatgcgaagcgcgttcggaaagaatccgaaaagattaaggtgggggatgtagtcgaagtgcaagccgacgaaactttcccatgcgatctcatactcctgtcttcgtgcaccaccgacggaacatgttacgtaaccacggccagcctggacggagagtctaattgcaagacacattatgccgtccgcgatactatcgcgttatgcactgcagaaagcatagatactcttcgggcagctatagagtgtgagcaacctcagccagatctgtacaagttcgtggggcgtataaacatctactccaacagtctggaagctgtggcacgcagccttggaccagagaatttactcctgaagggagctactctgaagaacacggaaaaaatttacggagttgctgtatacacaggaatggaaaccaaaatggcattaaactaccagggaaagagtcagaagagatctgccgtcgagaagtctatcaatgcttttcttatcgtatacctcttcattctgctgactaaggctgcagtctgcacgacattgaaatacgtgtggcagagtaccccatacaacgatgagccctggtacaatcagaagactcagaaggagcgggagacattgaaggtgctaaagatgtttaccgattttctatcattcatggtgctgttcaactttattatcccagtgagcatgtacgtaacagtggaaatgcagaaatttttggggtcctttttcatctcttgggataaggacttttacgatgaggaaatcaatgagggggctttggtcaacacctccgaccttaatgaggagttgggccaagttgactacgtgttcaccgacaagaccggcactctgacagagaactctatggagtttatcgagtgttgtattgacgggcacaagtacaaaggtgtgacccaagaggtggatggcctgtcccagactgacggaacgctgacttattttgataaagtggacaaaaaccgggaggaattgttccttcgtgctctgtgcctgtgccacacggtagaaatcaaaaccaacgacgccgtggatggagctaccgaatctgcagagctcacctacatctcctccagccctgacgagatcgcattagtgaagggtgccaaaaggtacggctttacctttctgggcaatcgaaacggctacatgcgtgtggaaaatcagaggaaagaaattgaagagtatgagctgcttcatactttgaactttgatgccgtcaggcggagaatgtctgttatcgtgaaaacgcaggaaggcgatatactgttgttctgcaagggcgctgattctgccgtgttcccacgcgtacagaatcatgagatcgaattgactaaagtgcatgtggagaggaacgctatggatggatataggacattgtgcgtggcctttaaagagattgcgcctgacgactacgagcggataaatcgtcagctgattgaggcaaagatggctctgcaggatcgggaggagaagatggagaaagtgttcgatgatatagaaacgaacatgaacctgataggcgcaacagccgtggaggacaagttacaggatcaggcagctgagacaattgaggccctgcatgccgcaggcctgaaggtgtgggtcctgaccggagacaaaatggagaccgcaaagtccacttgctatgcctgcagactatttcagactaatactgagcttctcgaactgaccactaaaacgatcgaagagagcgaacggaaggaagaccgcctccatgaactcctgatcgaatacagaaagaaattactgcacgagttccccaaaagtacccgctctttcaaaaaggcgtggacggaacaccaggagtatggtctcatcattgacggatcgacattatcactcatcctcaactcgtcccaggacagctctagtaataattacaagtccatattcctccagatatgtatgaaatgtacagcggtcctctgttgtcgtatggcacctctgcagaaggcacagatcgtgagaatggtaaagaacttgaaggggagccctattaccctttccattggcgacggcgctaacgatgttagcatgatattggagtctcacgtgggcattgggattaaaggaaaggaaggcagacaggcggcacgcaactccgactattccgtccccaagttcaaacacttaaagaaactcctgctggctcacgggcacttatactatgtgaggattgcacacctggtgcagtatttcttttataagaacttatgttttattctccctcaatttctctatcagttcttttgcggcttctcacagcagccattatatgacgccgcatatctcaccatgtataacatttgctttacctccctgccaattttagcatattctctacttgaacaacacattaacattgacaccctcacttcggatcccagactgtacatgaaaatttccggcaatgcaatgcttcagttaggcccatttctgtactggacatttttggctgcattcgagggtactgtgttcttcttcggcacctacttcttgtttcagaccgcatcactggaagagaatgggaaggtctatgggaactggacttttggaactatcgtcttcactgtgctggtgttcacagtgactctgaaactggccttggataccagattttggacctggataaatcactttgtcatttggggttccctggcattctacgtattttttagctttttctggggcggtattatttggcctttccttaagcagcagagaatgtatttcgtattcgcacagatgctgagtagcgtgagtacctggctcgccatcattctgttaatattcatatccctcttccccgagattctgctaatcgtgcttaagaatgtcaggagacggagtgccagagtgcatcatctgatttctagtagcgcctag

SEQ ID NO: 48474 - DNA, 3360 bp, Artificial Sequence
  Description of Artificial Sequence: Synthetic coding sequence
atgcagatggtgcccagcttaccgcctgcatcggagtgcgcgggtgaggaaaagcgggttggtacccgtaccgtgtttgtgggcaaccaccccgtgtcagaaaccgaggcatacattgcgcagaggttctgtgacaaccggattgtgtccagcaagtacacactgtggaatttcctcccaaaaaatttgtttgaacaatttcgcagaattgccaatttctattttcttattatcttcctagtccaggtcacggtggatactccgacctctccagtaacaagtgggctccctttgtttttcgtgatcactgtgaccgccattaagcaaggttacgaggactgcctcagacacagggccgacaatgaggtcaacaaaagcacggtttacatcatcgagaacgccaagcgcgtccgcaaagagagcgaaaagatcaaggtgggggatgttgtagaggtgcaagccgatgaaactttcccctgcgatctgattttgttgagttcttgcaccactgacggcacatgctacgtgactacagcgtcacttgacggggagtctaactgcaaaacacactacgccgtgagagatactatagctctgtgtaccgctgagagcatcgatacactccgcgcagctatagaatgcgagcagccacaacctgacctgtataaatttgtgggccgtatcaacatatattcaaatagcttagaggcagtggccaggagcctgggcccagagaatctgttgttgaaaggagccactctgaaaaatacagagaagatttacggagtcgctgtctacactgggatggagacaaaaatggctcttaactatcaggggaagtcacaaaagaggagcgccgtagagaaatctattaacgccttcctgatagtgtacttatttatactgctcaccaaagccgctgtctgtaccacgctgaagtatgtgtggcagagcactccgtacaatgacgagccctggtataatcagaaaactcaaaaggagagagagaccctcaaagttctgaagatgtttacagattttctcagttttatggtgctcttcaactttatcatacctgtctcaatgtatgtgacggtagagatgcagaaattcctggggtcgttcttcataagctgggacaaagacttttatgatgaggagataaacgaaggcgctctcgtgaatacaagcgacctcaatgaggaactgggtcaagtggactatgtgtttacggacaagacggggacccttacggagaatagcatggaattcattgaatgctgcatcgacggccataagtacaagggcgtgacacaagaggtggatggcctgagccagacggatggcactctgacctactttgacaaagttgataaaaacagggaggaactctttcttcgggctttatgcctctgccacacagtggagatcaaaactaacgacgcagtggatggagccaccgaaagcgcagagttgacctatattagctccagccccgacgagattgcactggtgaaaggagccaaacgatacgggtttacatttctggggaaccggaacgggtatatgagggtggaaaaccagcgcaaagagatcgaggaatatgaactgttacatacacttaattttgacgctgttcgtcgcagaatgtctgtgatcgtgaagacccaggagggagacatcctcctgttttgcaaaggcgcagatagtgcagtctttcctcgcgtccagaaccacgaaatcgagctcaccaaggtgcacgttgagcgcaatgctatggatggctaccgcaccctgtgcgtggccttcaaggaaatcgccccagatgattacgagagaatcaacaggcaattgattgaggcaaagatggcgctgcaggaccgtgaggagaaaatggaaaaggtctttgatgatatcgaaaccaatatgaacctgataggcgctacggcagtggaagataagctccaggatcaagcggcagaaacgatcgaggctctgcacgccgctggactcaaggtttgggtactgaccggagataaaatggagaccgcaaagtcaacatgttacgcatgtcgcctattccagaccaataccgaattgctggaactgacaaccaaaacaattgaggagagcgaacgcaaagaagacaggcttcacgagctgttaattgagtatcgcaagaagttgttacatgagttccctaaaagtacgcggagttttaagaaagcctggactgagcatcaagaatacggactgataatcgatggatcaacattgtcgctgattctcaactcctcacaagactcttcaagcaacaattataagagtatttttttgcagatctgcatgaaatgtacagctgtgctgtgctgtaggatggcaccccttcagaaggctcaaatcgtgcggatggtgaaaaatctcaagggatcccctattacactgagtatcggggatggggcaaatgacgttagcatgatcctggaaagccacgtagggatcggcataaaaggaaaggaaggccgacaagccgctagaaactctgactacagcgttccaaaattcaaacacctgaaaaaactgctccttgctcatgggcatctatattatgtgcgcattgcccatcttgtgcagtattttttttacaaaaacctgtgtttcattctccctcaattcttataccagttcttctgcggctttagtcaacagcctttgtatgacgccgcttacctaactatgtacaatatctgctttacctcactgcctattttggcgtattccttactggagcagcacatcaacattgatacacttaccagcgacccacgcctgtatatgaagatcagcggaaatgcaatgctgcaactaggacctttcctgtattggacctttctcgctgctttcgaaggtactgtctttttcttcggaacctacttcctttttcaaacagctagcctggaggagaatggcaaggtttatggtaactggacattcggcacaatagtctttactgtgcttgtttttaccgtgacattgaagctggctctcgatacccgattttggacctggattaaccacttcgttatctggggttctctggccttctacgtcttcttttctttcttttggggcggtattatatggccattccttaagcagcagaggatgtattttgtttttgcacagatgctttcatccgtgtccacatggctggccatcatcctcttgattttcatctctttgtttcccgaaatattgcttattgtgcttaagaatgtccggagacgctcggctagaaaccccaacctggagcttcctatgctcctatcgtataagcataccgattccgggtacagttag

SEQ ID NO: 48475 - DNA, 3387 bp, Artificial Sequence
  Description of Artificial Sequence: Synthetic coding sequence
atgcagatggtgccatccctgccacccgctagcgaatgcgctggggaagagaagcgagttggcacacgaactgtttttgtgggaaaccatcctgtttctgaaaccgaggcgtatatcgcgcagcggttttgtgataaccgaatcgtgtcgtctaagtacacattgtggaacttcctccccaagaatctgttcgagcaattccgtaggattgctaacttctactttctgataattttcctcgtccaagtcaccgtggatacacccacttcacccgtgacctcgggtctgccactgttctttgtaatcacagtaacagctatcaaacagggctacgaggattgtctgagacatcgcgctgacaacgaggtgaacaaaagcacagtatacataattgaaaacgctaaacgcgttcgaaaagagtcagaaaagattaaagtaggagacgttgtggaagtgcaggctgacgagacgtttccgtgtgacctgatcctcctgagctcttgcacgacagacggcacgtgctacgtgaccactgctagcctcgatggagaatcgaattgcaagactcactatgctgtgagagacactattgctctctgcacagcggaaagcatcgacaccctgagggccgctattgagtgtgaacagcctcagcctgatttatataagttcgtcgggaggatcaatatttacagcaattctctcgaggcagtggccaggtctctgggaccagaaaatttgctgctgaagggggctaccctcaagaacactgagaaaatctatggcgtggcggtgtacaccggcatggagacaaagatggcccttaattaccagggcaagagtcaaaagagatccgccgttgagaagtcgattaatgccttcctcatcgtttacctgttcattttgctgaccaaggccgctgtgtgcaccacgctcaagtacgtatggcagtcaaccccttacaacgatgaaccctggtataaccagaagacgcagaaggagagagagactctgaaggtactaaagatgttcaccgacttcctgtcctttatggtgttgtttaactttatcattccagtgtcaatgtacgtgaccgtcgagatgcagaaatttcttggcagcttcttcatcagttgggataaggatttttatgatgaagagatcaacgaaggagccctggtgaatacctccgacctcaatgaggaattgggacaagttgactatgtctttactgacaagacagggaccctcaccgaaaatagtatggagtttatcgagtgttgcatagatggccacaaatataagggcgtcacacaggaagtggacgggctgagccagactgacggcactttaacctactttgacaaagtggataaaaatagagaagaactgtttctgcgggctttatgtctttgccacactgtcgagatcaagaccaatgacgccgtcgatggagccaccgagtctgcagagttaacatatatttcatctagccctgacgagattgccctagtcaaaggagccaagcgctatgggttcacctttcttgggaacagaaatggatacatgagagtagagaaccagcggaaagagattgaagaatatgagctcctccataccttgaactttgacgcagtgcgccgtcggatgagtgttattgtgaaaacacaagaaggtgacatcctgcttttctgcaaaggagcagattccgctgtgtttccaagagtccagaaccatgagatcgagctgactaaggtccacgttgagaggaatgcaatggacggctaccgaaccctctgcgtcgctttcaaagagatcgcaccagatgactacgaacggatcaatcggcagttgatcgaggcaaaaatggccttgcaagatcgcgaggagaagatggaaaaagtgtttgatgacatcgaaactaatatgaatttaatcggcgctactgcagttgaagataaattacaggaccaggctgccgaaacaatcgaagccctacatgctgcaggtctgaaggtctgggtattaactggtgacaaaatggagaccgcaaagtcaacttgctatgcctgccgactattccagaccaacacagagcttcttgagcttacaacgaagactatcgaggagtcagaacgtaaagaggaccgattacatgaactcctgattgagtacagaaagaagctactgcacgaattcccaaagtccacgcgcagctttaagaaggcctggactgagcatcaggaatacggtctgatcatcgacggatctaccttatcactgatcttaaactcatcccaggattccagtagcaataactataagtcaatcttcctccaaatttgcatgaagtgcaccgccgtgctgtgttgtagaatggccccactgcagaaggcccaaattgtcagaatggtaaagaatttgaaaggatcaccgatcaccctgagcatcggggatggagcaaacgacgttagcatgattcttgagtcacatgttggaatcgggatcaagggtaaggagggcagacaggctgctagaaattctgattattcagtccctaaatttaaacatctgaagaaattgcttctggcccacggccacctgtactacgtgagaatcgcacatctggtgcaatattttttctacaaaaatctttgttttatcttgccccagttcctctaccagtttttttgtgggttttcccagcagcctctgtatgacgcggcttatttgacaatgtacaatatctgcttcacaagccttcccattctggcatactccctcctggagcaacatatcaatatcgacaccctgacatccgacccacggctttatatgaagatctctggaaacgctatgctgcaattagggccattcctttactggacctttctggccgctttcgaaggtaccgtgtttttttttggcacttactttttgttccagacagcatctttggaagagaacggcaaggtctatgggaattggaccttcggtactatcgtgttcaccgtccttgtgtttacagtgactctgaagcttgccctagatactaggttctggacttggattaaccacttcgtgatctggggatccctggccttctacgtatttttctcctttttctggggcggtatcatttggccctttcttaaacaacagcggatgtactttgttttcgcccagatgctgtctagtgtcagcacatggttggccatcatcctactcatcttcattagcctgttcccagagattctactcattgtcttgaaaaacgtcagacgaagatctgcacgcgtcacgaaacgtcttcctagctcaggaacctcagctattttcatgctgagccagacttcttcaaatcacagcttttcctggagtgagtag

SEQ ID NO: 48476 - DNA, 3342 bp, Artificial Sequence
  Description of Artificial Sequence: Synthetic coding sequence
atgttccgcagaagtctgaaccgattttgcgcgggtgaggaaaagagagtgggcacacgaactgtctttgtggggaaccatccagttagcgaaactgaggcctatatagcacagagattttgcgataaccgaatcgtgtccagtaagtataccctctggaacttcctgccgaagaacctttttgagcaatttcgcagaattgctaacttctacttcttgatcatctttctcgtccaggtcactgtcgacacaccaacaagccccgtgacgagtggcttacctttattctttgtcattacagtgaccgctattaagcagggttatgaggattgcctccgccatagggcagacaacgaggtgaacaagtcaacagtgtatattatcgaaaacgccaagcgggttagaaaagaatcggagaagattaaagtgggagatgtggttgaggttcaggccgatgaaacattcccatgtgacctgattctgctgtcgtcttgtaccaccgacggaacctgctacgtaaccaccgcatccttggatggcgagagcaattgtaagactcactacgctgtgagagacaccatcgcactgtgtaccgccgagtccattgacaccctgagagccgcaatagaatgcgagcagccacaacctgatctctacaagtttgtcggtcggattaatatttattccaactcccttgaggcagtggcgagatctttgggcccagagaatctgctactcaagggagccaccttaaagaacactgaaaagatttatggagtggctgtctataccggcatggagactaagatggccctcaattaccaggggaaatcacagaaacgatcagccgtggagaagagcatcaacgcatttctgattgtttatctgttcatcttgttgactaaggcagctgtttgcaccacacttaaatatgtgtggcagtctactccatataacgacgagccttggtataatcaaaaaacccaaaaggagcgagagacactgaaagtcttgaagatgtttactgacttcttgtccttcatggtgctttttaattttatcatccccgtaagcatgtacgtcacggttgaaatgcagaaatttctcggcagtttcttcatttcctgggataaggacttttacgacgaggagattaatgagggggctttggttaacaccagcgatttgaatgaagagctggggcaggtcgattatgttttcacggataaaacagggaccctgacagaaaactctatggaatttatcgagtgttgtatagatggccataagtataagggagttacacaagaagtcgatggcctgtctcagactgacggaaccctcacttattttgataaagtggataagaaccgcgaagagctctttttaagggcattgtgtctttgtcacaccgtggaaattaagactaacgacgcggtggatggcgctacagagtccgcagaactgacctacatcagttccagccctgacgaaattgccctggtaaagggggcaaagcggtacggctttacattcctaggaaatagaaacggttacatgagggtggagaaccagcgaaaagaaattgaggagtatgaattgctccatacccttaactttgacgcagtccgacgcaggatgagcgtcattgttaagacccaggaaggagatatcttactgttctgtaagggagccgactctgctgtattccctcgggtgcagaaccatgaaatcgagcttactaaggtgcacgtcgaacgcaacgccatggacggatatcgcactttgtgcgtggctttcaaggaaattgcccctgatgactatgaacgtataaatcggcagttaatcgaggcaaaaatggctttacaggaccgcgaagaaaaaatggaaaaagtgttcgacgacatcgaaacaaatatgaacctcattggagccaccgctgtagaagacaagctgcaggatcaggccgctgagacaattgaggctctgcacgctgccggacttaaagtgtgggtgctgactggggacaaaatggagacggccaagtcaacttgttacgcgtgtcggctcttccagacaaatactgagctcctggagctcactacgaaaactatcgaagaatcagagagaaaggaggataggctacatgagctgcttatcgagtaccggaaaaaattgctccacgaatttccaaagtccacgaggagcttcaagaaggcatggacggagcaccaggaatacggacttatcattgacgggtctacactctctcttatactcaatagcagtcaagactccagctccaataactataagagtatcttcttgcagatttgcatgaaatgcactgccgttctctgctgccggatggccccattgcagaaggcccagattgtacgtatggtcaagaacctgaaggggagccctattaccctctctattggcgacggtgctaacgacgtgtcaatgattcttgagtctcacgtgggcattggaaaggaaggacgccaggccgctcgcaactctgattatagcgtccccaagttcaagcacctcaagaagctgctgcttgcacacgggcacctatactacgtgcgcatcgcccatctggtacagtacttcttctataaaaacctatgcttcattttaccccaatttctgtatcaattcttttgcggcttttcccagcagccactgtatgacgctgcatacctcacaatgtacaatatatgctttacctccctacccatcctggcctatagccttctggaacaacacattaacatcgacaccctgaccagcgatcccaggctctacatgaaaatatccgggaacgctatgctgcaattgggcccattcctgtactggacttttctggccgctttcgaaggaaccgtcttttttttcggcacgtacttccttttccaaacagcatctttggaggaaaatgggaaggtctacggcaattggaccttcgggactattgtatttactgttctcgtttttaccgttacactcaagttggcgctggatactcggttctggacgtggataaaccacttcgtcatttggggctctctggccttttacgtgttcttcagcttcttttgggggggaataatctggcctttcttgaagcagcagaggatgtattttgtgtttgcacagatgctgagctcagtcagcacttggctggccataattctgttaatctttatcagcctgttcccagagattctgcttatcgttctcaagaatgttcgcagaaggtctgcacgaaaccccaacctggaactgcctatgttactctcttataaacatactgactccggatactcatag

SEQ ID NO: 48477 - DNA, 609 bp, Artificial Sequence
  Description of Artificial Sequence: Synthetic coding sequence
tgagagtgctgcattgacggacacaagtacaaaggcgtcacacaagaggtggacgggctgtcccagactgacggaaccctgacatactttgataaagtcgacaaaaatcgcgaagaactgttcctgcgagccctgtgtctgtgtcatactgtagaaattaagaccaacgacgccgtggacggagctactgagagtgctgagctaacctacatttccagttcaccagacgagatcgccctcgttaaaggcgcaaaacggtacgagctactgcacacattaaactttgacgccgttcggagaaggatgtctgtgatcgttaagacccaggaaggcgacatcctgctgttctgtaagggcgctgatagcgccgtgttccctagggtgcagaatcacgagattgaactcacgaaagtccatgtggagagaaacgcgatggacggctaccgcaccctctgcgttgcgttcaaggaaattgctcccgacgactacgagaggattaaccgacagctcatcgaggcgaagatggcactgcaggatcgagaagaaaaaatggagaaagtattcgatgatatcgagaccaacatgaatttaatcggcgctactgcctag

SEQ ID NO: 48478 - DNA, 498 bp, Artificial Sequence
  Description of Artificial Sequence: Synthetic coding sequence
taagaaggcacagtttttttcttcggtacctactttctgttccagacagcttccctcgaggaaaatggaaaggtgtacggaaattggacattcggcactattgtgttcacggtcctggtgttcaccgtaacactgaaactagcacttgacacacgtttctggacttggatcaaccactttgttatctggggcagcttggccttctacgtgttctttagcttcttttggggcggaatcatctggccgtttctgaagcaacagcgtatgtacttcgtgtttgcgcagatgctcagtagcgtatcaacctggctcgctataattctgctgatatttatctccctctttccagagatcctgttaatcgtgctcaagaatgtcaggcgcaggtccgctcgtcgcaacttgtcttgccgtagggcatccgactccctgagcgcacgcccttcagtcaggccgcttctccttaggacattcagcgacgaatctaatgtgctctag

SEQ ID NO: 48479 - DNA, 519 bp, Artificial Sequence
  Description of Artificial Sequence: Synthetic coding sequence
accttgacaagcgaccctaggctgtacatgaaaatttcaggaaatgccatgctccagctgggaccttttctgtattggaccttcttggccgcattcgagggcaccgtcttcttcttcggcacctattttcttttccaaaccgctagcttggaagagaatggcaaggtctatggaaattggacattcggcactattgtcttcacggtcctagtgttcaccgtcacgctgaagctggctctggacacccgcttttggacctggatcaaccattttgttatctggggctcccttgctttttatgttttcttctcatttttctgggggggtatcatttggccatttttaaagcaacagcggatgtactttgtgttcgcccagatgctatcctctgtgagtacctggctggcaattattcttttaatattcatctccctttttcccgaaatcctccttatcgttcttaagaacgtgagacgtcgatcagctcgagtacaccatttgatctcctccagcgcatag

SEQ ID NO: 48480 - DNA, 357 bp, Artificial Sequence
  Description of Artificial Sequence: Synthetic coding sequence
atgacctctcagagtcaggggatccatcagctgctccaggcggagaagcgcgctaaggacaaattggaggaggctaaaaaacgcaagggcaagcgactcaagcaagcaaaggaggaggctatggtcgagattgaccagtatagaatgcaacgggataaagaatttaggctgaaacaatctaaaataatgggctcccagaataacctcagtgacgagattgaggagcagacccttgggaagattcaagagctcaacggccactataataaatacatggagtccgtcatgaatcagttattgagtatggtttgcgacatgaaaccagagattcatgtgaactatagagctacaaattag

SEQ ID NO: 48481 - DNA, 180 bp, Artificial Sequence
  Description of Artificial Sequence: Synthetic coding sequence
atgacaagccagtcacagggcatccatcagcttctgcaagcagagaagcgcgctaaggacaaactggaagaagctaagaagatcttgcacctactgttccttaagcgcagggactgggattgcttctggaagcgtaaagccattgaggctagtcagggtgggtcaaacggtcgcaactag

SEQ ID NO: 48482 - DNA, 375 bp, Artificial Sequence
  Description of Artificial Sequence: Synthetic coding sequence
atgacgtcccagtctcagggcatacatcaactcctgcaggccgagaaacgggcaaaagataagctcgaggaggccaaaaagaagacgggaaccgcctcaggtaagggcaagcggctcaaacaggcgaaggaggaggcaatggtggaaatcgatcaatacaggatgcagagggacaaagagttccggctgaaacagagcaaaataatggggagccaaaacaacctgtcagacgagatcgaggagcagacactgggcaagatacaggaacttaatgggcactacaataagtacatggagtccgtgatgaatcagctgctttcgatggtctgcgatatgaaacctgaaattcacgtcaactatcgagccaccaattag

SEQ ID NO: 48483 - DNA, 357 bp, Artificial Sequence
  Description of Artificial Sequence: Synthetic coding sequence
atgacctctcagtcccagggcattcatcagctgctacaagcagagaaacgggctaaagacaagctggaggaagccaagaagaggaagggtaaacgcttaaagcaagcaaaagaagaagcaatggtggagatcgatcaataccgcatgcagcgcgacaaggagttccggcttaaacaaagtaagatcatgggctcccagaacaacctgagtgatgagattgaggaacaaacattaggcaagattcaggagctgaacggccattataacaagtacatggagtccgttatgaatcagcttctgagcatggtatgtgacatgaagccagagattcacgtgaattacagagccacaaattag

SEQ ID NO: 48484 - DNA, 375 bp, Artificial Sequence
  Description of Artificial Sequence: Synthetic coding sequence
atgaccagccagtctcagggtattcaccagcttctgcaagcagagaagagggcgaaagataaactggaggaggctaaaaagaaaacagggacagctagtggaaaaggcaaaagactgaagcaagctaaagaagaggctatggtggaaatcgatcagtaccgcatgcaacgcgacaaggaatttcggcttaagcagagtaagatcatgggaagccaaaacaacttgtctgacgagattgaagagcagaccctcggtaaaatccaagagttgaacggccattacaataagtacatggagtccgtgatgaaccagcttctgtcaatggtgtgcgatatgaaacccgaaatccacgtgaactatagagccacaaactag

SEQ ID NO: 48485 - DNA, 360 bp, Artificial Sequence
  Description of Artificial Sequence: Synthetic coding sequence
atggcaggcaggggtaaactcattgcagtgataggggacgaggacaccgtgactggcttcttactggggggaataggagaactgaataagaataggcatcctaacttcttggtggtggaaaaagacacgaccatcaacgagattgaggacacctttcggcagttccttaacagagacgatatcggaattatcctcatcaaccaatacatagccgaaatggttcgccacgcgcttgacgcccaccagcagtcaatcccagcagtattggaaattcctagcaaggagcatccttatgatgccgctaaagattctatcctaaggagagcacggggaatgtttaccgcagaagatctcaggtag

SEQ ID NO: 48486 - DNA, 681 bp, Artificial Sequence
  Description of Artificial Sequence: Synthetic coding sequence
atggcattgtcagacgttgatgttaagaaacagataaaacacatgatggcctttattgaacaggaagcaaacgagaaagctgaggagattgacgccaaggccgaggaggagtttaatatcgaaaaggggagactcgtgcaaacacaacgcctcaagatcatggaatattatgagaagaaggaaaaacagatagagcagcagaaaaagatcctcatgagcacaatgcggaaccaagcacgtctgaaggtgctgcgagcgcgtaacgacctgatctctgatcttctctcagaagccaagctgcggttgtctaggatagtggaggatcccgaagtctatcagggcttgctggataaactagtgctgcagggcttacttcggcttctggaacctgtgatgattgtcaggtgcagaccccaagacctactgctggtggaagcagctgtccagaaagctattcccgaatacatgactatcagccaaaaacacgttgaggtacaaatagacaaggaggcatacctggccgttaatgccgcagggggagtggaggtatatagcggaaatcagcgtataaaggtcagcaacaccctcgaatcacggttggacctcagcgcaaagcagaaaatgcctgagatacgcatggccctatttggggctaatactaatcgcaagttctttatctag

SEQ ID NO: 48487 - DNA, 681 bp, Artificial Sequence
  Description of Artificial Sequence: Synthetic coding sequence
atggccctgtcggatgtggacgtcaagaagcaaattaagcatatgatggcctttattgagcaggaggccaacgaaaaggccgaggaaatcgacgcaaaggctgaagaggaatttaatatcgagaagggacggctggtgcagactcagagactgaagattatggaatattatgaaaagaaagaaaaacagattgagcagcaaaaaaagatcttaatgtccactatgcggaatcaggcgagactgaaggttctccgagcccgtaacgacctgatcagtgatctgctctcagaggcaaaactgcgactatcacggatcgtcgaggacccagaggtctaccaggggttgcttgacaagctcgtcctgcaggggctcttgcgcctcctggaaccagtcatgattgttagatgtcgccctcaggacttgctgctggtggaggcagctgtccagaaagcaatccctgaatacatgacaatcagccagaaacatgtcgaagtgcagatcgataaagaagcttatctagccgtgaacgcagcgggtggcgtggaagtgtattccggcaatcagaggatcaaggtgtcaaatactttagaatcacgtctagatttgtcggctaagcagaagatgccggagattcgaatggccttgtttggagccaacacaaatagaaagttcttcatctag

SEQ ID NO: 48488 - DNA, 999 bp, Artificial Sequence
  Description of Artificial Sequence: Synthetic coding sequence
atggccgctgtctttctcgttaccctttacgagtactcccctctcttttacatcgccgttgtcttcacttgttttatcgtgaccaccggacttgtcctcggatggtttggttgggatgtcccagttattcttcgtaactccgaggagacgcaattttccacgcgcgtattcaaaaagcagatgcgacaggtgaaaaacccatttggactggagattactaaccccagctctgcgtcaatcacgaccgggattacactcacaacagactgtctcgaggacagcctgcttacctgttattggggatgctctgtgcaaaagctatacgaggcattgcagaaacatgtgtactgcttccgtatcagcaccccacaagctctggaggatgccctgtattctgaatacctgtaccaagagcagtattttattaaaaaggacagcaaagaggaaatctattgccagctcccgcgtgacacaaaaatcgaggacttcggaaccgttccccgaagtcggtatcctctggttgcattgctgaccttggcagatgaggatgaccgggagatctatgatattatctcgatggttagcgtgatacatatcccagatagaacatacaaattgtcatgtaggattctctaccagtaccttctattggctcagggccagttccacgacctgaaacagttgttcatgtcagccaataacaattttactccatctaacaactcttcctccgaggaaaaaaacacagaccgtagcctgctggaaaaagtgggtctgtctgagtctgaggtggaacccagtgaagagaatagtaaggactgcgtggtctgtcagaatgggactgttaattgggtgcttttgccatgccgccatacatgcctgtgtgacggttgcgtgaaatactttcagcaatgccccatgtgccgccagtttgttcaggagagtttcgccctgtgttcgcagaaagagcaggataaggacaaacccaaaactctctag

SEQ ID NO: 48489 - DNA, 744 bp, Artificial Sequence
  Description of Artificial Sequence: Synthetic coding sequence
atgagtggtaaagacaggattgaaatattcccttcgcgcatggctcagaccattatgaaagcccgattgaaaggcgcacaaacaggacggaatttactgaagaagaagagtgatgccctgacactcagatttagacagatactcaagaagataattgagaccaaaatgctcatgggggaagtaatgcgggaagctgctttttccttagcagaggctaagttcactgctggcgacttttcaaccaccgtgatacagaatgttaacaaagcgcaggtgaagattcgagccaagaaagacaacgtggccggagtcacactgcctgtcttcgaacattaccatgaagggactgacagttatgagttaacagggctggccaggggtggcgagcagctggccaagttgaaacggaattacgccaaagctgtcgagctcctagttgagctggcctctctccagacaagcttcgtcaccttggacgaggcaattaaaataaccaatcgcagagtaaacgctatagagcacgtcatcatcccacggatcgaacgaacattggcctacataattaccgagctcgatgagcgcgaaagggaggaattttaccggctgaagaaaatccaagagaaaaagaagatattgaaggaaaaaagcgagaaggaccttgaacagagacgggcagctggcgaggtgctggagcccgcaaatctactggccgaggaaaaggatgaggacctattgtttgaatag

SEQ ID NO: 48490 - DNA, 219 bp, Artificial Sequence
  Description of Artificial Sequence: Synthetic coding sequence
atgagcggaaaagacagaattgaaatctttccctctaggatggcccaaacgatcatgaaagcacggctgaaaggggcacagacaggtaggaacttacttaaaaaaaagagtgacgccctcactctgaggtttcggcagattcttaagaagattatcgagaccaaaatgctgatgggagaggtgatgcgtgaggccgcattttctctagcggaagcatag

SEQ ID NO: 48491 - DNA, 1053 bp, Artificial Sequence
  Description of Artificial Sequence: Synthetic coding sequence
atgctagaaggtgctgagttgtactttaacgtggaccacggatacctcgagggactggttcgcggatgtaaagctagcctgctcacgcagcaggattatatcaatcttgtgcagtgtgaaacactggaggacctgaagatccacctgcagaccacggactatggcaatttcctggccaaccacactaacccactcaccgtgtctaagatcgataccgaaatgaggaagaggttatgtggcgagtttgagtatttccgcaatcactcacttgaacctctctctacattccttacatatatgacctgcagttacatgattgacaacgtgattctactgatgaacggagctctgcagaagaaatccgtcaaggagatcttggggaagtgccatcctctgggacgtttcacagagatggaggcggtaaacattgcagaaacaccctcagacctttttaacgctattctcatagaaacccccttagcaccattctttcaggattgcatgtccgagaatgccttggatgagctgaatatagaattgctcagaaataagctttacaagtcttacctggaggcgttctacaaattctgtaagaatcatggcgatgtgactgctgaggtcatgtgtcccatattggagttcgaggcagacagacgggctttcatcattacattgaattcgttcgggaccgagcttagcaaggaagaccgcgaaactctctacccgaccttcgggaaactgtaccctgaaggtttacgtctcctggcccaggctgaagacttcgaccagatgaagaatgtcgctgatcactatggtgtgtataaacctctattcgaggccgttgggggtagtgggggtaaaacactggaagatgtcttttatgagagagaggtgcagatgaatgttctggcctttaacaggcagttccactatggagttttttatgcctatgtgaagttgaaagaacaggaaatccgcaatattgtgtggatcgccgagtgtatctcccagaggcatcgcacaaagatcaactcttacatacccattctgtag

SEQ ID NO: 48492 - DNA, 111 bp, Artificial Sequence
  Description of Artificial Sequence: Synthetic coding sequence
atgctggagggggctgagctgtactttaacgtggaccatgggtacctggagggcctggtcaggggctgtaaagcgagcctgctcacacagcaggactacatcaatttatag

SEQ ID NO: 48493 - DNA, 132 bp, Artificial Sequence
  Description of Artificial Sequence: Synthetic coding sequence
atgctggagggggctgagctatatttcaacgtcgatcatggttatttggaggggctggtcaggggatgtaaggctagcctgttaactcagcaggattatatcaatctggtccaatgcgagaccttggagtag

SEQ ID NO: 48494 - DNA, 1284 bp, Artificial Sequence
  Description of Artificial Sequence: Synthetic coding sequence
atgtccgagttttggctcatttcagccccaggcgacaaggaaaacctgcaggctcttgaacgaatgaacaccgttactagcaaaagtaatctgagctacaacacaaaattcgccatccctgactttaaagtcggcacacttgatagcttggtgggcctgtcagacgaactcggaaagcttgatacttttgcagaatccttaatccgccgaatggcccagagcgtggttgaggtgatggaagacagcaaaggaaaggtccaggagcatttgctcgcaaacggggtcgacctcacgtccttcgtgacccattttgagtgggatatggcaaaataccctgtgaaacagcctttagtatccgtcgtggacaccatcgccaaacaactcgctcagattgagatggatcttaaatcgaggactgctgcttataatacattaaagacaaatttggagaacttagaaaaaaaaagcatgggtaacctattcacaaggacattatcagacattgtctctaaagaggacttcgtcctggactctgaatacctggtaacgctcctagtaattgttcccaagcctaactatagtcaatggcagaaaacctacgagagcctatcagatatggtggtccccaggtcgactaaacttattacagaggataaggaagggggactgtttaccgttaccctcttccggaaagtaatcgaagattttaaaacgaaggccaaggagaataagttcaccgtgagggaattctactacgacgagaaggaaatcgaaagggaaagggaggaaatggcccgtcttctgtcagacaagaaacaacaatatcagacatcttgtgtagcattgaagaaaggctcctcgacattccccgatcataaagttaaagtaacacccctgggaaatcctgaccgaccggcagccggtcagacagacagagagcgggaaagtgaaggtgagggagaaggtccactcctacgatggttgaaagttaactttagcgaggcattcatcgcttggattcatatcaaagcattaagagttttcgtcgagagcgtgctacgctacggcttacccgttaactttcaggcagtgctgctccagccacataaaaagagcagcacaaaaagactcagagaagtgcttaattctgtatttcgacacttagatgaggtggccgcaacgtccatcctagacgcctctgtcgagattcccggattgcaattaaacaaccaagattactttccctatgtttattttcacattgacctctctcttctagactag

SEQ ID NO: 48495 - DNA, 1146 bp, Artificial Sequence
  Description of Artificial Sequence: Synthetic coding sequence
atgtccgaattctggctgatctcagctccaggagacaaagaaaacctgcaggcattagagaggatgaatacagtgacctctaagagcaacctgagttacaacacaaaatttgcaatccctgacttcaaggttggcactttggactccctggttggcctgagcgacgagcttggtaaactggatacattcgccgagtcactgatccgcaggatggcacaatcagtggtggaagttatggaagacagcaaaggtaaagtccaggaacacctgctggccaatggggtcgacctgacatccttcgtgacccattttgaatgggatatggcaaagtaccccgtgaagcagccacttgtgtccgtagtggacacgattgctaagcaactcgcccagatcgaaatggacttgaagtctaggacagcagcgtataacacactcaagacaaatcttgaaaatctggagaagaaatccatgggaaacctgttcactaggaccctgagcgatatcgtttcaaaggaggattttgttctggactccgagtacttagttactctcctcgtaatcgtgcccaagcctaattacagccagtggcagaagacctacgagtctttatctgacatggttgttccccgtagcaccaagttgattactgaagacaaggagggaggcctttttaccgttacactgttcagaaaagtgatagaggattttaaaacgaaagcaaaagagaacaaattcaccgtccgcgagttctattacgacgagaaggagatcgagcgtgaacgcgaggagatggctaggttacttagtgacaagaaacaacaatatgggccactcctcaggtggctgaaggtgaacttcagcgaggcttttatcgcatggatccacataaaagctctgagagtattcgtcgagtccgtcctgcgatacggcctgccggtgaatttccaggctgttcttttgcaaccccataaaaaatcatcaaccaagaggcttagagaagtgcttaacagtgtctttcgtcatctagatgaggtcgctgccactagcattctggatgcttccgtggagatccccggactccagttaaacaatcaggattattttccttatgtctacttccacattgacttaagtttactggactag

SEQ ID NO: 48496 - DNA, 1398 bp, Artificial Sequence
  Description of Artificial Sequence: Synthetic coding sequence
atgactaagatggatataagaggggctgtcgatgccgctgtaccgacaaatataatcgcggctaaggcggcagaggttcgggcaaataaggtgaattggcagtcgtatcttcagggccaaatgatatctgcagaagactgtgaatttatccaaaggtttgagatgaagcgatcaccagaagagaaacaggagatgctgcagaccgaggggtctcaatgtgcaaagactttcattaatttaatgactcacatctgtaaggagcagacagttcagtacatactaaccatggtagatgatatgctgcaggaaaatcatcagagagtctctatctttttcgactatgccaggtgttcgaagaatactgcatggccttactttctgcccatgctcaaccggcaggaccccttcactgtacacatggccgcacggattattgccaaattagctgcgtggggaaaggagctgatggaaggttccgacctgaactattatttcaactggattaagacccagctttcttcacagtcctcgcagtatgtccaatgtgtggccggatgcctccagcttatgctgagggttaatgagtataggttcgcatgggtagaggctgatggggttaactgtattatgggcgtgctgtcaaacaagtgcggcttccagctccagtatcagatgatcttctctatctggctgttggcattctcgccccagatgtgtgaacatctgagaagatacaacattatccctgtactgtctgacatcctgcaggaatctgtgaaagaaaaggtgactcgcatcattctcgccgcttttcgaaactttttagagaaatccacagagagggagactcggcaggaatacgcgctggcaatgatccagtgcaaagtgctgaaacaactggaaaatttagagcaacaaaaatatgatgacgaggatatctccgaggacattaaattcctcctggagaaactgggagagagcgtccaagatctgtcatccttcgatgagtattcttccgagctaaaatcaggacgactggagtggtcccccgtccacaagtccgagaaattttggagagaaaatgccgtgaggctgaatgaaaagaattacgaactgcttaagattctgaccaagctgctcgaggtaagtgacgatcctcaagtgttggcagttgccgctcacgacgtaggcgagtacgtcagacattaccctcggggtaaacgggttattgaacagttaggaggaaagcagttggtgatgaaccacatgcaccatgaggatcagcaggtgcgttataatgccctgctggcggtgcagaagctaatggtgcacaattgggaatatttgggcaagcagctgcagtccgagcagccccagacggccgcagccaggagctag

SEQ ID NO: 48497 - DNA, 1452 bp, Artificial Sequence
  Description of Artificial Sequence: Synthetic coding sequence
atgacgaaaatggatatacgcggagcggtggatgcggcagtccctacaaatatcattgcagcaaaggcggctgaggtgcgagcaaataaggtgaactggcaatcatacttacaaggccagatgatatcagctgaggactgtgagttcatccaacgcttcgagatgaaaagaagcccggaagagaagcaggaaatgttacaaacagaagggtcccagtgtgccaagacttttataaatctaatgacacacatatgtaaggagcaaaccgtgcagtacatccttacaatggtggacgatatgctccaggaaaatcatcagagagtatctattttcttcgactacgctcgttgctctaaaaacacagcttggccgtatttcctgcccatgctgaatcgtcaggaccccttcaccgtgcacatggccgcacgaatcatcgcaaagctggccgcatgggggaaggaactgatggaaggcagcgaccttaactactacttcaactggataaaaacacagctgagctctcagaaactcagaggatcaggcgtggcagttgaaaccggcactgtgagctcttctgactcatctcagtatgtacagtgcgtcgccggatgcttgcagcttatgctccgagtgaatgaatatagatttgcttgggtcgaggcggacggggtcaattgcataatgggggttctgtccaataaatgtggcttccaactacagtaccagatgattttttcaatttggctgctggccttctctccgcagatgtgcgagcacctgcgcagatacaacattattcccgtgctgtctgacattctgcaggagagtgtcaaggagaaggtcactcgaataattctcgcagcttttaggaactttctagagaagtctaccgagagggagactaggcaggagtacgcactggctatgattcagtgcaaagtgcttaaacagttagaaaaccttgagcaacagaagtacgacgacgaagacatctcagaagacataaagtttctgctagagaaacttggcgaatcggtgcaggatcttagctcctttgacgaatactcctctgaactgaaaagtggacgactagagtggtcgcccgttcacaagtctgaaaagttttggagggagaatgccgtccgtctgaacgagaagaactatgaactcttaaagatcttaacaaagctgttggaggttagcgacgacccgcaggttttggctgttgctgctcacgatgtgggagagtacgtgcgtcattatccacgtgggaagcgagtcatcgagcagctgggaggcaaacagttggtcatgaaccacatgcaccacgaagatcaacaggtgcgctacaacgccttgcttgccgtgcaaaagctgatggtgcacaactgggagtacctgggcaaacagctgcagtcagagcagccccagacagccgcagcacggagttag

SEQ ID NO: 48498 - DNA, 1452 bp, Artificial Sequence
  Description of Artificial Sequence: Synthetic coding sequence
atgaccaagatggatattcgaggagccgttgacgctgctgtcccaactaatataatcgcagcaaaagcagccgaagtgagggccaacaaagtaaattggcaatcatatctacaaggccaaatgatctcagcagaagattgcgaatttatacagcgttttgaaatgaaacgcagtcctgaggagaagcaggaaatgctgcagaccgaaggcagtcagtgcgccaaaacattcatcaacctaatgacacacatttgtaaagagcagaccgtacagtacattctgaccatggttgacgacatgctgcaagaaaaccaccagagagtgtccattttttttgactatgctcgttgttctaaaaataccgcatggccttattttcttccgatgctcaatcgtcaggacccctttactgtccatatggctgccagaatcattgcgaaacttgccgcatgggggaaagagttaatggaaggctcagatctcaattactattttaattggatcaaaacccagctttctagtcagaaactgcggggttcaggagtggcagttgaaactggaacagtcagttcctctgattcgagccagtacgtacagtgcgttgcagggtgccttcagctgatgcttagagtgaacgaatatcgcttcgcctgggtcgaggcagatggggtcaactgtatcatgggcgtgttgagcaacaagtgtggctttcaactgcagtatcaaatgatcttctccatttggctgttggctttttccccacagatgtgcgaacacctaagaagatacaacataataccagtgctgagcgacattctccaagagtctgttaaggagaaagtgacgcgcatcatactggcggcttttcgaaacttcctggaaaagagtactgaacgcgagactaggcaggagtatgcgctcgccatgatccagtgcaaggtgttgaagcagctcgagaacctggagcaacagaagtatgatgatgaagatatctctgaggatattaaattcttgctggaaaaactcggagagtccgtgcaagacctctcttcctttgatgagtattcgtcggagctgaaatccggtcgcctcgagtggtctccggtccacaagtctgaaaaattttggcgagaaaatgctgtgagactgaatgaaaagaactatgaacttctgaagatcttaacaaagctgctggaagtgtccgacgatccacaggtgcttgcagtcgccgctcacgatgtgggggagtacgttcgtcactacccacggggaaaaagagtgatcgaacagctgggtggtaagcagttggttatgaatcacatgcatcacgaggatcaacaggtgagatacaatgcactgctggccgttcagaaactgatggtgcataactgggaatatctcgggaagcagctacaatccgagcaaccccagactgcggctgcccgtagttag

SEQ ID NO: 48499 - DNA, 309 bp, Artificial Sequence
  Description of Artificial Sequence: Synthetic coding sequence
atgaccaaaatggacatacggggagcagtggatgctgctgtgcccaccaatatcatagctgctaaggcggcagaggtgcgggctaataaagttaactggcagagttatctgcagggtcagatgatttccgccgaagactgcgaattcatccaacgattcgaaatgaaaaggtcccctgaggaaaagcaagaaatgctgcagacagaaggtagtcaatgtgcgaagacctttatcaaccttatgactcatatctgtaaagaacagaccgtgcagtatattcttaccatggtggatgacatgctccagtag

SEQ ID NO: 48500 - DNA, 306 bp, Artificial Sequence
  Description of Artificial Sequence: Synthetic coding sequence
atgacaaaaatggacatccgaggcgcagtcgatgccgcagtgccaaccaatataattgccgctaaggctgccgaagtgcgggcaaataaagtcaactggcaaagctatctgcaaggacagatgatctcggctgaggattgcgagtttatccaaaggttcgagatgaagcggtctccagaggagaagcaggagatgctgcaaacagagggcagccagtgcgcaaagaccttcattaacctcatgacccatatctgcaaggagcagacagtccaatatatccttactatggtagacgatatgctgtag

SEQ ID NO: 48501 - DNA, 873 bp, Artificial Sequence
  Description of Artificial Sequence: Synthetic coding sequence
atgggagacggcggagctgagcgggacagagggccagccaggagagccgagtcgggcggtggaggcggaagatgtggagacagaagcggtgccggtgacctccgggcagatgggggaggtcacagtcctactgaagtagctgggactagcgctagctcaccagcaggctccagagagtccggcgctgattcagacggtcagcccggtccaggagaggccgatcattgccgcaggattttggtgagggacgcaaaaggaacaataagagaaattgtccttccaaaggggttagatctcgatagacctaaaaggacccgtacgagcttcacagccgaacagctgtatagattggaaatggaatttcagcgatgtcagtatgtcgtgggccgagaaaggacggagttggcccgacagctgaacctgtcggagacacaggtgaaagtgtggttccagaacagaagaacaaagcagaagaaagaccagtcacgcgacttggagaagcgggcatcttccagtgcctccgaagccttcgcgacctctaatatcctgcggctgctcgagcaagggagactcctgagtgttcctcgggcaccttctctcctagcacttactccatctctgcctggattgccagcgagccacagagggaccagcctgggagaccctcgaaatagctccccacgcttaaatccgctttcttccgccagtgcgtctcccccactcccaccgcctcttcctgcagtgtgttttagctccgcccctctgctagatctgcctgctgggtatgagctagggagcagcgcctttgagccctactcatggctggagcgtaaggtgggtagtgcatccagctgtaagaaagcgaacacctag

SEQ ID NO: 48502 - DNA, 1491 bp, Artificial Sequence
  Description of Artificial Sequence: Synthetic coding sequence
atggccatggagattgacagcagaccaggcggtctccccggttcgtcctgtaatctgggggctgctcgggaacacatgcaggccgtcactcgtaattatattactcatccacgggtgacttaccggactgtatgcagtgtgaacggcccactcgtcgtccttgacagggtcaaatttgcacagtatgcagagatcgtccacttcactctccctgacggcactcaacgatccggacaagtccttgaggtggcgggaactaaggcaattgtccaggtgttcgaaggcacttctggaatcgatgcaaggaaaaccacttgtgaattcacaggagacatcttgcgaactccagtgtccgaggatatgctggggcgagtgttcaatggatcgggaaagccaattgataaaggacctgtggtgatggccgaggacttcctcgatataaacggtcagcccataaacccccacagtcgcatttatccagaagagatgatccaaacagggattagtcctatcgatgtgatgaactcgattgccagggggcagaagattcccatcttcagtgccgctggcctgccgcacaacgaaattgcagctcagatttgccgtcaggcagggctcgtcaagaagtcgaaggcggtgttggattaccatgatgacaattttgcaatcgtctttgcagcaatgggggtcaacatggagacagcacggttctttaagagtgacttcgagcagaacggaaccatgggaaatgtgtgtctgttccttaatcttgcaaatgatcctaccatcgaaagaataattactccacgcctggcgctgacaaccgcggaatttctggcatatcagtgtgagaagcatgtgttagtaatcctcaccgacatgtcgagctatgccgaggctttaagggaggtgtccgcggctagagaagaggtgccaggcaggagaggctttcctggctatatgtataccgatcttgccaccatttacgagagagcgggaagggtagaggatattactcacccaattcctgaccttacagggtttatcacggagggtcagatttatgtagacaggcagctgcacaaccgccagatctacccccctattaacgtgttgccatctttgtccagactgatgaagtctgcaatcggtgaagggatgacacggaaggatcatggtgacgtgtctaatcaactgtacgcgtgctacgccatcggcaaggacgtacaggccatgaaagccgtggttggcgaggaagccctcaccagtgaggacctgctctacctagagtttctgcaaaagttcgaaaaaaattttatcaaccagggaccttacgaaaaccgcagtgtctttgagagtctggaccttggctggaagctgctgcgaatttttcccaaggaaatgctcaaaagaatccctcaggcagtcattgacgagttctattctcgggagggggctcttcaagacctggccccagatacggctctgtag

SEQ ID NO: 48503 - DNA, 1467 bp, Artificial Sequence
  Description of Artificial Sequence: Synthetic coding sequence
atgcaagccgttaccagaaactatattacacacccacgagtgacatatcggactgtatgttcagttaatggcccacttgtagttctggatagagtgaagtttgcccagtacgcggagatcgtgcactttacccttcccgacgggacacaacgcagcggacaggtgttggaggtcgccggaaccaaggccattgtgcaggtgttcgagggtactagcgggatcgatgcaaggaaaacaacgtgcgaattcacaggggacatcctgcgcacgccagtgagcgaggacatgctgggacgggtgtttaatgggtcaggtaagcccatcgacaaaggcccagtcgtgatggctgaggattttttagatattaacggtcagccgatcaacccccactctcgaatttaccccgaagagatgattcagacgggtatcagtccaatcgacgtgatgaactccattgctcggggacagaaaattccaattttttccgctgccggactacctcacaatgagatcgctgcacagatttgcaggcaagccggactggtgaagaaatccaaggctgtgctggattaccacgatgacaacttcgcgatcgtttttgccgcaatgggcgtgaacatggaaacagcacggttctttaagagcgactttgaacaaaatggtaccatggggaatgtgtgcctgttcttaaatctggccaatgatccgaccattgaaaggattatcacccctcggttggccctgacgacagctgaatttctcgcctaccaatgtgagaaacatgtcctcgtgatcctcacggacatgagctcatatgcggaagccttgagggaagtctccgctgctcgcgaagaagtcccgggtagacggggattcccaggctatatgtataccgatctagctacgatatacgaaagagccggacgcgttgagggcaggggaggaagcattacccagattcccatcctgacaatgccaaacgacgatattactcacccgatccccgacctgactggattcattactgaggggcagatctatgtggaccgacagctgcacaataggcagatctacccaccaattaacgtcctgccaagtctgtcacggttgatgaagtccgctattggcgagggaatgacccgaaaggaccacggggatgtttccaatcagttgtacgcatgttatgcaatcgggaaggacgtgcaagccatgaaagctgtggtgggtgaggaggctttgacgtctgaagatctgctatacctggaattccttcagaagtttgagaaaaattttatcaaccagggcccatatgagaaccgctcagtctttgaatctctggatctggggtggaagctgctgagaatctttccgaaagagatgctaaagcggatcccacaggccgttattgacgagttctattcgcgggaaggcgctttacaggacttggcgcctgacacagcgctgtag

SEQ ID NO: 48504 - DNA, 1536 bp, Artificial Sequence
  Description of Artificial Sequence: Synthetic coding sequence
atggccctgagggcaatgcgtgggatagtgaatggcgcagcccctgagttgcccgtgccaacaggcggtccagcggttggcgctagagagcaggcactggctgtctctcgcaactatctaagccagccacgccttacctataagacagttagtggtgttaatggacctctcgtgattctcgatcatgttaagtttcctagatatgcagagatcgtgcacctgacgttacccgatggtactaagcgtagcgggcaggtactggaggtctccggatcaaaagcagtcgtgcaggtgtttgaggggacaagcgggatagatgcaaagaagacttcctgcgaattcactggcgatattctgcggaccccagtcagcgaagacatgctgggtcgtgtgttcaacgggtctggcaaaccaatagacagagggccagtggtgctggcagaggactttttggacatcatgggccagcccatcaaccctcagtgtcggatttatcccgaagaaatgatccagaccggtatcagtgctatcgatggaatgaacagcatcgcacgaggtcagaaaataccgatattctctgcagccggactacctcacaatgaaatcgctgcccagatttgtcgccaggccggactggtgaagaagagtaaggacgtggtggactattcagaagagaacttcgctatcgtgttcgccgctatgggagtgaacatggaaacggcaagattcttcaaatctgatttcgaggagaacgggtccatggacaatgtatgcctctttctgaatctggccaacgatcctacaatcgagcggattatcacacctcgcttggccctgacaactgctgaattcctggcataccagtgtgagaaacatgtcctggtgatcctcaccgatatgtccagctacgcagaggccttgcgggaagtctctgcagctagggaagaggtacctggacggagaggattccctggctatatgtacacagatctcgccactatctatgaacgagctggaagagtggagggcagaaacggctcgatcacacagatccctattttgacgatgccaaacgacgacattacacacccaatccccgacctcacaggatacataactgaagggcagatttacgtggaccggcaattgcacaataggcagatctacccgccaatcaacgtcttgccctctttgagccggctcatgaaatctgctattggagaggggatgacaaggaaggaccatgctgacgtatccaatcaactctacgcctgttatgcaataggaaaggacgtgcaggccatgaaggcggtcgttggtgaggaagcactcacttcagacgacttgctgtatcttgaatttttgcagaagttcgaaaggaactttatagcacaggggccttacgagaaccggaccgtgtttgagacattggacattggatggcagttactcaggattttcccgaaggagatgctgaagaggattccccagagcactctgtcggagttctatccgagggattccgctaaacactag

SEQ ID NO: 48505 - DNA, 1158 bp, Artificial Sequence
  Description of Artificial Sequence: Synthetic coding sequence
atgttaggtcgagtgtttaatgggtcgggcaaacccattgaccgcggaccagtggtcctcgcagaggattttctggatatcatgggccaacctataaacccccaatgtagaatctatccagaggagatgatccagaccggcattagtgctatcgatgggatgaatagcatcgcgagaggtcagaagatccccattttctccgccgcaggactcccccataacgagattgctgcgcaaatctgccgacaggctggcctggtcaagaagtctaaggacgtcgttgattatagcgaggaaaactttgcaattgtgtttgccgcaatgggcgtaaacatggagacggcacgtttttttaagtctgactttgaagagaatgggagcatggacaatgtgtgcctgttcctgaatctcgccaacgaccccactattgagaggattattacccctcggctggccctgactactgccgaattcctcgcctatcagtgtgagaagcatgtgctcgtgatactcactgacatgagctcttatgccgaggcccttcgcgaagtcagcgctgcccgtgaagaagtccccggaaggcgcggatttccaggctacatgtatacggatctggccacgatttatgagcgggctggaagagtcgaaggcagaaacggctctattacacagatcccgatcttaaccatgcccaatgacgacattacccaccctatccccgacctcacaggctatattacagaaggccaaatatatgtggatagacagttacacaaccggcagatctacccacccattaatgttctgcccagtctcagccgcctgatgaaatctgcaatcggtgaggggatgactaggaaggatcacgcagatgtgagcaatcagctttatgcctgctatgcaattgggaaggacgtccaggccatgaaagccgttgtgggtgaggaagctctaacttcagacgacctgctgtatcttgagtttcttcaaaagttcgaacggaattttattgcccaggggccttacgagaacagaacagtcttcgaaacgcttgatatcgggtggcaactactgcgtatttttcccaaagagatgttaaagaggataccgcagtccactttaagtgagttttatccgagggactcagccaagcattag

SEQ ID NO: 48506 - DNA, 1854 bp, Artificial Sequence
  Description of Artificial Sequence: Synthetic coding sequence
atggacttttccaagctgcctaaaatacttgacgaggacaaggagagcacgtttggatatgtgcacggcgtgagcggtcctgtggtgacagcatgcgatatggcaggcgcagcaatgtacgagctggtccgggtcggccatagcgaactggtgggcgagattatccggcttgaaggtgacatggctacaatccaagtctacgaagagacatcaggggtaagcgttggggaccccgtattacgcactggaaagcctctctcggtggagttgggcccaggtatcatgggtgcaatcttcgatgggatccagcgaccactctctgacatctcctcacagactcaaagcatatatatcccacgaggagtgaacgtttccgctctgtcacgagacattaagtgggacttcaccccatgcaagaatctccgagtcggatctcacatcacgggcggagatatttacggaatcgtctccgagaacagcctgatcaagcacaagatcatgctccctcccagaaataggggtactgttacctacattgctccaccagggaactacgatactagtgacgtggtactggaacttgaattcgagggagtgaaggagaagtttactatggttcaagtttggccagttcggcaggttaggcctgttacagaaaagctcccagcgaatcacccccttctgaccggccaacgggtgctcgacgcattattcccctgtgtgcaggggggaacaaccgctatccctggcgctttcggttgtggcaaaacagttatctcccaaagcttgtcgaagtactccaattccgatgtaataatctacgttggatgtggagagagggggaacgaaatgtctgaggttcttcgtgatttccctgagcttacgatggaggttgatggcaaagtagagagcatcatgaaacggactgcccttgtcgcaaacaccagcaacatgccagtggctgcacgagaagcttccatctataccggtatcactctcagtgagtactttcgcgatatgggctatcacgtgtcgatgatggcagacagtacaagtcgttgggccgaggctctgcgggagatctcaggacgattagcagaaatgccagcggatagcggctacccagcctacctgggtgctcgcctggcatctttttacgaacgggcaggcagggttaagtgtctcggcaaccccgaacgagaggggagcgtgtccatcgttggtgctgtttcaccgccaggaggtgacttcagcgacccagtgacatccgccacgctaggcattgtccaggttttctggggcctggataaaaaactcgcgcagagaaaacacttcccaagtgttaattggctgatcagctattctaagtacatgcgggcacttgatgagtactatgataagcattttactgaatttgtgcccctgcgcaccaaggcaaaggagattctgcaggaagaggaggatttagctgagattgttcagcttgtgggtaaggcgagcctagctgagactgacaaaattaccctcgaagttgctaagttgatcaaggacgattttctgcagcaaaacggatacaccccatacgaccggttctgtccattttataaaacagtaggtatgcttagcaatatgatcgccttctacgatatggcccgtagagcagtggaaaccacagcccagagtgacaacaaaattacatggagcatcattagagaacacatgggcgatatcctgtacaagctgtcgtctatgaagtttaaggaccccctgaaagacggtgaggctaaaatcaaatccgactacgcccaactgttagaagacatgcagaatgccttccgttccctagaggattag

SEQ ID NO: 48507 - DNA, 666 bp, Artificial Sequence
  Description of Artificial Sequence: Synthetic coding sequence
atggatttcagcaagttacccaaaattctggacgaagataaagaatctaccttcggctatgtgcatggggtgtcgggtcctgtcgtgaccgcctgcgacatggccggtgcagccatgtacgagttagtacgcgtgggacacagcgaactagttggcgagatcattagactggagggagacatggcaacaatccaagtttatgaggaaacttctggagtctcggttggagaccctgtcctgaggactggcaagcccttgtcggttgagctggggccaggcattatgggagccattttcgatggtattcagcgcccattatccgacatctccagccagacacagtccatatatatcccaaggggcgtcaacgtgagcgctctatctcgggacataaagtgggacttcactccttgtaaaaacctgagagttgggagccacatcactggcggtgacatttatgggattgtttctgagaactcgctgatcaaacataagattatgctcccacccaggaaccgcggtacagtcacttacatcgcaccaccaggaaactacgatacctccgacgttgtgctagagttggagttcgagggagttaaagagaaattcaccatggtgcaagtctggcccgtgagacaggtccgccctgtgaccgaaaaattatag

SEQ ID NO: 48508 - DNA, 1755 bp, Artificial Sequence
  Description of Artificial Sequence: Synthetic coding sequence
atggccggagccgctatgtacgaactggtgagagtaggacacagcgaattggtgggtgagatcattcgcttggaaggggacatggcgacaatccaggtgtacgaggaaacgtccggagtgagtgtaggcgacccagtgctgcgcaccggtaaacccctcagcgttgaacttgggccaggaattatgggcgctatcttcgacggcatccagcgacccttgagcgacatttcttcgcagacacagtctatatatatcccgcgtggggtgaacgtttctgcgctgtctcgcgacattaagtgggatttcactccttgcaaaaatcttcgcgttgggagccacatcacgggaggggacatatatggcatagtctcagagaatagcctgattaagcataagataatgttgcccccacgcaataggggcactgtaacctacatagctcccccaggaaattacgatacttctgacgttgtgctggagttggaatttgaaggggttaaggaaaagttcaccatggtacaagtttggcccgtcaggcaggtgcggcctgtaactgaaaaactccccgcaaaccacccccttcttaccggacagagggtgttggacgctctgttcccttgtgttcagggcggaactacagccatacctggagcatttggctgcgggaaaaccgtcatcagccaaagtctatctaaatactcaaacagcgatgttattatttacgtgggatgcggcgaaagaggcaacgaaatgagcgaagtcctgcgagactttcccgaactcaccatggaagtcgatggcaaggtggaatccatcatgaaaaggacagcactggtggctaatacaagtaatatgccggtggccgctagggaggcctccatatacacgggcattacattatctgaatactttcgtgacatgggctaccatgtctctatgatggccgactccacttctagatgggccgaggccctcagagagatctcggggagactggctgagatgccggctgactcaggttatcctgcctatctgggcgcaaggctcgctagcttctatgaacgagccggacgggtgaagtgtttagggaacccagagcgggaggggtcagtgagcatcgtgggagccgtgtcacctccaggaggtgacttttctgacccagtaacctctgcaaccctgggaattgtccaggtgttttggggactagataaaaagctggcccagagaaagcatttcccaagcgttaattggcttatcagctattcaaagtatatgcgggcactcgatgagtactatgacaagcattttacagagtttgttcctctgcggaccaaggctaaggaaatacttcaagaggaggaggacctggcagagatagtccaactggtcgggaaggctagtctcgctgagaccgacaagatcacacttgaagtggctaagctcataaaagatgacttcctgcagcaaaacggctataccccatacgaccgcttctgtccgttttataagactgttggcatgcttagcaatatgatcgcattttatgatatggcacgaagggcagtagaaacaactgcacagtccgataataagatcacctggtccatcattagagaacatatgggggatatcctgtacaagctttccagcatgaagttcaaagaccccctaaaggacggagaagccaagatcaagagcgattatgcccaacttctggaagacatgcagaacgccttccggtcactcgaggattag

SEQ ID NO: 48509 - DNA, 1005 bp, Artificial Sequence
  Description of Artificial Sequence: Synthetic coding sequence
atgtccgaagtcttacgggactttccagaactcactatggaagttgacggcaaagtggagtcgatcatgaaacgcaccgcactggtggccaacacttccaacatgcccgtggcagcgcgtgaagcttcgatttacactgggatcactctcagcgaatattttagagatatggggtatcatgttagtatgatggcagatagtacatccagatgggctgaagccctaagggagatatccggcagactggccgaaatgcccgctgacagcggctaccctgcatacttgggtgcacgcctggctagtttttacgaacgtgccggtcgggtgaaatgcctgggaaaccctgagagagagggctccgtgtcaattgtgggagctgttagtcctccaggtggtgacttctccgacccagtaactagcgccacactgggcatcgttcaggtgttctggggcctggataagaaactggctcaaaggaagcacttcccttccgtcaattggctgatttcctatagcaagtatatgcgggcactggatgaatattacgataagcattttaccgaattcgtgcccctacgaaccaaggctaaggagatactccaggaggaggaggacctggccgagatcgtgcagcttgtcggcaaggccagcctggccgaaacagataagattaccctagaggtggccaaactgatcaaggacgattttctccaacaaaacgggtacacgccctacgaccggttctgtccattctacaagactgttggaatgctgtcaaatatgattgcattctacgacatggcacgacgagcggtcgaaaccactgcacagagcgacaataaaataacatggagtattatacgcgagcatatgggcgatattctgtataagctaagttctatgaagtttaaagacccgctgaaggatggtgaagctaagattaagtcagactacgcccagctactggaggacatgcagaatgcctttaggtcacttgaggattag

SEQ ID NO: 48510 - DNA, 246 bp, Artificial Sequence
  Description of Artificial Sequence: Synthetic coding sequence
atggcctaccacggattgaccgtcccactgatcgtaatgtcagttttttggggcttcgtgggctttctagtgccgtggttcattccaaaaggcccaaatcgaggggtcatcatcactatgcttgtaacatgttcagtctgctgctaccttttctggctcatcgctattttggcccaacttaacccccttttcgggccacagctgaagaacgagacaatttggtacctcaaataccactggccatag

SEQ ID NO: 48511 - DNA, 246 bp, Artificial Sequence
  Description of Artificial Sequence: Synthetic coding sequence
atggcgtaccacggcctgaccgtaccacttatcgtgatgtccgtgttctggggttttgtgggcttcctggtcccatggtttatccctaaggggccaaaccgcggtgtgattatcaccatgctcgtcacctgtagtgtctgctgctatttgttttggctgattgctatcctggctcagctgaatcccctgttcggtccacagcttaagaatgagacaatctggtaccttaagtatcactggccttag

SEQ ID NO: 48512 - DNA, 1413 bp, Artificial Sequence
  Description of Artificial Sequence: Synthetic coding sequence
atgatggcggctatggccaccgccagagtcaggatgggccctagatgtgcccaagccctgtggcgaatgccatggctaccagttttcctctccctggcggctgccgctgctgccgcagccgctgagcagcaggtgcctctggtcctgtggtcaagcgaccgtgacctttgggccccagctgccgacacccacgaaggtcacatcacctcagatctgcagctgtctacgtacctggatccggcattggaactcggaccgaggaatgtactcctcttcttgcaggataagctcagcatcgaagactttaccgcttacggcggagtctttggtaacaagcaggattctgccttctcgaacctggaaaacgcattagaccttgctccgtcctctctcgtgctgcccgctgtcgattggtatgctgtcagcacgcttacgacttacctccaggagaaattgggggcttcacccttacacgttgacctggctaccctgcgagagctcaaactcaatgcatcactgcccgcactgctgttgatcagactgccatataccgctagttcggggctcatggcgcctcgggaagtcctgaccggaaacgacgaagtaatcgggcaggtactgagcaccctcaaatccgaagacgtaccctacaccgccgcactgacagccgtcagaccttctcgtgtagctagagacgtggctgtggtggccggaggcttgggaagacaacttttacaaaaacagccagtctctcccgttattcacccccctgtatcttacaatgataccgccccaagaattctgttctgggcacagaatttttccgtggcatataaagatcagtgggaggatctgacacctctgacgttcggcgtacaagaattgaacctcacagggagcttctggaatgatagcttcgctaggctctctctaacctatgagcgcctgttcggaaccacggtgaccttcaagttcatcctggcaaacaggctctaccccgtttctgcccgacactggtttacaatggagcggctggaggtgcattcaaatggtagcgtggcttattttaatgcttcacaggtcacaggaccgagcatctactcgttccactgcgagtacgtatccagtttgtcgaaaaagggatctctgctggtcgcccgaactcaaccttctccctggcagatgatgctccaggatttccaaatccaggcctttaacgtaatgggtgagcaattcagttatgctagcgactgtgcctctttcttttcccccggtatatggatggggttgctgaccagcctgttcatgctttttatcttcacgtacgggctgcacatgatactttcattaaagactatggatagatttgacgatcacaaaggtcctaccatttctttgacgcaaattgtttag

SEQ ID NO: 48513 - DNA, 822 bp, Artificial Sequence
  Description of Artificial Sequence: Synthetic coding sequence
atgatggccgctatggccacggcgagggtcaggatggggcctcgttgcgcacaggctctgtggcgaatgccatggttaccagtctttctctctctggccgctgccgctgctgccgcagcagccgaacagcaggtccccttagttctctggagctccgacagggacctatgggctccagcagcagatacccatgagggacacattactagcgatctgcagctgagtacctatctggatcctgccctcgagttaggaccacgcaacgtcctgctatttctccaagacaagctctcgattgaagactttacagcatacgggggagtgtttgggaataaacaggactccgccttctctaacctcgaaaatgctttagacctggccccatcctctctcgtgctgccggcagtcgactggtacgccgtgtccacactgacaacatacttacaggagaagctgggcgcttcaccacttcacgtggccagggacgtcgctgttgtagcgggagggctcggcagacagctacttcagaagcaacccgtttcaccagtgattcaccccccagtgtcttataatgacacagcccctaggatcctcttctgggcccagaacttttcagtggcatacaaagatcagtgggaggacctgaccccactcacattcggcgtacaagagctcaacctcacgggctcgttctggaacgacagcttcgccaggttcatcttggctaatcgcttgtaccctgtaagcgcccgtcactggtttaccatggagcgacttgaggtccattctaatgggagcgtggcatacttcaatgcctcttag

SEQ ID NO: 48514 - DNA, 885 bp, Artificial Sequence
  Description of Artificial Sequence: Synthetic coding sequence
atgaaagcaacttcacctgcgacctgctcctccggcctgatggcaccgagagaggtgctgacaggaaacgacgaagtaataggtcaagtcctgagcactctgaaaagcgaagacgtgccttacaccgcggcactgactgccgtccgtcctagtagggtcgcgcgtgatgtggccgtagtggctggagggttaggcagacagctgctgcagaaacaacccgtctcacccgtgatccatcccccagtgtcgtataacgacactgcccctagaatcctgttttgggctcaaaacttcagcgtcgcctataaagaccagtgggaggacctgacacccctgactttcggcgtccaagagttgaatctcaccgggagcttctggaatgacagcttcgcaagattgtccctcacatatgagagattattcgggaccactgtgacttttaagttcatcttggccaaccgcctgtacccagtgtctgcacgccattggttcaccatggaaaggctggaagtgcatagcaacgggagtgtggcctatttcaatgcttctcaggtgacgggcccatctatatacagtttccactgtgaatacgtgtctagtctgtcaaagaaaggcagcctgctggtggccaggactcagccgtctccatggcagatgatgctccaagattttcagattcaggcctttaacgtgatgggggaacagttcagttacgcttcagactgtgcctcctttttctcccccggaatctggatggggttgctgacttctttgttcatgttgttcattttcacctatggcctgcatatgatcctgagtctgaaaacgatggaccgattcgatgatcataaaggcccaaccatctcccttacacagatcgtttag

SEQ ID NO: 48515 - DNA, 693 bp, Artificial Sequence
  Description of Artificial Sequence: Synthetic coding sequence
atgatggcagcgatggctacagcaagggttagaatgggcccacgttgtgcccaggcgctctggagaatgccttggctgccagttttcctgtccctcgccgctgctgctgcagccgcagctgcagaacagcaagttcccttggttctctggtcaagcgaccgagacctgtgggcacccgcagccgacacacatgagggacacatcacaagcgatctccagctgagtacctatctcgacccagcgctggaactcggcccacgaaacgtgctgctgttcctgcaggacaagctgtcaatcgaagacttcactgcttatggtggggtgttcgggaacaagcaggactctgcattcagcaatctggagaatgctctcgacttggcccctagcagtctggttctgcctgccgtcgattggtatgccgtgtctactctaacaacatatctgcaagaaaagttgggggcatcacctctgcacgtcgacctcgccaccttgcgtgagctgaaactaaacgctagcctgcctgccctattattaatccgactgccctacactgcgtctagtgggctgatggcacctcgcgaagtccttaccgacgaggtgatcggacaggtgctgtctacactcaagtcggaggatgtgccatatactgccgcactaactgccgttcggccaagccgcgtggccagggattag

SEQ ID NO: 48516 - DNA, 675 bp, Artificial Sequence
  Description of Artificial Sequence: Synthetic coding sequence
atgcgcctgtggaaggccagggtccttaaactggtgctgaagaccgcgaaggactcaaggctgggtttgaattccaaatggctgtcgcttaagctgggcgatgccggtaacccaagaagccttgctatcagattcatccttaccaactacaacaagctgtctattcagagttggttctccctcagaagagtggaaattatatcaaataacagcatccaggccgtgttcaaccccaccggcgtttatgcccctagcggctatagctatcgctgtcagagggtcggctctctgcagcaggaccaggctctcttgctgcccagcgatacagacgatgggtccagcctctgggaggtaacattcattgacttccagatccagggtttcgcaatcaaaggaggcagatttactaaagctcaagactgtgcgtcttccttttcgcccgcatttctgattggccttgccatgagtttgatcctgctgctcgtgctggcctatgcgttgcacatgttgatatacctgaggtatctggatcagcagtacgacctgatcgcctctccagcccacttttcacaacttaaggcacgggacacagccgaggagaaagaactgctgagatcccaaggagctgagtgctacaagttgaggagtcagcagatctccaaaatttatgtgtag

SEQ ID NO: 48517 - DNA, 675 bp, Artificial Sequence
  Description of Artificial Sequence: Synthetic coding sequence
atgcgactctggaaggcgagggttctcaagctcgtcctgaagactgccaaagactctcgtctaggtctgaactccaaatggctttccctgaagctgggcgatgccggaaaccccagatcgttagctatacgctttattctgaccaactacaacaagttatcaatccagtcatggtttagtctgcgcagggtggagataatctcaaacaattctatccaggcagtgttcaatcccaccggagtgtacgcccctagcggctactcctaccggtgtcagcgtgtcggctcactgcaacaggatcaagccctactcttaccatccgacactgatgatgggagttcactctgggaagtgacgttcatcgacttccaaatccagggctttgcaatcaaggggggacgcttcactaaggctcaagactgcgccagtagcttttctcccgcatttctcatcggcctagcaatgagtctcatcctcctgcttgttttggcttacgccctgcacatgctgatttatctgaggtaccttgaccagcagtacgacctgatcgcatcccctgcgcatttctcccaactgaaggcgcgagacaccgccgaagaaaaggagctgctcaggtcccagggggctgaatgttataaactgcgtagccaacagatttctaagatttacgtctag

SEQ ID NO: 48518 - DNA, 3327 bp, Artificial Sequence
  Description of Artificial Sequence: Synthetic coding sequence
atgtttctaggcctcggaagattcagtcgcctagtgctttggttcgccgcattcagaaaactgctagggcaccacgggctagcttccgcaaaatttctgtggtgtttgtgtctgctctccgtcatgtccctgccccagcaagtgtggactctaccgtataaaatcggtgtggtaggtccttgggcttgtgactccctgtttagtaaggcactgccggaagtagcagccaggctcgccatcgagaggataaatagagatcctagctttgacctgagttacagcttcgagtatgttattttaaacgaagactgccaaacgtctcgcgcactcagtagctttatcagccaccaccaaatggcaagcgggttcattgggcctacgaatccagggtattgcgaagccgctagtctgctgggcaacagctgggacaagggtatctttagctgggcctgcgtgaactatgagcttgacaacaagattagctacccgaccttttcccggactctgcctagccccatcagggttttagtgacggtaatgaagtacttccagtgggctcatgcaggcgtgatctcctccgatgaggacatctgggtccacactgcaaatagagtggcttcagcccttcgctctcacggacttcccgttggggtggtgctgaccactggccaggactcacaatccatgcgcaaagctctgcaacggattcatcaagccgatcgaatccgaattatcattatgtgtatgcactccgcgctcatcggcggagagacccagatgcatttgctggaatgcgcacatgaccttaaaatgacggatggaacatatgtcttcgtgccatatgacgctctgctgtattcgctgccctacaagcatacaccttaccgggtgctgcggaacaatcctaagctgcgagaggcatacgatgcagtactgactatcactgtagagtcccaggaaaagactttctaccaggccttcacagaagccgctgccaggggggagatccccgaaaaactggaattcgatcaggtctctcctctgtttgggacaatctataattccatctatttcattgcccaggccatgaataacgctatgaaggagaacgggcaggcaggagccgcaagtctggtgcagcattcccggaacatgcaattccacgggtttaatcagctaatgcggacagatagtaacggcaatggtataagcgaatacgtgattctggacacaaaccttaaagaatgggagctccacagcacctacactgttgatatggagatggagctgctgcggttcggagggacccctatccattttcccggtggtcggccaccaagggctgacgccaaatgctggttcgctgaaggaaagatatgtcatggcggaatcgatcccgctttcgcaatgatggtctgcctcaccctcctgattgcgctgctttctattaatggcttcgcctactttatcaggcgacggataaataagatccagctgataaaagggccaaatcggatactgctcaccctcgaagatgtgacctttattaatccccatttcggcagtaaacgcggtagtagggctagtgtttcatttcagataacttccgaggttcagagtggacggtcccctaggctgagtttttcttctggctccttaacacccgcaacatatgaaaattcaaatattgccatctacgagggggattgggtgtggcttaaaaagttttccctgggggattttggcgatttgaagtccatcaagagccgggcatctgatgtctttgagatgatgaaggacctaaggcacgaaaatattaatcccttgctaggcttcttctacgattccggaatgttcgcaatagttactgagttctgtagtcgaggcagtctggaagacatcttaactaatcaggacgttaaactcgactggatgttcaaaagttccctcttgctcgacttaatcaaggggatgaaataccttcatcacagggagtttgtgcacgggaggcttaagtcccgcaactgcgtggtcgacggtcgcttcgtactcaaagtcaccgactatggatttaatgatatcctggagatgctaagattgtctgaagaggagagctctatggaggagttgctgtggactgctcccgagttgctcagggcccctcgcggatcccgcctcggaagctttgctggggacgtatacagcttcgccatcatcatgcaggaggtgatggtgaggggaactccattctgcatgatggacctgcccgcacaagaaataattaaccgccttaagaagccgccaccggtttaccgacccgtagtcccgcctgaacacgcacctccggagtgccttcagctgatgaagcagtgctgggcggaggcagcggagcagaggcccactttcgatgagatatttaaccagtttaagacatttaacaagggtaagaaaaccaacatcatagacagtatgctacggatgttggaacaatatagttctaaccttgaagatctgattcgcgagcgcaccgaggagctcgaaatcgagaaacaaaaaaccgaaaaactccttacccaaatgcttccccctagcgtggccgagtctctgaagaagggctgcactgtcgaacccgagggtttcgatcttgtaaccctgtacttctcggacattgtggggttcaccactatctccgctatgtctgaacctatagaggtggtggatctccttaatgacttatataccctatttgatgcaatcattgggtcacatgatgtgtacaaggtggaaactatcggggatgcctatatggtcgcatccggtctgccgaagcggaatggctcgagacatgctgctgagattgccaatatgtcactagacattctttcatccgtgggaacttttaaaatgagacacatgccggaagtccccgtaagaatacgaatcgggctccattccgggcctgttgtggcgggagtggttgggttgaccatgccacggtattgtctcttcggtgacacagtgaatactgcaagtaggatggagtcaactggcttaccctataggatccatgtgtcgttgtccactgtaaccatcctgcagaacctctcagaggggtacgaagtcgagctgcgagggagaacagagcttaaagggaagggcaccgaggaaacgttttggctcataggcaaaaagggctttatgaaaccactacctgtccctccccctgtggataaggacggccaggtcggacacggtctgcagcccgtggaaatcgccgctttccaacgtcggaaagccgagagacaacttgttagaaacaagccctag

SEQ ID NO: 48519 - DNA, 1062 bp, Artificial Sequence
  Description of Artificial Sequence: Synthetic coding sequence
atgcggaggcagctcaggagcaggagggcaccaagtttcccgtactcctaccggtaccgattagacgatcctgatgaggccaaccaaaattacttagcagacgaggaagaagaggctgaagaggaggccagagtcaccgtcgtgccgaaaagtgaggaggaggaagaagaggaggaaaaggaggaagaggaagaggaggagaaggaggaagaggagggacaggggcagcccacggggaacgcctggtggcaaaagcttcagattatgagcgagtatttatgggatcccgaaagaaggatgttcttggccagaacaggtctaatactgctgatctatttctttttctatgcatcactggcagctgtgattacgctctgcatgtacactctgtttctgactatcagtccatatatcccgacatttaccgagagggtaaaacccccaggagtcatgatccgcccttttgcccactcgctgaatttcaacttcaacgtctccgagccagatacttggcagcattacgtcatttcgcttaacgggtttctccagggctataatgatagcctgcaggaggagatgaacgtggactgccctcctggccagtatttcattcaggacggaaacgaagatgaggacaaaaaggcctgccagtttaaaagaagcttccttaaaaactgtagcggtctcgaagatcctacattcggctactcaacagggcagccatgcatcctgctaaagatgaataggatcgtgggattccggcctgagctgggggaccctgtgaaagtttcatgtaaggtgcagcgaggggatgaaaatgacatcagaagcatctcctattatccagagagtgccagctttgatttgcgctactacccttactatggcaagctaacacacgttaattacacctctcccttggtggcaatgcatttcactgatgtagtgaaaaaccaagctgtgcctgtacaatgccagctgaagggcaagggtgttattaacgatgtaattaatgaccgttttgttgggagggtgatattcaccttgaacatcgagacatag

SEQ ID NO: 48520 - DNA, 945 bp, Artificial Sequence
  Description of Artificial Sequence: Synthetic coding sequence
atgcgaagacagctccgatctaggcgagccccatccttcccatacagctatagataccgactggacgatccagatgaagccaaccaaaattatctggcggatgaggaggaggaggcagaggaggaggctcgtgtgaccgtggtgccaaaatctgaggaagaggaggaggaagaggaaaaggaagaagaagaagaggaagagaaagaggaggaagagggacaggggcagcctaccggcaacgcatggtggcaaaagctccagatcatgtcagagtatttatgggatccggaacgaaggatgttcctagctagaacgggccaatcctggagagtgatgatcaggcccttcgcccactcactgaactttaatttcaacgtatctgaacctgacacatggcagcactatgtcataagtctgaatggctttctgcaggggtacaacgactcgttgcaggaagaaatgaatgtggattgcccgccagggcagtatttcattcaggacgggaacgaggatgaagataaaaaagcttgtcaatttaaacggagttttctgaagaactgcagcggactggaggatcccaccttcggctacagtactggtcagccctgcatcctgctaaagatgaaccggatcgtggggttccggcctgagctgggcgatccagtgaaggtctcctgcaaagttcagagaggggacgaaaatgacattagatcgatctcgtattatccagaatccgcatccttcgacctcaggtactacccttattatgggaagctgactcatgtcaattacacttcacctctggtcgccatgcactttacagatgttgtgaaaaaccaagccgtgccagtccagtgccagcttaaaggcaagggagtcatcaacgatgttattaacgacagattcgttgggcgagttattttcaccctgaacatcgagacatag

SEQ ID NO: 48521 - DNA, 381 bp, Artificial Sequence
  Description of Artificial Sequence: Synthetic coding sequence
atggtggatgagaatgacatccgggctctcaacgtgcgacattaccgggatcacataggagtggttagccaggagcccgtgctgtttggcaccacaatctccaataatataaagtacggtcgagacgatgtgactgacgaggaaatggagcgagccgcacgcgaagcaaacgcttatgattttattatggagtttccgaacaaattcaacacgttagtgggcgaaaagggagcccaaatgtccggaggccaaaagcagaggatcgccatcgcaagggcgctcgtgcgcaaccctaaaatcctaatcctggacgaggcaacaagtgccctggactctgaatctaagtctgccgtgcaggccgcactggaaaagaaaaagtag

SEQ ID NO: 48522 - DNA, 2439 bp, Artificial Sequence
  Description of Artificial Sequence: Synthetic coding sequence
atggtggatgagaatgatatccgcgctctgaatgttcggcactaccgggatcatattggggtggtgagccaggagccggtcctgttcgggaccacaatatccaacaacatcaagtatggtcgggacgatgtaacggacgaagagatggaaagggctgctagagaagctaacgcctacgactttattatggagttccccaacaagttcaacactctagtgggggaaaaaggggctcaaatgagtggaggccaaaagcaaagaattgccatcgcgagggccctggtgcgcaatcccaagatattaatacttgatgaagctacctccgctctggacagtgaatctaagtcggccgtgcaagccgctctggagaaagcctctaagggcagaactaccatcgttgtcgctcacaggctgtccacaatacggagcgcagatctaattgtgaccctgaaggatggtatgctcgctgagaagggagcccatgcggaattgatggccaaacgcggactgtattactcactagtcatgtctcaggacatcaagaaggcagatgaacagatggaaagcatgacgtacagtacagaaaggaagactaacagcctgccactgcatagtgtaaaaagcatcaaaagcgatttcatagataaggcagaggagagcacccagagcaaggagatatctctaccggaggtgtcactgcttaaaatcctgaaactgaacaaaccagaatggccatttgtcgtcctcggaacgctggcaagtgtgctcaacggaacggtgcacccggtctttagcattattttcgctaagataattaccatgtttggaaacaatgataagaccactctgaaacatgacgctgagatctattctatgatcttcgtcatcctgggcgtgatctgctttgtgtcttatttcatgcagggcctgttttatgggcgagctggggagatccttaccatgaggcttcgtcacttagcctttaaggctatgctttaccaggacattgcttggttcgatgaaaaggagaactcaacaggcggtctgacgaccattctcgctatcgatattgctcagatccagggggcaacgggatctcggataggtgtcctgacacagaatgccactaacatgggcctgtcagtcattatttcctttatctacgggtgggagatgacttttttgatcttatctattgcacccgtgctcgcggtaacaggcatgattgaaaccgcagcaatgaccgggttcgcaaacaaggataagcaggaactcaagcacgcaggaaaaattgccaccgaggcattggagaatattcgaacaattgtctctctcacacgagaaaaggccttcgagcagatgtatgaagagatgctgcagacacagcatagaaatacatctaaaaaggcacagattatcggcagctgttacgccttctcacacgcatttatctattttgcttatgccgcaggatttagattcggagcctatttgatccaggccggacgcatgacccctgagggaatgttcatcgtttttaccgccatcgcttatggcgcaatggctatcggtgaaaccctggttttggccccagagtattcaaaagccaagtctggggctgcgcacctgttcgccttgctcgagaagaaacctaacattgacagtcgatctcaggagggaaagaaacctgacacttgtgagggaaacctggagttccgggaggtctcattcttctacccctgcagacctgacgtcttcatccttcgcggactgtcgctttcaatagagcgcggtaagactgttgcatttgtgggatcatcgggatgtggaaagagcacgtcagtgcagctgctgcagcgtttatacgatcctgtccagggccaggtcttgtttgatggggtggacgccaaggagctcaatgtgcaatggctgcgttcccaaatcgccattgtgcctcaggagccggttctgtttaactgcagtatcgcggaaaatatcgcatatggtgacaactccagagtggtgccgctggacgagatcaaagaggccgctaacgccgctaacattcattcattcattgaaggacttcctgaaaagtacaacacccaggtcggcctgaaaggcgctcagttgtccgggggtcagaagcagcgcctcgccattgccagagcactcctccagaagcccaaaatcttgctcctggacgaggcgacgagtgcacttgacaacgatagcgagaaagttgtccagcatgctctggataaagcaagaacagggcgtacctgccttgtggttactcatagactgagcgcgatccagaacgccgacttgatcgtggtactgcacaatggaaagatcaaagagcaggggactcaccaagaactcctgcgtaatcgcgacatttacttcaagttggtgaacgcccagagtgtccaatag

SEQ ID NO: 48523 - DNA, 3774 bp, Artificial Sequence
  Description of Artificial Sequence: Synthetic coding sequence
atggagaactccgagcgggctgaggaaatgcaggaaaattatcagcggaatggcactgccgaggagcagccgaagctcaggaaggaagctgtggggtctattgagatcttccgtttcgccgatggcctagatataacactgatgatcttgggcatcctggctagtctggttaacggggcatgtttgccacttatgcccctggtcctcggcgagatgtcggacaacctgatatctgggtgcctggtccagaccaatacgacaaattatcaaaattgcacccagtctcaggagaaacttaacgaagatatgaccctgctgacactgtactatgtgggaatcggggtagccgctctgatatttggctatattcagatctctttatggattataaccgctgcacgccagaccaaacgcatccgcaagcagttcttccattccgtgctggcgcaggacataggatggtttgattcgtgtgatatcggcgagctcaatacacggatgacagacgacatagacaaaatttctgatggcatcggtgacaagatcgctttgctgttccagaacatgtcaacattcagcatagggcttgcagtcggcttggtcaaaggatggaagctgaccctggtgaccctgtctactagccctttaataatggccagcgcggctgcatgttcacgcatggtcatttctctgacgtctaaggaactgtccgcatattccaaagctggagcagtcgctgaagaagtgctgtctagcattcgcactgtgattgcattcagagcacaggaaaaggagcttcagcggtacacacagaaccttaaagacgccaaggatttcggtatcaagaggactattgcaagtaaagttagtcttggagccgtttacttcttcatgaacgggacatatgggctggccttttggtatgggaccagtctgattttaaatggcgagccagggtacacaatcggtactgtcctggccgtgtttttctccgtgatccactcttcctattgcatcggtgctgcagttccacactttgagacgtttgccatcgctagaggagctgcctttcatatctttcaggttatcgacaaaaagccctctatcgataacttctctaccgcgggttacaagccagagtccattgagggaacggtggagttcaaaaacgtatctttcaattatccctcacggccttctataaagattcttaaaggcctgaatctgcggataaaatccggcgaaacagtcgccctagtggggctcaacggctccggaaaaagtacagtcgtgcagctgctgcagcgcttgtatgacccagacgatggatttattatggtggacgaaaatgacatcagggcactgaacgtgcgtcactacagagaccatattggtgtggtgagtcaagagcctgtgttatttggtaccactatcagcaacaacatcaagtacggcagggatgacgtgacggacgaagaaatggagcgcgctgctagagaagcgaatgcctacgactttatcatggagttcccaaataagttcaataccctggtgggagaaaagggagctcagatgagtggtggtcagaaacagagaatcgccatagcgagagctctggtgcggaacccaaagattctcatactggatgaggccacatctgctctggattcagagtccaagtccgctgtacaggctgccttggagaaggccagtaaggggagaacaactattgtggtggcacacagactgtcaactatcagatccgctgacttgatagtcaccttaaaggatggtatgctagcggagaagggagcgcacgcggagttgatggctaaaagggggctgtattactctttagtgatgtcgcaggatatcaaaaaggccgacgagcagatggaaagcatgacatactccactgaacgcaagaccaattcattgccactgcactcggtaaaaagtattaaatccgattttatcgacaaggcagaggaatccacccagtcaaaggagatcagcttgccagaggtgagccttctgaaaatcctgaagctgaataaacccgagtggccatttgtggtgcttggcacccttgccagtgtgctgaatggtaccgtccaccctgtttttagcataatcttcgcaaagataataacgatgttcgggaataatgataaaacaactctgaaacacgatgccgaaatctatagcatgatatttgtgattttgggggttatctgcttcgtgagttatttcatgcaggggctgttctatggcagagccggagaaatattaacgatgcgcctacggcatctggcatttaaagccatgttgtaccaggacatcgcctggtttgacgagaaggaaaacagtaccggtggtctgaccacaatcctggcaatcgatattgcccaaatacagggcgcaactgggtcaaggatcggtgtgttgactcagaacgcgacgaacatgggcctgagcgttattatcagttttatctatggctgggagatgactttcctcatactgagtatcgctccagtccttgccgttaccgggatgatcgagactgcagccatgaccggatttgccaataaggataaacaggaactgaagcatgccggaaagatagccaccgaagccctggagaacatcaggactattgtgagtttgacacgggagaaggctttcgagcagatgtatgaggaaatgttgcagacccagcacaggaacacgagtaagaaggctcaaattatcggaagctgctatgccttttctcacgccttcatatactttgcgtacgcagctggcttccgttttggggcttatttgattcaagccggtcggatgactccggaggggatgttcatcgtttttactgcaatcgcttatggtgccatggccataggcgagacactggtcctcgcaccagagtatagcaaggcaaagagcggcgcagctcacctgttcgcacttctggaaaagaaacctaatattgatagtcgatcacaagagggaaaaaaacctgacacctgcgaggggaacctggagttccgcgaggtgagcttcttctacccctgccgacccgacgtgtttatcctgcgcggtttgagtttatcaatcgagcgaggaaaaaccgtggctttcgtggggtcctcgggttgcggaaaatcaacgtccgttcagcttctgcaaagactatatgacccagtgcaaggtcaagtgctgtttgacggggtcgacgctaaggaactaaacgtgcagtggctgaggtctcaaattgctatcgtaccacaggaaccggtacttttcaattgcagtattgcagagaacattgcttatggagacaattctagagtagtgccgctggacgaaattaaggaggcagcaaatgcagccaacatccactccttcatcgaaggcttacccgaaaagtataacacacaggtcggtttgaagggcgcacagctctctggcggacaaaaacagcggctagccatcgccagggctttgctacagaagcccaaaatcctgttactcgacgaggcaacttctgccctcgacaatgactcagagaaagtagttcagcacgctttggacaaagccaggactggccgtacatgcctggttgtcacacatagactgtccgccatccagaatgccgatttgatcgtcgtccttcataatgggaagataaaggaacaaggaacgcaccaagagcttctccgcaatagggatatctattttaagctggtgaacgcccagagcgtgcagtag

SEQ ID NO: 48524 - DNA, 396 bp, Artificial Sequence
  Description of Artificial Sequence: Synthetic coding sequence
atggtcgacgagaatgacattcgggcactcaatgttcggcactacagggatcacatcggagtagtgagccaggaacctgtgctgtttggcaccaccattagcaacaacatcaagtacggacgagatgatgtgaccgacgaggagatggaaagggctgccagagaagccaacgcttacgattttatcatggagttccccaacaagttcaatacgctggtgggagaaaaaggtgcacagatgagcggcggacagaagcagagaatcgcaatcgctcgggctctggttaggaaccctaaaattttaatcctggacgaagccacatcagccctggattctgaatctaagtccgcggtacaagccgcactggaaaaagatacccccaggtattctttctag

SEQ ID NO: 48525 - DNA, 4749 bp, Artificial Sequence
  Description of Artificial Sequence: Synthetic coding sequence
atgcccctggcgttttgtggttccgagaaccattcggccgcataccgcgtagatcaaggcgtattgaacaatggctgcttcgtggacgcactcaatgtagttcctcacgtgttcctgctcttcattactttcccgatcctgtttattgggtggggcagccagtccagcaaggtgcatatccaccacagcacctggcttcacttccctgggcacaacctgcgctggatcctgactttcatgcttctgtttgtgctggtctgtgagattgccgaggggattttgtcagatggcgtaaccgaatcccatcacctgcatctttacatgcctgctgggatggcattcatggcagccgtcacctctgtggtctattaccacaatattgagacctctaactttccaaagcttctaattgcacttctggtgtattggacacttgcctttattactaagaccattaagtttgtgaagttcctggaccacgctattggatttagtcagttaagattctgtcttactggattgctcgtcatcttatatggcatgctcctcttagttgaggtgaacgtcatacgggtacgcagatacatatttttcaagacccctcgcgaagtgaaaccacctgaagacttacaggacttgggggtgagatttctccagccatttgtcaacctgctgtctaagggcacttactggtggatgaatgccttcattaaaaccgcccacaaaaaacccatcgaccttcgcgcaatcggtaagcttcctattgctatgcgcgcattgactaattaccagagattgtgcgaagccttcgatgctcaggtgaggaaggatattcaaggcacacaaggagctcgtgcgatctggcaggcgctgtcacacgcttttggccgtcgccttgtgctgtcctccactttcaggatcctcgccgatctactaggatttgccggaccactgtgtatcttcggcatcgtggaccacctggggaaagaaaatgacgttttccaacccaagactcagttcctgggagtgtatttcgtgtcatctcaagaatttcttgcaaatgcctatgtcctggctgtgctgctgtttctggctctgttgctgcagagaacattcctacaagcctcttattacgtggcaatcgagacggggatcaacctgcggggagctatccagacgaagatatacaacaagatcatgcacttgtcgacctccaaccttagtatgggagagatgactgcaggtcaaatttgcaacctggttgcaattgacacaaaccagctgatgtggtttttctttctctgccccaacttgtgggcaatgccagtgcaaatcatagtaggtgtaatcctgctctattatatcctgggagtctctgccctgatcggagcagctgtgatcatccttctcgctccagtacagtattttgttgctaccaagctctctcaggcccagagaagtacactcgaatactccaacgagagactgaagcagaccaatgaaatgctccggggaattaagttgctcaagctctacgcatgggaaaatatttttcggactagagtcgagaccactagacggaaggagatgactagcctgcgtgcttttgcaatctacacctccattagtatcttcatgaataccgctattcccattgcagcggtgctgatcacctttgtagggcacgtcagtttttttaaagaggccgacttttctccatcagtggcattcgcaagcctgtctctcttccatatcctagtgacacctctgttcctcctgagtagcgtcgtgcggagcacagtgaaagccctggtgagcgtccagaagctatctgagtttctttcttctgccgaaattagggaagaacaatgtgccccacacgagcccacacctcagggtcccgcatctaagtaccaggctgtgcctctccgcgtcgtcaataggaagcgtcccgctcgggaggactgccgaggcctcactggcccactccaatcattggtaccctccgcagatggagacgccgacaactgctgcgtgcaaataatggggggatatttcacgtggacacctgacggcattcctacactgagcaacatcacaataaggatcccacgcggacagctgaccatgatcgttgggcaagtcggctgtgggaagagcagtctccttctcgccgcacttggcgaaatgcagaaagtcagcggtgctgtgttctggagcagcagcctgcctgattcagagataggtgaagatccgtcacctgaacgggaaactgccaccgatctggacatcaggaaacgcggaccagttgcctacgcctcacagaagccttggctgctcaacgcgaccgttgaggaaaacattatatttgagagccccttcaataagcagcggtataaaatggtgatcgaggcctgcagcctacagccagacatcgatatcctcccgcacggcgaccagacccagatcggcgagcgaggaatcaacctttccgggggtcagaggcagaggatcagtgtggcaagagccctgtaccagcatgctaatgtggtattccttgacgacccttttagcgcccttgatattcatctgagcgatcacctcatgcaggctggcatattggagttactcagagacgataaaaggacagtggtgctggtcacccacaagctgcagtatctgccacatgcagattggatcatcgctatgaaagatggcaccatccaaagggaaggaacactaaaggatttccagcgtagtgaatgccaattatttgagcattggaagactctgatgaatcgacaggatcaagagctcgagaaggaaacggtgacggagagaaaggcgactgagcctccacagggtctttcccgcgctatgtctagccgcgatggactcctgcaggacgaggaggaagaggaggaggaggccgctgagtccgaggaagatgataacctctcttccatgctgcaccagagggccgagattccttggagagcctgtgctaaatacctgtcgtccgctggaatcttgctcctgagccttctagtcttcagccagctgctgaaacatatggttcttgtcgctatagattactggctggcgaaatggacagattctgccctgacacttacacccgctgccaggaattgcagcctgagccaggagtgcactctggaccagaccgtttacgccatggtgttcacggtgctgtgtagcctaggcattgttctctgcctcgtgaccagtgtcacggttgagtggaccggcctgaaggtggccaagagattacaccgctccctgctcaatcggataatattggctccgatgcggtttttcgaaacaacccctttagggagcattctgaaccgcttcagttcagattgtaatactatcgatcagcacattccttctacactggagtgtttgtcccgcagtaccttactatgtgtctctgcactggctgtgatctcgtatgtgaccccagtgtttctggtcgcccttctgccgcttgcaattgtttgctactttatccagaagtattttcgggttgcttctcgagaccttcagcagttagacgacaccacacaattgcccctgctttcccattttgccgaaaccgtggaagggctcactaccattagagcctttcgctatgaggcccgtttccagcagaagttgctcgagtataccgacagcaataatattgcaagccttttcctgaccgccgctaataggtggcttgaggtaaggatggagtacattggcgcttgcgtggttctgatcgccgcagttacgtccatatcgaattctctccatcgggaattgtctgcaggattggtgggacttggccttacttatgcactcatggtgagtaattacctgaactggatggtgagaaacctggcagacatggagctgcagttaggcgctgttaagcgcattcacggcctgctcaagactgaggccgaatcgtatgagggcctcctcgccccttcgctcatcccgaagaattggcccgaccagggaaaaatccagattcagaacctgagcgttcggtatgattcttcactgaagcccgttcttaaacatgtcaacgctctgattgcccctggccaaaaaatagggatctgtgggcgaaccggtagcgggaaatcttccttcagtttggcatttttccggatggtcgacacttttgaggggcacatcattattgacggcattgatattgccaagttgccactacacaccctccgctctcggcttagtattatattgcaggatccggtgcttttctccggaacaatccggtttaacctggacccggaaagaaaatgctccgatagcaccttatgggaggccctcgaaatcgctcagctcaagctcgtcgtaaaagccctgcccggagggctcgacgcaatcattaccgagggcggagagaacttctctcagggccaacgtcagctattttgcctggccagagccttcgtgagaaaaacatcaatcttcatcatggatgaggctactgccagtatcgacatggcgactgagaacatcctccagaaagtggtgatgaccgcattcgctgatcgaaccgtggtcacaattgcacatagagtgcacaccatattgtctgccgacctggtgatcgttttgaagcgcggagctattctcgagttcgacaaacctgaaaagctgttatcaagaaaggacagcgtgttcgcaagctttgtgcgggcagataagtag

SEQ ID NO: 48526 - DNA, 3036 bp, Artificial Sequence
  Description of Artificial Sequence: Synthetic coding sequence
cggtcccagttaagcccctctcccgctcgagcgagggctgccatgcctctcgccttttgcggcagtgaaaaccacagtgcggcttatagagtggatcagggggtgctaaacaatggttgtttcgtcgatgcccttaatgtcgtgccccatgtgttcctgttgttcattacattcccaattcttttcataggatggggatctcagtcaagcaaggtccatatccaccacagtacatggcttcacttcccaggccacaatttgaggtggatcctgacattcatgttattgtttgtgctcgtgtgcgaaatcgcagaaggcattctgtccgacggagtgacggagtcccatcatcttcatctctacatgccggcaggtatggcttttatggcagcagtcacctctgtcgtttactatcataatattgaaacctctaactttcccaagttattgatcgccctcttggtctactggacccttgccttcataaccaagaccataaagtttgtgaaatttctggatcatgccattggtttctctcagctgcggttttgcctgacaggcttgctcgtcatcttatatggcatgctgctcttggtggaagtcaatgttattagggtccgcagatacattttcttcaagacacccagagaggttaagcccccagaagacctgcaggacttgggtgtgcgctttttacagccgttcgtcaatcttttatctaagggaacctactggtggatgaatgccttcatcaagactgcccacaaaaagccaatcgatctcagggcaataggtaagttacccatcgcgatgagagctctgaccaactatcagcgcttgtgcgaagctttcgacgcacaggtacggaaggatatacagggcacacaaggcgctagagctatctggcaagccttatcacacgccttcggtaggagactggtcctgtcttccacttttcggattctggctgacctcctaggcttcgccggtccactgtgcatctttggcattgtcgaccacctgggcaaggaaaatgacgtgtttcagcccaagacgcagtttttaggggtgtactttgttagcagccaagagtttttggctaacgcctacgtgctcgctgtcttgctctttcttgctctgctgctgcagcgtacctttctgcaggcaagttactacgttgccatagaaacgggcataaacctgagaggtgccattcagaccaaaatctataacaagatcatgcatctcagcacatccaacctcagtatgggggagatgacagctggccagatttgcaacctggtcgcaattgatactaaccaactgatgtggtttttcttcctgtgtccaaacttgtgggctatgccagttcagattatcgtgggcgtgatcttgctatactacattttgggcgtatctgctctgattggagcggctgtcataattttgttagcacccgtgcagtacttcgtcgctaccaaactctcacaggcgcagcggtcaacactcgaatattctaacgagagactcaaacagacaaatgagatgctgcgaggcattaaacttttgaaactttatgcttgggagaacatcttccgcacacgggtggagacaacccggagaaaggaaatgactagcctgcgagcattcgctatttatacttctatcagcattttcatgaacaccgccatccctattgctgccgtccttatcacttttgtcggacacgtgagtttttttaaagaagccgatttctccccttccgtcgccttcgccagcctgtccctgttccacattctggtcactcctctctttctgctcagcagcgtggtccgtagtaccgtcaaagcactggttagtgctgagattagggaggagcaatgtgcaccccacgaaccgaccccacaaggcccagcctcgaagtatcaggcagtcccccttcgcgtggtcaaccgaaagaggcccgctagggaagattgtagaggtttgactggccctctccagtcacttgtgccatctgccgacggcgacgcggataattgctgcgtccagattatgggcggttactttacttggactcccgatggcatacccacgctttctaatataacaatccgcatacccaggggacaacttacgatgattgtgggccaggttggatgtggcaaaagtagcctgctcttagccgctctcggggaaatgcagaaagtgagcggtgccgtgttctggtcaagcctgccagattccgagattggcgaggacccatcccccgagcgggagacggctacagatctcgacataaggaagagagggcctgtggcgtacgcttcccaaaaaccctggttgctcaacgccactgtagaggagaatatcatattcgaatccccatttaacaagcagagatataaaatggtgatcgaagcgtgcagtctgcagcccgatatcgacatccttccacacggagatcagacccagatcggagagcgaggtatcaacctatctggcggacagcgccagagaatctctgtggccagagctctgtaccaacatgccaacgtcgtctttttggacgacccctttagtgctctggatatacatctctcagaccacttgatgcaggctggaatcttagagttgctgagagatgacaaacgtaccgttgtgctagtgacccacaaactgcagtatctccctcacgccgattggattatcgctatgaaagacgggacgattcaacgggaagggaccctcaaagacttccaaaggtcagagtgtcagctgttcgagcattggaaaactctcatgaacagacaagatcaagagttggaaaaacgtaggcaactcagggccagaaggatgaccacctgtaggccctgttgtactagtgttctgcggtcacacggtgagcctgcacctagcacatgccctcccccagctagctgctcttgtcggtgttggagttcacacagttgcagcagtacctggtcgtggtggcctagcactactggctggccctccggacctacagccccatag

SEQ ID NO: 48527 - DNA, 4746 bp, Artificial Sequence
  Description of Artificial Sequence: Synthetic coding sequence
atgccactggcattttgtggaagcgaaaaccacagcgcagcctatagggtagaccaaggcgtgctcaacaatggctgtttcgtggacgctttgaacgtcgtcccacatgtgtttctgctttttatcacattcccaatcctattcattggatggggtagtcagtcctccaaggtccatatccaccacagcacatggctccattttccaggccacaacctgcgttggatcctgacatttatgcttctgttcgtgcttgtttgcgaaatcgcagaaggcattctctccgacggagtgaccgagagccaccatctgcacctatacatgccggcaggtatggcattcatggccgcagtgacatctgtcgtgtactatcacaatatagagacctccaacttcccaaaactgttgatcgctctgctagtctactggacacttgcattcatcaccaaaacaatcaagtttgttaagttcttggatcatgctatcgggttcagtcaattgcgcttctgtctcacaggattactcgtaattctgtatgggatgttactcctggttgaagtcaatgttatcagggtgcgtcgttatatctttttcaagactcccagagaggtgaagcctccggaagatttgcaggatcttggagtgcggttccttcagccattcgttaacctgctttctaagggaacctactggtggatgaatgcttttatcaagacagcccataagaagccaattgacctacgggcaatcgggaagctgcctatagctatgagggccctcacgaactaccagagactttgtgaggccttcgacgcgcaggtccggaaggatattcaaggtacgcagggggctagggctatctggcaggccctttcccatgcctttggccgaaggctggtgctcagtagcacttttagaatcttggcagatctgctggggtttgccggaccactctgcatattcggaatcgtggatcacctgggaaaagagaacgatgttttccagccaaagacgcagttcctcggagtgtatttcgtgtcttcacaggaatttctggccaacgcctacgtcttggccgtgctcctatttctcgctctcctattgcaacgcacctttctgcaggcgagctattatgtggcaattgagacaggaatcaacctcaggggcgctatccagactaaaatttataacaaaattatgcacctatccacatcaaatctgagcatgggtgaaatgacggccggacagatctgtaacctggtggccatcgatacaaaccagttaatgtggttcttctttctttgccccaacttgtgggccatgcccgtgcaaatcattgtgggcgtgattcttttgtattacatactgggagtgagtgctcttattggcgcagcggtcataatacttctagccccagtgcagtacttcgtcgctactaaactctcccaggcacagcgtagcactctcgagtattccaatgagagactgaaacaaaccaacgagatgctgcgaggtattaagttgctgaaattgtatgcatgggagaacattttcagaacaagggtcgaaacaacacggaggaaggagatgactagcctgagggcattcgccatctatacctctatctctatcttcatgaacactgcaatcccaatagcagccgtcctaataacattcgtgggacacgttagcttttttaaagaggcagacttcagtccctctgtggcattcgcgagtttaagcttgttccacattctagttacaccactatttcttctgtcaagcgtggtgagatccacagtcaaggcactggtatcggtgcaaaagttgtcagagtttctgagttcagccgagataagagaggaacagtgcgccccacacgagccaactcctcagggtcccgcatccaaataccaggcagtccccctcagagtggtaaaccgtaaacgacccgctagagaagattgccgcggtctgaccgggcctcttcagtcacttgtcccaagcgccgacggcgacgcagataactgttgcgtgcagattatgggagggtactttacatggacacctgatggaattcccaccctgtctaacattaccatccggatccccagaggacagctgactatgatagtgggccaggttgggtgcgggaaatcttctcttcttttagcagcactgggagaaatgcagaaagtgtcaggggctgtgttctggagctccttgcccgactccgagatcggtgaggatccaagcccagaacgcgaaacagccacagatctggacattcggaaaagaggtcctgttgcttacgcctctcagaagccatggctgctgaatgctactgtagaggaaaatattatctttgaaagcccctttaataagcagcggtataaaatggttattgaagcctgttctctgcagcccgacatcgatatactgccgcacggtgaccaaacacaaatcggcgagaggggaataaatctatctggcggacagcgccagcgtatcagcgtggctagggctctttaccagcatgcgaatgtagtgtttttggacgacccattctctgcactggatattcacctgtccgatcatttgatgcaggccggaattttggaactcctgcgggatgacaagagaacagtcgtactcgtgacacacaaactgcagtaccttccccatgccgactggatcatcgcaatgaaagatgggactatacaaagggaaggtactctcaaagactttcagcgtagcgaatgccagctgtttgaacattggaagaccctaatgaaccgccaggatcaggagctcgagaaggaaacagtcactgagagaaaggctactgagccccctcagggccttagccgggcaatgtcatcccgcgatggtctcttgcaggacgaggaggaagaagaagaggaggcggctgaaagcgaagaggatgacaacctttcttctatgctgcaccagcgggctgaaataccatggcgtgcctgcgcaaagtatctatccagcgcgggaattttgttgctgtccttgctggtgtttagccagctgctaaagcacatggtcctagtcgccatagattactggctggcgaaatggaccgactcagccttaaccctgacccccgctgcccgtaactgttcactgtcccaggaatgcaccctcgaccagacagtctacgccatggtgttcactgtgctttgtagtctgggaatcgtgctctgtctggttacctcagtgaccgttgagtggaccgggcttaaagtcgccaaacggctccacaggtctctcctgaacagaattattctggctcccatgaggttctttgaaacgacccccctgggctctattttgaatcgcttttcatccgactgtaataccatcgaccagcacatcccaagcactctcgagtgcctttcccgctcaacccttctgtgtgtctctgcgcttgcagtcatctcttacgttaccccggtgtttctggtggccctgctgccactcgcgatcgtatgttattttattcagaagtactttagggttgcctcccgtgacctccaacagctggacgacactactcagctgcctctcctgtctcacttcgccgaaacagttgagggtctaaccacgatccgggcttttagatacgaggcccgtttccagcagaagctactcgaatatactgattccaataatatcgcctcgctgttcctgactgccgctaaccgttggctcgaggttcggatggagtacatcggagcctgtgtcgtgctgattgcggcagtcacctcaatatccaattctctgcaccgtgagttatctgccggtctggtgggactgggtctgacttacgccctcatggtgtccaattatctaaactggatggtccggaatctcgccgatatggaacttcagctgggagcagtgaagagaatccatggcttgctgaagacagaagcagagagctatgaggggttgttggcacctagcctcattcccaaaaactggcctgaccagggaaagattcaaatccaaaacttatccgtgagatatgatagcagtctgaaacccgtgctgaaacacgtaaacgctttaattgctccaggccaaaaaatcgggatttgcggcaggacagggtcaggcaaaagttctttcagcctagcattcttcagaatggtggacacattcgagggccatatcatcatcgacggtattgacatcgccaaactgcctctacataccctcaggtctaggcttagcatcatcctgcaggatccagtcctgttcagcggaactattcgattcaacttggatcctgaaaggaaatgctctgatagtacgctctgggaagctctggaaatcgcgcagctcaagctcgtggttaaggccctgccaggcggattagatgcgattatcacagagggcggagagaacttttctcagggacaaagacagttgttttgcttagcgagagcgttcgtccgcaagacctccatttttattatggatgaagcgaccgcatccatagacatggccacggaaaacatcctccaaaaggtggtgatgactgccttcgctgacagaacagtcgtgaccattgcccatagagtgcacacgattctcagcgcggatctagttatcgtgctgaaacggggtgcaatcttggaattcgacaagccggagaagctactttcgcgtaaagattctgtctttgcctccttcgttagggctgataaatag

SEQ ID NO: 48528 - DNA, 2994 bp, Artificial Sequence
  Description of Artificial Sequence: Synthetic coding sequence
atgccactcgccttttgtggatccgaaaaccactccgcggcatatcgtgtagatcagggtgtgttgaataatggatgttttgtggacgccctgaacgtcgtgccacacgtctttttgctgtttattacattccccattcttttcataggatgggggtcgcagagcagtaaggtccacattcaccacagcacttggttgcatttcccgggtcacaacttgcggtggatcctcactttcatgttgctctttgtgctcgtttgcgagattgcggaaggaatcctctctgacggagtaacggagtcccatcatctgcatctgtacatgccagccggaatggccttcatggctgccgtgactagcgttgtgtattaccataatattgagacctctaactttcccaaactgctgattgcgctgctggtgtactggaccctggcctttattaccaaaacgattaagttcgtcaaattcctggaccacgcgatagggttcagccagctcaggttctgtctgaccggcttgctcgttattttatatggaatgctgctgctcgtggaggtgaatgtcatccgagtgaggcgatatattttcttcaagactccaagggaggtgaaaccgcctgaggatctccaagacctgggagttcggtttctccagcctttcgttaatctcttgtccaaaggcacctattggtggatgaacgcgtttatcaagaccgcacataagaaaccgatcgacctgcgggctattggaaaattacccatcgcgatgagggccctgaccaactaccaacgcctgtgtgaggcgtttgacgctcaagtgcgtaaggatatacagggtactcagggtgcaagagccatctggcaggcgctgtctcacgctttcgggaggcgacttgtactgtcctccacattcaggatccttgcggatttgctcggcttcgctgggccactatgcatttttggcatcgtggaccatctgggtaaggaaaacgatgtgtttcagcccaagacacagttcttgggagtttactttgtaagcagtcaggagtttctggccaacgcctacgttcttgcggtgttgctgttcctggccctgcttttgcagcggacgttcctccaggctagttactatgttgccatcgagacaggcatcaacctgcgaggagctatacagacgaagatttacaacaagattatgcatttgtccacaagcaacttgagcatgggcgagatgactgcagggcaaatttgtaacctggtagccattgacactaatcaactcatgtggtttttcttcctgtgtcctaatttgtgggctatgccggtgcagataatcgtgggagtgattcttctgtactatatactgggcgtgtccgccctcattggcgctgcagttattattctgctggcgcctgtacaatactttgtggccaccaaactgagccaggctcaaagatccacattagaatattcaaatgaacggctgaagcagactaatgaaatgctacgcggtatcaaattattgaaactgtacgcatgggagaacatctttcgcaccagagtcgaaacaacccgcaggaaagagatgacatctctgcgtgccttcgctatctacacaagtatctctatatttatgaacactgctattcccattgcagcagtgctcattacttttgtgggacacgttagcttcttcaaagaagcggatttctcaccatctgtagcctttgctagcctgtccttgttccacatcctggtgacgcctttgtttttactcagttccgtagtgagaagcaccgtcaaggccctagtgagtgctgaaatccgcgaagaacagtgtgctcctcacgagccaactccacagggaccagcatcaaaatatcaagccgtaccactgagggtggtgaataggaagcgacctgctcgggaagactgcagaggactgacaggcccactacagtcactggtgccaagcgctgacggcgatgcagataactgctgcgtgcaaatcatgggaggctactttacatggactccggatggtatcccaactctgagtaatataacaattaggatacctagggggcagttaactatgatcgtgggccaggtgggatgcgggaagagctcccttctgctggcagctctcggcgagatgcagaaagtgagcggagcagtgttctggagctcccttccagattcggagatcggggaggatcccagccccgagagagagacagcaaccgacctagacatcagaaaacgtggcccagtggcatatgcaagccagaagccctggctcctcaatgccacagtcgaggagaatatcatcttcgagagccctttcaacaagcaaagatataaaatggtcattgaggcatgctccttgcaacccgatatcgatatcttacctcacggagatcaaacgcagatcggagaaagaggcatcaaccttagcggaggacagcgccaacggatcagcgttgctcgagctttatatcaacatgcaaatgtcgtttttctggatgaccctttcagtgctttggacatccatctcagtgatcacctgatgcaggctggcatcctggaattactgagagacgataagcgcactgtcgtcctggtcacccacaagcttcaatacctgccacacgctgattggataattgcgatgaaagacgggaccatacagcgcgagggcactctgaaggatttccaacggagcgaatgtcagctcttcgagcactggaagacactcatgaaccgacaagatcaagagttagagaagaggcgccagcttagggcccgacggatgacaacctgccgtccatgctgtacatccgttcttagaagccatggcgaaccagcaccctccacgtgtcctccacccgcatcctgttcctgccgctgttggagctctcactcttgtagctctacatggtcgtggtggccctccacaaccggatggcccagcggcccaacagccccatag

SEQ ID NO: 48529 - DNA, 792 bp, Artificial Sequence
  Description of Artificial Sequence: Synthetic coding sequence
atgtctttcgctgtctttctcatccacaccaaacgcaagaagggcgttcaaagcagcggcgtgctcttcgggtactggttgctgtgcttcgtgctgcccgcaaccaatgccgctcaacaagcaagcggcgctggttttcagtcagaccctgtcaggcacctgtctacatatctctgtttgagcctggtggtcgcccagtttgtactctcatgtctcgccgatcagcctccatttttcccggaagaccctcagcaaagtaatccctgccccgaaactggcgctgccttcccatccaaagccactttttggtgggtgagcggcctggtttggcgaggctaccgccgtcccctacgccctaaagatctgtggagcctagggagagagaattccagcgaagaattggtttctcgactggagaaagagtggatgcgcaaccgctcagctgcccgagggcataacaaggcaatcgcgttcaaaaggaaggggggatccggtatggaggccccagagaccgaacctttccttaggcaggaaggctcccagtggcgccctctcttgaaagcaatttggcaggtctttcacagcacctttctgctcggcaccttgtcactcgtcatcagcgatgtctttagattcactgttcctaaactgctgagcctcttcctggaattcatcggcgatccaaaacctccggcatggaaggggtacctgttggccgttctgatgttcctgagcgcatgcctgcagaccctgttcgaacagcagaatatgtaccgcctcaaggttctatag

SEQ ID NO: 48530 - DNA, 600 bp, Artificial Sequence
  Description of Artificial Sequence: Synthetic coding sequence
atgctgttaggacgactgacgtctcaactgttgcgggcagtaccatgggctggcggtcgcccaccctggccagtctcaggagtgttgggctcacgagtgtgtggccctttgtactccaccagcccagcagggccaggtcgggctgcttccctccccaggaagggcgcacagcttgaattagaggaaatgctggtgcccaggaagatgtccgtttcacccttggagtcatggctgacagccaggtgttttctgcccaggctggatacgggcaccgctggaacggttgcccctccccagagctaccagtgccctccttcacagatcggagaaggagcggagcaaggtgatgagggggtggccgatgcccctcagattcaatgcaaaaatgtcttgaagatcagaagacggaagatgaatcaccacaaataccggaagctggtgaaaaaaacccggttcctacgcaggaaggtccaggagggaagattgaggaggaaacagataaagttcgagaaggatctccggagaatttggctcaaggctggtctgaaggaggccccagaaggctggcagactcctaagatctatctgaggggaaaatag

SEQ ID NO: 48531 - DNA, 600 bp, Artificial Sequence
  Description of Artificial Sequence: Synthetic coding sequence
atgctgctgggtcgtctgacctctcagctcctccgcgcagtaccttgggccggaggcaggccaccgtggccggtttcaggcgtgcttggcagtcgggtttgcgggccattgtactctacctcccctgcaggcccaggtcgtgccgcttcattgcctcgcaaaggcgctcaactggagctggaggagatgctggtgccaaggaagatgagcgtgtccccgctggagtcttggctcacggctcgctgcttcctgccacggctggatactggaaccgcgggaacggtggcccctccgcagtcttaccagtgtcccccttcccagatcggcgaaggggcagaacaaggtgacgaaggcgttgcagatgcacctcagatacagtgcaagaatgtgctgaagattcgccgtcggaagatgaatcaccacaaatacaggaaactggtcaaaaaaacgcgatttcttcgaagaaaggtgcaggaaggccgactcagaaggaagcagatcaaatttgagaaagatctcagacgcatttggctgaaggcaggactcaaagaagcccctgagggatggcagacacccaaaatctacctaagaggtaagtag

SEQ ID NO: 48532 - DNA, 600 bp, Artificial Sequence
  Description of Artificial Sequence: Synthetic coding sequence
atgctactgggcagattaacctcccagctgctgcgtgctgtaccttgggcgggaggcagacccccttggcccgtatcaggtgtccttggatctagggtctgcggacctctctactctacatccccagctggccctggaagagccgcttccctccccaggaaaggggcacagctagaattggaagaaatgcttgttccacgcaaaatgagcgtctcgcctctggagtcctggctgacagcgaggtgtttcctgcctagactcgatactgggaccgcgggaactgtcgcacctccacagtcatatcagtgccccccttcccaaattggtgagggcgcagagcagggggacgagggcgttgccgacgcccctcagatacaatgtaaaaatgtacttaagataaggagacgtaagatgaaccaccataagtatcggaaacttgtgaagaagacacggttcctgcgccgaaaggtccaggaaggaaggttaagacggaagcagattaagttcgagaaagacctgcggagaatctggctgaaggccggacttaaggaggcccctgagggctggcaaacccctaagatttatctgaggggcaagtag

SEQ ID NO: 48533 - DNA, 600 bp, Artificial Sequence
  Description of Artificial Sequence: Synthetic coding sequence
atgttgctgggtcgcctcaccagtcagcttttgcgggcagtgccctgggcaggcggtaggccgccttggcccgtatccggagtcctcggctctcgcgtgtgcggcccactgtattctacatcgcctgccggaccgggacgggctgcctccctacctagaaagggcgctcagctcgagctcgaagaaatgttggtgccaaggaagatgagtgtcagtccccttgaatcatggctgacagctaggtgtttcctcccccgtctggacactgggaccgccggtacagtggcacccccacagtcctatcagtgtccaccctcacagatcggtgaaggcgctgaacagggggacgagggcgttgctgatgctcctcagatccagtgtaaaaatgtgttgaagatccgcaggagaaaaatgaatcaccacaagtacaggaagctggtgaagaagacaaggtttctccggcgtaaagttcaggaagggaggttaagacgcaaacagataaagttcgagaaagatctgcggaggatatggcttaaagccggacttaaagaggcacctgaaggatggcaaacaccgaaaatctacctgaggggaaaatag

SEQ ID NO: 48534 - DNA, 870 bp, Artificial Sequence
  Description of Artificial Sequence: Synthetic coding sequence
atgaagaccctccccgcaatgctgggaaccggtaaactgttctgggtgttttttctcatcccttacctggacatctggaatatacatggaaaagaaagctgcgacgtacagctgtatattaagagacagtccgaacacagcatcctcgccggtgatccttttgaattggagtgtcctgtcaaatattgtgccaaccggccacacgtcacttggtgcaaactgaacgggaccacctgcgtcaaactcgaggacaggcagacgagctggaaagaagagaaaaacatctctttctttattcttcacttcgagccagtgttacctaacgacaacgggagttaccgctgcagcgccaatttccagagtaacctcatagagagccactctaccacactttacgtgacagatgttaagtccgcctctgagagaccctcaaaggacgagatggcttcgcgaccttggttgctgtacagacttttacccctgggcggactgcccctgcttatcaccacctgtttttgtttgttttgttgcttgagacgacaccaaggcaagcagaacgaactatctgacactgcaggaagagagatcaacctggttgatgcccatttgaagtcagaacaaacagaggcatctacgaggcaaaattcacaggtacttctgtccgagactggcatttatgataacgatcctgatctttgtttcaggatgcaggaagggtccgaagtatactctaatccttgcctagaagaaaataaaccaggaatcgtatacgcttccttgaaccattctgtaatcggtccgaactccaggctggctcggaacgtgaaggaagctcctactgaatatgccagcatctgcgtacgatcttag

SEQ ID NO: 48535 - DNA, 726 bp, Artificial Sequence
  Description of Artificial Sequence: Synthetic coding sequence
atgaagactcttcccgcaatgctcgggactggtaaattattttgggtcttcttcttaataccttacctggacatatggaatatccacgggaaagagagctgcgatgtgcagctgtatattaagcggcagtctgagcattcaattctggccggtgacccattcgaactggagtgccccgtgaagtactgcgcgaataggcctcatgtcacgtggtgtaagctcaatggtacaacctgtgtgaaactcgaagacaggcagacatcttggaaggaagagaaaaacatcagcttttttattctgcactttgaacctgtgttgcctaatgacaacgggtcgtaccggtgcagcgccaacttccaatccaacctaattgagtcacactctactaccctgtacgtcaccggcaagcagaacgagcttagcgatacagcaggacgagagataaatctggtggatgcccacttgaagtctgagcagacggaggctagcacccgacagaacagtcaagtgcttctgtccgaaactggcatatacgacaatgacccagacctctgtttccgcatgcaggaaggatccgaggtctattcgaatccttgtctggaagaaaataagcctggtattgtttacgcctcactcaaccactctgtgatcggaccaaatagcagactcgccagaaacgttaaggaggcaccaacagaatatgcatctatctgcgtccgctcctag

SEQ ID NO: 48536 - DNA, 1365 bp, Artificial Sequence
  Description of Artificial Sequence: Synthetic coding sequence
atgacctggagagccgctgcgtcgacctgcgctgcccttctgatcctgctatgggcgctgaccactgaaggggacctcaaggttgagatgatggcgggaggcacacagatcacccccctgaacgataacgtaactatcttctgcaatatcttctattcccagcctctaaatatcacttctatgggaatcacttggttctggaagtcactgacatttgacaaggaagtaaaagtgtttgagtttttcggcgaccaccaagaggcattccgtcctggcgctatcgtgagcccttggcggctgaaatctggtgacgcctctctccgcctgccaggtattcaactcgaggaggccggagaatataggtgcgaagtcgtcgtgacacctcttaaagctcagggcacggtgcagctggaggtcgtcgcctcacctgccagcaggcttctcttagaccaagtgggaatgaaagagaacgaagacaagtacatgtgcgaatcatccggcttctacccagaggctatcaatatcacctgggaaaaacagacccaaaagttcccccaccccattgaaatatctgaagacgtgataactggccctactatcaagaatatggatgggacattcaatgttacctcttgtcttaagctgaattcttctcaggaggatccagggacagtatatcagtgcgtggtgaggcatgcctcactgcatacacctctcagatccaattttaccttaactgctgctcgacatagcctgtccgaaaccgagaaaactgataatttctctatccactggtggccaatatcattcattggagtcggactcgtcttattgattgtcctgattccatggaagaagatatgtaataagagctccagcgcgtacacacccctgaaatgtatactaaaacactggaacagcttcgatacacagactctaaaaaaagaacacctcattttcttctgcactcgggcttggccatcttatcagctccaagacggagaggcatggccaccggaggggagtgtaaacatcaataccatccagcagttagatgtattttgtaggcaggagggcaaatggtctgaagtaccttacgtccaagcgtttttcgcgctcagagataaccctgacctctgtcaatgctgtcggatcgaccctgcattgctgaccgtcactagtggcaaatcaatcgatgataactctacaaagagcgagaaacaaactccacgggaacactcggacgccgtgccagacgccccaatactacccgtttcccctatttgggaaccgccacctgctacaacaagcactacccccgtgctctcctcccagcccccaacactcctgctccctctgcaatag

SEQ ID NO: 48537 - DNA, 1365 bp, Artificial Sequence
  Description of Artificial Sequence: Synthetic coding sequence
atgacttggcgcgcagcagccagcacctgtgcagccttgctgatacttctgtgggctctaaccacggaaggagacctcaaggtggaaatgatggctgggggaacccaaatcacacccctgaatgacaacgtaacgatcttctgtaatattttttatagccagccgctgaatatcactagcatgggaatcacatggttctggaagtcactgacctttgacaaggaagttaaggtgtttgaattttttggagatcaccaggaggcttttaggccaggtgcaatcgtgtccccctggcgcctgaagtccggggatgcgagtttacggcttcctgggatacaactggaggaagccggtgagtaccgctgtgaggtggtagtgactcctctgaaggcccagggaactgtgcaactggaagtggtagccagccccgcttctaggttattgttggaccaggtcggcatgaaggagaatgaggacaagtatatgtgtgagagctctggtttttacccggaggctattaacattacatgggaaaagcagacgcagaagtttccacatccgatcgagatttcggaagacgtcataaccggaccaacgatcaaaaatatggacggaacatttaatgttacgtcatgtctgaagttaaattcctcacaagaggaccctggcaccgtgtatcagtgcgtagtccggcacgcatcattacacactcctcttcgatcaaactttacattaacagccgctcggcacagtttgtcagagacagagaagaccgataacttttccattcattggtggcctatatctttcatcggcgtgggcttggtgctgctaatcgtattgattccctggaaaaaaatttgtaataaatcgtcttccgcctacaccccactgaaatgcattttaaagcactggaacagtttcgacactcagacacttaaaaaagaacacctgatcttcttttgcaccagggcgtggcccagttaccagttgcaagacggagaagcctggcctcccgaggggagcgtaaacatcaacacaattcaacagctggacgtgttttgtcggcaggaaggcaaatggagtgaagtgccctacgttcaagccttctttgcgttacgcgataatcctgatctatgccaatgttgtcggatcgacccggctctcctgacagtgacaagcggcaaatccattgacgacaattctaccaagtcagagaagcaaacccctcgtgagcactccgatgcggtgcctgatgccccaattcttcccgtgagtcctatatgggaaccgcctcccgcaaccaccagtaccactccggtcctgtccagtcagcctcctacgttgctcctgccgcttcaatag

SEQ ID NO: 48538 - DNA, 660 bp, Artificial Sequence
  Description of Artificial Sequence: Synthetic coding sequence
atggcccctgaaatggatcagttttataggagcactatggcaatctataaatcaatcatggagcaattcaaccccgctctggaaaacctcgtttacctgggcaacaactacctccgtgcttttcacgccctgtccgaagccgcagaggtctacttttccgcgattcagaagatcggagaacgcgcactgcaatctccaacttcacaaatcttgggcgaaatactcgtccagatgagtgatactcagcggcacctcaacagcgacctcgaagtcgtggtgcagactttccatggcggtctgcttcaacatatggagaagaacacaaagctggacatgcagttcatcaaggattcacgtcagcattatgagctggagtatcgccatagagctgcaaatctagaaaaatgtatgagcgagctgtggcgcatggagcggaaacgcgataagaatgtgagagaaatgaaggagagtgtgaacaggctgcacgctcagatgcaagccttcgtcagtgagtcccaaagggctgcggaactggaagaaaagcggagatacaggttcttagccgaaaaacatttgttactctccaacacctttcttcagtttttcgggagaatgctggccgatggcagattagtcgtttcaacactgtggctctcttag

SEQ ID NO: 48539 - DNA, 1590 bp, Artificial Sequence
  Description of Artificial Sequence: Synthetic coding sequence
atggctcctgagatggaccagttttacaggtccacaatggctatctacaagtctatcatggaacagttcaatccagcgctagagaatctggtctacctaggtaataactacctgagagcctttcacgccctttctgaagccgcagaggtgtactttagcgctattcagaagatcggtgagcgggcacttcaatcacccacatcacaaatcctcggagaaatacttgtgcagatgagtgatacccagcggcacttgaatagcgatctggaagtcgtggtgcagaccttccatggtgggttgctgcagcacatggaaaaaaacaccaagttggatatgcagtttattaaagattcaaggcagcattatgagttggagtatcggcatcgagccgcaaacctggagaagtgcatgtcagaactatggcggatggaacgcaagagggacaagaacgtgagagaaatgaaagagagcgtcaacagactacacgcccagatgcaagcttttgtaagcgaatcacagagggccgctgagctagaggaaaaaagacggtataggtttctggctgagaagcacctcttattgagtaacacatttttgcagttctttggtcgagccagaggtatgctccagaaccgggtgctgctatggaaggaacaaagcgaggctagtcgcagcccaagtcgagctcacagccccggattattaggtcccgcacttggccctccctatcccagcgggcgtctgaccccaacctgccttgacatgcccccacgtccactgggcgagttcagttcccctcggtcgaggcacggctccggttcatacgggacagaacctgatgcccgaccagcctcccagcttgaacctgaccggagaagtctccccagaacccccagcgcatcaagtctttacagtggtagcgcacagtcatcccggagcaatagtttcggcgagagacccggaggtggaggtggcgcacgcagagttagagctctggtgtctcactccgagggtgctaatcataccctcctgcggttcagtgcaggcgatgtggtagaggtcctggtgcctgaagcccagaatggatggctgtatggcaagttagagggctcctctgcctccgggtggtttccagaggcctatgtgaaagcattggaggagggccctgtcaatcccatgacacccgttacacccatgacctccatgaccagcatgagccctatgactccaatgaaccccggtaatgaactacctagccggagctatcccctgcgcggttctcactctctggacgacctgctcgatcggccagggaatagcattgcaccaagcgaatactgggatggacagtcacgctcccgcactccgtccagggtgccatcacgggcaccttcccctgcacccccacctctcccttcttcccgaagaagtagcatgggctccaccgccgtggccaccgacgtcaagaagctgatgtcaagcgagcaatatccaccacaagagttattccccaggggcacaaatcctttcgcaactgttaaacttcgccctacaattaccaatgacaggagtgcgccactgatcagatag

SEQ ID NO: 48540 - DNA, 1548 bp, Artificial Sequence
  Description of Artificial Sequence: Synthetic coding sequence
atggcccctgagatggaccagttttataggagcacaatggctatctataagtcaattatggaacaattcaaccccgctttagaaaatttagtgtatcttggtaacaactacctgagggcctttcacgctctcagcgaggccgcagaagtctacttctctgctattcagaagataggtgagagggctctccaaagtccgacctcccagatcctgggcgagattttggtgcagatgtccgatacccagcggcatctaaattcagacctcgaggttgtagtgcagactttccacgggggactgctgcagcacatggaaaaaaatacgaagctggatatgcagttcatcaaggacagtagacaacactatgaactcgagtaccggcaccgcgcagccaatttagaaaaatgcatgtccgagctgtggcgcatggaaagaaagagagataaaaacgtgcgcgagatgaaagaatctgtcaataggctgcacgcccagatgcaagccttcgtctccgagtcccaacgggctgccgagcttgaagagaagagacggtacagatttttggcagagaagcatcttctgctgagcaatactttcttgcagttcttcggacgggctagggggatgctccagaatcgagtgctactttggaaagagcagtccgaagcctctcgcagccccagtcgtgcccactcccccggtttgttgggaccagccctggggccaccatacccatccggccgtctgacacctacttgcctggatatgcctccgagaccgctcggcgaattttccagcccccgttcaaggcacggatccgggagctatggcacggaacccgatgctcggcctgcaagccagctggagcccgaccggaggagcctgccccgtacccctagtgcctccagtttgtatagcgggtctgcgcagtctagccgctctaattcgttcggtgagcggcctgggggtgggggtggcgcacggagagtgagagccctggtgagccactctgaaggagccaatcacacactccttcggttctccgcaggcgatgttgtggaggttctggttcctgaagcccagaacggttggctgtatgggaagctggaaggctcatctgcatctggctggtttcctgaagcttacgtcaaggcactcgaggagggtcccgtgaaccccatgacccctgtcactccaatgacctcaatgaccagcatgtcccccatgactccaatgaaccctgggaatgagctgccttcacgctcttatcccctcagaggttcacatagcctcgatgatctgctcgaccgcccagggaactctactccttcacgggtaccatcccgggcaccgtcacctgctccacccccacttcccagctcccggaggagttccatgggcagtacagcagttgccaccgatgtgaagaaactcatgagcagcgagcagtatcctccacaggaactgtttcccagagggacgaacccattcgctaccgtgaaactcaggcccacaatcaccaatgaccgttctgccccactgatacgttag

SEQ ID NO: 48541 - DNA, 726 bp, Artificial Sequence
  Description of Artificial Sequence: Synthetic coding sequence
atgacactccagtgggctgccgtggcaacattcctttacgctgaaattggtcttatcctcattttctgtctgcccttcattccccctcagcgatggcagaaaattttttcctttaacgtttggggcaagatcgcgactttctggaacaaagcttttttaactatcataatattgctgattgtcttgtttctagatgccgtgagggaagtgcgcaaatatagcagcgtccacacaattgagaaatcttctacatctaggcccgacgcatacgaacatacgcagatgaaactattccggagtcagcggaatctttacatcagcggtttctcactttttttttggctcgtgctcaggaggctggtgacactgatcacgcagctcgccaaggaactgagcaacaaaggagtgctcaagacacaagccgagaataccaacaaagccgctaaaaagttcatggaggagaatgagaaattaaaacgaattctaaagtcccacggcaaggacgaagagtgcgtgctcgaagccgagaacaagaaactggtcgaggaccaagagaagctgaaaactgaactgcgtaaaacgtccgacgctttgtctaaggcacagaatgacgtgatggagatgaaaatgcagtctgagagattgtctaaagaatatgatcagctgctgaaggagcacagcgaactgcaggaccgtctggagcgcggaaataagaagagattgtag

SEQ ID NO: 48542 - DNA, 726 bp, Artificial Sequence
  Description of Artificial Sequence: Synthetic coding sequence
atgacactccagtgggctgcagtggccacctttctatacgcggagattggactcatattaatcttttgcttaccatttattccaccgcagcgctggcagaaaatctttagctttaacgtgtggggaaagatcgcaaccttctggaataaagcatttctgacaatcattattcttctgatcgtgctatttttggacgctgttcgcgaagtgcggaaatatagttccgtgcacaccatcgagaaatcctctacttctagacccgacgcctacgaacacacccagatgaagctttttcgaagccagcggaatctgtatatatccggcttcagcttgttcttttggttggtgttaagacgcctggtgactctcatcactcagctcgccaaagaactgtccaataagggcgtattgaaaactcaggcagagaatacaaacaaggccgcaaagaagtttatggaggaaaatgagaagcttaagcggattttaaaatcccatggcaaagacgaagaatgtgtgctggaggcagagaataagaagttggtggaagaccaggaaaaattgaaaaccgaactgcgaaaaacatctgacgctctcagcaaagcgcagaatgatgttatggagatgaagatgcagtctgaacgtctctccaaagagtacgaccaactgttgaaggagcactctgaactccaggacaggcttgaacgcggtaataagaagagactgtag

SEQ ID NO: 48543 - DNA, 1047 bp, Artificial Sequence
  Description of Artificial Sequence: Synthetic coding sequence
atgacccttcaatgggctgccgttgccacctttctgtacgctgaaatcggccttatattaatcttctgtctgccttttattcctcctcagaggtggcaaaagattttttcattcaatgtatggggcaagatcgccacgttttggaataaggcttttctgacaatcatcatcttattgatcgtgctgtttcttgatgctgttagagaggtacgcaagtacagtagtgtgcataccatagagaaatcgtcaacatcccggcctgatgcatatgagcatacgcagatgaaactattcagatcacaaaggaatctgtatattagcggatttagtctctttttctggctcgtcctccgccgacttgttacgctcatcacccagctggctaaggaactctccaacaaaggggtcctcaagacgcaggcggagaacactaataaagctgctaagaagttcatggaggaaaacgagaaactgaagaggatattaaaatcccatggtaaagacgaagagtgtgtacttgaagcagaaaacaaaaagctggtcgaagaccaggaaaagcttaaaacggaacttaggaaaaccagtgatgccttgtctaaagcgcagaatgacgtcatggaaatgaagatgcagagcgaaaggttgagtaaggagtatgaccagcttctcaaggagcattcagagttgcagcacagttcttttggcgagttcctgtctaaaagaagtcacaagaacggctcaataggaaaacagactggaagccggaagggctcttttcgcaagcgccagcaggagaagactgtgaattttattaaggacacatgtaatatcctttgtcagaatgacaactttgtcatgctggccagtcgtaagttcaaattccggaagatgcactacgataggttcgtcattttcctgatgcctcatatcggatgtatcgttatggcactgagcaagtaccttatgatgttccaaatttactgcaaggtgtgtatccccgcactcaaaaaaaacatcagtatgctgaataccattttcacatactag

SEQ ID NO: 48544 - DNA, 468 bp, Artificial Sequence
  Description of Artificial Sequence: Synthetic coding sequence
atgaaactgtttcgctcccaacgcaacctgtacatctcggggttttcacttttcttctggcttgtacttcggagacttgtgactctgatcacccaactcgcaaaggagttgtcgaacaagggagttctgaagacccaggccgagaataccaacaaggccgcaaaaaagttcatggaggagaacgaaaagctgaaaaggatcctgaagagccacggtaaggacgaagagtgtgtgctcgaagcggaaaacaagaagctggttgaagatcaggagaaactcaagacagagctcaggaaaacatccgacgccttgagtaaggcgcagaatgacgtgatggaaatgaaaatgcagtcagaacgcctgtcaaaagagtacgatcagttgctcaaagaacactccgaattgcagaagtcacactctcagcctggagcagcagctttcctcgttaaggaggtggagagtttttag

SEQ ID NO: 48545 - DNA, 402 bp, Artificial Sequence
  Description of Artificial Sequence: Synthetic coding sequence
atgacgttacagtgggccgcagtcgctaccttcctgtatgctgaaattggccttatcttgatcttctgccttccttttattcctccacagcgatggcaaaaaatatttagttttaacgtgtggggcaaaattgcgacattctggaataaggctttcctaaccattatcattcttctcatcgtcttgttcctcgacgccgtcagggaagtgagaaagtattctagcgtgcatactatcgagaaatcaagcacgagcagacctgatgcttacgagcacacacaaatgaaactttttcgcagccagcggaatctctacatctccgggttttctctgttcttctggttggtgttacgacgcttagttaccctgatcactcagctcgccaaggagttatctaactag

SEQ ID NO: 48546 - DNA, 492 bp, Artificial Sequence
  Description of Artificial Sequence: Synthetic coding sequence
taagatgcctacgaacatacacaaatgaagctgtttcggtcgcagcgaaacctctacattagtggcttctcactgtttttctggctagtgctacgtcgcctggtgacccttattactcaactcgctaaagaactgagtaataaaggggtgttaaagacacaggccgagaatacaaataaggctgcaaagaaatttatggaagagaacgaaaagctgaagagaatccttaagagccacgggaaagacgaggagtgtgttctggaggccgagaacaagaaactagtcgaggatcaggaaaaattgaaaaccgaactgcgtaaaacttccgacgctttatccaaggctcaaaatgatgttatggaaatgaagatgcaatccgagagactgagcaaggagtacgatcagctactgaaggagcacagcgaactacaaaaatcacacagtcagccgggagccgctgcttttctcgtgaaagaagttgagtccttttag

SEQ ID NO: 48547 - DNA, 1047 bp, Artificial Sequence
  Description of Artificial Sequence: Synthetic coding sequence
atgacactccagtgggcagccgtggctacatttctatatgccgaaatcggcctcatccttattttctgcctaccttttatccccccacagcgctggcagaaaattttttctttcaatgtatggggcaagatcgccactttttggaataaagcatttctgaccatcatcatactgctgatagtcctattcctggatgccgtgagagaagtgcgcaaatattcttcagtgcataccatcgaaaaaagctctacgagccggccagatgcctacgagcacacacagatgaagctcttcaggtctcaacggaatctgtatatttccggattctccctgtttttttggctggtgctgagacgccttgtgacactgattacccagttagcgaaagagctctccaataaaggagttcttaagactcaggctgaaaatacaaacaaagcggcaaagaagttcatggaggagaatgagaaactaaaacggattcttaagtcgcatgggaaagatgaagaatgtgtgttagaggctgagaacaagaaactggtggaagatcaggagaagctgaagacagagctccgcaaaacctcagacgccctttccaaagcccagaatgatgtgatggaaatgaaaatgcaatcggagcgcctcagtaaagagtacgaccagctccttaaggaacactctgagttgcagcactcgagcttcggcgagttcctctccaagcggtcacataagaatggatccattggcaaacagactggctcacgcaaggggagctttcgcaagcgtcagcaggaaaaaacagtgaacttcataaaggatacatgtaatatcctgtgccagaacgataacttcgttatgctggctagccgaaagttcaagttccgcaagatgcattacgatagattcgttatcttcttgatgccccacatcggatgcatcgtgatggccctgtccaagtacctcatgatgtttcagatctactgtaaggtgtgcatccccgctctgaagaaaaatatttctatgctgaatactatctttacatattag

SEQ ID NO: 48548 - DNA, 693 bp, Artificial Sequence
  Description of Artificial Sequence: Synthetic coding sequence
atgactctacagtgggccgctgtggccacctttctatatgccgagatcggtttgatcctgattttctgcctgccatttattcctccgcaaaggtggcagaagatcttctcttttaacgtgtggggcaaaatcgcaacattctggaacaaagccttcctcaccatcatcatactcttgatcgtgctgttccttgacgcagtccgggaggttcgcaaatactcgtctgtgcataccatcgagaaatcaagcacgtctcgccctgacgcgtacgaacacactcagatgaaactgttcaggtcacagcgaaacctgtatatttccgggtttagcctgtttttttggctcgtgctccgacggctagttaccctgatcacacagctcgctaaagaactctccaacaagggcgtcctgaaaacacaggctgagaatacaaacaaagctgccaaaaaattcatggaggaaaacgagaagctgaagcgtattctgaaaagccatggtaaggacgaagagtgtgtgctcgaagccgaaaacaaaaagctcgtggaggatcaggagaaactgaagacagaattgcgtaagactagcgacgccttaagcaaggcgcagaatgatgtgatggaaatgaagatgcagtctgagcgtctgagcaaagagtatgaccagctgctcaaggagcattccgagctacagtag

SEQ ID NO: 48549 - DNA, 444 bp, Artificial Sequence
  Description of Artificial Sequence: Synthetic coding sequence
atgaagctgttccgttctcagcgtaacctatatatttcaggcttcagtcttttcttctggcttgttctcaggagactggtaacccttatcacccagttggctaaggagctctctaacaagggggtcctcaagacgcaggcagagaacacaaataaggccgcaaagaagttcatggaggaaaacgagaaacttaagcgcattttgaaaagtcatgggaaggatgaggaatgcgtgctcgaggctgagaacaaaaagctggtcgaagaccaggaaaagcttaagactgaactacgcaaaacttctgatgccctctccaaagctcagaacgacgtaatggagatgaagatgcaatcggaacgtctttcaaaagaatacgatcagcttctcaaagaacactcggagttacaggacagactagaacggggaaacaaaaaaaggctgtag

SEQ ID NO: 48550 - DNA, 195 bp, Artificial Sequence
  Description of Artificial Sequence: Synthetic coding sequence
atgacgctgcagtgggctgcagtcgcaacattcctatacgcagaaataggattaatacttatcttttgtctgccttttatccctccccagcggtggcaaaagatctttagcttcaatgtgtgggggaagattgctaccttctggaataaggcattcttgaccatcatcattctgctcatcgtcctgtttctgtag

SEQ ID NO: 48551 - DNA, 591 bp, Artificial Sequence
  Description of Artificial Sequence: Synthetic coding sequence
atgacactccagtgggcagcagtcgccacgttcctgtacgccgagattggactgatccttatcttttgcctgccattcatcccgcctcagcgatggcagaagattttctcgttcaacgtgtggggcaagatcgctacattctggaataaggcttttctgacgattataatcctgctgatcgtactgtttcttgacgcggtgcgcgaggtgcgcaagtattctagtgtgcataccattgagaagagtagcaccagtagaccggatgcttatgagcacacacagatgaaactcttccgatcgcagcgcaacttgtatatcagtgggttcagcctctttttctggcttgtccttaggcgactagtaaccttaattacgcaactggctaaggagctgagcaataaaggtgtactgaagacgcaggccgagaataccaacaaggccgctaaaaagtttatggaggaaaacgaaaagctgaagaggatactcaaatcacatggcaaggacgaggagtgcgtactggaggccgaaaataaaaaactcgtcgaagaccaggagaagctgaagacagagcttcgtaagacctccgactag

SEQ ID NO: 48552 - DNA, 741 bp, Artificial Sequence
  Description of Artificial Sequence: Synthetic coding sequence
atgtctctgcagtggaccgctgttgccaccttcttatacgctgaggtgtttgtagtactgctactgtgcatccccttcatctcacctaaaagatggcagaagatattcaagagtaggctggtggagttgctcgtgagctatggaaacacttttttcgtcgtcctcatagttatccttgtgcttctggtgatcgacgcggtcagggaaatacggaaatatgatgatgttaccgagaaagtgaatttgcagaataaccccggagcaatggaacacttccacatgaagctgtttcgcgctcagcgcaatctgtacatagccggattcagtcttctgctgagcttcctgctgcggagactggtgacattgatcagccagcaagcaaccttgctagcctctaatgaagccttcaaaaagcaggctgagagcgccagcgaggccgctaagaaatatatggaggagaatgatcagctcaagaaaggcgcagccgtggatggcggtaagctcgatgtcggaaacgctgaagtgaaattggaagaggagaaccgatcgcttaaggctgacttacagaagctcaaggacgagctggccagcacaaaacaaaagttagagaaggccgaaaaccaggtgttagcgatgcggaaacagtcagaaggcctgacaaaagaatacgacaggctgttagaggaacatgccaagctgcaggctgccgttgatgggccaatggataaaaaggaggagtag

SEQ ID NO: 48553 - DNA, 549 bp, Artificial Sequence
  Description of Artificial Sequence: Synthetic coding sequence
atgagtctgcagtggactgcggtggcaacttttctgtatgccgaggtcttcgtggtcctgctgctgtgtattccatttatctcaccaaagaggtggcaaaagattttcaaaagcagacttgttgagctgttggtttcttacggcaacaccttcttcgtggtcctcattgttatactcgtactgctggtcattgacgcagttcgagaaatcaggaagtacgacgacgttacggaaaaagtcaatctgcaaaacaatcctggcgctatggaacatttccatatgaaactgttccgagcccagcgcaacctgtacatcgcgggtttcagtctactgttgtcttttttgctcaggagactcgtgacactcatcagccagcaagctacacttctagcctcaaacgaggccttcaagaagcaggcggaatcggccagtgaggcggctaagaaatacatggaagagaacgatcaactaaagaaaggcgcagcagtggacggaggaaagctcgatgtggggaacgccgaagtcaagctcgaagaggaaaacagatag

SEQ ID NO: 48554 - DNA, 537 bp, Artificial Sequence
  Description of Artificial Sequence: Synthetic coding sequence
atgtctctccagtggacagccgtcgctacatttctgtacgctgaagtcttcgtcgtgctccttttgtgcataccattcatttcccccaagagatggcagaaaatcttcaagtcccggctggtagagcttctggtttcttatggaaatacattttttgttgtactgatagtcattctggtactgcttgttattgatgctgttcgcgaaatccgcaagtatgacgacgtgactgaaaaagtgaaccttcaaaacaacccaggagcaatggagcattttcacatgaaactctttcgggctcagcgtaatttgtatattgccggttttagtctgctcctctcctttctgctaagacgactcgtaaccctgatatcccaacaggccacactgctcgcctccaatgaggcgttcaaaaagcaggctgagtcagccagtgaggccgctaaaaagtatatggaagaaaatgatcagctgaaaaagggagctgccgttgatgggggaaaattagacgtcgggaacgcagaagtcaaacttgagtag

SEQ ID NO: 48555 - DNA, 942 bp, Artificial Sequence
  Description of Artificial Sequence: Synthetic coding sequence
atgggagccgaggccagcagttcctggtgtcccggaaccgccttgccagaggagcggctgagtgtcaagagggcctcagagataagtggattcctgggtcagggatcttctggcgaggcggcactggacgtcctgacccacgtcttagagggtgccggaaataagctgacaagctcctgcggaaaaccatcatccaacagaatgagcctgcaatggacagccgtcgcaacttttctctacgctgaagtgttcgtggtgctcctcctctgcattccgtttatcagtcctaaaagatggcagaagatctttaaatctaggcttgtagagttgctggtatcctatgggaacacattctttgtagtgctcatcgttatcctggtcctgctggttatcgacgctgtccgcgaaatcaggaaatacgatgacgttaccgaaaaggtgaacctgcagaacaatcccggagcaatggagcactttcacatgaagcttttccgcgcacagcgcaatctgtatattgcaggcttcagcctgcttttgtcgttcctattgcgcagattggtaactcttataagtcagcaggctactctgttggcttctaacgaagccttcaaaaaacaggccgaatcagcatcggaggccgctaagaagtacatggaagagaatgatcaactcaaaaaaggagcagcagtcgacgggggaaagttggatgttgggaacgcggaggtgaaattggaggaggagaaccgtagcctgaaggcagacttgcagaaactgaaagacgaactcgcctcaaccaaacagaagctggaaaaagccgagaaccaagtcctggcaatgcgcaagcaaagcgaaggcctgactaaggagtacgatagattactggaggaacacgccaaattgcaagcagccgtagacggacccatggacaagaaagaagaatag

SEQ ID NO: 48556 - DNA, 564 bp, Artificial Sequence
  Description of Artificial Sequence: Synthetic coding sequence
atgtcattgcagtggactgcagtggccaccttcctctatgctgaggttttcgtggtgcttctgctgtgtatcccatttatcagtcccaagcgatggcagaagatctttaaatcccgcctcgtggaactgctggtttcctacggaaatacttttttcgttgtgttaattgtgatcctggtgcttctagtcattgatgctgtgcgagaaatccgaaaatatgatgacgtgacagagaaagtgaatctgcagaacaaccccggtgctatggagcatttccatatgaaactttttcgagcccagagaaacctctatatagcagggttctctcttctactttcttttttattgcgtaggctggtcactctgatctcacagcaggcaacgctcctggccagcaacgaagcttttaagaagcaagccgaaagcgcttctgaggctgctaaaaaatacatggaagagaacgaccagctcaagaagggagcagccgtcgatgggggtaagctggatgtgggaaatgccgaagtgaaactcgaggaagagaatagatcgctgaaagccgattag

SEQ ID NO: 48557 - DNA, 417 bp, Artificial Sequence
  Description of Artificial Sequence: Synthetic coding sequence
atgtccctgcagtggactgcagtagctacttttttgtacgccgaggtgtttgttgttctgctgctgtgtatacccttcattagccccaagaggtggcagaaaatttttaaatcaagattggtcgagctgctggtatcctatggaaatactttcttcgtggttttgatagtcatcctcgtgctcctagtcatcgacgccgttagggaaatacgaaaatacgacgatgtgaccgagaaggtcaatttgcagaacaaccccggagcgatggagcacttccacatgaagttatttcgagcacagcgcaatctctatatcgctggattttccctgctgctttcattcttgctcagaagactggtcacattaatatctcagcaggcaacacttctcgcgagtaatgaagctttcaaaaaatag

SEQ ID NO: 48558 - DNA, 741 bp, Artificial Sequence
  Description of Artificial Sequence: Synthetic coding sequence
atgtctctccaatggaccgcagtggcaacctttctctacgcagaggtattcgtagtgctgctgttgtgcatccccttcatcagcccaaaacgatggcaaaaaatctttaagtcaagactcgtcgaactcctggtgagttatggcaacacttttttcgttgtgctgatcgtgatcctcgtgctactggtgatcgatgctgtccgggagataaggaaatatgatgacgtcacagaaaaggtcaacttacagaacaacccaggagccatggaacattttcacatgaaactctttagggctcagagaaacctatatatcgccggatttagcttacttctgagctttctcctgaggagacttgtaaccctgatctcccagcaggctaccctactagcttccaacgaggccttcaaaaagcaggcagaaagcgccagcgaggctgctaagaagtacatggaggagaacgatcaactaaagaaaggcgcagccgtcgacggagggaagctagacgtcggaaacgcagaagtgaagcttgaggaggagaacagatcactaaaggctgatctacagaagctgaaggacgagcttgcgagcacaaaacagaaactggagaaggcagagaaccaggtgttggctatgcgcaagcagtctgagggactgaccaaagagtacgacagacttcttgaagagcatgcaaagctgcaggctgctgttgacggcccaatggacaaaaaggaagaatag

SEQ ID NO: 48559 - DNA, 567 bp, Artificial Sequence
  Description of Artificial Sequence: Synthetic coding sequence
atgagcctccaatggacagctgtggccactttcctgtatgctgaggtgttcgtggtgttgctgttgtgtatcccattcatatccccgaagaggtggcagaagatttttaaaagtcgactcgtcgaattgcttgtctcttacggcaacacattcttcgtggtccttatagtaatactggttttgttggtgattgatgcagtcagggagattagaaaatatgatgacgtaaccgagaaggtcaatttgcagaataacccaggcgctatggagcacttccacatgaaactgttcagagcacagagaaacctgtatattgcaggtttttcactattgctgagtttcctgctcaggagactggtcaccctgatcagccagcaagccacactgttggcctctaatgaagcttttaagaaacaagcggagagtgcctccgaggccgctaaaaagtacatggaggagaacgaccagctgaaaaagggagctgctgtggatggtggaaaactggatgtaggcaacgcagaagtgaaattggaagaggagaacagatccttgaaggccgacctatag

SEQ ID NO: 48560 - DNA, 942 bp, Artificial Sequence
  Description of Artificial Sequence: Synthetic coding sequence
atgggagcagaggcatcttctagctggtgcccaggcactgcgttgcccgaggagcgtctttccgttaaacgtgcatccgagatttctgggtttctcggacaggggtcctcgggtgaggccgctctagacgtgctgacgcatgtgctggagggcgcaggaaataaacttaccagcagctgcggtaagccgtcaagcaaccgcatgagcctacagtggaccgccgttgctacattcctctatgccgaagtgtttgttgtgctcctgctgtgtattccttttatatccccaaagagatggcagaaaatcttcaaaagtagacttgtcgagctgctggttagctatggtaacacctttttcgtcgtgctaattgtgattctggtcctgttggtgatcgatgctgttcgcgaaattagaaaatatgacgacgtgaccgagaaagtcaatctccagaacaaccccggagctatggaacactttcatatgaagctttttcgggctcagaggaacctttacatagctgggttttccctcttgctttcatttctgttgaggcgactcgtgactctaatttcccagcaggcaacactcttagccagcaatgaggctttcaaaaagcaggctgagtcagccagcgaggccgctaagaagtatatggaggagaacgatcagttaaaaaagggggctgcagtggacggcggtaaactggacgtgggaaatgcagaagtgaagttggaagaggagaacagatcactcaaggctgatctgcagaagctcaaggacgaattagcgagtacaaagcagaagttagagaaagctgagaaccaagttctcgcgatgagaaagcagtccgagggcctcacgaaggagtacgataggttactggaggaacacgccaaacttcaggccgcagttgatggcccaatggataagaaagaagaatag

SEQ ID NO: 48561 - DNA, 798 bp, Artificial Sequence
  Description of Artificial Sequence: Synthetic coding sequence
atgtatgttggatatgttctggataaggatagcccagtctatcctgggccagctcgcccagcttctctcggcctagggccacaggcctacggccctccagcccctcctccggctccgccacagtaccccgatttttcttcctacagtcatgtggaacccgctccggcaccccctaccgcttggggcgctcccttccccgcacccaaagacgactgggcagcagcatatggccctggacccgcagccccagctgcctccccagcatcgctggcatttggtccaccacccgatttttcaccagtacccgcaccgccaggaccgggacctggtctcctagcacagccgctgggtggccctggcactccctcatcccctggagcccaacgtcctacaccctacgagtggatgcggcgaagcgtggccgcaggcggtggtgggggttccggcaaaacacgcaccaaggacaagtatagggtagtgtacaccgaccaccagcggctggaactggagaaagagtttcactactccagatacataactatccgcagaaaatctgagctagccgcaaatctgggacttaccgagagacaggtgaaaatttggtttcagaacagacgggcaaaggagcggaaggtgaataagaaaaaacagcagcagcagcagccacctcagccacccatggcccatgatataaccgcaacaccagccggaccctcactgggaggactatgtcccagcaacaccagcctgctggccacttctagtcctatgccagttaaagaggagtttcttccttag

SEQ ID NO: 48562 - DNA, 687 bp, Artificial Sequence
  Description of Artificial Sequence: Synthetic coding sequence
atggccgctcctcaagacgttcacgtgcgaatctgcaaccaagaaatcgtgaagttcgatcttgaggtgaaggccttgatccaggatattagggactgctccggcccactgtcggcgttgacagagcttaatacaaaggttaaagaaaaattccagcagcttcggcataggatccaggaccttgagcagttagctaaggagcaagataaggagtccgagaaacagcttttgttacaggaggttgagaatcacaaaaagcagatgctatcaaaccaagccagctggaggaaagctaacctcacctgcaaaatagcaatcgacaatctcgaaaaagccgagctcctgcagggcggagacctcctgcgccagcggaagactaccaaagagtctctcgcccagacctcaagcacaatcaccgagtccttgatgggcattagcaggatgatggcccagcaggtgcagcagtccgaggaggccatgcaatcactggtgacaagctccaggacaatcctggatgcaaatgaagaattcaagtccatgagcggcacaattcagctcggtcgaaagctgataacgaagtacaacagacgggagcttactgataagttgttgatctttctggcactggccctctttctcgcaacagtgttgtacatcgttaagaagcggttattcccatttttgtag

SEQ ID NO: 48563 - DNA, 714 bp, Artificial Sequence
  Description of Artificial Sequence: Synthetic coding sequence
atggccgcaccacaggacgtacatgttagaatctgcaaccaggaaatcgtcaaatttgatctagaggtcaaggctctcattcaggacatcagagactgcagtggtccactgtcggccctgaccgaactaaacacgaaagtgaaggaaaagtttcaacagctccgacaccggattcagcctgtattgtaccagagagcattcatctggacagccagtacgtttttcttcaaactcacttattctctgactgatttttcgtccacccagcatgacttcaactctccaaccacccccgtcacgtttagcgatctggaacaactggcaaaggagcaggacaaggagagcgagaaacaattgcttctccaagaagtggagaatcacaaaaagcagatgctccggaagaccaccaaggagagcttggcacaaacctcaagcacaattacagagagtctcatgggtatttctcgaatgatggcccagcaggtgcagcagagcgaggaggccatgcaatcccttgtgacttcctcccggacaatcttggatgccaacgaggagttcaaaagcatgtccggcacaatccagctgggcagaaaactgataaccaagtacaaccgcagagaactgaccgataagctccttatctttttggcattagctcttttcctggccacggttctttacatcgtaaagaaacgactttttccatttctgtag

SEQ ID NO: 48564 - DNA, 585 bp, Artificial Sequence
  Description of Artificial Sequence: Synthetic coding sequence
atggctgctccacaagacgtgcatgtgcggatttgtaatcaggagattgttaagttcgacttagaggtgaaggctctaattcaggacatacgggattgtagcggcccattgagtgcgttgaccgagctgaatacaaaggtgaaagagaagttccagcagttaagacataggattcaggacttggaacagctcgcgaaagaacaggacaaagaaagtgagaagcagttactgcttcaagaggtcgaaaaccataagaagcagatgttgagaaaaacgaccaaggagtcccttgctcaaacctcaagcactatcaccgagagcttaatgggcatttcgagaatgatggcacaacaggtccaacagtcggaagaagccatgcagtctctggtcacctcatctagaacaatcttggatgctaacgaggagtttaagagtatgtcaggaactatccagctcgggagaaaactgattactaagtacaaccgacgtgagcttactgacaagctcctcatattcctggcccttgctctgttcttggccaccgtgctttacattgtgaagaaacgcctatttccctttttatag

SEQ ID NO: 48565 - DNA, 1458 bp, Artificial Sequence
  Description of Artificial Sequence: Synthetic coding sequence
atggcttctagttcaaccgtcccactcgggtttcattatgagaccaagtacgtggtcctgtcctaccttggccttctgtcccaggaaaagttgcaggagcaacacctttcctctccacaaggtgtgcaactagatatcgcgtcgcagtccctggatcaggaaattttgctgaaagtaaaaaccgagatagaggaggagctgaaaagtctcgacaaggagatcagcgaggctttcacctccaccggcttcgaccgccacacgtctccagtttttagcccggcaaaccccgaaagctcaatggaagattgcctggcacatcttggagagaaggtctcgcaggaactaaaagagcctttacacaaagcactacagatgctgctgagccaacctgttacctatcaggcatttcgggagtgcactttagaaaccacagtgcacgccagtgggtggaataagatactggtcccgctggtattactgagacagatgttattagaactgacgagaagaggtcaggagccactgtctgccttactgcagtttggtgtgacttacttggaggactactctgcagagtatatcatccaacagggaggttggggaaccgtcttctccctggaatcggaggaggaggagtatcccggaataactgctgaagatagtaatgatatttatatactcccttctgataatagcggccaggtttcaccacctgaatccccgacagtgaccacatcttggcagagtgagtctctacccgtgtcactaagtgcaagccagagctggcataccgagtcactgccagtctctctgggaccggagagttggcagcagattgcaatggacccagaagaggtgaaatcactggacagtaacggtgcaggcgagaaatctgagaacaactcttctaatagcgacattgtgcacgtggagaaggaggaggttcctgagggtatggaagaagcagcggtcgctagcgttgtgctccccgctcgcgagctacaagaggcactccccgaggctcccgcaccacttctcccccacatcacggccacttccctcctaggcactagggagccggataccgaagtaattactgttgaaaagagcagtcccgctaccagtctgttcgtggagttggacgaagaagaggtgaaagccgctacaaccgaacctactgaggtagaggaggtggtcccggcactggagcccaccgagaccctgctctctgagaaagagataaacgcccgagaggagagcttagtggaggaactgtcccctgcctccgagaaaaagcctgttcccccatcggaggggaagtcccggctgtcccctgccggagagatgaagcctatgccactgtcggaggggaaatccattttattgttcgggggagccgctgcagtcgccattctggcggttgctattggtgtcgccctggccctaagaaagaagtag

SEQ ID NO: 48566 - DNA, 972 bp, Artificial Sequence
  Description of Artificial Sequence: Synthetic coding sequence
atgctattagagctaactcgaaggggtcaagaacccttaagcgccctcctccagttcggtgtgacctacctggaggattattcggccgagtacatcatccagcaggggggatggggcaccgtgttcagtctcgagtctgaggaggaagagtaccctggcattactgccgaggactcgaacgatatttacatcctcccatccgacaactcgggtcaggtgtccccccctgagtcccctacggtaaccacttcctggcagagcgaaagtttgcccgtttctctcagtgccagccagtcatggcatacggaatccctaccagtgtccctcggacccgaatcttggcagcagattgctatggaccccgaggaagtgaaatctctcgattcgaatggtgctggcgagaaatctgaaaacaactccagcaattctgacatcgtccatgtggagaaagaagaagtacccgaaggcatggaagaagcagcagtggcgtctgtggtactccccgctcgagaacttcaggaagcactacccgaagccccagcccctctgctgcctcacatcaccgccacatccttgctcggaactcgggagccagatacagaagtcattacagtggagaaatccagtcctgccaccagcttatttgtcgaactggacgaggaggaggtgaaggccgcaacaacagaacctacagaggtggaagaagtagtgcctgctttagagcccactgaaactttactgtccgagaaggaaattaacgccagagaagagtccctggtggaagagctgtctccagctagtgagaaaaagccggtacccccatctgagggaaaatcccgactgagtcccgctggagagatgaaaccaatgccgctgagtgagggcaagtccatcctgcttttcggtggcgctgccgctgttgcgattctggccgtggccataggcgtagctctggcactgaggaaaaagtag

SEQ ID NO: 48567 - DNA, 606 bp, Artificial Sequence
  Description of Artificial Sequence: Synthetic coding sequence
atggcgagctctagcactgtgcccttgggatttcactatgagaccaaatacgttgtgctgtcatatctgggacttctgtcacaggagaagctgcaggagcaacacctcagctctccccagggggtgcaattggatatagctagtcagagcctcgaccaggaaattcttttgaaggtgaagaccgagattgaggaggagcttaagtcgctcgataaggagatttctgaggcatttacaagtaccggatttgataggcatacctcaccggtcttctctccggctaaccccgagagttccatggaagattgtctggcacacctgggagagaaagtgtctcaggaattaaaggaacctcttcacaaagccctgcagatgctgctgtcacagccggttacctatcaggcatttcgtgagtgcaccctagaaacgacagtccatgcatctgggtggaataagatcctcgtgcccctagtgctcctcaggcagatgcttctcgagttgacccggagaggccaggagccactctctgcccttttgcaattcggtgtgacgtatctggaagattattccgccgagtacatcattcagcaggggggatgggtgtag

SEQ ID NO: 48568 - DNA, 315 bp, Artificial Sequence
  Description of Artificial Sequence: Synthetic coding sequence
atggctagttcctcgactgttcccttgggctttcattacgaaaccaaatatgtggtcctgagctatctcggtttattgtcccaagaaaagctgcaggagcagcacctgagttccccccagggtgtacagcttgacatagcatcccaatccttagatcaggagatactgttaaaagtgaagacagaaatcgaagaagaactgaagagcttggacaaggagatcagcgagggttggagtgcagttgcaccatccaggcccactacaacatcaatttcccaggtgcagatgattctgctatcacaaccccctgaatag

SEQ ID NO: 48569 - DNA, 606 bp, Artificial Sequence
  Description of Artificial Sequence: Synthetic coding sequence
atggccagttcttcaacagtgcccctcggatttcactatgaaacgaaatatgtagtcttgtcctacttagggcttttgagccaggagaagcttcaagagcaacaccttagctctccccagggagtgcaactcgatatcgcctctcagtccctggaccaagaaattctgctgaaagtcaaaacagagatcgaggaagagctcaagagtctggacaaagaaatttcagaggcatttaccagcacagggttcgatagacatacgagccccgttttttctccggcaaacccggagtctagtatggaggattgcctcgctcatctaggggagaaggttagccaagaactgaaagaacctttgcacaaagccctccagatgttactatcacagcccgtaacataccaggccttcagagagtgtaccttagagaccactgtccatgcctctggctggaataaaattttagttcctttagtgctgctccgccagatgctgctggaattaactaggcggggtcaggagcctttgtccgcactgttgcagtttggggtgacctacctcgaagattactctgccgaatacataatccagcagggaggatgggtgtag

SEQ ID NO: 48570 - DNA, 1086 bp, Artificial Sequence
  Description of Artificial Sequence: Synthetic coding sequence
atgaagcaatctatgctcttctccgccacgtgggacagctcactgaagcgtagctgcaagagtaacatcttccctcacccaaagatcctggtgccacttgtgctgctccggcaaatgctgctcgaactgactaggcgcggtcaggagcctttgtccgcccttctgcagttcggtgtcacgtacctcgaggattactctgccgagtacatcatccaacagggcggatggggcaccgttttctccctggagtctgaggaagaggaataccccggtattactgcagaagacagcaacgatatctacattttgccatccgataactctggacaagtttcccccccagagtcccccacggtgacaacaagctggcaatccgagagtctgcctgtttcccttagtgcaagtcagagttggcataccgagagccttccagtgtctctagggccagagtcctggcagcagattgcgatggacccagaagaggttaagtcacttgatagcaatggggcaggagaaaaatctgagaacaattcaagcaatagtgatatcgtgcatgttgaaaaggaagaagtgccagagggaatggaagaggcggctgtcgccagtgtggtgctgcctgctagagaacttcaagaagcgttgcctgaagctcccgctcctctcctcccacatatcaccgccacctctttgctggggacgagagagcccgacactgaggtgatcacagtggagaaatccagtcccgctaccagtttgttcgtggagctggacgaggaggaagtaaaagcagctaccactgagcccaccgaggtggaggaggtggtaccggcactcgagcctactgaaactttactctccgaaaaggagatcaacgccagggaagaatctctggtagaggagttgagcccagcatctgagaagaaaccggtgccgccaagcgaaggaaaatcgcggctgtccccagcaggagagatgaagcctatgccgctttccgaagggaaaagtatactgctctttgggggtgccgcagctgtggccatcctggccgtggccatcggtgtggccttggcactccggaaaaaatag

SEQ ID NO: 48571 - DNA, 972 bp, Artificial Sequence
  Description of Artificial Sequence: Synthetic coding sequence
atgctactggagctcacgagacggggacaggagcccttatctgcgctccttcagttcggtgttacatacctggaagactatagcgctgagtatattatacagcagggagggtggggcaccgtttttagcctggaatccgaggaggaagagtatcctggaatcacggcggaagacagtaacgacatctacattctgccatcagataattcgggtcaagtgtcgcctcctgagtcaccaactgtgaccacttcttggcaaagtgagtctctcccagtgtccctgtcggcgagccagtcatggcacacagagagcttgcctgtgtccctaggtcccgagagttggcagcagatcgctatggatcctgaggaggtgaaatcgctggactcaaatggcgcaggcgaaaagagtgaaaacaactcttcaaattctgacatagtccacgtggagaaagaagaagtgcctgaggggatggaggaggctgccgtggcttctgtcgtactgcctgccagagagctgcaagaagcattaccagaagcccctgctccccttttacctcacatcaccgccacctctctcctcggtactcgagagcccgatactgaggtgatcactgtcgagaagtcctctcctgcaaccagtttgttcgtcgagctggatgaggaagaggtgaaagctgcaactaccgagccaaccgaggtagaggaagtagtgccagctttagagccaaccgagaccctgctgtcagagaaggagatcaatgctcgggaggaatccctggtggaggaactgtcccccgctagtgaaaaaaaacccgttcccccttccgagggcaagtctagactcagccccgcaggcgaaatgaaacctatgccactgtctgaaggcaagtctatcctactgttcggcggagccgctgccgtcgccatactggccgtcgcaatcggcgtggccctcgctctcaggaaaaagtag

SEQ ID NO: 48572 - DNA, 516 bp, Artificial Sequence
  Description of Artificial Sequence: Synthetic coding sequence
atggccagctcctcaacagtgcccctgggtttccactacgagaccaaatacgttgtattgagttatttaggcctgctcagtcaagaaaagctacaggagcagcatcttagctccccacagggtgtgcaattggatatcgcatcacaatctcttgatcaggaaatcctgttaaaagtgaagaccgagatcgaggaagagcttaagagtttggataaagagatatccgaggcctttacaagcacaggtttcgatcgccacactagtccagtattttcacccgctaaccccgagtctagcatggaagactgtttagcccatctgggagagaaagtgagccaggaattgaaagagcctcttcataaggccctacagatgctcctgtcacaagctctctgcctggtgttgtctcaaaggcggcgaaatactcttgagtcactccagaaaatcgccatgacattcacatcctgccctgccaccactctggataagagtgttccccagtcgctccagctttag

SEQ ID NO: 48573 - DNA, 402 bp, Artificial Sequence
  Description of Artificial Sequence: Synthetic coding sequence
atggacaaatatattctcgataacggtaaggtgcaccttggaagcggaatttgggtagatgaggagaagtggcatcagttgcaagtgacacagggggatagcaaatatactaagaatctcgcagtcatgatctggggcacagatgttctcaagaacaggtccgtgacaggggttgccaccaaaaagaagaaggacgccgtgcctaagccaccgctctcaccgcacaagctgagtatagtgcgcgagtgtttatacgatcgaatcgctcaggagacagtcgacgagaccgagatcgcccaacggttgagtaaggtgaataaatacatctgcgagaagattatggacataaacaaatcctgcaagaacgaggagaggagagaagcgaagtataatcttcagtag

SEQ ID NO: 48574 - DNA, 1266 bp, Artificial Sequence
  Description of Artificial Sequence: Synthetic coding sequence
atgtatgcttttgtgcgcttcctggaggataacgtctgttatgccctgcctgtttcttgcgtaagggatttttctccacggtctcgcttggatttcgacaatcaaaaagtgtacgccgtttatcgcggacccgaagagctaggggcaggcccagagtcccccccaagggcacccagagactggggggctctgctcctgcacaaggcccagattctagcattggctgaagacaagagtgatctggagaattccgtgatgcagaaaaagataaagatccctaagctatccttgaaccatgtggaagaggatggcgaggttaaagactacggggaagaagacctgcagctgaggcacatcaaaagacctgagggtagaaaaccaagcgaagtggctcacaagtccatcgaagcagtggtggcacggctggagaagcaaaacggcctctctctgggccattctacatgcccagaagaggtttttgtggaagcttcccctgggactgaggacatggatagcctggaagatgctgtggtgcccagggccttatatgaggaactgttacggaattatcaacagcagcaagaggagatgaggcatctccagcaggagctggagcgtaccagacgacagctggtccagcaggccaaaaagttgaaggagtatggggcactcgtatccgagatgaaggagctgcgggatttgaacagacgcctccaggacgtcctgttgcttagactcggttccgggccagcaattgacctcgaaaaggttaaatcagaatgtttagaacctgagccggaactgcggtctaccttttccgaggaagccaacacttcttcatattaccctgcacccgctccggttatggacaagtatattctcgacaatggcaaggtgcacctgggatcaggcatttgggttgatgaggaaaagtggcaccagttacaggtcacacaaggtgactcaaagtatacaaagaacttggctgttatgatttgggggaccgacgtgctgaagaacaggagcgtgacaggagtggccactaagaagaaaaaagatgctgtgccaaagcctcctctctctccgcacaagttgtccatcgtgagggaatgcctgtacgatcgcatcgcacaggagaccgtggacgagacagagatcgctcagcggctgtccaaggtgaacaaatacatttgcgagaaaatcatggatataaacaagtcttgtaagaatgaggagagacgcgaagccaaatacaatttgcagtag

SEQ ID NO: 48575 - DNA, 399 bp, Artificial Sequence
  Description of Artificial Sequence: Synthetic coding sequence
atggctgaggaaggaatcgccgcaggcggagtgatggatgtgaataccgcacttcaggaagtcctgaagactgcacttattcacgatggtctggcccgtggcattagagaagctgctaaggccctggataagcgccaggcccacttgtgcgttctggcatccaactgcgacgagccaatgtatgtaaaacttgttgaggctctgtgtgccgagcaccagatcaacctcattaaggtggatgacaataaaaagctgggggaatgggtgggcctctgtaagatagaccgggaaggcaagcctcggaaggtcgtaggatgttcctgtgtggtcgtgaaggactacggcaaggaatcccaagccaaggatgtcatcgaggagtatttcaagtgtaaaaagtag

SEQ ID NO: 48576 - DNA, 996 bp, Artificial Sequence
  Description of Artificial Sequence: Synthetic coding sequence
atggcatctgctctctggacggtgctgccatcaaggatgtctctgcggagcctcaagtggtctcttctgctgctgagtttgctctccttttttgtgatgtggtacttgagcctgccccactacaacgtgatcgaacgagtgaattggatgtatttctacgagtatgagcccatctatcggcaggatttccatttcactctccgagagcacagcaattgtagtcaccagaacccttttttggtgatcctggtcaccagccacccctccgatgtgaaagccaggcaggccatccgtgtgacatggggcgagaaaaaaagctggtggggttacgaggtcctcacgtttttccttttggggcaggaagccgagaaagaggacaagatgctggctttaagcctggaggacgaacacttgttatatggagacatcattcggcaagacttcctcgacacgtataacaatcttacgctgaaaactataatggcctttagatgggttacagagttttgccccaacgcaaaatatgttatgaaaaccgacacagacgtctttataaacactggtaatttagtgaaatacttactgaatttgaaccatagcgagaagtttttcacaggatatcccttaattgacaactatagttaccgaggattttatcaaaaaactcatatctcttaccaggagtatccgtttaaggtgtttccaccttattgcagcggtcttggatatatcatgtctcgcgacttagtccccaggatatatgaaatgatggggcatgtaaaacccatcaagttcgaggatgtgtacgtcggaatttgtctaaatctgctcaaggttaatattcacatccccgaagacacaaatcttttctttctgtatcgaattcatctggacgtttgccagctaagaagagtgattgccgcacatggcttctcctctaaggagatcatcaccttttggcaggtaatgctccggaacacaacatgccactattag

SEQ ID NO: 48577 - DNA, 996 bp, Artificial Sequence
  Description of Artificial Sequence: Synthetic coding sequence
atggccagtgccctgtggacagtgctgccaagccggatgtcgctacgtagtctgaagtggtccttgttacttcttagcctcttatctttctttgtcatgtggtacctgtcccttccacattataatgtgatagaaagagttaattggatgtatttctacgaatacgagccaatctatcgacaggacttccactttacactccgagagcactccaattgctcacatcagaacccatttctggtcatactagttacatcccatccatctgacgttaaggcgaggcaggctatacgtgtcacatggggtgagaagaagtcctggtggggttacgaagtgttgactttttttctcctgggccaagaagctgagaaggaggacaaaatgctcgccttgtccctcgaggatgagcacctactttacggagacatcattagacaggattttcttgacacctacaacaaccttacccttaagactattatggcttttcgttgggtgacggagttttgcccaaacgctaagtatgtcatgaagaccgacaccgacgtgtttatcaataccggtaacctagtcaaatacctgctgaatctgaatcactctgagaagtttttcacagggtatccgctgatcgataactattcctatcggggattctaccagaagacccacatttcatatcaagagtaccctttcaaggtctttcccccatactgttccggattagggtatatcatgtcacgtgatttggttccccgtatttacgaaatgatgggccatgtgaaaccgattaagtttgaagatgtgtatgtgggaatctgtttgaatttgctgaaggtcaatatccatatccccgaagacaccaacctgtttttcctttatagaattcacctcgacgtgtgccagctaaggagagtgatcgctgcacacggattctcatctaaagagatcatcacattctggcaggtaatgctgcggaatacaacctgtcactactag

SEQ ID NO: 48578 - DNA, 996 bp, Artificial Sequence
  Description of Artificial Sequence: Synthetic coding sequence
atggccagtgccctgtggacagtactaccctctaggatgtcactccggagcctaaagtggtcactgctcctgctcagcctgttaagtttctttgtgatgtggtacctatcactgcctcactataatgtgattgagagagtcaattggatgtatttctatgagtatgagcctatctatcgacaggatttccatttcactttgagggaacattcgaactgcagccatcagaatccttttttagtgatactcgtaacctcccacccctcagatgtgaaagccagacaggcaatacgggtgacctggggcgagaagaaatcttggtgggggtacgaggtcttaacattctttctgcttggccaggaggccgagaaagaagataaaatgctcgcactgagtctcgaagatgagcatctgttatatggggatataatacgccaggatttcctggacacatataataaccttaccctgaagaccatcatggcctttcggtgggtgactgagttctgcccaaatgcgaagtatgttatgaagacagataccgatgtatttattaacacgggaaacttggtgaagtacctcctcaatctcaatcatagtgagaaatttttcaccggttaccctttgattgataactacagctatcgcggattttaccaaaaaacacacatctcctatcaggaatacccgttcaaagtgttccctccgtattgcagcggtctcgggtatattatgtcccgagatctggtcccacgcatatatgagatgatgggacacgttaaacccattaagttcgaggatgtgtacgtgggaatttgcttgaatctgctaaaggtaaacattcacattcctgaggatacaaacctctttttcctgtacaggatccatctggatgtgtgtcagttgcgacgcgtaattgctgcccacggcttttcctcgaaagagatcattaccttttggcaagtcatgctgagaaataccacctgccactactag

SEQ ID NO: 48579 - DNA, 996 bp, Artificial Sequence
  Description of Artificial Sequence: Synthetic coding sequence
atggcttctgccctctggacggtgcttcccagtaggatgagtctccggtctttgaagtggtcactgttactcctcagcttgctgtcctttttcgtgatgtggtacctgagcctgccccactataacgtgattgaaagggttaattggatgtacttttacgaatacgagcccatctataggcaagattttcactttaccctacgtgagcactcaaattgctcccatcagaacccattcctggtgattcttgttacgtctcaccccagtgatgtgaaggccaggcaggccatccgcgttacttggggagagaaaaagtcttggtgggggtatgaagttctgaccttctttctgctgggccaagaggccgagaaggaggacaagatgctggcactgtcactggaggatgagcacctgttatacggagacatcattagacaggacttccttgatacctacaataatctgaccttgaaaaccattatggcgttcaggtgggtcactgaattttgccctaatgccaaatatgttatgaagaccgacaccgacgtttttataaacacaggaaacctggtgaagtatctgttaaatttgaaccatagcgaaaaatttttcaccgggtacccactcatagacaactactcataccgcggtttctatcaaaaaacacacatttcctatcaggagtacccattcaaagttttccctccatactgcagcggactgggatatattatgtcccgtgatctcgtgcccagaatatatgagatgatgggccatgtgaaaccgataaaattcgaggatgtctatgtaggcatatgcctgaacttgttgaaagtcaacattcacatacctgaggacacaaacctgttcttcctctatcgaattcatctagatgtgtgccagttgaggcgagtcatagcagctcatggcttcagctccaaggaaatcatcactttctggcaggttatgctgaggaatactacatgtcactactag

SEQ ID NO: 48580 - DNA, 276 bp, Artificial Sequence
  Description of Artificial Sequence: Synthetic coding sequence
atggcaagtgcactgtggaccgtgctaccaagtcgcatgtccctccgttccctgaagtggtctttgttactcctatccctcttgtccttttttgtgatgtggtatctctccctaccccattacaatgttatcgagcgcgtgaattggatgtatttttacgaaattcacttagacgtgtgtcagctccggcgagtaatcgctgcgcacgggttctcttccaaagagatcatcacgttctggcaagttatgctgcggaacaccacttgtcactactag

SEQ ID NO: 48581 - DNA, 336 bp, Artificial Sequence
  Description of Artificial Sequence: Synthetic coding sequence
atggcctccgccctttggaccgtgttgccctcccgcatgtccctccgcagtctgaaatggtccttacttctcctgagcctactgtccttctttgtcatgtggtatctgtctctgccacactataatgtgattgaacgggttaactggatgtatttctatgaatacgaacctatttatcgccaagactttcactttaccctcagggaacatagtaactgctctcatcagaatccctttctggttattctggtcacctcacaccctagcgatgtgaaagcgaggcaggcaatacgtgttacatggggggaaaagaaatcctggtggggctacgagtag

SEQ ID NO: 48582 - DNA, 177 bp, Artificial Sequence
  Description of Artificial Sequence: Synthetic coding sequence
atggcctctgccctgtggacggtcttgcctagtagaatgagcctgcgttccctcaaatggtccctgttactcctgtctctcttgtcattttttgtcatgtggtatctgtcactgccacattataatgtgattgagcgtgtaaattggatgtatttctatgaatacgagcctatctag

SEQ ID NO: 48583 - DNA, 996 bp, Artificial Sequence
  Description of Artificial Sequence: Synthetic coding sequence
atggcttccgccctgtggaccgtgttgccaagccggatgtccctccgcagcctcaaatggtcacttctgctcctatctctgctgagcttctttgtgatgtggtatctgtccctaccccactacaatgtgattgaacgggttaattggatgtatttctacgagtacgaacctatctataggcaggatttccacttcacactgagagagcattcaaactgcagccatcagaaccctttcctagttatccttgtgactagccatccatccgatgtgaaggcccgtcaagccattcgggtgacctggggtgaaaagaagtcctggtggggctatgaggtccttacctttttcttgctgggccaggaagccgaaaaggaagacaagatgctggccctgagcctggaagatgagcatttattatacggagacattatacgacaggactttctggacacctataacaacctgaccctaaagactatcatggcttttcgatgggtcactgagttctgtcctaacgctaaatatgtaatgaagactgacaccgacgtttttatcaacacaggcaacttggtgaagtacctgctgaatctgaaccactctgagaagttcttcaccggctatcccttaatcgacaactattcttaccggggattctaccagaaaactcacatcagctaccaagagtacccattcaaggttttccccccttactgcagcggcttggggtacatcatgtcccgtgatctggtgcctagaatatacgagatgatgggacacgtgaaacccattaaatttgaggatgtctacgtcgggatctgtctcaatttgctaaaggtgaacattcatatccctgaagatactaaccttttttttctgtacaggattcatctggacgtatgtcagctgagacgggtaatcgcagcacacggcttctcatccaaggaaatcatcaccttttggcaggtgatgctgagaaacactacttgccactattag

SEQ ID NO: 48584 - DNA, 126 bp, Artificial Sequence
  Description of Artificial Sequence: Synthetic coding sequence
atggcctctgcgttgtggaccgtgctgccttccagaatgagcttacgatcactgaaatggtccctgctgctcctgagtctcctttctttcttcgttatgtggtacctctctctacctcactactag

SEQ ID NO: 48585 - DNA, 996 bp, Artificial Sequence
  Description of Artificial Sequence: Synthetic coding sequence
atggccagcgctctgtggacagtcctgccttcacgcatgagtttgaggtccctgaaatggtccctgctgctgctgtcactcctgtctttcttcgttatgtggtatctgagtctcccacactacaacgtgatagagcgggtgaattggatgtacttttacgagtacgagcctatctataggcaggatttccacttcacactgcgggaacactctaactgttctcaccagaatcccttcctggtcatcttggtgacttcccacccatcagatgttaaggccagacaggccattagggtgacctggggcgagaagaagagctggtggggatatgaggtgttaacattttttctactggggcaggaagccgagaaggaggataaaatgctggctctcagcctggaggacgaacacctcttgtacggggacattatccggcaagacttcttagacacttataataatctgacacttaagaccataatggcatttaggtgggtgacagagttctgtccgaacgcgaagtatgttatgaagactgacacggatgtgtttattaatactggcaacctagttaagtacctccttaacctgaaccactccgagaaatttttcacaggatacccgctaattgataattattcatatcggggtttctaccagaagacacacatatcataccaggagtacccttttaaagtgtttccaccatactgttcaggactcggatacatcatgagcagggacttagtgcctcggatctacgagatgatggggcacgtgaagccaattaagttcgaggatgtctatgtggggatctgtctcaatctcctcaaagttaatattcacattcccgaggataccaacttattttttctatatcgtatacacctggatgtctgccaattacgaagggtgatcgctgcccatggcttctcatcaaaggagatcataacattctggcaggtgatgctacgcaacaccacctgccactactag

SEQ ID NO: 48586 - DNA, 198 bp, Artificial Sequence
  Description of Artificial Sequence: Synthetic coding sequence
atggcctccgctctgtggacggttctcccaagccggatgtctttacgctctttgaagtggtctctgttgttactgtccctattatcctttttcgtcatgtggtatctaagtctccctcattataacgtgattgagcgcgtgaactggatgtatttttatgagtacgaacctatttatagacaggatttccatttttag

SEQ ID NO: 48587 - DNA, 90 bp, Artificial Sequence
  Description of Artificial Sequence: Synthetic coding sequence
atggcctccgctttgtggacggtcctgccttcccgtatgtcgctgaggtcactgaaatggtcgctgctcctgctctctctcctttcatag

SEQ ID NO: 48588 - DNA, 165 bp, Artificial Sequence
  Description of Artificial Sequence: Synthetic coding sequence
atggcttcagcactgtggaccgtccttccttccagaatgtcacttcgatctctaaagtggtccttgctgctccttagcttgctttccttcttcgttatgtggtacctatccctccctcactataatgtgatcgagagggtgaactggatgtacttctacgagtag

SEQ ID NO: 48589 - DNA, 981 bp, Artificial Sequence
  Description of Artificial Sequence: Synthetic coding sequence
atgagaaactggctggtgctcctctgcccatgcgtgctgggggcagccttgcatctgtggttacgtttaagatccccacctcccgcatgcgcctcaggcgctggtcctgcgggtggagtctcactgctgctgccaagactcgagtgtaacggggcagtttctgcacaccctaacttgcaccttccgggttccagggattctccagcttctgcttcccaagtagccggtatcaccgaccagctggctctgtttccgcagtggaagagcactcattacgatgtggtggtgggggtcctatccgcaagaaacaatcacgaactcaggaatgttatcagatctacgtggatgcggcacctccttcagcaccccacactctctcagagggtgctggtgaagttcattataggcgcacatggatgtgaagtgcccgtagaggatcgagaggatccttattcctgtaagctcctgaacattaccaaccccgtgctgaatcaggaaatcgaggcgtttagcctaagcgaagacacgtctagtggcctgcccgaagaccgggtggtgagcgtgtcctttagggttctatatccaatcgtgattacctctttgggggtgttctacgatgcgaacgacgtcggattccaaagaaacatcacggtgaagctctaccaggctgagcaggaagaggcgcttttcatagctaggtttagccccccaagctgcggggttcaggtgaataaactgtggtataaacctgtggaacagttcattctcccagagagttttgaagggaccatcgtctgggagtctcaggacctgcacggtctggtctcacggaatctgcataaggttacagtgaacgacggcggaggagtacttcgtgtaattaccgcaggggaaggtgctctcccccacgaattcctggaaggagttgaaggcgttgcaggaggctttatttacacgatccaaggcaaattcgccagttag

SEQ ID NO: 48590 - DNA, 966 bp, Artificial Sequence
  Description of Artificial Sequence: Synthetic coding sequence
atgagaaattggctggtcctgctctgtccctgtgtcctgggtgcagccttgcatctgtggctgcggctgcgttctccaccacctgcctgcgcatcaggtgcaggtccagcgggtggtgtatctctgctgctgccacgtttagagtgtaatggagccgtgagtgcacacccgaatctgcacttgcctggctcccgtgattcccccgcaagtgccagtcaagtggccggtatcaccgatcagctcgccctgttcccacaatggaagagcacacattacgacgtggtggtcggagtgctttccgcacgaaacaatcacgagctaaggaacgtgatcaggtctacatggatgaggcacttgctccaacaccccactctgagccagagggttctcgtaaaattcattatcggggcacatggctgtgaggtgccagtggaagatcgggaggacccttacagctgcaaattgttaaacataaccaatcctgtgctgaatcaggaaatcgaagcatttagcctgagcgaggacaccagctccgggctcccggaggatcgggtggtcagtgtgtcatttagagtcctttatcctattgtgatcacatcccttggcgtattctatgacgctaatgatgttggttttcagcgaaatattacggtgaagctgtatcaggctgagcaagaagaagccctgttcattgccaggttcagtcctccctcttgcggcgtgcaggtcaacaaactctggtacaaaccagtggaacagttcatactcccagaatcctttgagggaactatcgtctgggaatcccaagacctccacggactggtcagtcggaatttacacaaggttactgttaacgacggagggggagtgctacgcgtgatcactgctggtgagggggctctgccacacgaatttctcgaaggagtcgagggcgtggctggaggcttcatatacactatccagtag

SEQ ID NO: 48591 - DNA, 1503 bp, Artificial Sequence
  Description of Artificial Sequence: Synthetic coding sequence
atgcgcaattggttagtgctgctatgtccctgtgtcctcggagctgccctccacctgtggctaaggctgagatctcccccacccgcttgcgcatccggcgctggtcctgccgaccagctggccctgttcccccagtggaagagtactcactatgatgttgttgttggagtgctgtctgcccgtaataaccatgaactgagaaacgtgattagatctacttggatgaggcatctgctacagcatcccaccctttcccagcgagtgctggtcaagttcatcatcggcgcacacggttgcgaggtacctgtggaggatagagaggatccatactcctgtaagctcctaaacatcaccaatcccgtgctgaatcaagaaattgaagctttcagtctgtctgaggatacgtccagcggcttgcccgaagaccgcgtagtctccgttagtttccgagtgctttaccctatagtgattacaagcctgggagtcttctacgacgccaacgacgtgggattccagagaaatattaccgttaagctgtaccaggccgagcaagaggaggcactttttattgccaggttcagtcctccttcgtgtggtgttcaagtgaataaactgtggtacaaacctgttgagcaatttattctgcccgaatctttcgaaggaaccatcgtgtgggaatcacaagacttacacggacttgtctcccggaatctgcataaggtgaccgttaatgacggcggtggggtgttaagagtgattacagccggagagggggcactgcctcatgagttcctggaaggtgtggagggggtagctggcggatttatttatactatccaggagggtgacgccctactccataatctgcactctcggccacagcgattgatcgatcacatccggaatcttcacgaggaggacgccctcctaaaagaagaatcctctatctatgatgatatagtctttgtggatgttgttgacacctatcggaatgttccagctaaattattgaatttttatcgttggactgtggaaacaacatcgttcaatcttctgctgaaaacagacgacgactgctatatcgatttagaggccgttttcaatcgcatagtgcagaagaatctcgacggaccgaatttctggtggggcaactttagactaaattgggctgtggatcgcacaggcaagtggcaggaactggagtacccttcccctgcctaccctgcctttgcctgcgggtcaggctatgtgatatcaaaggatatcgtcaaatggctggcctcaaactcaggacggctgaaaacttaccagggcgaggacgtgtccatgggcatctggatggccgctatcgggccaaagcgatatcaggattctctgtggttatgcgaaaaaacctgcgagactggtatgctctcctctccccaatatagcccctgggagttgacagagctgtggaaacttaaggagcggtgcggggacccatgcagatgccaagccaggtag

SEQ ID NO: 48592 - DNA, 1602 bp, Artificial Sequence
  Description of Artificial Sequence: Synthetic coding sequence
atgtggctcggcagacgagctctgtgtgctcttgttctgctgctcgcctgcgcgtctctagggctcctgtatgcaagcacaagagacgctcccggtctccgactaccactcgccccatgggcccctcctcaaagtccaaggagaccggagctgcctgacctcgcgcctgagccacgctatgctcacatccctgtgagaataaaagaacaagtcgttggactgctcgcctggaataattgctcctgcgagtcgagcggtggcggacttcccctcccttttcagaaacaagtccgcgctatcgatctgacaaaagcctttgaccccgcagaattaagagccgcaagtgccactagagagcaggaatttcaggcattcttgtccagatcccagtctcctgcagaccaactcctgattgctccagccaattcacctctccagtatcctctgcaaggagtggaggtacagccactccgcagcatcctagtcccaggtctgagcctgcaagccgctagcggtcaggaagtgtaccaggttaatctgacagctagcctcggcacatgggacgtggccggagaggtgactggggtaaccctgaccggggagggccaggctgacctcacactggtgtccccagggctggaccagttgaaccgccagctgcagctcgtgacatacagcagcagatcctaccagacgaatactgctgatacagtgcgtttctctacagaaggacacgaggctgcctttacaatccggatccgccacccccctaatcctagattatatcctcctggttccctgccccagggagcccagtataacatcagtgccctagtgactatagccaccaagacctttttaagatacgacagactacgtgcgctgatcacttcgatcagacggttttacccaacagtgactgtcgtgatcgcagacgattccgacaaacccgaacgcgtgtcgggcccatacgtggaacactatctcatgccgttcggcaagggttggttcgccggtcggaacctggctgtgagccaggtgaccaccaagtacgtactgtgggttgacgatgacttcgtcttcacagccaggactcgattagagaggctcgtggatgttctggagagaactcccctcgaccttgtggggggtgcagtccgtgagatttccggctttgctacaacctataggcagttacttagcgtggagccaggagcccctgggcttgggaactgcctgcgacagagacgaggatttcaccatgaattggtgggattcccaggttgtgtagtcacagatggggtggtgaacttctttttggccaggacagacaaggtgagagaagtggggttcgatcccagactgtccagggttgcccacttggaattctttcttgacgggctgggaagcctccgcgtcggatcgtgctcggatgtcgttgtggaccatgcctcaaaactcaagctgccttggacctcccgggatgctggcgctgagacctatgcacgctaccggtaccccggatccttagatgaatcccagatggccaagcatcgtctcttattttttaaacacaggctgcaatgcatgacctcccaatag

SEQ ID NO: 48593 - DNA, 714 bp, Artificial Sequence
  Description of Artificial Sequence: Synthetic coding sequence
atgtggttgggccgacgagccctgtgcgctctcgttctgctgctggcttgcgcttctctggggctactatacgcttctaccagagatgcgccaggcttgcgcctgccccttgcgccttgggccccaccacagtctcccaggagaccagagttgccagatctggccccagagcctcggtatgcgcacattcccgtgaggattaaagagcaagtggtcggactcctcgcgtggaacaactgtagctgcgaatcgagtggtggcggactcccgctcccgttccagaagcaggtgagagccatcgacctcaccaaagcgttcgaccccgctgaactgcgtgctgcttcggctactagggaacaagaattccaggccttcctgagtaggagccagagccctgctgaccagctgctaatcgctccagctaacagtcctctccagtaccctctgcagggcgtggaagtgcagcccctgcgatctattctggtgcccggactctccctccaggcagccagcggtcaggaggtgtaccaggtgaatctgaccgcttctctgggcacttgggatgttgctggagaagttaccggcgttacccttaccggagagggccaagcagaccttacattagtgagcccagggttggatcagctgaatagacaactgcaattggtgacttactcctccaggtcttaccagaccaacaccgctgacacgtag

SEQ ID NO: 48594 - DNA, 363 bp, Artificial Sequence
  Description of Artificial Sequence: Synthetic coding sequence
atgtggctggggagaagagcgctctgtgccctggttctactgcttgcttgtgcctcactcgggctgctgtatgcttcaacacgcgacgcacctggtttgagacttccactggccccttgggcaccccctcaatcacctagaaggcctgagcttcccgatctggctcccgagccacggtatgcccatatccccgtcaggatcaaggaacaggtggtgggattgttggcatggaataattgctcttgcgagagcagcgggggtggcctccccctgccatttcagaagcaggttcgagccatagacttgactaaggctttcgatcctgctgaacttcgtgcagctagcgccacccgcgagcagtag

SEQ ID NO: 48595 - DNA, 1701 bp, Artificial Sequence
  Description of Artificial Sequence: Synthetic coding sequence
atgggctcagccggtttctctgtgggaaagtttcatgtggaagtggcctcccggggtagggagtgtgtctcaggtacccctgaatgcgggaatcgcctcgggagcgctgggttcggggctctttgtctcgaactcagaggcgctgaccctgcttggggaccgtttgcggcacatggtagatctagacgccagggatcaaggttcttgtggctgctgaaaatcctggtcattattctcgtgcttggaattgttggattcatgtttggctctatgtttctacaagctgtttttagcagccccaaaccagagttacccagccccgctcctggggtccagaaactgaagctgttgccagaggaaagactccggaatttatttagctatgatggaatctggctgttccccaagaaccaatgtaagtgcgaagccaataaggagcaggggggatataacttccaggatgcatatgggcagtccgacctgcctgccgtcaaggcaagacgccaagcagagtttgaacactttcagagaagagaagggctccctaggccactcccccttctagtccaacccaacctcccgtttggataccccgtccatggagtggaagtcatgcctctgcacactgtaccaatccctggtttgcagttcgaagggccagatgcccctgtgtacgaggtgaccctcacggccagtctcgggactctcaacactctggccgacgtccctgactctgtggtgcagggcagagggcagaagcaactcattatttctacatctgatcgaaaactgctaaagttcattcttcagcacgtgacttataccagcaccggatatcagcaccagaaggtcgatattgtgtctcttgagtcccgcagcagcgtggctaaattccctgtcaccatcagacatccagtgatccccaagctgtatgatcccggtccggagcgtaaactgcgcaatctggtgacaattgcgacgaagacctttctccggccacacaagctcatgatcatgctgagatccataagggagtattaccccgatctgaccgtgatagtggccgatgattctcagaaaccactggagatcaaggataatcacgtggagtattacacgatgcccttcgggaagggttggttcgccggaagaaatcttgccatttcccaggtgacaactaagtacgtgctatgggttgatgatgatttcctcttcaacgaagaaactaagatcgaggtgctcgttgatgtgctggagaagacagagcttgacgtggtggggggaagcgtgttggggaatgtttttcagttcaagctgcttttagagcaatcagagaatggcgcttgcttgcacaagcgcatggggttttttcagccgctagatgggtttccctcttgcgtggtgacgtcaggcgtggtgaatttctttctggctcacacagagcgactgcagcgggttggctttgacccacgcttacagagagtcgcccattccgaattttttatcgacggcctcggaactttgctggtgggtagctgcccagaggttattatcggacatcaatcaagatcacccgtggttgatagcgagttggctgccctggaaaaaacgtacaacacttataggtccaatactctcacccgagttcagttcaaactggctcttcactacttcaaaaatcatttgcagtgcgctgcctag

SEQ ID NO: 48596 - DNA, 1521 bp, Artificial Sequence
  Description of Artificial Sequence: Synthetic coding sequence
atgacctcagggggaagccggttcttgtggcttctgaagatcctggtcatcatcttggtattgggcattgtggggttcatgttcgggtctatgttcctgcaggctgtattcagctctccaaaacctgaacttccaagtccagccccaggagtccagaaacttaagctcctccctgaagagaggctgcgaaatctcttcagctacgacggcatttggttgtttccaaagaaccagtgtaagtgtgaagcaaacaaagagcaaggaggatacaacttccaggacgcttatggccaaagtgacttgcctgccgtcaaggccagaaggcaggcagaattcgagcacttccagagaagagaagggctgcccaggcccctgccccttctggtgcagcccaacctgcccttcgggtacccagtgcacggagtcgaggttatgcctctgcacacagtccctattcccggactgcagttcgagggccctgatgccccagtgtacgaagtcacgctcacggcttcgctgggaaccctgaatactctcgctgacgtcccagacagtgtggtccagggaaggggccaaaagcagcttattatcagcacgtctgataggaagttgctcaaatttattctccaacacgttacatacacctccacaggttatcagcaccagaaggtggatattgttagccttgaatctcgaagtagtgtggctaagttccctgtcaccattaggcaccctgtgattccaaagctttatgatccgggtcccgaacggaagctgagaaacctggtgacaatagcgactaaaaccttcctgagaccccacaagcttatgattatgctgcgttcgatacgggaatactacccagacctgaccgttatcgtagcagatgattcccagaaacccctcgaaataaaggataaccatgtggagtattacacaatgcctttcggcaaaggatggttcgctgggaggaatctggccatttcacaggttacgaccaaatacgtgctctgggtcgacgatgacttcctgttcaacgaagagaccaagatagaagtactggtggacgtgttagaaaagaccgagttagacgttgtgggcggatctgtgctcgggaacgttttccaattcaaactgctgcttgagcagagcgaaaatggcgcttgcctgcacaaacggatgggattctttcagcctctcgacggattcccttcatgcgtagttacttcgggggtggtcaactttttcctggcacacaccgagaggttacagagggtgggcttcgaccccaggttgcaaagagttgcccactcagaattctttattgatggcctcggaaccctgttagtgggaagctgtccggaagtcataatcgggcaccagtctcgaagtccagtagttgatagtgaattggctgctctggagaaaacttacaatacatatcgctcaaacactctgacacgcgtccagttcaagctggctctgcactatttcaaaaaccatttacaatgcgctgcgtag

SEQ ID NO: 48597 - DNA, 1443 bp, Artificial Sequence
  Description of Artificial Sequence: Synthetic coding sequence
atgttcggatcaatgttcctgcaagccgtgtttagctcacccaagcctgaacttccctctccagctcctggagtgcagaaattgaaactccttcctgaagaacgcctccgaaaccttttttcgtacgacggcatctggctgttccctaagaaccagtgtaagtgtgaggctaacaaggaacagggaggctacaatttccaagatgcctatgggcagtccgatctgccagcggtaaaagccagacgccaagctgagttcgagcatttccagcgacgggaaggccttccacgcccacttccactgttggtgcagcccaatctgccttttggctaccccgtgcacggagttgaagtcatgcctcttcacactgtccccatcccaggcctgcaattcgagggacctgacgcaccagtgtatgaggtgacgcttaccgctagcctgggtaccctgaacactctggcagatgtcccagattcggtagtgcaaggtaggggtcagaaacagctgatcatctctacgtcagatcggaaactcctaaagttcattctgcagcacgtgacttataccagcacaggctaccagcatcaaaaggtcgacatcgtcagccttgagtccaggtcttctgtggctaagtttcctgtgactatccggcatcccgtcattccgaaactctatgatccaggaccagaacgcaagctgcggaatttggtgacgatagcaaccaagacttttctgagaccccataagctaatgatcatgcttaggtctatccgtgaatattatcctgatcttacggtgatcgtggccgatgactctcaaaagcccttagagataaaggataatcacgtcgagtattatactatgccattcgggaagggctggttcgccggaagaaatctggcaatcagccaggtgactacaaagtacgttttgtgggttgacgatgacttcctttttaacgaggaaacgaagatagaggtgctcgtggatgtcctcgagaagactgagttggatgttgtgggtgggtcggtactgggaaacgtgttccagtttaagttgctcttggagcagtctgaaaacggcgcttgtctacataaaagaatgggatttttccaacccctggatggatttccctcttgcgtcgtaacaagcggtgtggttaactttttcttagctcacaccgagaggcttcagagggtcgggtttgatccaaggctgcagcgcgtggcccatagcgagttttttattgacggcctcggtactttgctggtcgggagttgccctgaagtgatcattggtcatcagtcaaggagccctgtcgtcgacagcgaattagccgctctggagaagacctataatacgtatcgtagcaatacccttacacgggtgcagttcaagctggcactccattacttcaagaaccaccttcaatgtgctgcttag

SEQ ID NO: 48598 - DNA, 3120 bp, Artificial Sequence
  Description of Artificial Sequence: Synthetic coding sequence
atgcccagactgcccgttaaaaagatacgcaagcagatgaaactcttactgttacttctacttttgtcgtgtgctgcctggttgacgtacgtgcatttgggacttgtgcgccagggacgcgctctcaggcaaaggctcggctacggcagggatggcgagaaactgacatcagagaccgacggaaggggcgtgcacgccgctcctagtacccagcgtgccgaagattccagcgagtcccgcgaagaagagcaggctcccgaaggtagggatcttgatatgctgttccccggtggcgcaggtagacttcctttgaatttcactcatcagactcctccttggagagaggagtacaaaggccaagttaacctccatgtgtttgaagactggtgcggaggtgccgtgggacacctgagaagaaaccttcatttcccattattcccacatacgagaacaaccgtgaaaaagctggcggtgtctcccaaatggaaaaactatggcctcagaattttcggttttatccaccctgctagagatggtgatgtgcagttctctgtggcatctgacgataatagcgaattctggttgtccctggatgagtctccggctgccgcacagctcgttgccttcgtggggaaaacaggtagcgaatggactgctccaggcgagttcaccaagttttcctctcaggtgagcaagcccagaaggctcatggccagccgcaggtattacttcgagctgctgcataaacaagacgatcgaggctctgaccacgtggaagtcggatggagagctttcctgccagggctcaagttcgaagtgatcagttccgcccacatcagcctatatacagatgaaagcgctttgaaaatggaccacgtggcccatgtaccacaatcgccagccagccatgtcggcggtcgcccaccgcaggaagaaacttcagctgacatgctgcgacccgaccctcgggataccttttttctaacacccaggatggaatctagcagcctggagaatgttctggaaccctgcgcctacgcccctacttatgtggtgaaggatttccccattgctcgataccagggcctgcagttcgtctacctgtctttcgtctaccccaacgactacacgcgcctcacacatatggaaacagacaacaagtgcttctaccgggagtctcccctctacctggaacgtttcgggttttacaagtatatgaagatggataaggaggagggcgatgaagacgaggaagacgaggtgcagcgcagagcttttctgttcctcaacccagacgacttcctcgatgacgaagatgagggggagctgttagactcacttgaacctacggaagccgcaccgcctcgctcagggcctcagagcccggctcccgctgctcccgcacagccaggcgcaacactcgccccacctactccgcctcgtcccagagatggagggacaccacgtcactccagagcactatcttgggccgcacgagccgcaaggccactcccgttgttcctcggcagagctcctcctcctaggcctgctgtggagcagcccccacctaaggtatacgtgacccgggtccggcctggccagcgggcaagcccacgagctccagccccacgcgctccttggccgccatttcccggagtttttttacaccctagaccgttaccccgagtgcaactgcgggcacccccaaggccaccacgccctcatggtcgtaggaccgggggacctcaggcaacacagcccagaccacctgccagggcccaagccacccaaggcggaagagagggccaagctcggacgctgggacctgccgctcctactgtagattccaatctgtctagtgaggcccgacctgtgacatcctttctgtccctttcacaagtcagcggccctcagctccctggagaaggggaagaggaggaagagggagaggacgatggggctcctggtgatgaagccgcaagtgaggactccgaagaagctgccggaccagccctgggcaggtggagagaggacgcaattgactggcagcgcactttttccgtcggggctgtggatttcgagttactacgatcagactggaatgacctgcggtgtaatgtgtctggaaatttgcagctgcccgaggccgaggccgtggacgtgaccgcccaatacatggaacgactgaacgcgaggcacggcggacggttcgctctcttgagaattgtgaatgtcgagaagcgaagggacagtgccagagggtccagattcctattggagctggaattgcaggagcgcggtgggggacgcttaaggctgtcggagtacgtattcctccgactaccgggagctagggtcggcgacgctgatggcgagagccctgagcctgcgcctgcagcctccgtgcgacctgacggcagacccgaactgtgccggcctctacgcctagcctggaggcaggacgtcatggtgcactttatagtgcctgtcaaaaaccaggccaggtgggtagctcagttccttgcagatatggccgcactgcacgctagaacaggagacagccggttctcagtggtgctagtggattttgagtctgaggatatggacgttgagcgcgctctgcgggctgcccgtctcccaaggtatcagtatctgaggcggaccgggaacttcgagcgctcagccggactccaggcaggggtcgatgccgtggaggacgcatcttcaattgtgtttctgtgcgatctgcatatacacttccctcctaatatcttagatgggatacggaaacactgtgtggaaggacgtctcgcgttcgctcctgtggtcatgagactgtcctgtggaagctcaccgagagacccacatggatactgggaggtcaacggattcggcctcttcggcatctataaaagcgatttcgatagagtgggcggaatgaacactgaagagttcagagaccagtgggggggagaggattgggagttgttggaccgcgtgctgcaggcaggactggaggtagaacgactgcgtctacgaaatttctaccaccactatcactccaaaagaggcatgtggtccgtacgatcacggaagggctctagaaccggtgcttcctag

SEQ ID NO: 48599 - DNA, 708 bp, Artificial Sequence
  Description of Artificial Sequence: Synthetic coding sequence
atggacccagcccgaccacttggcctgtccatcctgctgctgtttttaaccgaggccgcactgggggacgccgctcaggaacctaccggaaacaatgcggaaatctgcctgttgcccctcgactacgggccatgtcgcgcactactgttgcgatattattatgatcggtacacccagtcatgtcgccagtttctgtacggagggtgcgaggggaatgctaacaacttttacacctgggaggcttgtgacgacgcatgctggaggatagagaaagtccctaaagtgtgtcgactacaggtgagcgtggatgaccagtgtgaagggagcacggagaagtacttcttcaacctctcttccatgacttgtgagaagtttttcagcggtgggtgtcatcgaaatcgtatagaaaacagatttccagatgaggctacgtgcatgggattctgcgctccgaagaaaatcccttccttttgctactcccccaaggacgagggcttgtgctcggcaaacgtgacccggtattacttcaacccccgatatagaacatgtgacgcctttacctataccgggtgcggtggcaacgataacaactttgtgagccgggaggactgtaagagggcctgtgctaaggccctcaagaaaaagaaaaaaatgcctaaactgcgtttcgcgagcaggatcaggaagattagaaaaaaacagttctag

SEQ ID NO: 48600 - DNA, 309 bp, Artificial Sequence
  Description of Artificial Sequence: Synthetic coding sequence
atggctgactgggccagagcacagtctccaggcgctgtggaagaaatcctggaccgcgagaacaaaaggatggccgatagtctggctagcaaagtgacacgcctgaagagccttgcacttgacatcgatcgagatgctgaggatcagaacagatacctagatggaatggtgcgcgcacacggtgtgcgcgtttccgtcccatgccctagcacaacttgctgtcgggcttgcagtgtgagcttttccaccggcgctggcggatggagcaaccatcacttttgcgttatcctactcggctttttgccgtag

SEQ ID NO: 48601 - DNA, 336 bp, Artificial Sequence
  Description of Artificial Sequence: Synthetic coding sequence
atggctgattgggcacgagctcaatcaccaggagcggtagaggaaatcctggacagagaaaataaacgaatggccgatagcctggcatcaaaggtgactcgattaaagagtctagcactggacatcgacagggatgccgaggatcaaaaccggtacctggacggaatggatagtgactttaccagcatgacttcccttctgaccggctccgtaaagcggttctccacaatggcgcgtagtggacaagacaatcgcaaactgctctgcggaatggctgtggggctgatcgttgctttcttcatcttaagttattttctttctcgggctcgcacctag

SEQ ID NO: 48602 - DNA, 3348 bp, Artificial Sequence
  Description of Artificial Sequence: Synthetic coding sequence
atgctgaggggtaccatgacagcgtggcgcggtatgcggcctgaggtgaccttagcatgcctgctattggctacggctggatgtttcgccgacctgaacgaagtgccacaggtgacagtgcagcccgctagcacggtacagaagcctggcggaacagtgattctgggctgtgttgtcgagcccccacgcatgaacgtgacttggagactaaacggaaaggagctcaacggcagtgatgacgcattgggagtgctcattacacacggcacattggttattaccgccttgaataaccatacggttggcagataccagtgcgtggctcgtatgcccgctggggctgtagcgtcggtcccagcaacggtgactctggcaaacctgcaggacttcaaacttgacgttcagcatgtaatagaagtcgacgaggggaacaccgccgtgatcgcgtgccacctgccagagtcacaccccaaggcccaagtgcgatactccgtgaagcaggagtggttggaggcgtcccgcggtaactacctgattatgcccagcggtaatctacagatcgtgaacgctagccaggaagatgaagggatgtacaagtgcgccgcttacaatcccgtaacccaggaagtgaagacatcaggatcttccgaccgccttagagtgcgacgcagcacagcagaggcggcacgcattatttacccaccagaagcccagacgatcattgtgaccaagggacagagccttatcttggagtgtgtcgcctctgggataccgcctccaagggtaacctgggccaaggacggctcgagcgtgaccggatacaataaaacacgctttttactgtcaaacctgctgattgacacaacctcggaggaggactctggcacttatcgttgtatggcagataatggagtgggacagcccggtgcggctgtcatcctgtacaatgttcaggtcttcgaacccccagaggtgacgatggaactgtcacagctcgtaattccttgggggcagtcagccaaactaacgtgcgaagtgcggggaaacccacctccaagtgtgctgtggctacgcaacgctgtccccttgatcagcagccagaggttacgcctgtctaggagagctttgcgggtattatctatggggcctgaggacgaaggggtctatcaatgcatggccgagaacgaggtgggcagcgcccacgcggtcgtccagctgaggacatccagaccgagtattacaccaaggctgtggcaggacgccgaattggccacgggcaccccgcctgtgtcgcccagcaaattaggaaatcccgaacagatgctgaggggccagccggcactaccacgtccccctacgagcgtgggaccagcttcccctcagtgccccggagaaaaaggccagggggctcctgccgaggcacccatcatcctgtcctcgccaagaaccagtaagaccgattcctacgagctggtgtggcggcctaggcatgaggggtctggacgggctcctattctgtactatgtcgtgaagcatcgaaagcaggtgaccaattcatcagacgattggacaattagcggaattcctgccaaccagcacagactgactctaactcgcctggatcctgggagtctatatgaggttgagatggccgcatataactgcgccggagaggggcagactgcgatggtcacatttcgcacgggcaggagaccaaagcccgaaataatggcaagcaaagagcagcagatccagcgggatgaccccggtgcaagccctcaaagctcaagccagccggatcatgggcgactgtcccctcctgaagcaccggacaggccaactatctccactgctagtgagacttcggtctacgtaacttggatccctaggggaaacgggggatttccaattcagtcttttcgagttgagtacaagaagcttaagaaggtgggggactggattctagccactagcgctatccctccatccaggctgtccgtggagatcactggcttagagaaaggaacatcctacaagtttagagttcgagcactaaacatgctcggagagagtgaaccgtctgcgccaagtcgtccttatgtcgttagcggctatagcggcagggtttacgagcgtccagtggctgggccatacataaccttcaccgatgccgtgaatgagacgaccataatgctcaaatggatgtacattcccgcatcaaacaacaacacgcctatccatggtttctatatctactatagacctaccgactccgacaacgacagcgattacaagaaggatatggtggagggagataagtattggcacagcatctcccatctccagcccgagacctcttacgatatcaagatgcaatgctttaacgagggcggagagagcgagtttagcaatgtcatgatttgtgaaactaaggccagaaagagctctggccaacccggtcgcctgcctccaccaactctagcccctccccaacctccactgccagagaccatcgaaaggcctgtaggaactggggcaatggtcgctcgaagctcagatttgccttacttgatcgttggagtagtccttggctccattgtgctcatcatcgtgacctttatccccttctgcctttggcgcgcatggtcaaagcagaaacatacaacagacctgggttttcccagatccgcattaccgccttcatgtccatatactatggtcccactagggggactgccaggccatcaagcctccggtcagccatacctgtctggaatatcaggacgagcctgcgccaacggtattcatatgaatagaggctgcccctcagccgcagttggatatccaggtatgaagccacagcagcattgccccggtgagctgcagcagcaatcagacacctcaagcctgctgagacagacccacttgggcaacggttatgatccacaaagtcatcaaattactcggggaccaaagtcaagtcccgatgaggggtcattcttgtacaccctgccagacgactccactcatcagctcctgcagcctcaccacgattgctgtcagagacaggagcagcctgccgcagtcgggcagagtggcgtcagaagggccccagatagtcccgttctcgaggctgtgtgggaccccccttttcattctggcccaccttgttgtttgggcttggtgccagtcgaggaggtagacagcccggattcctgccaggtgtccggtggagactggtgtccccagcatcctgtgggtgcatatgtggggcaagaaccgggaatgcaactttctccaggacccttggtccgtgtgtcatttgagacccctcctcttaccatctag

SEQ ID NO: 48603 - DNA, 3345 bp, Artificial Sequence
  Description of Artificial Sequence: Synthetic coding sequence
atgctccggggaactatgactgcttggcggggaatgaggcctgaagttaccttggcatgtctcctgctggcaaccgcaggatgctttgccgacctgaatgaggtgcctcaggtcacagtgcagcctgcatccaccgtgcagaaacctgggggtacagtcatcctgggatgcgtggttgaaccaccaaggatgaacgtgacttggagactcaacggaaaagaactcaacggatccgatgacgccctgggcgttctcatcacccacgggacgctggtcattacagcccttaacaatcacacagtgggccgataccagtgtgtggctcgaatgccagcgggagcagttgcctctgtacctgctactgtgacactcgccaacttgcaggactttaaattggatgtacagcatgtcatcgaggtggatgaggggaacactgcagtcatagcttgccacctgcccgagtcacatccgaaagcccaggtgcggtactccgtgaagcaggagtggcttgaggctagtcgcggaaactacctaataatgccctccggcaatctgcaaatagttaatgccagtcaggaagacgagggcatgtataagtgtgccgcatacaaccctgtgacccaagaagtaaagacatcagggtcctccgaccggctaagagtgaggcgcagcaccgcagaagccgctcggattatctaccccccagaagcccaaacaatcatcgtaaccaaaggccagtctttgatccttgagtgcgtggccagcggcattcctcctcctagagtaacctgggccaaggatgggagtagcgttacaggctacaacaaaacgcgttttctgctttccaatctgttgatcgacaccacttccgaggaggacagtgggacatatagatgcatggcggacaacggcgtgggccagcctggagctgcagtcatactgtacaacgtgcaagtgtttgagcccccagaggtcacaatggagctgtctcagctcgtcatcccatggggccagtccgccaagcttacttgtgaagtccggggaaaccctccccctagcgtactgtggctgcggaacgccgtaccgttgatctctagccaacggctgagactctccaggagggctctcagggtgctctctatgggacccgaggatgagggcgtgtatcagtgcatggccgaaaacgaggtgggttccgcccacgcagtcgtgcagctccgcacatccaggccgtccattacaccccgactatggcaggacgccgagctcgccaccggcactcccccagtgagcccttcaaagcttgggaacccagaacagatgttacggggacagcctgccttacccaggccacccacaagcgtcgggcctgcgtctccccagtgtccaggggagaaagggcagggcgcaccagctgaagctccaattatcttgtcttcgccgaggacctccaaaacagactcatacgagctggtgtggagacccagacacgaggggagtggccgagcaccaatattatactacgttgttaaacaccggaaggtcacaaattcgtcggacgattggacaatctcaggtattcccgcaaaccagcacagattaactttgacaaggctggatccaggatcgctttacgaagtagagatggccgcatacaactgcgccggtgaagggcaaaccgctatggtgacgttcagaacgggaaggaggcctaagcccgagatcatggccagtaaggagcagcagatacaaagggacgaccccggagcctctccacagtcctcctcccagcccgatcatgggaggcttagccctcccgaggctcctgatagacccaccatcagcaccgcatctgagacatcagtgtacgtgacttggatcccgcgtggcaatggaggctttcccatccagagtttcagagtggaatataagaagctaaagaaagtcggtgattggattctggccacgtcagccatccctccatctagactgtctgtggaaattactggcctggagaaaggcacttcttataaattcagagtgagggcactcaacatgcttggcgagtcagagccttctgcaccaagtcgaccttacgtggtgtctggatactctggacgggtgtatgagcgtcctgtggccggaccttacatcactttcaccgatgccgtgaacgagaccactattatgctgaagtggatgtatattcctgccagtaataataatactccaattcacggtttttacatctactatagaccaacagactccgataacgattccgactacaaaaaggatatggtggaaggtgataagtattggcatagtatttctcacctgcaaccagagacctcttacgacattaagatgcagtgctttaacgagggaggagagtctgagttctcaaacgtgatgatttgcgagaccaaagcacgcaagagctcagggcagcctggcagattgcccccacctaccctagctccccctcaaccgcctctgcccgagactattgagagaccagttggcacaggagctatggttgcacgctcctctgatctcccgtacctgatcgttggggtcgttctcggaagcatcgtgcttataatcgtcactttcattcctttctgcctgtggagggcgtggtcgaagcagaagcatactaccgacctcgggtttcccaggtcagccctgcccccatcttgtccatatacgatggttcctcttgggggacttccgggtcatcaagcctcgggtcagccctacctgagtggcatctctggcagggcctgtgccaacggcatccacatgaatcggggatgcccctctgccgcagtgggatatccaggtatgaagccacaacagcactgccccggtgagctccagcaacaaagcgacacctccagtctgctgagacagactcacttggggaatgggtatgatccccagtcacaccagatcaccagggggccaaagtccagccctgacgaaggatcatttttatacacacttccggatgactccacacaccaacttctgcagccacaccatgactgctgccaaagacaagaacagccggcagccgttggccagtcaggtgtgcgtcgagcccctgacagtcctgttctggaggctgtgtgggatccacctttccatagcgggcctccatgctgtctgggattagtgcccgtagaggaagtggatagccctgacagctgccaggtaagcgggggagattggtgcccccagcaccccgtcggagcttacgtgggacaggaacccggaatgcagctgagtccaggacctctggtgcgggtgtcttttgagaccccaccactgacaatatag

SEQ ID NO: 48604 - DNA, 69 bp, Artificial Sequence
  Description of Artificial Sequence: Synthetic coding sequence
atgctgcgcggaaccatgaccgcgtggcgtgggatgagacccgaagtaacactggcatgtctgctctag

SEQ ID NO: 48605 - DNA, 258 bp, Artificial Sequence
  Description of Artificial Sequence: Synthetic coding sequence
atgctcaggggtacaatgaccgcttggaggggcatgagacccgaagtgactctggcgtgtctgctccttgctaccgccggatgctttgcagacttgaacgaagtgccccaggtgactgtgcaaccagcttcaaccgtccagaagcccggtggaactgtcattctggggtgcgtcgtggaacctcctcgtatgaacgttacttggagactgaatgggaaggaacttaacggatctgatgacgcacttggtgttctctag

SEQ ID NO: 48606 - DNA, 474 bp, Artificial Sequence
  Description of Artificial Sequence: Synthetic coding sequence
atgcttagagggacgatgactgcatggcgagggatgcgcccagaagtgaccttggcatgcctattgctcgccaccgccggttgtttcgctgatcttaacgaagtgccacaagtgacggtgcaacccgctagtaccgtgcaaaaacccggtggcacagtaattctggggtgtgtggttgagccgccaagaatgaacgtcacgtggcgactgaatgggaaagagcttaatggtagtgacgatgctttgggggttctgatcacccacggcacactggtaattacagctctcaataatcacaccgtaggaagatatcagtgtgttgccaggatgcctgccggtgctgtcgcgagtgtgccggctactgtgaccctggcaagcgagtccgcccctctgcccccatgtcacggcgcagtacctccgcatttatcccacccagaggcgcctactatccacgccgcttcctgttattcttag

SEQ ID NO: 48607 - DNA, 474 bp, Artificial Sequence
  Description of Artificial Sequence: Synthetic coding sequence
atgctgcggggaacaatgacagcatggcgtggcatgagaccagaggtgactctggcgtgcctattgctggcgaccgccggttgtttcgctgacctgaacgaggtgccgcaggtgactgttcagcctgcaagcaccgtacagaagccgggtgggaccgtgatcttggggtgtgtggtggagccccctcggatgaacgttacatggaggctgaacggcaaagaactgaacggctcggacgatgcactcggcgtactgattacgcacggcacgctggttatcacagccttgaacaaccacacggttggtaggtatcaatgcgtggctcgcatgcccgctggggctgtcgcgtctgtacccgcaacagtcaccctagcctcagagtctgctccattaccgccttgccacggagctgtgcccccacacctgagtcacccggaagccccaactatccatgctgccagctgttacagctag

SEQ ID NO: 48608 - DNA, 99 bp, Artificial Sequence
  Description of Artificial Sequence: Synthetic coding sequence
atgctgagagggactatgactgcttggagaggcatgaggccagaggtgaccttggcttgcctactgttggcaaccgcgggatgttttgctgacctgtag

SEQ ID NO: 48609 - DNA, 3345 bp, Artificial Sequence
  Description of Artificial Sequence: Synthetic coding sequence
atgctgaggggaacaatgacagcttggcggggtatgcggccagaggtcacactggcctgcctccttttagcaaccgctggctgtttcgcggacctgaacgaggtgccccaggtaacagtgcaaccggctagtactgtacaaaagcccggtggcaccgtgatcttaggatgcgtggttgaacccccacggatgaatgttacttggaggctgaatgggaaggaactgaatggaagtgatgatgccctcggcgtgttgattacccatggaactctggtcataacagccctgaataaccacactgtaggaaggtaccagtgtgtggctaggatgccggcaggggctgtggcgtccgtgccggctaccgtaactctcgctaacttgcaggactttaagctggacgttcaacacgtaatcgaagtcgatgagggaaatacagcagtgatcgcttgccacttaccagaaagtcacccaaaagcacaggtgcgctactctgttaagcaggaatggctggaagcctctcgagggaactatcttatcatgccttcgggaaacctgcaaatagtgaacgccagccaggaggacgaggggatgtataagtgtgccgcttacaatcccgtcactcaggaggtaaagaccagcggctcatctgataggctacgggtaagacggtcaactgcggaagccgctagaatcatttatcctccagaagctcaaacgatcattgtgacaaagggtcagagtctcatcctggagtgcgtggcctcgggcatccctcctcccagagttacatgggcaaaagatggtagctcagtgacagggtataacaaaacccggttcctactgtctaatttgctcatagacaccacctccgaggaggatagtgggacctatcggtgcatggctgacaacggcgtcgggcagccaggagctgctgtgattttatacaatgtgcaagtgttcgagccccctgaagtgacaatggagttatcccaactcgtaattccatgggggcagtctgccaaactgacgtgtgaggttcgagggaacccaccgcctagcgtactgtggctgcgtaacgccgtacccctgatcagctcccaacgcctgaggctgtcccggagggccttgagggtgctgagcatgggacctgaggatgagggtgtgtatcagtgcatggctgagaacgaggtgggcagtgctcacgcagtggttcagttgcggacttctagaccgagcatcacccccaggctgtggcaagacgccgaactggcaactggtacaccaccagtgtcccctagcaagctggggaaccccgagcagatgctgcgtggccagcctgctctccccagacccccaacgtcggttggccctgccagccctcagtgtccaggagagaagggacagggggctcccgcagaggcaccaatcattctgtcgtcgccacggactagcaagacagatagttacgagctagtctggaggccgcgacatgagggttccggcagggccccaatactctactatgtcgtgaagcacagaaaggtaaccaactcttctgatgactggacaatctccggcatcccggcaaatcagcatcgactgactctgactaggctggaccctgggtctttatatgaggtcgagatggccgcttataactgtgccggtgagggccagacggccatggtcacctttcgtacgggtagacgacctaaaccggagattatggctagcaaggaacagcaaatacagcgcgacgacccaggagcgtcacctcagagctccagtcagcctgaccacggacgcctctctccccctgaagcgccagaccgaccgaccatcagtacagcatcagaaacaagcgtgtacgtgacctggatacccaggggcaacggaggcttcccaatacagagctttagagtcgagtataagaagctgaagaaagtgggtgattggatcttggccacatccgccataccacccagtagactcagcgtggaaataaccggactggaaaaaggcactagttataaatttcgcgtgagggccctcaacatgctcggtgaaagtgaacccagcgccccaagccgaccctatgtggtttcaggctactccggcagagtgtatgagcgtccagtggcaggcccttacatcacttttactgacgctgtcaatgagactacaatcatgttgaaatggatgtacatccctgcaagcaataataatacaccaatccacggattttacatttactaccgaccaaccgattcggacaatgacagtgactacaagaaggacatggttgagggtgacaagtactggcactctatatctcacctccagcctgaaacaagctacgacatcaagatgcaatgcttcaatgagggaggggaatccgagtttagtaacgtgatgatctgtgagacaaaggcaagaaagagttccggccagccagggaggcttccgcctccaacgctggcccctcctcaacctccccttccagaaacaattgagaggcccgtggggactggtgcgatggtggctcggtcctcagatctaccgtatctaatcgtgggcgtcgtcctgggttcaatcgtgttgatcatcgtgaccttcattcctttctgtctatggagggcctggagcaagcaaaaacataccacagacctgggctttcctaggtcggctctgcctcctagttgtccgtatactatggtccctctggggggactgcctggccatcaggcatccgggcagccgtatctgtctggaatcagtgggagggcttgtgcaaatggaatccacatgaatcggggatgccccagcgcggctgttggctaccctgggatgaagcctcaacaacattgtcctggagagctgcagcaacagagcgacacctcttcactactgaggcagactcacttaggcaatggctatgatccccagtcccaccaaataacaaggggccctaaatccagccccgatgaaggtagtttcctgtataccctccccgacgactccacccaccagctgctgcagcctcaccacgactgttgtcagaggcaggagcagcctgcagcagtgggccaatcgggtgtaagacgcgcacctgacagtcctgtgttggaggcagtgtgggatccaccatttcacagcggacccccatgctgcctgggtcttgttcccgtcgaggaggtggacagccctgatagctgtcaagtgtcaggaggagactggtgccctcagcatccagtgggagcttatgtcggacaggaacccggtatgcaattgtctccagggccactggtccgcgtttcttttgaaaccccaccactgacaatctag

SEQ ID NO: 48610 - DNA, 627 bp, Artificial Sequence
  Description of Artificial Sequence: Synthetic coding sequence
atgaggtacgcatgttcctcctcggaggactggcccccaccgctggatataagttccgacggcgacgtggacgctacagttttgagagaactgtatcccgatagcccacccggagtgagcctgtctagattgcggtggtctgccatgatgtatacaggctcctttacatactgggtgaggagcatgctgagtaggcacaaactggatgcaatcttgggcaggcttggctacacggcgaccctagagtcggagttttctctcgtgcaggccatttctaaggagaatgtgaagcaaatggtgtttaagatatttttggtgcgagtgtcttgtgaggctgtactcagaacagccggaacgcggatgctggagcccggaaccgagaaattggccaggacccatagtcggcatagcagcgagaaaaggttggtcaagccctgctcatgcctcgaaggggtgcagcctgggcctgggagtggagggcctcagcagggacccagtgagggagtgggctcagagacagccctggctgaagggacagcaggacaaaggagcctgccgatggctctgtctccttccgaggtttccacggcccctaactccctgcccagcgggtcaccagtcttatag

SEQ ID NO: 48611 - DNA, 753 bp, Artificial Sequence
  Description of Artificial Sequence: Synthetic coding sequence
gcacggtacaacagaacctcctatttctacccaactttttccgaaagttcggagcactcacaccttctggtctctccagtgctggtggcgtctgcagttattggagtggtgatcattctaagctgcattaccataattgtgggctctatccggagagatagacaggctagattgcagcgacacagacatcgccaccacagacatcaccaccatcaccaccatcatcgcaggaggcggcatcgggagtatgagcacgggtatgtgtcagatgagcacacttattcccgctcatctcgtcgcatgcgctatgcctgcagtagtagtgaagactggccccctcctctcgacattagcagtgacggggatgtggacgctactgtcctcagggaattgtaccctgattctccacccggatacgaagagtgcgtgggaccaggcgcaacacagctttacgttcccaccgatgccccaccaccctattcactcacagactcctgccccactttagacggaacgagtgacagtggctcaggtcattctcccggtcggcaccagcaggagcagcggacgcccgctcaggggggattacacaccgtctcaatggatactctccccccttacgaggccgtatgtggggctggccctccatctggccttttgcccctcccaggtcccgaccccggtccgcgaggatcccagggcagtcctactcctactagagctcccgcaagcggcccagagcggatagtctag

SEQ ID NO: 48612 - DNA, 780 bp, Artificial Sequence
  Description of Artificial Sequence: Synthetic coding sequence
atgtcgtttaagcgcccatgcccacttgccaggtataaccgcacttcttatttctacccaacattttcggaatctagcgaacatagccaccttctcgtgtctcccgtactggtcgcatcggccgtgattggcgtagtcatcatactctcttgcattaccattatcgtgggaagtatacggcgtgatcggcaagcacgccttcagcgccataggcacaggcatcatcgccaccatcaccaccaccaccaccatcggaggcggaggcatagagaatacgagcatgggtacgtgagcgatgagcacacatatagccggtcctctagaagaatgagatacgcctgctcctcatcagaggactggcctccccctcttgatatctctagtgacggagatgtggatgccactgtgctacgcgaactgtatccggactcacctcccggatatgaggaatgcgtagggcctggcgctacccaactctatgtgcccaccgatgcaccaccaccctacagtttgactgactcttgtcctaccctggatgggacctctgattccggatctgggcattccccagggagacaccagcaggaacaaagaacgccagcgcaggggggtctgcataccgtgagcatggatactctccctccctacgaagcagtgtgtggggcagggcctccaagtgggttgcttcctctcccaggcccagacccgggtccaagggggtcacaagggagccccacccctacgagagcgcctgctagtggacctgagcggatcgtctag

SEQ ID NO: 48613 - DNA, 384 bp, Artificial Sequence
  Description of Artificial Sequence: Synthetic coding sequence
atgagcgcggcaggtgctcggggactgcgggcaacttaccatcgtctgctggataaagtagagttaatgctgcccgaaaaattaagaccactgtataatcaccccgctggacccagaaccgtgttcttctgggccccaatcatgaaatggggtcttgtgtgtgcgggactggcagacatggcacgaccggcagagaaactctcaaccgctcagtctgcagttcttatggctaccgggtttatctggagtcgatattctctcgtgattatacccaagaattggtcactgtttgccgtgaatttcttcgtcggagccgctggcgctagccagctctttcgtatctggagatataatcaggaactgaaggctaaagcgcacaaatag

SEQ ID NO: 48614 - DNA, 384 bp, Artificial Sequence
  Description of Artificial Sequence: Synthetic coding sequence
atgagcgccgcaggtgccaggggactgagggctacttaccaccgactactggacaaagtcgagttaatgcttccagagaaactgcgacccctgtacaaccatcccgcaggcccaagaacagtattcttctgggctcctataatgaagtggggcttagtttgcgctggcttagccgacatggcacgtccagccgagaaactttcaacggcacaaagtgctgttttgatggccaccgggtttatctggtcccgttattctcttgtgatcattcccaaaaattggtctctctttgccgtgaatttctttgttggtgctgccggagcgtcacaactgtttcggatctggaggtacaatcaggagctaaaggcaaaggcacataaatag

SEQ ID NO: 48615 - DNA, 318 bp, Artificial Sequence
  Description of Artificial Sequence: Synthetic coding sequence
atgtctgcagccggtgctagaggcctgcgtgccacataccacagactgctggataaagttgagctcatgctgcctgaaaaactgagacctttatacaaccatcccgctgggcctcgaactgtcttcttctgggccccaatcatgaagtgggggctggtgtgcgcaggactggccgatatggcccgacctgcagaaaagctgagcactgcccaatcagcagttttgatggccacaggctttatttggtctagatacagcctcgtgatcattcctaaaaactggtcacttttcgccgtaaatttttttgtgggagcttag

SEQ ID NO: 48616 - DNA, 330 bp, Artificial Sequence
  Description of Artificial Sequence: Synthetic coding sequence
atggccggagcactcgtgaggaaggccgcagattatgtccgaagcaaggattttagagattacctcatgtccaagcacttctggggtccggttgctaattggggcctgccaattgccgctatcaatgatatgaagaagtccccagaaatcatcagtggccgaatgacctttgctctgtgctgctacagcctaacgtttatgaggttcgcgtataaagtacagccaagaaactggcttcttttcgcatgtcacgcaactaacgaggtggctcagctcatccagggtggccgactgattaagcacgaaatgactaagactgcctcggcctag

SEQ ID NO: 48617 - DNA, 330 bp, Artificial Sequence
  Description of Artificial Sequence: Synthetic coding sequence
atggccggagccctggtgaggaaggctgcagattacgtcagaagtaaagacttccgggattatctaatgtcgacacacttttggggccctgtggcgaattggggcctaccaatcgccgcaattaatgacatgaagaaatctccagaaatcatatctggcagaatgactttcgccctctgctgttatagcctgacattcatgcgatttgcatacaaggtccaacctcgcaactggctcttattcgcttgccacgcaacaaatgaagttgcacagttgatccaaggtgggaggctcataaaacatgaaatgaccaaaacagcttccgcatag

SEQ ID NO: 48618 - DNA, 201 bp, Artificial Sequence
  Description of Artificial Sequence: Synthetic coding sequence
atgaagaagagcccagaaattatttctgggaggatgactttcgctctgtgttgttactcactgacattcatgcgcttcgcttataaggtgcagcccagaaattggctactgtttgcttgccacgctaccaacgaggttgctcagctcatccaaggtggaagactgattaagcacgaaatgaccaagaccgcctcagcgtag

SEQ ID NO: 48619 - DNA, 642 bp, Artificial Sequence
  Description of Artificial Sequence: Synthetic coding sequence
atgccagacgaaaatattttcctgttcgtgcccaacttgataggttacgccagaatagtattcgccataatctccttctacttcatgccgtgctgccccttgacagctagcagcttttatttgctatccggactgctagacgccttcgatggccatgcagctcgcgcactcaatcaggggactaggttcggtgctatgctggacatgctaacagacagatgttcaacgatgtgtttgcttgttaacttggcgttgttatacccaggagctactctttttttccagattagcatgtccttggacgtagcatctcattggttgcacctgcacagctctgtggtgcggggttctgaaagccacaagatgattgatctgtccggaaacccggttctccggatttactacacgtctcggcctgcactcttcaccctctgtgccggaaatgagctgttttattgcctgctttacctgttccactttagcgagggcccactggttgggtccgtgggcctgttccgaatgggcttgtgggtgaccgctcccatcgccctgttgaaaagcctcatatctgtgatacacctcatcaccgcagcacggaacatggcagctttagatgctgcagaccgggctaaaaagaagtag

SEQ ID NO: 48620 - DNA, 1008 bp, Artificial Sequence
  Description of Artificial Sequence: Synthetic coding sequence
atgattctggcatctgtgctgaggtccggacccggagggggtctgccgttgagacctcttctcggccctgccctggctctgcgtgccagatccacttccgctaccgatactcaccatgtcgaaatggcccgtgagaggtccaaaaccgtgacttccttttacaatcagagcgctattgacgcagcagccgaaaagccctccgtgcgcttaaccccaactatgatgttgtatgccggtaggtcacaagacggaagccacctgctaaaatctgccagatacctgcaacaggaactgcctgtacgaattgcccaccgaatcaaaggattccggtgcttgccctttatcattggttgtaacccaaccatcctgcacgtgcacgagctatacatccgcgcattccaaaaattgactgacttcccaccaatcaaagatcaggccgacgaggcccagtactgtcagctggtgaggcaacttctcgatgaccacaaggacgtggtgactctgctagcggaaggactaagggagtcacgcaagcatatcgaagatgagaaactcgttagatacttcttggacaagaccttaacatctcgtcttgggatacgcatgctggccacacaccatctggccctgcatgaggacaagccagattttgttgggattatatgtacaaggttatcccccaaaaaaattatagaaaagtgggttgatttcgcgcgtcggttgtgcgaacacaagtacggcaatgcccctagagtgaggatcaacggccacgtagcagctcgttttccgtttattcctatgcccctggactatatcctgcccgagcttctgaaaaacgccatgcggatctcagatagaggcggtggcattgcacataaggaccttgatagagtgatggattaccatttcactactgccgaagcctccacacaggatccacgcatctcccccctatttggtcatctggatatgcactctggggcacaaagtggtcctatgcacggctag

SEQ ID NO: 48621 - DNA, 1098 bp, Artificial Sequence
  Description of Artificial Sequence: Synthetic coding sequence
atgatactggcaagcgtcctgcgctctgggccagggggaggccttcccctgcgcccactgctcgggcctgcgctggcactacgggctcggtccacatccgcaacggatactcatcatgtcgagatggccagagagcgttcaaagacggtcacaagcttttataatcagtccgccattgacgcggcagccgagaagccaagtgtgcggctgacacctactatgatgctgtacgcaggcagatcccaagacgggagtcacttactcaaatctgctaggtacctgcagcaggagctgcccgtacgcatcgcacaccgtattaaaggtttcagatgcctcccttttatcattggctgcaaccccacaattctgcacgtgcacgagctttacatccgagctttccaaaagctgaccgatttcccgcctattaaggatcaagcagacgaggcgcagtactgtcagctggtgcggcagctactggatgatcataaggacgtggtgaccttactcgctgaaggactcagggagagccgaaagcacatcgaagatgaaaagctcgtgagatacttcctggacaaaacacttacttcccgcctcggaattcgtatgctggcaacccaccacctggcattgcatgaggataagcctgatttcgtcggaatcatttgcacgcggctcagtcctaagaagatcatcgaaaaatgggtggattttgcaaggagactgtgcgagcataagtacggcaacgcgccaagagtgcgtattaacggccacgtagctgcacggttcccgtttatccccatgccgttggactatatattgcccgaacttctaaaaaacgctatgcgcgctactatggaaagtcacctggacacaccctacaatgtccctgatgtggtcatcaccattgctaataatgatgtcgacctcattatacgcatttcggatcgcggtggcggaatcgcccacaaggacctggacagagtaatggattaccatttcaccaccgccgaagccagtacgcaggacccaaggattagcccgctgttcggacatcttgatatgcactcaggtgcccagtccggccctatgcacgggtag

SEQ ID NO: 48622 - DNA, 1239 bp, Artificial Sequence
  Description of Artificial Sequence: Synthetic coding sequence
atgatcctggccagcgttctccggagcgggcctggagggggactcccattgcgccctctcctcggccctgccttagccctcagggccaggtctacctccgcgacagatactcaccacgtggagatggccagggagcgtagcaagactgtaacctccttctacaaccagagcgcaattgatgctgcggctgaaaagccatccgtgagattaacacctacaatgatgctgtatgctggccgaagccaggatgggagtcatttgctgaagtccgcgaggtacctgcagcaggagttgcccgtgagaatagcgcacagaatcaagggtttccgatgtctgccgttcatcatcggatgtaaccctacaatcctgcatgttcatgaattgtacatcagggcattccagaaacttaccgatttcccccctatcaaggaccaagctgacgaggcacagtattgccagctcgtgcgacaactcttagacgatcataaggatgtggttacactgctagcggagggcttgagagagagcagaaagcacatcgaggacgagaagctcgttcgctactttctcgacaaaacattgacgtcgaggctgggaattagaatgttggccactcatcatctggctcttcacgaggacaaaccggatttcgtcggcataatttgtacacgactctctcccaagaagattattgagaaatgggtagatttcgccagaagactctgcgagcacaagtacgggaacgctccacgagttcgcattaatggacacgtagctgcaagattcccgtttatcccaatgccgctggactacattctgcctgagctgctcaagaatgccatgcgtgcaaccatggaatcccacctggacactccatacaatgttccagatgttgtgattacaatagcgaataacgatgtggatctcattatcaggataagcgaccgaggaggcggaatcgcccacaaggatttagaccgggttatggactaccattttactacggcagaggcgagtacacaggatccccgtatctcccccctgttcggtcacttggatatgcactccggagctcagagcggaccgatgcacggcttcgggtttggacttcctacttcccgggcttatgctgagtacctgggtggtagtctgcagttgcagtccttacaaggcattggaacagatgtgtacttaagattgcgacatatcgatgggagggaggagagcttccggatctag

SEQ ID NO: 48623 - DNA, 756 bp, Artificial Sequence
  Description of Artificial Sequence: Synthetic coding sequence
atgggagcacgcgctagcggcggacccctggcccgtgcaggcctgctcctactactgctgctgctgctcctcctaggcttactggcccctggcgcacaaggcgcaagaggacggggtggagccgaaaaaaatagctacagaaggacagtaaataccttctcccaatccgtaagctccctgtttggggaagacaacgttagggccgctcagaagtttctggccaggctgactgagagattcgtgctcggggtggatatgtttgtcgagacgctgtggaaggtgtggacagaattgctggacgtgttgggcttggacgttagcaacttaagccaatatttctccccagccagtgtttcaagcagccccgcacgtgctctgctgttagtgggggtcgttttgcttgcctattggtttctcagtctgaccttagggttcacgttttccgtgctgcacgtggttttcggcaggttcttctggattgtccgcgtggtgttgtttagcatgtcatgcgtctatattctccacaagtacgagggtgaaccagaaaacgccgtcctgcctctttgctttgtcgtagccgtgtattttatgacaggacccatgggcttctactggcgctcttctccatctggtccctccaatccctccaaccccagtgtcgaggagaaactcgagcacctggaaaagcaagtccggttgctgaacatcaggctgaatagggtcttggagtctcttgatcggtctaaggacaagtag

SEQ ID NO: 48624 - DNA, 1236 bp, Artificial Sequence
  Description of Artificial Sequence: Synthetic coding sequence
atgacacactggtttcaccggaatcctctgaaagccaccgcaccagtatctttcaattactacggggtggtcactggtcctagcgctagcaaaatctgcaatgatttgcgaagcagccgggctcggcttctggagcttttcactgacctgtcctgcaaccccgaaatgatgaagaacgccgcagatagctatttcagcctgctacagggttttatcaacagtctggatgagagtacccaggaatccaagctaaggtatatccagaatttcaagtggacggatactctccaggggcaagttcccagcgcgcagcaggatgccgtattcgagctgatctcgatgggtttcaacgttgctctctggtacacaaaatacgcttctcgcctggctggcaaggagaatattacagaggatgaggctaaagaagttcataggagtttgaagatagccgcaggcatctttaagcacctcaaggagtcacatctgcccaagctaatcacgcccgctgagaaaggtcgggatttggagagccgacttatcgaagcctatgtgatccagtgccaggctgaggcccaggaagtcaccatagccagggccattgaattgaagcatgctcctggactgatcgcagctcttgcctatgaaacagcaaacttctatcagaaagccgaccatacactttcttctctggaacccgcttatagcgccaagtggcgcaaatatctccatctgaaaatgtgcttctacactgcgtacgcatattgctaccacggtgagacactgctcgccagtgataagtgtggggaggcgatcagaagcctgcaggaggccgagaagctctatgccaaagcagaggctctatgtaaagaatatggcgagactaaggggcctggcccaactgtgaaaccatcgggtcaccttttcttccgaaagcttgggaacctggtgaaaaataccttggaaaaatgtcagcgcgagaacggtttcatctacttccaaaaaatcccaaccgaggctcctcaactggagttaaaggcgaactacggtctggtggagcccatcccctttgagtttcctccaacctctgtgcagtggacacccgaaaccctggccgcttttgacttgaccaaacgcccaaaggacgattctacaaagcccaagcctgaagaggaggtcaaacccgtgaaggaacctgacatcaaaccgcagaaggatactggatgttacatcagctag

SEQ ID NO: 48625 - DNA, 648 bp, Artificial Sequence
  Description of Artificial Sequence: Synthetic coding sequence
atgactcactggtttcacaggaaccccttgaaggctacagccccagtctcctttaactactatggcgtcgtgaccgggccaagcgctagcaagatctgcaatgacctgagatcctcacgagccagactactcgagctgttcacagatttaagttgtaacccggagatgatgaaaaatgctgctgactcttatttttctctcctgcagggattcatcaacagcctcgacgaaagtacccaagaatcgaaactgcgctacatccaaaatttcaaatggaccgatactttacagggtcaggtaccatctgcccaacaggacgctgtgtttgagttaataagcatggggtttaacgtggccctttggtacactaaatacgccagcaggctcgccggtaaggaaaatattacagaggacgaggccaaagaggttcacagatctttgaagatagcagcaggcatattcaaacaccttaaagaatcccacttacctaaacttatcactcctgccgaaaaaggccgtgatcttgagagtcggcttatcgaagcgtatgtgattcagtgccaggccgaggcgcaggaagtcacgatcgcacgcgcaattgagctgaaacacgcaccagggttgatagccgctctggcttatgaatag

SEQ ID NO: 48626 - DNA, 1017 bp, Artificial Sequence
  Description of Artificial Sequence: Synthetic coding sequence
atgacccactggttccaccgcaatccacttaaggcaaccgcccctgtctctttcaactactatggcgtggtgaccggcccttcagcttctaaaatctgcaatgacctaaggtcctcccgagctagactcctagagttgttcactgacctgagttgtaacccagaaatgatgaaaaatgcagccgacagctattttagcctcctccagggctttatcaactcactagacgaaagtacgcaggagtctaagctccgttatatccaaaactttaagtggactgacaccttgcagggtcaagtgccttccgcccagcaggacgctgttttcgaattaattagcatgggatttaacgtggcactctggtacacaaaatacgcttctaggctggccggaaaagagaatatcaccgaagatgaagcgaaggaagtgcacagaagcctgaaaattgctgccggaatattcaagcatctcaaagaatctcacctgccgaaactcataactccagccgaaaaggggcgtgacctcgaatcgcgcctgatcgaagcctatgtcattcagtgccaggccgaagcacaagaggttacaatcgccagggccatagagctgaaacatgcgcctggccttatagctgcccttgcctatgagacagccaacttttatcaaaaggccgaccacaccctcagcagcctggagccagcttattctgccaagtggcgaaagtatctccacctaaaaatgtgtttttacactgcctacgcctactgctaccacggggaaacactgctggcctctgataaatgcggcgaggcaattcgctcccttcaggaggccgaaaagctgtatgccaaggccgaagcgctttgtaaagagtatggtgagacaaaaggccctgggcctaccgtcaaaccgagtgggcaccttttcttccggaaactcggaaacctcgtgaagaacactctggaaaagtgtcagcgggagaacggtttcatccttaaccccaaccagaaaaagaagtag

SEQ ID NO: 48627 - DNA, 1140 bp, Artificial Sequence
  Description of Artificial Sequence: Synthetic coding sequence
atgacccactggtttcacaggaatcctttgaaagccacagcccctgtcagctttaactattatggggtggtgacggggccaagcgctagtaaaatctgcaatgatctgcgttcgtctcgtgccagactcctcgagttgtttacagatcttagctgcaacccggaaatgatgaagaatgctgcggatagctattttagcctcttgcaagggttcataaatagtttggatgagagtactcaggaatctaaactgcgctatattcagaacttcaagtggacagacactcttcaggggcaggtcccatcgattactgaagatgaggccaaggaggttcacagatctctgaagattgcggcaggaattttcaagcacctgaaggaatcccaccttccgaaactcataacccctgcggaaaagggacgggatcttgagtccagattgatcgaagcttacgtcattcagtgccaggcagaagcccaggaggtgactatagcgagagcgatcgagttaaagcacgcccctggacttattgctgccctggcttacgagaccgccaacttctatcagaaggccgaccacactctgtcctcattggaaccggcatatagtgccaaatggcgcaagtacctgcatttaaagatgtgcttctatactgcttacgcctattgttatcatggagaaacccttcttgcctccgacaaatgtggggaggctatcaggtcgctgcaggaggccgagaagctgtacgccaaagccgaggctctatgcaaagagtacggcgagactaagggaccaggcccaacagtgaaaccatctggacacttattttttagaaagctgggcaacctggttaagaacaccctggaaaaatgccagcgagaaaacggattcatctatttccaaaaaattccgaccgaggctccccagctcgagctaaaagccaactacggcctcgtggagccaattcccttcgagtttcccccaacgagcgtccaatggactcccgaaaccttagcagcctttgacctgacaaagaggcctaaggacgatagtacaaagcccaagccagaggaggaggttaagcccgtgaaagaaccggatatcaagccccaaaaggacaccgggtgctacatctcttag

SEQ ID NO: 48628 - DNA, 309 bp, Artificial Sequence
  Description of Artificial Sequence: Synthetic coding sequence
atgtcatccccaccagaaggaaagcttgagacaaaagccggtcacccacctgctgtaaaggctggaggcatgagaatagtccagaaacaccctcacactggagataccaaggaagagaaggataaggatgatcaggagtgggagagcccttcaccaccaaagccgaccgtatttatctctggagtgatagctagaggcgacaaagattttcccccagctgcagcacaggtcgcccaccagaaaccccatgcttccatggataagcacccctcgccgagaacacagcatattcagcaaccacgaaaatag

SEQ ID NO: 48629 - DNA, 2274 bp, Artificial Sequence
  Description of Artificial Sequence: Synthetic coding sequence
ctggcaaaaaagattaccctgaaaaagaagctggaagaagaggaagcagaggtgaagcgtaaggctaccgacgccgcataccaggctcgccaggctgtgaaaacccctccaagacgcctgcctactgtgatggtcagatcccccatagacagtgcctcccccggtggggattacccgctgggagaccttacccctaccacaatggaggaggctacttccggagttactccaggtactttacctagcacaccggtcacctcgtttccaggaataccagacacactgccaccaggaagtgccccattggaggcccctatgaccccagtgaccgacgatagcccacaaaaaaaaatgctcggccaaaaggccacacccccaccatctccactgctgtcagagttgctgaaaaaaggcagtctgctgcccacctccccccgtctagtcaatgagagcgagatggccgtggcgtctgggcacctcaacagcacaggagtgctgctagaggtgggaggagttctgcctatgatccatggtggagagattcaacagacgcccaataccgtcgccgcatctccagctgcttcggagagcgtgtctcaggcaactatcgtcatgatgcccgctctgcctgccccttcgtcagcacccgcagtgtctactaccgagtctgtggctcctgtgtcacaaccggacaattgcgtgccgatggaggcagttggagatcctcataccgtcaccgtcagcatggactcgagtgaaatttccatgatcattaacagcattaaagaggaatgcttccgaagcggagtggcagaagcgcctgtgggttcgaaagccccttctattgacggtaaagaagagctggatctcgctgaaaaaatggacattgcagtgtcctataccggcgaagagctcgacttcgagactgtgggagacattattgccattatcgaggacaaggttgatgatcacccagaagttctggatgttgcagcagtcgaagctgcactgtctttttgcgaggagaatgacgatccacagtctttaccaggtccatgggagcatcctatacagcaggaacgcgacaaacctgttcctctacctgcccctgagatgactgtcaagcaggaaagattggacttcgaagagacagagaacaagggcatccacgagctggtggatattcgggaaccaagcgcagagataaaggtggaacccgctgaaccagaaccggtgatttccggcgcagaaattgtagcaggcgtggttcccgctacttcgatggagccccctgagctgcgatctcaagatctcgacgaggaactgggatcgacagcagccggtgagattgtggaggccgacgtcgctatcggcaagggagatgagaccccccttactaacgtcaagacagaggccagcccggagtctatgctttcaccttcccacggcagcaaccccatcgaggacccgctcgaagcagagactcagcataagttcgagatgtctgactccctaaaggaggagagcgggactatttttggttctcagattaaggatgcaccaggggaggatgaggaggaagatggggtgtcagaagctgcctcattggaggagccaaaagaagaggaccagggcgaagggtacctgtccgaaatggataatgagccacctgtgagcgaaagtgacgatggattctctattcacaacgccactcttcagtcccacacccttgcggattccattcctagctcccccgcttcttcgcagttcagtgtgtgcagtgaagaccaggaggctatccaggcccagaagatttggaagaaggctattatgctggtgtggcgcgcagctgccaatcaccgctacgccaacgtttttctgcaacctgtcactgacgacatcgctcccggatatcatagtattgttcaacggccaatggacttgtcgaccatcaagaagaacatcgagaacggcctgatcagaagcaccgctgagttccagcgagatataatgctgatgtttcagaacgctgttatgtacaattcttccgatcacgatgtttaccacatggctgtggagatgcagagagacgtgctagagcagatccagcagttcttagctacacaactgatcatgcagacctcagaaagtggcatcagtgctaagagcctgcgaggaagggatagcaccagaaaacaagatgcctctgaaaaagacggaggcacgagggggaggagatgtgctatcgaggctgacatgaaaatgaaaaaatag

SEQ ID NO: 48630 - DNA, 3708 bp, Artificial Sequence
  Description of Artificial Sequence: Synthetic coding sequence
atggcgaccggaacaggcaagcataaactgctgtccacaggtcctaccgagccttggtccatccgcgagaagttgtgccttgcctcgtcggttatgcgctctggagatcagaactgggtatctgtgtcacgcgctattaagccttttgccgagcctggaaggcccccagattggttttcacagaagcattgcgcgtcacaatatagcgaactgcttgaaaccactgagacacccaagaggaagaggggggagaagggagaggtggtggagactgtggaggatgtgatcgtccgcaaattgaccgctgaacgggtggaagaactcaaaaaagttatcaaggagacccaggagcgataccggcgactgaagagggacgccgagctcattcaggcaggtcatatggatagcaggttagatgagctttgtaatgatatcgccaccaaaaaaaaactggaagaggaagaggcggaagtcaagagaaaagcaaccgacgctgcctaccaagcgagacaagcagttaagactccgccacgcagattacctacagtgatggtgaggtcgccaatagattcagcgagtccaggcggtgattatccgctgggcgacctgactcccacaaccatggaggaagctacttccggcgtgaacgaaagcgaaatggccgtggcatccggacacctcaattcaaccggggtgctcctggaagtgggaggggtgctgcccatgatacacgggggtgagattcaacagactccaaatacggtagccgcatcccccgctgcatcgggcgctccaaccctgagtcgcctgctggaggccggacccacacagttcaccacaccactagcctcgttcacgacagttgcatccgagcccccagtgaaactagtgccaccccctgtggaaagcgtgagccaggcgactattgtgatgatgcccgctctgcctgcacccagctcagcccctgccgtgtcgaccactgagtcagtagccccagtgtcgcaaccagacaactgtgtccccatggaagctgtgggtgatccgcacaccgtaacagtgagcatggacagctcggagatctccatgatcatcaactctattaaagaggagtgcttcagatccggcgtagcagaagctcccgtggggtctaaggccccttctatcgatggcaaggaggaactggaccttgctgagaaaatggatattgcggtttcttacaccggggaggaactggactttgagaccgtgggtgacatcatcgccataatcgaagacaaggttgacgatcacccagaggtgctggacgtggccgcagtagaggcggcactgagcttctgcgaagaaaacgatgaccctcagtctctgccaggtccttgggaacacccaatacagcaggagcgggacaagcctgtgcccctgcctgctccagaaatgactgtgaagcaggaaaggctcgactttgaagaaaccgaaaataagggcatacacgaattggtcgatatccgcgaacctagcgctgagattaaggtggaacccgcagaacccgagcctgtaatttctggtgctgagattgtggccggtgtcgttcccgcaacatctatggagccacctgaacttcggagccaggatcttgatgaagagctaggatccactgccgctggcgaaatcgtagaggccgacgtagccatcggaaagggcgacgagacaccactgacaaatgtgaagacagaggcgtctcccgaatcaatgctgtctcctagtcacggaagcaatccaattgaggatcccctcgaggccgagacccagcacaagtttgagatgagcgatagcctgaaggaggaatccggaactatctttggaagccagatcaaagatgcaccaggcgaggacgaggaggaggacggcgtctctgaagctgcctcactagaagaaccaaaggaagaggaccagggcgaaggatatctgtccgagatggacaatgaaccgccagtatcggaatccgatgatggatttagcattcacaacgccacattgcagtctcataccctggctgattccattcccagcagccccgcttccagccaattttcagtctgctctgaggatcaggaagccatacaggcccagaaaatctggaagaaggcaattatgctggtgtggcgggcagccgcaaaccaccgttatgcaaatgttttcttgcaaccagtgactgacgacatcgcccctgggtatcatagtatcgttcagcgcccaatggatctttcaacgattaagaagaatattgagaacggtctgatccgaagcactgccgagttccagcgtgatatcatgctgatgtttcaaaatgcagtcatgtacaactcaagtgaccacgacgtctatcatatggctgtcgagatgcaaagagacgtcttggaacaaatacaacagtttcttgctacccagctgatcatgcagactagtgagtccggaattagcgcaaagtcccttcgagggagagacagtactagaaagcaagacgcttcagagaaggacagtgtgccgatgggcagtcccgcatttctactgtccttgttcatgggtcatgaatgggtgtggctagacagtgagcaagatcatccaaacgacagcgagctgtctaacgattgcaggtctttgttttcttcctgggacagctctctggacttggatgtaggcaactggcgcgagacagaggatcctgaagccgaggagctggaggagtcctccccagaaagggaaccaagcgaactactcgttggtgatggcggatcggaagaaagccaggaagctgcacggaaggccagtcatcagaacctattgcatttcctgtctgaagtagcctatctgatggagcccctctgcatttctagcaacgagtctagtgaggggtgctgccctccctctggcacccggcaggaaggaagagaaattaaggcaagcgagggcgaacgcgagctgtgccgagaaacggaagagcttagcgcaaaaggcgacccattggttgccgaaaagccactcggcgagaacgggaaacctgaagtcgccagtgcaccttctgttatttgtaccgtgcagggactgctgactgagagtgaagagggcgaggcccagcaggagtccaaaggtgaggaccagggtgaggtttatgtgagcgagatggaggatcaaccaccttccggcgaatgcgacgacgcttttaacattaaagagactccgctcgtggatacactgtttagccatgccacatcaagcaagctcactgatttgtctcaggacgatccagtgcaagaccacctcctctttaaaaaaacactcctgcctgtgtggaaaatgatagcaagtcataggttttcaagtccctttctcaaacctgtttcggaaaggcaggcacccggatacaaggatgtggtgaagcgtcctatggacctgacatcactgaagaggaacctgagcaaaggtagaatacgcaccatggcgcaattcttacgcgacctcatgctcatgttccagaacgccgtgatgtataatgacagcgaccatcacgtatatcatatggctgtggagatgcggcaagaagtgctagaacagattcaagtgctaaacatatggctcgataagagaaaaggttcctcttctctggagggagagcctgccaatcctgtggatgacggcaaacccgttttctag

SEQ ID NO: 48631 - DNA, 2601 bp, Artificial Sequence
  Description of Artificial Sequence: Synthetic coding sequence
atggctaccggcactggcaaacacaagctgctgagcaccggtccgacagaaccttggagcatccgcgagaagttgtgcttggcttctagtgtgatgagatcgggcgatcagaactgggtgtccgtaagccgcgctattaagccttttgcagaaccagggcgacctcctgactggttttctcagaagcactgcgctagtcaatatagtgaattgcttgagacaaccgagaccccaaagagaaagaggggtgagaaaggggaagtcgttgagaccgtggaagacgtgatagttagaaagttgaccgctgagcgggtcgaggagcttaaaaaggtcattaaggagacccaggagcgctacagaaggcttaagagggatgccgagttgatccaagctggtcacatggacagtcggctcgatgaactctgtaacgacatcgccaccaaaaaaaaactggaggaggaagaggcagaggtaaagagaaaagccacagatgcagcatatcaggcacgccaggctgttaaaacacccccacggagactccctacggtaatggtgagatcacccatagattcggcgagcccaggcggagactaccccttgggcgatctgacgcccaccacaatggaggaagccaccagcggggtgacgccagggacccttccctcgacacccgtgacatcgttccccggaattcctgacactttacctcccggaagtgctccattggaggcccctatgacgccagtgacagatgactctccacagaagaagatgcttggccagaaagcaacgcctccaccctcccctctgctgtccgaattgctgaagaaaggctcactgctgcccacctcccctagactggtcaacgagagtgagatggctgtggctagcggccatctgaacagtactggagttttacttgaggtcgggggtgtgttgccaatgatccatgggggagagattcaacagactcctaacactgtggcagctagtcctgcagcaagcgtgtcccaaccagacaactgtgtgccaatggaggcggtcggagatccacacactgtcacagtcagtatggacagttctgaaatctccatgataatcaatagcatcaaggaagagtgctttagatccggcgtagccgaagctccagtggggtcaaaagccccaagtatcgatggtaaggaagagctggacctggctgaaaaaatggacattgccgtgagttacactggagaagagctcgatttcgaaacagtgggagacataattgccataatcgaggataaggtcgatgaccatccggaagtacttgatgtagcagcggtggaagcagcactctccttttgcgaagaaaatgatgacccacaatctctgccaggaccttgggagcacccaatacagcaggaacgcgataaaccagttcctcttcccgctcctgagatgacggttaagcaggagagactggacttcgaagaaaccgaaaataagggaattcacgaacttgtggacatccgcgagccaagtgcagagatcaaggtcgagcctgcagagccagagcctgtcatatctggcgctgagatagtcgctggtgtcgtgcccgctacatccatggaacctccagagctgaggtctcaggatctggatgaagaactgggaagcacggctgccggtgagatcgtggaagctgatgttgccattggtaagggagatgagacccccctaactaacgttaagaccgaggccagtcctgagtccatgctctccccctcacatggcagtaaccccattgaggacccactggaggctgaaacccagcataagttcgaaatgtcagactctctgaaggaagaatctggtaccatcttcggtagccagataaaggacgcgcctggagaggatgaagaagaagatggggtctctgaagccgcaagcctggaggagcctaaggaggaggaccaaggcgagggctacctcagtgaaatggataatgaaccgcctgtatctgaaagtgacgacgggttcagcatccacaatgccaccctccagagtcacacactcgcggactcaatcccaagtagtcctgcctcttcccagttctcggtatgctcggaggatcaggaagccatacaggcgcagaaaatctggaaaaaagctataatgctcgtgtggagggccgctgctaatcatcgttacgcaaacgttttcctgcagcctgttacagacgatattgcccctggctatcacagtatcgtacagagacctatggatttgagcacgataaaaaaaaatattgaaaacgggctcataaggagcacggcagagtttcagcgagatatcatgcttatgtttcagaatgctgtgatgtacaatagcagtgaccacgacgtttatcacatggcagttgagatgcaaagagatgttctcgagcagatccagcagttcctcgcaacgcagctgatcatgcagacaagtgaatccggaatttccgcaaagagcttgcggggtcgtgattcgactcgcaagcaagatgcatccgagaaggatggcggtacgcgaggacgtcgctgtgccattgaagcagacatgaaaatgaaaaaatag

SEQ ID NO: 48632 - DNA, 2586 bp, Artificial Sequence
  Description of Artificial Sequence: Synthetic coding sequence
gggaaacacaaactgctgtccacaggcccaaccgaaccctggtctatacgcgagaagctgtgcctagctagctcagtgatgagaagtggagaccaaaattgggtttcggtatctagagctatcaaaccttttgccgaaccagggagacctcctgattggtttagccagaaacactgtgcgtctcagtactcagagctcttggagactaccgaaactcccaaaagaaagagaggcgagaagggggaagtcgtggaaaccgtagaggatgtcatagtccggaaattaactgccgagagagttgaggaactgaagaaagtgatcaaggaaacccaggaaaggtacaggaggctgaaaagggatgcagaacttattcaggcagggcatatggattctaggcttgatgagttgtgcaatgacattgctacaaagaagaagctcgaggaagaagaagcagaggtcaagcgaaaggctacagacgccgcataccaagctaggcaagcggtcaagactccccctcgaagactaccaactgtcatggtcagaagcccgattgattcagcatcgcctggaggcgattacccgctcggagacctcacccctacaacaatggaagaggcaacctctggcgttacaccgggtactttaccctcaacccccgttacatctttcccgggaattcctgatacactgcctccagggtcagcccctcttgaggccccaatgaccccagtgactgatgactcccctcagaagaaaatgctgggccagaaagccacaccgcctccaagtcctttactgtccgagctgctgaaaaaaggcagcctactgcctaccagcccccgtctggttaacgagtcagaaatggcggtagcatccggccatttaaacagcaccggagtgctcttggaggtgggtggggtcctgcccatgatccatggcggagaaatccagcaaacgccgaataccgtggctgcaagcccagccgcttccgtgagtcagcctgacaactgtgtgccgatggaggctgtgggagatcctcataccgtgacggtctcaatggattctagcgaaatctctatgatcatcaatagcataaaagaagagtgttttcgatccggtgtggctgaagccccagtgggcagcaaagccccttctatcgacggcaaagaggagttggacttagccgagaaaatggacattgctgtcagttacaccggggaggaattagacttcgaaaccgtaggcgatatcatcgccatcatcgaagataaggtagacgaccatcccgaggtgcttgacgttgcggctgtcgaggcagccttgtccttctgcgaagaaaacgatgatccacagagcctgcctgggccttgggaacatccaattcaacaagagcgagataagcctgtgccactcccagctcccgagatgaccgtgaaacaagagcgcttagattttgaggaaacagagaataaaggtatccacgagctggtggatattagagagccctctgcagagatcaaggttgaacctgccgaaccagagccagtcatatctggcgctgagatcgtggctggggttgtgccagccacgtcgatggagccccctgaactgcgcagtcaggacctagacgaggaactcggaagtaccgccgctggcgagatcgtggaggccgacgtggccattggtaagggcgacgaaacaccgctgacgaatgtgaagaccgaggcgtctcccgagagtatgctgtccccctctcacgggagtaatcctatcgaggaccccctggaagccgagactcagcataaattcgaaatgagtgacagccttaaagaggaaagcgggaccatctttggcagccagattaaggatgcacctggcgaagacgaggaagaagatggtgtgtctgaggctgcaagcctagaggagcctaaagaggaagaccagggggagggttacttatccgagatggacaatgagccaccagtgagcgagtcggatgacgggttctctatacacaacgcaaccctgcagtcccacacactagcggacagcatccctagttcgccagcctcatctcagtttagcgtatgcagcgaggatcaggaagccattcaggcccagaagatttggaaaaaggcgatcatgctcgtgtggagggccgctgccaatcacaggtacgccaatgtgttcctccaacctgtgacggatgatatcgcaccgggttatcatagcattgtgcaacgtcctatggatctttctactataaagaagaatatcgagaacgggctaatccgttccaccgcagaattccagcgagatattatgttgatgtttcagaatgctgtcatgtacaactcttccgatcacgatgtgtatcatatggcggtcgagatgcagcgggatgtgctggaacagatccagcagttcctcgccacccagctcatcatgcagaccagcgagtcaggaatttcagctaagtccctgagagggagagatagcaccagaaaacaggatgcttccgaaaaagacggtggcacaaggggcaggagatgcgctatcgaagccgatatgaagatgaagaagtag

SEQ ID NO: 48633 - DNA, 2679 bp, Artificial Sequence
  Description of Artificial Sequence: Synthetic coding sequence
ggaaagcataagctgctgtcaaccggtcccacagagccttggtcaattcgggagaagctgtgcctggcctcgtccgtaatgagaagtggtgaccagaattgggtgtcagtctcaagagctatcaagcccttcgcagagcccggaagacctccagactggttctcacaaaagcattgtgcttcacagtattccgaattgctagagaccacagagacccccaagcggaagcgcggagagaagggagaggtggttgaaaccgttgaggatgtaatcgtacggaagctgactgcagagcgcgtagaggaattaaagaaggtgataaaggagacacaggagcgatataggcgattgaaaagggatgcagagctgatccaggccggacacatggactctaggctagacgagctatgcaacgatattgcgacgaaaaaaaaactggaagaagaagaggctgaggtgaagcgtaaagcaactgatgctgcttaccaggccaggcaagcggtaaaaacgccccctcggcgactcccaaccgtgatggtcagaagccccatagattctgcgagtcccggaggggactatccactgggagacctaacacctacgaccatggaggaagccacaagcggcgtgacccccggaacccttcccagcactcccgtgacctcattccctgggatccccgatactctgcctcccggatctgctcctctggaagcccctatgaccccggtcactgatgactccccgcaaaaaaagatgctcggccagaaggctactcctcccccatccccattactgagtgaactcctcaagaagggctccctgctgccaacctctcctcgcctggtcaacgaaagcgagatggcagttgcctctgggcacctcaactccactggcgttctgctggaggtaggtggcgtactccccatgattcatgggggagagattcagcagaccccgaacactgtcgccgcttcacctgcggcaagtgaaagcgtgagtcaggcaacaatcgtgatgatgccagctttgccggctcctagctcagcaccagcagtgtctacaacggagagcgtggctccagtgtctcaaccagacaactgcgttcctatggaagctgtgggcgacccgcacactgtcaccgtctcaatggattcaagtgagattagcatgattataaatagcattaaagaggagtgcttccgctctggcgtggcagaggccccagttggatcaaaagccccatccatcgatgggaaggaagagttggatttggcggaaaagatggatatagcagttagctataccggggaggagctggactttgagaccgtgggcgacatcatagccattattgaggataaggtggacgatcaccctgaagtactggacgtcgccgcagtagaagctgccctgtcattttgcgaagagaatgacgacccccagtctctgcctggaccctgggaacacccaattcagcaggagcgagataagccggtcccccttcccgcacctgaaatgaccgtcaagcaagaaaggctggattttgaagagactgaaaataaaggtattcacgagctagtggatatacgagaaccctcggcggagataaaggtggaaccagctgagcctgagccagtgatttccggagcagagatagtcgccggtgttgtgcccgctacctctatggagcccccagaactaaggtcccaggacctcgatgaagaactgggtagtaccgctgcgggagaaatcgtggaagcagatgtggccattggcaagggtgatgagactccattgaccaacgtgaaaactgaagccagccctgaatcgatgctgagcccctcccacggttcgaatcccattgaggatcccctggaggcagaaacacaacacaagtttgagatgtccgactccctaaaagaggaatccggaactatatttggtagccaaattaaagacgcgccaggggaggatgaagaggaggatggcgtctcggaggcagcctcactcgaggagccaaaggaagaggatcaaggggaggggtacctgtccgaaatggacaacgagcccccagtgtcggagagtgatgatgggttttccattcataacgccacacttcaaagtcacactctcgccgactctattcccagttctcctgcctcgtcccagtttagcgtgtgtagtgaggatcaagaggctatacaggctcaaaaaatctggaagaaagctataatgcttgtctggcgcgctgccgctaatcatcgatacgctaatgtgttcttacagcccgttaccgacgacattgcccctggctaccattcaattgtgcagcgcccaatggatctgagtacgattaagaaaaatatcgaaaatggcctaatccggagcacagccgaattccagcgggacatcatgctgatgttccaaaacgccgttatgtataactcgagcgatcatgatgtctatcacatggccgtcgaaatgcaacgggacgttctggaacaaatccaacagtttctcgctacccaactcatcatgcaaacatcagagagcgggatcagcgccaaatccttgcgagggagagactccacccgcaaacaggacgcatccgagaaagacggcggaactcggggtcggagatgcgccatagaggctgacatgaagatgaaaaaatag

SEQ ID NO: 48634 - DNA, 2514 bp, Artificial Sequence
  Description of Artificial Sequence: Synthetic coding sequence
atggttcatccccgagaggcaatgttctctatcttctgccacgagaagtggcgctctaaactgcattgcgcatcccaatactcagaactactggagaccacggagactcctaagaggaagaggggggaaaagggcgaagtggtggaaacagttgaggatgttatagtcaggaagctgaccgccgaacgagtggaggaactcaagaaggtgatcaaggaaacacaggaacgctaccggcgactgaagcgcgatgctgagttgattcaggctggccacatggattcacggctggacgagctatgcaacgatatcgctactaaaaagaagttggaggaggaagaagcggaggtgaaacgtaaggcgacagatgcggcatatcaagccagacaggccgtgaagactcctccacgtcggctgcccaccgtcatggtcaggtctcccatcgattcagcttctcctggcggagactaccccttaggggacctgacccccactaccatggaggaggcaactagcggcgttaatgagtccgagatggctgtcgcgagcggtcatctcaattctacgggagtgctgttagaggttggcggagtactgccaatgatacatggcggagaaatccagcaaacgccaaataccgtggccgcatcccccgcagctagtggcgctcccaccctaagtcgcttattggaggcgggtccgacacagtttacaactcctcttgcttcttttacgacagttgcttcggagccaccagtgaaactcgttcctccaccagttgaatctgtgtcgcaagccaccatagtaatgatgcccgcactacctgccccaagctctgcacctgccgtcagcactactgagtcagtggccccagtaagccagcccgataattgtgtgcccatggaggctgtaggagaccctcacactgtgacagtctctatggatagcagcgagatcagcatgatcatcaattccattaaggaggaatgctttcgaagtggagtggctgaggcgccagtcggttcaaaggccccatctatcgacggcaaagaagaattggacctggctgaaaagatggatatcgcagtttcttatacaggcgaagagcttgatttcgaaaccgtgggggacatcatcgctatcatcgaagacaaggtggatgatcaccctgaagtgctggatgtggctgccgttgaagcggctcttagcttctgcgaggagaatgatgaccctcaaagcttgccagggccttgggagcatccaattcagcaagagagggacaagcctgttccattgcctgctccagaaatgaccgtcaagcaggagcgccttgatttcgaggaaaccgaaaataaaggtattcatgagttggtcgacattagggagccgtcagctgagataaaagttgagcctgccgaacccgaaccagtgatttccggcgcagagatagtggctggcgttgtgccagctaccagcatggagccacccgaactgagatctcaggatttggacgaggaactgggatccaccgcagctggtgagatagtggaggccgatgttgccatcggcaagggagatgagacacccctcacgaatgtaaagacggaagcttcacccgaatccatgctgtcaccaagccatggatccaaccccattgaggatcccttagaggccgagacacaacataagttcgaaatgagcgactcccttaaggaggagtcaggtaccatcttcgggtcccaaattaaagatgcgcctggcgaggacgaagaagaggatggtgtctcagaggccgcaagtctggaagagccaaaagaagaagaccagggggaggggtacctgtctgaaatggacaatgagcctcccgtctccgagtctgacgacggcttttctatccacaatgcaactttgcagtcccacacgttggcagattcaataccctcaagccccgcatcttctcagttctctgtgtgcagcgaggatcaggaggccattcaggcccagaagatatggaagaaagccattatgctagtctggcgcgctgctgcgaatcatcgatacgcaaacgttttcctccagccagtcaccgacgacatcgcgccaggatatcactcaatcgtccagcgccctatggatctaagcactatcaaaaagaacatcgagaacgggctgataagatccactgccgaattccagcgggatatcatgttgatgtttcagaatgcggtgatgtataattcgagcgatcatgacgtgtatcacatggccgtcgagatgcagcgcgatgtgcttgaacagatccagcaatttttggccacccagcttattatgcagacgtctgaatctggtatctctgccaagagcctccggggacgcgactctacaaggaagcaggatgctagcgagaaggattcggtccccatgggaagccctgccttcttactgtccctgttcgacgggggaacaagagggcgacgctgcgcaatcgaggcggacatgaaaatgaagaagtag

SEQ ID NO: 48635 - DNA, 3315 bp, Artificial Sequence
  Description of Artificial Sequence: Synthetic coding sequence
atggcacggagaggcaaaaagccagtggtaagaaccctggaagatctgactctggattctggctacggtggggctgcggatagtgtgcgctctagcaatttatctttgtgctgcagcgactcccacccggcaagcccatacggcggttcttgttggcctccattagcagattcgatgcatagtcggcataactctttcgacacagttaacacagccctggtcgaagactctgagggcctggactgtgccggtcagcactgcagcagactgttgcctgacttggacgaggttccctggacactccaggagctggaggctctacttcttcggtctcgggacccaagggccggacctgctgtgcccggtggcctgcctaaggacgccttagccaaactcagcacgctggtcagccgggctctggttcgcattgccaaggaggctcaaagattgagcctccgatttgctaaatgcaccaagtatgaaattcaatccgctatggaaattgtgctatcttggggactggcagctcattgcacggccgcagccttagcagccctgagcttgtataacatgtcatccgccggaggggaccgactggggcgagggaagtccgcccgatgtggactcactttctctgtggggagggtgtatcgctggatggtcgattcaagggtagccttgcgcattcatgagcatgcggctatctacctgaccgcttgtatggagtcattattccgggacatttactccagggtcgtcgccagcggcgtccctcggtcttgcagcggaccagggtccggcagtggcagcggccctgggccatccagtggccctggagctgcgccagccgctgataaagaaagagaggctccgggtgggggagccgcaagtggcggagcttgctcagcagctagttcagcctcgggcggtagctcatgttgtgcaccacccgcagccgctgcggctgccgtgccacccgcagcagccgcaaaccaccatcatcatcatcaccacgctcttcacgaggcgcctaaatttactgtagagaccctggagcatacagttaataatgactctgaaatatggggcctgcttcaaccctatcaacatcttatttgcggcaagaacgcttcgggcgtgttgtgcctcccagactccctcaatctgcatcgggacccccagcgctccaacaaacccggtgaacttcctatgttttcccaatcagagttaaggacaatcgagcaaagcctgctggcgacacgtgttggcagcatcgctgagttgtctgaccttgtgtcccgggctatgcaccatcttcagcctctcaacgcaaagcaccatgggaacggcactcctttacaccacaagcagggggctctgtattgggagccagaagcactatacactttatgttactttatgcattgcccacagatggagtgggaaaatccaaacgtcgagccttctaaggtgaacctccaagtggaaaggccatttttggtgctcccccctctaatggagtggatcagggtggccgtggcccatgccggtcatcgtcggagcttttccatggatagcgacgatgttagacaggcagcacgactcttattaccaggggtggactgcgaaccaaggcagctgagagcagacgactgtttctgcgcttcgcgaaaactagatgccgtggcaatagaggccaaattcaaacaagatttgggcttccggatgctgaattgcggcaggaccgacctggtaaaacaggcggtgtccctgttgggacctgacgggatcaacactatgtccgaacagggaatgaccccactgatgtacgcctgtgtacgaggcgatgaagccatggtccaaatgctcttggacgctggtgccgacctgaatgtcgaggtggtcagtacgccccataaatacccctctgtgcatccagagaccaggcattggacagccctgactttcgctgtgcttcacgggcacattccggtggttcagctgctgttagacgccggagctaaagtggaaggaagtgttgagcacggggaagagaattattctgagacacccttgcagctggccgcagctgtgggtaatttcgaactcgtgagcctgctcctggaaaggggagccgaccccctgatcggtactatgtaccggaatggcataagcacaacaccccagggcgacatgaactcgttctcacaggccgcagcgcatggacaccggaacgtgttccgcaagctgctggcccaacccgaaaaggagaagtctgacatcctcagtctagaagaaatccttgcagaaggcactgacctagcagaaactgcccctccccctttatgcgcatccaggaatagtaaagcaaaactgagggctcttagagaggctatgtatcatagtgccgagcatggatatgttgatgtaaccatcgacattcgttcaataggagtcccctggaccctgcatacttggctcgaatccttgaggatagctttccaacaacacaggcgtccactgattcagtgtttacttaaggaattcaagactatccaggaggaggagtacaccgaggagctcgtgactcaaggactccctttgatgttcgaaatcttgaaagcctcgaagaacgaagtgatttcacagcagctctgcgttatctttacacattgttacggaccatacccgataccaaagctgaccgagattaagcgcaaacagacctctcgtctggaccctcactttctgaacaacaaggagatgagtgacgtgactttcctggtggaggggaggcccttttacgcacacaaagtgctgctgtttacagcaagtcccaggttcaaagccctcttgtcaagcaagcctacaaatgacggtacctgcattgaaattgggtacgtcaaatactcgatttttcagctcgtaatgcagtatttatattatggcggacccgaatccctccttataaagaacaacgaaataatggaacttttgtcggccgctaaattctttcagttggaagccctgcagaggcattgcgagattatatgcgccaaaagcatcaacactgacaactgcgtggatatctacaaccacgccaagttccttggcgtgaccgagctttccgcctattgcgagggatattttctgaagaacatgatggtgctaatcgaaaatgaggcctttaaacagttgctctacgataagaacggagagggtacgggccaggatgtcctgcaggacctccagagaacactggccatcaggatacagtccatacatttgtcatcctcgaagggtagcgttgtctag

SEQ ID NO: 48636 - DNA, 1926 bp, Artificial Sequence
  Description of Artificial Sequence: Synthetic coding sequence
atgagaaagttgcgcccaaaggattcacgagagcctgcccctggtagccccgtccgctcaggatgcctacagcgcctgtctcactactccgggatccagcgcccatttcttgttctgccccctctgatggagtggattcgtgtggccgtggcccacgccggtcatcgtagaagcttctccatggattccgatgacgtgcgccaggccgctagactcctgctgcccggagtggactgcgaacccaggcaactcagggcggacgactgtttttgcgcctcccgcaaactggacgcagtggccatagaagctaagttcaaacaggacctaggatttcgaatgctgaactgtggtagaaccgatctcgtaaagcaagcggtgagcctcctagggcctgatggcattaataccatgtcggagcaagggatgactcccctgatgtacgcttgtgtgcggggagacgaagccatggtccaaatgcttctggacgctggggcagatctgaatgtggaggtggtcagcacaccccacaagtacccgtctgtgcaccccgaaactcggcattggactgcactcacctttgccgtcctgcatgggcatatccctgtcgtccagctgctcttagatgccggagcaaaagtcgaagggtccgtggaacatggtgaagaaaactactctgaaactccactgcagctggccgctgctgttgggaattttgaactggtgtcattgctgctggagagaggtgctgaccccctcatcggaacgatgtatcgtaatgggatcagcaccacaccacagggcgacatgaactcgttctctcaagccgcagcccacggccaccgaaacgtctttaggaaactgctcgcacagcctgagaaggaaaaatctgacattctcagcctggaagaaatcctggcggaggggaccgacctggccgagaccgctccccctcccttgtgcgcatcaagaaactccaaagccaagctgagagctttgagagaagcaatgtaccattccgcagagcatggctacgtggacgtcacgattgatatcagatctataggcgtcccttggaccctgcacacctggctagagagcctgagaattgcattccagcagcaccgcaggcccctgatccaatgtttgctgaaggagttcaaaacaatacaggaggaggagtacacagaagaactggtgacccaagggctgcccctcatgttcgaaatcttaaaggcatctaaaaatgaggtgatctctcagcagctgtgcgtgatctttacccattgttatggaccttatcctattcccaagctgaccgaaattaagcggaagcaaacctcaaggctggacccccactttctgaataataaagaaatgtccgacgtgacgttcttggtggaagggaggcctttttacgcccacaaggttttactgttcacggcctcccctcggttcaaggcgctgctgtctagcaagcccactaacgacgggacctgtattgagattggatacgtgaagtacagcatcttccagctcgtcatgcagtacttgtattacggcggacccgagtcactgctgataaaaaacaacgagattatggagctcttgtcagctgcaaagttcttccagctcgaggctttgcagcgacattgtgaaatcatctgcgcgaagtccattaatacggacaactgcgtcgacatttacaaccacgccaagtttctgggcgtgacagagctgagtgcttattgtgagggttattttttaaaaaacatgatggtgctgatagagaacgaggcctttaagcagctcctgtacgacaaaaacggcgagggaactggccaggatgtattgcaggatctgcagcgtactctggccattcgcattcagtccatccatctgtcctcgtctaaggggtcagtggtctag

SEQ ID NO: 48637 - DNA, 2958 bp, Artificial Sequence
  Description of Artificial Sequence: Synthetic coding sequence
atggcgcgacgtggtaaaaaaccagtggtgaggacgctggaagacctgaccctggactccggatacgggggtgctgctgatagtgtacggagctcaaacctcagtctgtgctgttccgactcccatcccgcatcaccttatggcggttcctgctggcccccactggccgactctatgcactcccggcataactcctttgacacagtgaatactgcgctcgtagaggattcggaggggctcgactgtgccggacagcattgtagccgcttgcttcccgatctagacgaggtcccatggactctgcaggagctggaggccctcctgttgcggagccgggatcctcgcgctggccctgccgtacccggagggctgccaaaggacgccctcgcaaagctttcgacgcttgtgagcagggcgctagttcgcatagccaaggaggcccagcgccttagcttgagatttgccaagtgtactaagtacgaaattcagagtgctatggaaattgtgttaagttggggcttggccgcacattgcaccgctgctgcgctcgctgccttgtccctgtacaatatgtcatccgccggtggcgatagattgggtcggggaaagtctgccagatgtgggcttacatttagtgtaggaagagtctaccgttggatggtggatagtcgcgtcgccctgagaatccatgagcacgcagcaatctatctaaccgcctgtatggaaagtctgttccgtgacatatatagtcgggtcgtggcctctggggtccccaggagttgctcagggccaggatccggcagtggctcaggtcccggaccaagttcaggcccaggcgctgcacctgccgctgacaaggaaagggaggcccctggaggtggcgctgcttccggcggtgcctgtagcgctgcttccagcgcgagcggtggcagttcttgttgtgctccgccagccgctgccgctgccgcagttcccccagcagccgcagctaaccaccatcaccaccatcaccacgcacttcatgaagcaccaaagttcacagtcgagaccctggagcatacagtgaacaatgactccgagatttgggggttgttacaaccttatcagcacttgatctgcggtaaaaacgcgagcggtgttctctgtctacccgacagtttaaaccttcacagggatccgcagcggtcaaacaagccaggagaattaccaatgttttctcagagtgagctgaggaccatcgaacaaagtttattagctacacgcgttggcagcatcgctgaactctctgatctggtgtcccgagctatgcaccacctacagcccctcaatgcgaagcatcacggtaacggcacccccctccatcacaagcagggcgcattatactgggaacctgaggcattatataccctgtgttattttatgcactgcccccagatggaatgggagaacccaaatgtcgagcctagcaaggttaatctccaggtggaacggccatttctggtcctgccacccctcatggaatggatacgggtcgctgttgctcatgccggacatagacggtccttttctatggattcagacgacgttcgtcaggccgctcgcctcctgcttcctggcgttgactgtgagccgcgacaacttagagcagacgattgtttttgcgccagtcgcaaactcgacgcggtggccatagaagccaaattcaaacaagacctgggattcagaatgctgaactgtggcagaaccgacctcgtgaagcaggcagtgtcattgttggggccagatgggatcaatacaatgtctgagcaaggtatgaccccccttatgtacgcttgtgtgcgcggagacgaggcgatggtgcagatgctgttagacgcgggtgcggatttgaacgtggaggtggtgagtactccacataagtatccatcggtgcaccccgaaactaggcattggacggctctcacctttgcagtattacacggacatatccccgtggtacagctgcttctagatgccggtgctaaggtggagggtagcgtggaacacggcgaagaaaactactccgagacccccctgcagctggcagctgccgttggtgtaccctggactctacacacatggctggagagtctgagaattgcctttcagcagcataggagacctcttatccaatgtctactgaaggaattcaagaccatccaagaagaggaatatacagaagaacttgtcacccaggggctgccactgatgtttgagattctcaaggcatctaagaacgaggtgatctctcagcagctgtgtgtgatttttacgcactgttacggtccttatcctatcccgaaactgactgaaattaaacgtaaacagaccagtagactcgacccacattttctcaacaacaaggaaatgtccgacgtcaccttcttggttgaaggaagacccttctatgcgcacaaggtgctgctgtttacagcgagtcctcgctttaaggcactgttgtcatccaaaccaactaacgacgggacctgcattgaaatcggctacgtcaaatacagtatttttcagctcgtgatgcagtatttgtattatggcggaccagagtcccttttgattaaaaataacgagattatggagcttcttagtgcagcaaaattttttcagcttgaggccctgcagcggcattgcgagattatttgcgccaaatccattaacaccgataactgcgtggatatctataaccacgccaagtttctgggggtaactgagctaagcgcatactgtgagggatatttcctgaagaacatgatggtcctcatcgagaatgaggctttcaagcaactgctctacgataagaatggggagggaaccgggcaggatgtgctccaagacttgcagaggacgctggcaatcaggatccagagtatacacctgagcagctctaagggatcagtcgtgtag

SEQ ID NO: 48638 - DNA, 3024 bp, Artificial Sequence
  Description of Artificial Sequence: Synthetic coding sequence
atggcacggcgaggcaagaaacctgttgtccgcacgttggaggacctgacacttgattctggatatggtggggcagctgactccgtgaggtcatccaacctgtctttgtgttgctcagattcccaccccgcttcgccctatggtggctcttgttggccccctttagcagattccatgcactccaggcataactcattcgatacagtgaataccgctctcgtggaagattcagaaggcctggattgcgctggccagcactgttcccggttactgcccgatcttgacgaggtgccctggacactgcaggagctggaggccctactactcagatctagagaccctagggcgggaccagcagtccccggaggactccctaaggatgccctggccaagctgtccaccctggtctctagagccctcgtgcgcatcgctaaagaggcccagagactgtcactcagattcgcaaagtgtactaaatacgagatacagtctgcgatggagatagttttgtcttggggtcttgctgctcattgcacagccgctgctctggccgctttgtccttgtataacatgtcctccgctggcggagacaggctcggcagaggaaagtcagcaagatgtgggctgacgttttctgtggggagggtttacagatggatggtggattcaagggtggccctccgcatccacgagcatgcagctatttatctaacagcctgcatggagtctctcttccgggatatttacagtcgggttgtggctagcggcgtaccacgaagctgttccgggcctggctccggatccggttccggaccgggaccgagcagtggacctggcgctgctccagccgcagacaaagagagggaggctccaggaggcggagccgcttcaggaggggcatgctctgctgcctctagtgcctcagggggaagctcttgctgcgcacctccagcagcagccgctgcagcagtgccgcctgccgcagctgctaaccatcaccaccatcaccatcatgccctgcatgaagctccaaaattcacagttgaaactcttgagcatacggtcaataatgattccgagatttggggactcctgcagccatatcagcatctgatctgtgggaagaacgcttctggggtgctttgtctacctgattcactcaatctccaccgggatcctcaacgatctaataagcccggagagttgccaatgttctcccagagcgaactgcggactattgagcaatctttgctcgcgacacgtgtgggctccatcgctgagttgtccgatctagtctctcgcgctatgcaccacctgcaaccactcaacgccaaacatcacggcaacggcacgcctctacaccacaagcaaggcgctttgtattgggagccggaagcattatacactctgtgttatttcatgcactgcccacagatggagtgggagaacccaaacgtcgaaccctcgaaggttaatctgcaggtggaacgcccatttctggttctgcctcctctgatggaatggatcagagtagcagtggcgcatgcagggcatagaaggagcttttcaatggattctgacgacgtaaggcaggctgctcgcctcttgctgccaggtgtggactgtgaacctcgtcagctgcgggctgatgattgtttctgcgccagtcggaaattggatgccgtggcaatcgaggcaaaattcaagcaggacctgggtttcaggatgctcaattgcgggaggacggacctggtgaagcaggctgtgtctctccttggacccgatggtatcaacacgatgagtgaacaggggatgaccccattgatgtatgcttgtgtaaggggtgatgaggctatggtgcaaatgctccttgatgccggagcagatcttaatgtggaggtggtcagtacaccacataagtatccatccgtccatcccgagactcgccactggacagctctcacttttgcagtgctgcacggacatattccggtcgtacagctgctcctggatgcaggcgcaaaagttgagggttcggttgagcatggcgaagaaaactacagcgaaacgcccctccaactggcagcagccgtgggtaatttcgagctggtgtccctcctgctggaacggggagctgaccctctgatcggcaccatgtatcgcaacggcatctctactaccccccagggagatatgaatagttttagccaggccgctgctcatggacatagaaatgtgttcagaaagctacttgctcagccagaaaaggagaagtctgacatcctgtcactggaggaaatcttggcggaaggaacagatctcgcagagacagcgcctccacccctgtgtgcttccagaaattcaaaggccaaactgagggctctgcgcgaggccatgtatcatagtgccgaacacggatatgttgacgtgaccatcgatattcggagcataggggtaccatggacacttcacacttggctggaaagtctgcgtatcgcctttcagcagcaccgtcgcccacttattcagtgcttgcttaaggagtttaaaactattcaggaggaggagtacaccgaggaactggtcacgcagggccttcctctaatgttcgagatactgaaggccagcaagaacgaggtgatctcccagcagctgtgcgtgatattcacccactgctacggcccttaccccattcccaaattaaccgagataaaaaggaaacaaacatccaggctggatccccatttcctgaacaacaaggaaatgtctgacgtgaccttcctggttgaaggccgtccattctacgcccacaaggtgcttctttttaccgcatctccaaggttcaaagccctactgtccagcaagcctaccaatgacggcacctgcattgagatcggttacgtcaagtactccatcttccagctcgtgatgcagtacctctattacggtggaccagagtctctgctcatcaagaacaatgaaattatggaggtgagagatcccctctggtgctggttgagctag

SEQ ID NO: 48639 - DNA, 552 bp, Artificial Sequence
  Description of Artificial Sequence: Synthetic coding sequence
atgtcggacgttactttcctggtagaagggcgaccattctacgcccacaaagtgttactgtttaccgcaagcccgcgatttaaggcattgctgagtagcaaacccacaaacgacggcacctgcatcgagataggttacgtgaaatactcgattttccagcttgttatgcagtacctgtattatggcggacctgagtcactccttattaagaataacgagatcatggaactacttagcgcagcaaaattctttcagttagaagcactgcaacgacactgcgaaattatttgcgcaaagtccataaacactgataactgtgtggatatctataatcatgctaaatttcttggtgttacagagttgtccgcgtattgtgaagggtattttttaaagaacatgatggtgctcatagaaaatgaggcgtttaagcagctgctgtatgataaaaacggagagggaactggtcaggatgtgttgcaggacctccaacgcaccttggcgattcggattcagagtatccacctgtcctcaagcaaggggtccgtggtctag

SEQ ID NO: 48640 - DNA, 987 bp, Artificial Sequence
  Description of Artificial Sequence: Synthetic coding sequence
atgtgccatcagcagctcgtgatatcatggttctcactggtgttcttggcttcccccctagttgcaatttgggaactgaaaaaggatgtgtatgtggtggaactagattggtaccctgacgcgcctggcgaaatggtggtgcttacgtgcgatacccctgaggaggatgggataacgtggaccctcgaccagagcagtgaggtgctcggtagtgggaaaactctgacaatccaggtaaaggagtttggcgacgctgggcaatacacatgccataagggtggggaggtgctttcgcattctttgttactgctgcacaagaaagaggatggaatctggagtacggatatactgaaggatcaaaaagagcccaaaaacaaaaccttccttaggtgcgaggctaaaaattatagcggacgcttcacttgttggtggttgacgacaatctcaaccgacctgacctttagcgttaagtcatctcgaggcagcagtgatcctcagggagtaacctgcggggctgctacgctgtcagccgagcgagtgcgaggcgataacaaagagtacgaatattccgtcgagtgccaggaggactctgcatgtcccgctgccgaggagtcattgcctatcgaggtgatggtagatgccgtccacaaattaaaatacgagaactatacgtccagcttttttatacgcgatatcatcaagcctgaccctccaaaaaatcttcagctaaagcccctgaagaactcacgccaagtagaagtttcatgggagtatcccgatacatggagcacaccccacagttatttttccctgacattttgcgtgcaagtgcagggaaagagcaagcgcgaaaaaaaagacagggtctttacggacaagacttccgctaccgtgatatgccgcaagaacgcaagtatatctgttagagcacaagaccgatactactcctcatcctggtccgagtgggcgtcagtcccctgttcgtag

SEQ ID NO: 48641 - DNA, 1503 bp, Artificial Sequence
  Description of Artificial Sequence: Synthetic coding sequence
atggctttgatgctgagcttggttctcagtctcttgaaactaggatcagggcagtggcaagttttcggaccagacaagccagtgcaagccctagttggggaagacgctgcgtttagctgcttcctgtcacctaaaaccaacgccgaagcaatggaagtcagattttttcgtggccagttctccagtgtcgttcacctgtatcgcgacggcaaagaccaaccctttatgcaaatgcctcagtaccaggggagaaccaaattagtgaaggactctatagccgagggacgcatttcgctgagactcgagaatattactgtgcttgatgctggtctgtatggctgtcggatatcatcacagagttattaccagaaagcaatttgggagctgcaagtgtccgcacttggatcagtgccactgatttcgatcacagggtatgtggaccgggatattcagcttctttgccagagctcagggtggtttccaaggcccactgctaagtggaaaggacctcagggacaggatctcagtacagactctaggaccaatagagacatgcacgggttatttgacgtcgaaatctctctaactgtacaggagaacgccggttccatcagttgcagcatgcggcacgcccacctgtcaagagaagtcgaatctcgggtccagattggcgacacctttttcgagcccatttcctggcatctggcaacaaaggtcctgggaatcttgtgctgcgggctgttctttggtattgtgggactgaagatcttcttcagcaaatttcagtggaaaatacaagccgaacttgactggagacgcaagcatggccaggccgaactgagggatgctcggaaacacgctgtggaggtgactctggatcctgagaccgctcatcctaagctgtgcgtgagcgatctgaaaaccgtgacccaccgaaaggctcctcaggaagtgccccactccgaaaagcgcttcactcgcaagtcagttgttgccagccagtcattccaggctggaaaacattattgggaggtggatgggggtcacaataagcgttggcgtgtaggggtgtgcagagatgatgtggatagaaggaaagaatatgtcaccctctctcccgaccacgggtactgggttcttcgactcaacggagagcacctctatttcactctgaaccccaggttcataagtgtgtttcctagaaccccccctaccaaaattggggtgttcctcgattacgaatgcggtacaatctctttttttaatatcaacgatcaatctctcatatacactctgacatgccggttcgaaggcctcctgcgcccttacatcgagtacccatcctacaatgagcagaatggtacgcccatcgtgatctgtccggtcacccaggaaagtgagaaagaagctagctggcagcgggcaagcgccatacccgaaacaagtaacagcgaatcctcttcgcaggccacaaccccttttttaccaagaggtgaaatgtag

SEQ ID NO: 48642 - DNA, 951 bp, Artificial Sequence
  Description of Artificial Sequence: Synthetic coding sequence
atgcatgggttgttcgacgtggaaatcagtttaacagtccaggagaatgccggatccatatcttgttctatgagacatgctcatctctcgcgggaggttgaatctagagtacaaataggagacactttctttgaacccatcagttggcatctcgcaaccaaagttctgggcatactttgctgcggactttttttcggtatcgttggtctgaagatatttttctccaagtttcagtggaagattcaagccgagctggactggagacggaagcacggccaggcggaactcagggatgcgagaaaacatgcagtggaagttactctggacccagaaactgcccaccctaaactgtgcgtctcagacttaaaaacagtgacacataggaaagcccctcaggaggtgccacactcagagaagcgatttactagaaaatccgtggttgcatctcagagctttcaggctgggaagcactattgggaagtggacgggggacataacaaacgttggagggtgggagtctgcagggatgacgtagatcgtcgcaaagagtatgtgaccctcagccccgaccatggctattgggttctccggcttaacggcgagcatttgtacttcactctgaatccaagatttatctctgtcttcccacggactccacccactaagataggcgttttcctggattacgagtgtggaacaattagttttttcaacattaatgaccaatccttaatctacaccctgacttgtagatttgaagggctgctgagaccatacattgagtacccctcctacaatgagcagaatggtactccaattgtcatctgtcccgtcacacaggagtccgagaaagaagcatcatggcaacgggctagcgcaattcccgaaacatccaactccgaaagcagctcccaggctactaccccctttttgccgaggggtgaaatgtag

SEQ ID NO: 48643 - DNA, 1128 bp, Artificial Sequence
  Description of Artificial Sequence: Synthetic coding sequence
atgtggacatggttcgtgaaatctcttggaagcgttcccctcattagtattaccggatacgtcgacagggacattcagttactgtgtcagagctctggctggtttcctcgtcccaccgcaaagtggaaaggccctcaaggccaggacctcagtactgactccaggaccaacagggacatgcatggtctgttcgacgtggagatatcattaactgtgcaagagaatgccggttctatttcatgtagtatgaggcacgctcacttgagtcgcgaggtggagagccgagtgcaaatcggtgatactttttttgaacctatcagctggcatttggcaacaaaagtgctcggaattctgtgttgcggactgtttttcgggattgtcggtctgaaaatatttttctccaagttccagtggaaaatccaggctgagctggactggaggcgaaaacacggtcaggccgagctgcgagatgccagaaaacacgccgttgaagtgacgctggatcccgaaactgctcaccccaaactttgcgtttctgatctgaaaacggtcacccacagaaaggccccacaggaagtcccacactctgagaagagattcaccaggaagagtgtggttgctagccagtcatttcaagcaggcaaacactactgggaggtagatggaggacataataaaaggtggagggtgggagtgtgtagggacgacgtggaccgaagaaaagaatatgtgaccttgagcccggatcatggctactgggttttgcgcctcaatggtgagcacctgtattttacacttaatccacgatttataagcgtgttccctagaacccccccaacaaagataggcgtttttctggactacgagtgtggcaccatctctttttttaatattaacgatcagtctctgatttatacactcacctgtagattcgaggggctcctccggccatacattgagtacccttcctacaatgaacagaatggcacacctatcgtgatctgccctgtgacacaggaaagcgaaaaggaagcgtcttggcagcgggctagcgctatccctgaaactagtaactccgaatcttcttcccaagctaccacccctttcctcccgcgaggagagatgtag

SEQ ID NO: 48644 - DNA, 1023 bp, Artificial Sequence
  Description of Artificial Sequence: Synthetic coding sequence
atggccctgatgttatctctagtgcttagccttctgaaactgggctctggccagtggcaggtgttcggcccagacaagccagtacaggccctggttggcgaagatgctgccttttcttgctttctttcccccaagacaaatgcagaagcaatggaagtgagattctttcgaggacagttttcttcagtagtgcatctgtaccgcgatgggaaggaccagccctttatgcaaatgccccaatatcaggggagaactaagctcgtaaaggactccatcgctgaggggaggatttctttgcgtctcgaaaacattactgtgttagacgctggcctctacggctgtagaatatcttcgcaatcttattaccagaaagccatttgggagctgcaggttagcgcgctcggctctgtgccgttgatcagtattactggttacgtggaccgggatatacaactcctctgtcagagcagcggatggttcccaagacctactgctaaatggaagggcccacaaggtcaggatctttctacggactcgcgaactaaccgggatatgcacggtctgtttgacgtggaaatttcattaacagtccaagagaatgcgggtagcatatcctgctccatgcgccacgctcatttaagtcgcgaggttgagtcacgcgtacaaataggcgatacgttctttgaacccataagctggcatctcgccactaaagtgctcggcattctctgctgcggcctgttttttggtatcgtcggactgaaaatcttttttagcaaatttcagtgtaaaagagagagggaggcctgggccggtgcattattcatggttcccgctggcacaggatctgagatgttgccacatccagcggcttctctgctgctcgttcttgcgtccaggggcccaggcccaaaaaagcttgagaagaaggccaggaccggcagaattgagagacgccctgaaacccggtcagggggtgactctggctcaagagacggctctcccgaggctctccgattttag

SEQ ID NO: 48645 - DNA, 1155 bp, Artificial Sequence
  Description of Artificial Sequence: Synthetic coding sequence
atggccctcatgttgagcctggttctgtccttactgaagttgggcagcgcactgggcagtgtgcccctaatcagtattacaggatatgtcgatagagacatccaactcctgtgtcagtcatctggatggttccctcgacctacagccaaatggaaaggaccccaagggcaggatctctcaacagatagcaggaccaacagagatatgcatggacttttcgacgtggagattagcctcacagtgcaggaaaacgccggatcaatctcgtgttccatgagacacgcacacctctccagggaagtggagtcccgggtccagattggcgacacgttttttgaaccgatctcatggcaccttgcgacgaaagtgcttggcatcctgtgttgcgggctattttttggcatcgtgggcctgaagatattctttagtaagtttcaatggaagatccaggccgagctggactggcggcgtaaacacggacaggcggagttaagagatgcaaggaagcatgctgttgaggtcaccctagacccagaaaccgcccacccgaagttgtgtgtgagcgatttgaagaccgtgacgcaccgcaaggcccctcaggaggttccacacagcgaaaagcggtttacgcggaagagcgtggttgcatcccaatcctttcaagccggaaagcactactgggaagtggacggtgggcataataaacggtggcgggtaggcgtctgcagggacgacgtggaccggagaaaggagtacgttacgctttctcccgatcacggatactgggttttgagattaaacggggaacatttatactttaccctcaatccaagatttatttctgtgttcccgcgaactccacctaccaaaataggagtgtttctcgattacgaatgtggcactatttcgttcttcaacataaacgaccagagtctcatctacacgctgacttgccggttcgagggactcctgcggccttatatagaatacccctcctacaacgagcagaatgggactcctatcgtgatctgcccggtgacccaggaaagcgagaaagaagccagttggcagcgtgcctctgcgattcccgagacctctaactcagaaagctcttctcaggcaactacaccctttcttccccgaggcgaaatgtag

SEQ ID NO: 48646 - DNA, 1608 bp, Artificial Sequence
  Description of Artificial Sequence: Synthetic coding sequence
atggtcgaccttagtgtgtccccggactccttaaagcctgtttcactcacaagctcactggtgtttctgatgcatctgctgctcttgcaaccaggggagccctcgtcagaggtcaaagtgctaggacccgagtatccgatcctggcccttgttggcgaggaagtggagtttccctgccatctgtggccccagctggacgctcaacagatggaaatccggtggttcagatctcagacttttaatgtggtgcacctgtatcaggaacaacaggaactgccgggaagacagatgccggcattccggaatcgtacaaaactcgtgaaggacgacatagcctatggatcagtagtcttacagttacatagtatcatcccctctgataaaggaacatacgggtgccggtttcattccgacaactttagcggcgaggccctttgggaactggaggtggccggactggggtcagacccacacctgagcctcgagggctttaaagagggcggtatccagctgcgcctcagatctagcggttggtaccctaaacccaaagtgcagtggcgggaccaccaagggcagtgtttgccccctgaattcgaagccattgtgtgggatgctcaggacttattttccttggaaacctccgtcgtggtgagggcaggcgcactgtcaaacgttagtgtgtcaattcaaaatctgcttctttcccagaagaaggagctggtggttcagatagctgatgtattcgtccctggcgcttctgcgtggaagtccgcttttgtggccactctccccctgctgctcgtgctggctgccctagctctcggggtcctaagaaaacaaaggcggagtagggaaaagctgaggaaacaggccgagaaaaggcaggagaaactgaccgccgagctggaaaagttgcagactgagctcgattggcgaagagccgaaggccaagccgagtggagagctgcccagaagtatgcagtagacgtgacactagaccccgcttcagcacacccttccctggaagtgagcgaggatggtaaatctgtctcctctcggggagccccacccggtcccgcacctggtcatccccagaggttttccgagcagacctgcgctctttccctcgaacgattttctgccggacggcattattgggaggtccatgttggccgacgctcacggtggttcctgggtgcatgcctggcggcagtgcctagggccggtcctgcccgactgtcgcccgctgcagggtattgggttcttgggttgtggaacgggtgtgagtattttgtgctggcaccccatagagtggccctgaccctgcgcgtcccaccacgtaggctcggcgtgttccttgactatgaggctggcgaactgagtttcttcaatgtttcagatggtagtcacatttttactttccatgatacgttcagcggcgcattgtgcgcgtacttccggccacgtgcccatgatggaggggaacaccccgaccctctgaccatctgcccgcttcctgtgaggggcactggcgtaccggaagagaatgatagcgatacttggctccagccttacgaaccagcggatcctgccctggactggtggtag

SEQ ID NO: 48647 - DNA, 1035 bp, Artificial Sequence
  Description of Artificial Sequence: Synthetic coding sequence
atggtggacctgagcgtgtctccagactcattaaaaccagtcagtctgacttcaagcttagtctttctgatgcacttactcctgctgcaacctggggaaccatcctcagaggtcaaagtcctcggcccagagtacccaattctagctcttgtgggcgaagaggttgagttcccttgtcacctgtggccccaactcgacgcccagcagatggagattcgctggttcagatctcagacttttaacgtcgtccatctttatcaggaacagcaggagctgcccggaaggcaaatgccagctttccgtaaccgaaccaaactcgtgaaagacgacatcgcatacggcagcgtggtactacagttgcactcaattattccctccgataaaggaacctacggatgccgcttccactcagataacttctccggggaggctctttgggagctggaagtggccggactcggctcagaccctcatttatctctcgaggggtttaaggagggcggaatacagttgcggcttcggtcttccggttggtatcccaagccaaaggtgcagtggagggaccatcaaggccagtgcctgccacccgaattcgaggccattgtctgggacgcccaggatctgttctccctcgagacatcagtggtcgtaagggcgggtgccttgtcgaacgtgtctgtgtctatccagaacctgctgctcagccaaaagaaagagctcgtcgtccaaatagccgacgtgtttgtgccaggggctagcgcctggaaatccgctttcgtagccacactccctctgctgcttgttctcgcagccctagctctgggggtactgcgcaagcaacggaggagccgcgagaaactgcgaaagcaggccgagaaacgccaggagaagctgaccgccgaactggagaagttgcagacagaactggattggcggagggcggagggacaggcagaatgcttcgtgttggctagtcatccccctggggaggggattcaggccgcttccaatagcaccaccacattaaatgcttag

SEQ ID NO: 48648 - DNA, 1611 bp, Artificial Sequence
  Description of Artificial Sequence: Synthetic coding sequence
atggtagatttatctgtgagtcctgacagcctgaagcccgttagcttgactagctctctcgtgttcctgatgcacctgctcttgctccaacccggtgagccaagttccgaagtgaaggtactaggtccagagtaccctatcctggcactcgtcggagaggaggttgaattcccgtgtcacttgtggcctcagctggatgcacaacagatggaaatccgttggttccgcagtcaaacctttaatgtggtgcacctctaccaggagcaacaagagttgcctggacgccagatgccagctttcagaaacagaaccaaattagtaaaagatgacatcgcgtacggatcagtcgtcctgcagctccatagtatcattccctccgacaagggcacctacggatgccgatttcatagcgacaatttttccggtgaggctctctgggaactagaagttgctggcctcgggagtgatcctcacctcagcctggagggctttaaagaaggcggaattcagctcagactgagaagcagcggatggtatcccaagcccaaagttcagtggcgcgatcatcagggtcagtgcctcccgcctgagtttgaggctatagtatgggatgcccaggacctatttagcctggagaccagtgtggtggtgcgcgcaggagcactatccaacgtgtcagtttctatacagaacctcctgctctctcaaaaaaaggagctggtcgtgcagatcgccgacgtgtttgtacccggagcatccgcgtggaaatcagcctttgttgccaccctgcctctgctgttagtgctcgctgccttggctctcggcgttctgcggaagcagagacggtcacgtgaaaagcttaggaaacaagccgaaaaacggcagggcaccgagaagacagcacagctgcctcccaatcaggttgctagcgattggaggagggctgagggacaggccgagtggagagccgcacagaagtacgctgtcgacgtcacacttgaccccgcatctgcacacccatccctcgaggtgagcgaggatgggaagtcagtgtcttcaagaggggctcctccaggtcctgctccaggtcacccccagaggttcagcgagcaaacatgcgctctttccctggagagattcagtgcaggcagacattactgggaggtccacgttggacgcaggtctagatggtttctgggcgcttgccttgctgctgtgccgagagcgggacctgctagattaagcccagccgcaggttactgggttcttggcttgtggaacgggtgtgagtattttgttctggccccacatcgagtggcactgactttgcgtgttcccccacgcaggctcggcgtgtttctggactacgaagcaggtgaactgagcttttttaatgtgagcgatgggagccatatcttcacgttccacgatacgtttagcggggctctgtgtgcttacttccggcctcgtgctcatgatggtggcgagcacccagatccactgaccatctgcccactgccagtccgcggaaccggcgtgcccgaggaaaatgacagcgatacttggctgcagccctacgaaccggctgaccctgctctggattggtggtag

SEQ ID NO: 48649 - DNA, 1035 bp, Artificial Sequence
  Description of Artificial Sequence: Synthetic coding sequence
atggtggacctgtccgtaagtcctgactccctcaaaccagtcagtctgacatcaagcctggtgttcctgatgcatctgctgctcctgcagcctggggaacctagttctgaagtgaaggtgctgggccctgagtacccaatccttgctctggtgggggaagaagtggagttcccatgccatctgtggccacagttagatgctcagcagatggagatccgatggttccgctcacagacatttaacgttgtgcatctgtaccaggagcagcaggagctgcccggaagacagatgcctgcatttaggaatagaactaaattagtgaaagacgatatcgcgtacgggtctgttgtcctgcagctgcactcaattatcccttccgataaaggaacatacggctgccgcttccactccgataattttagcggagaagctctctgggaattagaggttgctggcctagggtccgacccacatctgagtctggaaggcttcaaggagggcggtatccagctcagactgcgaagttcgggctggtatccaaagccgaaagtccagtggcgcgaccaccagggccaatgtttgccacccgagttcgaggccattgtgtgggatgcccaggacttatttagccttgagaccagcgtggtagtgcgggcaggtgctttgtcaaatgtgagcgtgagcatccagaatctgctgctgagccagaagaaggagctggttgtacagattgccgatgttttcgtgccgggtgcctcagcttggaagagcgcctttgtggcgaccctgcctcttcttctggtgcttgctgcgttggccctgggcgtgttgcggaaacaacggaggagccgcgaaaagctgagaaagcaggcagagaaacggcaggctcgatatgatgcacaggcgggtccacttcttgtcgcgtctgactggagacgggctgaaggccaggcagaatgttttgtgctcgcctcccaccctcctggcgaagggatccaggctgcctctaattcaactacaacactgaacgcatag

SEQ ID NO: 48650 - DNA, 3672 bp, Artificial Sequence
  Description of Artificial Sequence: Synthetic coding sequence
atgaggagactggccgctgaggagctgggggttgtgaccatgcagcgtatctttaactccttcgtgtacaccgagaagatcagtaatggagaatctgaagtacagcagttggctaaaaagatccgcgagaaatttaacaggtacctggacgtggtcaatcgaaacaagcaggtggtcgaagcgtcatatacagcccacctcacttcacccctgaccgccatccaggattgttgtacaataccgccttcaatgatggaatttgacggcaatttcaacactaacgtcagcaggaccatttcttgcgataggctgagcaccaccgtgaattcacgcgctttcaatcctggccgagacttaaattccgtgctggctgacaatctgaagtcaaatcctggtattaaatggcagtatttttcctcggaggaagggatattcactgtcttcccagctcacaagttccggtgcaagggtagttatgaacacaggtctagaccgatctacgtttccacggtgcggcctcagtccaaacacatagtggttattttagaccacggagcgtccgtgaccgacacccagctccagattgctaaggacgctgcccaggtcatcctgtccgccattgacgagcatgacaagatctctgtcctgaccgtggctgatactgtccgcacctgctccctggaccaatgttataaaacattcctaagtcctgccacctctgagaccaagcgaaaaatgtctaccttcgtgagttccgtaaagtcttccgattctcccactcagcacgccgttggtttccagaaggcctttcaattaatccgaagcacaaataataatacaaagtttcaagccaataccgacatggtcataatttacctgagcgccggtattacatcaaaggacagttctgaagaggacaaaaaggctacgctgcaggtgatcaatgaggaaaactcattcctgaacaatagtgtgatgatactcacctatgcgctgatgaacgacggtgttaccggcttgaaggagttggcttttctcagggatttggcggagcaaaattctggcaagtatggggtgcccgataggatggcactccccgtgatcaagggatccatgatggttctgaatcagctgtctaacttggagactacagtgggcaggttctatacgaacctaccaaataggatgatcgatgaggccgttttttcattaccttttagtgatgagatgggagatggcctgattatgaccgtgtccaaaccttgctattttggcaatcttctgctgggaatagtcggcgtcgacgttaacctggcgtacatcttggaggatgtgacctactatcaggatagtttagcgagttatacatttctgatcgatgacaaagggtacaccctgatgcatccttcactcacacgcccatatctgctgtccgaaccaccactgcatactgacatcattcattatgaaaatatccccaaattcgagttagtgagacaaaatatcttgtccttgcccctgggctcccagataattgctgtccccgtcaacagctcgctgtcatggcatattaataaacttcgtgaaaccggcaaggaagcctacaacgttagctatgcctggaagatggtgcaggatacctcatttatcctttgtattgtggtcatccagcccgagattccggtgaagcagctcaagaatttaaacactgtaccttcttctaagctcttgtaccaccggctcgacctgctcggacagccttccgcctgtctccattttaagcagctggccacactggagtctcccacaattatgttaagtgccggatcttttagttcgccctatgagcacttgagtcaaccagagacgaagcgaatggtagagcattacacagcttacttgtccgataatacgcgtctgattgcaaatcccggactgaaattcagcgtgcggaatgaggtcatggcgactagccacgtgaccgacgaatggatgactcagatggagatgagctcccttaatacctatatcgtccgtaggtatattgccacgcccaacggtgtgctgcgaatttacccaggtagtctgatggacaaggcatttgaccctacgaggagacagtggtacctgcatgctgtagccaatcccggactgatctcccttacaggtccttacctggatgttggcggagccggatatgtagtgaccattagtcacactatccatagtagcagcactcagcttagctcgggccacacagtcgcagtgatgggcatcgacttcacacttcgatatttctacaaggttctaatggacctgctgcctgtgtgtaaccaagacggcggaaacaaaatccgctgttttataatggaggatcgaggatatctggtagcccatcctaccctaatcgaccccaaagggcacgccccagtggaacagcagcatattacacacaaagaaccgctggtcgcaaacgatattttgaaccatcctaatttcgtcaagaaaaacctgtgcaattctttctcggatcgcacagttcagcgattctataaattcaatacttcactggcaggtgatttgactaatttagtacacgggtcccattgttccaagtataggttagcgagaattcccggaactaatgccttcgtgggtatcgtgaacgagacatgtgatagcctagcattttgtgcatgctccatggtagataggctctgtctaaactgtcacaggatggaacaaaatgagtgtgagtgcccatgcgaatgtccgctggaggtgaacgaatgcacgggaaatcttacaaacgcagagaatagaaatccatcatgtgaggtccatcaagagccagtgacgtataccgctatcgaccccggacttcaggacgctctccatcagtgcgtgaactctcgctgttcccagagactggagagcggagactgtttcggagttcttgactgcgagtggtgcatggtggactccgacggcaagactcacctcgacaagccttactgcgctcctcagaaggagtgtttcggtgggatagtcggggctaagtcgccttacgtcgatgacatgggtgctatcggggatgaggttatcacccttaacatgataaagtcggcccctgtgggccctgtggctgggggaattatgggatgcataatggtgctggtcctggctgtgtacgcttatcgccatcagattcacaggcggtctcatcagcacatgtcccctctagctgctcaggagatgtcagtgcgcatgagcaacctcgaaaatgaccgggatgaaagagatgatgactcccacgaggaccggggtattatctcaaatacacgcttcattgcagctgtaatcgagaggcatgctcattcacctgaacgcagacggagatattgggggagatccggcaccgaaagcgaccacgggtactccacaatgtccccacaggaggattccgaaaacccaccctgcaataacgacccactgtcagctggagtcgacgtcggcaatcacgacgaggatctcgacctggatacaccccctcagactgccgctctcctgtcccacaaattccaccattacaggtcgcaccaccctacattgcatcacagtcaccacttgcaggccgcagtgacagttcacaccgtggacgctgagtgctag

SEQ ID NO: 48651 - DNA, 3825 bp, Artificial Sequence
  Description of Artificial Sequence: Synthetic coding sequence
atggcccgtcagccagaggaagaggagactgccgttgcccgtgctagaaggccacctttatggctgctgtgcctcgtggcctgttggctgctcggcgcaggcgcagaagccgacttctctatcttggatgaggctcaggttcttgcctcccaaatgcgacggctggcagcagaagagctgggtgtggttacaatgcagcgaatcttcaattcctttgtatacactgagaaaatttctaacggcgaatcagaggttcagcagcttgccaaaaaaattagagagaaattcaaccggtaccttgatgttgtgaacagaaataagcaagttgtggaagctagctacaccgcccatctgaccagtcccctgacagctattcaggactgttgcaccatccccccatcgatgatggagttcgacgggaacttcaatactaacgtctcccgcactatttcatgcgatcgcctctctacaaccgtaaatagccgtgcgtttaatccaggacgagaccttaatagcgttctggcagacaacctcaagtccaaccccggaatcaagtggcagtattttagctcggaagagggcatttttaccgtgtttccggcacacaaatttaggtgtaaggggtcttatgagcaccggagccgaccaatctacgtctctaccgtacgccctcaatcgaaacacatcgtcgtgatattagatcatggagccagtgtcacagacacgcagctgcagatcgcaaaggacgcagcccaagtgattcttagtgctattgacgaacatgataagatatctgtgctgacagtggcggataccgtgcgcacctgttcactggatcagtgctacaaaacctttctcagtcctgctacctcagagacaaagcgtaaaatgagtaccttcgtttcttctgtgaaatcctcggattcacctacacagcacgcggtagggttccaaaaggcttttcagttgattagatcaacgaacaacaataccaaatttcaagcgaacaccgacatggtgattatatacctgagtgcaggcatcacgagtaaggacagctcagaggaggacaaaaaagccaccttgcaggttatcaatgaggaaaactcatttttaaacaacagtgtaatgatcctgacatatgccttaatgaatgacggtgtaacagggctgaaagagctggccttcctcagagacctggcagagcaaaactccggcaaatacggggttcctgatcggatggccctgcccgtcatcaagggtagcatgatggtcctaaaccagcttagcaatttggagacaactgtgggaagattctataccaacctacccaatagaatgattgacgaggctgttttcagtctccccttctcagacgagatgggagatggactgattatgacagtctctaaaccttgctactttgggaacctccttcttggcattgtgggagtggatgtgaatctggcttacatccttgaagacgtgacttactatcaggacagcctagcctcatatacctttctcattgatgacaagggatacaccttgatgcatccttccctgactagaccctacctgctctccgaaccacccttgcataccgatattattcactatgagaatattccaaaatttgaactcgtgcgccagaatatcctgagtctccccctgggctcacaaatcatcgctgtgccggtcaactccagcctttcatggcacattaacaagctgagagaaactggtaaggaagcctacaatgtctcatacgcctggaagatggttcaggatacaagctttattctctgtatcgtagtcattcagccagagattcccgttaagcagctgaagaatctgaacaccgtaccctcgtcaaagctgctgtatcatagattggatttgctaggccagcctagtgcctgtctccatttcaagcagttagctactctggagtccccaacgatcatgctgtcagccggatccttttctagtccttatgagcacctatcacaaccggagacaaaacgcatggtggaacattataccgcatacttgagcgacaatacaaggttgattgctaatcccggtctcaagttctcagtcaggaatgaggttatggccacctctcacgtcacagatgaatggatgacccagatggagatgtcctcactgaatacttacatcgtaaggcgctatattgccacaccaaatggagtgttgcgtatatatccaggaagtctgatggataaagcctttgatcctacacgcaggcagtggtacctgcacgccgtagcaaacccagggctcatctctctaacgggaccctacctagatgttggtggggctggatatgtagtgaccataagtcacacaattcacagttcttctactcaactgtcatccggtcatacagttgccgtgatgggaatcgacttcactctccgctatttctacaaagttctcatggacctactgcctgtatgtaatcaggacggtggcaataaaattaggtgctttattatggaggatcgcggatatctggtcgcacatccgacccttattgaccccaagggccatgcaccggttgagcagcagcatattactcataaggagcccctcgttgctaacgacatcctgaatcaccccaattttgtgaagaagaacctatgcaatagtttctctgaccgaaccgttcagcggttttacaagttcaacacctccctggccggtgacctcacaaatttagtgcatgggtcccattgcagtaagtataggctggcccgaatacctggcacaaatgcatttgtgggaatagtgaacgaaacttgcgactccctggccttctgcgcctgcagcatggtggatcgtttgtgtctgaattgtcatagaatggagcagaatgagtgcgaatgcccatgtgagtgcccactcgaagttaacgagtgcactggcaatctgactaacgcagagaaccggaacccctcctgtgaagtacaccaggagcccgtgacttatacagcaatagacccgggattacaagatgcactgcaccagtgtgtaaatagcaggtgtagtcagcgcctcgagtccggggattgctttggagtccttgattgcgagtggtgcatggtggactccgacggaaaaacccacttggacaagccatattgcgcacctcagaaggagtgcttcgggggtattgttggcgcaaaatccccctatgtagatgatatgggtgctatcggagatgaagttattactttgaacatgatcaagagcgcaccagttggtcccgtggcaggcggtatcatggggtgcattatggtactggtgctggctgtgtacgcctataggcatcagatccataggagatctcaccagcatatgtcccctctggctgcccaggagatgtctgtccggatgtctaacctcgaaaacgaccgggacgagcgagacgacgattcacacgaagaccgcggaattatcagtaacacccgttttatcgccgcagttattgagagacacgcccattctcccgaacgcagaagaaggtattgggggcgaagcggaacggagagcgaccacggatattccaccatgtctccccaggaggactctgagaaccccccatgcaacaatgatcctttgtccgctggagtggacgtaggaaaccatgatgaggacctggacctggatacaccaccccagactgctgctcttctctctcataagtttcaccactacagaagtcatcaccccacacttcatcactcccatcacttacaggctgcagtgaccgtccacaccgttgatgctgagtgttag

SEQ ID NO: 48652 - DNA, 2460 bp, Artificial Sequence
  Description of Artificial Sequence: Synthetic coding sequence
atgtggggactggtccgactattgctcgcttggctggggggatggggatgtatgggtaggctcgctgcaccagctcgggcatgggcaggttctagagagcaccccggacccgctctcttacggactcggagatcctgggtctggaatcagtttttcgtgattgaggagtatgccggaccagaaccagttctgatagggaagcttcatagtgacgtggacaggggtgagggaaggacaaaatatctactgacgggcgagggtgccggaacagtattcgttatcgatgaagcgaccggtaatatccatgttaccaaaagtctggatagggaggaaaaggctcaatatgtgctgctagcccaagccgttgacagggctagtaatcgaccattggagccaccctcagaattcattatcaaagttcaggacatcaatgataatcctccgatctttcccctgggcccttaccacgccactgtcccggaaatgtcaaatgtaggaacctccgtcattcaggtgaccgctcacgacgccgacgacccctcctatggcaatagcgccaagctcgtgtataccgtcctggatggtttgcctttcttcagtgttgacccacagaccggagtggtgcgcaccgcgattccgaacatggacagagaaacccaggaagagtttctcgttgtgatccaggcaaaggacatgggtggacacatggggggactgtcaggctccaccactgtgacagtcaccctctctgatgtgaatgataaccccccaaaatttcctcaatccctataccagttctccgtagtggaaactgcagggccaggcaccttggttgggagactccgggctcaagatccggacctgggcgacaacgctctgatggcttacagtatcctcgacggcgagggttctgaggcgttcagtatatccactgacctgcaggggagagacggactcctgactgtcaggaaacctcttgactttgagtctcaacgctcgtacagtttcagagtggaggccacaaatactctcatcgacccagcatacctaaggcgcggaccgttcaaagacgttgctagcgtgagagtggccgtacaggacgccccagaaccccctgcatttacccaggcagcttaccacctaactgtgccagaaaacaaggctccaggcacattggttggtcagatatccgccgctgacctggactctcctgcctccccaatccgatactccatactgccacactccgatcctgaacggtgtttcagcattcagcccgaagaggggacgatacataccgcagcaccactcgatcgggaggccagggcctggcacaacctaactgttctcgccaccgaactgggttggagctggggacctgagcgtggatgggtcccgttgcttgtggcggaatggagcgccccagcagcaccaccccagcgttctccagttggttcagccgtggggattccacaggattccagcgcgcaggctagtcgcgttcaagtagccattcagacccttgacgaaaatgataatgcccctcagttggctgagccctatgatacatttgtctgcgatagcgcggctcctggtcagctcatacaggtcatacgcgcattggaccgcgatgaagtcggcaactcctcccacgttagcttccagggtccactcggacctgatgcgaacttcactgtccaggacaaccgagacgggtcggccagccttttacttccttctagacccgcaccaccacggcacgctccctacttggtccctattgaactgtgggattgggggcaaccagctttgtctagtaccgctaccgttacggtttccgtgtgccgctgccaaccagacggctccgttgcgagctgttggcctgaggcccacctctccgcagccggacttagcaccggggctctgctggccattatcacttgtgtgggcgcactgcttgcattggtggtcttgtttgtggcactgcgcagacaaaagcaggaagcactaatggtgctggaggaggaggacgtccgcgaaaatatcattacctatgatgatgagggagggggtgaggaggatactgaggctttcgatatcacagcactacaaaatccagatggagctgcacctcctgcgccaggacccccagcgaggcgggacgtgctgcccagggctagggtgagtcgccagcccagacctccaggacccgctgatgtcgcacagcttctggccctaaggctgcgagaggccgacgaggatcccggagtgcccccttacgattcggttcaggtgtatggatacgaaggtagaggctcttcatgtggtagcctgtcaagcctggggtccggatccgaggctggcggtgctcccggacctgccgagccgctggatgactggggtcccttgtttcgcacactggccgagctgtatggcgctaaggagccacctgccccatag

SEQ ID NO: 48653 - DNA, 2460 bp, Artificial Sequence
  Description of Artificial Sequence: Synthetic coding sequence
atgtggggtttggtgagactgctgctggcttggctaggtggatgggggtgcatggggaggctcgctgctccagccagggcctgggccggtagtagagaacatcccggtccggcactgctgcgaaccagaaggagttgggtctggaaccagttctttgtgatagaggaatatgccggacccgagcctgtcctgattggcaaactacactccgatgtcgacagaggagaaggcaggaccaaatacctgctgaccggtgagggcgctggcactgtcttcgtcattgatgaggccacggggaacatccacgtcactaaatcactcgaccgcgaggagaaggcacagtatgtgctgctcgcacaggctgtcgatagagcctctaatcggccactggaacctccttctgaattcattattaaggtgcaggacattaacgacaacccacctatattcccacttggcccttatcatgctacagttccggaaatgtcaaatgttgggacatccgtgattcaggtgaccgcccacgatgccgacgaccccagttacggcaacagcgcgaagctggtttatacggtgctcgacggactcccatttttcagcgtggatccacaaacaggcgtagtgcgcaccgctatcccaaacatggatagggagactcaggaggagtttctcgtggtgatacaggccaaggacatggggggtcacatgggtggcctgtcaggttctacaacagtgaccgtcacactgtccgatgtcaacgataatccgccaaagtttccgcagtccctgtaccagttctccgtggtggaaacagccggacccggaacactggtgggtcggctccgcgcacaagaccccgatttaggagataatgctttaatggcatacagtattctcgacggcgagggatcggaggcctttagtatctccaccgatctccagggaagagacggactactaactgtgaggaagccactcgattttgaatctcagcgctcatattccttcagagtcgaagctaccaacacactgatcgatcctgcctatctcaggagaggccctttcaaggatgtagcttccgtccgggttgccgtgcaggacgccccagaacctccagcgtttacccaggccgcatatcacctgacggtgccggagaacaaggcgccaggcacattggttggccagatttccgcggctgaccttgattctccagcatctcctatccgttacagcatcctacctcactccgacccggagaggtgtttctccatccagccagaagaaggaaccatacacactgcagcgccacttgaccgcgaggctagggcgtggcacaacctgactgttctcgctaccgagttagggtggagttggggccctgagaggggttgggtgccactcctggtcgcagagtggtctgccccagcggctcctccccagcggagccccgtgggtagtgctgtcggtatccctcaggattccagcgcccaagcatcccgagtgcaagttgctatacagacattagatgaaaatgacaacgcccctcagctagccgagccttacgacacctttgtgtgcgatagtgccgcaccaggtcaacttatacaggtcatacgagctctcgatcgggatgaggtcgggaatagcagtcatgtaagtttccagggccctctaggtcccgacgcgaacttcaccgtgcaagacaatagggatgggtcagcttcactcctcttgccttcccggcctgcccctcccagacacgcaccctatctcgtcccaatcgagctctgggactggggccaaccggcactctcctccactgccactgtgacagtcagtgtctgtcgatgtcagcccgatggaagcgtggcaagttgctggccagaggcacacctgtccgcagccggtttatcaactggggcacttctcgccatcattacctgtgtaggcgcacttttagctcttgtcgtgctcttcgttgccctccgccgacagaaacaggaggcgctcatggtcctggaagaggaagacgtacgggaaaacattatcacctacgacgatgaagggggaggagaagaagataccgaggctttcgacattacagcgctacagaatcccgacggggcagcccctcccgctcctggaccaccagcgagacgggatgtacttcctcgtgcgagggttagtcgacagcctaggccaccaggacccgctgacgttgcacaactacttgctttgcgccttcgagaggccgatgaagaccctggtgtgccaccttatgacagtgttcaagtgtatggctacgaaggaagagggtcgagttgtggctccctgagtagcctggggtcgggctccgaagctgggggagcaccaggcccagcggaacctctggacgactggggtcccctttttagaactttagcagagctgtatggcgcaaaggaacccccagcaccctag

SEQ ID NO: 48654 - DNA, 945 bp, Artificial Sequence
  Description of Artificial Sequence: Synthetic coding sequence
atgtggggactagtgcggctcctgttggcctggttggggggatggggttgtatgggccgactggccgctccagctcgagcgtgggcagggtccagagagcacccaggacctgcgctgctgaggacgaggcgttcttgggtatggaaccaatttttcgtgatcgaagaatacgcgggtcccgagccagtgcttatcggcaaacttcattccgacgtggatcgcggagaaggcagaactaagtacttactgacaggagagggtgcgggaaccgtgtttgtgatcgacgaggccacgggaaacattcacgtgactaaaagtttagaccgtgaggaaaaagcgcaatacgtgctgcttgcccaggccgtggaccgagcctcgaacagacccctggagcccccttctgagtttattatcaaaataattacctgtgtcggggctttactggccctcgtggtgctgtttgtggctcttcgaaggcaaaaacaggaagcactcatggttctggaggaagaggacgttagagagaacattatcacatacgacgacgagggaggcggagaggaggatacggaggccttcgatatcacagcacttcagaaccccgatggcgctgcaccgccagctcccggacctcccgctagacgggatgttcttccacgcgcaagagtgtccaggcagcctcgaccccctggtcctgcggatgtggcccagctactggccctccgtcttagagaagcagatgaggatccaggggtccctccatacgactccgttcaggtgtacggctacgaaggtagaggcagcagctgcggctctctgtcctctcttggtagtggatcagaggccggtggagcccctggacccgcagaacccctagatgattggggcccactgtttaggacactggccgaactgtacggagcaaaagagccgcctgctccgtag

SEQ ID NO: 48655 - DNA, 2346 bp, Artificial Sequence
  Description of Artificial Sequence: Synthetic coding sequence
atgtggggcctagtcaggctgcttctagcttggctgggcggttggggctgcatgggtcgcctggcagcccctgcgagggcttgggcaggtagcagagaacatcccggtcctgcgctgctcagaactcgcaggtcttgggtgtggaatcaatttttcgtaatagaggagtacgctggaccagaaccggtgttaatcggtaaactgcactctgatgttgataggggggaaggcaggaccaaatatctcctcaccggtgaaggggctgggacagtgttcgttatagacgaagccaccggaaatattcacgttaccaagagccttgatagggaagaaaaggcccagtatgttctgctagcccaggctgtagaccgggctagtaatcgtccattggagcctccttctgaatttatcattaaggtccaggacattaacgacaatccacccatctttccgcttggcccttaccatgccactgtgccagagatgtccaacgtcggcacaagtgtcattcaagtgaccgctcacgacgccgacgatccaagctacggtaacagcgccaaactggtgtacacagtcttggatggactgccttttttttcggtcgatccccagacaggggtggtgcggacagctattcccaatatggaccgggaaactcaagaggagttccttgtggtaatccaggcaaaagacatgggaggacacatgggcggactttccggcagcactactgttacagtgaccttgtctgacgttaatgataacccacctaagttcccacagagcctctaccagttctccgtggtcgaaaccgctggtccagggacactggtgggcagactgcgagcacaggaccctgatctcggagataacgcacttatggcctattctatcctcgacggagagggcagtgaagcctttagtatctcgacggatctgcaagggagagatggcttactcacggtcaggaagcctctcgacttcgaaagtcagcggtcttacagctttagggttgaagccacaaataccttgattgacccagcatatctccgaaggggacctttcaaagacgtggcttccgtgagggtggctgtccaggatgcgcctgaacccccagcatttacgcaagccgcttaccacctgactgttccggaaaacaaggccccaggcaccctagtgggccagatttccgcagccgacctcgacagtccggcatcccctattaggtatagcattctaccacactctgatccagaaaggtgctttagtatacagccagaagagggtactattcacactgcagcgcctcttgaccgcgaggcaagagcctggcataacctcaccgtactggccaccgagcttgactcctctgcccaggcttcacgagtgcaagtggccattcagaccctggatgagaatgataacgcacctcagttagcagagccatacgacacatttgtctgcgattcggccgcacccggacaattaattcaagttatacgggctctggaccgagatgaggtcggcaactcgtctcacgtgtcttttcagggacctctgggtccagatgcaaacttcacagtacaggataacagagacggctcagctagcctccttctaccttcccggccagccccacctcgacacgccccttacctggtaccaattgagctgtgggactgggggcagcccgctctctcaagtaccgcaacagtcaccgtaagcgtgtgccgatgccaaccagatggtagcgtagctagctgctggcccgaggcacacctttcggctgccggtctttctaccggagcactgctggctatcattacatgtgtgggcgctctgcttgccttagtagtccttttcgtcgccctgaggaggcaaaagcaagaagctctcatggttctggaggaggaagatgtcagggagaacattatcacctacgatgatgaggggggtggggaggaagacacagaggcgttcgacattactgctctgcagaaccccgacggcgctgcacctccagcccctggcccacccgctaggagagacgttcttcccagggcccgagtgtctcgccaacctaggccacctggcccagctgatgtggcccaactgctcgcattaagactgagagaggcggatgaagatcccggagtcccgccttacgactcggttcaagtttacggttacgaggggagaggctcctcatgcggaagcctctccagtctcgggagcggatctgaggccggtggtgcaccaggacccgcagagccccttgacgattggggccctttgttccggacattagctgagctgtacggcgcaaaggaacctcccgctccgtag

SEQ ID NO: 48656 - DNA, 2346 bp, Artificial Sequence
  Description of Artificial Sequence: Synthetic coding sequence
atgtggggccttgtgcgcctgctcctggcatggttggggggatggggctgcatgggcagattggccgctccagccagggcctgggccggaagccgggagcatccagggccagctctgttacggacacggagatcctgggtgtggaaccagtttttcgttatcgaggagtacgctgggccagagccggttcttattggaaaactgcattctgacgtggataggggtgagggccgaaccaagtacctcctgaccggcgaaggagcaggcactgtgtttgtcattgacgaagctacaggcaacatacatgtgaccaagtccctcgacagggaggaaaaggcacagtatgtgttgctagcccaggcggtcgaccgagcaagcaaccgacctcttgagccgccttctgaatttatcatcaaagtgcaggacataaatgacaacccccctattttccccctcggtccataccacgctacagtccctgaaatgagtaacgtcggcacctctgtgatacaggtcaccgcgcacgacgcagatgacccatcttacggtaactccgctaaactagtgtacactgttttggacggactcccatttttttccgtggaccctcagaccggggttgtaagaacggcaatcccaaatatggaccgagagacgcaggaggaattcctggtggtgatccaggcgaaagacatggggggtcacatgggcggtttatcggggagtactaccgttacagtaaccctttctgacgtgaatgacaatcccccaaaatttcctcagagtctgtaccagttttccgtggtcgagacggctggcccaggaactcttgtggggaggttgcgagcacaagaccctgatctgggcgacaacgcactcatggcgtactctatccttgacggagagggctctgaggccttcagcatcagcactgacctgcaaggccgagatgggctccttacagttagaaaaccgctggactttgaaagtcaacgttcttattctttcagggtcgaggctacaaacacactcatcgatccagcctatttgcgacggggtcccttcaaggacgtggcctctgtcagagtggcagtacaggatgcgcctgaaccaccggcttttacccaggccgcatatcacctgaccgtgccggaaaacaaggcgccagggactctggtaggccaaatctcagcagcggacctagattctccggctagccctattcggtacagcatcctgccccactcagaccctgaacgatgtttttcgatacaacctgaggagggcaccatccatactgctgcacctctagatcgagaggcccgagcgtggcataatctgacagtcctggcaacggaacttgactcgagcgcccaggcttcaagggttcaggttgctattcagactcttgacgagaatgacaatgctcctcagttggctgagccttacgacacctttgtgtgcgactcagcagccccagggcagctgatccaagtaattcgtgctctcgatagggatgaagttgggaatagttcccacgtctcattccagggcccactggggcctgatgctaatttcacagtacaagataatagggatggaagtgcaagcctgctgttgccatcgagacctgcgcctcctaggcatgccccatacctcgtgcctattgaactgtgggactgggggcagcctgctttaagctcgacagccacagtgacagttagcgtgtgccggtgccagcccgacggtagtgttgcctcctgctggcccgaggcacatttaagtgccgctggcctgtccaccggtgcgttgctggccataatcacatgcgtaggtgcactgcttgctctggtggtgttgttcgttgctctccgtaggcagaaacaggaagcattaatggttctcgaagaggaggacgtccgggaaaacataataacctacgacgatgaggggggaggcgaagaggatacggaagcctttgatatcaccgcacttcagaatccagatggtgccgcacccccagcacccggaccacccgctagaagagatgtgctgccaagagcaagagtcagtaggcagccgaggcccccagggccagcagatgtcgcacaactcttggctcttagactccgggaggcggatgaagaccccggagtccccccttatgatagcgtccaggtgtacggatacgaaggcagaggctcatcatgcggatccctaagcagcctcggatctggtagcgaagcaggcggagcccctgggccagcggagcctctcgatgactgggggcctctttttaggaccttagccgaactgtatggcgctaaagaacccccagccccttag

SEQ ID NO: 48657 - DNA, 2559 bp, Artificial Sequence
  Description of Artificial Sequence: Synthetic coding sequence
atggctatgcggagtgggaggcacccatccctactcctgttactagtgctgcttctgtggttgcttcaagtcagtattattgattccgtacagcaggagaccgatgacctcactaagcagacaaaggaaaaaatctatcagcccctgcggagaagtaagcgccgatgggtaattacgacactggaattagaagaggaggatccgggtcctttcccgaaactaattggcgaactgttcaacaacatgtcatataacatgtcactgatgtacctcatctccggtccaggcgttgacgagtacccggagattggtctgttctcgcttgaagaccacgagaatggcagaatttatgtacatcgtcccgttgacagagaaatgacgccatcgttcactgtctacttcgatgttgttgagagaagtaccggcaaaattgttgacacctctctaatattcaacatcaggatatcggacgttaatgatcacgcaccccagtttcccgagaaagaattcaacatcaccgtgcaggagaaccagagcgctggtcagccaatctttcagatgcttgctgtggacctggatgaggaaaatactccaaattcacaggtcctttatttcctgatcagccaaacaccccttttgaaggaatccggatttagggtcgatcggctttcgggcgagatccggctgtcgggttgcctcgactatgaaaccgctccccagttcactctgctgatcagagcacgagattgcggcgagccttcactgtcctcaacgaccacagtgcatgtggacgtgcaggagggtaataatcaccgacctgcctttacccaggagaattataaggtgcagattcctgagggcagagcgtcacagggcgtgttgcgtctgctggttcaggacagagatagtccatttacaagtgcatggcgcgctaagtttaacatcctccatgggaacgaagagggccacttcgatatttcaaccgacccagaaacaaatgagggtatcctgaacgtgataaaacccctggattacgagacaagacctgcacaatcgctgataattgtagtggagaacgaagaacgcttggtgttttgcgagagggggaagctgcaacccccacgaaaggcggcagcctccgctactgtgtccgtccaggtcacagacgcaaatgacccacctgcctttcacccccagtcctttattgtgaacaaggaagagggcgctcgcccaggcaccctcctgggcacttttaacgccatggatcccgatagccaaatccgatatgagctggtgcacgaccctgcaaactgggtgtctgtcgacaagaactctggcgtggtgataactgttgagccaattgatagagaaagcccgcatgtgaataattcgttctatgtaataataattcatgccgtggacgatgggttccccccacaaacggcaaccgggacgctcatgctgtttttatcagacatcaacgacaacgttccgacgttgcgacccagaagcaggtacatggaggtgtgcgaatctgctgtgcacgagcctttgcacattgaggccgaggatcccgacctggaacctttctcggaccctttcaccttcgagctggacaatacatggggcaacgccgaggacacatggaaacttggcaggaactggggacaatccgtggagctcttgaccctgcgtagcctccccagagggaactacctggtcccactgttcattggagacaaacaaggcttgtctcagaaacagaccgtgcatgttcgcatctgcccctgcgcatccggtctgacctgtgtggaattggctgatgcagaggtcgggctgcatgtcggggctttgtttccagtttgcgcggctttcgtcgccctggccgtcgcgctcttgttcctgttacgctgctatttcgtcctcgaacccaaaagacatggatgctcagttagtaatgacgagggccatcagacactcgtgatgtataatgccgaatctaaaggaacatccgcgcagacatggagcgacgtggagggccagcgtcctgccctacttatttgtacagccgcagccggaccaacacaaggggttaaagcttaccctgacgcaacaatgcacagacagctcctagctcccgtggaaggtaggatggcagaaacactaaatcagagtaaagaaagaaaccgcttttccctctcacggggttgcatcatcccccaggggagagcgaccgccggtagaggactgcctcaggacatctataaagagatgatgcctcggaggctgacccagaccggaaagagaaaacatggtgccctagctaggaccccaagttttaagaaggtagtgtacgaccataaggaggacgaagaaaataaggccggacggaagcaacggtctcacttgtttaaagttatgcagctgagaaatgaacagggaggagtacgtgtacagagtgctcactcaccatcgccactgaacaagaaagcctgttttccgggagactatagaggggagagcgcgggaggacacaactgccgtgctgtcagcggttag

SEQ ID NO: 48658 - DNA, 375 bp, Artificial Sequence
  Description of Artificial Sequence: Synthetic coding sequence
atgaagcctctgatctggacctggagcgatgtggaggggcagagacccgctctattgatctgcactgctgctgctggtcccacacagggtgtcaaggcctacccagacgccaccatgcatcgtcagcttctagcccctgtggaggggcgaatggccgagacgctcaaccagaaactgcatgtggctaatgtgctcgaagatgatccgggttacctcccccacgtatattccgaagagggcgaatgtggcggtgcgccatccttgagcagtttggcaagtctggagcaggagttgcagcccgacctgttggacagtttggggagcaaagccaccccattcgaggagatatattccgaaagtggcgtaccatcctag

SEQ ID NO: 48659 - DNA, 2499 bp, Artificial Sequence
  Description of Artificial Sequence: Synthetic coding sequence
atggcaatgcgttcgggcaggcacccctcccttctcttactcctagtgctgctcttatggctgttacaagtctctatcatcgacagcgtgcagcaggagaccgacgacctgaccaagcagaccaaagagaagatttaccagcctctgcgcagaagtaaaaggcgatgggtcattactacgctggagttagaagaggaagacccaggaccctttcccaagctgattggcgaattgttcaataacatgtcatataatatgagccttatgtacctgatctcagggcctggagtggatgagtaccctgagattggcctgttttccctcgaggatcatgagaatggcaggatctacgtgcacaggccggtcgaccgtgagatgactccaagttttaccgtgtacttcgatgtggtggagagatccacaggcaagatcgtcgatacatctctgatttttaatattagaatctctgacgtgaacgatcacgctccacagtttcctgaaaaagagttcaatatcacagtccaggagaatcaaagcgctgggcagcctatttttcaaatgcttgcagtggatctggacgaagaaaacacacccaattctcaggtcctttactttctgatttcccagacaccgctgctcaaagagagtggttttcgggttgataggctgtctggggagattcggctttcaggctgccttgattatgaaacggcgcctcagttcactctcttgattcgggctcgtgactgtggcgagcccagcctgtcttccactacgaccgtgcacgttgatgtacaggagggcaataaccaccgccctgccttcacccaagaaaactataaggttcagatccctgaagggagagcctctcagggggtgctgcgcctgctggtgcaggaccgagattcaccctttacctctgcatggagagccaaatttaacatcctccacggtaacgaagagggtcactttgacataagcaccgatccagagaccaatgaaggcatcctcaatgttatcaagccgctcgattacgagacccgcccagctcagtcgctgatcatcgtggtagagaatgaggagcggttagtgttctgcgagcggggtaaactgcagcccccacgtaaggctgccgcatcggccaccgttagcgtgcaggtgacagatgccaacgaccctccggcatttcacccacagtcctttattgtaaacaaagaagagggtgcaagacccggaaccctgctcggaacctttaacgccatggaccccgattctcagatccgatacgagcttgtgcatgacccagcgaactgggtatccgtggataagaattccggcgtggtaattaccgtagaacctatcgaccgggaaagcccccacgtgaacaactcattttacgtaatcatcatccatgctgtggacgacggttttccccctcagactgcaacagggaccctgatgctgtttctgtccgatattaatgataatgtgccgacactccggccaagaagtcgttacatggaagtctgtgagtcagccgtgcatgaacccctgcatatcgaggctgaagacccggacctggaacctttcagcgatccattcacctttgaattagataacacctgggggaacgccgaggatacctggaagctgggccgtaactggggtcagagcgtggaactgcttactctcagatccctccctcggggaaactatctggtccctctcttcatcggcgacaaacaaggcctgagccagaagcagacagtgcatgtcaggatatgcccatgtgcgtccggtttgacctgcgtggaattagccgacgccgaagttgggctgcacgtcggagctctgttccccgtgtgcgcagcctttgtggccctcgcggttgctctcctattcctattgaggtgctacttcgtcctggagcccaaacgccatggttgttccgtgtccaatgatgagggacaccagacactggttatgtataacgccgagagtaaagggacatccgcccagacatggtctgacgtggaaggccagcggcctgcactgctaatctgcacagccgcagccggacctacccagggtgtgaaggacctcgaagaggtgccaccttcggctgcctctcagtccgcccaggccagatgcgcgttggggagttggggctacggcaaacccttcgagcccagatctgtcaagaacattcatagtactccggcttaccctgatgcgacgatgcacagacagctcctggcacctgtagaaggccgaatggctgaaaccctcaaccagaaactgcatgttgctaacgtcctggaggatgaccctggttatctcccgcatgtctattccgaggagggtgagtgcggtggagctccttccctctcttcactcgcttccctcgagcaggagctccagcccgatctcctcgattcactcggcagcaaggccacaccatttgaggagatttactctgaatcaggcgtgccctcatag

SEQ ID NO: 48660 - DNA, 498 bp, Artificial Sequence
  Description of Artificial Sequence: Synthetic coding sequence
atgaaaccactcatttggacctggtccgatgtggagggtcaaagaccagcgctcctgatctgcacagccgctgccggacccacacagggtgtaaaggatttagaggaggttcccccaagtgccgcttctcagagcgctcaggcgagatgcgcgctgggaagttgggggtacgggaaaccctttgaacctagatctgtgaaaaatattcattccacccccgcttatcccgacgccacgatgcatcgacagctactggccccagtggaaggaaggatggccgagacgctcaaccaaaaacttcatgtcgccaatgtgttggaagacgatcctgggtatttacctcatgtgtacagcgaagaaggcgaatgcgggggtgcaccatccttgtcctctctggctagcctcgaacaagagcttcagcctgacctgcttgattcactggggagcaaggctactccgttcgaagaaatatattcagagtcaggtgtccccagctag

SEQ ID NO: 48661 - DNA, 1335 bp, Artificial Sequence
  Description of Artificial Sequence: Synthetic coding sequence
tgacgacccggaacgctgctcgggacctttaacgctatggatccagattcccagattaggtatgagctggtccatgaccccgctaattgggtgtctgtagataagaacagtggagtggttattacagtagagcccatcgatcgcgagagccctcacgtgaataacagtttctacgttattataatccacgccgttgacgatggcttccctccacagaccgccaccgggacactgatgctgtttttgtccgacattaacgacaacgtgcctactttaagacctagaagtagatacatggaagtttgcgagagcgcggtgcacgagccacttcacatagaggcggaagatcctgatctcgaaccctttagtgacccctttactttcgagttagacaatacttggggcaatgctgaagacacttggaaactgggaagaaattggggtcagagtgtagagctactcactctccgtagcttacctcgtggcaactatttggtacctctcttcatcggagataagcagggcttgtctcagaagcagacggtgcatgtccgtatttgtccctgtgcaagcggcttgacttgtgtggagctggcggacgcagaggttggcctgcacgtgggagccctattccctgtttgcgcggctttcgttgccctggcagtcgctctgctgttcctcctgagatgctatttcgtactagaaccaaaacgacacgggtgttccgtgagcaatgatgaaggacaccagactctggttatgtacaatgctgagagtaaggggacttccgctcaaacttggagtgatgtggaaggtcagaggcccgctctgctaatatgcacagccgcagccggacctacgcagggagtcaaagcttatcccgatgcaactatgcatcgtcagcttctggcccctgtggaggggaggatggctgagactctgaatcagtctaaggaacgcaatcgctttagcctctctagaggctgcattatcccacagggtcgggcaactgcgggacggggactcccccaggacatttataaagagatgatgccacgaaggctgacccagactggcaagcgcaaacacggtgcactcgccagaaccccttcttttaaaaaggtggtgtacgaccacaaggaagacgaggagaataaggctggacgcaagcagcgcagccacctcttcaaggtgatgcagctgcgcaatgaacaggggggagtccgggtgcagtccgcccacagccccagcccacttaataagaaagcttgctttcccggtgactataggggtgaatccgcaggcggacataactgtagggccgtgagtggttag

SEQ ID NO: 48662 - DNA, 3933 bp, Artificial Sequence
  Description of Artificial Sequence: Synthetic coding sequence
atggctcaactatggctctcctgctttcttctcccagcccttgtggtcagcgtcgccgctaacgtagccccaaaattcttagctaacatgacctccgttatcctcccagaagacctgcctgtgggtgcacaggcattctggctggttgccgaagatcaggataacgatcctctgacctatggtatgagcgggcctaacgcctatttcttcgccgtcactccgaaaactggcgaggttaagctggcttccgccctcgattacgagacattatacactttcaaagtgaccatatcggtatcagacccctatatccaagtgcagagggagatgctcgtgatcgtggaggaccgcaatgacaacgcgccagtctttcagaatactgctttcagcacctctattaacgagacactgcccgttggctctgttgtcttctctgtcctggccgtggacaaagacatgggctccgctggaatggttgtgtacagtattgaaaaagtcattccgagcaccggcgactccgagcacctgtttaggattctcgccaatggatccatcgtattgaacggaagtctgtcttacaacaacaagtccgccttttaccagctggagcttaaagcctgcgatctcggcggaatgtaccataacactttcactatacagtgttctctgcccgttttcctctctatctctgtagttgaccaacctgatctcgatccccaatttgtgcgcgagttctactccgctagcgtggctgaagatgctgctaaggggacctccgtactaactgtagaagcagttgatggcgacaaaggtattaatgaccccgtcatatatagcatcagctattcgaccaggcccggatggttcgacataggcgcagacggcgtgattagagttaatggctcgctggatagggagcagctcctcgaggcagacgaagaggtccaattacaggttactgctacagagacacacttgaacatctacggccaagaggcaaaagtgtccatctgggtaacagtgcgagtgatggacgtcaatgatcataagcccgagttttataactgctctttacctgcttgcacgttcacccctgaagaagcacaggtcaattttaccgggtatgtggacgagcatgccagcccgcgtatccctatcgacgacctgaccatggttgtgtacgatcctgacaaaggcagtaacggcactttcctactatctttgggaggcccagatgccgaagctttctcagtaagccccgagagagcagtaggatctgcttccgttcaggtgctggtccgtgtctcagcacttgtagattacgaacgacagaccgccatggccgttcaggtggtggccacggacagcgttagtcagaattttagtgtggccatggtgaccatccatctgcgggacattaatgaccatcgcccaacattccctcaatccctttatgtgctgaccgtgccagagcatagcgctactggttccgtcgtcaccgatagcatccatgccaccgatcccgacactggcgcatgggggcagattacatactctctgctgcccggaaatggagcagatctgttccaggtggatccggtcagtggaaccgtgacagtccgaaacggcgagctgctcgatagggagagtcaggccgtctactacctgaccctccaggctactgatggcggaaacctaagtagtagcacaacactgcaaatccacctactggatatcaatgataatgcaccagtcgtaagcggctcctacaacatattcgtgcaggaagaagaaggaaatgtttcagtcacaattcaagcccacgacaatgatgagccaggtactaacaattcccgtctgcttttcaatctattaccgggaccctacagccataacttcagcctcgatcccgatactgggctcttaagaaatttgggcccactggatagggaagcaattgatcctgcccttgagggccgaatcgttctcactgttctggtctcagactgcggggagcctgttctgggcacaaaagtgaacgtcactatcaccgtggaagatatcaacgacaacctccccatctttaatcagagttcatataacttcactgttaaggaggaggaccctggcgtgctggtcggagtagtaaaagcctgggacgccgaccaaaccgaagctaataatcggatcagcttcagcctctcggggtccggcgcaaactacttcatgataagggggctggtcctgggggcagggtgggcagagggctatctcaggttgcctcccgatgtgagcctggactacgagactcaacccgtgtttaacttgacagtgtctgccgaaaatccagacccccagggcggagagaccatagtggatgtgtgcgtgaatgttaaggacgttaacgataacccaccaacccttgatgtggcctcgctcaggggtatcagggtggcagagaacggcagtcagcacggccaggtcgccgttgtcgtcgcttccgatgtggacaccagtgcgcagctggagatacaactggtaaatatactctgcaccaaggctggcgtggatgtcggtagtttgtgttggggctggtttagcgtagccgcaaacggcagtgtgtacataaatcaatccaaagcaatagattacgaggcatgcgacctcgtcacactagtggtgcgagcctgcgatttagccaccgatcccggattccaggcctactctaacaacggctcactgttgatcacaatcgaagacgtaaacgacaatgccccttatttcttgccagagaataaaaccttcgtgataattccagaactggtgcttcccaatagagaagtggcttcagtgagagccagggatgacgactcaggcaataatggagtcatactgtttagcatcctacgggtggactttatttccaaggacggagctacaatcccttttcaaggggtcttttcaatcttcaccagttcagaagctgatgtgtttgcagggtcaatccaacctgtcaccagccttgattctactttacaaggtacttatcaggttactgtgcaggcacgcgatagaccgagtttgggtcctttcttagaggccactacgaccctgaatctttttacagtggatcagtcatacaggagccgattacagttttcgacgcctaaggaggaggtcggagccaatagacaggctattaacgctgcactcactcaagcaactaggaccacagtttacattgtagatattcaagatatagattctgcagccagagcgaggccacactcctatctggacgcgtattttgtgttcccaaacgggtctgcactgaccctggacgaacttagcgtcatgattagaaacgatcaggattccctaacacagctccttcagcttggcctggtggtgctgggctcgcaggaaagtcaggagtccgacctgtccaaacagttgatatcagtgataattggactgggagtcgccctgttgttggtgttggtgatcatgacaatggcattcgtttgtgtgaggaagagttataatcggaagcttcaggccatgaaggccgcaaaagaggcgcgtaaaacagccgcaggagtcatgccctcggccccagcaatccccggaaccaatatgtacaataccgaacgggctaatcctatgttgaatttaccaaacaaagacctggggttggaatacttgtccccatccaacgaccttgatagtgtgtctgtgaactccctggatgacaatagtgtggacgtggataaaaattcgcaagaaatcaaggaacacaggccccctcacactccccctgagcccgacccggagcccttgagtgtcgtgttgctcggtcgacaggccggtgccagtggacagctagaaggcccttcatacacaaatgccggattagacacgaccgacctctag

SEQ ID NO: 48663 - DNA, 3933 bp, Artificial Sequence
  Description of Artificial Sequence: Synthetic coding sequence
atggcccagctgtggctgagctgcttcttgctgcccgctcttgttgtaagcgtcgctgcaaatgtggcccctaagttcctggctaatatgacctcagtcattctcccagaggatctccccgtcggggctcaggccttttggctggtcgccgaggaccaggacaatgatcccctgacatatggtatgtcaggccctaatgcatatttcttcgctgtgacgccaaagactggcgaggtgaagctggcttctgctcttgactatgagaccctctatactttcaaggtgacaattagtgtttccgacccttacatccaggtccagcgagagatgctcgtgatcgtagaagaccgtaacgacaacgcaccagtgttccaaaacacagctttctccacgagtatcaatgagactctccccgtgggaagtgtggtcttctccgtgttggcagtggataaggacatggggagtgcagggatggtagtgtattccattgagaaggttatcccctctacaggggactcagaacacctgtttaggatcctagctaatgggtctatcgtcctcaacgggagcctgtcttacaataacaagagcgcattttaccagcttgaactcaaagcatgtgatctaggtggcatgtaccacaatacatttaccattcagtgtagcttacctgtctttctcagtataagtgtcgtggaccaaccggatttggatccgcagttcgttagagaattctatagcgccagcgtagcggaggatgctgccaaagggacatcagtgttgacagtcgaggccgtggatggagataagggtattaatgatcccgtaatctattcaatctcctactccacccggccagggtggttcgatatcggcgcagacggggtgatccgtgtgaatggaagccttgatcgtgagcagctcctcgaagcagatgaggaggtccagctgcaagtaacagccacagagacccaccttaacatctacggccaggaggccaaagtttcaatctgggtaactgtgagagtgatggacgtgaacgaccacaagccggagttttacaattgcagcctcccagcctgtacatttacaccggaagaagcgcaggtgaactttacaggatacgtggatgagcatgccagccctcgcatccccattgacgatctaaccatggtggtctacgatcccgataaggggagtaatggtacattcctgttaagcctcggcggacctgatgccgaggcattctcggtgtctcccgagcgggctgtgggctctgcctccgtccaggtgctggtaagagtgagtgccctggtggactacgagcgtcagactgcaatggctgtacaggtcgtggccacagactctgtaagtcaaaatttttccgtggctatggtcacaattcatctgagagacataaatgaccataggcctacctttccccagtcattgtacgtcctaaccgtaccagagcattcggcaaccggctcagtggtgaccgacagtatccacgcaactgatccagacacaggcgcatgggggcagatcacctatagcttactgcctgggaatggggcagatctctttcaggttgaccccgtgtctgggacagtcactgttaggaacggcgagctgttggacagggagagccaagctgtttactacctgacgctgcaggccaccgacgggggtaacttgtcttcctccaccaccttgcagatccacctgctggacattaatgacaatgctccagtcgtgtcagggagttataatatcttcgtgcaggaggaggaaggaaatgtaagtgtgactattcaagcacatgacaatgacgaacccggaacaaacaattcccgcctgttgtttaatttactgcctggcccttatagccacaactttagcctggacccagacactggactgcttcggaatctcggacctttggatcgggaagctatcgacccagctctggagggtaggatcgtgctaacggttctggtatccgattgtggggagcctgtgcttggcacaaaggtaaatgtgacaattacagtcgaggacatcaacgacaaccttcccatcttcaaccagtcttcatataacttcacagtcaaggaggaggaccccggtgttctggtgggcgtcgttaaggcctgggacgccgaccagacagaggctaacaatagaatcagttttagtctgtctggaagcggagctaactattttatgattcggggactggtcctgggtgcaggctgggctgaagggtacctgcgcctgcctcctgacgttagtctggattacgagacacagccagtatttaatctaactgtgagtgctgagaatcccgatccacaggggggagagactatcgtggatgtctgtgtgaacgtgaaagacgtgaacgacaatcccccaaccctggatgttgcgtcactccgaggcatacgtgttgcagagaatggctctcagcacggccaagtggcggtggtggtcgcctctgacgtcgacaccagcgctcagttggaaatccaattagtgaacatcctctgcactaaggccggagtagatgtcggctctctttgctggggttggttctccgtggccgctaatgggagtgtctacattaaccagagcaaagctatcgattacgaggcctgtgatctggtgactcttgtggtgcgcgcttgcgacttggctaccgatcctggcttccaggcctactcaaacaacgggtctcttctcataacaatcgaggatgttaatgacaatgcaccttatttcctgccagaaaacaagactttcgtgattattcccgagctcgtcctgccaaaccgggaagtggcgtccgtgcgcgctagagatgacgactccgggaataacggtgtgatattgtttagtatcctccgggtggatttcatatcgaaagatggtgcaacaattccatttcaaggcgtcttcagtatttttacctcgagcgaagccgacgtgtttgcgggtagcattcaacctgtcaccagccttgactcaacgctacagggaacataccaagtgactgtgcaggcaagggaccgcccatcactgggcccattcctggaagcaacaacaaccctgaacctattcacagtagatcagtcttatagatcccggctccagttttctactccaaaggaggaggtgggcgctaacaggcaggctatcaatgcagccctgacccaggctacgcgtactactgtgtacatcgtcgatatacaggacatagatagcgccgcacgcgcaagacctcattcgtatctagatgcatactttgtgtttcctaatgggtcagccttgaccctcgatgaactcagcgtcatgatcaggaacgatcaggatagcctgacccagctgctgcaactgggcttggtagtgttaggatctcaagaatctcaggaatctgatctgtctaaacagctgattagcgtgataattgggctcggcgtggcattgttgctggtgctggtgataatgacaatggcgtttgtttgtgtccgaaagtcgtacaacaggaaactgcaggccatgaaagcagctaaagaggcacggaaaaccgctgctggggttatgccctcagccccagctatacccggtacgaacatgtataacacagaaagagccaacccgatgttgaacctgcccaacaaagacttgggtttggagtatttgtccccatctaacgatctggacagcgtttctgtgaatagtctcgacgacaattcagtggacgttgataaaaatagtcaggagattaaagagcaccggcctccccatacgcctcctgagccggatcccgaacctttatcggtggtgctgctggggagacaagctggggcttcagggcagttggaggggccatcatatacaaacgcgggactcgatacgacggatctctag

SEQ ID NO: 48664 - DNA, 3933 bp, Artificial Sequence
  Description of Artificial Sequence: Synthetic coding sequence
atggcacagctgtggctgagttgctttcttcttcctgcccttgtggtgtcagtggcagctaatgtagcacctaaatttctcgccaatatgacaagtgtcattctgccggaggacctgcccgtgggagctcaggccttctggctggtggctgaggaccaggataacgaccctctgacatacggtatgtctggcccaaacgcatatttcttcgccgtgactcctaagactggagaggtaaagctggcaagtgcactcgactacgaaactctttacacctttaaagtgacaattagcgtgagcgacccctacattcaagtgcaaagagagatgcttgtgatcgtggaggatcgcaatgataacgcccctgttttccagaacactgcatttagcaccagcatcaatgaaaccctgcccgtagggagtgttgtgttcagcgtgttggccgtcgacaaggacatggggagtgcaggaatggtggtctatagcatcgaaaaggtcattccctcaaccggggactccgagcacctgttcaggattctcgcgaacggaagcattgtcctgaacggttccctctcctataataataagagtgctttttatcaactggaactaaaggcatgtgacctggggggaatgtaccacaacaccttcacaatccagtgtagtcttcccgtgttccttagcatctccgtcgtggatcaacctgatttggaccctcagttcgtgcgagagttttattcagcaagcgtggccgaagacgctgccaagggcaccagtgtcctgacagttgaagcagtcgatggcgacaaggggattaacgaccccgtcatttatagcatctcctacagtacacggcctggatggtttgatatcggggctgacggagtgatccgggtcaacgggtccctggatagggagcagttattggaggcggatgaagaagtccagcttcaggtaactgctacagagactcatctgaacatttacgggcaggaagctaaggttagcatctgggtaaccgttcgggtgatggacgtgaatgaccacaagccggaattttataactgttctctgccagcctgtactttcacccccgaagaagctcaggtgaacttcacaggctatgtagacgagcatgcttctcccaggattcccattgacgatctgaccatggttgtgtacgacccagataaaggttcaaacggaacttttcttctgagtctgggtggccctgacgctgaagctttctccgtgtctccagagcgggcagttggtagtgcaagcgtgcaggtattggttcgcgtgtcggccctggtcgactacgagcgccaaacagcaatggcggtccaagtagtcgccaccgacagcgtgtcccaaaactttagcgttgcaatggtgaccatacatcttagagacatcaatgaccatagacctacctttccccagagtctttatgtgttaacagttcctgaacattcagccactggctctgtggtgaccgactcgatccacgctacagacccagacaccggggcatggggtcagatcacatactctttgctgcccggaaacggtgccgatctgttccaggtggacccagtgtctggcactgtgaccgtgcggaatggagaactgttagatagggagtcccaggcagtgtactacctaaccttgcaggcaaccgatggcggtaacctcagttccagcacaaccctccagattcatctgttagatattaacgacaacgccccagtcgtatcgggctcctataacatttttgtgcaggaagaagaaggcaacgtttccgttacaatccaggcacatgacaatgatgagccaggcacgaacaatagcagactgctctttaaccttctcccgggaccctactctcataatttctcactggaccccgacactgggttacttcgtaatctcggacctctcgacagagaagctatagatcccgctcttgagggcagaatagtacttacagtgctagttagcgattgcggggagcccgtcctgggcacaaaagtgaatgtcactatcacagtcgaagatatcaacgataatctgcccattttcaaccagagtagctataactttacggtaaaggaggaggacccaggggtattagtgggcgtggtgaaggcatgggatgccgaccagacagaggctaataaccgtatctctttctccttaagtgggtctggagccaattattttatgataagaggacttgtgttgggggcagggtgggccgaggggtacctgcggctccccccagacgtgtctctggattacgagacacagcctgtgttcaatctgaccgtctccgcggaaaatcccgacccccagggaggcgaaactatagtggacgtgtgcgttaacgtgaaggatgtgaatgacaatcctcctactctggatgtggcctccctccgcggtatacgcgtggctgagaacggtagccaacatggccaggtcgcagtggttgtcgctagtgacgtggataccagcgctcaactcgaaatccaactggttaatattttgtgcactaaagcgggagtcgacgtaggtagtctgtgttggggctggtttagcgtggccgctaatggctctgtatacataaatcaatctaaagccatcgattatgaagcctgtgacctggtcactctggtcgtgagggcatgcgacctcgctaccgatcctggattccaggcttactcaaacaacggctcactcctgataacgatcgaagacgtgaacgacaatgccccttattttctcccggaaaacaaaacttttgtaattataccggagttagttctgcctaatcgcgaagtggcctcagtgcgggctcgtgatgatgactccggcaataatggcgtgattctttttagtattctgcgcgtagacttcatctcaaaggacggagcgacaatcccctttcaaggggtgtttagtattttcaccagcagcgaggccgatgtgttcgccggaagcatccagcccgtgacttccctggactccacactacagggaacttatcaggtgactgtacaggcccgagaccgacccagccttggcccttttctggaggccacaacaactctcaacctttttactgtggaccagagctacagaagccgtctgcagtttagcacacccaaggaggaggtgggggctaaccgtcaggcgattaatgccgctttaacacaggcaactcgtaccacggtttacattgtcgatatccaggacatagactctgctgctagggcacggccacacagctatcttgatgcttatttcgttttcccaaacgggagcgccctgactctggatgaactgtccgtcatgatcaggaatgatcaggactccctgacacagctcctccagctgggcctggtggtgctaggctcgcaagaatcacaggagtcagatctcagcaagcagctcataagcgtgataataggtctcggggttgctttgctcttagtccttgtcattatgaccatggcttttgtgtgcgtccgaaagtcctataatagaaagcttcaggcaatgaaagccgcaaaggaagcgcgaaaaaccgcagcaggtgttatgccttcagcacccgcaatccctgggacaaacatgtacaatacagagcgagcgaacccaatgctcaatctgccaaacaaagacctgggcctcgaatatctatcgccgagtaacgatctggactcagtgtcggtgaattccctggacgataatagtgttgacgtggacaaaaactcccaagagatcaaggaacacaggccacctcacaccccccctgagccggatcctgaaccactgtcagttgttctgctgggcagacaggcaggggcttctgggcaactggaggggcctagctatacaaacgctgggctagataccaccgacctgtag

SEQ ID NO: 48665 - DNA, 2658 bp, Artificial Sequence
  Description of Artificial Sequence: Synthetic coding sequence
atgcaggaggcaatcattctcttggctctcctgggtgccatgtctggcggtgaagctctccatctgatcctgttgcccgcaacaggcaacgtcgcggagaacagtccgcctggcacctctgtgcataaattctctgtaaaactttctgccagtctgtctcccgtcattccaggcttcccacaaatcgtgaattctaacccactgaccgaggcctttagggtcaactggctgtctgggacatattttgaggtggtcaccaccggtatggagcagctggacttcgagacaggcccaaacatcttcgatctgcagatatatgtgaaggacgaggtcggggtcacagatcttcaggtgctcactgtgcaagttaccgatgtgaacgaacctcctcaatttcaggggaacctggccgaaggcctgcatctttatatagtggagagggccaaccccggtttcatctaccaggtcgaagcgttcgatcctgaggatacgtctcgtaacatcccactctcttattttctgatctcacctccaaagtccttcaggatgagcgcgaacggtacgctcttttctactaccgagctagattttgaggctggccatcgtagcttccaccttatcgtggaagtcagagattctggtggcctgaaagcatctacagagttgcaagtgaacatcgtcaacctgaacgacgaggtgccacgctttaccagccccacccgcgtgtatacagtgctggaagagctgtcccctggaacgattgtcgctaatatcacagccgaagatcctgacgacgaaggcttcccgtcacatctgctgtacagtattacaaccgtgtctaaatatttcatgatcaatcagcttaccggcactattcaggttgcacagagaatagaccgcgatgctggagagttacggcagaaccccacaatttcactggaagtgctggtgaaagataggccctacggtggacaggagaatcgcatccaaatcacatttatcgtggaagacgtgaacgacaatcccgcaacttgtcaaaaattcaccttcagtatcatggtgccagagagaactgcaaaaggcaccctactgctggacctcaataagttctgttttgacgatgattcagaggccccaaataatcggtttaattttaccatgccgtcaggcgtgggcagtggttcacgatttctgcaggatccagcaggttcaggaaagatcgtgttgatcggagacctggattatgaaaaccctagcaatttagccgctggtaacaagtacactgtgataatccaggtacaggatgtggcacccccatattataagaataacgtttacgtatacatccttacctcgcctgagaatgagtttcctctcatttttgatcgcccaagctacgtgtttgacgtttccgaacgcaggcctgctaggacacgtgtggggcaggtgcgggctaccgacaaggacttaccacaatcctctcttctctatagcatttctacaggtggggcttccctacagtaccccaacgttttctggataaaccccaagacaggcgaattgcaactggttacaaaagtggactgcgagacgacacctatctacatcttaaggatacaggccacaaataacgaggataccagttctgtcactgttacggtcaatatcttagaagaaaacgacgaaaaacccatatgtacacctaattcatattttctggccctcccggttgatttaaaagtgggtaccaatattcagaacttcaagctgacctgcacggacctggattcctcaccaagatcctttcggtactctattggcccagggaacgttaataatcacttcacatttagtccaaacgctggatccaacgtgaccaggctgctgctaacgtcacgctttgactatgctgggggatttgacaagatatgggattacaagctgctggtttatgttaccgacgataatctcatgagtgacaggaaaaaggccgaggccttagtggagaccggcactgtgaccctgagcatcaaggtgatcccccatcctaccaccatcatcactacaactccaagaccacgcgttacttatcaggtgctcagaaaaaatgtgtactctccaagcgcctggtacgtaccattcgtcattacccttggatccatcctcttactagggcttctggtctacctggtagttctgttggccaaagctatccacaggcattgcccctgcaagacaggaaagaacaaagaacctctgaccaagaagggggaaaccaaaacagccgagcgtgatgtggttgtagagacgatccagatgaatacgatattcgacggcgaagcaatcgatcctgtaacgggcgagacttatgagttcaattccaaaactggagcacggaaatggaaggaccctctgacacagatgcccaagtggaaagaaagctcccaccaaggtgccgctccccgacgcgtaactgcaggagaggggatgggctccctgagatctgcgaactgggaagaagatgaactatctggaaaagcctgggctgaagatgccggactgggaagccggaacgagggcggtaaactgggaaatccaaaaaatcgtaaccctgccttcatgaatagggcataccctaagccccatccaggcaagtag

SEQ ID NO: 48666 - DNA, 600 bp, Artificial Sequence
  Description of Artificial Sequence: Synthetic coding sequence
atggtgctgctgcgcctgctcgtttttctgttcgcacccgtggtctccgatctgtgttcattaccttgttttatcaacgtctctgagtctcagggcccaggaacggtgctccagtttttgtccttcaattgttcttcgtacacacccacgcctaccctagagctgctgaatgtgcaaccacctacgacattttttaaccctccctccctggccagatggcaggggacctatgtgggcaagctcaccctgagtagcagcgcacagctggacgccctcatggtgaaccactacaaagtgcagctcaagttcacctgcgggaaccacgtgatggaggggagtttgtccgtcgatgttcagcgcgatctgtcacatattcagtgcgcgggtcagtttgcgtccccaggagaggctcggggatcaagacagggcggtgggagacatggactgagtaggtcttctctgacttccactcttgcaagctggggaaatgactccggagccagggacagccatacctgggggagtgcagtgcattcagctccccctaggccacgcacccccaggtccgctgggaaacccagaacctgggatggtggatag

SEQ ID NO: 48667 - DNA, 2367 bp, Artificial Sequence
  Description of Artificial Sequence: Synthetic coding sequence
atggttctgctgcgactgctcgtctttctgttcgcgccagtggtgtctgacttgtgctccttgccctgttttataaatgtgtcagaaagccagggtcctggcacagtgctgcagtttctgtcctttaactgcagtagctatacaccaacaccaacgctggagctgctgaatgtgcagccacccacgactttcttcaatcccccttcacttgcacgatggcagggcacatatgtgggcaagttgactctgtccagctccgcccagctcgatgccctaatggtgaatcactataaggtgcagctgaagttcacctgcggtaatcacgtgatggagggatctctctcagtagacgtccagagggacctctcccatattcagtgtgccggacagttcgctagccctgccggagagatgatccaggtgcccgagactgtgactcctggcgctcgcctatatactttgctcctgcctgggcttgagctgcatggcgctcaaatgtcaattatcagtgcccaggacctcccgcacttccctggacccttctctatcaacgaacaaggctggctacaagccccaagccaagggttgctcggtcaggcccagaaagtcttccagctgcagatttcagtgagcttcggccagagacagtcatgtcagggaatggtgattgtgaaggtgcttccagtgcccagctcacaggtgtcatttttggagcaggcccagaatatcacaataccagagaatctcgcgccaggatccgaggttgtccaggtgcaggccaggggtgtcgatctccgatatgagatattgtcacctgttccatcccccttattctcaataggaagggccgatggagtggttcgcactaccactccacttgagctcgcgagaacctctggcactgcagttagcagacttcaagttaaggcctttgagcaggggcaactgtgggcctctgctaagctgaaccttacaatgaacgtgcagttggttaatttgtggccacctaggtgcctgcccgctctgctggttagccagatcccagaaacggccccagtgggcacagtgcttaacactctgacatgtgaggaccctgattccgtgggagccactctcgattacaaactgtggtttcgcagctcctccaaccccgcttcactatgtctgtatgatcgtgtgttggaagtcaacgccactctggactgcgatactccaggtgcctgcttccagcacgccgcttccattcttgtgctcgacggaggacagccccagatgactactgaagtacctgtgctcgtgatggtaactcctattaacgagttctctcccgcttgtgcaccaaggaccttccgcgtgcaggaagacgctgcaccacacacgttactcggatcagtggtcggtacagacatggattatccccatgacaatatagaatactacacttctggaggtccgaccactttcgcggtggatcgcctatccggagaagttcaccttctgggccctctagactatgaacagcaacggctgtatcgcctgactgtcctggtcatcgatcacggtcaggaccagaatcctaatcaccacttaagcgggtcatgcactatcacgattgaagtcgaagatgtaaatgaccatgccccagagtgcgaaccacccttccaggaactgaccatctacgccccactgggccgatcggtggaagtgactaagatgtcatgccagatcccccaggaacctcagcgcctcatctatagctactcaatcgttggaggaaattcacaaaatcgctttatcctacagggagcaatattggtgcatagcgatcttgtgctcgggccattttggcccgagcagcctagaacttacgagttgctgatttgcgtggcggacgcaggcccttccacgccccacctgagcacaaccgccaccatcatagttcacttggtcccgagacgcgcatcaaccgttgccacctccacccatcgaaccactgttccatcaacaatgacacccatgcttgtgactgatactgaagccttctggcagccgcagccctggttcgttgtggttcttactgcaacaggggctcttctattgctggcactgggatggctgctgggccgattactccagggtctggcccaacttttgcaggccccatcaaaacctgcccaggcactgctcttaaacagcattcagggtacagaaggatctatcgagggcttcctcgaagcaccaaaaatggagatgagtcaagcccctagttccgtaatgtcactgcactttgacggcagggctcaagatagcagaactggcagggattatctctttaacacgcacactggcgctcgccgttggttgtag

SEQ ID NO: 48668 - DNA, 684 bp, Artificial Sequence
  Description of Artificial Sequence: Synthetic coding sequence
atgggcaactgcgtcaaatatccactcaggaatctgagcagaaagatgtgccaggaggagcagacgtcatatatggtcgtgcagacatcagaagaaggcctcgcggctgacgctgagctgcctggacctctcttgatgctggcacaaaactgcgcagttatgcataatcttctgggcccagcttgtatattcctgcggaagggcttcgctgagaaccgccaaccagatcgtagcttgcggccagaggagatcgaggaactccgggaggcctttagagaattcgacaaggataaagacggctatatcaactgcagagatctgggcaattgtatgcgcacgatgggatatatgcctaccgagatggagttgatcgaactgtctcagcagataaacatgaatttgggagggcatgttgacttcgacgacttcgtcgagctgatgggcccaaaattactagccgaaaccgccgatatgatcggagtgaaagaacttcgcgacgcattcagggagttcgatactaatggcgatggagaaatctccacgtctgaattgagggaggccatgcggaagctgctgggccatcaagtggggcatagagacattgaggagattatccgtgatgtcgacctgaatggggacggaagagtagacttcgaggagttcgtgagaatgatgtctcgctag

SEQ ID NO: 48669 - DNA, 1113 bp, Artificial Sequence
  Description of Artificial Sequence: Synthetic coding sequence
atgggaggaggcgacggagcagccttcaagcgacccggtgatggggctcgactgcagcgtgtgcttggcttagggtcacggagggagcctcgaagtcttcccgctggcggaccagcccctcgcagaacagctccacctcctccgggtcacgcctctgcagggcctgccgcaatgagtagtcacattgctaaaagcgagagcaagacctcgcttctgaaagccgcagccgctgcagctagcggagggtccagagctccgaggcacggacctgcgagggaccctggactcccgtccagacgactgccaggcagttgtccagctaccccgcagtctagcggagacccctcatcccgaagacctctgtgcagacctgcccctcgcgaggagggagctcgtgggtctcagagagtgctacctcaggcacactgtcgaccgcgagaggcactacccgctgcagccagtaggccttccccatctagcccgctacccccagccagaggcagggacggtgaagaaaggggtctgtctccagcgctcgggctcagaggaagccttagggcacgtggcagaggcgactctgtccccgcagccgctagtgaggcggatccgtttctgcataggctcaggcccatgctttcctcggccttcggccaggaccggtctctgcgccctgaagagatagaagagcttcgtgaagccttcagggagttcgacaaggataaggacggctacatcaactgcagggatttggggaattgcatgcgcacaatgggctatatgcctacagaaatggaactgatcgagctgagccaacagatcaatatgaatcttggtggtcacgtcgatttcgacgatttcgtggagttgatgggcccaaaactcctagccgaaactgccgacatgatcggcgtcaaggagctccgggacgcgttccgtgaattcgacaccaatggagatggtgagattagtacgagtgaacttcgggaggccatgcgcaaactgctcggccatcaggttggtcaccgagatatcgaagagatcattcgggatgtggatttgaatggagacggacgcgtggacttcgaggaatttgtgcgtatgatgtcacgttag

SEQ ID NO: 48670 - DNA, 504 bp, Artificial Sequence
  Description of Artificial Sequence: Synthetic coding sequence
atggggaattgcgttaagtatcctctgagaaacctgtcacgcaaggaccggagtctgcgtcctgaggagatcgaagaactgcgggaggcgtttcgcgagtttgacaaggacaaagacgggtacataaactgccgggacctcggaaattgtatgcgcacaatggggtacatgccaaccgaaatggagctgatcgaactatcccagcagatcaacatgaacctgggtggtcatgtggattttgatgatttcgtggaactgatgggccctaagttgcttgctgagacagctgatatgattggagtcaaggaacttagggatgcgttccgtgaattcgataccaacggagacggggagattagcactagcgagctgcgggaagcaatgcgcaaattgcttgggcaccaggtggggcacagagacatcgaggagattattagagacgtggatctaaatggggacgggagagtggactttgaagaatttgtgcgaatgatgtcacggtag

SEQ ID NO: 48671 - DNA, 1266 bp, Artificial Sequence
  Description of Artificial Sequence: Synthetic coding sequence
atggtggagatgctgcccactgcaattctcctggtgttggcagtgtccgtggtcgctaaagataacgctacctgcgatggaccctgcgggcttcgctttcgtcagaacccacagggcggagtacggattgtcggcggtaaggccgcacagcatggggcttggccctggatggtgagtctgcagatttttacatacaatagccaccgctatcatacatgtggtggctccctgcttaattctcgctgggtgctgacagccgcacattgttttgtaggaaaaaataatgtgcatgattggcgtctagttttcggcgcaaaagagatcacttacggaaataacaagccggtcaaagccccactgcaggagaggtacgttgagaagataattattcacgaaaagtacaactctgccactgaaggtaatgatatagcactggtggagataacccctccaatcagttgtggtaggtttatcggcccaggttgcctgcctcacttcaaagccggtctccccaggggaagccagtcctgctgggtggcagggtgggggtacatcgaggaaaaagcacccaggccgagcagcattctgatggaggccagagttgacctgattgacctagatctgtgcaattccacacagtggtataatggacgcgtgcaacccacaaatgtctgtgccggatatcccgtcggcaagatcgacacgtgccagggggattctggtggcccactcatgtgtaaagacagtaaagagagcgcatacgtcgtcgtcggaataacatcttggggggtgggatgcgcccgtgctaaacgacctggcatttatacagcgacctggccctacttgaattggattgcctccaagataggatccaacgccctacgcatgattcagtctgcaacaccaccacctcccacgactcgccctccacctatccgaccgcctttcagccacccaatcagtgcacatctgccctggtattttcagccgccaccaagacccctaccgccacggcctcctgcggctcaacctagacccccaccctcccccccaccgcctcctccccctcccgcttctccgttaccacctcctccaccccctcctccccctaccccctcatccactacaaaactgccacaaggactgagctttgccaagcgtctccagcagctgattgaggtgctgaaaggtaagacgtacagtgatggtaagaaccactacgacatggagactacagaattaccagagctcacaagcacaagctag

SEQ ID NO: 48672 - DNA, 3333 bp, Artificial Sequence
  Description of Artificial Sequence: Synthetic coding sequence
atggccgcagggtgcctcctggctctgactttgaccctgttccagtccttgctaatcgggccatcaagtgaagaaccgtttcccagtgccgtgactatcaagtcgtgggtagacaaaatgcaagaggaccttgttaccctggctaagacagcaagcggggtgaatcaactggtcgacatttacgagaaataccaggacctatacaccgtggagcccaacaatgcaaggcagctcgtggagatcgccgcacgggacattgagaagctgctgtcaaaccgcagtaaagccctagttcgccttgctctggaggcagagaaggtgcaggccgctcatcagtggagggaggactttgctagcaatgaagtggtttattataacgccaaagatgatctggatccagaaaaaaatgattctgagcctgggtcccagcgaatcaaaccagtgtttattgaagacgccaattttggacgccagattagctatcaacatgctgcggtgcatatacctaccgatatctatgaggggagtaccattgtactgaatgagctgaattggactagtgcgctcgacgaagtctttaagaaaaatcgtgaagaagatccaagtctcctttggcaggtgttcggcagtgccaccggcttggcacgttactatcccgcttccccgtgggtggacaattcacgaacacccaataaaatcgacctctatgacgtgagaaggagaccatggtatatccaaggagctgctagtcccaaggacatgctgatactagtcgacgtttcaggtagtgtcagtgggctcacgctgaagctgattcggacttcagtcagtgagatgctcgaaactctgtcggacgatgacttcgtgaatgtggccagctttaattctaacgcccaagacgtgagctgctttcagcatctggtccaggccaatgtgcggaacaagaaagtgcttaaggacgctgtgaacaacattaccgctaaggggataaccgattacaaaaaaggtttcagcttcgcttttgagcagttgttgaactacaatgtgagtcgcgctaattgtaataagataatcatgctctttaccgatgggggagaagagagggcccaagaaattttcaataagtataataaagataagaaggtccgtgtgtttacattctcagtgggccaacataattacgaccgtggacctatccagtggatggcatgcgaaaataagggctactattacgaaatccccagcatcggagcaatccgcatcaacacgcaggaatatctcgatgtgctgggcaggccgatggtactcgccggagacaaggcaaaacaggtacagtggacgaacgtgtacctggacgctctggaactggggctcgtgataaccggaactctccctgtgtttaatattaccggtcaattcgagaacaagacaaacctgaagaaccagctcatcttgggagttatgggtgtcgatgtcagcctcgaagatattaagcgtttgaccccccgatttaccctttgccctaatgggtattacttcgctattgaccctaatggctacgtattgctgcaccccaatctccagcctaaacctattggcgtcggtatccctacaattaacctaagaaaaagacggcctaatattcagaatccaaaatcccaggagcccgttacactcgacttcttagacgccgagctggagaatgacatcaaggtggaaattaggaataagatgatcgatggagaaagcggcgaaaaaacattccgcaccttggtcaaatcccaggatgagcggtatatcgataaaggtaacagaacatacacctggacccctgtgaatgggaccgattacagtcttgcccttgttctgcctacttacagcttctactacataaaggccaaactggaggagaccatcacacaagctcgatgtaagtactgtgaacgttccgatagcgaaacattgaaacctgacaattttgaagagtccgggtacacctttatagcacctcgggattactgtaatgaccttaaaatttcagataataatacagagttcctgcttaacttcaatgaatttatcgacaggaagaccccaaacaacccatcatgtaatgcggatctaattaacagagtcctacttgatgcaggattcacaaacgagcttgtgcagaattattggtcaaaacagaagaacataaaaggtgttaaagccaggttcgtcgtgacagatggagggatcactagagtatatcctaaggaggccggagaaaactggcaggaaaatcccgaaacttatgaggacagtttctacaagcggtccctggacaatgacaattacgtattcaccgcaccttatttcaacaagtctgggccaggcgcatacgaaagtggaatcatggtgtccaaggctgtggaaatctacattcaaggtaaactgctgaaacctgctgtcgtggggattaagatcgacgtgaactcatggatagagaacttcacgaaaacatcaatccgtgatccatgcgccggacctgtgtgtgattgcaaacgaaacagcgatgtgatggactgcgtcattctggacgacggtggcttcctactgatggccaaccacgatgactacaccaaccaaatcggacggttttttggagaaatcgacccctcactgatgagacacctagtgaatatctctgtatacgctttcaacaaaagctacgactaccaatctgtctgcgagcctggggcagcccctaaacaaggagcaggacacagatcagcctatgtcccctccgtggcagacatactgcaaataggctggtgggcgacggcagcggcttggtcaatattgcagcagttcttattgagcttgaccttcccccgtcttttagaggctgtagagatggaggacgatgatttcaccgcatccttaagcaagcagagctgtattacggagcagacgcagtactttttcgataatgattccaaatcgttttctggggttctggactgtggcaattgcagtcgtatatttcacggagaaaagctgatgaacaccaacctcatctttatcatggtagagtcaaaagggacttgcccatgtgacactcggctcttgatccaagctgagcagacatcagatggccctaatccatgcgacatggtcaagcagcctcgatacagaaaggggccagatgtttgcttcgacaacaacgtgttggaagactacactgattgtggaggcgtgtcaggcctgaacccaagcctgtggtacatcatcggcatccaattcctgttgttgtggctcgtaagtggaagtacccaccgtctgctatag

SEQ ID NO: 48673 - DNA, 3312 bp, Artificial Sequence
  Description of Artificial Sequence: Synthetic coding sequence
atggccgcaggctgtctcctagcattgactctcaccctatttcagtcactcttgattgggcctagcagcgaagaaccattcccatctgctgtgacaatcaagtcctgggtggacaagatgcaagaggaccttgtgaccctggctaaaacagcgtcaggagtgaatcaacttgtggatatttatgagaagtaccaggatttgtacaccgtggaaccaaataatgctcgacagttggtagaaattgctgccagggacatcgaaaagcttctttcaaacagaagcaaggccctggtgcgactggccctcgaggcagagaaagtacaggccgcacatcagtggagagaggactttgccagcaatgaggtggtttactacaatgccaaggatgatctggatcccgagaagaacgactccgagccaggaagtcagcggatcaaacctgtgttcattgaggacgccaattttgggcgtcagatatcataccaacatgcggcagtccacatccctaccgacatctacgagggcagtactatagtgctcaacgagttaaattggaccagtgcactagacgaggtgttcaagaagaacagggaggaagacccaagtctcctttggcaggtcttcgggtccgccaccggcttggcaaggtactaccctgcgagtccttgggtggataactcccggactccgaacaaaatcgacctatatgacgttcggaggcggccttggtacatacagggggcagcctctcccaaggatatgctcattttggtggacgtgtccggttccgtgtccggcttgacccttaagctgattcggacttcggtctctgaaatgctggagaccctgtctgacgacgattttgtgaatgtcgcttccttcaacagcaatgcccaagacgtgtcctgctttcagcatctggtgcaggccaacgtcaggaacaaaaaagtgttgaaggatgccgttaataatattacggcgaaggggatcacagattataagaagggattttcattcgcctttgagcagcttctcaattataatgtgtcccgtgccaactgtaataaaatcatcatgctctttacggacggtggcgaggaacgtgctcaggagatcttcaataagtataacaaggataaaaaggtccgggtttttacgttttcagttgggcagcataattacgacagaggcccaattcaatggatggcttgtgagaacaagggctattactacgaaatccctagtatcggagctatacgaatcaatactcaggaatacctagatgtacttggccgaccaatggtcttggcaggcgataaggcaaagcaagtccagtggacaaacgtgtatctcgatgccctggagctgggtttagtcattactggaaccctgcccgtattcaacatcaccggacaatttgagaataaaactaatctgaagaatcaactcattcttggcgtaatgggggtagacgtgtctcttgaggatattaaaagactgacccctagattcaccctgtgcccaaatggctattactttgccattgacccaaatggctacgttctcctgcatcccaaccttcagccaaaacccattggggtcggcattccaacaatcaacctccggaaaagacggccaaacatccagaatcctaagtcccaggaaccagtgacactggactttctagacgccgagctcgaaaatgacattaaggtggagatacgcaataaaatgatagatggcgaaagtggggaaaagacattccgcaccttggtaaaaagtcaagatgagaggtatatcgataaaggcaaccgaacctatacctggaccccagtgaatggaaccgactatagcctggctctcgttctacccacctactctttttactatattaaagccaaactagaggagactattacacaggcacgatactctgagactctcaaaccagataattttgaggagtccggttatactttcatcgcccctagagactactgcaacgacttgaaaatttcagataacaacacagaatttctgttgaactttaacgagtttattgaccggaaaacacctaataacccgagctgcaatgcagatctgatcaatagggtactgctggatgctggcttcaccaatgaactggttcagaactactggtccaaacaaaagaacattaaaggtgttaaggccagattcgttgtgaccgatggaggcattacacgtgtgtatcctaaggaagccggtgagaattggcaggaaaaccctgagacatacgaagacagtttctataagagatccctcgataacgacaattacgtttttactgcaccatactttaacaagtcaggccctggagcttatgagagtggaataatggtgagcaaggccgtcgagatctatatacaagggaaacttctgaagcccgcagtggtgggcattaagatcgatgtaaattcttggatcgagaatttcactaagaccagtatacgggacccatgcgcaggaccggtatgtgattgtaaaaggaactcggacgtgatggattgcgtgatacttgacgacggtgggttcctgctcatggccaatcacgatgactacacaaatcagatcgggaggttctttggagagatagatccctccctcatgcgtcatctggtaaatatcagcgtttacgcttttaacaaatcttatgactaccaatccgtgtgcgagcccggagctgcaccaaagcagggagccggacacaggtccgcttatgtgccttctgtggccgatatcctccagattggatggtgggccactgccgctgcatggtctattttgcaacagttcctcctgtccctaacgttccctcgcctgttggaggccgtggaaatggaagatgacgattttacggcctcattgtctaagcaatcatgcatcaccgaacagacccagtatttttttgacaacgattccaaatcctttagcggcgttttagattgcggtaactgttctcgcatctttcacggagagaaactgatgaacacaaatcttattttcatcatggtagagagtaagggaacctgtccctgcgataccagactcttaatacaggctgaacagacctccgacggccctaacccgtgtgacatggtgaagcagccgagatataggaaaggaccagacgtctgctttgataataacgtgctagaggactacactgactgcggcggtgtgtcagggcttaacccaagtctctggtacattattggtatccagtttcttctgctctggctcgtctcaggcagtactcatcgcttactctag

SEQ ID NO: 48674 - DNA, 3276 bp, Artificial Sequence
  Description of Artificial Sequence: Synthetic coding sequence
atggctgcaggctgcctccttgctcttacactgaccctgtttcagagtctgctgatcggtcctagctctgaagaaccttttcccagcgccgtcacgattaagtcatgggttgataagatgcaggaggatctagtcaccctggccaaaaccgcgtccggggtgaatcaactggtggacatttatgaaaaatatcaggacctgtatacggtggagccaaacaacgcaagacagcttgtggagattgcagccagagatatcgaaaagctgctttctaataggtctaaagctctggtgaggctggcgctggaagcagagaaagtacaagcagcccaccagtggcgcgaggattttgcatcaaatgaggttgtttactacaatgcaaaagacgacttggatcctgagaagaacgactccgaacctggctcccagcgcatcaaacccgtattcatcgaagacgccaacttcgggagacagatctcctatcaacacgccgcagtgcatattcccacggatatctacgagggaagcacaattgttttgaacgaactcaactggacaagcgccctggatgaggtgttcaagaaaaaccgcgaggaggacccctccctgctgtggcaggtgtttgggagcgcaactggactggccaggtattatcccgcatcgccttgggtggataactcccgcacacctaacaagatagacttgtacgatgtgaggagacggccttggtatattcaaggggctgcaagtcccaaagacatgctgatcctggtcgatgtaagcggctccgttagtggtttaaccctgaaactaatccgcacaagcgttagcgagatgctcgaaactctctccgacgacgacttcgtgaacgtggcgtcctttaacagcaacgcacaggatgttagctgctttcagcacctggttcaggcgaacgtaaggaacaagaaggtactgaaagacgcagtgaataatattacagcaaaagggatcactgactataaaaaaggtttctcttttgcctttgaacagctcctaaattataacgtttcgagggcaaactgcaacaagattattatgttgtttaccgacggaggggaggagcgagcccaggagatatttaataagtataataaagacaagaaagtgagagtgttcactttttctgtgggccagcacaattatgatcgcggacctatccagtggatggcctgtgaaaataagggttattactatgaaatcccttctattggggctattaggattaacactcaggagtacctcgacgtgttaggcagaccaatggtattggcaggggataaagctaagcaggtgcagtggactaacgtgtacctggatgcactggaattaggtctggtgatcacaggaaccctgccagtctttaatatcaccgggcagtttgaaaacaaaacaaacttgaagaaccagctgattctgggggtgatgggcgtggatgtctctttggaggacatcaagaggcttactcctaggttcactctgtgccccaatggctactacttcgctatagatccaaacggctatgtactcctgcatccaaacctgcagccaaagaatccaaagagccaggagcccgtaaccctcgactttctcgacgccgaactggagaatgacatcaaagtcgagatccgtaacaaaatgatcgacggagaaagcggtgagaagaccttccggaccttggtgaagagtcaagatgaaaggtatatcgacaagggaaatcgcacctacacttggacccccgtgaacggcacagactactcactggcgctggtactgccaacgtacagtttctactatataaaagccaagctggaggagaccattacacaggcacgatcaaagaagggaaagatgaaagatagcgagacgctgaagcctgacaactttgaggagtccggctacacttttatagctccacgagactattgcaacgatcttaagatctctgacaacaacactgagttcctgctgaatttcaacgaatttattgaccgaaagacgcctaataatccttcctgcaatgcagatttgatcaaccgggtgcttctggatgctggattcacgaatgaactcgtacagaattactggtctaagcagaagaatatcaaaggtgtgaaagcgaggttcgtggtcaccgacggcggaattacacgcgtctatcccaaggaagctggtgagaactggcaggagaatcctgagacatacgaggactcgttttataagcgcagcctggacaacgataattacgtcttcactgccccttacttcaacaagtcagggccaggcgcttatgaatccgggatcatggtgagtaaggctgttgagatctatattcaagggaaattgcttaagcctgccgtcgtgggaatcaaaattgacgtgaattcttggatcgaaaattttacaaagactagcattagggatccctgtgccggaccagtctgtgactgtaaacgaaattccgatgtcatggactgcgtgattctggatgatgggggattcctgttgatggccaatcatgacgactacaccaatcagatcgggagattctttggcgaaattgacccatctctcatgaggcacctggtaaacattagcgtgtacgctttcaataagtcgtacgattatcaaagcgtgtgcgagcctggcgcagcccctaagcagggagcagggcacaggtccgcgtatgttccatccgttgcagatattctgcagatcggttggtgggctaccgccgcagcgtggagtatcctgcagcagttcctgttaagccttacatttccgagacttctagaagctgtagaaatggaggatgatgacttcaccgccagtctgtcaaaacaatcctgcattacagaacagacacagtactttttcgataatgattccaaatccttctccggcgtgctggactgtggaaactgttctcggatctttcacggcgaaaagttgatgaacacgaacctaattttcatcatggtggaatctaagggaacatgtccatgtgacactaggttattgatccaggccgagcagacctctgatgggcctaacccgtgcgacatggttaagcagccacggtaccggaagggtcctgatgtgtgcttcgacaacaatgtcctggaggattacacagactgcggcggagtctctggtctcaacccttccctgtggtacatcattgggatccagtttctcctactgtggctggtcagcggatccacgcaccggctgctctag

SEQ ID NO: 48675 - DNA, 912 bp, Artificial Sequence
  Description of Artificial Sequence: Synthetic coding sequence
atggtgggcctgccggaattcatccccaaaattgtgggaattaagattgatgtgaactcctggatcgagaatttcactaaaacctctatccgagacccctgtgcgggaccagtgtgcgactgcaagcgaaactccgatgtcatggattgcgttatactcgacgatggtgggttcctcctgatggccaatcacgacgattataccaaccagattggcagattctttggggagatagatccctcactgatgagacatctggttaacatatccgtttatgctttcaacaaaagctatgattatcaatccgtttgtgaacctggggcagcccctaagcaaggggctggacacaggagcgcttacgtcccctcagtggctgatatcttgcagatcggctggtgggccacagccgcagcctggtctatattgcagcagtttctgctatcactgacatttcccagactgctagaggcggtcgagatggaggatgatgacttcactgccagtctttctaagcagtcatgcatcaccgagcagacacagtatttttttgacaacgattcaaagtcgttttcaggagtactggattgcggcaattgtagtaggattttccatggagaaaaactcatgaacaccaatctgatttttatcatggtggagtccaaagggacctgtccttgtgatacgcggctgctgatccaggctgagcagacttccgatgggcctaacccttgcgatatggtgaaacagcctagatacagaaaaggtccagatgtgtgtttcgacaacaacgtgttggaagattacaccgactgtgggggtgtttcgggcctcaacccatctctctggtacattatcggaatccagtttctgctgctttggctagtgagcggctcgactcaccggctcctgtag

SEQ ID NO: 48676 - DNA, 984 bp, Artificial Sequence
  Description of Artificial Sequence: Synthetic coding sequence
atggtcaggtgtgatagaggccttcagatgctgctgactaccgccggtgcttttgccgctttcagtttgatggcaattgctatcggaaccgactattggctgtattccagtgctcatatttgtaacggaaccaatctaaccatggacgatggccctccccctcgtagggctagaggagacttgacccattccggcctgtggcgagtgtgttgtatagaaggaatttacaaaggacactgcttccgtattaatcactttcctgaggacaatgattatgaccacgattcatctgaatacctcttgcggattgtgcgagcttcatccgtgtttcccattttgagcacaattcttctccttcttggtgggctgtgtatcggagccggaagaatctactcgcggaagaataatatcgtcctgtcagccggtatcttgttcgtggccgcagggctgtctaatatcattggcattatagtctatattagctccaatacaggagacccctccgataaacgtgatgaggataagaagaaccattataactacggatggagtttctactttggagccctaagttttatagttgcagaaacagttggagtcttggcggtgaacatttacattgagaaaaacaaagaacttaggttcaagaccaagcgtgagtttctgaaagcctcatccagtagcccatatgcaagaatgccttcctaccggtatcgccgaagaaggagtagaagtagcagccgaagtactgaggcatctcccagccgggacgtgagccctatggggctcaaaatcacaggtgccatccccatgggcgagctgtcaatgtataccctgagcagggaacctctgaaggtgactacagcggcatcatactctcccgaccaagaggcgagctttctacaggttcacgacttctttcagcaagacctgaaagagggatttcacgtctcaatgctgaaccgacgaacgacccccgtatag

SEQ ID NO: 48677 - DNA, 6119 bp, Artificial Sequence
  Description of Artificial Sequence: Synthetic coding sequence
gaaagagtcgagtacctgtttctcataatttttaccgtggaggcattcctgaaagtgattgcatacggtctcttgttccacccaaacgcttatcttcggaacggttggaatcttctcgatttcattattgttgtcgtcggactatttagtgccattttagagcaggctactaaggcggatggagctaatgcgttgggaggcaagggggcaggctttgatgtcaaagccctgcgagccttccgggtgctgcgtcctctgaggctggtaagtggtgtgccttccctgcaggtggtgctcaactctattatcaaggcaatggtccccctcctacatattgccctgctcgtactattcgtgatcataatttacgcgattataggactggagctgttcatgggaaaaatgcacaaaacctgttacaatcaggagggcatcgctgacgttcctgcagaagatgatccctcaccctgcgccctggagaccgggcacggacgccagtgccagaatggcaccgtttgcaagccaggttgggacgggccaaagcatggtattacaaacttcgacaactttgcctttgccatgctcaccgtgttccagtgcatcactatggaagggtggaccgatgttctttattggatgcaggatgccatgggctatgagttgccttgggtgtactttgtatctctcgtgatattcggaagcttctttgttctgaacttggtgctgggggttctgagtggggaatttagcaaggaaagagagaaggcaaaggcccgtggtgatttccagaagcttcgggagaagcaacagcttgaagaagacctgaaaggatacctagactggatcacccaggccgaggacatagatcccgagaacgaagacgagggtatggacgaagaaaaaccaagaaacatgtcaatgcccaccagcgagaccgaaagcgtaaatacggaaaacgtcgctggcggagatatcgaaggggagaactgtggggctaggctcgcacatagaatctccaagtcgaagttttctagatactggcggaggtggaatagattctgtaggcgaaaatgtagagccgcagtgaagagcaatgtgttttactggctggtcatattccttgtgtttttaaatacgctcacgattgccagcgagcattataatcagcccaactggttaacagaggtgcaggacacagctaataaggctctgctggccttatttacagctgaaatgctactcaagatgtacagtctcggattgcaagcttacttcgtcagcctattcaacagatttgactgtttcgtggtgtgcggaggaatcctggaaaccattctggtagaaacaaaaattatgagccccctcggtattagcgtgctccgctgcgtgagactgctccggatttttaaaatcacacgatattggaatagtttatctaatctagtggcctcattgctcaattctgtccgatcgatcgcctccctgctcctgctgctgttcttgttcattattatctttagcctgctaggaatgcaactgttcggtgggaagttcaactttgatgagatgcagacccggaggagcacctttgacaatttcccccagtcacttctgaccgtgtttcagatactgaccggcgaagattggaattccgttatgtatgacggaatcatggcctatggaggcccatctttcccaggaatgctggtgtgcatctatttcattatccttttcatctgcggcaattacatcctgctgaatgtttttctcgctattgctgtggacaatctcgcagatgccgagtcactcacctccgctcagaaggaagaagaagaagaaaaagagcggaagaagctggctaggacagcatccccggaaaagaagcaggagcttgttgagaaacccgctgtgggtgaaagtaaagaagaaaagatcgaactgaaatcaatcactgccgatggtgagtccccccctgccaccaagatcaatatggatgacctgcaaccgaatgagaacgaggacaagtcaccttatcctaatccagagacaacaggagaagaggacgaggaggaacccgagatgcctgtggggccaaggccaaggcccctctctgaactacatctcaaagagaaggcagttcctatgcccgaagcatcggctttcttcatcttctcctctaacaaccgatttcggctacaatgccaccgaattgtcaacgacacgattttcacaaaccttatcttgtttttcattcttctcagctccatatcgttggccgcagaggatcccgtgcagcacacatccttccggaatcatattctgttctacttcgatatcgtatttacaacaatctttaccatcgagatcgctttgaagatgaccgcctacggcgctttcctccacaaggggtcattttgccggaattattttaacattctcgatcttctcgtcgtgtcagtgtctctgatcagtttcggaatccagagcagcgcgattaacgtggtcaagattcttagagttttacgggtcctcaggcctttgcgggcaattaacagggcgaaggggctgaaacacgtggtccagtgtgtctttgtcgctatccgaacaatcgggaatatcgtgatcgttacaactttgctgcagtttatgttcgcgtgcattggtgtccagcttttcaagggtaaactttatacttgctcagacagcagcaaacagactgaggcagagtgcaagggcaattacatcacgtataaggacggagaggttgaccatccaattatccagccgcgtagttgggaaaactctaaatttgacttcgataatgtcttggctgctatgatggccctgtttaccgtgtcgacctttgaaggctggcccgagctcctttatcgcagtattgatagtcacaccgaggacaaggggccaatctataattatcgtgttgagatatcaatattttttattatttacatcattatcatcgctttttttatgatgaacatcttcgttggcttcgtgatagtgaccttccaagagcagggcgagcaggagtataagaattgtgagctcgacaagaatcaaaggcagtgcgtggaatacgctctgaaggccaggcccctgcgcaggtacatacccaagaaccaacaccagtataaggtatggtacgtagttaatagcacctactttgagtaccttatgtttgtgttgatcctgctgaacacaatctgcttagcgatgcagcattatggccaatcctgtctgttcaagatcgcaatgaacattctgaatatgctttttaccggactgtttaccgtcgagatgattttgaagctcatcgctttcaagccaaaacactacttctgcgacgcctggaatactttcgacgcgttgattgtcgtgggctctatcgtcgacatcgccataacggaggtgaataacgccgaggaaaactctcgaatttccattaccttttttcggcttttcagggttatgagacttgtaaaactcctatcgcggggagagggtattcgcacactgctatggacatttatcaagtctttccaagctcttccgtacgtggccttgcttattgtcatgcttttttttatctacgccgttattggcatgcaggtatttggtaaaattgcactcaacgataccactgaaattaatcgcaacaacaactttcagaccttcccccaggccgtgttactgctcttccgatgtgctactggagaagcctggcaggatatcatgctggcctgtatgccaggtaaaaaatgcgcaccggaatcagaaccaagcaactcgaccgaaggggaaactccatgcggctcaagctttgctgtgttttactttatttcattctatatgctgtgtgccttcctgattattaacttgtttgtcgctgttattatggacaacttcgattacttgacccgggattggtcaattctgggcccacatcacttggacgaatttaaaagaatttgggctgagtatgatcctgaagccaaagggcgtatcaaacatttggatgtggtgaccctgttaagacgtattcaacctcccctcggatttgggaaactgtgcccccaccgtgtcgcatgcaagaggctcgtgtccatgaacatgcccttgaattccgacgggaccgtgatgttcaacgccaccctgtttgctctagtccggaccgctttacgaattaagactgaagggaacttggaacaggccaacgaagagctgcgcgctattataaaaaaaatatggaaaaggacaagcatgaagctgcttgatcaagtcgtccctcctgccggtgatgacgaggttacagtaggtaaattctatgccacctttttgatccaggaatactttaggaaatttaaaaagcgtaaggagcaggggctcgtcgggaagccctcccaaagaaacgccctgagtctgcaggctggactgcgcacgcttcatgatattggacctgaaattcgccgtgccatttctggtgatctcaccgcggaggaagagctggataaagctatgaaggaggctgtgtctgcggctagcgaggatgacatcttcaggagagcgggtggtctgtttggcaaccatgttagctattatcagagcgacgggaggagcgcctttccccaaactttcacgactcaacggcctttgcacatcaataaggcaggctcttcccaaggggacacggaatccccgtctcacgaaaagctggtggactcaacttttactccgtcgtcatactcgtcaaccggttcgaatgcgaacatcaataatgctaacaataccgcgctcggacgcctgccgagacctgcaggatatccatctaccgtcagtactgtggaggggcacggcccacccctgtcccctgccatccgggtccaagaggtcgcgtggaagctgtcttcaaaccgtatgcattgctgtgacatgttggatggcggtacgtttcctccagcactggggccacggagagcccctccttgcttgcaccagcaactgcaggggtcccttgccggactccgggaagataccccatgcatagtcccaggtcacgcttccctctgctgtagttcccgggttggtgagtggttacccgctggatgtacagcaccccaacacgctaggtgtcacagtagggaatcccaagccgcaatggccggacaggaagagactagtcaggacgagacatacgaggtgaagatgaatcacgacaccgaagcttgtagcgaaccttcacttctttctaccgaaatgttaagctatcaggacgatgagaaccgtcagttgaccctgccagaagaggataaaagggacatcagacaatctccaaagagaggcttcctgcgtagcgcctccctcgggcgtcgcgcatcctttcatcttgagtgcctgaagcgacagaaagaccgcggtggcgacattagtcaaaagacagttttgcccctgcacctggtgcaccatcaagccctggccgtggcaggcctctcccctctgcttcagaggtctcactcgccagccagcttccctcggccatttgcgacgccacctgccactcccggaagtcgagggtggcctccgcagccagtgccaaccttgaggctagagggtgtggagtcctctgagaagctaaacagcagtttcccctcgattcactgtggaagttgggcagaaaccaccccgggaggcggaggctcaagtgccgcaagacgcgtccgaccagttagtctcatggtcccctcccaggcaggggcacccggacggcagtttcatggttcagcgtcttcactggtggaggctgtgcttatttccgagggactggggcaattcgcacaggacccgaaatttattgaagtgacaacgcaggagctggcagatgcatgcgacatgacaatagaggaaatggaatccgcagccgataacatactgagtggcggagcccctcagagccccaacggagctctgctcccgtttgtgaattgccgtgacgccggtcaggatcgcgctggaggcgaggaggatgctgggtgcgttagggcccgtggaaggccctccgaagaagaacttcaggacagtcgggtatatgtcagctccctata

SEQ ID NO: 48678 - DNA, 6521 bp, Artificial Sequence
  Description of Artificial Sequence: Synthetic coding sequence
atggttaacgagaatacacgtatgtacatccccgaagaaaaccaccagggttccaattacggaagccctcgccctgcacacgcgaatatgaatgccaatgctgcagctgggctcgcacccgagcacattcccaccccaggagcagccttatcatggcaggctgccattgacgcagctagacaggcgaaactgatggggtcggccggaaacgctaccatttccactgtgtcctctacccagcggaagcgacagcagtatggcaagcccaaaaagcaaggctccacaactgctaccaggccaccacgggcattgttgtgcctgacgttaaagaatccaattcggcgtgcgtgcatctcaatagtggagtggaagccctttgaaatcataatcctcctgactatcttcgccaactgtgtcgcacttgccatatacattcccttccccgaggatgattctaacgccactaattctaaccttgaaagggtagaatatctcttccttattatcttcactgttgaggcctttttaaaggttatcgcgtacggcctcttgtttcaccccaacgcttatctgcgaaacggctggaatctcttggatttcattatcgtggtggttgggctgtttagtgcaatcctggagcaggccaccaaggccgatggcgctaacgcgttgggcggtaagggtgcaggcttcgacgtaaaagcattacgagcctttagggtcctgaggccgctgaggctggtctcaggggtgcctagtctccaggttgtgttgaattcaattatcaaggcgatggttccattgctccacatcgctctactcgttctgtttgtgataatcatttatgctattatcgggctggagctcttcatgggaaagatgcataaaacttgttataaccaggagggtatcgcggacgttcctgccgaagatgatcccagcccttgtgcgctggaaacaggacatgggcgacagtgccagaacggtaccgtttgtaagcccggatgggacggacccaaacatgggattacgaactttgacaacttcgcgtttgccatgctgaccgtgttccaatgcattactatggaaggttggacagatgtactgtactgggtgaatgacgccgttggtcgggactggccttggatctattttgtcaccttaattattattggttcctttttcgtgctgaacttagttctcggggtactctccggcgaattttccaaggagcgagagaaagccaaggcccgaggtgattttcaaaaacttagagagaagcagcaactcgaggaggacctgaagggttacctcgattggatcactcaggctgaggacatagatccggagaatgaggatgaaggcatggatgaagagaaacccagaaatatgtctatgccaactagcgagaccgagtcagtaaacaccgagaacgttgctggcggagacatcgagggtgagaattgtggtgcacgccttgcccatcgtatcagcaagtccaaatttagccgttattggcgcaggtggaaccgcttctgtagaaggaagtgcagggctgctgttaagtccaatgtcttttactggctcgtcatatttctggtgttcttgaacactttaactatcgcttccgaacactacaaccaaccaaactggctaaccgaagtgcaagatacagctaacaaggccttgctcgctctgtttaccgcggagatgctattgaaaatgtattcccttggacttcaggcttattttgtgtctcttttcaatagatttgattgtttcgtcgtgtgtgggggtattctcgaaactatcttagttgaaaccaaaataatgagcccactgggcatctcggtactccggtgtgttcgcctgctgcgcatattcaaaatcactaggtactggaacagcctttcgaaccttgtggcctcactccttaattccgttagatccatagccagcctcctgctcttactctttctgtttatcatcatttttagcctgttgggcatgcagctgtttggagggaaattcaattttgatgaaatgcaaactagaagaagcaccttcgacaattttcctcagtccctgctgacggtttttcagatccttactggcgaggattggaattcggtcatgtatgatggtatcatggcctacggaggtccttcatttcctggaatgctggtttgcatatacttcatcatcctctttatctgtggtaactacatcctcctcaacgtgtttctcgctattgctgtggataaccttgcagatgccgagagccttaccagtgcccaaaaagaggaggaggaggaaaaggaacggaagaagttggccagaaccgcttcccctgagaagaaacaggagttggtagagaaacctgccgtcggggaatctaaagaggaaaaaatcgagctcaagagcataaccgccgatggagagtctcctcctgctaccaagataaatatggacgatctgcagcctaacgagaatgaggacaagtctccatatcccaacccggaaacaactggagaggaggatgaagaagaacctgaaatgcccgtgggaccacggcctcgaccgctaagcgagctccatctcaaggaaaaagccgtccccatgcccgaagcaagcgctttttttattttcagtagcaacaaccgtttccgtttacagtgtcataggatcgtcaatgataccattttcaccaatctcattctgttcttcattttgctctctagcatcagcctggcagccgaggacccagtacagcatacttcttttagaaaccatattctgggaaacgctgattatgtatttacttctatttttaccttagagatcattctcaagatgaccgcctacggagctttccttcataaaggatctttttgccggaattattttaacattctagatttgctggtcgtgtcagtgagcctcattagtttcggcatccagagctcagccattaacgtagtgaaaattctgcgcgtccttcgcgtgctccgtccgctgcgcgctatcaatcgggcaaagggactgaagcacgtcgtacagtgtgtattcgtcgccattcggactataggaaacattgtcatagttacaacactgctacagtttatgttcgcatgcatcggagtacagctgttcaaagggaagctctacacatgctccgactcctcaaaacagacagaggctgagtgcaaggggaattatattacatacaaggacggcgaagtagatcaccccatcattcaacctagaagctgggagaactctaaattcgattttgataatgtgcttgcagccatgatggcactatttaccgtctcgactttcgagggatggcctgagctgctgtacagaagtatcgactcgcacacggaagataaaggacccatttataattaccgagttgaaatatccatcttctttattatatacataattatcatcgctttctttatgatgaacatatttgtcggctttgtaattgtaacattccaagagcaaggggaacaggaatataagaactgcgaacttgacaagaatcagcgacagtgcgtggaatacgcgctgaaagcccgtcccttgcgaaggtacatccccaagaatcagcaccaatacaaagtttggtatgttgtgaatagtacttacttcgaatatctcatgttcgtgctaatcctgctcaacactatatgtctggctatgcagcactatgggcagtcctgcctgttcaagatcgccatgaatatcctgaacatgctgtttacggggttatttacggtcgagatgatcctaaaactgattgcctttaagccaaagcattacttttgtgacgcatggaatactttcgacgcattgatcgtcgtcggcagcatagtggacatagctatcaccgaagtaaacccggctgagcatacccagtgctctcctagtatgaacgctgaagagaattccaggattagtattaccttcttcagactttttagggtgatgagactggtgaaattactgagtcgtggggaaggtatccgtacactcctgtggaccttcattaagtctttccaagcacttccatacgttgctcttctgatcgtgatgctcttcttcatttatgccgtaataggcatgcaagtgttcggcaagattgctctgaacgacacaactgagattaacaggaacaacaactttcaaacatttccacaagccgtactcctcctgtttcgctgcgcaactggcgaggcatggcaggacatcatgctggcctgtatgcccggaaagaagtgtgctcccgagtccgaaccgtccaattctaccgagggggagaccccctgtggctcctcattcgcggtgttctatttcatatcattctatatgttgtgcgcatttctcatcatcaatctctttgtggccgtcattatggataatttcgattatctgacccgggactggagcatcctcggcccacaccatctagatgaattcaaacgaatttgggccgaatacgaccccgaggcgaaggggcgtatcaagcatctagatgtagtcacacttcttagacggatccaacccccactgggattcgggaagctctgtccacaccgtgtggcatgtaaaaggttagtcagcatgaatatgccactgaactccgatgggaccgtgatgttcaacgctacactcttcgctctcgtgagaaccgctcttagaataaagactgaaggcaaccttgagcaggccaatgaggagctacgtgccatcatcaagaaaatctggaagcgcaccagcatgaaattactcgatcaggtcgtccctcccgctggagacgacgaagtgaccgtgggaaaattttatgcaaccttcctgatccaggaatatttccggaaatttaagaagagaaaggagcaaggattggtaggaaaaccttcacagcgtaatgcactgtccctccaggccggactgcgcacactgcacgatattggacctgagataaggcgggcaatttcaggcgatctaaccgctgaagaagaactggataaagctatgaaagaggcggtgagcgccgcttcagaggatgacatcttccgccgtgcaggtggactgtttggcaaccacgtgtcctattaccagtcagatgggaggtcagctttcccgcagacatttactactcagcgacccctccacataaacaaggccggaagctcacaaggcgatactgagtctccgagccacgaaaagctggtggattccaccttcacacctagctcatacagttcaactggttcaaatgctaacataaacaatgcgaacaatacagcgttaggccgtttaccacgtcccgctggatatccctccaccgtgagtactgtagaggggcacgggccaccgctgtcacctgccatccgagtgcaggaggttgcctggaagctcagctctaaccgggagcgacatgtcccaatgtgtgaggatctggagctcagaagagattctggcagcgctgggacacaagctcactgtctgctcctgaggaaggccaacccttccaggtgccattctcgagagagtcaggctgccatggctgggcaggaagaaacctcccaggatgagacctacgaggtaaagatgaatcacgacacagaggcctgcagtgagccttctttgctaagtacagaaatgctgagttatcaagacgacgagaaccgacagcttactctcccggaggaagataagcgcgatattcgccaaagtcctaagaggggtttcctgagatccgcatctcttggcaggagggcctcattccacctggaatgcctgaagcggcagaaggacagaggaggggatatttcccagaagacggtgttgccgttgcatctggtgcaccaccaggcgctcgccgtggctggcctttctccactacttcagagaagccacagcccagcgagcttccctcgtcctttcgctaccccacctgcgaccccaggtagtcgagggtggcctccccagcccgtaccgacacttcggttggaaggcgtggagtcgtccgagaagctgaactcctccttcccaagcatccactgcggatcatgggcggagacaaccccagggggtggaggctcaagtgccgctcgtagggttcgacctgttagcctcatggtgccgtcccaggctggcgctccgggacggcagttccacggatccgcgtcatcgctggtggaggccgtattaatcagtgagggcctgggtcagtttgcccaggacccaaagttcatagaggtgaccacacaagagctcgcagacgcatgtgacatgacaatcgaagaaatggagagtgccgctgacaatatcctgagcggcggagcgcctcaaagtccaaatggggctctgttgcccttcgtgaattgcagggatgctggacaagatcgtgccggaggagaagaggatgcaggatgcgtccgtgccagagggagacccagcgaggaggagttacaggattctagagtgtatgtttcctcactgta

SEQ ID NO: 48679 - DNA, 6491 bp, Artificial Sequence
  Description of Artificial Sequence: Synthetic coding sequence
atggttaacgaaaacactcggatgtacatcccggaagagaatcaccagggctctaattatggatccccccgaccagcacacgccaatatgaatgccaatgcagctgctggattagcacccgagcacatacccactcccggagctgcactgagctggcaggctgccattgatgctgctagacaggccaagttgatggggtctgcaggtaatgccacaatctcaactgtgagctcaacgcagaggaaacggcaacaatatggaaagcctaaaaagcagggatcaacgactgccactcgaccccctagagctctcctttgcctcaccttaaaaaaccccatacgacgagcctgtatttcaatagtggagtggaaaccattcgaaattattatactgctcactatatttgccaattgcgttgccctcgccatttacataccattccctgaagatgacagtaatgctacgaattctaatctggagcgagtggagtacctcttcctcataattttcaccgtggaagcctttttgaaagttatagcgtacgggttactcttccaccctaatgcatacttgcggaacggctggaatttgttggattttatcatcgtcgtcgtcggcttgttctctgccatcctggagcaggcaaccaaagccgatggggctaatgctctcggcggaaaaggagctgggtttgatgtcaaagctctgagagcctttagagttttgcgccctctgaggctcgtgagcggggttccctcccttcaggtggtgctgaacagtattataaaggcaatggttcctctacttcatatagcactgctagtcctctttgtgataatcatctatgccataattggtctggagctttttatggggaagatgcacaagacctgctacaaccaggaggggatcgcggatgttcctgctgaagacgacccctccccttgtgcgcttgaaaccggacacgggcgtcagtgtcaaaatgggaccgtgtgtaaaccaggctgggatggccctaagcatggcatcacaaactttgataacttcgccttcgccatgctcacagtattccagtgcatcaccatggaaggatggaccgacgtgctctactgggtgaatgatgctgtggggagggactggccgtggatttatttcgttacgcttatcatcattgggtccttctttgtgctgaacctcgtgctgggtgtactgagcggagaattcagtaaggagagagagaaagctaaggccaggggcgatttccagaaattgagagaaaagcagcaacttgaggaggatctaaagggctacttggactggatcacccaggctgaggacattgatcctgaaaacgaagatgagggcatggacgaagaaaaaccaagaaaccgagggacccccgctgggatgttggatcagaaaaagggcaagtttgcatggttttcgcactccactgaaacccatgtgtccatgccgacatcggagaccgagtcagtcaacactgaaaatgtcgccggaggggatatcgaaggcgagaactgtggcgctcgtctggcccatcggatctccaagagtaaattttcaagatactggcgcaggtggaacagattttgccgcaggaagtgtagggcggctgttaaaagtaacgttttttactggttggtaattttcctcgtgtttctgaatactctaactatagcctctgagcactacaatcagcccaactggctgacggaagtccaggacaccgccaataaggccttattggctcttttcaccgctgagatgctgttgaaaatgtattcactcggcctacaggcctacttcgtctcactctttaacagatttgactgtttcgtggtgtgtggaggaattctggaaaccatccttgtggaaactaaaatcatgtcccccttggggatctccgtcctgaggtgcgtgcgtctgctgaggatattcaaaattacacgctattggaattcgttaagcaacctggtcgcatcactgttgaacagcgtacggagcattgctagcctactgctcctgctgttcctcttcatcataatcttctcactgttgggaatgcaactctttgggggaaaatttaacttcgatgagatgcagacaaggcgatcaacatttgacaatttccctcagagcctcttaaccgtcttccagattcttacaggcgaggactggaatagcgtcatgtacgacggcatcatggcgtatgggggaccttccttccccggaatgttggtctgtatctacttcatcattctgttcatctgtgggaattatattctgctcaatgtgttcctggctattgccgtggacaacctggccgatgctgaatcgcttacatccgcccagaaggaggaggaggaggagaaggaacgcaaaaagctggctagaacagccagtccagagaagaagcaggagctggtggagaaaccggcagtaggggaatcaaaagaagagaagattgaactgaagtctatcacggctgatggagagtcccctccagctactaagatcaacatggatgaccttcaaccaaatgagaatgaggacaagagcccttaccccaatccagaaacaacaggcgaagaggatgaagaagagcctgaaatgccagttggtccccgacccagacccctgtccgagctgcatctgaaagaaaaggcagtacccatgcccgaggcgagcgcattctttatcttctccagtaacaatcggtttagattgcagtgtcaccgtatcgttaatgatacaatctttacgaacctgatcctctttttcatattactttcctcgatctcgctagccgctgaagatccagtgcagcatacaagcttcagaaaccacatcctcttttacttcgacatcgtgtttacaacaatctttaccatcgaaatagccctgaaaatgacagcatatggggcattcctccataaaggttcattttgtcgcaattactttaacattctggacttgctcgttgtgtcggtgagcctgatttctttcgggattcagagttcagccattaatgtggtcaaaattctgcgtgtgttacgcgtgcttagacccctccgggctattaacagggcaaaagggttaaagcacgtcgtgcagtgcgtttttgtcgctatcagaaccatcggcaacattgtcatcgtaacaactttacttcaatttatgttcgcatgtatcggggtgcagctcttcaaaggtaaattatacacctgctctgacagttcaaagcagactgaggccgagtgtaaaggaaattacattacgtataaagatggcgaagtcgaccacccaatcatccagcccaggtcctgggagaacagcaagttcgactttgataatgtcctagcagccatgatggccctattcactgtctcgactttcgagggctggcctgaattactgtaccggagcattgactcacatacagaggacaagggcccaatttacaattaccgggtggaaattagcatctttttcattatttacatcattattattgcattttttatgatgaacatttttgtgggctttgtcatagtcacttttcaggaacagggagaacaggagtataaaaattgcgaactagataagaaccagcgtcagtgcgtcgagtatgctctcaaagctaggcccttaaggaggtatatacccaaaaaccagcaccaatacaaggtctggtatgtagttaatagcacctactttgagtacctcatgttcgtgttgattctgctcaacactatctgcctggccatgcagcactacggccagagctgtctgttcaagatcgctatgaacattcttaatatgctttttacagggctgttcactgtagaaatgatactgaagctgatcgcctttaaaccaaagcactacttctgcgacgcctggaataccttcgatgctctgattgttgttgggtctatcgtggacattgccattacggaagttaatcccgctgaacatactcaatgctctccctcgatgaatgccgaagagaactccaggatcagcataaccttctttaggctgttccgcgttatgagattagtcaagctgctttccaggggggagggcataaggactcttctgtggaccttcatcaagtcctttcaggcacttccttatgtcgccctgctgatcgtgatgctgttcttcatttacgctgtgatcgggatgcaagttttcgggaaaatcgcgttgaacgatacgacagagatcaataggaacaacaatttccaaacctttccccaagctgtcctcctgttatttagatgcgccactggcgaggcgtggcaggatattatgttagcgtgtatgcctggaaagaaatgcgctcctgagagcgaaccctccaattctaccgagggagagactccatgtggctcaagttttgccgtcttctactttatcagcttttacatgctgtgcgctttcttaataattaatttgttcgtagcagtcattatggacaactttgactacctaacccgggattggtcaattctcggcccacatcacctggatgagtttaaaagaatatgggctgagtatgatcctgaagcgaaggggaggatcaagcaccttgacgtggttaccctcctacgtaggatccagccacccctgggctttggaaagctttgtcctcaccgtgtggcctgcaaacgcctagtgagcatgaatatgcccctgaatagtgatgggacagttatgtttaatgcgacgttgtttgccttggtgcgcacggccctgaggatcaaaacggagggcaatctcgaacaggcaaacgaggagttgagggcaatcattaaaaaaatctggaagcgcacttctatgaagctgctcgaccaagtggtgccacctgccggagacgatgaggtgaccgtcggtaagttttacgccacatttctgatccaggagtactttcgtaaatttaagaagcgtaaggagcaggggttggtgggaaagccgagccagcggaacgcactcagcctacaagccggattgcgcacgctccatgacatcggccctgaaattcgccgagcaatatctggcgacctgactgcagaagaggaactggacaaggctatgaaggaagccgtatccgcggctagcgaagatgatatctttcggagggccggaggtctctttggtaaccacgtgagttattaccaaagcgacggcagaagtgcctttccccagactttcaccacccaacggcctctacacatcaataaagcagggagctcacagggggacacggaatcaccgagtcacgaaaagcttgtggactccaccttcaccccatcaagttactcctccacaggttctaacgccaacatcaataatgcaaataatacggccttggggcgtctgcccagacccgcaggatacccctccactgtgagcacagtggaaggtcacggcccacccctatcccccgcaataagagtgcaggaggtcgcctggaaactctcaagtaaccggtgtcacagcagagagtcacaggcagccatggctgggcaggaggagactagccaggacgagacatacgaggtaaagatgaatcatgatactgaggcttgtagcgaacctagtctgttgtcaaccgagatgctatcctatcaggacgacgagaatcgccagcttaccctacccgaggaagacaaacgcgacataaggcaaagtccaaaacggggttttcttcggtctgcttcactgggccgtcgggctagcttccatctggagtgcctgaagcgccagaaagatagagggggagacatttcccagaaaacagtgcttcctctgcacctggtgcaccatcaagctctggctgttgccggtctaagtcctttattacagcgtagtcacagtcctgcatcctttccgaggccctttgccacacccccagccactcctgggtctagggggtggccaccccagccagtacccacactgagactagagggggtcgagtcctccgaaaagctgaactcttcattcccaagtatccattgcgggagttgggcggagaccactcccggtggtgggggatctagcgcggcaagaagagtccgtcccgtttcacttatggtgcccagtcaagctggggcaccaggccgtcagttccacgggagcgcctcctctctggtggaggccgttctgatttctgagggtctcgggcaatttgctcaggaccctaaattcattgaagtcactactcaagagttggctgacgcctgcgatatgactattgaggagatggaatctgcggcagacaacattttgagcgggggtgctccacaatcacccaatggggctctcctgccttttgtaaattgtagagatgccggacaggaccgagcaggaggagaagaggacgccggatgcgtgcgcgctcgagggcgacccagcgaagaggaactgcaggactctagagtttatgtgtcatcacttta

SEQ ID NO: 48680 - DNA, 6752 bp, Artificial Sequence
  Description of Artificial Sequence: Synthetic coding sequence
atggatgaggaggaagacggggcaggagcggaggagtcaggtcaaccacgatccttcatgcgtctgaatgacctatcaggagccggtggaaggcccggacctggatccgctgagaaggatcccggaagtgcggactccgaagccgaagggctgccctaccccgcactggcgcctgtggtgtttttttatctgagtcaggattcaaggccacggtcctggtgtctcaggacagtgtgcaacccctggtttgagaggatctcaatgctagtgatactcctcaattgcgtgacattagggatgtttcgtccatgtgaagacatcgcgtgtgactcacagcggtgcagaatcttgcaggctttcgatgattttatttttgctttcttcgcagtggagatggtggttaaaatggtggccctcggaatctttgggaaaaagtgctatttaggcgacacatggaatcgactggatttcttcatcgtaattgcaggaatgttagagtattccctggatctgcagaatgtaagttttagcgccgtacggactgttagagtgctgcgcccactgcgcgctataaaccgcgtccccagcatgaggatactggtaaccctcttactggacactttgcccatgctgggcaacgtgctgctgctttgctttttcgtgttcttcatctttggcattgtgggagtgcagctttgggcaggactcctgagaaaccgctgctttctgccagagaatttctccctgcccctgtcggtcgatctggagcgctattatcaaactgaaaatgaagacgagtcccctttcatctgttctcagcctagggagaatggcatgcgctcctgcaggagtgtgcccacactgaggggcgacggcggagggggtcccccttgtgggctggattacgaagcttacaatagcagttccaacaccacctgcgtgaattggaaccagtattacacgaactgctccgccggtgaacataaccccttcaaaggcgcaattaattttgataatatcggatacgcctggatcgccatattccaggtcattactctcgaaggttgggtggacatcatgtattttgtgatggatgcacacagcttctacaactttatttattttatcctgctgatcattgtgggctccttcttcatgatcaacctgtgcttggtagtgatcgcaacccagttttccgaaaccaagcagagagagtctcaacttatgagagaacagcgggtccgattcctttcaaatgcttctaccctggcctcatttagcgaaccagggagctgctacgaagagctgctgaaatacctggtatacatcctgcgcaaggctgccaggcgcctcgctcaggtgtctcgcgcagcaggagtccgcgttggactactttcttcccccgcacccctcggcggacaggagactcaacccagcagctcgtgcagtagatcacatcgtagactatctgtgcatcacttagtgcatcaccaccaccaccatcatcatcactatcacctgggaaacggcactttgagggcccctcgagcctcccccgagattcaggatagagatgctaacggctcacgacgcctgatgcttcctcctccctccacacccgctctgagcggggcaccacctggcggagccgagagcgttcattccttctaccacgctgattgtcatttggagcccgttcgctgccaagcccctccacctcggagtccctctgaagcaagtggacgtactgttgggtctggtaaggtttacccaactgtgcacaccagtcctcctccagagacgcttaaggagaaagctttagtggaggtggccgcatcatctggtccacctacgctcaccagtctgaacatcccccctggaccatactcctctatgcacaaactcttggagacccagtctacaggcgcatgccagtcctcttgcaaaatttcctcaccctgtctgaaagccgacagtggggcatgtggtcctgacagttgcccatactgtgcacgagcaggtgcgggagaggtggagttggcagatagagaaatgcccgattccgattccgaggctgtatacgagtttactcaagatgcccagcattcggacctgagagaccctcacagccgcagacagcgcagcctcggcccagatgcagaaccgtcctctgtgctcgccttctggcgcctgatctgcgacacatttcggaaaatcgtcgatagcaagtattttggtagggggattatgatcgccattctggtcaacacattgtctatgggtatcgagtaccatgagcagcccgaggagctgactaatgctttagagatatccaatatagtgtttaccagcctttttgcactggagatgcttcttaaattgttagtctatgggcctttcggatatattaagaatccctacaatattttcgacggagtgatcgttgtgatctcagtatgggagattgtcgggcagcaaggagggggactctcagtcttacggacattcaggctgatgagagtccttaaactggtgcgcttcctgcctgctttgcaacgtcagctagtggtgttaatgaagacaatggacaatgtcgccactttctgcatgttgctaatgctgtttatatttatcttttcgatcttggggatgcatttattcggctgcaaatttgcttccgagagagatggcgacaccctgccggacaggaagaatttcgattcccttctgtgggcgatcgtgacagtcttccaaatcttaacacaggaggattggaacaaagtgctgtataacgggatggcgtcaaccagttcctgggccgcactttattttattgctctgatgacctttgggaactacgtgctgttcaacctgttagtcgccattctggtggagggatttcaagccgagggggacgctaacaagtccgaaagtgagcccgacttttttagcccctccctggatggagatggggatagaaaaaagtgtctggctctggtcagcctaggggagcacccagagttacgcaagtcgctgctcccccctctgatcatacacaccgctgcaactcctatgtcattacctaagagcacatcaacagggttgggggaagccctcgggccagcatctcggaggacaagttctagcggcagtgctgaacccggtgctgcccatgaaatgaagtcccctccatccgcccgatccagtccgcattcaccatggagcgccgcaagttcttggacctccaggcgaagctcccgaaacagcttggggagggcgccatcccttaagcggaggtcgcccagcggtgagcgccgttctttgctcagcggtgagggccaggaatcgcaggatgaagaggagtcaagcgaagaggaacgggctagcccagctgggagtgaccatcgccacagaggctccctagaaagggaagcaaaatcctcattcgacctgcctgataccctccaggttccaggcttgcatagaacggccagcggaagagggtcagcttctgaacatcaggattgcaacggcaagtctgcaagcgggaggctggccagagctcttcgcccagacgaccccccactggatggcgatgatgctgacgacgagggcaatcttagcaagggggaacgcgtgagggcctggattcgcgctcgtcttccggcttgctgtctggagcgagacagctggagtgcgtacattttccctccccaatctcgcttccgcctgttatgccatcgcatcatcacccacaaaatgttcgaccatgtcgtgctagtgatcatttttctgaactgcatcaccattgctatggaacgtccaaaaatcgaccctcacagcgccgaaagaatttttctgaccctgtctaactacatcttcacagccgtgttcctggccgagatgacagtaaaagtcgtcgccctgggctggtgttttggggaacaggcctatctgcgaagcagctggaacgttctggatggactactggtgctgatcagcgtcatcgacattctggtctcaatggtgagtgactctggaactaaaattttgggcatgctccgagttttacgcctgctccgaaccctgagaccactcagagtaatttcgcgcgcacagggcctgaagctagtagttgaaactcttatgtcatccttaaagcccatcggtaatatcgtcgtgatttgctgtgctttttttatcatcttcgggattttaggcgtccagctcttcaaagggaagttcttcgtctgtcagggcgaggatacccgcaacataacaaataaaagcgattgtgccgaggcctcctaccgctgggtgagacataaatacaacttcgacaatctgggtcaggcgctaatgtcacttttcgtcctggcctcgaaggacggttgggtagacattatgtacgacgggctagatgctgtgggagtggaccagcagcctatcatgaaccacaatccctggatgcttctttacttcatcagctttttgctgattgtcgctttcttcgtgctgaatatgttcgtaggagtggttgtggagaattttcataagtgtcgccagcaccaggaggaagaggaagcaagaagacgggaggagaagaggctgaggaggcttgaaaagaagcgtcggtctaaagaaaagcagatggcagaagcacagtgcaagccctactactctgactactccaggtttaggttattagtgcatcatttatgcacttctcattaccttgacttattcattacaggagtgataggtcttaacgttgttaccatggcaatggagcactaccagcagccacagattctcgatgaagcccttaagatctgtaactatattttcaccgtgatcttcgtgctagaatctgtgttcaagctggtagctttcggattccggaggtttttccaagataggtggaaccagctagacctggccatcgtgctcctgtctattatgggaatcaccttggaagagattgaggtcaacgcctcgcttccaattaatcccactataatccgcattatgagagtgctccgcattgctcgcgttctcaaattgcttaagatggccgtgggaatgagagctctcctcgacactgtgatgcaggcattgccccaggttgggaatcttggactactgtttatgctattgttttttatcttcgccgctttgggagtagaactattcggggatctggagtgcgatgaaactcatccctgcgagggtttgggccgtcatgccaccttcaggaatttcggcatggcctttctgacactcttcagagtgagcacaggggacaattggaacggcataatgaaggataccctaagggattgcgatcaagagtccacctgctacaatactgttatctcaccaatctattttgttagcttcgtgctgacagctcaattcgtgctggtcaatgttgtcatcgctgtattgatgaaacacttggaggagtccaataaggaggctaaagaggaagccgagcttgaagccgaactggagttggagatgaagacactgtcaccccagcctcattctcctcttggaagcccgtttctatggcccggagtggaaggcccagactctcccgatagtcccaaaccgggagccctgcaccccgcagcccatgctagaagcgcttctcactttagtttggagcacccgacaatgcaaccacacccaactgagctacctggccctgatctcttgacggtaagaaaatccggtgtctccagaactcacagcctgccaaatgattcttatatgtgccgccacggctctaccgcagaggggccactggggcatagagggtggggattgcccaaggctcagagcggctcagtgctgagtgtacactcccagccagctgatacaagctacatactccagctgccaaaggacgcaccccatcttctgcagccacactcagcgcctacttgggggactatcccaaaactgcctcccccaggcagatctcccctcgctcagagaccgttgaggcgccaggccgcaatccggactgattcattggacgtccaaggactgggcagccgagaggacctgctggcagaggtgagtggcccatccccccctttagcacgagcatacagcttctggggacagagttccacccaggcccaacaacacagtagaagtcattccaaaatcagcaaacacatgacaccacctgctccatgcccagggccagagcccaattgggggaaaggtcctcccgagacccgttctagcttggaactcgacactgagcttagctggatctccggggatctcctgccgccaggtgggcaagaggagcccccatccccaagagatctgaagaagtgttactcagtggaggcacagagttgccagcggaggccaaccagttggctcgacgagcagaggcggcactcaattgcggtaagctgtctcgattccggttcacagccacatctgggcactgaccctagcaacctgggcggacagcccttgggcggacctggctccagaccaaagaaaaagttgtcacccccttctattaccatcgatcctcccgagagccagggcccacggacaccgccatcgcccggaatttgtctgaggaggcgtgctccatcctccgacagtaaagaccccctggcttctggcccaccagactccatggccgctagccccagccccaagaaagatgtattgtctctgagtgggctctcttctgaccctgctgacctggatcccta

SEQ ID NO: 48681 - DNA, 7031 bp, Artificial Sequence
  Description of Artificial Sequence: Synthetic coding sequence
atggacgaggaggaggatggtgctggagctgaggagtctggccagccacgcagcttcatgcgattaaatgatttgagcggggcaggcggtaggccaggtccaggtagcgccgagaaagatccaggcagcgccgatagcgaggcggaaggcctcccatacccagccttagcacctgtggtcttcttctacctgagccaggacagccgacccaggtcctggtgcctgcgaactgtatgcaacccttggttcgagcgtatctcaatgcttgtgatactccttaactgcgtcactctgggcatgtttcggccatgcgaagatattgcgtgtgacagtcaacgttgcaggatattgcaggcgttcgacgatttcattttcgctttttttgccgtggagatggtggtgaagatggtggccctcggcatttttggcaagaagtgctatctgggggacacatggaatcgcctagacttcttcatagtgattgctgggatgctagagtactccctggatctgcagaacgtctccttcagcgctgtcaggactgtgagggtcctgcggccactgagagccataaatagagtgccatccatgaggattctggtgaccctcctattggacacgctccccatgctggggaatgtgctcctgctgtgtttcttcgttttttttatcttcggcattgtcggggtccagctctgggccggactgctgcgcaatcgctgttttttacctgaaaacttctctctgcctctgtcagtcgatctggagcgctactaccagaccgaaaatgaggacgagtccccttttatctgtagtcagccccgtgagaacggcatgcgctcttgtaggagcgtgcctacgcttaggggggatggaggaggaggacctccctgtggactggattatgaagcatataattctagtagcaatactacatgcgtgaactggaaccagtattataccaattgttctgcgggtgagcacaatcccttcaaaggagccatcaactttgataatatcgggtatgcctggatcgccatttttcaggtcatcaccttggaaggttgggtcgacatcatgtatttcgtgatggacgcccactctttttataactttatatacttcattcttctgataatcgttggttctttctttatgataaacctgtgtctagtcgtcatcgccacccagttttccgagactaaacagcgcgagagccaactcatgagggaacagagagttaggttcctctcaaatgcatctaccctggcttctttttctgaacctggctcatgttacgaggagcttcttaaatacctcgtctacatactgcgcaaagctgccaggcgactggctcaggtctcacgagcagccggtgtgcgggtcggccttctgagtagtccggcacccctggggggacaggagactcagccttcttcgtcctgctccaggtcccataggcggttaagtgtgcaccacctggtccaccatcaccaccaccaccaccaccactaccatttggggaatgggactcttagggctccacgggcatctccagagatccaggacagagacgccaacggtagccgcaggctcatgttgcctcccccttccacccctgctttgtcgggcgctccaccgggaggtgccgagagtgtgcactctttttaccatgccgactgccaccttgagcctgtgcgttgtcaggctcccccaccacggtccccttctgaagcttctgggagaacggtggggtcaggcaaagtgtaccccactgtgcacacttccccaccccctgagaccctgaaagagaaggctctggtggaggtcgcagcaagcagtgggccaccgaccctcacaagcttaaacataccccctggcccttatagcagcatgcataagctccttgagacacagagcactggggcttgccagtcgagctgcaaaatcagttctccttgtctaaaagccgattctggagcctgtggcccagactcatgtccatactgtgctcgtgccggtgcgggagaggtggagttggccgatagagaaatgcctgactccgactccgaagcggtatacgaatttacccaggacgcccaacattccgatttgcgggatccccactccaggcggcagaggtctttgggcccagacgcagagccatcgtcggtactggctttctggcggctcatctgcgatacctttcgtaagatagttgattccaagtattttggacgcggtatcatgatcgctattctggtcaatacactgagtatgggcatcgaataccatgaacagcctgaggaactcactaacgcccttgagatttccaatatcgtcttcaccagcttattcgccctcgagatgctcctgaaactgctcgtgtatggtcccttcgggtacattaaaaatccatacaacatattcgacggagtcatcgttgttatcagcgtctgggaaatcgttggtcaacagggcggaggactgtccgtgttaagaaccttccgccttatgagggtgcttaaattggtgcgcttcctgccagcgctccaacgacagctggtggtgctcatgaagaccatggataatgtagcaacattttgcatgctcctcatgttatttatctttattttcagcatattggggatgcacctcttcggatgcaaattcgccagtgagagagatggagacacactgcctgatcgcaagaatttcgatagcttgttgtgggctatcgtgaccgtgttccagatacttacgcaggaggactggaacaaagtactgtacaacggcatggcatcaacctccagttgggcagccctatatttcatcgcgctaatgacatttggcaactatgtgttgtttaatctgcttgtcgctattctagtggagggttttcaggcagaaggagatgcaaacaagtccgagagtgagcccgattttttttctccaagcctcgacggggatggggaccgaaaaaagtgcctggccttagtctctttaggggagcatcccgagctgcgaaaatcccttctcccacccctcatcatacacaccgctgccacccccatgtccttgcccaaaagcaccagcacaggtctcggcgaggctctcgggccagcctccagacgcacttcctcttcaggctcggctgagcctggcgctgctcacgagatgaaaagtcccccttccgctcggagctctccccactctccatggagcgccgcaagttcgtggacatcccgacgtagcagtcgaaactctttggggagggcgcctagtctcaagcgcaggtcgcccagtggtgaacgcaggtcactactgtcaggcgaaggccaggagtctcaggacgaagaagagtctagcgaggaagagagggcctcaccagctgggtctgatcatcggcatcgtggttccctggagcgcgaagcaaagtcctcctttgacctcccggatacactgcaagtgcccggactgcaccgaaccgcctcggggcgtgggagtgcatccgagcaccaagactgtaacggcaagtctgcctctggcagactggcgagagccctgcgtcccgatgaccccccactcgacggggacgatgcggatgacgaaggaaatttatccaaaggtgagcgggtacgggcttggatccgggcacgccttccagcttgctgccttgagagagactcatggtccgcgtacatcttccctccacaaagccggttccgactgctgtgccataggatcatcactcacaaaatgttcgaccatgtggttttggtcatcatcttcttgaactgtatcaccatcgccatggaacgccctaagatcgacccacactctgccgagagaattttcctcaccctgtcgaactatattttcactgctgtgtttctggccgaaatgacagtcaaggtcgtggccctgggatggtgtttcggagagcaggcctatctgcgcagtagctggaatgtgcttgatggcctgttagttctgatctccgtgatcgatatcctagtgtctatggtgtccgacagcggcaccaaaattctcggtatgcttagggtcctgcgcctgctaagaacccttcgccctctccgcgttatctcaagagcccaggggttgaagctggttgtcgaaacattaatgagctctctgaagccgatagggaatatcgtcgtgatctgctgcgccttcttcatcatttttggtatattgggagtgcagttgttcaaaggaaagttcttcgtctgccagggtgaagacactcgcaatatcaccaataagagcgattgcgccgaagcatcttacagatgggttcgccataaatacaactttgacaatctggggcaggctctgatgagcctatttgttctcgccagtaaggatggttgggtggacattatgtacgacggactggacgctgtaggcgtcgaccaacagcctattatgaaccataatccttggatgctactttactttatctccttcctacttatcgttgcattctttgttttgaacatgtttgtgggagttgttgttgagaacttccataaatgcaggcagcatcaggaggaggaagaagccagacgtcgagaagagaagaggttacgcagactagagaagaagcgccgaagcaaagagaaacagatggctgaggctcagtgcaaaccctactactcagactatagcagattcagactgctggtccaccacttatgcactagccattatctggacctgtttatcacaggagtcattgggctgaacgttgtgacaatggccatggagcattatcagcagcctcagatcttggacgaggctcttaagatttgtaactacatctttactgtgatcttcgtcctagaatcagtcttcaaattggtggcttttggcttcaggagattcttccaggaccggtggaatcagcttgatttagccattgtgcttctgtcaatcatgggcatcaccctggaggagattgaagtgaatgcctctctgcccatcaaccccaccattatccgcataatgagggttctgcggatcgcccgtgtgctgaaactgctcaaaatggccgttggaatgagggcgttgctggatacagtcatgcaggctctgcctcaggtgggcaatctggggctcctgttcatgctcctgttcttcatctttgctgctctgggagtcgagctctttggagatctcgagtgcgacgagactcacccatgtgaaggacttggcagacatgcaacattccgcaacttcggtatggcgttcctgactctgtttagggtgtctacaggggacaattggaatggcataatgaaagacacactacgggactgcgaccaggagagcacatgttataacactgtaatcagtccgatttattttgtgtcatttgtgctcactgctcagtttgttcttgtgaacgttgtaatagcagtactgatgaagcacctagaagaatcaaacaaggaggcaaaagaagaagcggaacttgaggctgaactagaactggaaatgaagactctttccccccaaccccacagcccccttggctccccattcctttggccgggagtcgaggggccagactcacctgactcccccaagcctggggcactccacccagccgctcatgccagaagtgcgagtcatttctccttagagcacccaactgatcggcagctgtttgataccatttctcttctcatccagggttccctcgagtgggagctaaagttgatggatgagctggcaggtccaggcggacaacccagcgcttttccctccgctccctcattaggtggtagcgatccacagattccattggctgaaatggaagctctctctcttactagtgagattgtttcggagccatcatgcagtcttgccctgacagacgacagtctcccggatgacatgcacactttgctactgagtgcactcgaatctaacatgcagcctcacccaaccgagctgcctggtcccgatcttttaaccgttaggaagagcggagtgagcaggacccactccctgccgaatgattcctatatgtgtcgccacggcagtactgccgagggaccattggggcaccgcggatggggattgccaaaggcccagtctgggtcagtcctgagtgtccacagtcaaccagcggacacatcctatattttacagctccccaaggatgcgccacatctgctgcagccgcattccgcgccaacctggggaaccatacctaagctgccgcctccgggaagaagcccgttggctcaaaggcccttgaggaggcaggcagccatccgcaccgatagcctggacgtgcaggggttaggctcacgggaggatctcctagctgaagttagtgggccaagtccgcctctggccagagcctactctttctggggccaatcgtctacccaggctcaacagcacagccgaagccacagcaagatcagcaaacacatgacccctccagcgccatgtccaggccctgagccaaattggggcaagggcccacccgaaactcgctcatcactcgaacttgacactgagctatcctggatttctggcgacctgctgccccctggagggcaggaagaaccccctagccccagagacctaaaaaaatgttacagcgtggaagcacagtcatgccagagaagacctacctcttggttggacgagcagcgaagacactccatcgctgtcagttgcctggactcggggtcacagccccaccttgggactgatccatctaatctgggtggtcaacccctgggtgggccaggatcccgtcctaagaagaaattgagcccacctagcattaccatcgaccccccagaatctcagggtcctagaacacctcccagcccagggatttgcctgcggagaagggcaccttcatcagatagcaaggatcctctcgctagcggccctcctgatagcatggccgcaagtccatcgccaaaaaaggacgtgctctcactgagcggactatctagcgatccggcagacttggatcccta

SEQ ID NO: 48682 - DNA, 6515 bp, Artificial Sequence
  Description of Artificial Sequence: Synthetic coding sequence
atggatgaggaagaggatggggctggagccgaggagagcgggcagcctagaagcttcatgcgcctcaatgacctgagtggcgcagggggtagaccaggccctggttcagccgaaaaagatccaggcagcgctgactccgaagccgagggactcccctatcccgctctggcccctgtagtctttttctatttaagccaggacagtcgcccaaggtcctggtgccttagaacagtgtgtaatccttggtttgagcgcatttctatgctggtgattctgctgaattgcgtcacgctggggatgtttcggccttgcgaagacatcgcttgtgatagccagcggtgtagaatacttcaggcattcgacgacttcatctttgctttttttgctgtggagatggtggttaagatggtcgccttgggaatcttcggcaagaaatgttatttgggcgacacatggaataggctggatttcttcattgtgattgctggtatgctagagtattcccttgatctccagaacgtttccttttcagcggttcggactgttagagtgctgcgccctttaagggcgatcaacagggttccctccatgcgcattttagtgaccttactgctggatacattgccaatgctgggcaatgtgctcctgttatgctttttcgttttcttcatctttggaatcgtgggcgttcagttgtgggctggccttttgagaaacaggtgttttctgcccgagaatttctccctgccattatctgtggatctagagcggtactaccagactgagaatgaagacgaatctccctttatatgctctcagccacgggagaatggtatgcggagctgccggtccgtgccaacacttaggggagacggaggaggaggcccaccatgcgggctggactacgaagcctataacagcagcagtaacaccacctgcgtcaactggaatcagtattacacaaattgcagtgcgggagagcataatcccttcaaaggcgcaatcaactttgataatattggctatgcttggattgccatctttcaggtgataacgttggagggctgggtggacattatgtatttcgtcatggatgctcactctttttataattttatctattttatcctgcttattatcgtaggatccttctttatgataaatttatgtttggtagtcatcgctacacagttctcagagacaaagcagagggagtcccagttgatgcgagagcagcgcgttagatttctgtctaatgcctctactctggcatctttttccgagcccggttcctgctatgaggaactgctgaaatacctggtatacatcctgcgaaaggctgctagacgcctcgcgcaggtgtcccgagcagcaggcgtgagagtcggcctgctatcaagtccggctcccctgggaggccaggagacccagccttcttcaagttgtagccgcagccatagacggttgtctgtccaccatctggtacatcaccatcaccatcaccatcaccattaccatctaggtaatgggacgcttcgggcacctagggcctcccctgagattcaggatcgggacgcaaacggctctcgtaggctgatgcttccaccaccttctaccccagccctgtctggcgctccacccggaggggctgagtctgtgcacagcttctatcacgctgattgccacctggaacctgtgcgatgccaggccccaccacccagatctccaagcgaagcctcggggaggacagtcggttccgggaaagtctaccctactgtgcatactagcccaccacctgagacactgaaagaaaaagccctcgtcgaagtggcagccagcagcgggcctcctacattaacgtcattgaatatcccccctgggccttattctagtatgcacaagcttctggaaacccagtctactggcgcatgccagtccagctgtaagattagcagtccatgtctcaaggccgactccggggcatgcggtccggactcttgtccctattgcgcgagggccggagcaggggaggttgagctcgccgaccgcgagatgccagatagcgacagcgaggccgtgtacgagttcacacaggatgcacagcattctgatttacgggatccacacagcagaagacagcgctccctgggacccgacgcagagccttcttccgtcctagccttctggagactcatctgcgacactttccgaaagattgtggacagtaagtactttggcagaggaatcatgatcgccattctcgtcaataccctaagtatgggaattgaatatcacgagcagccagaagagctgacaaacgctcttgagatctcaaacattgtcttcacttctctgttcgctctcgaaatgctgctgaaactgttagtctacggcccatttggatacattaagaatccttataacatcttcgatggagtgattgtggtcatcagcgtttgggaaatcgtgggccaacaggggggtggtctgtccgtgctgcggacctttcgcttaatgagggtgcttaaacttgtccggtttctgcctgctctccaacgacaattggtggtgctgatgaagactatggataatgttgccacattctgcatgttgctcatgctgtttatctttattttctctatcttggggatgcacctgttcggctgcaaatttgccagcgagcgtgatggggacaccttgcccgatcgtaagaatttcgatagtcttctgtgggcgatagtcactgtctttcagatcctgactcaagaagattggaacaaggtactctataatggtatggcaagcacatcttcctgggcagccctgtacttcatagccctgatgacttttggtaactatgtcttgttcaacttattagtggccatcctggtagaaggatttcaagcagaaggagacgccaataaaagcgaatctgagcctgatttcttcagcccatctctggacggtgatggagatcggaagaagtgcctggcgcttgtttccctgggtgaacacccggagctgaggaaatctctcctgcctcctctcataattcacactgccgctacaccaatgagtctccctaagagcactagcacgggcctgggtgaggcactgggcccagcttcccgccgtactagttctagcgggtcagctgagcccggagccgctcatgagatgaagtcaccaccatcagcgcgttcctctcctcattccccgtggagcgccgcttcttcatggacctctagaagaagttccagaaattccctggggagagctcccagcctgaagcgccgtagcccgtccggagagagacgatcacttctgtctggtgagggacaggaatcccaggacgaggaggaatcgtcagaagaggagagagcttcccctgcaggctctgatcatagacatagaggttcattggagcgagaagcaaagagctcgttcgacttgcctgacactctgcaggtgcctggcctgcaccggactgctagcggacgtgggagcgctagtgaacatcaggactgcaacggcaagtcggcttccgggaggctcgccagggctctgcggccagacgatccgcctctggacggtgacgatgccgacgatgaagggaatctgtccaagggcgaacgagtgcgagcttggattagagcaagattgccagcctgctgcctggaacgggactcctggtctgcctacatctttcctcctcagtcccgctttcgtttactctgccatcgcatcattactcataaaatgtttgatcacgtggtgcttgtcatcatcttccttaactgtattacaatcgccatggagcggccaaaaatcgacccccacagtgccgagcgaatcttcttaactctttccaactatattttcaccgctgtgttccttgcagagatgacagtgaaagtcgtggcactgggttggtgcttcggcgaacaagcctacctgaggagctcttggaatgtgctcgatgggctcctggtgctaatatctgtgatagatatccttgtgtccatggtctctgattccgggacgaaaattctaggtatgctgcgcgtattgcggctgctgcgcacactgaggccattaagggtgatatccagggctcaaggtttaaaactagtggtggagactctgatgtccagcctcaaacctataggcaacatcgtggtcatctgttgcgcatttttcattatttttggaattttgggcgtccagctattcaaaggaaaattttttgtgtgtcagggagaagacacccggaatattacaaataaaagtgattgcgcagaggcatcctaccggtgggtgcggcacaaatacaactttgataatctgggacaagcattaatgagtttatttgtcctcgcctcaaaagacggatgggttgacattatgtatgacgggcttgatgcggtcggtgtcgatcagcaacctatcatgaatcataacccttggatgctcctctatttcatcagctttctcctgattgttgcattcttcgtgcttaatatgtttgttggcgtggtggtggagaacttccacaaatgccggcagcaccaggaggaggaagaagcacgaagaagggaggagaaaaggttaagacgactggagaagaaacggaggtccaaggaaaagcagatggctgaagcccaatgtaagccctactacagtgactacagcaggtttaggctactggtgcaccacttatgcacctcacactatctcgatctattcatcactggagttataggactaaacgttgtgaccatggccatggaacattatcagcagcctcagatcctggacgaagcgctgaaaatctgcaactatattttcaccgtcatctttgtgctggagagcgtcttcaaactggtggctttcggctttaggagattcttccaggaccggtggaaccagctcgatctagcgatagtcctgctgagtatcatgggtataacgctggaggagatcgaagtaaatgcttccttgccaattaatcccacaattattaggattatgagggtcctacgtattgccagggtacttaagcttctgaagatggcggttggaatgcgggcactcctggacacggtcatgcaggcactgccacaggtgggtaaccttggcctgctgtttatgcttctgtttttcatctttgcggctctgggcgttgagcttttcggtgatcttgagtgtgatgaaactcatccttgcgaaggcctgggaagacatgccacctttcggaactttggaatggcgtttctcacgctgttccgggtgtccacaggcgacaactggaacggcataatgaaggacactctgcgggattgtgatcaagagtccacatgttataatacagtcatctccccgatttattttgttagtttcgtgttaacagctcagttcgtcctggtgaatgtggtaatagcagtgcttatgaaacatcttgaagaaagcaataaggaagcgaaggaagaggcagaactcgaggccgagctagagctggagatgaaaaccctgtcccctcagcctcattcaccacttgggtccccattcctgtggcctggcgttgaggggccagacagcccagactcccctaagccaggagccttgcatccggctgcacacgcaagatctgcttcacatttctctctcgaacatccgaccatgcaaccacaccccaccgagctgcctgggccagatctgttgacagttcggaagtccggtgtttcccgaacacattccctcccaaatgattcctatatgtgccgccatggatccactgcggaaggtccattaggacaccgcggttggggcttgccaaaggcacagagtgggtcagtgttgagtgtgcatagccagcccgctgatacttcctatatcctccagctcccgaaagatgcaccacatctgctgcagcctcactcggccccaacatggggtaccatccctaaactgcctcctcccggtcgatccccactcgcccagagacccttaaggaggcaagctgcaatacgcaccgattcactggacgtacagggcctgggcagtagagaggatctcctggcggaggaggagccccctagtcccagggacctgaagaaatgttatagtgtcgaagcccaatcatgtcagcgtaggcctacatcctggctggacgagcagcgcaggcactccattgccgtgtcatgcctggactcggggtcccaaccgcatctcggcaccgatcctagcaacctgggcggacagcctctggggggtccaggttcacgcccaaaaaagaagctatctcctccctccattacaatcgatcccccagagtcacagggacctcgtactccccctagcccaggcatctgcctcaggcggagagcgccatccagcgattcgaaggacccgttggccagtggacccccagattcgatggcagccagtcctagccccaagaaggacgtgttaagccttagcgggttaagttcagatcccgcagaccttgacccgta

SEQ ID NO: 48683 - DNA, 7133 bp, Artificial Sequence
  Description of Artificial Sequence: Synthetic coding sequence
atggatgaggaagaagatggcgcaggagccgaggagagcggacaaccccgtagtttcatgaggctcaatgacctgtctggagccggagggaggcctggccctgggtccgccgaaaaggaccccggaagtgccgacagcgaagccgaggggttaccctaccccgctctcgcccctgtggtattcttttacctgtcccaggactcccggccacggtcatggtgcctgagaacagtatgtaatccgtggttcgaaagaatttctatgctggtaattctgcttaactgcgtgacattaggaatgtttagaccctgcgaggacatagcatgtgatagtcagcggtgtcgcatactccaggcttttgatgatttcattttcgccttcttcgctgtagagatggtcgtgaagatggtagctctcggcatctttggaaaaaagtgctacctaggggacacctggaataggctggatttcttcatcgtcattgctggcatgctcgagtattctctggatctgcagaacgtgtccttttccgccgtgaggaccgtgagggtgctgcgaccacttcgggctataaatcgagtacctagtatgcgtattctcgtgactctgctcctggacactttgccaatgctcgggaatgtcctcctcctgtgtttctttgtattcttcatcttcggcatagtgggcgtgcagttatgggccggactgctacgaaacagatgtttcctgcccgagaactttagtctacctttgtctgtggacctcgaacggtattatcaaacagagaatgaggatgagtcccccttcatatgtagtcagccacgtgagaatggtatgcggagctgccgctcagtccccacattgcgcggagatggaggaggtggccctccctgcgggctggattacgaagcctataatagtagctccaataccacttgtgtgaactggaaccagtattatactaattgttcggctggcgagcataatcctttcaaaggagctattaactttgacaacattggctacgcctggatcgccatcttccaggtcatcactcttgagggatgggttgatatcatgtatttcgtaatggatgcacattcattttacaatttcatctattttatcttgctgattatcgtgggaagttttttcatgataaatttgtgcctggtcgtgatagccactcagttctctgaaaccaagcaaagggagtcccagctgatgagagagcagagggtgcgttttctatccaatgcatccactctcgctagtttttccgagcccggaagctgctatgaagagttgcttaagtatttagtgtacatcttgcgcaaggctgccagaaggctcgcccaggtctcacgggcagccggagtgcgggtgggccttttatcctctcccgcaccactgggaggccaggagacccaacctagctcgagctgcagcaggtcacatagacgcctgtccgtgcatcacctggtccaccaccatcatcatcatcaccaccattatcacctgggaaacggtaccctgagagccccaagagcctcccctgaaattcaggatcgagacgctaacggatcccgcaggctgatgttacctcctccaagtactcccgctctttcaggcgctcccccaggaggggcagagagcgttcactcattctatcacgccgattgccaccttgaacccgtccggtgtcaagctccaccaccaagaagtccctccgaggcttccggccgtacagtcggatcgggtaaggtctatcctacagtgcacacctcccccccacctgaaaccctgaaggaaaaagctctggtcgaggtagcagcatcaagtggacctcccacgctgacctccctgaacatcccaccgggtccgtactcctcaatgcataaactgctcgagactcaaagcacaggcgcttgccagtccagctgcaaaatctctagcccatgcctcaaagccgactctggggcttgcggccctgattcatgcccctactgcgcaagagcaggagcaggcgaagtcgaactggccgacagagagatgccggatagcgactccgaggcagtctacgagtttacccaagatgcacaacacagtgacttgcgcgacccacatagcagacgacagcgctccctagggccagatgcggaaccttcaagtgttttggccttctggcgcctgatttgtgatacttttagaaaaatcgtggactctaagtactttggtagaggcataatgatagctattcttgtgaataccctgtctatgggcatcgaataccacgaacaacccgaggagctgaccaatgctctagaaattagcaacatcgtgttcaccagtctgttcgccttagaaatgctgttgaaactacttgtctatggaccctttggctacatcaagaacccttacaacatatttgatggggttattgtggttatttccgtttgggaaatcgtggggcagcaggggggagggctgagcgttttgcgaacatttcggctcatgcgcgtgttgaagcttgtgcggtttctgccagctctgcagcgccagttagtcgttctgatgaagacaatggacaacgtagccaccttttgcatgttgctgatgttatttatcttcatcttttcaatcctcggaatgcatctgttcggatgtaagttcgctagcgagcgcgatggagacaccctgcctgatagaaagaactttgactcccttctttgggccatcgtaaccgtcttccagatcctgactcaggaggactggaataaggtcctgtacaacggcatggcgagcacctcttcttgggcagccctgtattttatcgccctgatgaccttcggcaattatgtgttgtttaatctgctcgtcgctatactggttgaagggtttcaggctgaggaaatctccaagcgggaagacgccagcggtcagctgagctgcattcaactcccggtggattctcaaggaggtgatgctaacaagtccgaatctgaaccagatttcttttcccccagtttggatggagatggggatcgtaaaaaatgcttggcactcgtgagcctgggcgagcacccagagctgcgtaaatcacttctgccgccactcatcatccacacagccgctaccccaatgtcactgccgaaatcaacgtctactggactgggggaggccctggggccagccagccgccgaacctctagctcagggtcagctgaacctggtgctgcgcatgaaatgaaaagcccgccttctgcccgaagttccccacactcaccctggtctgccgctagcagttggacgtcgcggcgatcctcgcgcaactctcttggccgtgctccttcactcaagcggaggagcccctcaggcgaacggcgatccctcctgagcggcgagggccaggagtcccaggacgaggaagaaagctctgaagaggagcgtgcgtctcccgctggcagtgaccacagacaccggggatctctggagcgtgaagctaagagcagttttgacttgcccgatacactacaggtgcccggactgcaccgcacagccagcgggcgtggaagcgcttctgaacaccaggattgtaatgggaagtctgcttcaggcagactcgctcgagccctgcgccctgatgatcctccgctggacggcgacgacgccgacgatgaagggaaccttagtaagggcgagagagtacgtgcctggatccgcgctcgtctgccagcctgctgtctggaacgcgattcatggagtgcctatatcttccctcctcaatcccgcttcaggctgctatgccaccgtatcatcacccataaaatgttcgaccatgtggtcttggtaatcatctttctcaactgcatcactatcgccatggagagacctaagatcgacccacattctgccgaaagaatctttcttacactgagcaattacatttttacagcagtttttctcgctgaaatgacggtgaaagtggtggctctgggatggtgcttcggtgagcaggcttatcttagatcgagttggaacgtgctagatggactcctggtgttgatctccgtgatcgatatcctggttagcatggtttcggatagcgggactaaaatcctgggtatgctgcgcgtgctgcgtctcctgcgaaccctgcgccctctgagagtaatttcaagggcgcaagggttaaagctggtggtcgagaccctcatgagttcgctgaagcccattggtaacattgtggttatttgttgcgcctttttcatcattttcggtattctgggcgtacagctgttcaagggtaaattttttgtttgtcaaggagaagatacgcggaatatcactaataagagcgattgtgctgaagccagttaccggtgggtgaggcacaaatacaatttcgacaacctgggtcaggctctcatgagcttatttgtcctggcctctaaagacggatgggtcgatattatgtatgatggactggacgccgtcggagtggaccaacaacccatcatgaatcacaatccatggatgttgctgtatttcatcagttttctgcttatcgtggccttcttcgtgcttaatatgtttgttggagtcgtggttgaaaatttccacaaatgcagacagcatcaggaggaagaggaagcccgaagacgcgaggagaagagactgcggcgtctggaaaaaaaacggaggaatttgatgctcgatgatgtcattgcttcaggcagctccgcctctgctgcctccgaggctcagtgcaaaccatactattcagattatagtaggttcagactgctggtccaccacctttgcacatctcattatctcgatctcttcatcaccggcgtgatcggtttaaacgttgttacaatggccatggagcactaccaacagccccagatcctggatgaggccctcaaaatctgtaattatatattcacggtgatttttgtactggaatccgtcttcaaacttgtggccttcggcttcaggcgcttctttcaggatcgatggaaccagctcgatctggctattgttctgctgagcatcatgggaatcacgcttgaggagatagaggtcaacgccagcttacccatcaacccaaccataatacggatcatgcgtgttctgaggattgcgagagtcttaaagctcctaaaaatggccgtgggcatgagggctctgctcgataccgtcatgcaagcactcccgcaggtaggaaatctgggcctgctcttcatgctgctgttttttatcttcgccgcactgggcgtcgagctattcggcgacctagagtgcgacgagactcacccttgtgaaggcctgggaagacacgccaccttccgtaattttggtatggctttcctgacactgtttcgagttagcacaggagataactggaatggcattatgaaggacacgctccgggattgcgatcaggagtccacgtgctacaacacagtgatttctcctatctatttcgtgtcttttgtcctaactgcgcagttcgtactggtgaacgttgtgattgccgtactcatgaaacacttggaagagagtaacaaggaggcgaaggaagaggccgagcttgaggccgaacttgaactggagatgaagactctgagccctcagccccatagtccacttggatcgccattcctttggcctggcgtggagggccctgatagccccgacagcccaaaaccgggtgcgctccaccctgctgcccacgcccgttccgcaagtcatttctcactggagcatcccacggacaggcagctgttcgacacgatttctctgctgatccaggggagtcttgagtgggaactgaaacttatggacgaactcgcaggccctggcggacaacctagtgccttccccagtgctccctctcttgggggaagtgaccctcagattcctctggctgaaatggaggccctgtctctgaccagcgagattgtctctgagccttcctgcagtctggcacttacggacgactcccttcccgatgatatgcacactttgcttctgtccgccctggagagtaatatgcaaccgcacccgactgagctgcctggcccagatctgctgaccgtgcgaaagtctggagtgtcgaggacacattcgctgcctaatgattcatatatgtgcagacatggaagtacagccgagggccctttagggcatcggggatgggggctacctaaggcccaaagcggctcagtgctttccgttcacagccagcctgccgatacctcgtacattttgcaattgccaaaggacgccccacatctgttgcagccacacagtgctcccacctgggggactatcccaaagctgccccctcccggacggtcgcccctggcacagcgacccttaagacggcaggctgctataagaacagatagtctggatgtgcagggcctgggctctcgtgaggatcttctggctgaagtgtcgggcccaagcccccctcttgcaagagcctacagcttctgggggcagtcatcgacccaggcacagcaacatagtcgctcccacagtaagattagcaaacatatgacccccccagccccatgtcctggacctgaaccaaattggggtaaagggcctcccgagacaaggagcagcctcgagttggacacagagctgagctggataagtggagaccttctcccacccggagggcaggaagagccacccagcccccgagacctcaaaaaatgttattctgtggaggcacagtcttgtcaacggagaccaacgtcatggctagacgaacaacggagacattctatcgcagtgagttgtctggatagtgggtcacagccccacttgggcaccgatccctccaacctgggcggacagccacttggcggtcctggatctaggcccaagaagaagttatcccccccttctataaccatcgatccccctgagtctcagggtccccgaactccaccgtccccgggaatctgcctgaggaggagagcgcctagttctgactcgaaagatccgctcgcctccggacctccagactccatggcagcgtcaccttccccgaaaaaggacgtactctccctcagcggcctgtcgagtgatcctgcggacctggatcctta

SEQ ID NO: 48684 - DNA, 6785 bp, Artificial Sequence
  Description of Artificial Sequence: Synthetic coding sequence
atggacgaggaggaagacggcgcaggggctgaagaaagcggacagccgcgttcctttatgaggcttaacgatctgagtggcgctggaggtaggccaggacccggtagcgctgagaaggaccctggctctgctgatagtgaggcggaggggctgccttatcccgctctcgcccctgtagtgttcttttacttatcacaagactcgcggccacggtcttggtgtctgcgcaccgtatgtaacccttggttcgagcggattagcatgcttgtgatactactgaactgcgttacactcggcatgttccggccatgcgaggacattgcatgcgattcacagaggtgcaggattcttcaagctttcgacgattttatcttcgccttcttcgccgtggaaatggtcgtcaaaatggtcgcccttgggattttcggcaagaagtgttacctcggtgatacgtggaacaggctcgatttcttcatcgtaatcgctgggatgctagagtactctctggatcttcagaatgtttcattcagcgctgtgcggactgttcgtgtgttgaggcccttaagagctatcaatcgtgttccaagtatgcgaattctcgtcacactcctgttagacacactgcccatgctcgggaatgttcttttgctttgtttctttgttttctttatttttgggattgtcggggtccaactgtgggctgggctgctgcgaaacaggtgcttcctaccagagaacttctcactgcccttatccgtagacttggagcgttactatcagacagagaatgaagatgagagcccttttatctgcagtcagccaagggagaacggcatgaggagttgccgttccgtccccacactgcgcggtgatggaggtgggggtccgccatgtggtctggactatgaggcatataactccagcagcaacacaacttgcgtgaactggaatcaatactatacgaattgctctgccggtgagcataacccctttaaaggggctatcaatttcgataacatcggctatgcctggatcgccatttttcaggtcattacgctggagggatgggtcgacattatgtactttgtcatggacgcgcactcattttataactttatctatttcattctactaattatcgtgggatccttttttatgataaacctctgtctcgtggtgatcgcaacccagttttccgagacgaagcagcgagaatctcagcttatgagggagcagcgagtgcggtttctgtccaacgcatccacattggcttccttctccgagcctggaagttgttacgaggaactgctgaaatacctcgtttatatactcagaaaagcggctagacgcttagcccaggtctcccgcgcagctggagtccgggtgggacttctttccagtcccgcaccactcggcggtcaggagactcaaccatcctctagctgttctcgaagtcatcgtaggctttcagtccaccatctggtgcatcaccatcaccatcaccatcaccattaccatctgggcaacggcacccttcgagccccacgcgctagcccagagatccaggacagggatgcaaatggttctagaagactgatgctaccacctccgtcaactcctgcgctgtcaggcgctcctccaggaggcgctgagtcagtccactccttctaccatgctgattgccatctggaacccgtccggtgtcaggccccaccccctaggtccccatcggaggcctccggaaggaccgtaggtagtggaaaagtatacccgacagtccacacaagtcctcctcctgagaccctaaaggaaaaggccttggttgaagtcgctgcgtcttcaggccctcctaccctaacgtccctgaacattccgccaggaccctacagcagcatgcacaagctgcttgagacacagagcacaggggcttgccagtcaagctgcaaaatcagctctccatgtctgaaagcggactctggggcatgcggcccagacagctgcccctattgcgccagggctggcgcaggggaagtcgagttggctgatagagagatgccagattctgactcagaagcggtctacgagttcacacaagacgcgcaacactctgatctccgggacccacactcaagaagacaacgtagtttaggacccgacgccgagccctcatcagtgctggctttctggcggttgatctgcgacacctttcggaagatcgtagatagcaagtactttggcaggggcatcatgatcgcaattttagtgaatacccttagcatgggcattgagtaccacgagcagccggaagaactgaccaacgcccttgagatctcaaacatcgtatttacttccctgtttgccctggaaatgctgctgaagcttttagtgtatggccctttcggctatataaaaaatccatataacatctttgatggcgtgatagtggtcatttctgtgtgggagatcgtaggccagcaggggggagggcttagtgtgctccggactttccggcttatgagagtgttgaagctcgtgcggtttctcccggcactgcaacggcaattagtagtgttgatgaaaacgatggataatgtggctaccttttgcatgctgctgatgctgtttattttcatcttctccattttagggatgcacctgttcggctgcaagtttgctagcgagcgggacggtgacactctgcccgaccgaaagaatttcgacagtctgctgtgggcgattgtcactgtgttccagatcctgactcaggaggactggaacaaagtcctatataacggaatggcttcaacaagctcgtgggcagccctttatttcattgccctgatgaccttcggcaactacgtgttgttcaatctcctcgtggctatcctggtcgagggattccaggccgaaggcgacgccaataagtcagaatccgaacccgactttttctctccctcgttagacggagatggagaccgtaagaaatgtttggccctggtgtccctcggcgagcatccagaacttaggaagtctctgctcccccctctgattattcacacagcagccaccccaatgtcactcccaaaatctacttctacaggccttggcgaggcattaggacctgcgtccaggcgtaccagttcgagtgggtcagcagaacccggagcagcccacgaaatgaagtcgcctcccagcgcaaggtcttctcctcattcgccctggtctgctgcttcaagctggactagcagacggtcttcacggaacagtctgggcagagccccatcacttaaacgccgttcaccctcgggagaaagaaggtctctcctcagcggcgaagggcaggaatcacaggacgaggaagaatccagcgaggaagagcgtgcatctcccgctggatccgatcacagacaccgcggatctctggagcgcgaagccaagagctcatttgacctccccgacaccctgcaggtgcctggccttcacaggacggccagtgggaggggcagtgccagcgaacatcaggactgtaacggaaaaagcgcttcgggccgactcgcccgagcactgagaccagatgaccctcctctggatggtgatgatgcagacgacgaaggcaatttgtccaaaggtgaaagagtacgagcgtggattcgggctcggctcccagcatgttgcctggagagggacagttggagcgcctacattttcccaccacagtcaaggttccgcctgctgtgtcacagaattatcacccataagatgtttgaccacgtggtacttgtgatcattttcctaaattgcatcaccatcgctatggaacggcctaagattgaccctcacagcgcggagcgaatcttcttaacccttagtaactatatctttactgcagtgttcttggcggagatgaccgtgaaagtagttgctttgggttggtgcttcggcgagcaggcttacttacgcagtagctggaacgtcttggatggactgctggtactgatcagcgtgattgatatcctcgttagcatggtgagcgatagcggcaccaagatcctgggtatgctcagggtcctgcgcctgcttcgtacactgcgccctttgagggtgatcagccgggcacagggcctgaaactggttgtggaaacacttatgagttccctcaaaccgatcgggaacattgtcgtaatatgctgtgcattctttataattttcgggattctgggcgtgcagctgttcaaaggaaagttttttgtgtgtcaaggcgaggacacccggaacatcacaaacaaatctgattgtgcagaggcctcctacaggtgggtgagacacaagtataacttcgataatctgggacaggctctgatgtctctattcgttcttgcctccaaagatgggtgggtggacattatgtacgacggcctcgacgctgtaggtgtagatcaacagccaattatgaaccataatccctggatgttgctgtactttatcagtttcctattgatcgtggctttcttcgttctgaatatgttcgtgggtgtcgtggtggaaaattttcataagtgcaggcaacaccaagaggaggaagaggcaagaagacgggaggagaagaggttgcgacgtcttgaaaagaagaggagaaatttgatgctggatgatgtgatagcctctggatcttcggcctcagcagcttcggaggctcaatgtaagccttattattcagattacagccgattccgcctcctcgtccaccatctatgcacatcgcattacttagacctgtttattaccggggtcataggactgaacgtcgtgactatggctatggaacactaccaacaaccacagatattggatgaggctctgaagatttgtaactatatttttacggtcatcttcgtgctggagtccgtgtttaagttagtggctttcgggttccgaagattttttcaagatcgctggaaccagctagatctcgcgattgtgttactcagcatcatgggtattaccctggaagagatcgaagtgaacgccagcctgccgatcaaccccaccattatcagaattatgcgcgtgcttagaatagcaagggttctgaagctcctgaagatggctgtgggaatgcgcgcactgctcgatactgtgatgcaagctttaccccaggtcggaaatctgggactactgtttatgctgttgttctttatattcgccgcactgggtgtcgaattgtttggcgaccttgaatgtgatgagacccacccctgcgagggactcggcaggcatgccaccttcaggaattttggtatggcattccttactctgttcagggtgtcgaccggcgacaattggaacgggatcatgaaggataccctgcgcgattgtgaccaagagagcacctgctacaatactgtgatttcccctatctacttcgtgtccttcgtcctgactgcgcaattcgtactggtgaacgtagtcattgcagtgctgatgaagcatcttgaagagagcaataaggaagcaaaggaagaagccgaacttgaagcagaactcgagttggaaatgaaaaccctttcccctcagccacatagcccactcggtagtccatttttatggccaggggtggagggcccagatagtccggactccccgaaaccaggcgcattgcaccccgctgcccacgcacggagtgcatctcacttttcgttagagcaccctactatgcagcctcacccgacagaactccccggacccgacctactgactgttcgcaagtccggggtttctaggacccacagtctccccaacgattcctacatgtgcagacacggctccactgctgaaggtcccctggggcatagaggatggggtcttccgaaggcccagtctggcagtgttctgagcgtccacagccaaccggctgacacctcctacatcctacagttacccaaagatgctcctcatttattacagccacattcggcccctacttggggcaccattcccaagcttccccctccgggtaggtctccacttgcccagagacctcttaggcggcaggccgctattagaaccgatagcctcgatgtccaaggcctcggatcccgtgaagacttactggccgaagtttcaggcccatctccccctctggcaagagcatactccttctggggccagtcctccacgcaggctcaacagcattctaggagccattctaaaatatctaagcatatgacacctcccgcaccttgtccaggcccagagccgaactgggggaaggggcctcctgagacaaggagcagccttgagttagacacggaactttcatggatttccggggatctcctgcccccaggtgggcaggaggagcccccatcgccacgtgatctcaaaaagtgctacagcgttgaagctcagagctgccagcggagacccacatcctggctagacgaacaacggaggcacagcatcgccgtttcctgtctggactcaggctcccagccgcatctcggaacagatccatccaaccttggaggccagcctctgggcggaccaggatctcgcccaaagaagaagctatcaccgccttcgattacgatcgaccctccggagtcgcaaggcccacggacacccccttccccgggaatatgtcttcgacggagagcgccttccagcgactccaaggaccccttagcaagtggaccgccagattccatggctgcatctccatcacccaaaaaggacgtcctgagcttgtccggattatcaagcgacccagcagacttagaccctta

SEQ ID NO: 48685 - DNA, 4668 bp, Artificial Sequence
  Description of Artificial Sequence: Synthetic coding sequence
atggacgaggaagaagatggagctggagccgaggaatcaggacagccaaggtcttttatgagactgaatgatctgagtggggcagggggtcggcctgggccagggagcgctgagaaggaccccggaagcgctgattctgaagccgaaggactgccataccccgctctggccccagtggtctttttctacttgtcccaggatagtagaccacgctcatggtgtttgcggactgtgtgtaacccatggttcgagcggatcagcatgcttgtgatcctgcttaattgcgtgacactgggaatgttccgtccatgtgaagatatcgcctgtgacagccagcgttgtcgcatcctccaggcttttgacgactttatatttgcattctttgcagtggaaatggttgtgaagatggtcgcattgggcatttttggtaaaaagtgctaccttggggacacctggaacaggctcgacttcttcatcgtcatagccggaatgctggagtattctctggacttacagaacgtttctttctctgccgttcgtaccgtccgggtgctcaggcccctgagagctatcaaccgtgtgccgtcaatgaggatcctggtgactttgcttctagacacattgcctatgctcggtaacgtcctgctgctttgcttcttcgtgttttttattttcgggatcgtgggagtgcaattatgggcagggcttttgaggaacaggtgcttcttgcctgaaaacttctccttacccttgtctgtcgacctggagcggtactaccagaccgaaaatgaagacgagtcaccttttatatgctcgcaacccagggaaaatggcatgagatcgtgcagatccgtgccaaccttacgtggtgacggcggtgggggaccgccatgtggcctggactacgaggcctataactctagctccaataccacttgcgtcaattggaatcagtattacacgaattgtagcgcaggggaacacaatccatttaagggggctattaacttcgacaatatcggatatgcctggatcgctatattccaggtgatcacattggaaggctgggttgacataatgtactttgtgatggatgcccacagcttttacaatttcatatattttatactgctgatcatcgtcgggagcttctttatgatcaacttgtgtctggtcgtgatcgctacgcagttctcagagaccaagcagcgcgaaagccagctgatgcgggaacagcgggtcagattcctgtctaacgcttccacactcgcgagcttctctgaaccgggatcgtgctacgaggagctcctgaagtatctggtctacattttacgcaaggcagctcgcaggctggcccaggtctctagagcggctggcgtgcgcgtgggcctgcttagcagtcccgcaccactggggggacaagaaacacagccaagctcgtcctgctctaggtcccatagaagactgagcgtgcatcacctggtacatcaccatcaccatcaccaccaccattatcatctcggaaacgggactcttagagcacccagggcctctcctgagattcaagatcgggatgccaacggaagcagacggttaatgctcccaccaccatcaacacctgcactttctggggctccaccaggcggagctgagtcagtgcattccttctaccacgcagactgtcacttggagccagtacggtgccaggcaccgcctccccgatctccaagtgaggcctccgggcgaaccgtgggttctgggaaggtttacccaacagtgcatacctctcctccgcctgagactctcaaggagaaggcacttgtggaggtggccgcttcttccggtccgccaacactgacgagcttgaatattcctccagggccttactcatcaatgcacaaactccttgagacacagtctacaggcgcttgtcaatcctcatgtaagataagctccccttgcttgaaggcagacagtggggcttgcgggcctgatagctgcccctattgcgctcgggctggcgctggtgaggtggagctggccgacagagagatgcctgactcagattctgaggccgtttacgagttcacacaggacgctcagcacagcgatttgcgggacccacactcacgccgacagagatctttggggcctgatgcggagcccagtagtgtgctggccttctggcggcttatatgcgacacattcaggaagatagtggatagtaagtacttcggcagaggcatcatgatcgccattctggtcaacactctaagcatggggatagagtatcacgagcaaccagaagaactgaccaacgcactggagatcagtaacatcgtgtttacatccctgtttgccttagaaatgcttttaaagctgttggtgtacggccctttcgggtatattaagaatccctacaatatcttcgacggtgtcatcgtggtgatcagcgtgtgggaaattgtgggacagcaggggggtggtttatccgttctgaggaccttccgtctgatgagggttttgaagctggtaaggtttctgccggcacttcaacgccagctggtggtgctaatgaaaacaatggataacgttgctacattttgcatgctcctaatgttgtttatattcatctttagtatcttgggaatgcatctatttggatgcaagtttgcttccgagcgtgacggcgacactctgccggataggaagaattttgacagcctgctctgggctattgtgacagtgtttcagattctgacccaagaagactggaacaaggtcctttataacggcatggcttcaaccagctcgtgggctgccctgtactttatagcccttatgacgttcggaaattacgtgctgttcaacctgcttgtggcgatcctagtagaggggttccaggccgaagagatctctaaacgcgaggatgccagtggccagctgtcgtgtatacaattgcccgtggactcacaaggcggtgatgctaacaagtctgagtctgagcctgactttttttcacccagcctcgatggagacggcgataggaaaaagtgtcttgcactggtgagcctaggagaacaccccgagctccgcaagagtctgcttcctcccctgatcatccatacggctgcaacaccaatgtccctcccaaagtctacctcaaccggcctaggggaggccctgggaccagcttcacggaggacctcttcctctgggagcgctgagcccggagccgctcacgaaatgaaaagccccccaagcgctaggagctcccctcactcaccttggtctgccgctagcagttggacttcgagacgttctagcaggaatagtcttggaagggcgcctagtttgaaacgtagatccccaagcggagagcgccgaagcctcctgtctggagagggccaggaatctcaagatgaggaagaatcctcagaggaggagcgcgctagccccgcaggaagcgatcacaggcatcgcggttctttagaaagagaggccaaaagtagcttcgatctgcctgacacgctgcaggtgcccggattgcatcgaacggcgtccggacgtggctcggccagtgaacaccaagactgcaatgggaaatctgcttccggcaggctcgcaagggctctacgtcctgacgaccctccgctggacggtgacgacgctgacgacgaggggaacttgagcaaaggagagagggtgagagcttggatcagagcacgcctcccggcatgctgcctggaacgggactcctggagcgcatacattttcccccctcagtccaggtttcggctgctttgtcataggattatcacacacaaaatgttcgaccatgtcgtgctcgttatcatttttttgaattgcataacaattgccatggaacgcccaaagatagaccctcactccgcagagcgcatctttttaaccttgagtaattacatttttactgcagtattcctggcagagatgacagttaaagtagtggccctaggatggtgttttggcgagcaggcctaccttcggagcagctggaatgtgcttgacggactgctagtgcttatctctgtaatcgatatcttggtgtctatggtgagcgatagcggtaccaagatattggggatgctgcgggtcctgagactgctgcggactctacgcccactgcgcgtgatctctagggcccagggactgaaattggtggttgagactctcatgagtagcctcaaacccattggcaatatagtcgtcatttgttgcgcgtttttcatcatatttggcatcctgggagttcagctgtttaagggcaaattctttgtttgtcaaggcgaagacacccgcaacattacgaacaagagcgactgtgcagaggccagttaccggtgggtccgtcacaagtacaactttgacaacttaggccaggtgtccccccgtctgaggggcggagccgtggtcaaagaagcaggcggtggtactggcccatgtctggtcatacccgcagacagtggcggagggggacttcatgaagagatatccccatcccatcccctactcagcaaccaccagcatgtggctaagccatccccttctcactccgctccaaagtcaggccctatggggtccctggctgttttgaaggacgaggaaacggaggcgcagaggggatag

SEQ ID NO: 48686 - DNA, 6800 bp, Artificial Sequence
  Description of Artificial Sequence: Synthetic coding sequence
atggacgaagaggaggacggagctggcgctgaggagagtggccagcccagatcctttatgagactgaacgacctttccggtgctgggggtcgccctgggcctgggtccgcagaaaaggatcctgggtctgctgattctgaagctgagggcctcccttatccggctctggccccagtggtctttttctacttgtctcaggattctcgtccccgaagttggtgtctgaggactgtctgtaatccatggtttgagcggatctcaatgctagttatccttctgaactgtgttacactggggatgtttagaccatgcgaagatatcgcctgtgatagtcagaggtgtaggatcctccaggcatttgacgatttcatcttcgctttcttcgctgtggaaatggtggtgaagatggtagccctaggtatttttggaaaaaagtgctatctcggcgatacatggaaccgactcgatttctttatcgtgattgctggcatgttggaatactcccttgatcttcagaacgtctctttctccgcagtgcggactgtgcgagtgctcaggcctttgagagctattaacagagtgccttcaatgaggattctcgtcacccttttactggacacgttgcccatgttgggcaatgtgctgctgctctgtttcttcgtgtttttcatttttgggattgtaggcgtgcagctgtgggctggcctactgaggaatagatgttttcttcctgagaacttctccctgccgctgagtgtcgatctcgagcgttattaccaaacagaaaacgaggacgagagcccattcatctgctctcagccccgagagaacggcatgcggagttgtcgatcagttccaacattgagaggagacgggggtggaggacctccttgcggactagactatgaggcctataactcgtctagcaacaccacgtgtgtaaactggaatcagtattatacaaattgctcagccggagagcataatccatttaaaggagcaatcaacttcgataatatcggatatgcatggattgccatcttccaggtgattacactggagggctgggtggatatcatgtatttcgtgatggatgctcacagtttctataatttcatttatttcatactgctaattatagtgggatcattctttatgattaacctgtgccttgtggttattgctacgcagttctccgagaccaaacaaagggaaagccagctgatgcgcgaacaacgcgtgcgattcctgagtaacgccagtaccctggcatcttttagcgaacccggtagttgttacgaagaactgctcaaatacctcgtgtatatcctccggaaggccgcaaggcgactggcccaggtatcaagagcagccggtgttcgggtgggtctactgagctcccctgcccctctgggagggcaggaaactcagccaagcagctcttgttcgagaagccatcgaaggctgagcgtgcatcacctcgtgcaccatcaccaccaccatcatcaccactatcacctgggaaacgggactctgagagctccaagagcatccccagagatccaagacagggacgccaacggaagcaggaggttaatgttacctcctcctagcacccccgctctttctggcgcaccaccgggaggcgctgaatccgtgcacagtttttaccacgccgactgtcacctcgaacctgtacgctgccaggctccccctccaaggtcaccctccgaggcatcagggcgaaccgttgggtcggggaaagtgtacccaacggtgcacacctcaccacccccagagacactgaaagaaaaagcgcttgtggaggtggccgctagtagcgggcctcccacactcacctctcttaatatcccacccggtccctactcaagtatgcacaagctgctggaaactcaatcaactggtgcatgtcagtcaagctgtaagatatcttccccttgcttaaaagccgacagcggagcttgcgggccagactcctgcccttactgtgctcgggctggcgctggtgaggttgagctcgccgatagagagatgcccgattctgattcagaagccgtgtatgagtttacacaggacgctcaacattccgacctgcgtgacccccactcaaggagacagaggagtctgggcccagatgccgaacccagctccgtgctggctttctggcgcctcatttgtgatactttccggaagattgtggatagcaaatacttcgggagaggcatcatgatcgctatactggtcaacacgctgtcaatgggaattgaatatcacgagcagcccgaagagctcacaaacgccctggagataagcaacattgtcttcacaagtttatttgctctggaaatgttgctgaagcttctggtctacggcccttttggctatattaagaacccttataacatatttgatggagtgattgtggtcatttccgtgtgggaaatcgtgggccagcagggaggcggactgtcagtgctccggactttccgattgatgcgggtgctcaagctggtgcgtttcctgcctgctctgcaacgacagctggtggttttaatgaagactatggacaacgtggctactttctgcatgcttttaatgctgtttatttttatcttttcaatcttaggaatgcatctctttggatgtaagttcgccagcgagcgggatggtgacacgctgcctgataggaaaaactttgacagcttgctatgggcaatcgtgactgtgttccaaattttaacgcaagaggactggaacaaagttttatataatggtatggcctctacctcaagctgggcagcactctatttcatcgcccttatgactttcggtaactacgtgctattcaatctcctggtagcgatcctggtcgagggctttcaggccgaggagattagtaaacgagaggatgcttctggtcaactgagctgcatccagcttcccgtagacagccaaggaggggacgcaaacaagtccgagagcgagcctgattttttctcccccagcctggatggggatggggaccgtaaaaagtgtctggccctggtttcactcggggaacatcctgagctaaggaaatcactgctcccaccactaatcatacacaccgccgctaccccaatgtcattgccaaagagcacatcgacaggtctgggcgaagctctcggacctgccagccggaggacgtcttcgtcagggagtgcagaacctggagccgcacatgagatgaagtcaccaccttctgccaggtcctctcctcattctccatggtcagcagcgtcttcgtggacttcccggcgtagcagtcgaaacagtctgggcagagctccttcccttaagcggcgatccccatccggcgaacgacgctccttgctgagtggggaagggcaagagagccaggatgaagaagaaagctctgaggaagaaagggcttctccagccggatcagatcaccgacacagaggtagcctagaaagggaagcaaaatcttctttcgacctcccagacaccctccaggtgcccggacttcaccgtaccgccagtggccgaggtagcgcctcagagcatcaggactgcaatggaaagagcgcctcaggccgtcttgcccgagcgctccgcccagacgatccgccactggacggagacgatgctgatgacgagggaaatttgtctaagggcgagcgagtgagagcctggatacgcgcaagactgccagcatgttgtctcgaacgggatagttggtccgcctacatctttccccctcagagtcgatttagactactgtgtcatcgcataatcacccacaaaatgtttgaccacgtggttctggtgatcattttcctgaactgcattactattgcaatggagcgcccaaagatcgatccacactcagctgagcgcatcttcctcactttgtcaaactatattttcacggcagtttttctggctgagatgacagtgaaagtggtggccctgggctggtgctttggtgaacaagcatacctccggtctagctggaatgtgctggacgggctactcgtcctcatctccgttattgacatcttggtgagtatggtttccgatagcggaactaaaatacttgggatgctacgtgtcctccggcttctgcgaacacttagacctctccgcgtgatcagccgcgctcagggcctgaagctcgtagtggagacgctgatgtcgtcactaaaacccatcgggaatatcgtggtgatttgttgcgccttctttatcatctttggtatcttgggagtgcagctctttaagggaaaatttttcgtctgtcagggagaggacacacgtaatatcaccaacaaaagcgattgcgctgaagcgagttatcgctgggtgaggcataagtacaattttgacaacctggggcaggccttaatgtctctgttcgtgctcgcttccaaagatgggtgggttgatataatgtacgacgggctagacgccgttggcgttgatcagcagcccatcatgaaccacaatccctggatgctgctctacttcatatcctttttattaattgtggcttttttcgttttaaacatgttcgtcggggtggtggtggagaactttcacaagtgccgccagcatcaagaggaggaagaagcaaggcgcagggaggaaaagcggctgcgccgtctggagaagaagaggagaaaggcacaatgtaaaccttattatagcgattacagcagattcaggctgctcgttcaccacctatgcacttctcattacttggacctcttcattactggggtaatcgggctgaacgtagtgaccatggcgatggaacactaccagcagcctcagatcctggatgaagcactgaagatctgcaactatatattcactgtgatattcgtgctggagagcgtcttcaaactggtcgcctttggcttcagacgcttttttcaagatcgttggaaccagttagacctggctatagttctgctatctattatgggcattactctggaggaaatagaagtgaacgctagcctccctataaatcccactatcatacggatcatgcgggtacttcgaatcgctagggtgttaaagttgctcaaaatggccgtcggcatgagagctttgcttgacaccgtgatgcaggcactaccccaggtgggcaacctgggtctcctgtttatgttgctgttcttcattttcgccgctctcggggtggaactgttcggagatctggagtgtgatgaaacacacccttgcgagggtctcggcaggcatgctaccttccgtaattttgggatggccttcttaacactatttagggtctctactggagataattggaatggcatcatgaaagatacactgcgtgactgcgaccaggaatcgacttgctataacacggtcatctcaccaatctattttgtgagttttgtcttaacagctcaattcgtgctcgtgaatgtggttattgcagtccttatgaagcacctggaggagtccaataaggaggctaaggaggaagcggagctggaagctgaattggaactggaaatgaagaccctctcaccgcagcctcatagccctctgggatccccctttctttggccgggtgtggaaggacctgacagcccagattcccctaagccaggagccctgcaccccgcagcccatgccaggtcggcaagtcacttttccctggaacatcctaccatgcaaccccaccccaccgagctgcccggaccggacctgctaactgtaaggaaaagcggtgttagtaggacgcactccctgccgaacgattcatacatgtgtcgccatggcagtactgcggagggaccattaggacatagggggtggggcttgccgaaggctcagagcggatccgtattatctgttcactctcagccagcggataccagttacatcttgcaactgccaaaggatgcccctcatctgctgcaaccccattcggcgccaacgtggggaactattccgaagctaccccctccaggtcggagtccactggcgcagcgcccactgcggagacaggcagctataaggactgacagcctggacgttcagggactggggtcccgtgaagaccttttagccgaggtgtccggaccatctcccccactggcacgtgcctattcattttggggccagtctagcacacaggcacagcagcattctaggagccactcgaaaatcagtaagcacatgacaccacccgctccttgtcccggtcccgagcctaactggggcaaggggccacctgagactagaagcagcctggagctggatacagagttgagttggatatccggagacctgttgcctcctggcggacaggaagagcccccatcccccagagaccttaaaaagtgctattcagtggaggcccagtcttgtcagaggcgcccaacttcatggctcgacgagcaacggagacacagtattgccgtttcctgccttgactccggatcgcagccccatcttgggacagatcctagcaacctcggtggacagccactgggcggaccaggctcacgaccaaagaaaaagctctcaccgccatcaattaccatcgaccccccagagtcccaggggcctcggacccctccatccccgggaatatgtctgcggagacgcgcaccctcgagcgacagcaaggacccgctcgccagcggccctcccgacagcatggctgcctctcctagtcccaaaaaagacgtcctcagcttgagcggcctgagctcagatccagccgatcttgacccata

SEQ ID NO: 48687 - DNA, 6731 bp, Artificial Sequence
  Description of Artificial Sequence: Synthetic coding sequence
atggatgaagaggaagacggcgcaggcgcagaggagtcgggccagcctcgttctttcatgagactcaacgacctgtccggggctggtggccgacctggcccaggatctgccgagaaagacccaggctctgcggattctgaggccgaagggttaccgtatcccgcactggctcccgttgtcttcttctatctgtctcaggatagccgacctcgctcatggtgcctcaggaccgtgtgcaatccttggttcgagagaatcagcatgctggtcatcctcttaaactgcgtgactctgggcatgtttagaccttgcgaagacatcgcctgcgattcccagaggtgtagaatcctgcaggctttcgatgattttatcttcgcattctttgcagtcgaaatggtcgtgaagatggtagctttgggaattttcggaaagaaatgctacttgggggatacctggaaccgattggatttcttcattgtgatcgccggtatgcttgagtatagtctagacttgcagaacgtgagcttctcggcagtgagaactgtgcgcgttcttaggcccctcagagccatcaacagggtcccgtcaatgaggattcttgtgacattattactggacactttgcccatgcttggtaatgtactcctgctgtgcttcttcgtcttcttcatttttgggatcgtcggcgtacagttatgggccggacttctgcgaaacagatgtttcctgcctgagaacttttcattgccattgtcggtggatctcgagcgatactaccagaccgaaaatgaggatgagtccccctttatctgtagtcagccaagggaaaatgggatgaggtcatgccgatctgtgcccaccctgcggggagatggcggaggtggcccaccctgcgggctggactacgaagcgtataactcatcaagcaacacgacctgcgtcaactggaaccagtactatacgaactgttccgctggtgaacataatccgtttaagggagccattaacttcgataatattggatatgcctggatcgccatcttccaggttatcacactggagggctgggtcgacattatgtactttgttatggatgcgcatagtttttacaacttcatatatttcatccttctcattatcgtggggagcttttttatgattaacctatgcctcgtggtcatcgccacacagttttccgaaacaaagcagcgcgagagtcaattgatgagggaacagcgagtcagattcttatccaacgccagcacacttgcatcttttagtgagcccggatcatgctatgaggagctactgaaatatctggtctatatcctccgtaaggccgcacgtaggttggcgcaggtcagtagagcagccggagtccgagttggacttctgagcagtcctgctcctttgggaggccaggagactcagcctagttcgtcttgcagccggagccaccggaggctgagcgttcatcacttggtacaccatcaccatcaccatcaccaccactatcacctgggaaacgggactctgcgtgcaccccgtgcaagcccagaaatacaggaccgtgacgccaatggaagtcgtaggctaatgctgccccctccttccacccccgctctatccggagctcctccagggggagctgaaagcgtacattccttctaccatgccgattgccacttagaaccagtgcgatgccaggcccctccaccaagatccccatctgaggcctctggcaggacagtgggaagcggcaaggtgtaccccacagtgcacacatccccgcctcccgagacattaaaagagaaagctttggtcgaggtggccgcatcctctggaccacccaccctgacctctttgaacatcccccctggtccctacagtagcatgcacaagctccttgagacccaaagcactggggcttgccagtctagctgcaagatttcaagcccttgcctgaaagcggattccggcgcttgtgggccagatagctgtccctactgcgcacgagcaggtgctggcgaggtggagctggctgacagagaaatgccagactccgattctgaagccgtttacgagttcacgcaggacgctcagcattccgatctgcgggaccctcatagtcgccgacagaggtccctgggaccagacgcggaacctagtagcgtattggctttttggaggctgatttgtgatactttcaggaagatcgtggactcaaagtacttcggacggggtataatgatcgccattctggttaataccctctccatggggatagagtatcatgaacagcccgaggaactcactaacgccctagagatctctaatatcgtcttcaccagtctcttcgccttagaaatgctactgaagctgctggtttacgggccatttggctacatcaaaaacccatacaatatttttgatggcgtaattgtggtgatttccgtctgggagatcgtcggacagcagggcggaggactgtctgtcctgcgtacttttagactcatgagggtgctgaagctcgtaagattcttacctgctctgcagaggcagttggtagttctgatgaagactatggacaacgtggcgactttctgtatgctgctcatgttgttcatcttcatcttcagtattcttggaatgcatctgttcggctgcaagttcgcgtctgaacgagatggcgacaccctacctgaccgaaagaattttgacagcctgctgtgggcaattgtcacggtgttccaaatcctgacccaggaggattggaacaaagtactgtacaacggcatggcttccacctccagctgggccgcactgtattttatcgctctcatgaccttcgggaactacgttctttttaaccttctggtggcaatcctggtcgaaggattccaggctgaaggggatgctaacaaaagtgagagcgagcccgattttttctctcctagccttgatggcgacggcgaccgcaaaaagtgcctggccttggtttctcttggcgaacaccctgaattaaggaagtccctgctgccacctctaattatccatacagccgctactccaatgtccctgccgaagagcaccagcactggtctcggtgaggcacttggccctgcctcaaggcgaacttcttcttccggctccgccgaacctggggctgcgcatgagatgaagagccctccatctgccaggtcttccccacacagcccttggtccgccgcatcttcatggaccagcaggcggtcgagccgcaattctctgggaagagcccctagcctcaagagaaggagtcccagtggggaacggagatccctgctttcaggagagggccaagaatcacaagatgaagaggagtcgagcgaggaagagagggcctctccagctgggtctgatcatcggcataggggctctctcgaaagagaggcaaaaagtagtttcgacctgccagacacgctgcaggtccctggcctgcacaggactgcgtctggaagggggagcgcttctgagcatcaggactgcaatggcaagtcagcatctgggagattggcgagggcccttcggccagatgatccccctcttgacggggacgatgccgacgacgagggaaacctgtcaaagggggagagagtcagagcctggatacgtgctagactgcccgcatgctgccttgaacgcgattcctggtccgcctatattttccccccacagagccggttccgcctgctgtgtcaccggattattacgcataagatgttcgaccacgtggtattggtgatcatctttctaaactgcattaccatagcgatggaacggcctaagattgacccccattctgcagagcgaattttcctcaccttatccaactacatctttactgctgtgttccttgctgaaatgacggtgaaggtggtggcactggggtggtgtttcggcgaacaagcttacctcagatcatcatggaatgtactggatggtctgctcgtcctcatttccgttatcgatatattggtcagtatggtgtctgactctgggaccaagatcctcggcatgttaagggtgctgagactgctccggactctcagacctctgagagttatctcccgggctcagggcctgaaactggtagttgaaacgcttatgagtagtctgaaacccatcgggaacatcgtggtgatctgttgtgcctttttcattattttcggcatcctgggtgtgcagctattcaaaggcaaattctttgtgtgccagggagaagacacccgaaacataaccaataagtctgactgcgccgaagccagctaccgctgggttcggcataaatataacttcgacaacctcggtcaagctcttatgtctctatttgtcctggcctcaaaagatggatgggtcgacattatgtacgatggccttgatgcagtcggcgttgatcagcagccaatcatgaaccacaacccttggatgctgctctacttcatttcattcctcctgatagtcgcatttttcgttctgaacatgttcgtgggggtggtggtcgaaaattttcacaaatgccggcagcatcaggaagaggaggaggctcgtagacgtgaagaaaaacggctaaggaggctggagaagaaacgcaggaaggcccagtgtaaaccttattactccgactactcccgattcagactactcgtgcatcacctgtgcacatcccattacctggatctgtttatcaccggagtcatcggtctgaatgttgtgaccatggccatggagcactaccaacagccccagatactcgatgaagctctcaagatatgtaattacatttttaccgtcatcttcgtgctggagtcagtgttcaaactcgtggcctttggcttccgccgattttttcaggaccggtggaatcaactcgatttggccattgtcctactttctataatgggaatcacattggaagaaattgaggtgaacgctagccttcccatcaatcccacgataatccgaatcatgcgggtgctgcgaatagctagagttttgaagctgttgaagatggctgtgggaatgagggccctgttagatacagtcatgcaggccctgccccaagtcgggaacctcgggctgttatttatgctcctgttcttcatctttgcggctttaggagtggagctgttcggcgatctggaatgcgatgaaacccatccatgtgaaggactcgggagacatgccacgttcagaaactttggaatggcctttctaacactcttcagagtttctacaggggacaattggaacggcataatgaaagacacacttagagactgtgatcaggagtccacctgctacaatactgtgatctctcccatctattttgtgtcttttgtgctgacagctcagttcgtactggtcaatgtggtgatcgcggttttaatgaagcatttagaggagtccaataaagaagctaaggaagaagctgaacttgaggctgaactggaattagagatgaaaacactgagcccacaaccgcactcccccttggggtcaccctttctgtggcccggtgtcgaagggcctgattccccagactctcccaagcccggagcactgcaccctgccgctcacgctagatctgcctcccactttagtctggaacatcccactatgcagccccacccaaccgagctgccgggacctgacctattgacagtccgtaagagcggtgttagtcgcacacactcgctgccaaacgattcatatatgtgtcggcatggatcgactgcagagggcccactcggccatcggggatgggggttacctaaggcccagagcggcagcgttctgagtgtgcattcacagccggcagacacaagctatatcctgcagctcccaaaggatgccccacacttgctgcagccacatagcgcgcctacctggggaacgattcccaagttgcctccaccgggtagaagccctttagcgcaacgtcctctccgccgtcaggcagctatcagaacggatagcttggacgttcagggcctggggtcccgggaagacctcctcgctgaggtgagcggcccatccccacccttggctcgagcctactctttctggggacagagtagcacacaggcacagcagcatagtcggtcccacagcaaaatcagtaagcatatgacaccacctgcaccttgtcctggtcctgagcccaactgggggaaggggcctccagaaaccagaagttctcttgagttagatacagagctgtcatggattagtggggacttattaccgccaggtggccaggaagaacccccttctccacgtgaccttaagaagtgctattcggtggaggcacagtcttgtcagaggaggccaacctcttggctggatgaacagagacgccatagtatcgccgtgtcctgtttggattcgggcagtcagccgcacttgggcaccgatccaagtaacctgggaggccagccattagggggtccagggtcacgccctaagaaaaaattaagtcccccatccatcactattgatccccctgaatcccagggtcctcggaccccgccttctcccggaatttgcctcagacggcgagcgccttccagcgattccaaagacccattagcgagcggccctcccgactccatggcagccagcccaagcccaaagaaggatgttctctcgctgagcggtctttcctcggatcccgctgacctggatccgta

SEQ ID NO: 48688 - DNA, 6920 bp, Artificial Sequence
  Description of Artificial Sequence: Synthetic coding sequence
atggatgaagaggaagatggagccggagctgaggaaagcggacagcccagaagcttcatgagattaaacgatctctccggcgcaggaggcagaccaggccctgggtcggccgaaaaagatccaggaagcgccgacagcgaagcggaaggcctgccctatcccgcactggcccctgtcgtcttcttttatctgtcacaggattcccgacccagaagttggtgtctaagaactgtgtgcaatccctggtttgagcgcatctctatgttggtgattctcctaaattgcgttacacttgggatgttcagaccttgtgaagatattgcctgtgacagtcagaggtgtaggatcctgcaggctttcgacgatttcatcttcgcttttttcgcggtggaaatggtagtgaaaatggtagccctggggatttttggaaagaaatgttatcttggtgatacctggaaccgcctcgatttctttattgtgatcgctgggatgctcgagtactctctagatcttcagaacgtgtcttttagtgcggttcggactgtgagagttctgagaccattgcgggcaattaatagagtcccaagcatgcgcatcttggtgaccctgctcctcgacacactgcctatgttggggaatgtgctgcttttatgttttttcgtattttttatctttgggatagtgggcgttcagttatgggccggactgctccgtaatcgatgttttctgccggaaaatttctcactgcctctgtctgttgacctagaacgttactatcagacggaaaacgaggacgaaagccctttcatctgttcacagcctcgcgagaacggcatgaggtcttgtcggtctgtgccaactttgcgcggtgatggtggtggaggtcccccttgcggcctagattatgaagcttacaattcaagctctaatacaacatgcgtgaattggaaccagtactacaccaactgctccgctggagagcacaatcctttcaagggtgccattaacttcgacaacataggatacgcctggatcgccatttttcaggtcatcaccttggagggctgggtggacattatgtatttcgtcatggacgctcactccttctataactttatctatttcatactgctgataatcgtcggctcgttttttatgattaatctctgtctcgtcgtgattgcgacccagtttagcgagaccaaacagagagagtcccagctaatgcgcgagcaacgcgtcaggttcctttctaacgcctccactctggcctctttttcagaaccaggatcctgctatgaggagttgctaaaatatctcgtgtacattctgagaaaggctgctcgtagactcgcccaggtgagtcgcgctgccggtgttcgggtaggcctgctgtccagtcccgcaccccttggcggtcaagaaacacagcccagctctagttgctcaagaagtcaccggagattatcggtccatcacctggttcaccaccaccaccaccaccaccaccattatcacctgggaaatggaacactgagagcgcctcgcgctagccctgagatacaggacagggacgctaacgggagcagaaggttgatgctgcccccacccagtacaccagctttgagcggagctccgccaggcggtgcggaaagcgttcacagtttttatcacgccgattgtcaccttgaacccgtgcggtgccaggccccacctcctaggtcaccgtcagaggcaagcggtaggacagtggggtctgggaaagtttaccccaccgtgcacaccagcccgccacctgaaacacttaaggagaaggccctggtcgaagtggccgctagctcggggcctccaactctgacatctttaaatatcccgcctggaccctatagttctatgcataaactgctagaaacccaaagtacgggagcatgccaatcgtcttgtaagattagttcgccttgccttaaagctgactcaggtgcttgtggcccagacagctgtccatactgcgctcgcgctggcgcaggcgaagtggaactcgctgatagagagatgccagactcagactccgaagccgtgtacgagtttacacaggatgctcagcactccgatctacgagatccacactctaggcgccagcgctctctaggacccgacgccgagccctcaagtgttctggccttctggagactcatctgtgatacttttcgtaaaattgtcgattcaaagtacttcggccgaggtataatgatcgcgatactagtgaatactctaagtatgggcatcgaatatcacgaacagccagaggagttgacgaatgccttagaaatatctaacattgtcttcacaagcctgttcgccttggaaatgctgcttaaactgctggtctacggcccatttggttacattaagaatccatacaatatcttcgacggtgtgattgttgtgattagcgtatgggagattgtggggcagcagggcggaggtctgagtgtgctcagaacctttaggcttatgagagtgctaaaactggtacggtttctcccagcactgcagcgacaactagtggtgcttatgaagactatggacaatgtggccacattctgtatgctgctgatgttattcatcttcattttcagcattttgggtatgcatctctttggctgcaagttcgccagtgagagggacggcgataccctgcccgacagaaagaacttcgactctcttttgtgggcaattgtgactgtgttccagatactcacccaggaggattggaataaagtgctgtataatggcatggccagcacgagtagctgggctgccctctacttcatcgcgctcatgacattcggcaactacgtgctgttcaatctgctggttgccattctggttgaaggattccaggccgaaggtgacgccaataaaagcgaaagtgaacctgactttttctccccatcactggatggcgatggtgatcgcaagaaatgtcttgcactggtatcactgggtgagcacccagaactgcgaaaatccttgctcccaccacttatcatacacacagccgctactcctatgtctcttcccaagagcacgagcacggggttgggcgaggctctgggaccagcttccagaagaacctcttcctcgggctccgccgagcccggagctgcccacgagatgaaaagcccccctagcgctcggtctagtccgcactccccttggagtgcagcttcctcctggacctccagaaggagcagccggaactcccttgggcgtgccccttccttgaagagaagaagtccctcgggggaacgaagaagtctgctctccggcgagggccaggagtctcaagacgaggaggagtccagcgaggaagagagggcttcaccggctggatctgaccatcggcaccgtggctccttggagcgtgaggccaagagctcctttgacttgcctgacaccctacaagtaccgggattgcaccgcacggccagtggacgagggtccgcttccgaacatcaggattgtaatggaaagagtgcctcaggaagactggctcgcgcactgaggccagacgacccgccactcgacggggatgacgccgacgacgagggaaacttaagtaagggagaacgtgtcagggcctggatcagagccagactgcctgcgtgctgtctggagagggactcttggtccgcgtacatctttcccccacagagtcgctttaggttactgtgccaccggattataacccacaaaatgttcgaccatgttgtcctggtcatcatcttcctcaattgcattaccattgctatggaacggccaaaaatagacccccactcagcagagagaatctttcttactttaagcaactacatttttaccgctgtctttctggctgagatgactgttaaagttgtcgcgctcggctggtgtttcggcgaacaagcctatctgcgcagctcttggaatgtcctggatggcctgttggtcctcatctcagtcattgatattcttgtgtccatggtcagtgatagtggcacgaagattctggggatgttgcgcgtcctgcggttgctccgtaccttgcgaccgcttagagtgatatcacgagcgcagggcctgaaattagtggtggaaacactgatgagctctcttaaaccgatcgggaatattgtggtgatctgctgtgctttttttattatcttcgggattctcggcgtgcagttatttaagggcaaattcttcgtatgccaaggggaagacacaaggaatattactaataagagcgactgcgctgaggcgagctaccgttgggtcagacataaatacaatttcgacaatttggggcaggctctcatgtcactgttcgtcctggcctccaaggatggttgggttgacatcatgtacgacggtttggacgctgtcggcgttgaccaacagcccatcatgaatcataacccgtggatgctgctctacttcatctccttcttgctcatcgttgccttctttgtattgaatatgtttgtcggcgtcgtcgtcgaaaatttccacaaatgtaggcagcatcaggaagaggaagaggccaggcgaagggaggagaaaagactccggagactggagaaaaaaaggcgcaatcttatgctggatgatgttatcgcatctggctcttccgccagtgcggcttcagaggctcagtgtaaaccatactattccgactattctagattccggctgcttgttcaccacctgtgtacgagccactatttagatcttttcatcactggtgtaattggtctgaatgttgtgactatggccatggaacactaccagcaacctcagatccttgacgaggcccttaagatctgtaattacatttttaccgtgatctttgtgctcgagtcagtgttcaagctcgtggctttcggctttaggcgcttttttcaggatagatggaaccagttggacctcgctattgtgctcctcagcatcatgggaattacgcttgaagagatcgaggtcaatgcctccctgcccataaacccgacaattattaggattatgcgggtattgcgcatagcgcgtgttctgaagctcctcaaaatggctgtcgggatgcgtgccctgctggacactgtgatgcaagccttaccacaggttggaaacttgggactgctgtttatgttgcttttctttattttcgccgcactgggcgttgaattatttggcgatctggaatgtgacgaaacacacccgtgcgagggtctgggcaggcatgctaccttccggaatttcggaatggcattcttaactctttttcgggtatcaacaggagataactggaacggtatcatgaaggataccttgcgggattgtgaccaagaatcaacttgttacaacacggtgatttctccaatttacttcgtgagctttgtgcttacagctcagtttgtcctggtgaatgtcgtgatcgccgtactcatgaagcatctcgaagagagcaacaaagaagcgaaggaggaggcagaactggaggccgaattggagcttgagatgaaaaccctttccccacagcctcattcgcctttgggaagtccattcctctggccgggagtggagggtccagattcgcctgatagtccgaagcctggagccctgcaccccgcagcacacgctaggtccgcgtcacactttagtctggagcatccgaccattccgttggccgagatggaggccctctcactgacaagcgagattgtctctgaaccatcctgctctctggccctgactgacgattctctaccagatgacatgcacactctcctactgtcggcgctcgaatctaatatgcagcctcatcccacagagctccccggaccagatttgctgaccgtacggaagtctggagttagtcggacccatagtctgcccaacgatagctatatgtgcaggcatggctccaccgccgaaggcccacttggacaccgtggctggggcttgccaaaggcgcagtcaggctcagtgctctccgttcattcgcagcccgcagacaccagctatattcttcagctgccaaaggatgccccacatctgctgcagccccattccgcgccaacctggggaacaattcccaaacttcccccacctggcaggtctccgttagcacaacggccactcagacggcaagccgctattcgtacagatagcctggatgtgcagggcctgggctcgcgggaggatttgctagcagaagtgagcggccctagccctcccctcgcaagggcctactcattttgggggcaatcatcaacccaggcacagcagcactcacgaagtcattccaagataagcaaacacatgacaccacccgctccctgcccagggcctgaacccaactggggcaagggaccaccggagactcggtcatcactggagctggacaccgagttgagctggattagcggggatctactgcctccaggaggtcaagaggagcccccttctccacgtgatctgaagaagtgctattccgtggaagcccagagttgccagagacgacccacatcgtggttggatgagcaaagacggcactcaattgccgtgtcatgcttggacagcgggtcacagccccatttaggcacagatccttcaaatctgggcggacagcccctgggcggtcccggttcccggccaaaaaaaaagctgtctccacctagtattactatcgatcctcccgagtctcaggggccaagaaccccaccatcgcccggtatttgtttgcggagaagggcgccttcttctgattccaaggaccctttagccagcgggccaccggattccatggccgcatcgcctagccccaagaaagacgtattatctctgagtggcctcagtagtgaccctgccgatcttgacccata

SEQ ID NO: 48689 - DNA, 5261 bp, Artificial Sequence
  Description of Artificial Sequence: Synthetic coding sequence
atggacgaggaggaggacggagctggggctgaggaaagtggccagccaaggagtttcatgcgcttaaacgacctgagcggggcaggcggaagacccggacctgggtcagctgaaaaagacccgggttctgccgatagtgaggccgaaggtctcccttatcctgccttggccccagtcgtcttcttctatctgagccaggattctcgtccacgtagttggtgcctgcggaccgtatgcaacccctggtttgagagaatctcaatgctagtgatcctcctgaactgtgtgacactgggcatgttcagaccatgtgaagatattgcatgtgacagccaaagatgtcgcatattgcaagccttcgatgattttatcttcgcatttttcgccgtcgagatggtggttaaaatggtggcgttgggcatcttcgggaagaagtgctatctcggcgatacctggaaccggctcgatttctttattgttattgcgggaatgctcgagtatagcttggatctccagaacgtgagcttttccgctgtgagaaccgtccgtgtactaagacccctgcgggctatcaacagggtaccatccatgaggatattggtgaccttgctgttagacaccctccctatgctcggcaacgtgctgctgctttgttttttcgtctttttcatctttgggattgtgggggtgcagctgtgggcaggtctgctgcgtaacagatgctttttgcccgaaaacttctctctgccattgtcagtggacctggagcgatattaccagacggaaaatgaggacgagagccctttcatttgttcacagccccgagaaaatggaatgaggagttgccgcagcgtccccacattgcgaggagatgggggtggtggccctccctgtggcctggattatgaagcctacaactcttcatctaatacaacctgtgtgaattggaatcagtattatactaactgttccgcaggcgaacacaatccctttaagggggctatcaattttgacaatattgggtatgcatggattgcgattttccaggtcattactctggagggatgggtggatataatgtacttcgtgatggatgcacattctttctacaacttcatttactttatcctgctgataatcgtcgggtccttcttcatgattaacctgtgtcttgtggtcattgccacacagttcagcgaaaccaagcaacgagaatcacagctcatgcgggaacagcgcgtgcgtttcttgagtaacgcgagcactttagcctcattctctgagccaggcagttgctacgaagaactcctgaagtatctagtgtacatcctcaggaaagccgctcggaggctggcccaggtgtcaagagccgcaggagtcagagtggggctcttatccagtcctgctcctctgggcggacaagagacgcagccctcgagctcctgcagtcgctcccatcgcagactatctgtacaccatttggtgcaccaccatcatcaccatcatcaccactaccacctgggcaacggtaccttgcgagcccctcgcgcttcacccgaaattcaagatcgagacgccaacggctcaaggagactcatgctgcctccccctagtactccagcattgtccggagctccacccggtggcgcagaaagcgtccacagtttctatcacgccgattgccatctcgaaccagttagatgccaagcccctcccccacgtagcccttctgaggcgtcgggccgaacagttggctctggcaaggtttacccaaccgtgcacacctcacctcccccagaaaccctgaaagagaaggccttggtagaggtggccgcttccagcggaccgcctacacttacgtcattaaatataccacctggcccttatagcagtatgcacaagctattagagacacaatctactggtgcttgtcagagctcctgcaaaataagtagcccgtgtctcaaggctgactctggggcatgtggccctgatagttgcccatattgcgcccgtgcaggcgcaggggaagtcgagctggccgatagggagatgcctgacagcgattccgaggccgtatacgaatttacccaagatgcccagcactctgatctccgggacccacatagtaggcgccagagaagcctggggcctgatgccgaaccatcttcagttctcgctttttggagactgatctgcgacaccttcagaaaaatcgtcgattcgaaatacttcggcagggggatcatgatcgccatcctggtcaataccctgtccatgggaatagagtatcacgagcagcctgaggaattgactaatgccctagaaattagtaacatagtcttcaccagcctgttcgcgttggaaatgctcctgaagctcttagtctacgggccatttggatacattaaaaatccctataatatctttgatggagtaatagttgtgataagtgtgtgggagatcgtcgggcagcagggagggggattaagcgtgctcagaaccttcaggctgatgagggttttaaagctggtgcgcttcctgccagcactgcagagacagctggtcgttcttatgaagacaatggataacgtcgccaccttttgcatgttgctgatgctttttatattcattttttccatcctgggcatgcatctgttcggatgtaaattcgcctcggagcgtgacggcgacacactgccggaccggaagaatttcgattctttgctgtgggctatcgtgactgtgttccagatcctgactcaggaagattggaataaggtcctgtacaacggcatggcttccacctcatcctgggccgctctgtacttcatcgccctgatgaccttcggaaattacgtcctttttaacttactggtagcaatactggtggagggtttccaggcagagggtgacgcgaacaaatccgaaagcgaacccgatttcttctccccctctctcgacggtgatggggacagaaaaaagtgccttgcactggtgagcctgggcgagcaccccgaactgcgcaagagccttctccctcccctgatcatacacacagctgccacaccgatgagcctccctaaatcaactagcacaggcctgggtgaggccctggggcctgcttccaggaggacctcaagcagcggctccgccgaaccgggtgcagcccatgaaatgaagagccccccaagtgcacgttcctcaccccacagtccttggtcagctgcatccagctggactagccgcagaagctcgcgaaactccctaggtcgagcgccttctctgaagaggagaagtcctagcggcgagcgtaggtcactgctttccggagaggggcaggaatcacaggacgaggaggaaagcagcgaggaagagagagctagcccagcaggctcagaccatcggcacaggggctccctggaaagagaggcaaaaagctcattcgatctgcctgataccctgcaggtcccgggtctccacagaacggccagcgggagaggctctgctagtgagcatcaggattgtaacggcaaaagcgccagtggtcggctagcacgagcacttaggcctgacgaccctcctctcgacggcgatgacgctgacgacgagggtaacttgtccaaaggcgaaagagtgcgggcttggatcagagcaaggctgccagcttgttgccttgaaagagacagttggtcagcttatatctttcccccacagagcagattcaggttgctgtgtcaccgaataattactcacaaaatgttcgatcacgtggttttggtgatcatttttcttaattgtattaccattgcaatggaaaggcctaaaattgacccacactccgcagagcgcatctttctaactctcagcaattacatcttcacagcggtgttcctcgccgagatgaccgttaaggtggtggctcttgggtggtgttttggcgagcaagcatatctgcgcagttcctggaatgtcctagatgggcttctggtcctgatttctgttattgacatcctggtttctatggtgtcagattccgggactaagatcctcggtatgcttagagtgttaaggctgctcagaacattgagacccctacgtgttatatcacgtgcccagggtctgaagctggtggtcgaaacactgatgtccagcctgaaacccatcggaaatatcgtggttatctgttgtgcctttttcatcatcttcgggattctcggcgtccagctgttcaaaggcaaattttttgtatgtcagggcgaggacactcgaaatatcaccaataagagcgactgcgctgaggcatcataccgatgggtcaggcacaagtacaatttcgacaatctgggccaggccctgatgtcactgtttgtactcgcgtccaaggacggttgggtggatatcatgtatgatgggctagatgcagtgggcgtcgaccagcagcctatcatgaaccataacccctggatgctcttgtacttcatctccttcctcttgatagtcgctttcttcgttcttaacatgtttgtgggggtggtggtggaaaacttccacaagtgtcggcagcatcaggaagaggaagaggctcgccgaagggaggaaaagcgccttaggcgactggaaaagaaaaggcgcaatctgatgctggacgacgtcattgcatccggctccagtgcatccgccgctagcgaggcccaatgtaaaccttactacagcgactactctaggttccgcctgctggtgcaccatctctgcaccagccactatctggatctgttcataacgggagtaatcggcttgaacgtggtgactatggctatggagcactaccagcaaccgcagatactggatgaggcattgaagatatgcaattatatcttcacggttatattcgttttggagtccgtcttcaagctagtggcatttgggtttagaagattcttccaggacagatggaaccagctcgaccttgccattgtgctgctgtcaatcatggggattacccttgaggaaatagaagtcaacgcttcactgccgatcaaccctacaatcatccgtatcatgagagttttgcggatcgctagagtgctcaagctgttgaaaatggcagtcggcatgagggcacttttagacaccgtgatgcaggctttgccccagctttgggcttggagcagcctggagacctggtcagttacccgacatacccctgttagagcatgggcagtcatgcccccattcgggaccctcgcgtggcccagtta

SEQ ID NO: 48690 - DNA, 6752 bp, Artificial Sequence
  Description of Artificial Sequence: Synthetic coding sequence
atggatgaggaggaagacggggctggcgcagaagaatccggccagccaaggtccttcatgcgtctcaacgatctcagtggtgccggagggcgacccggaccgggaagtgcagagaaggatccaggatccgctgatagtgaagctgagggtctcccataccccgctctggccccagttgtattcttctatctaagccaggattcgcgaccccgttcgtggtgcctcagaacagtgtgcaacccctggtttgaacgaatcagcatgctcgtgatccttcttaactgtgtgaccctggggatgtttcgcccttgcgaggacatagcctgtgactcacaaagatgtcgcattctccaggcatttgatgactttatcttcgctttcttcgcagttgagatggttgtgaagatggtggcattagggatttttggcaagaaatgttacctgggcgacacatggaatagactagacttctttattgtcatcgccggaatgctggagtacagtctcgacctgcagaatgtgtcattttccgccgtgcggaccgttcgagtcctgcgcccactcagggccatcaaccgagtgcccagcatgcgaattctggtgaccctgttgctggacaccctcccgatgttaggtaatgtgctgctcctgtgtttcttcgtgttctttatctttggaatcgtaggggtgcaattgtgggctggtctcctcagaaatcgctgtttccttccagaaaacttcagtctgcctctgagcgttgacctcgagaggtattatcagaccgagaatgaagatgagtctccatttatatgcagccagcccagagaaaatgggatgcgcagctgtaggtcagtgccaaccctgcgcggagacggaggcggtggaccaccgtgtgggctggactatgaggcctataattccagttccaataccacttgtgtaaactggaatcagtactatactaattgctcagccggtgagcacaacccattcaaaggggctataaatttcgataatatcggctatgcctggatcgccattttccaggtgataactctggaggggtgggtcgatatcatgtacttcgtgatggatgcacacagcttctacaattttatttactttatcctacttatcatcgtgggctctttttttatgattaacctgtgcctggtggtgattgccactcaattttctgagactaagcagcgggaaagccaattgatgcgcgagcagagagttcgtttcttatctaatgctagtactctggcatctttttctgaacctggaagttgctacgaagagctgctcaaatacctggtatacatcttacgcaaggcagcgaggcggctagctcaggtgagtagagcggcaggcgtgcgtgtggggctgttgtccagtcctgctccgttagggggtcaagagactcagccatccagcagctgttcccggtctcaccgccgactcagtgtgcaccacttggtccaccatcatcaccatcatcatcatcattaccatctgggaaacgggacattgagagcaccaagggcatctccagaaattcaggatcgagatgccaacggctcccgtagacttatgctgccccctccctccacccccgctctgtcgggggctccccctgggggtgccgagtcggtgcactcattctaccacgccgactgccacctagagcctgtcaggtgtcaggccccacctccccgtagtccttctgaagcgagcggacgaacggtcggatccggcaaggtttaccccaccgtgcacacaagcccgccacctgagaccctcaaggaaaaggcattagtcgaagtggcagcaagttcaggaccccctaccctgacgagcctgaatatcccgccaggcccttattcttcaatgcataagttactggaaacgcagtccaccggagcttgtcagagttcctgcaaaatttcctctccttgtttgaaggccgacagcggcgcttgcggtcccgattcttgcccttactgcgcaagagccggagccggagaagtcgagctggctgacagggagatgccagatagtgactccgaagcagtctacgagttcactcaagacgcccagcattccgacctccgggatccccactcaagaaggcagagaagtctgggcccagatgcggagccttctagcgtgttggccttctggcgcctgatctgcgatactttcaggaagattgtcgatagtaaatactttgggagaggcatcatgatcgcgattctcgtgaacaccctgtccatgggtattgaatatcacgaacaacctgaagaactgaccaacgctttggaaatcagcaacatagtcttcacctctctgtttgcattggaaatgctcctgaagctcctggtgtacggcccatttggctacatcaaaaacccctataacatcttcgatggagtgatcgtcgtaatatcggtgtgggaaattgtgggacagcaagggggtggtctgtctgttctaagaacatttaggctgatgcgcgtcctgaaactggtacggttcctacccgctctgcagagacaactggttgttctgatgaaaactatggataatgtggccaccttctgcatgctccttatgctctttatcttcatcttttccattctgggaatgcatctgttcggatgtaaattcgcttcagaacgggacggagatacactacccgacaggaagaacttcgattccctcttatgggccatcgttacagtcttccagattttgacacaggaggactggaacaaggtgctctataatggaatggcctccacctctagctgggcagcactgtattttattgcactcatgacattcgggaactatgtgctgtttaacctgctcgtcgccatccttgtggaggggtttcaggcagaagaaatttccaagagagaggatgcatctgggcagctgtcatgcattcagctcccggttgattcgcagggaggggacgccaacaagtccgagtccgagccagattttttttccccatcccttgacggtgacggcgataggaaaaagtgcctcgccctggtgagtttgggggaacatccagaactacggaagtcccttctcccaccactgattatacacactgctgccacacctatgagcctcccaaaatctacgtccaccggcctgggcgaagccctggggccagccagtcggcgaacctccagctccgggagcgccgagcctggagccgcacacgaaatgaagtcccctcctagcgctagaagctccccgcattctccatggtccgctgcttcatcctggacctcccggaggtcctcccggaactccctgggcagggctccctcccttaagcgtcgctccccatcaggtgaacggagatccctcctgtcaggggagggacaggaatctcaggatgaagaggaaagtagtgaggaggaacgggcttcccccgctggcagcgatcaccgccatcgtggcagtttagagcgcgaagcgaagtcctcctttgatctgcctgataccctccaggtccccggtcttcacagaaccgcctccggcagagggtctgcctcagagcatcaggactgtaacggaaagtccgcctcgggtcggctcgccagagcgctgcgaccagatgatccccctctcgatggggatgatgctgacgacgagggcaatctatctaagggcgagagggtgcgagcctggatccgcgcacgtctgcccgcatgctgtttggaacgcgacagctggtctgcgtatatcttcccccctcagtcgcggtttaggctgttatgccatagaataattacacacaagatgtttgaccatgtggttctggttattatcttcctcaattgtattactattgccatggaacggcctaaaattgacccacactcagccgagagaattttcctaacactgtctaactatattttcacagctgtgttcctggctgaaatgacagtcaaagttgtagctctggggtggtgcttcggagagcaggcctatctgaggagcagctggaatgtgctggatggactgcttgttcttatttccgtcattgacatacttgtcagtatggtgtctgactccgggactaagatcctcggtatgttgcgcgtcttgaggttactcagaacgttgaggccgctacgtgtgataagccgagcccagggattaaagctcgttgtcgagacccttatgtcatcactgaaacctatcggcaatatagtcgtgatttgctgtgcatttttcataatatttggtattttgggcgtgcaactgttcaaggggaaatttttcgtgtgccagggggaagacacacggaatataacgaacaagtccgattgtgcggaggccagctatagatgggtgaggcataaatacaactttgacaaccttggccaggccttgatgtctttgttcgtcctggcctcaaaagatgggtgggtggatataatgtatgacgggctggatgctgttggagttgatcaacagaatttccacaagtgccgacagcaccaggaagaggaagaagcacgaaggagagaagagaagaggctgcgacgcctagagaaaaagcgtcgcaaccttatgttagatgatgtcatcgccagcggctctagcgcgtctgccgcatctgaggcgcagtgtaagccttactattctgactacagccgcttcagactgctagtgcaccatttgtgcacctctcattacttggatctctttattaccggagtgattggactgaatgttgtgacgatggccatggaacattaccagcagccacaaattctggacgaagcactgaaaatctgtaactatatcttcaccgtgattttcgttctcgagtctgtttttaagctggtggcgtttgggttccggaggtttttccaagaccgctggaatcagcttgacctggcaatcgtcctcctgagcattatgggaattactctggaagagatcgaggtaaacgcgtcactgcccattaatccgacaataataagaatcatgcgggtacttagaatagccagagtgctgaagctactgaagatggcagtaggcatgagagccttactggacacagtgatgcaggcgctccctcaggtggggaatctcgggctactttttatgctgctcttttttattttcgccgctctcggtgttgaactcttcggcgacctggaatgtgatgaaacccacccctgcgaggggctcggacgacacgccaccttccgaaatttcggcatggcatttcttaccctgtttagggtttccaccggcgataattggaacggcataatgaaagacactctacgagattgcgaccaggagtcaacgtgctataacactgttatttcccctatctacttcgtctccttcgtactgacggcacagtttgtattggtgaatgtggtgattgctgtgctcatgaagcatctggaggaaagcaataaagaggctaaggaggaagccgaactagaggctgagctggaactggagatgaagaccctgtccccacagccccacagccctctcgggagtcctttcctttggcccggagtggagggtcccgacagccctgactcgccaaaacctggtgcactgcaccctgctgcacacgcccgaagtgcctcccatttctcactcgagcatccaaccatgcagcctcaccctaccgaattaccaggaccagatctgctaacggtgcggaagtcgggggtgagccgaacgcattctcttccgaacgactcctacatgtgccggcatgggtccactgcagagggtcccctggggcatcggggttggggactgccaaaagcacagagtggctctgtactctctgtacatagtcaacctgctgatacttcctacatactacagctcccaaaagacgcacctcatttactacagccacatagcgctccaacctgggggaccattcccaaacttcctcctccaggcaggtcccccttagctcagagacctcttcgtagacaggcggcaatccggaccgatagtcttgacgtgcaggggctgggatccagagaggaccttttggcggaggtgagcgggcctagcccgccattggcacgcgcttactcattctgggggcaaagctctactcaagcacagcagcacagtcgctcccatagtaaaatttccaagcacatgacccccccagccccatgtccaggtccagaaccaaactggggaaaagggcctcctgagacacgcagttccctggagctggatacagagctctcctggatctccggggacctcttacctcccggaggccaggaggagcccccatctcccagagacttgaaaaagtgctattctgtggaagcccagagttgtcagcggaggcccacatcttggctcgacgaacagcggaggcattcaatcgccgtgtcatgtcttgattccggctcccagcctcacttgggaaccgaccccagtaacctggggggtcagcctctgggtgggcctggcagtcgcccaaagaagaagctgtccccacctagcatcacaatcgatcccccagagagccaagggcctagaaccccaccttctccgggtatctgtttacgccgtagggctccctcctccgatagcaaggacccattggcttctggccctccggatagtatggctgcctccccttcccctaagaaggacgtgttgtctttatcgggtctctccagtgatcccgcagacctggacccata

SEQ ID NO: 48691 - DNA, 5208 bp, Artificial Sequence
  Description of Artificial Sequence: Synthetic coding sequence
atggacgaagaggaggatggagccggagccgaggagtctgggcaacccaggagcttcatgcgcctgaatgacctctccggcgcaggtggtaggccagggcctgggagcgccgagaaagaccccggaagcgccgattctgaagctgaggggttgccttacccagcgttggcgcctgtagtgttcttctacctttcccaggactctcggcctcggagctggtgtcttaggaccgtttgtaatccctggttcgagcgaatatccatgctcgtgatactgctgaactgcgttacgctggggatgttcaggccttgtgaggacattgcatgtgattcccagcggtgccgcatactgcaggcctttgacgacttcatcttcgcattctttgcggtggaaatggtcgtgaaaatggtggccctgggaattttcggcaaaaagtgttacttaggcgacacatggaaccggctggacttctttatcgtcattgctgggatgctggagtactctctagatctgcaaaacgtgagctttagcgcagttaggacagtaagagtgctgcggcctcttcgtgctatcaatagagtgccgtcaatgaggattctggtgacactgctcttggatacgcttcctatgcttgggaatgtgctgctcctctgtttcttcgtattctttattttcggaatagttggggttcaactgtgggcagggctgctgcgcaatagatgctttctccctgaaaatttctccctcccactgagcgtagacctggaacggtattaccagacggagaacgaggacgagtctcccttcatctgcagccaaccacgagagaatgggatgcgttcgtgtagatcagtgcccaccctgcggggagatgggggtggtggtcccccatgtgggctggactacgaagcttacaacagctcgagtaacaccacttgtgtcaactggaatcagtattatactaattgctctgctggtgaacacaatcccttcaagggcgcaatcaactttgataacattgggtatgcttggattgccatcttccaggtgatcactctggaaggttgggtggatatcatgtactttgtcatggacgcccattctttttacaacttcatttacttcattctcctcattatcgtgggaagtttctttatgattaatctttgtttagtcgtaatagccactcagttcagcgaaaccaaacaacgcgagagtcaactgatgcgggaacagagggtgaggttcctgtctaacgccagcactctggcaagcttctctgagcccggttcttgttatgaggaactattgaagtatcttgtctatattcttagaaaggccgcaagaaggttggcccaggtgtccagggcggcaggtgtgagagtgggtctgctgtcctctccagccccactggggggacaggaaacacagccaagtagctcgtgcagcaggagccacagacgtcttagcgtccatcacctggtccatcaccaccaccaccatcaccaccactatcacctggggaatgggactttgcgagctccgagggcctcccctgaaatccaggaccgcgatgctaacgggtctcgtaggctaatgcttccccctccctctacacctgcattgagtggggctccgcctggtggagcagagagcgttcacagcttttaccatgctgattgtcacctggagcctgtccgctgccaggcacccccaccaaggagcccatccgaagcctccggaagaacagtgggctcaggaaaggtttaccctactgttcatacatctcccccacccgaaaccctcaaggagaaggcattggtggaggtcgccgcttctagcgggcctcctaccctgacctcactcaacataccccctggcccatactctagtatgcacaagctgcttgagactcagtcaactggcgcatgtcaatccagctgcaagataagttctccttgcctgaaggcggacagcggtgcttgcgggcctgactcttgcccttattgtgccagagcgggagcaggagaggtggaactggccgaccgggagatgcccgactcggacagtgaagcggtttacgagtttacccaggacgcacagcactccgacttgcgcgacccccactctcggagacagagaagtcttggacctgacgctgaacctagcagcgtcttggccttctggcgcctcatttgtgatacttttcgtaagattgtggactcaaagtactttggccgaggtataatgatcgccatacttgtgaatactctgtccatggggatcgaatatcatgaacaaccagaggagctcacaaacgccctggaaatctcaaatattgtctttaccagccttttcgccctcgaaatgcttctgaagttactcgtctatggcccatttgggtacatcaagaacccctacaacatcttcgacggtgtgatcgtcgtaatttcagtgtgggaaattgtaggccagcagggcggtgggctttcggtgttacgcacctttagactgatgagggtactgaaactggtcaggtttctccctgctctccaacgccagcttgtggtactcatgaagactatggataatgttgctactttctgtatgttgctcatgctgttcatctttattttctccattttggggatgcacttgtttggctgcaaattcgcatccgagcgtgatggagatacacttcccgatagaaagaactttgactccctgctctgggcaatcgtaacggtgttccagatcctgacgcaagaggactggaataaagtgctgtataacgggatggcctcgacctctagctgggccgctttatattttatcgccttgatgacattcggaaactatgtcttatttaatctacttgtggccattcttgtggaggggtttcaggctgagggcgatgcaaacaaatctgagagcgagcccgactttttcagccctagcctggatggggacggggatagaaaaaagtgcctcgccctagtctccttaggcgagcaccccgagctcagaaaaagcctgctgccaccactgattatacacaccgcagctacacctatgagcctccctaagagtacctcaaccggtctgggcgaagccttgggacccgcatctaggcggacctccagttcaggctcagctgagcccggagctgctcatgagatgaaatcacccccatcagcccgttcttccccacactcaccttggtctgccgcttcttcatggacttcgcgccgatcgtctcggaacagtctcggccgagccccatctctcaaacggcgtagcccaagcggcgagcggcgaagcttattgagcggtgagggccaagagagccaggacgaggaggaaagcagcgaggaggagcgcgcatccccagctggatcagatcacagacatcgtgggtctctcgagagagaagccaaatcatccttcgacttgcccgacaccctacaggttccaggccttcataggaccgcctcaggccgaggctccgcatccgaacaccaggattgtaacgggaaatccgcaagcggcagactcgcaagggccctcagacctgacgaccccccacttgatggcgatgatgcagatgacgaagggaacctgtctaagggggagagggtgcgtgcatggattcgggcacggctgcctgcttgctgcctggaaagggattcttggtcagcttacatattcccaccgcagtctcgctttcgactgttgtgccacagaataatcacacataagatgttcgaccacgtggtcctggtgattatctttttgaattgcatcaccattgccatggaaaggcccaagatagatcctcacagcgctgaacgcattttcttaaccctttcaaactacatctttacggctgtgttccttgcagagatgaccgtgaaagtcgtagcattggggtggtgcttcggcgaacaggcatatttgcgtagtagttggaacgtgctcgatggacttcttgttctcatcagcgtgattgacattcttgtttccatggttagtgactctggcactaagatcctgggtatgctgcgtgtgttgaggttactccggaccctgagaccgctgcgggtcatctctcgcgctcagggtctgaagctcgtggtggaaacattaatgagctcgctcaaacctattggcaatatcgtggtgatatgttgcgccttcttcatcatcttcgggatcctaggcgttcaactgtttaaggggaagttctttgtttgccagggcgaggacaccagaaacattaccaataagtcggattgcgcagaggcctcgtatcggtgggtacgtcacaagtataattttgataatctcgggcaggcgcttatgtctcttttcgtgctagcctctaaggatggctgggtcgacatcatgtacgatgggctggacgctgtcggtgtggatcagcagccgatcatgaaccacaacccctggatgttattgtacttcatctcctttctcctgattgtggccttttttgtgcttaacatgtttgtgggcgtggttgttgaaaatttccacaagtgtcgccagcaccaagaggaggaagaagcgcgaagaagggaggagaaaaggctcaggcggctcgaaaagaaacgacggaaagcccaatgtaagccctactactccgactattccagatttcgcttgcttgtccaccatttatgcacttcacattacctggatctcttcataactggcgtgatcggcttgaatgtggtaacaatggccatggagcactaccagcagccccagatcctggatgaggcacttaagatttgcaactacatctttacggtgattttcgtgctggaaagtgtgttcaagctggtggccttcgggttccggcgattttttcaggaccggtggaaccaactggacctggccatcgtgctcctgtccattatggggatcaccttggaagaaatcgaggtgaacgcaagtttaccaattaatccgactatcattcgaataatgagagtgcttcgcattgcccgtgtgctgaaattgctgaagatggccgtcggtatgcgggcacttctagacactgtaatgcaagctcttccccaactgtgggcgtggtcctccctggaaacctggtcagtcacgcgacacacccccgtacgtgcgtgggccgttatgcctccctttggaacccttgcctggccatcataa

SEQ ID NO: 48692 - DNA, 5297 bp, Artificial Sequence
  Description of Artificial Sequence: Synthetic coding sequence
atggacgaggaggaggatggcgcaggggctgaggaatctggtcagcccaggagctttatgcggctcaatgatctgtctggagccggtggacgtcccggacccggatcagccgaaaaggatccaggttccgctgactctgaggccgaaggcctgccctatccagcgctggctcctgtcgtgttcttctatttatcacaagactcgcgccctagaagttggtgtctgcgcactgtgtgtaacccctggttcgagcgaattagtatgctggtcatcctcttgaactgcgtaactttgggcatgttcagaccctgcgaggatatcgcttgtgattcccagaggtgtaggatcctgcaggcctttgacgattttattttcgcctttttcgccgtcgagatggtggtcaagatggtggcactgggtatatttggcaagaaatgttatcttggggacacttggaatcggctggatttctttatcgtcatcgctggtatgctggagtactccctagacctccagaatgtcagtttcagcgctgtgcgtacggttcgagtgctcaggccacttagagcaataaatcgggtgccttcaatgcggattttggtgaccctgctgctcgatacactccccatgctgggaaacgtcttgcttttgtgcttctttgtgttctttatatttggtattgttggcgtgcagctttgggcgggtctactgcgcaacaggtgtttcttgccggagaattttagtctcccgctatcggtggatctggagcgctactatcagaccgagaacgaggacgagagccccttcatctgctcccagccgcgtgagaatggaatgaggtcctgtcgaagcgtgccaaccctccgtggtgacggaggaggaggcccaccatgtggtcttgattatgaagcttataattccagttctaacacgacctgcgtgaactggaatcagtattacaccaactgcagcgcaggcgaacacaatcctttcaaaggcgcaatcaattttgacaacatcggttatgcctggatcgcgatttttcaggtcattacgcttgagggctgggttgacatcatgtatttcgttatggacgctcatagcttttacaatttcatttactttatcctcctgatcatcgtaggcagtttcttcatgatcaatctatgcttggtcgtcatcgctacacaattcagcgagacgaagcaacgggaatcccaactcatgagagagcaacgcgtgcggtttctgagcaacgccagcacactggcttcattctctgagccaggctcttgttatgaagagcttctcaagtacctcgtgtatattctgcggaaggccgctagaaggcttgcccaggtgtcaagggctgctggagtgagagtcggcctcctcagttcaccagctccgctcggcggacaggagactcagccctccagttcgtgctcacggtctcatagaagactctcagtgcaccatctagtgcaccatcaccatcatcatcaccaccattatcacttgggaaatggcaccctgcgcgcaccacgggctagccccgaaatccaggaccgtgacgcaaatggaagccgacgactgatgctgccacctccatctactccagcattgtccggagccccacctggtggcgctgaaagtgtgcattccttctaccatgccgattgtcacctggagcctgtgaggtgtcaggctccgccacccaggagtccttcggaggcctctgggagaaccgtgggcagcggcaaggtatacccgacagtacatacaagtccaccaccggaaacccttaaagagaaggctttagtggaggtggctgccagttctggccctcctactctgacgtctctgaatattcctccgggaccatactcctccatgcataagttactggaaactcagtcaacaggagcctgtcagtcaagctgcaaaattagttctccttgcctgaaggctgattctggggcatgcggcccagacagctgcccctactgtgccagagcaggcgctggcgaagtggagctggccgatagagaaatgcccgattccgacagcgaggcagtctacgaatttacccaggacgctcaacacagtgacttgcgggacccacacagcaggagacagcggtccctcgggcctgatgctgagccatcctccgtgctcgctttctggcgtctgatctgcgatacctttcgcaagatcgtggattccaagtatttcgggagagggatcatgattgctatcctagtgaacaccctcagtatggggatcgagtaccatgagcagccagaggagctcaccaatgcactggagatctcgaacattgtatttacttctctctttgctctagaaatgcttttgaagttgctcgtatatggcccatttgggtatatcaagaatccatacaacatatttgatggagttattgtggtcattagcgtctgggagatcgtcggacagcaggggggaggactttcggtgcttagaaccttccgactcatgcgggtgcttaaactcgtcaggttcctgccagctctgcaacggcagcttgtcgtgctcatgaagaccatggacaacgtcgctactttttgtatgctgttaatgctttttatttttatctttagcatcctgggcatgcacctgttcggatgtaagttcgcgtcagaaagagacggcgatacgctcccagaccgtaaaaacttcgatagcctactttgggccattgtgacagttttccagatcctgacccaggaggattggaataaggtcctctacaacggcatggccagcacgtctagttgggccgctctttacttcattgctcttatgacattcggcaattacgtgctctttaatctgctcgtggctatactcgtggagggcttccaggccgaggaaatctccaagagggaggatgcaagcggacagctgtcatgtatccagctgccagttgacagccagggcggagatgccaataagagcgagagcgagccggatttctttagcccttctttagatggcgacggcgatcgaaagaaatgcctcgcccttgtgagtttgggcgagcaccctgagttgcgcaaaagtctgctgccccctttgatcattcataccgccgcaacacctatgtcacttcctaaatcaacttccaccggacttggggaggccctcgggccagcctcaagacgtacatcctcctctggatccgcagaacccggtgccgcacacgaaatgaaaagccccccttctgctagatcttcgccccattctccatggagcgcagcttctagttggaccagtagacggagcagtcgtaatagcctgggccgtgcacccagcctgaagagacggtcccccagcggtgagcggaggagtctgctgtcgggcgagggccaggagtcccaggatgaggaagaatctagtgaggaggagcgggcaagcccagcaggttccgatcacagacaccgaggctcccttgagcgagaagccaaatcttcttttgacctgcctgatactttgcaggttccaggtctccacaggacagctagtggacgcggttctgcctcagagcaccaggattgcaatggtaaaagtgcatcagggcgtctggctagagcactacgccctgacgatccacctctggacggggatgatgcagatgacgaggggaacctcagtaaaggcgaacgagtgagagcatggatccgggctagactaccagcctgttgcctggagagggactcttggtccgcatacatttttcctccccagagtagatttcgcttactgtgtcataggattatcacccacaagatgtttgaccatgtggttctggttatcatctttctcaattgtatcacaatcgccatggagagacctaaaattgatccccattctgcagagcggatcttcctgaccctgtccaactacatcttcaccgccgtgtttctggctgaaatgaccgtgaaggtcgtcgccctcggctggtgctttggtgagcaggcatatctccgcagcagctggaacgtcctcgacggattgctggtactgattagcgtgatcgacatcctcgtctctatggtgtcagatagcggcaccaagatactgggcatgctcagggtgctgcgcctgctccgtaccttgaggcccctgagagttatcagccgggctcaagggctcaaactggtggtggaaaccctgatgtcgtcactgaaacccatcggaaacatagtagtgatttgttgcgcgttctttattattttcggcatactcggcgtgcagctgtttaaaggaaagtttttcgtgtgccagggggaggacacccgtaatatcacaaataagtccgattgcgccgaagctagttaccgttgggtacgacacaaatacaattttgacaacctaggccaagcccttatgtccctgtttgtgcttgcttccaaagacggctgggtggatattatgtatgatggactcgatgcggttggggtcgatcagcagccgatcatgaatcataatccatggatgctattgtatttcatatcatttttgctgattgtggccttcttcgtgttaaacatgtttgtgggggtcgtggtggagaactttcacaagtgcaggcaacaccaggaagaagaagaggcgcgtaggcgagaagaaaagagactgcggagactcgaaaagaagagaagatcgaaagagaaacagatggccgaggcgcagtgcaagccctactattccgattattcccggttcagactcctggttcaccatctttgcacgtcccactatctggatctttttatcaccggggtgatcggacttaatgtcgttactatggctatggagcactaccagcaacctcagattctggacgaagctcttaaaatctgcaactacatttttactgtgatttttgtgctggagtcagtctttaagctggtcgctttcgggtttcgcagattttttcaggaccgatggaatcagcttgacctggcaattgtgttactgtccataatggggatcaccctggaggaaatagaggttaacgcttctctgccgatcaatccaaccatcatcaggatcatgagggttctgcggatcgctcgcgtgctcaaactgctcaagatggccgtcggaatgcgagcattgctggacaccgtcatgcaggctttgccacagctatgggcctggtcatcactggaaacttggtccgtgacccgtcatactccggttcgcgcatgggccgtaatgcccccttttggtacgctggcctggcctagcta

SEQ ID NO: 48693 - DNA, 6617 bp, Artificial Sequence
  Description of Artificial Sequence: Synthetic coding sequence
atggacgaggaggaggatggggctggggcagaggaaagcggacagcccagaagctttatgagacttaatgacctctcgggagcaggcggacgcccaggtccaggcagtgccgagaaggaccccggttcggctgatagtgaggccgaaggtcttccttatccagcccttgctcccgtcgtgtttttttacctctcgcaggattccagaccacgttcttggtgcctgagaaccgtgtgcaacccgtggttcgagaggattagtatgctggtgattcttctgaactgcgtgaccctggggatgtttcggccttgtgaggatattgcgtgcgattcccagagatgcaggatcctccaggccttcgatgactttatcttcgctttctttgcagtggaaatggtcgtgaagatggtcgcgctcggtatcttcggcaagaaatgttatctcggagatacttggaatcgtctagatttttttattgttattgccggtatgcttgaatatagccttgacttgcagaacgtgagcttttccgcagtgcgaacagtgcgcgtcctccggcctctcagggcaatcaatagggttccctccatgcggatcttagtgaccctgctgcttgataccctccctatgttgggtaacgtcctgctgctgtgcttcttcgtgttttttatctttggtatcgtaggagtgcagctctgggccggactgttacgtaacagatgctttctaccggaaaatttttctttgccactctctgtggacctcgagcgctactatcagacagagaatgaagacgagagcccatttatttgtagccagccacgcgagaacgggatgaggagctgccggagcgtgccgacgcttagaggagacggtggcggaggccctccatgtggccttgactatgaggcctataactcctccagtaacacaacctgtgtaaactggaatcagtactacacaaattgcagtgctggggagcacaacccttttaagggcgcaataaactttgacaatataggttatgcctggattgccatcttccaggttatcaccctggaagggtgggtggatataatgtattttgtcatggatgcgcacagcttttacaactttatctacttcatcctcctcataatcgttggttccttctttatgatcaacttgtgtttggtagtgatcgccacgcagttctccgagaccaaacaacgagaatcacagttgatgagggagcagcgcgtacgcttcctgtctaatgcgtccacactcgcctccttttctgaacctggctcctgctatgaggagctgctgaaatatctggtctatattctcagaaaggccgctcggagactggcccaggtgtccagggccgctggtgtgagggtggggttgctatcaagccccgctcccttgggcggtcaggagacccagccctctagcagctgcagcagaagccaccgacgattgtcagtgcatcatcttgttcaccatcatcatcaccatcaccaccactaccacctgggaaacggcaccctcagggctcctagagcatccccggaaattcaggatcgggacgccaatggctcccgacgcctgatgctcccccctccgtcaactccagcgctatcaggagccccacctggaggcgcagagagcgttcatagtttctatcacgcagactgtcatttggaaccagtgaggtgtcaggcccctcctcccaggagcccttctgaagcatctggacgaacggtgggaagcggtaaagtctacccgacagtgcacacttcaccacctccggaaactctcaaggagaaggccttggtggaagtagccgctagcagtggtcccccaacactgacgtcattgaatatcccccctggaccatactccagcatgcacaagctgcttgaaactcaatccactggcgcttgccagagtagctgtaagatttcaagcccatgcctcaaggccgattccggcgcatgcgggcctgactcatgtccatattgcgcacgggcaggcgcaggtgaggtagagctcgcggacagggagatgcccgattccgattccgaggccgtgtatgagtttacccaggacgcccagcactccgacctccgtgatcctcatagcagacggcaacgcagtttgggacccgacgctgaaccgagttccgtacttgcattctggaggctcatttgtgatacttttcgcaaaatagtagacagcaagtatttcggacgcggaatcatgatagccattctggttaacactctctccatgggcattgagtaccacgagcagcctgaggaacttaccaatgctctcgaaatcagtaatattgtgtttacgtccctcttcgccctcgagatgctgctgaagctactagtctacggacccttcggctacattaagaacccatataacatcttcgacggcgttatcgtcgttatctcggtctgggagatcgtggggcagcagggcggtggactgtccgtgctgagaacattccgcctcatgcgcgtgctgaaattggtacggtttttgcctgcactccagcgccaattggtagtgctgatgaaaacaatggataatgtcgcaaccttttgcatgcttctgatgctgttcatcttcattttctccattcttgggatgcatcttttcggatgcaagtttgcaagcgagagagatggcgatacccttcctgaccggaaaaatttcgactccctgctatgggctatcgtcacagtttttcagattcttacacaggaagactggaataaggtactgtacaacgggatggcttccacctcatcttgggctgccttgtactttattgccctcatgacattcgggaattacgtcttatttaatctcctggtagccattttggttgaaggattccaagcagaagaaattagcaaacgcgaagacgctagcggtcagctctcttgtatccagctaccggtggacagccagggtggtgatgccaataagtccgaaagtgagccagactttttctcccctagcctggatggtgacggcgaccgaaagaagtgcctggctctagtgtctcttggagagcaccccgagttgcggaaatcgctgctgccccctcttattatccatacagcggctactccgatgtcactgcccaaatccacatctaccgggctgggtgaagctctcggacccgcttcaagacgcacctcatccagcgggagtgctgagcctggtgcggctcatgaaatgaaatcccctccttctgcacggtcctctccccactcaccatggagtgcagcgagctcctggacctcacgcagaagctccaggaatagtttgggaagggcaccatccttgaaacgccgatcgccgtcaggggaaagaagaagcctgctcagcggcgagggacaggagtctcaggacgaagaagaatcatcagaggaggaacgagccagtccagccggaagcgaccatcggcacagagggagccttgagagagaggctaaaagtagtttcgacctcccagacactctgcaggtcccaggattgcatagaactgcatccgggcgaggtagtgcctccgaacaccaggattgtaatgggaagtccgctagcggaaggcttgcacgtgctctgaggccagatgacccaccattggacggggatgacgccgacgacgaggggaacctgagtaaaggggagcgcgtgagggcctggatccgggcacggctgcctgcctgctgcctcgaacgggacagttggagtgcatatatttttccgccacaaagccgatttcgtctactatgtcataggataatcacccataaaatgttcgaccatgtggtgctggttatcatctttctgaattgtataacaatcgccatggagcgacctaagattgatcctcactccgcggagcgtatatttcttactctcagcaattatatttttaccgctgtttttctggccgagatgacagtcaaagtggtggcgctgggctggtgtttcggcgaacaagcttatctgaggtcatcctggaacgtgctggatggcctgctggtactgataagtgttattgacattttggttagcatggtttctgattctgggactaaaatattaggaatgcttcgggtattaagactgctccggactcttaggccactccgggtgatatcaagagcccaggggctgaaattggtggtagaaaccctgatgtcaagtctgaaacccataggtaatatagttgttatatgctgcgccttcttcataatttttggcatcctcggcgtacagctcttcaagggcaagttcttcgtttgtcagggagaggacactcgcaatataaccaacaagagcgactgtgcagaagcctcctatagatgggtccgacataagtacaattttgataatctgggacaggccctcatgtcgttgttcgttctggcctctaaggacgggtgggttgacatcatgtatgacgggctggatgccgtaggcgtcgaccagcagccaatcatgaatcataacccatggatgctgctgtattttatatctttcttgctgatagtcgctttcttcgtcctgaacatgttcgtcggcgtcgtggtcgagaacttccataaatgtaggcagcaccaggaggaagaggaggctcggagacgtgaggagaaaaggttaagaaggctggaaaagaaaaggaggaacttgatgctagacgacgttattgccagcgggagctctgctagcgcggcatcagaggctcagtgtaagccgtattactctgactatagcaggttccgtttgctggtgcaccacctttgtacgtctcactaccttgacctgtttattaccggagtgatcggccttaatgtcgtgaccatggccatggagcactaccagcagccgcagatactggatgaagctttgaagatctgtaactatatttttacagtgattttcgtgttagagtccgtatttaagctggtcgccttcgggttccgtaggttttttcaggaccgctggaaccaacttgatctggcgatagtgctcctgtccatcatgggtataaccctcgaggaaattgaggtaaatgctagcctcccaatcaacccaacaataattagaatcatgcgcgtgctgcgcatcgctcgtgtgctcaaactgctgaagatggcagtggggatgcgagcccttctcgacacagtgatgcaagctcttcctcaggtaggcaatctaggccttcttttcatgttactgttcttcattttcgcagccctcggagtggagctcttcggcgacctggaatgcgacgaaactcatccttgtgaaggtctgggacgccatgccaccttcagaaattttggaatggccttcctgaccctcttccgtgtgtctaccggagacaactggaatggtatcatgaaggacaccctgcgagactgtgaccaggagagcacctgctacaataccgtgatctctccaatctacttcgtgagcttcgtgttaaccgcgcagttcgtgttggttaatgtagtgattgctgtgctcatgaaacatctggaagaatctaacaaggaagccaaggaagaggcagaactagaagctgagctggagctcgagatgaaaactttgtctccacagcctcattctcctctggggtctccttttctgtggccgggagtggagggccctgactctcctgattcccccaaacccggagcacttcaccccgcagctcatgcgagatctgcaagtcatttctcccttgagcacccaactatgcagccacaccccacagagttgccgggtcccgacctcctcacagtcagaaagtccggagtgtctcgcacacatagtttgcccaacgacagctacatgtgtcgccatggctccaccgccgagggccctcttggacataggggatggggtcttccaaaggcccagagcgggtcggtgctgtcagtgcactcccagccggctgacacttcatacattcttcagttacccaaagatgcaccgcatctgttgcagcctcactccgcccctacttggggcaccatacctaagctcccaccacccggtagatcacccctggctcaaagaccattgagacggcaggccgcaattcgcaccgactctctggatgtgcaaggtttaggttcacgtgaagacctgttggccgaggaagagccgccatcaccccgtgatcttaagaaatgctattccgtggaagcgcaatcctgccagcgcaggccaacatcctggcttgacgaacaacgacgtcactcaatcgccgtgtcatgtctcgatagcggctctcaacctcaccttggaacggatccgtccaacctcggtggccagcctctgggcggaccgggatccagaccaaagaaaaagctttctcctcccagcatcactatcgatccgcctgagtcccaggggccacgcacaccccctagtccaggcatctgcctgcgaaggagagcaccgtctagtgatagcaaagacccacttgcatcgggaccacctgactctatggccgcttcaccttcccctaaaaaagacgtgctgtctctgtctgggcttagttctgatcccgcagacctggacccata

SEQ ID NO: 48694 - DNA, 5330 bp, Artificial Sequence
  Description of Artificial Sequence: Synthetic coding sequence
atggacgaagaggaggatggggctggagccgaggagagcgggcagcccagaagtttcatgagactcaacgacctgtcaggcgcagggggtcgcccaggaccaggatctgcggagaaggaccctgggagcgctgatagtgaagctgagggccttccctatcccgcactggctcctgtggtgtttttctatctgagtcaggatagcagaccaagaagctggtgcctgagaactgtgtgtaacccttggtttgagaggatctctatgctcgtcattctgctgaactgcgtcacactcgggatgttccgcccatgtgaggatatagcatgcgactcacaaagatgtagaatcttgcaggcgtttgacgactttatcttcgctttcttcgccgtggaaatggtggttaaaatggtcgcactcggaattttcggcaaaaagtgctacctaggtgatacctggaaccgacttgatttttttatcgtgattgccggaatgttggaatattcactggacttacagaacgtaagtttttctgcggtgcgcaccgtgcgcgttctccgtcccttacgagccatcaatcgagtccctagcatgaggattctggtgaccctgctcctcgacactcttccaatgctggggaacgtcctcctgctgtgcttcttcgtcttcttcatcttcggtatcgtgggtgtgcagctctgggccggactcctgcgcaacagatgtttcttgcccgagaacttctccttaccgctcagcgtcgacttggagcgctactatcagaccgagaacgaagatgaatcaccatttatctgctctcagcccagagaaaatggaatgaggtcttgtagaagcgttccaacacttcgcggagatggcggtggcggaccgccttgtggcctggattacgaggcttataactcctcctcaaacacaacatgcgttaattggaaccagtattacacgaactgtagcgctggcgaacacaatcccttcaaaggcgctatcaacttcgacaacatcggctacgcctggatcgccatctttcaggtaattaccttggaaggctgggtcgacatcatgtatttcgtgatggatgcccacagtttctacaactttatctatttcatcttactgataatcgtcggctctttttttatgatcaacctctgtcttgtcgtaattgctactcagttcagcgagaccaagcaacgagagtctcagctcatgagagagcagagagtccgattcctttccaatgcaagcaccctggcttcgttcagtgagccaggctcttgctacgaagagctgctgaaatatctcgtgtatattctgcgcaaagccgcacgccgactggctcaagtgagtcgcgctgcgggtgtcagggtgggactgcttagctctcctgccccactagggggtcaagagacgcagccatcatcatcttgctcaaggtctcatcgacggctttccgttcaccatctcgttcatcatcaccatcatcaccaccaccattatcacctcgggaacggcaccttgagggcccctcgagcatctcccgaaattcaagatagagacgccaacgggtccaggcggctcatgctgccccctcccagcacaccagctctgtcaggagcccctccaggcggagctgaatccgtgcactcattctaccacgccgattgtcacttggaaccagtccgttgtcaggcacctccgcctcgatctcccagcgaggcctctggcaggaccgtggggagcggaaaagtatacccaacagtccatacgtctcctccgcctgagactctcaaagagaaggctcttgtagaggtcgcagcctctagtggtcctcctacacttactagcttgaatattcctccagggccttacagctcaatgcacaagctcctggagactcagagtaccggcgcttgtcagtcatcctgtaaaattagcagcccttgccttaaggcagactccggcgcttgtggacccgacagctgcccatactgtgcaagggctggcgctggagaggttgagttagccgatagggagatgcccgactcagatagtgaggcggtctacgaatttacccaggacgcacagcacagtgacttaagagatccacatagcaggaggcaacgttctctcggcccagacgcggaaccatcgagtgtgttagcattctggagattaatttgcgacaccttcaggaaaatcgtggattccaaatactttggcaggggtataatgattgctatactggtaaacactctgtcaatggggattgaatatcatgaacagccggaggagttaaccaatgctttggagatttcaaacatagttttcacaagcttgttcgcgctggaaatgcttttgaaattgcttgtctacgggccattcggctatattaagaacccttataacatctttgatggcgttattgttgtgatctcggtctgggagatagtcggccagcagggagggggattatcagttctaaggacttttaggctcatgagagtgttgaagctggtcaggttcctcccggcactgcagaggcaactggtggtactcatgaagaccatggataacgtggctacattttgcatgctgctcatgctgtttatctttattttctccatcctcggaatgcacctgtttggctgcaaatttgcgagtgaacgagacggggatacgttacctgatcgcaaaaacttcgacagccttctctgggcgattgtgactgtgtttcaaattctgacccaagaggactggaataaggtgctctataacggcatggctagcacaagcagttgggcagccctgtacttcatagccctgatgacctttggtaattacgtgctcttcaaccttttagtggctattctcgtagagggctttcaggcagaagaaataagtaagcgcgaggacgccagtggccagttatcgtgcatccagctgcccgtggactctcagggaggggacgccaacaagagtgagtccgagccggactttttctctccctccctagacggagacggggacaggaagaaatgcttggctctagtgagccttggtgagcatcccgagctgcggaaatccctgctgccaccactcatcattcataccgccgctacacccatgtcacttcccaaatcgactagtacagggctcggagaggcactgggacccgcttctcggcgaacgagcagctcaggttctgcagaacctggggcagcccacgagatgaaaagccctccgtccgctaggtcctcccctcatagcccgtggtctgcggcaagttcatggaccagcagaagaagcagtaggaattccctcgggagagcaccatccctaaaacggaggagcccgagtggtgagcggcgttctctcctcagcggggaggggcaggaaagccaggatgaagaggagtccagcgaggaggagcgagcgagtcccgctggctcagaccaccgacatcggggatcactagagcgagaggccaaaagctcattcgatctacccgacactctgcaagtccccggtttgcaccggaccgcctccgggaggggttccgccagcgagcatcaagactgcaatggcaagagcgcctctgggaggctggcaagagcattaaggcccgacgatccaccactcgatggcgacgacgctgacgacgagggaaatctctctaagggagagagagtgagagcatggatcagggccaggttacctgcctgttgtctcgaacgcgactcttggagcgcttacatttttccccctcagagtcggtttaggctgctgtgccaccggattattacccacaaaatgttcgatcatgttgtcctggtaatcatcttcctgaactgcatcacgatagctatggagcgccctaagatcgaccctcactccgcagagcgcatttttttaacactaagcaactacattttcacagctgtgtttttggcggagatgacagtgaaagttgtggcccttggttggtgcttcggtgaacaggcatatttgcgctctagttggaacgtgctggatggcctcctagtgctgatctctgtaatcgacatcttagtgtctatggtctctgattctggcactaagattctcgggatgctgagagtcctcaggttgctgcgaacacttcgaccgcttagagttatctcgagggcacaaggcctaaaactagtggtggagacactcatgtcgagcctgaagcctattggcaacattgtcgtcatctgctgcgcgtttttcatcatctttggcattcttggcgtacagctctttaagggaaaattctttgtgtgtcagggtgaagataccagaaacataaccaacaaatcagattgtgccgaagctagctatcgctgggtgcgacacaagtacaacttcgataacctgggtcaagccttgatgagccttttcgtcctcgcatccaaagatggttgggtggatatcatgtacgacggcctggacgccgtgggcgtcgaccagcagccgataatgaatcataatccctggatgctgctgtacttcatctccttcctactcatagtagcgttctttgtgctgaacatgttcgtgggggttgtcgtggaaaattttcataaatgtaggcaacaccaggaggaggaagaagcacgtcgtcgagaggaaaaaaggctgaggcggttagagaaaaaaagaaggaatcttatgctggacgatgtgatagcatccgggagttctgcctcagctgcctctgaggcccagtgtaagccctactattcagactacagtagattccggttgctcgttcaccatctctgtacaagtcattacctggacctttttattacaggtgtgatagggctgaacgtggtaacgatggcaatggaacactatcagcagccacagatcttagatgaggccctcaagatctgtaactatatcttcacagtgatcttcgtcctggaatcagtatttaagctagtagcattcggctttcgcagattcttccaagataggtggaaccagctggacttagctatagtccttctatcgattatgggcattacactggaagaaattgaggtgaatgcctctctgcccataaaccctaccataatccggatcatgcgcgtcctgaggattgcccgtgtgctcaagctgctgaagatggctgtcggcatgcgtgcccttctcgatacggtgatgcaagcactgcctcagctgtgggcttggagttcacttgagacttggtccgtcacacgacacactccagtcagagcctgggccgtgatgcctccctttgggacacttgcatggccatccta

SEQ ID NO: 48695 - DNA, 7100 bp, Artificial Sequence
  Description of Artificial Sequence: Synthetic coding sequence
atggacgaggaagaagacggggcaggcgcagaggagtcaggacaaccacggtcctttatgaggctgaacgatctatcaggcgcagggggtagaccgggaccaggcagtgctgagaaggatccaggaagtgccgattcagaagcagaggggctgccttaccctgccttggcccctgtcgtgttcttttatctctcacaggactctagacctcgctcgtggtgcctccggacagtgtgtaacccatggtttgagagaatcagcatgctggtgatccttctaaactgtgtcacgttgggcatgttccgtccctgcgaggacatagcctgtgacagccagagatgcaggatacttcaagccttcgacgattttatcttcgcatttttcgcagttgagatggtggtcaagatggtagcactgggcattttcggtaaaaaatgttatctgggcgatacatggaaccggctggactttttcattgtgattgccggaatgctagaatacagcctcgatttgcaaaacgtgagcttcagcgcagtgcggactgtgagggttctgcggccattgcgtgcaatcaaccgagtaccttctatgaggatattggtgaccttgttactcgacacactacctatgctagggaacgtcctcttgttgtgctttttcgtattcttcatctttggtatagtaggggtgcagttatgggccggtctcttgagaaatcgctgcttcctgccagagaactttagcttgccattgtccgtcgatctcgagcgttactatcagaccgagaacgaggatgagagccctttcatttgtagtcagcctcgtgagaatggcatgcggtcatgcaggtcagtcccaaccctacgcggtgacggtggaggcggacccccttgcggactcgactacgaggcgtataacagctcaagcaatactacgtgtgtgaactggaaccagtattacaccaattgctcagccggagagcacaatccttttaagggtgccataaactttgataacatcggatacgcctggatcgctatcttccaagtcatcacactggaagggtgggtggacatcatgtattttgtgatggacgcccactctttctacaacttcatctacttcattctgttaatcattgtgggctcattcttcatgatcaatctgtgtctggtggtgatagctactcaattcagtgaaaccaaacagagagagtcccagctcatgcgggagcaaagggtcaggtttctgtctaacgccagtaccctggcctccttctcagagcccggtagctgttacgaagagctgctgaaatatttagtttacatcttgcgcaaggcagctaggcgactcgcccaggttagtcgtgccgcaggtgtgcgcgtgggcctgcttagcagccccgcaccgctggggggacaggaaacgcaaccatcctcttcgtgtagcaggagccaccggagactatccgtccaccatctagtgcatcatcaccaccatcatcatcatcattaccacctgggtaacgggaccctgagggcaccaagagcttcccccgagatacaggaccgagacgcgaatggaagccgtagattgatgttacctcctccttctacccccgctctttcaggggcacccccaggaggtgccgagagcgtccattcattctaccatgccgattgtcatttagaaccggtccgctgccaggcccctccgcctcggtcaccaagcgaggcgtcaggaaggaccgtggggagtggaaaagtttaccccacagtgcacaccagccctccccctgagacactcaaagaaaaagctctggttgaagtagccgcatcctccgggcctcccaccttgacttctctgaacattccacctgggccttactcatcaatgcacaaacttctcgagacccagagcactggggcatgtcaaagttcttgcaaaattagcagtccttgccttaaagcagactcaggcgcttgtgggccagatagttgcccctattgtgccagggccggagctggagaagtagaactggcggatagggagatgcccgattccgattcagaggccgtttacgaatttactcaagacgctcaacacagcgatctccgggacccacactcccgcagacagagatccctgggtcctgacgcagagccaagctccgtgctagctttctggcgccttatttgtgacaccttcaggaagatcgtggattctaaatactttgggagaggcatcatgatagccatactggtgaacacactgtctatgggcattgagtaccacgaacagcctgaagagctaacaaatgcactggaaattagcaatatcgtgtttacctcactctttgcattagaaatgttactgaagctgcttgtatatggtccctttggatacatcaaaaacccctacaacatcttcgacggagtgatcgtggtgatcagtgtgtgggaaatagtaggacagcagggtgggggactgtccgtacttcgcacgtttcgactaatgcgcgtcctcaaactggtgaggttcctcccagcactgcagagacaactggttgtcctgatgaaaacaatggacaacgtagctactttttgcatgctgcttatgttgtttatctttatattttcaatacttggtatgcatttattcgggtgcaaatttgcatctgagagggacggggacactctgcctgacagaaagaacttcgatagcctgctgtgggccattgtgaccgtctttcagattctgacccaagaggattggaataaggtgttatacaacggaatggcctctacgtcaagctgggccgctctgtattttatcgcgctcatgaccttcggaaactatgtattatttaatcttctggtggcgatcctcgtggaagggtttcaggccgaggaaatctctaagcgcgaggatgccagcgggcagctgagctgtatacaactgccagttgactcacaggggggagatgcaaacaagagcgaatccgagccagacttctttagcccttccttagatggcgacggagatcgaaagaaatgtctggcactggtgagccttggcgaacatccggagctgagaaagtcactcctgccgccactcatcatccatacagcagctacccctatgtctctgccaaaatctaccagcactggcctcggggaggcgctcggccctgcgtcccggcgaactagctcctcaggttctgcggaaccaggagctgcccatgaaatgaagagccccccttctgcccgtagcagtccccatagcccctggtcagcagcgtcttcctggacaagtaggaggagctctcggaactcactgggcagagcccctagcttaaaacgccgttcgccatccggagaaagaaggagtctgctgtctggagaggggcaggagtctcaggatgaggaagagtcatccgaagaggagagagccagccctgcagggtctgaccaccgtcatagggggagcctcgagcgggaagctaaaagctctttcgatctccctgacactttacaggttcccggacttcacagaaccgcttcggggcgtggcagtgcttccgagcatcaggattgtaacggaaagagcgcaagtggcaggcttgcgagagctctgcgtcccgatgacccaccgctggatggcgacgacgccgatgacgaaggaaacctctccaagggagagcgagtcagagcatggatacgagcacgtctccccgcatgctgcctggagcgggacagttggtctgcatacattttccctccacagagcaggttccgcctattgtgccaccgaattattacacacaagatgtttgatcacgtcgtcctcgtgattatcttcctgaactgcatcacgatcgccatggagcgacccaaaattgatccacacagcgccgagcggatatttctgaccctgagcaattatatatttacagccgtgttccttgcggaaatgaccgttaaagtggtcgcgctcggatggtgcttcggcgagcaggcttaccttcgatcttcttggaatgtactggatggcttgctagtcctaattagcgtcattgacattctcgtgtcaatggtgagcgactcagggacaaagatactaggaatgctgcgcgtgctccgattgctcaggacactgcggcctctgagggtcatcagtagagctcaggggctgaagctggtggttgagacccttatgagcagtctcaaaccgataggaaatatcgtcgtgatctgctgtgcctttttcatcatttttgggattctaggcgtgcaactcttcaagggcaagttttttgtctgtcagggtgaggatactcgcaatatcaccaataagtccgactgcgcagaggcttcctaccggtgggtgcgacataagtacaatttcgataacttgggccaggctcttatgagcctgttcgtcttggcttcaaaggacggctgggtggatatcatgtacgacggcttagacgccgtgggagtggaccaacagcccatcatgaatcacaatccgtggatgcttctgtactttatttcctttctcttgatcgtggcgttcttcgtgcttaatatgtttgtcggggtcgtggtcgagaacttccacaaatgtagacagcaccaggaggaggaggaggccagacggagggaggagaaacggctgagacggctcgaaaaaaaacggagatctaaggagaaacagatggctgaggcccagtgcaagccctactactcagattatagtaggttcaggctcctggtccatcacttatgcaccagtcattatttggacttattcatcactggggtgattggactgaacgtggtgactatggcgatggaacactatcagcagcctcagatactcgacgaagccttaaaaatctgtaattacattttcacagttatctttgttctcgagtcagtgtttaaattggtcgcttttggcttcaggagattctttcaagatcggtggaaccagcttgaccttgctatcgtgctgctctcaatcatggggataacattggaggaaatagaggtgaatgctagcctgcctattaatccaactatcattcgtattatgcgcgtgctgcggatcgcaagagttcttaaactcctgaaaatggctgtggggatgcgcgcattacttgatactgtgatgcaagctctcccacaggtggggaacttgggcctgctctttatgctgctcttttttatcttcgcagccctcggtgtggaactgtttggggatctggagtgcgatgaaacacatccatgtgaaggcctcggaagacatgcaacttttcgcaatttcggtatggcattcctgactttgtttagagtgtctacaggagacaactggaatgggataatgaaagacactttaagagactgcgatcaggagtccacttgctataacactgtgatatcaccgatttactttgtttcattcgtgcttaccgcgcagtttgtactcgtgaacgtggtgatagccgtgctgatgaaacaccttgaggaatcaaataaggaagctaaagaagaggccgagctcgaggccgagctggagttggagatgaaaactctgagccctcagcctcactctccgctgggatctccctttctttggccgggagtggagggccctgactctcctgattcccccaaacctggggcactccatcccgcagctcacgccagaagcgcctctcacttcagcctggagcacccaacggacaggcagctgttcgacaccatctctctcctgatccaagggtcactcgagtgggaactgaaattaatggacgaactcgctggcccagggggacagccctctgcatttccctcagccccttcactcggcggaagtgatccacagataccgcttgcggagatggaggcattaagcttgacatccgaaatcgtgagcgagccaagctgttctctcgcgttaacagatgatagcctgcccgacgatatgcacactctcttgcttagcgccctagaatccaatatgcaaccccatcctaccgaactgcctgggccagacttgttaactgtacgcaaaagcggcgtcagccggacacactcgttgccaaacgacagctatatgtgccgacacggcagcactgcagagggccctctgggccatcggggatggggactgccgaaggctcagtctgggagtgtactgtctgttcacagccagccggctgatacaagttacattctgcagctcccaaaggatgccccacacctgctgcagccacatagtgctcccacatggggcacgatccccaaactccctcctcctggccgatcgccgttggcacaacggccactccgccgacaggcagccatcagaacggattccctggacgtgcaggggctgggaagtagggaggacctcttggctgaggtctctggcccatctcctcctctggctagggcttattcattctggggtcagtcctctacgcaggcccagcagcactccaggagccactcgaaaatctctaaacatatgacacctccagcaccatgcccaggccctgaacccaactggggaaaggggccacccgagactagatccagtctcgaattagacaccgagctcagttggatctcaggcgacctgttaccccctgggggacaggaagaacctccttctccaagggacttgaagaagtgctactccgtggaggcccagagttgtcaacgcagacccacaagctggctggatgaacagcgacgacatagcatagccgtcagttgcctggatagcggaagccagccccacctcggaactgatccctctaatctgggcggacaacctctgggtggacccggatctaggccgaaaaaaaaactgagtcccccaagcatcaccatcgatcccccagagagccaaggtccgagaaccccaccaagccccggaatttgcctgagacgccgagcaccttcctccgacagtaaagaccctctggcgtccggccctcctgactccatggccgcaagtccatctccaaaaaaggacgtgttgtctctgtctggcctaagcagcgaccccgctgaccttgaccctta

SEQ ID NO: 48696 - DNA, 6998 bp, Artificial Sequence
  Description of Artificial Sequence: Synthetic coding sequence
atggatgaagaagaagacggagccggtgccgaagaatcaggccagccccgaagtttcatgcgtctgaacgatctctcgggggctgggggacgccctggacccggaagcgcagagaaagaccccggatcagctgatagtgaggccgaaggcctgccctacccagcactcgcacccgtagtcttcttctatctttcacaagattcccgcccacggtcttggtgtttgaggaccgtatgcaatccgtggttcgaacgaattagcatgcttgtgattttgcttaattgtgtcaccttggggatgttccgcccttgcgaggacattgcatgtgattcccagcgctgtcgaatactgcaggcgttcgacgacttcatcttcgctttctttgcggtagagatggttgtgaaaatggttgccctgggcatctttggaaaaaaatgctacctgggcgatacatggaacaggttggactttttcatcgtgattgctggtatgctggaatactcactggatcttcagaacgtgtccttttctgcagtgcgcaccgtccgcgtccttcgacccttaagggccatcaatcgcgttccttccatgcggatcctcgtgacactgctgttagacactctgcccatgctcggcaacgtcctcctgctgtgcttttttgtgttttttatatttgggatcgtaggtgtgcaattgtgggcagggctgctccggaacagatgctttttgcctgaaaacttcagcctccccctgagcgtggatctggagcggtattaccagactgaaaacgaggacgagagcccatttatttgctcccagcccagggaaaacggcatgcgatcttgccgctctgttcctaccctgaggggcgatgggggtggaggacctccatgtggattagattacgaagcttacaactcttcctcgaacacaacatgcgttaattggaatcagtactataccaattgcagtgcaggagagcataacccttttaagggagccattaatttcgataatattggctacgcttggatcgcaatcttccaggtgattactttggaaggttgggtcgacatcatgtatttcgtgatggacgcacattctttttacaattttatctacttcattctgctgatcattgttgggagttttttcatgatcaatctgtgtctcgtggtgattgctactcagttttcagaaactaagcaaagagagtcccagcttatgcgcgagcagagagtgcggtttctctcaaatgcctctacactggccagtttttcagagcccggaagctgttatgaggagttactcaaatacttggtatacatcctcagaaaggccgctagaaggttggcccaggttagccgcgctgcaggggtaagggtcgggttgctctcctcacccgctcccctcggaggacaggagacccagccatcatctagctgttctaggtcgcaccgtaggctctctgtgcaccacctcgtacaccaccaccaccatcaccaccatcattatcacctcggaaatggaacactccgggcacctcgggcttctcctgagatccaggatagggacgccaatggttcgcgaagactgatgctcccccctcccagtaccccagcactatctggcgcaccaccgggaggtgccgagagcgtccatagtttctatcatgctgattgccacctggagcctgtaaggtgccaggcccctcccccacggtcgccctcagaggcaagtggcagaactgttgggtccggaaaagtgtatcccaccgtgcatactagccctcctcccgaaacactgaaagagaaagctttggtagaggtggccgcttcgagcggcccacccactctgacctctctgaatataccccctggaccgtatagttctatgcacaagctcctggagacgcaatccacaggagcttgtcaaagctcttgtaaaattagctcaccctgtctcaaggctgatagcggcgcatgtgggccagattcgtgcccctactgcgctcgagccggtgcaggcgaagttgaactggccgatagggaaatgcctgacagtgactctgaagccgtgtatgagttcacgcaggatgcacagcattctgatctgagagacccacattcccgccgtcagcgtagtctgggccctgacgcggaaccgagttccgttcttgcattctggaggctgatttgtgatacatttaggaagatcgtcgactccaaatactttggtcgtggtattatgatagcaatcctcgttaataccctgtccatggggattgaatatcacgagcagcctgaggaactgacaaatgccttggagatctctaacatcgtcttcacatctctcttcgccctggaaatgttgctcaagctcctggtgtacggcccatttggctacatcaaaaacccctacaatatcttcgacggagtgatagtggtgatttccgtctgggagatcgtcgggcaacaagggggaggcctgagtgtgcttagaactttcaggcttatgagggtgcttaagctcgtgcgattcctgcctgcacttcagcgtcagcttgttgtcctgatgaagaccatggacaacgtcgcaacattctgtatgttattaatgctcttcatcttcatttttagcatactcgggatgcacctgttcgggtgtaaatttgctagtgagcgtgacggcgatactttgcccgatagaaagaactttgactctctgctctgggcaattgtcacagtctttcaaatactcacccaggaggactggaacaaagtgttgtataacggcatggccagcacttcgtcatgggccgctctgtacttcattgcgctgatgaccttcgggaactacgtcctgtttaacctgcttgtcgcaattctggtggaaggctttcaggcggaggaaattagtaaaagagaagatgcttcaggtcaactgtcttgcatccaactccccgtagactcccaaggaggcgatgcaaacaaatcagagtcggaaccagattttttcagcccttcactcgacggggatggcgaccgtaagaagtgcttggcactggtctcccttggggagcaccctgaacttagaaagtccttgcttccacctttaattatccacaccgcggctacacctatgtcgctgcctaagtctacctcgaccggcctcggcgaagctctgggcccagcatctagacgcacatcctcctctggatccgctgaacctggcgctgcccacgagatgaaatcccccccatcagccagatccagccctcactccccctggagtgctgccagtagctggacctctaggaggtcttctagaaattccctgggcagagcccctagtttgaagagacggtcaccaagtggtgaacgtagatcgttgttgtccggcgagggccaagagtcacaagacgaagaggagagttccgaagaggaaagggcctctccagccggttcggatcatcggcatcggggatccctggagcgggaggcaaaatcttctttcgatctgcccgatacccttcaggtcccgggattgcaccggactgcgtctggcaggggttcagcatccgagcaccaggactgtaatgggaagtcagcaagtgggagactggcacgggcactccgccctgacgacccacctttggacggggatgatgccgacgatgagggcaatctatcaaaaggtgagcgggtaagggcgtggatccgggctcggctgcccgcatgctgcctggagagggattcatggtcagcatatatttttccaccccagtctcggtttcggctgttatgccatcgcatcatcacccacaagatgttcgaccacgtcgtcctggtcattatattcctgaattgcattactatcgctatggagcggcctaaaatcgatcctcacagcgctgagaggatcttcctaacactgagcaactacattttcaccgcagtctttttggccgagatgacagtcaaagtagtcgcccttggatggtgtttcggcgagcaagcttatcttcggtcctcctggaatgtgttggacggattgctggtgttgatctcagtcatagatatcctggtctctatggtaagcgacagcggcaccaaaatcctgggaatgctgagagtgctgcgccttctgcgaactctgcgcccactcagagtaatctccagggcacagggattaaaactcgtcgtggaaacactgatgagcagtctgaaacccatcggcaacattgtcgtgatctgctgcgcattctttatcatcttcgggatccttggagtccagttgttcaaggggaaattttttgtgtgtcagggggaagacactcgaaacattactaacaagagtgactgtgccgaagcctcctaccgctgggtacgccacaagtataactttgacaatttggggcaggccctcatgtccctgttcgttctggcctctaaagatgggtgggtggatatcatgtatgacgggctcgatgccgtgggggttgatcaacaaccaatcatgaatcacaatccctggatgctactgtatttcatatcattcctcctgatagtcgctttttttgtactaaacatgtttgtgggggtggtggtcgaaaattttcataagtgccgccagcaccaggaagaagaggaagcacggaggcgcgaggagaagcgactgcgtcgcctggagaagaagcggaggaatttgatgctcgatgacgtgatcgccagcggctcttctgcttcagccgcttccgaagcacagtgtaaaccatactatagtgattactcaagattccggctcctagtacaccatctgtgcacctcacattatctcgacctctttatcactggcgtcattgggctcaacgtggtaacaatggcaatggagcactaccagcaacctcagatcctggatgaggctcttaagatctgcaactatatcttcaccgtgatctttgtgctggaatccgtgttcaagttagtcgctttcgggtttcgtaggttcttccaggatagatggaatcagttggatctggcgattgtgctgttgtcaataatggggattacattggaagaaatcgaggttaatgcatcattgccaattaaccccacgatcatcaggattatgcgggtgctccggatagccagggtgctcaagcttcttaaaatggccgtgggaatgagagcccttctggacacggtaatgcaggccctcccgcaggttggcaacttagggcttctttttatgctactgttctttatcttcgcagccctcggagtcgagctattcggcgacctcgagtgtgatgagacccacccatgcgaaggtttgggacgccatgccacattccgtaacttcgggatggcatttctcactctcttcagagtaagcacgggagacaattggaacggaatcatgaaagacacattacgggactgcgaccaggagagtacttgttataatacagtcatctcacccatttacttcgtgagctttgtgctcaccgcacaattcgtcctggttaatgtggtgattgctgtacttatgaagcacttggaagaaagtaacaaagaagcaaaggaggaggccgagctcgaagccgaattggaactcgagatgaaaaccctgagtccccagccgcacagtcctctgggttcccctttcctgtggcccggagtcgagggacctgacagccccgactcgcctaagcccggagcacttcacccagccgctcacgccaggagcgcttctcactttagtctcgagcatcccactgatagacagctgttcgatacaatttctctgctgatccaggggtccctcgaatgggaactcaaattgatggatgagctggccggacctggtggacagccttccgccttcccatccgcgccttcgctcggtggatccgatccccagatgcagccacaccccacggagttacctgggcctgacctgctgacagtgcgcaagagcggtgtgtctcgaacacattccctaccaaacgattcctatatgtgtcggcacggcagtaccgccgaaggacccctgggccatcgtgggtgggggctacctaaggcgcagagtggttctgttctctccgtgcacagtcaaccagctgacacgtcttatatcctccaactaccaaaagacgccccacaccttctgcaacctcatagcgcaccaacttggggaacgatccctaaactgccgccaccgggacgctctcccctggcccagcgacccctacggagacaggctgctatcaggacggattcccttgatgtccaaggcctgggaagccgcgaggatctcctggccgaagtttctggcccatcacctcccctggccagagcctacagcttttggggacaatccagtactcaggcacagcagcactccaggagtcacagcaaaatctcgaaacacatgactccgcctgccccttgcccaggacccgagcctaattgggggaaggggcctcccgagacgcgttcttctttggagctggacaccgaactcagctggatttccggcgacctgctcccaccaggagggcaggaggaacctcctagcccgcgagatctaaagaagtgctattcagttgaggcccagtcttgccagcggcgtccgaccagctggctggatgagcagaggagacactcaatcgccgtgtcctgtctggacagcggctcccagccccatctgggtactgatccgtcaaacctgggaggccagcctctcggaggcccagggtcccggccaaagaaaaaactatcgcctcctagtataactatcgatcccccagaatcccaggggcctcgtacccctccgagcccagggatctgcctgaggaggcgcgctccaagttcagattcaaaggaccctttagcctctggcccaccagacagtatggccgcatctccctcaccaaagaaagatgtgctaagcctgtccggtttatcttccgacccggcagacttggatcccta

SEQ ID NO: 48697 - DNA, 6833 bp, Artificial Sequence
  Description of Artificial Sequence: Synthetic coding sequence
atggatgaggaagaggatggggctggggctgaggagagtgggcaaccgagatctttcatgcgtctgaacgacctgagtggagctgggggacgacctggacctgggtcagctgaaaaggatcccggttcagccgattccgaagcggaaggtttgccgtatccagccctcgcgccagtagtgttcttctacctatctcaggacagtcgcccaagatcctggtgtctccgaactgtgtgtaatccctggttcgaaagaataagcatgcttgtcatacttctcaattgcgtgacccttggtatgtttaggccatgcgaggacattgcttgcgactcacaaagatgtcggatcctccaagccttcgacgatttcatctttgcattttttgccgtcgaaatggtggtgaaaatggttgcgctcggaattttcggcaaaaagtgttatctcggcgatacctggaacagattagacttcttcatcgtcattgctggcatgctggagtattcactggacctgcaaaacgtgtcattttcggccgtgcggaccgtgcgcgtcctgaggccattgcgagctataaatcgcgtcccgtctatgagaatactggttacattgctgctggacacattgccaatgttaggcaatgtgctgctgctgtgcttttttgtgttctttattttcggcattgtcggagtgcagctgtgggccggtttgcttcggaatcggtgctttcttcctgaaaatttttctttaccactctctgttgatctcgagagatactatcagacagagaacgaggacgaatccccttttatttgttctcagcctagggagaacggcatgcgttcctgcaggagcgtgccaaccctgagaggcgacgggggtggcggtcctccatgcggactggactacgaagcatacaattccagcagcaacactacctgcgtgaattggaaccagtattacacgaattgctcagccggagagcacaacccgtttaaaggagcaatcaactttgacaatatcgggtatgcatggattgcaatattccaggtcatcacgctggaaggctgggtagacatcatgtactttgtgatggacgcccattccttttacaatttcatttacttcatcctccttattatcgtgggatctttctttatgatcaacctctgcctggtagtaatagctacccagttctctgagacaaagcagagagagtcccagctgatgcgcgaacagcgtgtgcgttttctcagcaacgcatcaaccctggcctcctttagtgaacccggatcttgctacgaagaactgttaaagtacttggtgtatattctgcgcaaagccgctagacgactcgcccaggtgagtcgcgcagcgggagtgcgtgtaggcctgctatcttccccggcaccactggggggtcaggaaacacagcccagctccagttgcagcaggtcgcaccggagactatccgtccaccatcttgtgcaccaccatcaccatcatcatcaccactatcacctaggtaacggaacgctgcgcgcaccccgagcgtctcctgagattcaggatagggacgccaatggtagcagaagactcatgctccctccaccttccacacccgcactgtccggtgctccccctggtggcgctgaatccgtgcattctttctaccacgcagactgtcacttggagccggtgagatgccaagccccaccgcctcgttccccctctgaggcgagtggcagaacagtgggtagtggaaaggtttatcccacagtgcacacctcacctccacctgagaccctcaaagaaaaagcccttgttgaagtggccgctagctcaggtccacccactctcacatctttgaacattcctcccggtccttacagcagcatgcacaagcttctcgagacgcaaagcaccggggcttgtcagtcctcatgcaagatttctagcccttgcctgaaggctgattcgggcgcttgcgggccagattcttgtccctactgcgccagggcaggggcaggcgaagtagaactcgccgatcgggagatgccagatagcgacagcgaggcggtgtacgaattcactcaggatgcgcagcacagcgacctgcgggatccccacagccgcaggcaaagatcactgggccctgacgccgagccctcttcagtactggcattctggagattaatttgcgacaccttccgcaaaatcgtcgacagcaaatactttggtagaggtattatgattgcaattctcgtgaatacgctcagcatgggcattgagtatcatgagcagccggaggagctgactaacgccctcgaaatcagcaatattgtgtttacaagtctattcgctttggaaatgctgctgaagctccttgtctatgggcctttcgggtacatcaaaaacccttacaacatcttcgacggagtcatcgtagtgatatctgtgtgggaaatcgtgggacagcagggtggcggtctgagcgtcctgcgaacgttcaggctgatgagagtgttgaagcttgtgaggtttctcccggcactccagagacaactggttgtactgatgaagactatggataacgtcgccaccttttgcatgctccttatgttgtttatttttatattttcaatcctcgggatgcatctatttgggtgtaagttcgcgagcgagagagatggcgacactctgcccgatcgcaagaatttcgatagcctgctgtgggctattgttactgtgttccagatcctgactcaggaggactggaacaaagtgctttacaatggaatggcatccacctcctcctgggccgcattatatttcattgctctgatgacttttggaaactatgtcctgttcaacctgctggtggctattttagtggaagggttccaagcagaggaaatatctaaacgagaagatgcgtctggccaactgtcctgtatccaactgccagtggacagccagggaggggacgctaacaagagcgagtcagagcccgatttcttcagcccttccctggacggtgacggagacagaaagaagtgtctggccctggtgagcttaggtgaacaccctgagctgcgcaagagcctcttgcccccacttattatccatactgccgcaactcctatgtccctccctaaaagtacctcgaccggccttggggaagcccttggtccagccagccgaagaacctcttcctctgggtccgccgaaccgggagcagctcacgagatgaagagtccacccagcgccagatcgtctccccactctccctggagcgccgcatcgtcatggacatctcgccgtagcagcaggaactctttagggagagcacccagtctgaaacggagatcccccagcggggagaggcgctccttgttgtctggcgagggtcaggaaagccaggatgaggaagaatcttctgaagaggaacgtgctagccctgcaggaagtgaccaccggcaccgcggatccctggagcgggaggcaaagtcatcatttgacctacccgatacattgcaggtgccaggtctccatcgcaccgcgtcaggacgcggatccgcttccgagcaccaggattgtaacggtaaaagcgcttccggacggctagcacgggcactccggcctgacgacccccctctggatggggacgatgctgatgatgaagggaacctcagcaaaggcgaacgagtccgcgcttggatccgagctcgactgcccgcttgttgtctcgagagagacagttggtcagcttatatctttcctccacagtccagatttaggctcctgtgtcatcgcattattacccacaaaatgttcgaccacgtggtgttggtgattatttttctcaattgtataaccatcgcaatggaacggcctaagatagatccccattccgctgagaggattttcttgactctcagtaattacattttcacagcagttttcctggccgagatgaccgtgaaagtggttgccctgggatggtgttttggcgagcaggcctacctcagaagcagctggaacgtcctggacggcctcctggttcttataagcgtgattgatatcctggtaagcatggtgtccgattcaggtaccaaaattctgggtatgctgcgggtgctgaggctactgcgaaccctgcgcccattgagagtgattagtcgcgcacaagggctcaagctggtggtagaaactctcatgagctcactcaaacctatcgggaatattgtggtcatttgctgcgcctttttcatcatcttcgggatcctgggagtacagctgttcaaaggtaagtttttcgtctgtcagggcgaagatacacgcaacatcactaataagtccgactgcgcggaggcatcttatagatgggtgcgtcataagtacaatttcgacaacctcggccaggctctcatgtccctttttgtgcttgccagcaaggacggatgggtagatatcatgtacgacggattggacgctgttggcgtggaccaacagcccataatgaatcacaatccatggatgctcctatacttcatctccttcctcttgatcgtagcattcttcgtgttgaacatgttcgtgggtgtagtggttgaaaacttccacaagtgccggcagcatcaagaggaagaagaggcaagacggcgtgaagagaaacgactgcgacgactcgagaagaagaggcgcaacctaatgctagacgacgttattgcctcaggaagcagcgcctccgcggcatccgaggctcagtgcaagccatactattcggattattccagattccgcctgctggtccaccacctgtgcacttcacactaccttgatctgttcatcacaggggtaatcggcctgaatgtcgttactatggctatggagcattaccaacaaccgcagattctcgacgaggctttaaaaatctgtaactatatctttacagtgatctttgttctcgaatccgtgtttaaactcgtcgccttcgggttcaggcgctttttccaagatagatggaaccagttagaccttgccatagtactgctaagcataatggggattactttagaggagatcgaggtgaatgcctccctccccatcaatccaaccatcataagaatcatgcgagttctcagaattgcccgagtgctaaaactcctaaagatggccgttggaatgagagcactcctggacactgtcggcaatctcggtcttttgttcatgcttctgttctttatctttgccgctctgggcgtcgaactttttggagacctggagtgtgatgagacacacccatgcgaagggttgggcaggcacgccaccttccgcaactttggaatggcctttttgacactattcagagttagtacaggcgataattggaatggaatcatgaaggacactctccgagactgtgatcaggagtcgacctgttacaacacagttatttctcccatttattttgtctctttcgtgctcacagcgcagtttgttctcgtgaatgtcgtcatcgccgtactgatgaaacacctcgaggaatcaaacaaagaggccaaggaggaggcggagcttgaggccgagcttgaactagaaatgaagaccttatctccccagccacactctcctctcgggagcccctttctatggcccggtgtggaggggccagattcacccgatagtccaaagcctggggctcttcatcctgccgcacacgctcggtcagcgtctcacttttctctggaacatcctaccatgcagcctcacccgactgagctgccgggaccagatctgttgaccgtgcgcaagagtggggttagccgcactcattctttgcccaacgatagctatatgtgccgccatgggagcaccgcggaggggcctcttggccacaggggctggggactccctaaggctcaatccggttctgtcttgtcagttcatagccagcctgccgacacgagctatatcctacagttgcccaaagacgcccctcacctcctccagccgcacagtgcacccacatgggggacaatccccaagctgcctcctccgggacgctctccgctggcgcagcggccactgagacgccaggccgctattcgcaccgactcgctggatgtgcagggactggggagcagggaagacctgctagcagaggtatcaggtcccagcccccctctcgctagagcttacagtttctgggggcagagttccacccaagcccaacagcattcacgctcccactccaagatatcaaaacacatgaccccaccagcaccatgccctggtcctgagcccaattggggaaagggaccgcctgagacaagaagctctctggagcttgacaccgagttatcctggatatctggcgatctgcttccaccagggggacaagaagagcccccatcacctcgtgatctgaagaagtgttacagcgtcgaggcacaatcctgccagagaaggcctactagctggttagacgaacaacggaggcactcgatcgccgtctcttgcctggattccggctcacagcctcatcttgggaccgatccatccaatctgggaggacagcctctggggggaccgggatctagacccaagaaaaagttgagccctcccagtatcacaattgatccccctgaatctcaaggaccgaggaccccacccagtcctggaatttgtttaagaagaagggccccttccagcgattcaaaagatcccttagccagtggtccacccgactcaatggcagcgagcccatctcctaaaaaggacgtactgtctttaagcggcctttcctccgaccctgcagacctggacccata

SEQ ID NO: 48698 - DNA, 6584 bp, Artificial Sequence
  Description of Artificial Sequence: Synthetic coding sequence
atggatgaggaggaagacggcgcaggcgctgaagagtcggggcagccgaggtcttttatgcggctgaacgacctttccggagctggcggtaggccgggaccaggaagcgctgaaaaagaccccggaagcgcggatagcgaggccgaaggcctcccttatccggctcttgccccagtagtgttcttctacctgagccaggatagtaggcctaggtcctggtgcctccgcacagtgtgtaacccttggttcgaaagaatttccatgctggtgattctgctaaattgcgtgacgctaggcatgtttcgcccatgtgaagatatcgcttgcgattctcagagatgtcggatcctgcaggcatttgatgacttcatcttcgctttctttgccgtggagatggttgtaaaaatggtggccctggggatatttggtaagaagtgctatctgggtgatacctggaacagactcgacttttttattgtgattgcaggcatgctggagtatagcctggacttgcagaatgtgagcttcagcgcggtgagaacagtaagggtgctgcggcctcttagagcgatcaatagggtccccagcatgcgtatccttgtaacactcctcttggacactctcccaatgttaggtaacgtgctcctgttgtgctttttcgtcttttttatttttgggatcgtgggagttcagctttgggctggattactcaggaatcggtgtttcctgccagaaaatttctcgctgcctctctccgtggacctcgagagatactatcagaccgagaacgaggatgagtcccccttcatttgttctcaaccaagggagaacggaatgcggtcatgccgcagtgtgcccactcttaggggcgatggcggagggggacctccctgcggcctggactatgaagcctacaacagcagtagcaatacaacttgcgtgaattggaatcaatattataccaactgcagcgccggtgaacataacccattcaagggagctataaattttgacaatattgggtacgcttggatcgcgatattccaggttatcactctggaaggatgggtggacataatgtatttcgttatggacgcccactcattctacaacttcatttatttcatcctgctgatcattgtcgggagcttcttcatgatcaacctttgcctggtggtgatcgctacacagttttcagaaacaaagcagcgcgaaagtcaattgatgcgcgagcagcgggtgcgatttcttagtaacgctagcactttggcctcctttagtgaacccggatcctgttatgaggaattgctgaagtatctggtgtatatcctcagaaaagcagccagacgactcgctcaggttagtcgggctgcaggtgtacgcgtgggcttgttaagcagccctgcccctctgggcggacaagaaacccagccttcttcctcctgtagccgctctcaccgcagactgtcagtgcatcatcttgtgcaccaccaccaccaccaccaccaccactaccacctggggaatggtactctacgggctcctagagctagtcctgagatacaagatagagacgccaacggatcccgtcggttaatgcttcctcccccttccacaccagccctgagcggggctccccctggcggagcggagtctgtccatagcttctatcacgccgactgccatctagaaccggttcgctgccaggccccaccaccaagaagtcccagtgaagcctctggtcgcaccgtcggctctggcaaagtttaccccactgtccacacctcccccccaccagagacactaaaagagaaggccctggtggaggtcgccgcttcatccggtcccccaaccttgacttcccttaatatcccaccgggaccatactcgtccatgcacaagttactcgaaacacaatcgaccggtgcatgccaatccagctgtaagatttcttccccctgcctcaaggctgacagcggagcgtgtggaccagactcatgcccctattgcgctcgcgcaggagccggagaggtcgagctggctgaccgggagatgcccgactccgactccgaggccgtctacgaatttacccaggacgcacagcactctgatctccgtgatccccacagcagacgtcagcgcagtctggggccagacgctgagcccagtagcgtcctggccttctggcgactgatttgtgatacattccggaaaatcgttgatagcaaatacttcgggcgaggtatcatgattgcaatactcgtgaacactcttagcatgggcatagagtaccacgagcaaccagaagaactcacaaatgcactggaaatttcaaacattgtgtttacatcactttttgccctggagatgttacttaaattgttggtctatggcccatttgggtatatcaaaaatccttacaatatcttcgacggtgtgatcgtggtgataagcgtatgggagatagtgggacagcagggaggaggtttaagcgtgcttaggacttttagattgatgcgcgttttgaaactagtacgattcctccccgctctgcagcgccaacttgtcgtactgatgaagacaatggataacgtggcaacattttgtatgctcctgatgcttttcatcttcattttttcaatcctcggcatgcatctgttcggctgtaagtttgcttcagagcgcgatggcgataccttacccgatcgcaagaattttgactctttgttgtgggctatcgttacagtctttcagattctgactcaggaggactggaacaaggtgctttataatggtatggccagtacatccagttgggccgctctgtacttcatcgccctcatgaccttcgggaactatgtactgtttaacttgctggtcgccattctggtcgaagggtttcaggctgaggaaatatctaaaagagaagacgcaagtggccagctgtcgtgcattcagctgcctgtcgacagccagggcggagacgctaacaaatctgagagcgagccagacttcttcagtccatcccttgacggagacggagaccgcaagaagtgtcttgctttagtctcccttggagagcatccagaactacgaaagagcttgctaccacccttgatcattcacactgcggcaacaccgatgagcctgcctaagtcaacttcaacgggcctcggcgaagcactcggaccagcctctcgccgaacatctagttctggaagcgcggagcctggtgctgcccacgagatgaagtccccgccatccgctaggagcagcccccacagcccatggtccgcagccagctcctggacttctaggcggagctcccgcaactctctgggtcgtgctccatctttgaagaggcgttccccaagcggggaacgcaggtctttactttcgggcgagggccaagaatcacaggatgaggaggagtcttccgaggaggaaagagcgtcaccggcaggttccgatcacaggcatcgcggatcattggaaagggaggcaaagtcctccttcgacttaccagacacattacaggtaccaggcctgcatcgaaccgccagtggtcgcggatccgcttctgagcatcaagactgtaacggtaagagcgccagcggtcgattggcaagagccctaagacctgatgaccctccgcttgacggggacgacgccgatgatgaagggaatcttagcaaaggagagagagtgagagcttggatccgtgctcggctacccgcttgctgtcttgaacgtgactcatggagcgcgtacatcttcccaccgcagtcaaggtttaggttgctgtgccatagaatcataacccataaaatgttcgaccatgttgtcctcgtaatcatcttccttaactgtattaccatcgccatggagaggcccaaaatagacccacactcagctgaacggatatttctcacgcttagtaactacatttttaccgctgtctttttggcagagatgactgtcaaggtggtggcactggggtggtgtttcggggagcaggcctatctcaggagtagttggaacgttcttgacgggctgttggtgttgatatccgtgatcgacatattggtgagtatggtttcagacagtggtactaagatcctaggtatgctgcgggtcctgagattgcttagaacactgcgcccactgagggtgatcagcagagctcagggcttgaagctcgtagtcgagactctaatgtctagtttaaagccaattggcaatatcgtagtgatctgttgtgctttttttatcattttcggaattctgggtgtacagctgttcaagggaaaattctttgtgtgccagggagaagatacacgaaatataacaaataaaagtgattgtgcagaggcctcctaccgttgggtaagacacaaatataactttgataatctcgggcaggctctgatgagcctgttcgtgctcgcatctaaagatggatgggtggatatcatgtacgacgggctggacgccgtcggggtagaccagcagccgatcatgaaccataacccatggatgcttctctatttcatttcttttctgctgatcgtggcttttttcgttcttaacatgtttgtaggcgtcgtcgttgagaacttccataaatgtcgacaacatcaggaagaagaggaggcccgtcgtcgagaggagaagcgcttgcggagactcgaaaaaaagcgcagatcaaaggaaaagcaaatggccgaagcccagtgcaagccatactattctgattactcaaggttccgcctgctcgtccatcatctgtgtacttcacactacctggacctcttcataaccggcgtgattggccttaacgtggtgacaatggccatggagcactaccagcagccccagattcttgacgaagctctcaaaatctgtaactacatctttaccgtgattttcgtcctcgagagcgtttttaaattggtcgccttcggcttccgcagattcttccaggaccggtggaatcagctcgacttagccattgtgctgttatccatcatgggcataaccctggaagagatcgaagtcaacgcatccctccctataaaccccactatcataagaatcatgagagtgctgcgcatcgcacgcgtgctcaagttgctcaaaatggccgtggggatgagagcccttctagacacggtgatgcaggcactgccccaagtgggaaatttaggcctgctatttatgctgctgttcttcattttcgccgcactgggtgttgaactgtttggggacctggagtgcgacgaaacgcacccctgcgaggggctgggacgccacgccaccttcaggaatttcggcatggcattcttgaccttgttccgggtgagcacaggcgataactggaatggtattatgaaggataccttgagggattgtgaccaggagagcacctgctataatacggtcatatccccaatatacttcgttagcttcgttctgacagcccagttcgttcttgtgaacgtggtgatcgccgtactgatgaaacacctggaggagtcgaacaaagaagccaaggaggaggctgagctggaagctgagctggagctggaaatgaagacactgtcaccccagccgcatagtcctcttggaagtccctttctgtggcctggagtggaaggtcccgactctcccgatagccccaaaccaggggcattacatcctgcagcacatgcaagatcggcttcccatttctccctagaacaccctaccatgcagccacatcccactgaactccctgggccagatctactcacagtccgcaagagcggggtgtcccgcacacacagcctgcccaatgatagctatatgtgtcgccatggttctacagccgaagggcctctgggacataggggttggggattgcctaaagctcagtccggaagcgtacttagtgtccattcccagccggctgataccagttacatattgcagctcccgaaggatgctccacatctccttcagccccatagtgcccctacctggggaactatccccaaattgccccctccagggcgatcaccgctcgcacaaagaccactgcggaggcaggccgcaatcagaacagatagcctggacgtccagggactgggcagcagggaggacctgcttgccgaagaagaaccaccttccccacgtgacttgaaaaagtgctattcggtcgaagcccaatcttgtcagcgaagaccaaccagttggctggatgagcaaaggaggcatagcattgccgtgagctgcctagattcagggtctcaaccccacctcgggacagacccgagcaatctgggaggacaacccttaggcggaccaggatcgaggccgaaaaaaaaactttcaccccctagtatcacgattgatcccccagaatcacagggccctcgtacacccccatcccctgggatctgcttacgtcggagggcccctagcagcgatagcaaagaccccctggcctctggccctcccgacagcatggccgcatcaccaagtccgaaaaaagacgttttgtctttaagtgggctctcatcagatcccgcagatctggacccata

SEQ ID NO: 48699 - DNA, 6896 bp, Artificial Sequence
  Description of Artificial Sequence: Synthetic coding sequence
atggacgaggaggaggacggagccggagccgaagaatcaggccagccgagatcgttcatgaggttgaatgatttgtccggcgctggcggtcgtccgggtcctggaagcgctgaaaaggatcccggatcggccgacagcgaagcagagggtctgccctatccagctctggcgcctgtagtctttttctacctttcgcaagactccaggcccaggtcctggtgtctgcgcacagtgtgtaacccctggttcgagaggattagcatgttggttattctgctcaactgcgtgaccctgggcatgttccgaccgtgcgaagacatagcttgcgattcacagcgatgccgaatcctgcaggcatttgacgatttcatatttgccttcttcgctgtggagatggtggtcaagatggtggccctaggaatttttgggaaaaaatgttacttaggcgacacttggaatcgcctggactttttcatcgtaattgctggcatgttagaatacagtctggatctccagaacgtgagcttttcagccgtcaggaccgtccgcgtcttgcgtccacttcgggcaattaatagagtgccttccatgcgcattctggtgactttactgctggataccctgcccatgctggggaatgtgctgctgctgtgtttctttgtgttctttatctttggcatagtaggcgtccagctttgggccggtctgcttcggaatcgctgttttctgcctgaaaacttctccctccccctctcagtggatctggaacgttattaccagaccgagaacgaggacgaaagtccttttatctgttctcagcctcgcgagaacgggatgcgctcctgccggagtgtcccaaccctgcgtggggatgggggaggaggcccaccatgcggcttagattacgaagcttataattcttcatcaaataccacttgtgttaattggaaccaatactacacaaactgttcggctggggagcacaatccttttaagggggcaataaacttcgataatattggatatgcttggattgcaatctttcaggtgattactttagaagggtgggtggacatcatgtattttgtgatggacgctcattctttttataacttcatctactttattctgttaataatcgtcggttccttctttatgatcaatttatgcctggtggtaatcgctactcagttcagcgaaactaaacagcgcgaaagccagcttatgcgggagcaacgcgttcgcttcctctcgaacgcctcaactctggcttcattttcagagccgggttcatgttatgaagaactccttaagtatcttgtgtacatcttaagaaaggcagcccgtagactagcccaggtgtcacgtgccgcaggcgtgcgagtgggccttctgagttccccggctcctcttgggggacaggagactcagccatcttcgtcctgtagcagaagtcacagaagactgagtgtgcaccacctagtgcaccaccatcaccatcaccaccaccactaccacctgggcaatggtaccctccgcgcacccagagcttccccagagattcaggaccgagatgctaatggcagtcggagactcatgctgccacccccatcaactccagctctgtctggagccccaccaggaggcgctgagtctgtccactctttttaccatgccgattgccatttggagccagttcgctgtcaagctcctcctcctcgctccccatcagaggcttccggcaggaccgtggggtcaggaaaagtctatccaactgtacacacctccccaccccctgagacactcaaggagaaagctcttgtggaggtcgctgccagtagcggcccacccaccctgacgtccctgaatattcctccaggcccatattcatcgatgcataagctattggagacccagtctacaggtgcctgccagtcttcctgtaaaatttccagcccttgcctgaaggcggatagcggagcctgtggccctgacagctgcccttattgtgcgcgtgctggggctggagaagtggagctcgcggacagggagatgcctgacagcgattcagaagccgtgtatgaattcacccaggacgcacaacactccgacctgagagaccctcattcgaggcggcagcggagcttaggacccgacgcagagccatcatcagttctggctttctggcgtttgatctgtgacacattcaggaagatcgtagattctaaatatttcggcaggggtattatgatcgccatcctggtaaataccttatcgatggggattgagtatcatgaacagcctgaggaacttacgaacgcactagagattagtaacatcgtctttacttcattatttgcgctggaaatgttactcaagctgctcgtctatggtcccttcggctacattaagaatccatataatatctttgacggcgttattgtagtcatttctgtgtgggagatagtgggccagcaaggtggaggactctcggtgctccgcaccttccgcctgatgagggtcctcaagctcgtgcgcttcctgcctgcactgcagaggcagcttgtcgtcctcatgaaaaccatggataatgtggctaccttctgtatgttgctgatgctgtttatcttcatttttagtatcctaggcatgcatcttttcgggtgcaaattcgctagcgaacgggacggcgatacccttccagatcgcaagaatttcgattcactgctctgggccatcgtgaccgtgttccaaatcttgacccaggaagattggaataaggtactgtataacggtatggctagtacttcttcttgggctgccctctatttcatcgcgctgatgacattcggcaactacgtgcttttcaacctcctcgtggcaattctggtcgaagggttccaggctgagggtgacgcaaataagagcgaatccgagccagacttcttctctccatcactggacggagacggtgaccggaagaaatgcctagccctggtgtctctgggtgagcatccagagttgaggaaatccctgctgcctcctctcattattcacacagctgccacaccaatgagcctgccgaaaagcacgagcacaggcttgggagaggctctgggacctgccagcaggcggaccagtagtagcggtagcgcagagccaggtgcggctcacgagatgaaatcacccccttcggccagaagcagccctcattcaccctggtctgccgcatcttcatggacttcccgccgatcctcccgcaacagtctggggagggctccaagtctcaaacgcagatccccatccggcgaacgccgatcccttctgagcggagagggacaggagtcccaggacgaagaagaatcctcagaagaggagagagcttcccccgcaggaagcgatcatagacataggggctctctggagcgcgaggccaagtccagctttgacctccccgacacattgcaggtgcccggattgcatcgtactgcatccgggagaggatccgcaagcgaacaccaagattgcaatggcaagtctgccagcggcaggcttgcaagggccctaaggccagacgatccaccattggacggagacgatgcagacgatgaaggtaatctgtcaaagggggaaagagtgagagcctggattcgggctcgcctgcctgcctgctgtctcgaaagggattcttggtccgcctacatctttcctccccagagcagattccggctcctgtgccatcgcattataactcataagatgtttgatcacgtggtactcgtaatcattttccttaactgcattacgatagcaatggaacggcctaagatcgatccacatagcgccgagcgaatattcctcacactgtctaactatatcttcactgccgtgtttcttgccgagatgacagtgaaagttgtagccttaggctggtgcttcggggagcaggcctacctgcgatcaagttggaatgtgttggacggcctcctcgtcctgatttcagttatcgacattctcgtgtcaatggtgtcggacagcggcaccaagatcctggggatgcttcgcgtgctgcgcctattgcggacgctccgacccctcagagtgatttcaagagcacagggattgaagctggtcgtggaaactctgatgagctcactgaaacccatcggtaacatcgtagtaatctgttgcgcttttttcattatcttcgggattctgggcgtccagctatttaagggcaaatttttcgtttgccagggagaagacacccgtaatatcacaaataagtccgactgtgctgaagcttcgtacagatgggtgcgccataagtacaactttgacaatttagggcaggccctcatgtcactgttcgtgctagccagcaaggacggctgggtggatatcatgtacgatggcctggatgcagtgggtgttgatcagcagccaatcatgaatcataacccatggatgctcctctactttatttctttcctgctgattgtggccttcttcgtactgaatatgtttgtgggcgtagtggtggagaacttccacaaatgcagacagcaccaggaagaggaggaggctcgcagacgcgaggaaaaaagactccgcagactggagaagaaacgcagatcgaaggagaaacagatggctgaagctcaatgcaaaccttactactctgattactcacggtttaggctcttagtccaccacctgtgcacttcacactatctggatctcttcatcaccggtgtgatagggctgaacgtggttaccatggccatggagcattatcagcagccccagatacttgatgaggccttaaaaatctgcaattacatattcacagtgattttcgtgctggaaagcgttttcaaattggttgcctttggcttcaggcgattctttcaggaccgctggaatcagttggaccttgccattgttctcctgagtatcatgggtataacgttggaggagattgaggtgaacgcttctctacctattaatcctaccatcattagaatcatgcgagtcctgcgtatcgccagagtgcttaaactgctaaaaatggccgtgggcatgagagcactcctagacactgtcatgcaggccctcccacaagtgggtaatctgggactgctctttatgctactgtttttcatctttgctgcactgggggtggagttgttcggggacctcgagtgtgacgagacccacccctgcgaaggtctgggtaggcacgctaccttccgcaactttggcatggcattcctgactctctttcgggtctccaccggcgataattggaatggcatcatgaaagatacgctccgagactgcgatcaggagtctacatgttataacaccgtgatctcgcctatttacttcgtgagttttgtgctgacagcccaatttgtactggtgaacgtagtgatcgccgtgcttatgaaacacttggaggagtcaaacaaggaagcaaaagaggaggccgagcttgaggccgaactggagcttgagatgaaaactctcagtcctcagccacacagtcccctgggctcccctttcctgtggcccggtgtggagggacccgactcacccgactctcctaagccaggcgctttacatcccgctgcccacgctagatctgcctctcatttttcattggagcaccccactgatagacagctctttgacactatctctttgctgatccaagggagcctggaatgggagctgaagctgatggacgaactagcagggccagggggtcagccaagtgccttcccctctgctccttctctgggcggtagcgatccccagatgcaaccacatcccactgagctgcccggtcccgatctgcttacggtgcggaagagcggcgttagccgcacgcactctcttcctaacgatagttatatgtgtagacacggctcaactgccgagggcccactcggccatagggggtggggtttaccaaaggctcaatcaggcagcgtactcagtgttcatagccagccagcagatacaagctacattctccagttgcccaaagatgctccacatctgctgcagccacacagtgctcctacctggggcactatccctaaattaccaccacctgggaggagtcccctggcccagaggcctctaagacggcaggctgcgatccgcacggacagtctagacgtgcaggggctggggtcaagggaggatctgctggcagaggtgtctggcccttctccgccactggctagagcgtattctttttgggggcagtcttccacgcaggcccagcaacactcgagaagccacagtaaaatctccaagcacatgactcccccagctccctgtccagggcctgaaccaaactggggcaaagggccaccggaaacccgatctagcctggagcttgataccgaattaagctggatctccggggaccttctgcccccaggagggcaggaagagccgcctagtcccagagatctgaaaaaatgctattctgtcgaggcccagtcctgtcagaggagacccacatcatggcttgacgagcagagacgccatagcatcgcagtcagctgtcttgactctgggagtcagccacatttaggcaccgacccaagcaacctgggcggtcagcctctcggaggccctgggtcacggcctaagaagaaattatccccaccttccatcaccattgatcctcccgagagccagggccctaggacccctccatctcctggtatctgtcttcggagaagggcaccatccagcgattcaaaggaccccctggcttccggtcctccggattcgatggcagcgtccccttcgccgaaaaaggacgtgctttcacttagcggtctgagtagtgatcctgctgatctggacccgta

SEQ ID NO: 48700 - DNA, 6698 bp, Artificial Sequence
  Description of Artificial Sequence: Synthetic coding sequence
atggatgaggaggaggatggcgctggtgcggaagagtccgggcagccgaggtcattcatgcgacttaacgatctgtcaggcgctggaggcagaccgggtccgggaagtgctgagaaagatccaggatccgctgacagcgaagctgaaggcttaccatacccagctctcgctccggtggtgttcttctacctttctcaggactccaggccccgttcttggtgcctgcggaccgtgtgtaacccctggttcgagagaatcagtatgttggtaatcttgctcaactgcgtgaccctgggtatgtttcggccttgcgaagacatcgcttgtgactcacagcgatgtagaatcctgcaggcttttgacgactttattttcgcattcttcgctgtggagatggtggtgaaaatggtcgccttgggtatcttcggaaagaagtgctacctgggcgacacgtggaacagactggattttttcatcgtgatcgctgggatgctggagtacagcctggatctgcagaatgtatcgttcagtgcagtgcggacggttcgagtgctaagaccgttgcgagcaatcaatagggtgccctccatgcgtattctggttacgttgctccttgatacactgcctatgttgggaaacgtactgctcctgtgtttttttgtattctttatcttcggcatcgtcggtgtgcagctctgggctgggctgcttaggaatcgatgtttcctgcctgagaacttttcccttcctctgtccgtagatcttgagaggtattatcaaacagagaacgaagacgaatcacccttcatctgtagccaaccacgagaaaacggaatgcgtagttgccgttctgtgcctacgctccgaggcgacggaggaggaggaccgccttgtggtctggactacgaggcctacaactcttccagcaacacgacctgtgttaactggaaccagtattacaccaactgctcagctggcgaacataacccgtttaaaggagctatcaactttgacaatattggctacgcctggatcgctatatttcaggtcattaccttagagggatgggttgatatcatgtattttgtgatggacgcccacagcttctataatttcatctatttcatcctattgatcattgttggtagtttcttcatgatcaatttatgccttgtggtgatcgcaacgcagttctctgagacgaagcagagagagtcccagctcatgcgagagcagagagtgaggtttctgtctaacgctagtaccctggccagtttctcagagccagggtcttgttacgaggaactgctgaagtaccttgtgtatatcctccgtaaggcagctcggcgactggctcaggtctctcgggcagctggagtgcgagtgggcttgcttagtagcccagcccctctgggcggtcaggagacacagccctcttcttcttgttcacggtcacaccgtcggctgtcggtacaccatctggtgcatcatcatcatcaccatcaccaccattatcacttgggcaatgggacgttgagagcgccaagggcctcaccagagattcaggaccgagatgctaatggcagtaggagactcatgttgccacctccctcaaccccagccctctccggggctccgccaggaggcgcagagtctgtgcattctttctaccacgcagactgtcatctggaaccagtgcggtgccaagcccctcccccaaggagcccaagcgaggccagcggaaggacagtgggcagcgggaaggtgtacccgacggtccacaccagcccgcctccagagacactcaaagagaaagccctggtagaagtggctgcttccagcggccctcctactctgacaagtctgaatatcccacccggaccgtatagcagcatgcacaagctgctggagacgcaatccacaggcgcttgtcagtccagttgtaaaatttcatctccgtgtctcaaagccgattcaggcgcatgtgggccagacagttgtccctactgtgctcgagcgggagcaggcgaggttgagttagctgacagggagatgcccgactcagatagcgaggccgtgtatgagttcacccaggatgctcagcattctgatcttcgggacccccattctcggaggcagcggagtctggggccagatgctgagcctagcagcgtgctcgccttctggcggctgatttgcgatacatttcgcaagattgtggactccaaatattttggccgtggtattatgattgctattctggtaaataccttaagtatgggcatcgagtatcatgaacagcctgaagaattgactaacgctctggagatttctaacattgtctttacatcccttttcgcactcgagatgctgttgaaactgcttgtgtacggacccttcggttatatcaaaaacccatacaacattttcgatggcgtgatcgttgtgataagtgtgtgggaaattgtcgggcagcagggtggcggattgagcgtgctgaggacgtttcgcctgatgcgcgtccttaagctggttagattcctgcccgcattgcaacgacaattggtggtattgatgaagaccatggataatgtagccactttttgtatgctactcatgctcttcatctttatatttagtattttgggcatgcatctatttgggtgcaagtttgcatccgaaagggacggcgacacactgcccgaccgcaaaaatttcgatagcctgttgtgggctatcgtgacagtgttccagatactgacgcaggaggactggaataaagtgctttataacggcatggccagcacctcttcttgggcggcactgtattttattgcactcatgacatttggtaactacgtgcttttcaatttactcgtggctatcctggttgaaggctttcaggccgaagaaatctccaaaagggaggatgctagcggacagctcagttgtatccagctgcccgttgatagccaagggggtgatgcgaacaaatctgaatctgagccagacttcttctccccgagtctcgacggagacggagaccgcaaaaaatgtctggcactggtgtcccttggtgaacaccccgaacttcggaaatctctgcttcccccactgatcatccataccgctgctacccctatgagcctgcccaaatccacctctaccggcctaggagaagcattgggccctgcttcaaggaggacatcatcctccggaagcgcggagccaggagctgcgcacgagatgaagtctcccccatccgctaggagctccccacactccccttggagtgctgcctctagctggacctctagaagaagctccaggaatagcttgggacgggctccttccctgaagaggcggtcgcccagcggggagcgcagaagcctgctttccggtgaagggcaggagtctcaggatgaagaagagtccagcgaggaagaacgcgcatcacccgcaggctcagaccatagacacagaggatcactggaacgggaggcaaaaagcagtttcgatcttccagacacactgcaagtcccagggctacaccggacagctagtgggagggggtctgccagcgagcaccaagactgtaacggtaaaagcgcctcggggaggctcgctcgcgctttacggcctgatgatcctcctctggatggggatgacgccgacgacgaggggaatctgagcaaaggtgaacgagtaagagcatggatcagagcgcgacttccagcatgctgtctggaacgggacagctggtcagcctatattttccccccacaatcacggttccgcctgctttgccacaggataataactcacaaaatgttcgatcacgtggtcctcgtgatcatcttccttaattgcattaccatcgcgatggaacggccaaagatcgacccacactcagcagaaagaatctttctgactctgagcaactatatcttcacagctgtgttcctcgcagaaatgacagtgaaagtggtggccctgggctggtgcttcggcgaacaggcctatctgcgctcttcttggaatgtgctggacggcttactggtcctcatatccgtgatagacatcctggtatcgatggtttcagattctggcacgaaaatactcggcatgctccgggtgctaaggcttctgcgcaccttgcgccctttaagggtaatatcgcgtgcccagggtctgaagttggtggtggaaaccctgatgagttcgttgaagcctattgggaacatcgtcgttatctgctgcgctttttttatcatcttcggtatcctcggcgtccagcttttcaaggggaagttcttcgtgtgccagggagaggataccagaaacattacaaataaaagtgattgcgcagaggctagttacagatgggtccgacataaatacaactttgacaatctgggtcaagccctgatgagcctgtttgttcttgccagcaaggacgggtgggtggacatcatgtatgacgggttagacgcagtaggcgtggaccaacagaactttcataaatgtcggcaacaccaggaagaggaggaagcccgacgacgggaggaaaaaagactccggcgactggaaaagaagcggaggaaggcacagtgcaaaccctattactcagattatagcaggtttagacttctggttcatcatctttgcacttcacactatctagatctgtttatcaccggggttatcggactcaacgtggtcaccatggccatggagcactaccagcaacctcagattttggacgaggctctcaaaatctgcaactatatctttacggtgatattcgtgttggaatccgtcttcaagctcgtggcttttgggtttcgccgttttttccaggaccgatggaaccagctagatctggccattgtgctgctttcgataatgggcattacactagaggagattgaagttaatgcttcactccccataaacccgaccataattaggataatgcgtgtgcttagaatcgccagggttctcaagttgctcaaaatggcggtgggcatgagagccttgcttgacacggtgatgcaggctctcccgcaggtcggcaacttgggcttactctttatgcttctgttctttattttcgccgctctcggcgtggaactgtttggagatctggaatgtgacgaaacccatccatgtgagggcctgggacgacatgccaccttcagaaactttggaatggcttttctaaccctgttccgtgtgtccacaggagacaattggaacggtataatgaaggataccttacgcgattgtgatcaggaaagcacatgctacaatacagtcatttcccccatctatttcgtgagcttcgtcctgacagctcagtttgtcttagttaacgtggtaatcgcggtactcatgaagcacctcgaggagagtaacaaggaggccaaggaggaggcagagctcgaggccgaactggaattggagatgaaaaccctctccccacagccccactcacccttgggcagcccgtttctgtggccaggcgtagaggggcctgattcaccggattcaccaaagccaggtgcactgcatcccgctgcccatgccagaagcgcaagccacttctcactcgagcaccctacaatgcagccacatcccacggaactgccgggaccagatctcctgacagttcgcaagtctggggtctctcgtactcactccctcccgaacgatagctacatgtgccgccatggctctaccgctgaaggtcccctgggccatcgtggctggggactgccaaaagcacagtcggggtccgttctatcagtccattcccagcccgcagacacctcatacattcttcagctccctaaagacgctccccacctgttacaaccccatagtgcacccacttggggaactattccaaagttgcctccacccggtaggagccccctcgcccagcggcctctaagacgccaggctgccatcagaactgattctttggatgtgcagggcctgggttcacgggaagatctgctggctgaagtcagcgggcctagtccccctcttgcaagagcctacagcttctggggtcagagcagcactcaggcccagcaacactcccggtcccatagcaagataagcaaacacatgacgccccctgccccatgtcctggcccagagcccaactgggggaaggggccaccagagactaggtcctctctggagctggatactgagctcagctggatctctggcgatctgctcccaccaggcggtcaggaagagccgccaagtccaagagatctaaagaaatgttatagcgtggaagcccaaagctgccagagacgtcccacctcctggctggacgaacagcggcgacattcgatcgcagtctcttgcctggattcaggcagccaaccacacctggggaccgatccaagcaacctgggcggacaaccacttggcggaccgggatcccgcccaaagaagaagctcagccctccctcgataaccatcgacccacccgaatcccaggggcctcgcaccccaccatcacccggaatctgtttacggcgtcgcgctccaagttccgactctaaagatcccctggcctccgggccaccagactcaatggccgcttcaccatccccaaagaaggatgtgctctcactcagcggactgtcctccgatccggctgatctggaccccta

SEQ ID NO: 48701 - DNA, 5276 bp, Artificial Sequence
  Description of Artificial Sequence: Synthetic coding sequence
atggacgaggaggaggacggggctggggcagaagagagcgggcagcctcggtccttcatgcgacttaatgatcttagcggggctggtggaagacctggccctgggagtgcggagaaagacccaggatcagctgactctgaggcagagggcttaccttacccagcgctggcacctgttgtgtttttttatctgagccaggattcgaggcctcgcagttggtgcctgcggaccgtttgcaacccctggtttgaaaggatcagcatgctggtgatactgttaaattgtgttaccttaggaatgttcagaccatgcgaggacattgcctgtgactcccaacgttgccgcattttgcaggctttcgatgactttatttttgctttctttgcggtcgagatggtggtgaagatggtcgcactcggcatcttcggaaagaagtgctacttaggagacacgtggaataggttggatttcttcatcgttattgctgggatgctggagtatagtcttgacctacaaaacgtatccttctcagccgtccgtaccgtcagagtgctgagaccactgagagctattaatagggtaccgagtatgcgaattctggttacccttctattggatactttgccaatgctcggcaacgtcttactcctctgcttttttgtcttcttcatctttggaattgtgggggtgcagctctgggcgggattgttacgcaataggtgttttctccctgagaactttagccttcctctgtcagtagatctggagcgatattaccagaccgaaaatgaagacgaatccccatttatttgttctcagcctagagagaacgggatgcggagttgcaggagcgtgccaaccctccgcggagatggcggaggtgggccaccatgcgggctggactacgaagcctacaatagttcctctaacaccacctgcgtgaattggaaccagtactataccaactgtagcgcaggcgagcataacccctttaaaggagcgataaactttgataacataggctacgcttggattgccatttttcaggtaattaccttagaagggtgggtggacattatgtatttcgtgatggatgcccatagcttctacaatttcatctactttattctgctgattatcgtgggaagcttctttatgataaatttgtgccttgtggtcatcgccacacagttttccgagacaaaacaaagagagtctcaactcatgagagaacagcgggtaagattcctgagtaatgcatccacgctggccagcttttccgaaccgggttcatgctatgaagaactgttgaaatatctggtgtacattctcagaaaagctgcccgaaggttggctcaggttagtcgagccgcaggcgttagagtgggtctcttatcctccccagctcccctcggtggtcaagagacccaaccgtcctcaagctgttcgaggtcacacagacgcctttccgtgcaccatctggttcatcatcaccatcatcaccaccatcattatcacctcggcaatggtaccctgagagctccaagggcgtctccagaaattcaggatcgcgacgcaaacggctccaggcggctgatgctcccaccaccgtccacaccagcgctctcaggcgctccacctggtggagctgagtccgtacactctttctaccacgccgactgtcatttggagcccgtgcgctgtcaggctccgccacccagatccccctccgaagcgagtgggcgtaccgttgggagcggcaaggtttatcctaccgtgcacacctctccacctcccgagacactcaaggagaaggcacttgttgaggtcgctgcatcttccggcccaccaaccctgacctccctgaacattcctcctggtccttatagcagcatgcacaagttgctggaaacccagagcactggggcatgtcagagctcctgtaaaatcagctctccttgcctgaaagccgattctggcgcatgcgggcctgatagctgcccatactgtgcgcgtgccggtgccggtgaggttgaactggcggatcgtgagatgccagattcagacagcgaggcagtgtatgaattcactcaggacgcacaacactcagacttgagggatccgcactcgagaaggcaacgttcattgggacctgacgccgaaccatcttccgttctggctttttggcgactgatttgtgacacctttaggaaaattgtggattctaagtatttcgggaggggaattatgattgccatactcgtgaacaccttatcaatgggaatcgaataccatgagcaacccgaagagctaaccaacgcactcgagatcagcaacatagtattcacatcgctatttgccctcgagatgcttcttaaacttctcgtttatggtccattcggctacatcaaaaatccatacaacatctttgatggagtcatagtagtgatttccgtttgggaaattgtggggcagcaaggcggagggctcagtgtgctgagaacctttcggctgatgagagtgctcaagcttgtgcgctttctaccagcccttcagcggcagctggtggtcctgatgaagaccatggacaacgtagccaccttttgcatgctcctgatgctgttcatcttcatattttctatcctcggtatgcacctgttcggctgtaagttcgcttcagagagggatggagacacactccctgatcgcaagaacttcgatagccttctgtgggcaattgtgacggtcttccagattctgacacaagaggactggaacaaggtgctgtataacgggatggcctcaacttcctcatgggctgctctgtacttcattgcccttatgacatttggcaattacgtgctttttaacctcctggtggccatccttgtcgagggcttccaggccgaggagatttcaaagagagaggatgccagcgggcagttatcatgtatccagctgccagtggactctcagggcggagatgccaacaagagtgagtccgaaccggacttcttctctccaagtctggacggtgatggagatcgaaaaaagtgcctggctctggtcagtctgggggagcatccagagctgcgcaaatccttgcttccccctctgattattcacaccgcagccacaccaatgtctcttcctaagagcaccagtacaggccttggggaggcactgggtcctgcgtcgcggagaacctcttcatccggctccgccgagccaggtgcagcacacgaaatgaagtctcctcccagcgcacgtagttctccccattccccgtggtccgcggcatcttcttggacgtcccgtcgctcttccagaaacagcttggggagagccccaagcttgaagcggcgatcaccctctggagagcgacgcagcctgctgagcggcgaaggccaagagtctcaggacgaagaggagagcagcgaggaggagcgtgcgtcccctgcaggtagtgaccaccggcaccggggtagtctggaaagggaagctaagagctccttcgacctaccagacacactgcaagtgcccggactgcataggaccgcaagcggtcgcggaagcgccagcgaacaccaggactgcaacgggaaatcagcttcaggtcggctggctcgcgcacttcgacctgatgatccaccactggacggggacgatgcagatgacgaaggaaatctgtctaagggagagcgcgtacgggcttggattagagccagactacctgcttgttgtctggagagagacagctggagtgcctatatcttcccccctcagtctcggttccgcctgttgtgccaccggatcattactcacaaaatgttcgaccacgtggtcctggttatcatattcttgaattgtatcacaatcgcaatggagcggccaaaaattgatccccattcagcggagagaatctttctgaccctttccaactacatcttcaccgccgtctttctagccgagatgactgtcaaggtggttgccctgggctggtgttttggcgagcaggcctacctgaggtcttcctggaatgtcctggacgggcttctagtacttattagcgtaatagacatcttggtctccatggtgtcagattcgggtactaaaatactcggaatgttgcgggtgctccgcttactgcgaactcttcgccctctccgggtaattagccgggctcaagggctaaagctcgtggtggagacccttatgtcatccttaaagcctataggaaatatcgtggttatatgctgcgctttctttatcattttcggaattctgggggtgcagctgtttaagggcaaattctttgtgtgccaaggcgaggacactaggaatattactaacaaatccgattgcgccgaagcatcatacaggtgggtacggcataagtataactttgataatttaggacaagcattaatgtctctcttcgtactggcgagtaaggatggatgggtcgatattatgtacgacggccttgacgccgtaggcgttgaccagcagcccattatgaaccacaatccctggatgctgctgtatttcatctctttcctactgattgtcgccttctttgtgcttaacatgttcgtgggagtagtggtggaaaatttccacaaatgtagacagcaccaggaggaagaggaagcgaggcgacgagaagagaagcgtcttagaagattggagaaaaagagaaggaaggctcagtgcaagccatattattcagactactctcgttttcgcttacttgtgcaccacctgtgtacaagccattaccttgacctgttcattaccggcgttataggcctcaatgttgttactatggccatggagcattatcagcagccccagatccttgacgaggctctcaagatttgcaattacattttcacagttatattcgtgttggagtctgtgttcaagcttgtggcgttcggcttccgaagatttttccaagatagatggaatcagctggaccttgccattgttctgctgagtattatggggattactctggaggagatcgaggtaaatgccagtttgccgattaatccgacgatcatccgtatcatgcgcgtgttacgtattgcgcgagtcttgaagctgctgaagatggcagtcgggatgagggccctgctagacaccgtgatgcaagctttgccacagctgtgggcctggagctccctcgaaacttggtctgtcacccggcacaccccagttcgagcatgggcagtaatgcctcccttcggaacattagcatggccttcata

SEQ ID NO: 48702 - DNA, 5240 bp, Artificial Sequence
  Description of Artificial Sequence: Synthetic coding sequence
atggacgaggaagaggacggggcaggagctgaggaatcaggccagccgaggtcttttatgcgtcttaacgacctgtctggcgctggtggtcgtccaggtcctggcagcgccgaaaaggaccccggaagcgcagactccgaagccgagggactcccttaccctgccctcgcccctgtggttttcttctatcttagccaggattcaaggccgcgatcttggtgtctgcgcactgtgtgcaacccatggttcgaacggatttctatgcttgtgatattgctgaattgcgtcacccttgggatgttccggccttgcgaagacatcgcttgtgattctcaacgttgtagaatcctgcaagcattcgacgatttcatctttgcgttttttgcagtggagatggttgttaagatggtggctctgggaatatttgggaaaaaatgctacctcggagatacttggaataggctcgatttcttcatcgtcattgccggtatgttggagtattcccttgacctgcagaatgtgtctttttccgctgttcggaccgtgagggtactgaggcccttgcgggctattaatcgagtaccttcaatgcggattctggtaacactgcttctcgacacgctgcctatgctagggaacgttttgcttttgtgtttcttcgtgtttttcattttcggaattgtgggggttcaactgtgggcagggcttctcaggaatcgctgttttcttccagagaacttcagcctgcccctcagcgtggatctcgaaagatattatcaaacggagaacgaagatgaatctcctttcatctgtagccagccacgtgaaaacggtatgagatcatgcaggtcagtgccaaccctgcgcggagatggagggggaggcccaccgtgcggtctagattacgaagcctataactcatcatctaatactacttgcgtaaattggaaccaatactatacgaattgctccgccggagaacataacccctttaagggcgcaatcaactttgacaacataggttatgcgtggattgccatctttcaggtaataacgctggaagggtgggtggacattatgtatttcgtgatggatgctcactctttctataactttatttatttcatacttctcattattgtaggcagcttcttcatgattaatctgtgcctcgtggtgatagctactcagttcagcgaaactaaacaacgagagtcccaacttatgcgcgaacagcgcgtaaggtttctttccaatgcaagcacactggctagcttctccgagcccggttcctgttatgaagagctccttaaatatctcgtatatatcttgcgtaaggccgctagaagactggcgcaagtcagcagagccgctggagtgagggttgggttgctgagcagtccagcaccactcggaggtcaggagactcagccctcatcttcatgtagtcggtcccaccgccgactcagcgtgcaccacttagtgcatcaccaccatcaccatcatcaccactatcacctgggcaatggcaccctgcgtgccccacgggcaagccctgagatacaggatagagacgccaacgggtccaggcgcctcatgctgccaccacctagtacacccgctctttcgggtgctccgccaggcggagcagagagcgtgcatagcttttatcatgctgactgtcatctcgaacctgtccgctgccaagccccaccacccaggagtccctccgaagcatcaggacgtactgtgggctccggaaaggtttatcctactgtccacacctccccgcctcctgagacattgaaagagaaggccctggtcgaggtagccgcatccagcggaccccctactctcaccagcctgaatatacctccgggaccctatagctccatgcataagttgttggagacgcagagtaccggagcatgccagtcttcatgtaagattagctcaccttgtctgaaggccgattcaggggcatgtggtccagatagctgtccatattgtgccagagctggggctggtgaagttgaactcgctgatagagaaatgcccgactcagattcagaggccgtgtatgagtttacgcaggatgctcagcactctgatctgagagacccccattctaggcgacagaggagtctagggcctgacgccgagccctcctccgtcctggccttctggcgcctcatctgtgacacgttccgcaaaatcgtcgactcaaagtacttcggacgcggtatcatgatagctattctggtcaatacacttagtatgggtatcgagtatcatgagcagccagaagagctgaccaacgcccttgagatctccaacatcgtttttactagcctgttcgcattggagatgctgctgaagcttctggtgtacggaccatttggatacattaaaaacccctataacatctttgacggtgttatagttgtgatttcagtgtgggaaatcgtcgggcaacagggcggaggactctccgtgttgaggacctttagacttatgcgcgtgctgaagctcgttaggtttttacccgctctgcaacgacagctggtcgttctaatgaagaccatggacaacgtggctactttctgtatgttgctaatgttgttcatttttatattctcgatcctgggaatgcatttatttggctgcaagttcgcgagtgaacgcgacggcgacactctacctgatcgaaagaatttcgactctctgttatgggccatcgtgaccgtgttccaaatcttaacccaggaagattggaacaaagtcctctataacggaatggctagtacgagttcatgggcagctctttactttatagcactcatgacattcggaaactatgttctgtttaatcttctggttgccatcctggtagaaggcttccaagccgaaggagatgctaataaatctgagtccgaacccgacttcttcagccctagtctggacggcgatggggacagaaagaagtgtctcgctttagtgagcctaggtgaacatcccgagctgcgcaaatccctgctgccaccgctaattatacacaccgccgcaactccaatgtcgctccctaaaagtacatctacaggcctaggagaggctctggggcctgcctcacgcaggacaagttcaagcggcagcgccgagcccggtgctgcacacgaaatgaaatctcctcctagtgcaagatcctctccccacagcccttggagcgctgctagcagctggacaagccggcgaagcagcagaaatagtctgggtcgcgcaccttcattaaaacggcgaagcccttccggcgagaggcgttctttgctgtcaggagagggacaagaatcccaggatgaagaagagtcctcagaagaggaaagagccagccctgcgggaagcgatcacagacaccgaggtagcctggaaagagaagcaaaatcttccttcgacctaccggatactttgcaggtgcccggtctccacagaaccgcaagcgggaggggatccgcttccgagcatcaggactgcaatggcaaaagcgctagtgggcgtctggccagggccctgcggcctgatgatcccccactcgacggggatgacgcagatgatgagggaaacctgtctaagggtgaacgagtgcgagcttggattcgtgcacgactccccgcatgctgtttggagagagatagctggtcggcctacattttcccgcctcagagccggttccggttgttatgccaccgaataatcactcacaagatgttcgaccacgtcgtgctggtgattatattccttaactgcatcaccatcgctatggagcggccaaagatcgacccacactccgctgagagaatatttctgacactcagcaactatattttcaccgctgtgttcctggctgaaatgacagtcaaggtggtcgccctcggctggtgtttcggagaacaggcctacctccgctcatcatggaacgtgcttgacgggttactcgtcctcattagtgtcatagatatcctggtgtcaatggtcagcgattccggaaccaaaattctcggtatgctgcgggtgctgagactgctgaggacactgcgaccgctgcgagtgataagcagggcccagggcctgaagctcgtggtggaaacgctcatgtcctcactcaagcctatcggtaatattgtagtaatctgttgtgcatttttcatcatcttcggaatcctgggggtccagttatttaaaggcaagttcttcgtgtgtcagggcgaagacacaaggaacatcactaacaagagtgattgtgcagaggctagttatcgctgggttcgccataagtacaacttcgacaacttgggacaggctctgatgtccctctttgtcttagcgagtaaagatggttgggtggacataatgtacgatgggctggacgctgttggcgttgatcagcagcccatcatgaaccacaacccctggatgctactctattttatcagctttctcctgattgttgcctttttcgttttaaatatgtttgtaggcgtggtggtggagaactttcacaaatgcagacagcaccaggaggaagaggaggccaggcgcagagaggaaaaacgtttacgtcggctcgaaaagaagcgcaggaacctaatgctggacgacgtaatagcttcaggatccagtgcatcagcagctagcgaagcccagtgtaaaccgtactattccgattactctagattcagattgctcgtacatcatctgtgtaccagccactatcttgatcttttcattacaggggtgattggcctgaatgttgtcaccatggccatggaacattatcagcagccgcaaatcctggatgaggctctgaagatatgcaactatatctttacagtaatttttgtgctggagtccgtgtttaagcttgtggcattcggcttccgccgattcttccaagaccggtggaatcaactggatctggccattgttctgctcagcatcatgggcattacactggaggaaatcgaggtgaatgcgtcactaccaatcaacccgacgatcatcaggatcatgcgtgttttgcgcatcgcgagagtcctcaagctgctgaaaatggccgtaggtatgcgcgctctgcttgatactctgtgggcctggtccagtttggagacttggtctgtcacgagacatacccctgtccgggcatgggctgtcatgcccccattcggcacattagcttggccctcata

SEQ ID NO: 48703 - DNA, 6821 bp, Artificial Sequence
  Description of Artificial Sequence: Synthetic coding sequence
atggacgaggaggaagacggagcgggagcagaggaatcagggcagcctaggagcttcatgcgtctgaatgatctgagtggcgctggagggagacctgggcctgggagcgccgagaaggatccagggtcagcagactctgaggcagagggattaccatacccagcgctagcgccagtagttttcttctatctcagccaagacagccggccacgctcatggtgcttacgtaccgtgtgcaacccatggtttgagcgaatatccatgttagttattctactcaactgtgtgacgctgggaatgttccggccatgcgaagacattgcatgtgactctcagcgctgccggatcttgcaggcattcgatgatttcatttttgcattttttgcggtcgagatggtggttaagatggtcgcgttggggattttcggaaagaaatgctacctcggcgacacctggaaccgattggactttttcatcgtgattgctggaatgcttgagtacagcctggatcttcagaatgtttcattctccgctgtgaggactgtaagagtcctccgccctttaagagctattaacagggtcccttccatgaggatcctggtgactctgctgttagacaccctgcctatgctcggaaatgttctgttgctgtgtttctttgtgttctttatcttcggtattgtcggtgtccagctgtgggctggactgctgagaaacaggtgctttctaccagaaaatttttcgttgcccttatccgtcgacttggaaagatattatcagaccgagaatgaggatgagtctccgtttatttgctcccagccgagagagaacggcatgaggtcctgccgctccgttccaacattgagaggcgatggcggtggtggcccaccctgcggattagactacgaagcctacaacagctcaagtaatacaacttgtgtaaattggaatcagtactatactaattgttccgccggtgagcacaatccctttaagggggctataaatttcgacaatattggttacgcctggatcgccatttttcaggtgattaccctcgaaggctgggtggacatcatgtatttcgtcatggacgcacatagcttctataacttcatttactttatcttattgattatagttggatccttcttcatgattaacctgtgcctggtggtgatcgccacacaattctctgaaactaagcagcgggagtcacagctcatgcgcgagcaacgagtgaggttcctttctaacgcgtctaccttggcctcattcagcgagcccggatcatgctacgaggagctactgaagtatcttgtgtatattttgcgcaaggctgcacggaggctagcgcaggtgagccgcgcagccggtgtgagagttgggctgttgtcctcccctgcacccctaggaggtcaggagactcagccatcatccagctgtagccgcagccaccgtagactgtctgtgcaccatttggtacatcaccaccaccatcaccatcaccactatcatctgggaaacggcacgctgagagctcctcgcgctagccccgagatacaggatcgggatgccaatggatccaggcgcctcatgttaccgcctccttccacgccagccctttcaggggcaccacctggcggagcagagtctgtacatagtttctaccacgccgactgtcatctggaacccgtccgttgccaggcccctccaccgcgaagtcctagcgaagcttccggaaggacggtggggagcggtaaagtgtatcccactgtgcacacttcgccgcctccggagacactgaaggaaaaagctctagtcgaggttgcggcttcatcgggtccaccaaccctcaccagtctcaatattcctcccggtccatactcatcgatgcataagttactcgaaacccagtccacgggagcatgccagagcagctgtaaaatctcttctccgtgcctgaaagctgatagcggggcatgcggcccagactcttgcccctattgcgcaagagcgggagcaggggaagtggaactggcagatcgggaaatgcccgattctgatagtgaggccgtatacgaatttactcaggacgcacagcactccgatctgagagaccctcacagtcggagacagcggagccttggaccagacgccgaacccagtagcgtgctcgccttttggagactcatctgcgacacctttcggaagattgtggattcaaagtattttggccgaggcattatgattgctattctggtcaatactctttctatggggatcgaataccacgagcaacccgaggagctgaccaacgcactcgaaattagtaacattgtgttcacaagcctgttcgctttggagatgctccttaagctgttagtctatggccctttcggctatatcaaaaacccctacaatattttcgatggtgttattgttgtcataagcgtctgggaaatcgtggggcagcagggcggtggtctgtcagtgctcagaacgttccgcctgatgcgagtgctcaagctggtgaggttcctgcctgcgctgcaaaggcaactcgtggtgctgatgaaaacaatggataatgtcgcgacgttttgcatgctccttatgctcttcatctttattttctcaatactgggtatgcatctgtttggatgtaagttcgcctctgagcgcgatggcgacactctgcccgatcgtaaaaacttcgatagcctgctttgggctattgtaacagtatttcagatacttacccaggaggattggaataaggtcctctacaatggtatggcttctaccagtagttgggccgcactatactttattgcactcatgaccttcggtaattacgtactgttcaatcttctggtggcaatattagttgagggcttccaggcagaggaaattagcaagcgggaggatgcctctggacagctgtcttgtatacagctgccagtggattcacagggcggtgacgccaacaagtccgaaagtgaaccggactttttttcccctagcctggatggagatggcgatagaaaaaagtgcctggctctcgtctcactcggcgagcatcccgaattgcgcaaaagcctgttaccccctctcatcatccacaccgccgcaacccccatgtccctgccaaagtccactagcacaggactgggggaggccctgggccctgcaagcagaagaacctcatcctccggaagtgccgagcctggcgctgcccacgaaatgaagtcgcctcctagcgcacgcagcagcccgcattccccttggtccgccgcttccagttggactagccgcagatcctcccgaaactccctgggaagagccccaagcttaaaacgcaggagtccctctggagaaaggcggagtctgcttagtggcgagggccaggagtcccaggatgaagaggagagcagcgaagaagagcgtgcttctccggcaggttctgatcaccgccatcgaggtagtctggagagagaagctaagtccagcttcgacctgccagataccttgcaggtcccaggcctgcaccggacggcttctggcagaggctccgcctcggagcatcaggactgcaatggaaaatccgcttcagggaggctggccagagccctgaggccagacgatccacctctagatggtgatgatgctgacgacgagggcaacttatcaaagggagagcgggtcagagcatggatccgggctcggctcccagcttgttgtctggagcgcgactcttggtccgcttatatctttccaccccagagccgatttaggctactctgtcatcggattatcacccataaaatgtttgaccacgtggttctagtgatcattttcctgaactgcatcacaattgcaatggaacggcctaagatcgacccacattcagccgaacggatcttcctgacactctctaactacatcttcactgccgtatttctcgccgaaatgactgtaaaggtagtggccttgggatggtgcttcggggagcaggcttatttaagaagctcctggaacgtgcttgatggcctgttggtgctgatttccgttatcgatatcttggtgagcatggtgtccgattcggggacaaaaatactgggtatgcttagagttcttcgactgctgagaacactccggcctctcagagtcatctctagagcacaggggttgaagcttgtcgtcgagaccctcatgagctctctaaaacctataggcaatatagtggtgatctgctgcgcctttttcattatattcggcattctcggagtgcagctgtttaagggaaaattcttcgtctgtcagggggaggacaccagaaacattacgaacaagtccgactgcgcagaagcatcctaccgatgggtgcgtcacaagtataactttgataatcttggacaggccctgatgtctttgtttgtcttggctagcaaggacggctgggtcgatattatgtatgacgggctggacgccgtgggggtcgatcagcagcccatcatgaatcacaatccatggatgctcttgtacttcatttcctttcttcttatcgtggctttcttcgttttgaacatgtttgtgggagtggtggtggagaacttccacaaatgccgccagcatcaagaggaggaagaagctcggagacgcgaggaaaagagactaagaagactggagaaaaagagacgctccaaagaaaaacagatggcagaagcccagtgcaaaccttattacagtgactactctagattcagactcctggttcaccatttgtgtacttcacactatctggacttattcatcaccggtgtgattgggctgaacgtcgtcaccatggccatggaacactaccagcaacctcaaattctggacgaggccttgaagatctgcaattacatctttactgtgatcttcgtgctggaaagcgtcttcaaactggtcgctttcgggttcagacgtttcttccaggatcgctggaaccagctcgaccttgccatagttctgctctcgatcatggggattaccctggaagagatcgaggtaaacgcgtctctgccaatcaaccctacgattatcagaattatgagggtgctccgtatcgcaagggtactcaaattgttgaagatggccgtgggaatgcgagctcttctcgacaccgtgatgcaggccctgccacaggtgggtaatcttggacttctttttatgctgctgttttttatctttgctgctctgggcgtcgagctcttcggtgatctcgagtgtgatgaaacccacccgtgtgagggactgggacggcacgccacctttcgaaacttcgggatggccttcctgacattgttcagagtttccacgggagacaactggaacgggatcatgaaggataccctgcgcgattgtgaccaagagagtacgtgctacaacacagtaatatccccaatctattttgtctcgtttgttttgacggcccagtttgtgctggtgaacgtggtaatcgcggtgctgatgaaacacctcgaggagtccaacaaggaggcaaaggaagaggccgaactggaggctgagctggaactcgaaatgaaaacactgagcccacagccgcattcccccttaggtagccccttcctatggcctggggtggaggggccagactctcccgattcccccaaacctggtgcgctgcatcccgctgcgcatgccagatccgcgtctcatttctccctggaacaccccactatgcagcctcaccctaccgagcttcccggaccagatctccttaccgtgcgaaagtccggtgtttcccgaacgcactcgcttcccaatgattcctacatgtgccgacatggttccaccgccgaagggcctcttggccatcggggttgggggctgcctaaggcgcagtcaggttcagtcttgtcagtgcattcacagcccgcagatacaagttatatcttgcagctgcctaaggatgcaccccacctgctgcaaccccattccgcgccaacatggggaactatcccaaaacttcctcccccaggcaggagccccctggcccagaggcctctgcgcaggcaggcggctatcagaacagattctctagacgtccaggggctcggttcacgggaggatctgctggctgaagtctctggaccgagcccgcctcttgcaagagcatacagcttctggggccagtcttccactcaagcacagcagcacagcagaagccattctaaaatatctaagcatatgacgccccctgcaccctgtcctggacccgaacctaattggggtaagggtccccctgagactaggagcagtctcgagctcgacactgaacttagttggatttcgggcgacctgttacccccaggcggtcaggaggaaccaccatcccctcgggatctgaagaaatgttactctgtggaagcccaatcatgccagcgtaggcctacatcctggctagatgaacaacgacggcactccattgcagtcagctgcttggacagtggcagtcaaccacacctggggaccgatcctagcaaccttggcggtcagcctctgggcggacccggatcaagacctaagaagaaactgagcccgccaagtatcacaatcgatcctccggaaagccagggccctcggactccacctagtcctggtatatgtttgaggaggagggctccttctagcgactctaaagacccgcttgcgtcggggccacccgacagtatggcggctagtccttctcctaagaaagatgtgctgagtctgtccgggctgagctcagacccggctgacctcgacccata

SEQ ID NO: 48704 - DNA, 6863 bp, Artificial Sequence
  Description of Artificial Sequence: Synthetic coding sequence
atggacgaggaagaagacggagccggtgccgaggaatccgggcagcccagaagttttatgaggttgaacgatttgtctggagctgggggtcgccctggccctgggtccgccgagaaggatccaggatccgcagactctgaggcagagggccttccttatcccgcactggctcctgtagtcttcttttatctgtcgcaggacagcagacctcgcagctggtgcctcagaacagtttgcaacccatggttcgaaagaatttccatgttggtaatactgcttaactgcgtgactctggggatgttcaggccttgtgaggacattgcttgcgattctcagaggtgcagaattctgcaggccttcgacgactttattttcgcctttttcgccgtggagatggtggtgaagatggtcgccctggggatttttggcaagaagtgctatctgggtgatacatggaataggctggatttctttattgttatagcgggtatgttggaatactcactcgacctccagaacgtgtccttttctgccgtgcggactgtgcgagttctgcgacctctgagagccatcaacagggttccgtctatgcgtatcctcgtgacactgctccttgatacactccccatgctgggcaatgtgctgctgctgtgttttttcgttttcttcatcttcggaatagttggggtgcagctatgggccggtcttttgcgcaatcggtgctttttacctgagaacttctctcttcccctgagcgttgatctagaaaggtattaccagacagagaacgaggatgagtcccctttcatatgttcccagcctcgggagaacggcatgagaagctgcaggtccgttccgacgttgaggggagacggcggtggcggacccccttgcgggcttgattatgaggcgtacaacagtagctctaatacaacatgtgtgaactggaaccagtattacacaaattgttcagctggagaacacaacccattcaaaggtgctattaacttcgacaacattggctatgcctggattgcaatcttccaggtcattaccctggaggggtgggttgacattatgtacttcgtcatggacgcccactcattctacaattttatttacttcattctgctcataatcgtcggaagtttctttatgattaatctgtgtctggtggtcatcgcaactcagttctctgaaactaagcagcgcgaatcacagctgatgagagaacagagagtgcgctttctttcaaatgctagtactctggcatcgttttctgaacccggaagttgctacgaggagctcttgaaatatctggtgtatatcttaagaaaggcagctcggagactcgcgcaggtatctcgtgccgctggggtgagggttgggctgctgtcatcaccagcccctctgggtggccaggagacccagccgagttcttcttgcagcagatctcacaggcgcctgtctgtccaccacctggtccatcaccaccaccaccatcatcaccactaccatctcggaaatggcaccctccgggcaccgcgagcatctcctgaaatccaggacagggacgcgaatggcagtcgaagactcatgctgccgccacccagcacccctgccctgtctggtgcccctccaggaggtgccgagtccgtgcacagtttctatcatgccgactgccacttagaacccgtacgttgccaagcacccccacctaggagcccaagcgaagcttctgggagaacagtgggcagcgggaaggtttacccaacagtgcacacctctccccctcctgagacccttaaagagaaagcattggtggaggtggcggctagttcagggcctcccaccctcacatctcttaacatcccgcctggaccctacagctcaatgcataagctcttggagacccagtcgactggagcatgccagagtagctgcaaaatctccagtccttgcctcaaggccgacagcggcgcttgcggtcctgattcatgtccatattgtgccagggcaggcgctggtgaagtggagttagccgatagagagatgcccgactccgattcagaggccgtatacgagtttactcaggatgctcagcattcagacctcagagatcctcacagccggcgacaaaggtctttgggccctgacgcagaaccatcttctgtcctagccttctggagattaatttgtgacacatttagaaaaatcgtggactcaaaatacttcgggcgtggtatcatgatcgcaattttggtgaatactctctcaatgggtatcgagtaccatgagcagcccgaagaactgaccaatgctctcgagatttcgaacatcgtatttaccagcctgttcgcgttggagatgctcttgaagctcctggtgtacggtcctttcgggtacattaagaacccctataacatctttgatggtgtgatagttgtcatctctgtgtgggagattgtgggacagcagggcggtggactatcagtgctccgcacctttcgcctgatgagagttctgaagcttgttagatttctcccagctttgcagcggcagttagttgtccttatgaagaccatggacaatgttgcgaccttctgcatgctgcttatgctgttcatattcatcttttcaatcctgggtatgcaccttttcggatgcaagtttgcttctgaaagagacggggacaccctaccagacagaaagaattttgactctttgttatgggcaatcgtgactgtctttcagattctaacacaagaggactggaataaagtgttgtacaacggtatggctagcacctctagctgggccgcactctatttcatcgccctcatgacattcgggaattatgtcctgttcaatctgcttgttgctatactggtggaaggttttcaggcagaagaaatctccaagcgtgaagatgctagtgggcagctcagctgcatacagcttcccgtggactctcagggcggagatgcaaataagagtgaatccgaacccgatttctttagcccttcactcgacggtgatggagatagaaagaaatgtctggccctggtaagtctcggcgaacatccagagctgcgcaagagtctcttgccacccctcataattcatactgccgctacccccatgagccttccaaaatccacctcaacgggtcttggcgaggcgctcgggccagccagtcgtcgcacgagttcctccggatcggctgagcccggagcagcacacgagatgaaaagcccacctagcgccaggtcttcacctcatagtccgtggtcggctgcttcttcctggacatccagacggtcctccaggaactctctcggacgggctccatcattgaagagaagaagcccatctggcgaacggagatcactcctttcgggtgaagggcaggaatcccaggacgaggaagagtcgtccgaagaggagagagcctctcccgctgggtcagaccacaggcaccggggttcccttgagagggaggccaagtccagcttcgacttgccagataccctgcaggttccaggcctgcacaggacggcgagtggtcggggtagcgcttccgaacaccaggattgtaatggaaagtccgccagcggccgtctcgcacgcgcactgcgtcctgacgacccaccactcgacggggacgacgctgatgatgaaggcaacctctcaaagggagaacgggtaagagcttggataagggctagacttcctgcctgttgcctcgagagggattcatggtccgcctatatctttcccccacagagtcgcttcaggcttctgtgtcaccggataatcacccataagatgtttgatcatgtagttcttgtgatcattttcttgaattgtatcaccatcgcaatggaaaggcctaagatcgatccccatagcgccgagcggatatttctcaccctcagtaattacatcttcacagcggtctttcttgcagagatgactgtcaaggtggttgcactggggtggtgttttggggaacaagcctacctgcgcagctcttggaatgtgctggacgggcttctcgtgctaatcagcgttatagatatcctagtatccatggtgagtgatagtggcacgaagatcctcggaatgcttcgtgtcctgcggctgctccggacccttcggccattgcgggtgatttcgagggcacaaggtctgaagctggtggtcgagacactaatgagttccctgaagcctataggtaatatcgtggtgatctgctgcgctttctttataatctttgggatcctaggggtccagttgttcaaaggaaagtttttcgtttgccaaggggaagatacacgcaatatcactaataagagtgattgcgcagaggctagctatcgttgggtgcggcataagtataactttgataatctcggacaggccctgatgagcctgttcgtccttgcctcaaaagatggctgggtggatatcatgtatgacggattagacgcagtcggagtggaccagcagaacttccacaaatgtagacagcatcaggaggaggaggaggccagaaggcgagaggagaagagactgaggcgcttggagaagaaacgcagatccaaagaaaaacagatggccgaagctcagtgcaagccatactacagtgactacagccgcttccgattactggtgcatcacctgtgcacatcccactatctggacctttttatcacgggtgtcatcggacttaacgtcgtgactatggcaatggaacactaccagcagccacagattctagacgaggcactgaaaatttgtaactatatctttaccgtgatctttgtgctggaatcagtatttaaactggttgctttcggattccggcgattcttccaggatcgctggaatcaactggatctcgccattgtcctactgagcataatgggcatcactctggaagagatcgaggtgaacgcctctctgccaataaatcccaccataatacgcatcatgagagtcctgagaatagcgagagtactcaaactgctgaagatggccgtcggtatgagagccctgctagatacggtgatgcaggcccttccccaggtggggaacctcggactcttgttcatgctcctgttcttcatcttcgccgctttgggagttgaactcttcggggatctcgagtgtgacgaaacacacccctgtgaggggctggggaggcacgcaaccttcagaaatttcggaatggcatttctcacactttttcgtgtctctaccggcgataactggaatggtatcatgaaggacacactccgcgactgcgaccaggaaagcacctgctataatactgttattagccctatctatttcgtgagcttcgtcttaaccgctcagttcgtactcgttaatgtggtgattgcagttttaatgaaacatctcgaagagagcaacaaggaggctaaggaagaggcagagttagaagcagagctggaactggaaatgaaaactctctccccacagcctcactcaccactgggaagcccttttctatggcccggtgtggagggcccagattccccggactccccaaagccaggggctttacatccagcagcacatgctcggtctgcgtctcatttctccctggaacatccaacagataggcagcttttcgacacgattagtctcctgatacagggatccctggaatgggaattaaagcttatggacgagctcgctggcccaggaggacagccctccgccttcccctctgccccatctctgggcggatcggaccctcagatgcagccccacccaactgaactgcctggccctgacctgctgactgtcaggaaaagcggagtgagccggacacattcacttcccaacgactcttacatgtgccggcacggatcgacagctgaggggccattgggacacaggggatggggactacccaaggcccagtcaggtagcgttctgtcggtgcactctcaacccgctgataccagctatatactacagcttcctaaggatgccccacacttactgcagccccactctgcgccaacgtggggaacaatccctaaactacctccgcctgggagatcccccctggcccagaggcctctacggaggcaggcggctataagaactgacagcctcgacgttcagggattgggttcaagggaagacctgttagctgaagtgtcgggcccatcaccgccactggctcgcgcatactctttctggggccagtcatccacacaggctcagcagcacagtagatctcattcaaaaatttcaaaacacatgaccccccctgccccttgtccaggacccgaaccgaactggggcaaaggcccacctgaaacccggtcttccctggagcttgatactgaactgtcctggatttcgggagacctattgcctcctggtgggcaggaggagccgccaagtccacgggatctcaaaaaatgttattcggtagaagcacagagttgtcagcgaaggcctactagctggctggacgagcagcgacgtcatagcatagccgtgtcttgtttagatagcgggtctcagcctcatttaggcactgatccatccaatttaggtggacagcctcttggagggcctggctcccgccctaagaagaagctgtcccctccttccataaccattgaccccccagaatcccaggggcctcgcacacccccatcccccggtatctgtctgcgacgacgcgcaccatccagcgatagcaaagaccctctggctagcggtcctcccgattccatggccgcttccccttccccgaagaaagacgtgttaagcctctctggactgagtagtgaccctgcagacctggaccccta

SEQ ID NO: 48705 - DNA, 6719 bp, Artificial Sequence
  Description of Artificial Sequence: Synthetic coding sequence
atggacgaggaggaggatggtgccggagcggaagaaagcggccagcccaggagcttcatgcgcttaaacgaccttagcggcgcaggcggacgcccaggccctggatccgctgaaaaggaccccggtagtgcggactccgaagccgagggactcccctatcctgccctcgcccctgtggtttttttctacctgagtcaggatagcaggccgcgatcgtggtgtttgaggacagtgtgtaatccatggtttgagcggattagcatgctcgtcatactgttaaattgtgtcacactcggaatgtttcgtccctgtgaagacattgcctgcgattctcagaggtgcagaatcctgcaggccttcgacgacttcatttttgcatttttcgccgttgagatggttgttaaaatggtagctctgggtatcttcgggaagaagtgttacctgggcgatacctggaacaggttagactttttcatagttattgccggaatgctcgaatatagcctggacctccagaacgtctcgttcagcgccgtgagaacagtgcgggtgctacgccctctgcgggcaattaatagagtgccctcgatgcgaattctggtgactttactgcttgataccctgccgatgctcggcaatgttctgttgctctgtttttttgtgttttttatttttggcatcgttggagtgcaactgtgggcaggtcttttgagaaacaggtgcttcctgcccgaaaacttttctttacccctcagtgtggatttagagaggtattatcagacagagaacgaagatgagtctccattcatttgttcccaaccccgtgagaatgggatgagaagttgtcggtctgtcccaacccttaggggagatggaggtggtggacccccatgtggcctcgattacgaagcctacaatagctcctccaacaccacatgtgttaattggaatcagtattacacaaactgtagtgcaggtgaacataacccttttaaaggcgctatcaactttgacaatattggttacgcgtggatcgctatctttcaagtcattactctcgaaggctgggttgacattatgtattttgttatggatgcccactcgttctataacttcatttattttatcctgctcatcatcgtagggtccttctttatgattaatctgtgcctggtggtaatagccacacagttttctgagacaaagcagagagagtctcagctgatgagagagcagcgagtcagattcctcagcaacgccagcacgttagcatcgtttagcgagcccggatcctgctacgaagaacttctgaaatacctcgtgtacatactgaggaaggcagcaagacgcctggcacaggtgagtagagccgcaggggtgagggttggactgctaagctctccggctccactgggaggccaggaaactcagcctagttccagttgctccagatctcacaggaggttgagtgtgcaccatctggtgcaccaccatcaccaccatcatcaccattatcacctgggtaacggcacccttagggcccctcgggcttccccagagattcaggatcgcgacgcgaacggcagccgcaggctgatgctccctccgccaagtacaccagcactctcaggagccccacccggaggcgcagaaagtgtgcactccttttaccatgcagactgtcaccttgagcccgtccggtgtcaagctcccccaccaagaagcccctccgaagctagcggacggactgttggttctggaaaggtgtacccgaccgtgcacaccagcccaccccctgaaacccttaaggaaaaggctctggtcgaagttgctgcttcttcaggccctccgacattaacgagcttgaatatcccacccggtccctactcctccatgcacaagctcctggagacgcagtcaacgggcgcttgccagtcatcttgcaaaattagcagtccgtgcttgaaagcagactccggggcatgtggcccagactcatgtccttactgtgctagagcaggagccggagaggtggagctagcagacagagaaatgcccgacagcgatagcgaggcagtgtacgaattcacgcaggacgcccagcatagtgatttgcgagatccccatagccgcagacagaggagcctcgggccagacgccgaacccagcagcgtactggccttctggaggttgatctgtgatacattcaggaagattgtggacagcaaatacttcggcagaggcattatgatcgctatcctggtcaacactttgagtatggggatcgagtatcacgagcagccagaagagttaactaacgcactggagatttccaatatcgtgttcacctccctctttgccctggagatgctactgaaactgctggtgtatggaccatttggttacataaagaacccctacaatatattcgacggcgttatagtagtgatctccgtctgggagattgtgggccagcaaggcggagggctgtctgttctacgtacatttaggctgatgcgcgtgctgaagcttgtccggttcctgccagcgctacaacggcagctggtggtgctgatgaaaaccatggacaacgttgcgaccttttgcatgctgctgatgcttttcattttcattttcagcatcttaggcatgcatttattcggttgcaagtttgcatccgaaagagacggggacaccctccctgaccggaagaactttgattcgttactttgggcaattgtgactgttttccagattctgacccaggaagactggaataaagtactctacaatggaatggcctctacttcaagctgggccgcactctattttatcgccctcatgacttttggaaactatgtgctcttcaaccttctggtcgccatcttagtggagggctttcaagccgaagagattagcaagcgcgaggatgcatcaggtcagctgagctgcatacagctaccagttgactcccaggggggagatgcgaacaagtctgagtctgagcccgatttttttagcccatccctagatggagatggagacaggaagaagtgcctcgcacttgtctctctgggggagcaccccgagctaaggaagagcctgcttcctccactgatcatccacaccgccgcaacgcccatgtctctccctaaatccacatctaccggtctgggggaagctctggggccagcatcaaggcgaacttcctctagcggatcagctgagcccggagccgcacacgaaatgaagtcacctccctcagcgaggtcgagtccacactccccctggagcgccgctagctcatggacatcccggagatcttcccgaaacagcctagggagggcaccctcactcaagcgcagaagtcccagtggtgagcggaggagtctgctgtctggcgaagggcaggagtctcaagacgaggaggagtcctcggaagaggaacgagccagccccgcagggagcgaccacaggcacaggggctctcttgagagagaggccaaaagcagttttgacctcccggacacgctgcaggttcctggcttgcacagaaccgccagcggccgtggaagtgcctctgaacaccaagactgtaacggcaaaagcgccagcggacgccttgctagggccctcaggcctgacgaccctccgctggacggtgatgatgccgacgatgaagggaatctatccaagggcgaacgggtccgggcatggatcagggccaggctgcctgcctgctgtctcgaaagggacagctggagtgcctatatcttcccacctcagtcaaggttcagactcctttgtcaccggataattactcataaaatgttcgatcatgttgtgttagtcatcatattccttaattgcattacaattgccatggaacgccctaaaatcgatccccactccgcagaacggatttttcttaccctgtccaactatatctttaccgcagtttttctagccgagatgaccgtcaaagtggtggcactggggtggtgtttcggtgagcaagcctatttacgctcgagctggaatgtgctcgatggcttgctcgtactgatctcagtgattgatattctagtgtccatggtgagtgattcaggtacaaaaattctggggatgctgcgggttctccggctcttgcgaacattgcgcccactcagggtcatttccagagctcaaggtttgaagttggtggtggaaactctgatgtctagtcttaagcccattggcaacatcgtggtcatttgttgtgcattctttataatcttcggcatcttgggcgtacagctgttcaagggcaaattctttgtgtgtcagggcgaagacacaagaaatattaccaataagtctgattgtgctgaagcctcttatcgctgggtaaggcacaagtataacttcgataatctgggccaggctctgatgagcctgttcgtgctggctagcaaagacggatgggtggacattatgtatgacggattagacgccgtcggcgtcgaccaacaaaattttcataagtgtcgccagcaccaggaggaggaggaagccaggcgcagagaggaaaagaggctacgcagactggaaaagaaacggcgttcaaaagagaaacagatggcagaagctcagtgcaaaccatactattctgattattctaggttcaggctgttagtgcaccacctgtgcacctctcattatttagatctgttcataactggcgtcatcgggttaaacgtggtcacgatggccatggagcactatcaacaaccccaaattctcgacgaggctctgaaaatttgcaactacatttttacggtcatttttgtactggaatcagtgttcaaactggtcgctttcggctttagacgattttttcaggatcgttggaatcagctcgatctggccattgtcctgctaagtattatgggaatcacactcgaggaaattgaagtcaatgcgtccttgcctatcaacccaaccatcattagaatcatgagagtcttgagaatcgcccgagtgctgaaattgttaaaaatggcagtcggaatgcgtgcgctcttagatacggtgatgcaggctctcccacaggtaggaaacttggggctgctcttcatgcttctcttttttatcttcgccgctctgggcgtcgaactgttcggcgatttagagtgtgacgaaactcacccttgtgaggggctgggccgacacgcgacttttcgcaacttcggaatggccttcttaactctctttcgcgtgagcacgggggataactggaatggtattatgaaggatacactgagagattgcgatcaggagagtacgtgctacaatacagtcatttctcccatttactttgtgagctttgttttaactgcacagtttgtcctggtgaacgttgtgatcgcggtattgatgaaacacctagaggagagcaataaagaggcaaaggaggaggctgagctcgaggctgaactagaacttgagatgaaaactttatcaccgcaaccacactcacccctggggtctccattcttatggccaggggtggaaggcccagattcccccgactctcccaagcctggtgctctgcaccccgctgcacacgctcggtctgcctctcacttctcactggagcacccaaccatgcagccccatccaacggagctgccgggacccgatttgctgacggttcgaaagtccggagtgtctcgcacccactcccttcccaatgacagttacatgtgtcggcatggctctaccgccgaaggccctctcggccatcgcggatggggtctgccaaaggctcaaagcggctcagtgctgtccgtgcactcacagcctgctgatacctcttacatattgcagctgcccaaggacgcaccccatttgctgcaaccccatagcgccccaacatggggaacgattccgaaactccctccgcctggcaggagtcccctcgctcagagacccttaaggcgccaggcagctatccgcacagattcgctggatgtgcaggggttaggatcccgcgaggaccttctggccgaggtgagcgggccatcaccacctctggctcgcgcttattccttctggggtcagtcgtcgacgcaagcccagcagcactctcgttctcactccaaaatttctaagcatatgacccccccagcaccttgtcctgggccagaacctaactggggcaagggccctccagaaaccagatcctcattagaattagataccgagttatcctggatcagtggagacttgctgcctcctggaggacaggaagaacctcctagtcctagagatcttaagaaatgctactcagtggaggcccagagttgtcagagacgcccaaccagctggctagacgagcaacggcgtcactcaatcgcggtttcctgcctcgactctggctctcaaccccacctcggaacagatccgagcaatctgggtgggcagccactagggggacccggtagtcgaccgaaaaaaaagttgtcgccgccatccattaccattgatcctcctgaaagccagggccctcggacacctcctagtcctgggatttgcctgagaaggcgagcccctagttctgattccaaggatcccttagctagtgggcctcctgacagtatggcagcctccccatccccaaagaaggacgttctgtccctctcggggctgtcttctgatcccgctgatctcgatcctta

SEQ ID NO: 48706 - DNA, 6875 bp, Artificial Sequence
  Description of Artificial Sequence: Synthetic coding sequence
atggacgaagaagaggacggagctggtgccgaggaaagtgggcagcccaggtccttcatgagattgaatgacctgtctggcgctggtggcaggcctggccctggtagcgcagagaaggatcctgggtccgctgactctgaggcagagggtttaccatatcctgcccttgctcctgtggttttcttctatctcagccaagactcacggcctcgttcctggtgcttgagaactgtttgcaatccttggtttgagcggatctccatgctagtgatcttgctgaactgcgttaccctgggcatgttcaggccttgtgaggacatcgcgtgcgattcccagaggtgtcggatccttcaagcctttgacgactttatcttcgcattcttcgctgttgaaatggtggttaagatggttgcgctgggtatcttcggaaagaaatgttatcttggggacacctggaaccgcctggattttttcattgttatcgcgggtatgctggagtattcgcttgacctacaaaatgtgtccttcagcgcggttcggacagtacgtgtcctccgtccactgcgggcaatcaatcgggtaccttccatgcgaatcttagtgacccttctcctggatactcttccaatgttggggaacgtgctgctcttatgctttttcgtgttttttatcttcgggattgtgggcgttcagctatgggcaggactcctgcgcaaccgctgttttttgcctgaaaattttagtctgcccctgagtgtagatctggagcgatactaccagaccgaaaacgaagacgagtccccattcatatgttcccaaccgagagaaaatggtatgaggagttgcagatctgtaccaacccttcgcggtgacggcggtggaggtccaccttgtggacttgattatgaagcctataattctagctccaataccacttgcgtgaattggaatcagtattacactaactgtagcgctggcgaacataatcccttcaagggtgcaatcaatttcgataacattggctatgcttggatcgctattttccaggtgatcaccctcgagggatgggttgatattatgtacttcgtgatggacgcccactcattttataacttcatctacttcatcttacttattatagtaggaagctttttcatgatcaacctttgtctggtcgtgattgccacacagtttagcgagactaagcaacgagaaagtcaactgatgcgcgagcagagggtcagattcctgtctaatgccagcaccctggccagcttctcagagccaggatcctgttacgaggagctcttgaagtatcttgtttacatccttcggaaagccgcaaggcggctagcccaggtctcccgagcagccggtgtgcgtgtcggcttattatcaagccctgctccattgggcggacaagaaactcagcccagcagttcctgttccagaagtcatcgccgtctgagcgttcaccatttggttcaccatcaccatcatcaccaccaccactaccacctggggaacgggactctcagggctccccgtgcatcgccggagatccaagaccgggacgctaacgggtcacggcgattgatgctgccccctccctcgacccctgctttgtctggtgctccgcctggaggagccgaaagcgtgcacagcttttatcacgctgactgccacctcgagcctgttcgttgtcaggctccacctccgcgtagtccttccgaagccagtggcaggaccgtcgggtccgggaaggtttacccaaccgtacacacctcccctcctccagaaacacttaaagagaaagccctggtggaagtcgcggcatctagtgggccaccaaccctcacttccctgaacatcccgccaggcccatattcctccatgcacaagctgctggagactcagtctacaggagcatgtcagagcagttgtaaaatttcttcaccttgtctaaaggcagatagtggagcttgtggtccggattcttgcccctattgtgcaagagccggtgccggagaagttgagctggccgatagggagatgccagacagtgactccgaagctgtgtatgaattcactcaggacgcacaacactccgacttgcgagacccacactcaagaagacagcggtccctgggtccggacgcagagcccagttctgtcttagcattctggcgcctcatatgtgacacttttcgcaaaatcgtggattccaagtactttgggcgtggcatcatgatagccatcctggtcaacacactgagcatgggcattgaataccatgaacaaccagaagagttgactaacgccttagagatatcgaacatcgttttcactagcctgttcgccctggaaatgttgcttaaactccttgtttatgggccattcgggtacatcaaaaacccctataacatctttgatggcgttatcgtcgtgatcagtgtgtgggaaatcgtgggccagcagggtggcggactgtccgtgcttagaaccttcaggctaatgcgggttttgaaactggttagattcctgcccgctcttcagcggcagctggtagtcctcatgaagactatggacaatgtggccaccttttgcatgcttctgatgcttttcatcttcattttctctattctgggaatgcatctgttcgggtgtaagttcgctagtgaaagagacggagacactcttccagacagaaagaacttcgacagcctgctgtgggcaatcgtcactgtgtttcagattttgacacaggaggactggaacaaggtcctttataacggcatggcgagcacgtctagctgggcagctctgtactttattgctctgatgacttttggcaactacgtcctgtttaacttgctcgtggccatcctggtggagggcttccaggccgaggagatcagcaaacgcgaagatgcctcaggccagctaagctgtatccaactgcccgtcgacagtcagggcggtgatgcgaacaaaagtgagtccgagcccgattttttttcaccaagtctggatggggacggcgaccggaaaaaatgtctggctctggtgagccttggtgagcatcccgaattaaggaagtcacttttaccgccactaattattcacactgcagctacccccatgagcctgcccaagagcactagcactggcttgggcgaagctctcggacctgcctcccggagaacttcctcatctggaagcgccgagcctggcgctgcccacgaaatgaagagtcctccctcagcacggtcaagccctcatagtccatggagcgcagcgtcttcatggaccagccgcaggagttccagaaattccttgggtagagcccctagtctgaagcggaggtccccctccggcgaaaggaggtcactgctgagcggtgaggggcaagagtctcaagacgaggaagagagtagcgaagaagagcgcgctagcccagccggatcagaccatcgacaccgcggatctttagaacgggaagctaagtcttctttcgacctgcctgatacactgcaggtacccggtcttcatcgaacagcatcaggcagaggatcagcaagtgagcatcaggattgcaatggtaagagcgcaagcggacggctggccagagctctgagacccgacgaccccccactggatggtgacgacgcagacgatgaagggaacctcagcaagggagaacgtgtcagagcctggattcgtgcgagactgccggcatgttgcctagagcgagatagctggtccgcttatatatttccccctcaatcccgctttcgactgctttgtcaccgcattatcacccacaagatgttcgaccatgttgttctggtcattatctttctgaattgtataaccattgccatggagagacccaaaatcgatccacactccgcagagaggatttttctgacactctctaattacatatttactgcagtttttcttgctgagatgacagtaaaggtggtggcactgggctggtgtttcggcgaacaagcatatcttcgatcatcttggaatgtgctcgacggccttttagttctgattagcgtgattgatatcctggtgagcatggtctccgactctggaacaaagatcctgggaatgctgagggtcctcaggctgcttcgcacattgcggccacttagagtcattagccgggcacaaggcctgaaactggtggttgagacactgatgagcagtcttaaacccattgggaacatcgtggtgatatgttgcgccttcttcatcatttttggaattcttggggttcagctctttaaaggcaaattcttcgtatgtcaaggggaggatacaagaaacattaccaacaagagcgactgcgctgaagcgtcttatcgctgggtcaggcacaaatacaactttgataatctgggccaggctctgatgtccctttttgtgttggcttctaaggatggatgggtggacatcatgtatgacggcctggacgccgtgggcgtggatcagcagcctatcatgaatcacaatccttggatgcttctgtatttcataagctttcttctgattgtggcgttctttgtactgaatatgtttgtcggcgtcgtcgtggaaaacttccacaaatgccggcagcaccaggaggaggaggaggccagacgacgcgaagaaaagcgactcagacgactagagaagaaacgcagatctaaagagaagcagatggcagatctgatgctggacgacgtcatagcctcggggagcagtgcctccgcagcgagtgaggcacaatgcaaaccttactattctgattactctcgtttccggctgttggttcatcatctctgcaccagtcattatctggatttgttcattaccggagtgattgggttgaatgtcgtaactatggctatggagcactaccaacagcctcaaatcttggatgaagctctgaagatctgcaattacatcttcacagtgatcttcgtgctggagtcagtgttcaaactggttgcttttggtttccgccgattctttcaagacagatggaaccaactggacctagccatcgtccttctgtctatcatggggatcaccctggaggagattgaggtgaatgcttcacttcctattaatcctacaatcatccggattatgagggtcctgcgcatcgccagggttcttaagctgctcaaaatggcagtcggaatgagagcactcctggatacagtgatgcaggctctgccgcaggtcggaaaccttgggctcctgtttatgttgctgtttttcatcttcgccgcactgggcgtggagctattcggggatctagaatgcgacgaaacacatccctgcgagggattgggcaggcatgctacatttcgcaactttggaatggcctttctgacccttttccgcgtgtccactggcgacaactggaatggcatcatgaaggacaccttacgggattgtgatcaggaatcaacttgctataacacagtcatttcccctatttacttcgtgtccttcgtgctgaccgcacaattcgtcctggtcaatgtggtaatcgccgtgctgatgaagcatttagaagagtcaaacaaagaggcaaaagaggaggctgaattggaggcagagctagagttggaaatgaagactctgtcaccccaaccgcacagccctcttgggagtcctttcctgtggcccggagtggaggggccagatagccccgatagccctaaacccggagccctgcaccccgctgcgcacgctaggtctgctagtcacttcagtctggagcaccccaccatgcagcctcacccaacggagttgcctggacctgatcttctgacagtccggaaaagtggtgtcagtcgcacccatagcttacctaacgattcgtatatgtgccggcacggttcaactgccgaggggccactggggcaccgcggatggggattgccaaaagcacagagcggctctgtactttccgtacatagccagcccgctgacacatcctacatactgcagctacccaaggatgcccctcacctcttgcagccacattcagcgccaacatggggcacgatcccaaagttgccccctcctggtcgttcaccccttgcgcagcgcccactgaggagacaagcggctataagaaccgatagcttggacgttcaggggctcgggtctcgcgaagacctattagccgaagtcagcggcccttccccgcctttagcacgtgcttactccttctgggggcagtcaagcacacaagcacaacaacactcgcgctcgcactcgaaaatatctaagcatatgacgcctcccgctccctgccctggccctgagcctaactggggaaagggacccccagagactagatccagcctagaacttgatacagagctgagttggatttcaggagacctgttgccacccggtggccaggaggaaccaccctcccccagggacctgaaaaaatgttacagcgtggaagcccagagttgccagcggcgtccaacatcatggttggatgaacaaagacgtcacagcattgcggtgagctgcttggactctggctctcagcctcacctagggacagacccctcgaatcttggagggcaaccactgggaggtcccggttcacgccctaaaaagaaactgtctccgccttccattactatagatccaccagaaagccagggtcctcgaacccctccaagccctggcatctgcctgcggagaagggctccctctagcgatagcaaggaccctctcgccagcggaccacctgattccatggccgctagtccaagccctaagaaggacgtgttgagtttgagcgggctgtccagcgaccctgcagatctggatccata

SEQ ID NO: 48707 - DNA, 6779 bp, Artificial Sequence
  Description of Artificial Sequence: Synthetic coding sequence
atggatgaagaggaggacggggctggggcagaagaatccggccaaccgagatctttcatgcggctgaatgacttgagcggagccggtggcagacccggtcctggctctgctgagaaggatcccggatctgcggatagtgaggctgagggtcttccctacccagctcttgcacccgtcgtgtttttttacctgtctcaggactcccgtccaaggtcctggtgtctgcgcactgtgtgtaatccatggtttgagcggatcagcatgctcgtgatcctgcttaactgtgtgacactgggcatgtttaggccgtgcgaagacatcgcgtgtgactctcagagatgcaggattcttcaggcattcgacgattttatctttgccttttttgccgtggagatggtcgtgaagatggttgctctaggcatatttggcaaaaagtgttatttgggagacacctggaaccgactggactttttcatcgtgattgctggaatgttggaatattctctggatttgcagaatgtttctttttcagcagtgcgcactgtgagggtgctgcgccctctaagagccattaaccgggtgcccagcatgcgcattttggtgacgcttctactggacactctgcccatgcttgggaacgtactgctgctgtgcttctttgtcttctttattttcggtatagtcggagtccaactctgggctgggttactccgaaaccgctgtttcctccccgagaacttctccctgcccctctccgtcgatttggaacggtattaccagaccgagaacgaggacgaaagtcctttcatctgcagccagccgagggaaaacgggatgcgtagctgtcggtcagtgcctaccctgagaggcgacggaggaggtggccctccgtgcggtctcgactacgaggcttataactccagctctaacaccacatgcgtgaactggaatcagtactacaccaattgtagcgcaggcgaacacaatccatttaagggggctattaactttgataatatcggctatgcatggatagctatcttccaggtgattacgctagagggctgggtagatataatgtacttcgtcatggatgctcattctttctacaattttatctacttcatcctgctcataattgtgggctcatttttcatgatcaacctgtgtcttgtggtgatagcgacgcaatttagtgagaccaaacaaagggagtcccagttgatgcgggagcagcgggtccggtttctttccaacgccagtaccctggcatccttctctgagcccggttcctgttacgaggaacttcttaagtacctcgtgtacatcttgaggaaagccgcacgcaggctggcacaggtatccagggccgctggcgttcgcgtgggactactgagtagtcccgctcctctgggcggtcaggagacacagcccagttcttcgtgctcacggtctcaccgccgactctcagtccatcacctggttcatcatcatcaccatcaccaccaccattatcacctgggcaatgggacactgagagccccaagagccagcccggaaatccaagaccgcgacgctaacggatctcgacggttgatgctcccccctcccagcacacctgcactaagcggagcccctccaggtggggcagaatccgtgcactctttctaccacgccgactgccacctcgagcctgttcgctgccaagcacccccacccagaagtccttccgaagctagtggcaggacagtgggcagtggtaaggtttatccgacggtgcatacgagccccccacccgaaactctaaaggagaaagcacttgtggaggtcgccgcatcatccggccctccaactcttactagtctgaatattccacctggtccgtatagttcaatgcacaagttgttggaaacacaatcaaccggggcttgtcaaagctcttgcaagattagtagtccgtgtttgaaggccgactctggcgcatgtgggcctgatagctgcccgtactgtgctagggcgggagccggagaggttgagctcgccgatcgggaaatgccggactctgactcagaggcggtgtatgagtttactcaggatgcacaacacagtgatctgagggatccccactcaaggcggcagaggtcattgggtcccgacgcggaacctagctcagttctcgcattttggagattgatctgcgatacctttcggaaaatcgtagactctaaatatttcggaagaggaattatgatcgccatacttgtgaataccctttcaatgggcattgagtatcacgagcagccagaggaattaaccaatgccttggaaatttcaaatattgtgttcaccagtcttttcgcactggagatgcttttaaaactgctggtatatggcccttttggctatattaagaatccctacaatatctttgacggggtgatcgtggtcatcagcgtttgggagatcgtgggacagcaaggcggaggtctaagtgttctgcgcacttttagattgatgcgggtgctgaagcttgtgagattcctgccggcactccagagacagctggtcgtgctcatgaaaacaatggataacgtggccacgttttgcatgttactgatgctgtttatctttatcttctctattcttgggatgcacttattcggatgcaaattcgcttctgagcgcgacggcgataccttacccgaccggaagaacttcgactccctgctttgggcaatagtgactgtcttccagatcctgacccaggaggattggaataaggtgctttataacggaatggccagcacttcctcctgggctgccctttacttcatcgctctcatgacattcggtaactacgtcttgtttaacctgctggtggctatacttgttgagggcttccaggcagaggagatcagcaaacgggaagacgccagcggacagttatcgtgtatccagctgcccgtggactcacagggaggggatgcaaataaaagcgagagcgaacccgattttttctcgcccagtcttgacggcgacggtgatcggaaaaagtgtcttgccctcgtcagcctaggagagcatcccgagctgcgcaagagcctcctcccccctctgataatccatacagccgctacccctatgtcactccctaagagcacttccactggcctgggtgaggcccttggccctgccagccgacgcacgtcaagtagcggctcagcagaaccaggagcggctcatgaaatgaagtcccctccctctgccaggagttctccacactccccatggtcagcagcgtcttcatggacctccagaagatcaagccgtaactcgctgggcagggccccttccctaaaacgcagatccccgtcaggcgagagacgcagcttgctgtccggggaaggacaggagtcccaggacgaggaagagagtagtgaagaggaacgtgcttctcctgcgggatccgatcaccgacatcggggtagtctggagcgcgaagctaaatcatcgttcgacttaccggacactctgcaggtccctggactgcataggacagcgagcggcaggggatcagcttctgaacatcaggactgcaacggaaaatctgcaagcgggaggctggcaagggctctgagaccggatgacccaccattagatggagatgatgcggatgatgaagggaacctcagtaaaggggaaagggttcgtgcttggatcagagcgcgtttgccagcttgttgtctggagcgcgattcatggtccgcctatattttcccaccgcagtcaagatttcggcttctatgtcatcgtataattacacataagatgtttgatcacgtggtgctggtgataatatttctcaactgtattactattgccatggagcgtcctaaaattgatccgcactccgccgagcgcattttcctgacactcagtaattatatctttacagccgttttcctagccgaaatgaccgtgaaggtggtcgccttaggctggtgcttcggagaacaggcctatttgcgctcgagctggaatgtcttggatggtttgttagtgttaatcagcgtcatcgacatattggtatccatggtttcagattccggcaccaaaatccttggcatgctgcgcgtgctgcgactgctccggaccctgcggccactgcgggtgattagcagggcacaaggactcaagctcgttgtggagactctgatgagcagcctcaaaccgattggtaatattgttgtgatctgctgtgcgttctttattatctttggtatattaggggtccagttgtttaaaggtaaattctttgtctgtcaaggagaagacacacgcaacattacgaataagagcgactgcgccgaagcgtcctatcgctgggtaaggcacaagtacaattttgataatttagggcaagctttgatgtccctgttcgttttggcaagcaaagacggctgggtggatattatgtacgacggcctggatgccgttggcgttgaccagcagccaatcatgaaccataacccctggatgctgctgtatttcatttcattcctgctcattgtagccttctttgtgctgaacatgtttgtgggcgtagtagtcgaaaatttccataagtgcaggcaacaccaagaagaggaagaggcgagaagaagggaggaaaagcgcctgcgtcgcctcgaaaaaaagcggcgtaaggcgcagtgtaagccctactacagcgattattcccggttccgcctgcttgtgcaccacctttgcacctcccattatcttgatctgttcatcacaggcgttatcggcctcaacgtcgtcaccatggccatggaacactaccaacagccccagatcttggacgaggcactgaaaatttgcaactatattttcacagtaatcttcgtgctagagagcgtttttaaactggtcgctttcggattccggaggttcttccaggaccgatggaaccagctggacctagctattgtgttgttgagtattatgggcatcacactcgaagaaatcgaagtgaacgcaagtctcccgattaatcctaccattataaggattatgagggtcctgcggatcgcgcgtgtgctcaagttgctcaagatggcggtcggcatgcgggctctcctggatacagttggcaacctggggttgcttttcatgctgctattttttatcttcgccgcactgggagtggagctgttcggagacctcgagtgtgatgaaacccacccctgtgaaggccttgggcgacatgctactttccgaaattttggaatggcgtttctgaccctttttcgcgtgtcaacaggcgacaactggaatggcattatgaaggataccttacgcgactgtgaccaggaaagcacatgttacaacacagtcatcagcccaatctattttgtttccttcgtgttgaccgcccagttcgtacttgtcaacgtggtgattgctgtgctgatgaaacacctcgaggagagcaacaaagaggcgaaagaggaggccgagctggaggccgagttggaattggagatgaaaaccctaagtccacagccccactcacccctgggcagccccttcctatggccgggagtcgaggggcctgactctcccgactcacctaagccgggagccctgcatcctgcggctcacgccaggtcggcatcccacttcagccttgagcatcccaccatgcagccacaccctacggaattacctgggccagacctgcttaccgtgcggaaatcaggtgtctctaggactcactcccttcctaatgattcctatatgtgcaggcacgggagcacagctgagggacctttgggccatcgcggatggggcttacctaaggcacagtcaggttctgtgctgtccgtacacagtcaacccgctgatacctcatacatcttgcagttgccaaaagatgccccacacctactgcaaccacactctgctccaacttggggtaccatccctaaactcccaccacctggccgaagtccactggcccagcgcccacttaggaggcaggctgccattagaactgactccctggacgtccaaggccttggaagcagagaggacttactggctgaggtgtccggaccttcacctcctctggcacgcgcatattccttctggggccaatcatctactcaggcccagcaacacagtcgttctcactccaagatcagtaagcacatgaccccacccgctccttgcccaggcccagagccaaattgggggaaaggccctccggagacaaggtcttctctggaacttgacactgaactaagctggatttcaggtgatctcctgcccccagggggacaggaggagcccccaagccctcgtgatctcaagaagtgctactccgtggaggcacagtcgtgtcagagacggcctacctcatggctggacgaacagcgcaggcattcaatagccgtgtcctgtcttgactctggcagtcagcctcatctgggcactgaccccagcaatttaggtggacagcccttagggggtcccggatcacgtcctaagaagaaactctcgccacccagcatcactatcgatcctcccgaaagtcagggccctcgcacccccccatctcctggcatctgtttgcggagacgcgcaccttcaagtgacagcaaagacccattggcttctggaccacccgacagcatggctgcgtccccatcacccaagaaagacgtcctgagcttaagtgggctttcctccgaccctgctgatcttgaccccta

SEQ ID NO: 48708 - DNA, 6683 bp, Artificial Sequence
  Description of Artificial Sequence: Synthetic coding sequence
atggacgaagaagaggacggcgctggcgctgaagaatcaggacagccgcgttcctttatgcggcttaatgatctttctggagctggtgggagaccaggacccggaagcgccgaaaaggacccagggagcgccgactcagaggctgagggccttccttatccagccctggccccagtcgtgtttttctatctgtcgcaggattcccgccctaggtcttggtgtctcaggaccgtgtgcaatccatggttcgagcgtatatcgatgctcgtcatcctcctcaactgcgtaaccctgggcatgttcagaccgtgtgaggacatagcctgcgactcacagcgctgtcgaatacttcaggccttcgatgattttatcttcgctttcttcgccgtggaaatggttgtgaaaatggtcgccctagggatctttggaaagaagtgctaccttggagatacatggaaccgcctggatttttttatcgtcatcgccggaatgttggagtactctctcgatttacagaacgtctcattttccgcagtgaggacggtgagggtgcttcgccctttgcgggctatcaatcgagtcccatcaatgcgcatcttagtgacactcctgctcgacacactgcctatgctcgggaatgttctgttactttgcttcttcgtcttttttattttcggtatagtgggggtccagttgtgggccggactattgcggaaccgctgttttctgccagagaatttcagtttgccactgtctgttgatctggaacgttattaccagacagagaacgaagatgagtcaccgtttatttgttctcagcccagggagaatgggatgcgcagctgtaggagcgtccctactctcaggggagatggtggaggagggccaccttgtggactggactacgaagcgtacaacagtagctccaacacgacatgcgttaattggaaccaatattacaccaactgctccgccggtgaacacaacccctttaaaggcgcaatcaactttgacaacatcgggtatgcctggatagcgattttccaagtcatcaccctcgaaggttgggttgatattatgtactttgtgatggacgctcactccttctataatttcatctactttatcctcctcatcattgttggctccttttttatgatcaacctctgcctggtggttatcgcaacacagttcagcgagacgaagcagagggaatcacagctgatgcgagagcagcgggtccggttcctttcaaatgcctctactctcgcctctttcagtgaaccgggatcatgctatgaggagctgctcaagtacctggtgtacatccttcggaaggctgcccgacgcctcgctcaagtaagtagggctgccggagtcagagttggtttgctgtcaagcccggctcctttgggtgggcaggagacgcagccaagtagctcctgctcacggagtcatcgcagactatcagtgcaccatttagtccaccaccatcaccatcaccaccaccattaccacctgggcaacggaacactcagggcaccacgagcctctcctgaaattcaggacagagatgcaaacgggtcaagacgcttaatgctcccccctcctagcacacctgcactcagcggagcgccacctggcggagcagagagcgtgcatagtttctaccacgctgattgccatctggagccagtcagatgtcaagctcccccacccagaagcccctcagaggcctccggacgcaccgttggatctggaaaggtctatcctaccgttcacacctcccctccgcctgagactctgaaggagaaggctctggtcgaagtcgccgcatcttccgggcctcctaccctgacctctctgaatatccctcccggtccgtattccagtatgcacaagttgttggaaacccaatcaacaggagcgtgccagagtagctgtaagattagcagcccttgcttaaaggctgattccggcgcatgtggacctgactcatgcccatattgtgccagggctggggcaggggaggtcgaactggccgatagagagatgccagactccgatagcgaggctgtctatgaattcacacaggatgcgcagcactccgacttgagagacccccactctcgaaggcagcggtctctcggaccagatgcagagccgtcctccgtcctagcgttttggagactaatctgtgacacttttaggaagatagtggacagcaagtacttcgggaggggcatcatgatcgccatcctggtgaatacactctccatgggtatcgaataccacgagcagcccgaagaactcaccaacgccctggaaatttcgaacatcgtctttacttcgttgttcgccctggagatgctattaaaattgctggtttacgggccattcggatacatcaagaatccctacaatatcttcgacggggtgatagtggtcatctctgtgtgggaaatagtgggacaacaggggggaggcctatcagtacttcggacttttcggctcatgcgtgtgctcaaacttgtaaggttccttcctgccctgcagcgacagctggttgtactcatgaagacaatggataatgtggccactttttgtatgttactgatgttatttatctttattttttctattctgggaatgcacttattcggttgtaagtttgcctctgaaagagacggggacaccctgccggataggaagaacttcgacagcctgctgtgggcgatcgtgactgttttccagatcctcacccaggaggattggaacaaagtgctctataatgggatggccagtacgtcaagctgggcagcactctacttcattgctctgatgacctttggcaattacgtgctgtttaatctgttagtcgctatcctggtggaagggttccaggcagagggtgatgctaataaatccgaatcagagccggatttcttttctccctctttggacggcgacggagacaggaagaagtgtcttgcactggtatccttgggagaacaccctgagctaagaaagtccctgcttcccccattaatcattcacacagccgctactcccatgtcattacctaagtccacctctaccggcctgggggaagcgttagggcctgcctcaagacggacatccagttctgggagtgccgagccgggtgcggctcacgaaatgaaaagccccccttctgccagatctagcccgcacagtccatggtcagccgcatccagctggacctctagacgcagttcgcggaactccctcggtcgggctccgagtctgaaacgcagaagtccaagcggcgagcgccgaagtctgctttctggtgagggccaggagagccaggacgaggaggaaagtagtgaagaagagagagcttccccggcaggctcagaccaccggcataggggtagcctagagcgagaggccaaaagctcctttgacctcccggacacgctgcaagtgcccggtctgcatcgcactgcttccggccgtggctcggcctcagagcaccaagactgtaacgggaagtctgctagcggcagactcgccagggcgttgagacctgacgaccctccactggatggagatgacgctgacgatgaaggaaacctttctaaaggcgagcgcgtgcgcgcttggatacgggcacgcttaccggcttgttgtctcgagagagacagctggtcagcctacattttccctccacaaagtcgattcaggctcctatgccaccgcatcatcacacataagatgtttgaccacgtcgtactagtaatcatcttcctgaattgtatcacaattgctatggagcggccaaagatcgacccccacagtgccgagcgaatatttttgaccctttccaactacatttttactgccgtattcttggcggagatgaccgtgaaagttgtcgctctgggctggtgctttggcgaacaggcttacctccggtcatcgtggaatgtgctagatggcctcctggtgcttataagtgtcattgacatcctagtgtccatggtcagtgatagtgggaccaagattctgggtatgctacgtgtcctgaggctgctgcggactctccgcccactgcgggtaatctccagagctcagggattaaagttagtcgtggagacactcatgtcatccttgaagccgatcgggaacattgtggtgatttgctgcgcattttttattatttttggaatcctgggtgtacagttattcaagggcaagttctttgtgtgtcagggagaggacactcggaacattacaaacaaatccgactgcgccgaagcctcataccggtgggtgcgacataaatacaatttcgacaatctggggcaggcactcatgagtctattcgttcttgctagcaaagacggatgggtggatataatgtatgatgggctcgacgctgtaggcgtggatcaacagaattttcataaatgtagacagcaccaggaagaggaagaagcaaggagacgagaagaaaagcgcctgcggaggcttgaaaagaagagaaggaatctcatgctggacgacgttattgcatctggctcaagcgccagcgcagcctcagaggctcagtgtaagccctactattccgactactctagatttaggctgctggtccatcacctgtgtaccagccattatctcgatctgttcatcacaggcgttatcggactgaacgtggttaccatggccatggagcactaccagcagccccagatcttagacgaggctctgaagatctgtaactatattttcacggtgattttcgtgctggagtcggtctttaagttggtggcctttgggttcaggagattctttcaagatagatggaaccagcttgatcttgcgatcgtgttgctatctatcatggggatcacactggaagaaattgaagtgaatgccagcctgcctattaaccctaccattatccggatcatgcgagtcttgcgcatcgcaagggtcttgaagttgcttaagatggccgtcgggatgcgcgcactcctggatactgtgatgcaagcactaccacaggtcgggaatctgggattgctgttcatgctccttttttttatttttgcagcccttggcgtggagttatttggagatctcgagtgcgatgagacacatccctgtgaaggcctaggccgtcatgccacatttagaaactttggcatggccttcctgacgctctttcgcgtgtccaccggggataattggaacggcattatgaaagataccttaagggactgcgaccaagagagcacctgctataacacagtcatctcccctatatattttgtgtcttttgtattgacagctcagttcgttctggtcaatgtcgtgatagctgtactgatgaaacatcttgaagagtctaacaaggaagctaaggaggaggctgagctcgaagctgagctggagctcgaaatgaagacactcagtcctcagccacactcacccctgggcagtcccttcctctggccaggagtggaaggcccagatagcccagattcacccaaacctggagcactgcaccccgcagcccacgccaggtctgccagtcactttagtttagagcaccctacaatgcagcctcaccccaccgaactgcctgggcctgacctcctgaccgtgcgcaagtctggggtaagccggacccattctctacccaatgacagttacatgtgccgtcacgggagcactgcggaagggccacttggtcaccgtgggtggggccttccaaaggcccagagcggctctgttctgagcgtccatagccagcccgcagataccagctatatcctccagctccctaaggacgcaccacacctcttacagccacacagcgccccaacttgggggacaatccctaagctgcctccgcctgggagatcaccccttgcgcagagacccctgaggagacaagccgcaatcagaaccgatagcttagacgtccaggggctcggaagccgtgaggatctgctggccgaggtttcaggaccttctccccctctcgcaagagcctactctttctggggccagagctcaacacaggcccagcaacactctaggtcacattccaagatatccaaacacatgacgcccccagctccctgtcccggaccagagcctaattggggaaagggcccacccgaaacacggtctagtctcgaactggataccgaactctcttggatatcgggtgatctgcttccaccaggaggccaagaggaacctccttctccaagagacctaaagaagtgctactctgtggaggctcagtcctgccaacggaggccaaccagctggctggatgaacagcggcgacacagcattgccgtgtcatgcttggattctgggtcccagccccacctgggcacagacccatccaatcttggtggacagccgttaggaggaccaggatcacgcccaaaaaagaagctgagtccaccctccatcacaattgatccccctgaatcacaggggccacggactcctccttcccccggaatctgtctgagaagaagggcgcctagctctgactctaaggatcctctggccagcgggcctccagactccatggccgcatctccaagccccaaaaaagatgtgctgagcctttccggcctctcctccgaccccgcagacttggatcctta

SEQ ID NO: 48709 - DNA, 6854 bp, Artificial Sequence
  Description of Artificial Sequence: Synthetic coding sequence
atggacgaagaggaagacggcgctggtgcagaggaatccggccagccccgtagcttcatgcgactgaacgacctgagtggagcagggggacggcctgggccagggtcagcagagaaggaccctggatcagcggactccgaagcagaggggctgccttaccccgctctggcccctgtggtatttttttacctctcccaggacagccggccacgctcatggtgtcttagaaccgtgtgtaatccttggttcgagaggattagcatgttggtgatcctccttaactgcgtcactttggggatgtttcgcccatgtgaggatattgcatgcgactcccagcggtgccgtatattgcaagcgtttgatgacttcatttttgccttctttgccgtagagatggtggtgaaaatggttgctctgggcatatttggcaaaaaatgttacctgggcgacacttggaatcgcctggacttcttcattgtgatcgccggaatgctagagtacagcctggatttgcagaacgtgagcttttctgcagtgcgtactgtgcgagtactcaggccactgagggcgattaatcgtgttccatcaatgcggatcctcgtgaccctcctgctggacaccctaccaatgctgggaaacgttttactcctttgtttcttcgtttttttcattttcggaattgtgggggtccaactttgggcaggcctgctcaggaatagatgttttctcccagagaacttctctctgcctctgtccgtcgacttggaacgctactatcagacggaaaacgaggacgaaagtccattcatctgctcccaaccccgagagaacgggatgaggagctgccgttccgtgcctacacttagaggagacggaggcggtggacccccatgtggtttagattacgaagcgtataatagttcgagcaacactacctgcgtcaactggaaccagtactatacaaactgttccgcaggggaacacaacccctttaagggagcgattaacttcgacaatataggctacgcgtggatagctattttccaggtgataaccttagaggggtgggttgacatcatgtacttcgtgatggacgctcactccttctataatttcatctactttattctgttaattatcgttggcagcttttttatgatcaacctctgccttgtggttattgcaacccagttttccgagacaaaacagagagagtcgcagctaatgagggaacagcgcgtaaggttcctaagcaatgcaagcactctggcttctttctcagaaccgggaagttgttacgaagagcttcttaaatacctcgtgtatatcttacggaaagctgctagacggctcgcacaggtgagtcgcgctgccggagtgcgggttggattgctttccagtcctgccccacttggaggccaagaaactcagccgtcttcatcctgctccagatcgcacaggaggttgtctgtgcatcatttggtgcaccaccatcaccaccaccatcatcactaccacctaggtaatggtactctccgagcacccagagcctctcccgagattcaggaccgcgacgccaatggatcaaggaggctgatgctgccacctccgtcaacacccgctttgtcaggtgcgcctcctggaggagcagaaagcgtgcatagcttctaccacgccgattgtcacctggagccagtacgctgccaggcaccaccgccaaggtctccaagcgaagcctcagggaggacagttggaagcggcaaggtgtacccaactgtgcacacctccccgccaccagaaaccctcaaagagaaggcgttggtcgaagtagcggcttcctccggccctccgacactgacgtcgctgaatatccctcctggcccttacagcagtatgcataaattgttggaaactcagagcacaggtgcctgccaatctagctgcaaaatctcttcgccatgcctcaaagcagacagtggagcttgtggacctgatagctgtccatattgtgccagggcgggagccggagaggtagagttagctgacagagagatgcctgactccgatagcgaagcagtgtatgagtttacccaggatgcccaacattcagatttgcgcgatccccactcacgcaggcagaggtctcttggcccagacgctgagccctcctccgtgctggccttctggagactgatctgtgataccttcaggaagatcgtggattccaagtacttcggcagaggcatcatgatagccatcctcgttaacacactgtccatgggtatcgaataccacgagcagcctgaggagctaacaaacgcattagagattagcaatatcgttttcaccagcctcttcgccctggaaatgttattgaaactgctggtctacggaccgttcggatatattaaaaacccctacaacatcttcgatggagtgatcgtcgtgatttcagtctgggaaatagtcgggcagcagggcggaggactgagtgtgctgagaacattcagactcatgagggtgctgaagcttgtccggtttttgcccgctctgcagagacagctggtggtgctgatgaaaacaatggacaatgtggcaacattctgcatgctgctaatgttattcatctttattttttctatactgggcatgcacttgttcggatgcaagttcgcatctgagcgcgacggagatactctccctgatcgcaagaactttgactctttattgtgggcaatcgtgactgtctttcaaattctcactcaggaagattggaacaaagtgctgtataatgggatggccagcacaagttcttgggccgcactatatttcatcgcgctcatgaccttcggtaactatgtgcttttcaacctccttgtggccattctcgtcgaaggctttcaggcggaggagatttcaaagcgagaggatgcatccggccagctctcgtgcatccagttgcccgtggattctcagggaggggatgctaataagagcgagagtgagcccgattttttttctccatctctggatggagatggcgaccggaagaaatgcctggctctagtgagtctgggagagcacccggagttgcgcaagtcgttgctcccccctttaatcatccacactgctgctacccccatgagcctgcctaagagtacttctaccggcttaggggaagccctcgggcctgcctctcggaggacctcctcctccgggtccgctgagcccggagccgctcatgagatgaagagcccgccaagtgccaggtcttcacctcattctccttggagcgctgccagttcctggacctcccgacgcagctcacgaaattccttggggagggcgccttccctcaagaggcgatcaccgtcgggagagcgacgctctctgctaagtggcgagggccaggaatcacaggacgaagaagaatcctccgaggaggaaagggcctctccagccggtagtgatcacaggcatcgaggctctctcgagagagaagccaagtcgagtttcgacttgcccgacactctgcaggtcccagggctccatcgcacagcatccggcagaggatcagcgagcgaacaccaggactgcaacgggaagtcagccagtgggagattggcacgcgcactgagacccgatgatccaccactggacggcgatgacgcggatgatgagggcaacctgtctaaaggagagagagtcagagcttggatccgcgcaaggttacccgcttgctgtttagagcgcgactcctggtcagcctacattttcccaccacagagtcgatttcgtctactctgtcatagaattattacacacaagatgtttgaccacgtcgtccttgttatcattttccttaattgcatcacgatcgcaatggagagacccaaaatcgacccacactctgccgagcgtatctttcttactctgtccaattacatcttcaccgccgtgttcctggccgagatgacggtgaaggtggtcgcactcggatggtgcttcggagagcaggcatacctgcgttcctcttggaatgtgctggatggactcctagtgctgatatccgtgatcgacatattggtaagcatggtaagtgactccgggactaaaatcctgggtatgctaagagtcctgaggctgctgaggacactccgccctctcagggtgataagtagggcccagggcttgaagctcgtggtagaaacccttatgtcgtccctcaaaccaattggcaacatagtggtaatttgctgcgcttttttcataattttcgggattctgggggtgcagctcttcaaagggaagttcttcgtgtgtcaaggggaggacacgcgcaatattacaaataagtccgactgtgctgaagcgagctataggtgggtgcggcacaagtataattttgacaacctggggcaggcactgatgtccctgttcgtgctggcatccaaagacggctgggtggacatcatgtacgatggactggatgctgtcggtgtggatcagcagcccatcatgaatcacaacccatggatgcttttatactttattagttttctgctgatcgtggcctttttcgtgctgaacatgttcgttggcgtggtcgtggagaatttccacaagtgtagacaacaccaggaggaagaagaggcacgcaggcgtgaggaaaagcggctcagacggctcgagaaaaagaggcggaacctgatgctggacgatgtgatcgccagtggcagttccgcaagcgctgcttcagaggcacagtgtaagccgtattactccgattattctaggttccgactgctggtccaccatttgtgcactagtcattatctcgatctgttcatcaccggggtgataggcctgaatgtagtgaccatggcaatggagcactatcagcagccccagatcctggacgaagccttaaaaatctgcaactacatttttacggtgatatttgtcctggagtccgtgtttaaactggtagcattcgggtttcggagattcttccaagatcgctggaaccaattggacctggctatagtcttgctgagtattatgggaatcacactggaggaaattgaggtcaacgcgagtctgccaattaaccccactatcataaggattatgagagtgctaaggatagctcgggtcttgaagcttctcaagatggctgtgggtatgcgggcattattggacaccgtgatgcaggcccttccgcaggtgggcaacctggggttattgttcatgctgctattcttcatattcgcagccctgggagtggaattgtttggggatcttgaatgcgacgaaacacatccgtgcgagggcttgggtagacacgccacctttcgaaacttcggaatggcctttttgaccttgttccgcgtgtcaacaggggacaattggaatggaataatgaaagacactcttcgggactgcgatcaagagagcacgtgctataataccgttatctctccgatatacttcgtgtcattcgtccttacggcccagttcgtgttagtaaatgtggtcatagcggtgctgatgaaacacctcgaagaaagcaacaaggaggctaaggaagaagccgagctcgaggctgaactcgagctggagatgaagacactgtctcctcagccacattctcccctgggatccccattcttatggcctggggtagaggggccagactcaccagacagtccaaagcccggagccttacaccctgccgctcacgctagatcggcttcccacttttcactggaacacccaaccatgcaacctcatccgacagaactacccggtccagatctgctgaccgtgagaaagagtggcgtgtctagaacgcatagtctgcccaacgatagttacatgtgccgccacggctccaccgcggagggtcccctgggacaccggggttggggcctgcccaaagcacagagtggatccgtgctttccgtccacagccaacccgcagacacctcttacatccttcagttacccaaggacgctccccatcttctacaaccccacagcgcacctacatgggggacaatacctaaacttccacctcctgggagatcccctttggctcagcgcccactaaggagacaagctgcaattaggacagatagtctagatgtgcagggcttggggagccgggaggatctactcgctgaggtcagcggtccttctccgcctctggctcgagcatatagtttttgggggcagtctagtacgcaggcccagcagcacagccgtagccatagcaaaatcagtaagcatatgacaccacccgcaccctgcccaggaccagagccaaactggggcaaaggccctcctgagacccggtcaagcttggagttggacactgagctgagctggatcagcggggatctccttcctcctgggggtcaggaggagccgcctagccccagagatctgaagaaatgctattcagtcgaggctcagtcctgccagcgcaggcccacgtcatggttggacgagcaacgccgacactcaattgcggtttcttgcctcgattcaggtagccagccacacttaggaactgatccatctaaccttgggggtcagcccctgggcggtcctgggagccgtccaaagaaaaagctgtcacccccttctattacgatagatccacccgagagtcagggcccaagaactccaccttcccccggaatttgcctcagacggagagccccaagttcagatagcaaagatcctttggcctccgggcctcctgatagcatggcggctagtccatctcctaagaaagacgtgttgagccttagtggactgtctagtgatccagccgatctggatcctta

SEQ ID NO: 48710 - DNA, 6944 bp, Artificial Sequence
  Description of Artificial Sequence: Synthetic coding sequence
atggatgaagaggaggacggagctggggctgaagagtctggccagccgaggagcttcatgaggctaaatgatctgagcggcgctggtggcaggcctggaccagggagcgccgagaaagaccctggcagtgccgattcggaagctgagggcttaccttaccccgctctcgcaccagttgtgtttttttacttgagccaagattccagaccgagatcctggtgtcttcggacagtctgcaatccctggttcgagcggataagtatgctcgtcatcctccttaactgcgttacgcttggcatgttcaggccttgcgaggatattgcatgtgattcacaaaggtgccgcattctgcaagcatttgacgattttatctttgctttttttgcggtggaaatggtggtgaaaatggttgccctgggcattttcggaaaaaagtgctatctaggggatacctggaacaggctggacttttttatcgtgatcgccggaatgctggaatattcactggacctgcaaaatgtcagcttttcagcagtccgcaccgttcgggtgctccgtccactgcgtgccattaatcgtgtcccatcaatgcgcattcttgtcacgctacttctcgacactcttcccatgttggggaatgtcctgctgctttgcttcttcgtattcttcatcttcggcatcgtcggagtgcaactatgggcagggttactgcggaatcgttgttttctccctgaaaatttctccctgcctctcagcgtcgacctcgagcgctattatcagaccgagaatgaagacgaatctccgttcatctgctcacagccacgcgaaaatggcatgcgaagctgcagatccgtgccaaccttacgcggtgacggtggcggtggtccaccctgtggcctcgattatgaggcctacaattcatcttcaaacacaacctgtgtgaactggaaccagtactacactaactgctcagccggagagcataaccccttcaaaggagcgatcaactttgataacattggatatgcgtggattgccatttttcaagtgatcacactggaaggttgggtcgatatcatgtacttcgtaatggacgcccatagtttctacaactttatatattttattcttctgatcatcgtaggcagctttttcatgataaacctatgcctggtggtcattgccacccagtttagtgagacaaaacaacgagaaagccaactcatgagggagcagcgagtccgtttcttgtctaatgcgagcactctcgccagcttctccgagccagggtcttgctacgaagagctgctcaagtacctggtctatattctcagaaaagcagctagacgactggcacaagtttcacgtgctgcaggtgtgcgtgttggtttgttatcatctccagctcccctcggtggacaggaaacacagccgagctcttcatgttcacggtcacatcggagattgtctgtacaccacctagtgcaccatcaccaccaccaccaccaccattatcacctagggaatggaacgttgcgggcacctagagcctcccctgaaatacaagaccgggacgctaatggcagccgacgcctaatgctgcctccacctagcacacctgccctgtctggagcccctccgggaggcgctgaatcagtgcattctttttaccatgccgactgtcacttagagccagttcgatgtcaggcaccgccaccgcgtagcccgagcgaagcctcaggtagaaccgtgggttctggaaaggtctaccccactgtccatactagccccccaccagagaccttgaaagaaaaggccctggttgaggtagctgcctcctctggacctcccactctcactagcttgaacatacctcccggtccctatagctcaatgcacaagcttttagaaacccagagtaccggagcctgccagagtagttgcaagataagcagtccttgcctcaaggcagattcgggcgcatgcggccctgactcttgcccatactgcgcacgcgcaggagcaggagaagttgagctggcagatagggaaatgcctgatagtgatagtgaagccgtttatgagtttacccaggatgctcaacattccgatctgcgtgaccctcactccaggaggcagaggagcctcggccctgacgccgagcctagtagtgtgctggcgttctggaggcttatttgtgataccttcaggaagattgtggattccaagtattttggtcgtggcatcatgatcgctattctggtaaacaccctatctatggggattgagtatcacgaacagccagaagagctgacaaatgcactagaaattagcaatatcgtctttacgagcctcttcgcgctagagatgctgctgaaactgcttgtatacggcccttttggctacattaaaaacccttataacatattcgacggcgtcatcgtcgtgatctccgtttgggagatagtcgggcagcagggagggggtctcagtgtgctccgaacatttcgcctaatgagggtgctgaaactggtgcggtttctgccagctttacagaggcagttagtcgttctgatgaagacgatggacaacgtggccacattttgtatgctactgatgttgtttattttcatcttctccattctgggaatgcatttattcgggtgcaagtttgcctctgagcgagatggagacacattgcccgatcgtaagaattttgactctcttctgtgggctattgttactgtgttccagattctcacacaagaagactggaacaaggtactctataacggcatggccagtacctcttcttgggccgctctttatttcatcgcccttatgactttcgggaactacgtcctttttaatctcttagtggctattctcgtggagggattccaggcagaggaaatatctaaacgcgaggatgcttctgggcaattatcctgtattcagctccccgtagattcccaaggcggagacgctaacaagtccgaaagtgagcctgattttttcagtccatctctcgatggcgatggtgacagaaagaaatgcctcgcccttgttagcttgggcgaacaccctgagctccggaagagtttgttgcctcccctcatcatacatactgcagcgacgcctatgtctctaccgaagagtacaagtacaggtcttggtgaggccctaggtcctgcttcacgccgtactagctcgagcggatctgctgagcccggagcagctcacgaaatgaagtctcccccatctgcacgatcgtccccacactccccatggagtgctgcttcctcatggactagcagacgctcctcgcgcaattcacttgggcgagctccaagcctgaaaaggaggtccccaagtggagagaggaggagtctgctgtctggggagggtcaggagtcccaggacgaggaagaatcttccgaagaggaacgagcctctcctgccggttccgaccacaggcacaggggctctctggaaagggaggccaaaagtagtttcgacttacccgatactttgcaggtccccggactgcatagaacagcttccgggcgtggaagcgcctcggagcatcaagattgtaacggcaagtctgcctctggcagactcgcacgcgcactcaggcccgatgaccctccactggacggagatgatgctgacgacgagggcaatctatcgaaaggtgagagagtcagagcctggatccgtgcacgattaccagcctgctgcctcgagagagattcctggtcagcttacatctttccacctcagtcaagattcaggcttctgtgccacaggatcattacccataaaatgtttgatcacgtggttttggttatcatcttcttaaactgcattactatagctatggagcgccctaagatcgatcctcacagtgctgagcgaatatttctcacattatcaaactatatctttactgccgtgttcctggcggaaatgaccgtcaaggttgttgccctcggctggtgtttcggtgaacaagcctaccttcgctcttcatggaatgtgttggacggcttgcttgtgctgatctcggtgattgacatcttggtcagcatggtcagcgactctggcaccaagattctgggaatgcttagggtcctaagactgctgagaacactgaggccgctgagggtcatttcacgagcacaaggcctaaaattggtggtagagacgctcatgagtagtctgaagcccattggtaatatagtcgtgatctgttgcgccttcttcatcatttttggcatcctgggagtgcagcttttcaaaggcaagttcttcgtctgtcaaggcgaagatacgagaaacattaccaacaaatccgactgtgctgaagcatcctaccggtgggtgagacacaaatacaactttgataatttgggccaagcactgatgtcactttttgtgctcgcatccaaagacggctgggtggacattatgtatgatggtctggatgccgttggggtggatcagcagcccattatgaatcataacccttggatgttgctttacttcatttccttcctgctgatagtggcattttttgtgctgaatatgttcgtgggcgtggtagttgagaatttccacaagtgcagacagcatcaggaagaggaggaagccaggagacgcgaggagaaaaggctaagaaggctggagaagaaaaggagaaaggcacagtgtaaaccttattactcggactatagccggtttcgactcctggtacatcacctatgcacctcccactatctagacttgttcatcactggagtgattggcttgaacgtcgtaactatggccatggagcattaccagcagcctcagatcttggatgaggctctaaagatctgcaactacatctttacagtcatctttgtgttagaaagcgtgttcaaattggtagcattcggcttccgaaggttctttcaggatcgctggaatcaactggacctggccatcgtacttctctcaattatggggattaccctcgaggagatcgaagtcaacgcttctttaccaattaatcctaccatcatcagaattatgcgtgttctgcgcatagccagggtcctaaaactcttgaagatggctgttgggatgagagccttgctggatacggtgatgcaggccttacctcaggtgggcaacttaggtctcctgttcatgttgctgttttttattttcgctgcccttggagttgagctgttcggcgacctggaatgtgatgagacccacccatgcgagggacttggtcggcacgctacatttcgaaactttggcatggcctttctcaccttgttccgggtgagcacaggcgacaactggaatggcatcatgaaggacacactcagagattgcgaccaggagtcaacatgctacaacacagtgatcagtccaatttactttgttagttttgtcctcaccgcgcagtttgtcctggtgaacgttgttatagccgttcttatgaagcacctggaggaaagcaataaagaagctaaggaagaggccgaactcgaggccgagctggagttagagatgaagacactgagtccacaacctcattcacctctagggagtccctttctgtggcccggagttgaagggcctgacagtccagattcacccaaacccggtgccctccatcctgctgcccacgcacgatcagccagtcactttagtttagaacatcctaccgaccgtcagctgttcgacacgatttcccttctgattcaaggatcccttgaatgggagctcaagctgatggacgagcttgccggtcccggtgggcagccaagcgcctttcccagcgcaccctcattgggcggttcagatccccagatgcagccacacccgacagaactgccgggacctgaccttctcaccgtgcgaaagtcaggcgtgagtcgcacccatagtctgcccaacgatagctatatgtgccggcacgggagtactgccgaagggccactcggacatcggggatggggccttccaaaagctcagtctggtagcgtgctctccgttcatagccagccagccgatacttcctacatcttgcaactgcctaaagatgctccgcatttgctgcagccccacagtgcaccaacctggggaacgatccctaagctccctcctccgggaaggtcccctctcgcacaaaggcccctcaggcggcaggcggcaatccgaacagacagccttgacgtccaaggattgggctcacgggaggatctacttgccgaagtgagtggaccctctcctcctctggctcgggcatacagcttctggggtcaatcctccactcaggcgcagcaacacagtagaagtcactccaaaattagcaagcacatgactccccctgcaccatgccctggccctgagccgaattggggaaagggtccacctgagacccggtcttccctggaattggataccgagctcagttggatttccggggatttattgcctccaggcggtcaggaggagccaccctccccacgagacctgaaaaaatgctattccgtggaagcacaatcctgccagcggcgtcctacttcctggctcgacgaacagaggaggcactccatcgctgtctcctgcctggattccggttcccagccacacctggggactgacccatccaatctcgggggacaacccttggggggtccgggttctagaccgaagaagaagctttccccaccctctattaccatcgaccccccagaatcccaaggtcctaggactcctcccagtcctggtatctgtcttcgcagacgggctccttctagcgactcaaaagaccctctggccagcggcccaccagactctatggctgcaagtccttcccccaaaaaagacgtgctcagtctctcgggccttagcagcgaccccgctgacctggatccgta

SEQ ID NO: 48711 - DNA, 6965 bp, Artificial Sequence
  Description of Artificial Sequence: Synthetic coding sequence
atggacgaggaggaagacggggctggcgcagaggagtccggacaacccaggtctttcatgagactgaatgacctgagcggtgcgggtgggagacctgggcctggcagtgctgagaaggaccctggcagtgctgattccgaagcagagggcttaccttatcctgccttagctcccgtggtctttttttatctctcccaagacagccgccctcgttcctggtgtctccgaactgtgtgcaacccatggttcgaacgcattagcatgctcgtgatcctgctgaactgtgttacgttggggatgtttcgaccctgtgaggatattgcgtgtgatagccagcgttgccgcatactgcaagcattcgacgactttatttttgctttcttcgcagtggaaatggtcgtgaaaatggtggccctaggtatattcggtaagaaatgctacctgggcgatacatggaatcggctggactttttcatcgtgatagcaggtatgctggagtactcgctggatctacagaacgtgtcctttagtgctgtacgcaccgtcagggtactccgccctctccgtgccatcaatcgggttccctccatgcgcattctggtgacactgcttctggacaccctccccatgctgggaaacgtcttattgctctgtttttttgttttcttcattttcggcatcgtgggcgtccagctttgggcgggattactgcggaacaggtgcttcctacccgagaacttcagcttgcctttgtccgtggacctggaacgatactatcagaccgagaacgaagacgaatcccctttcatctgcagtcagcccagagagaacggtatgagaagttgcagatctgtccctactttacgtggagacggaggaggaggcccaccttgtggccttgattacgaagcatacaattcctcctcaaatactacttgcgtaaactggaatcagtactacacaaactgttcagcaggcgagcacaacccgttcaaaggtgccattaactttgataacataggctacgcctggattgccatcttccaagtgatcacactggagggctgggtggatatcatgtattttgtgatggacgcacactcattctacaattttatctacttcattctgctcattattgtcggctccttctttatgattaatctctgtcttgttgtaattgccacccagttcagcgaaacaaagcagcgagagtcccagctgatgcgagagcagagggtcagattcctgtcgaacgcaagtacactggctagctttagcgaacccggttcctgttatgaagagctcctgaagtatttagtctacatcttacggaaagctgccagacgactggcccaggtctcccgggctgccggtgtccgtgtgggcctactgagcagccccgcacctctggggggtcaggaaacgcagccctcgtcaagctgctcacgcagtcatagaaggctgtctgtgcatcacctggtacatcaccatcaccatcatcaccatcattaccacctcggtaatgggactctgcgcgctcccagagcttcaccagagattcaagaccgagacgccaatggcagccggagattaatgcttccaccaccctcaacacctgccctgagcggtgccccacctggcggagcagaatccgttcattcattttatcacgccgattgccatttagaaccggttaggtgccaagcacccccacctagatcaccttctgaagcctctggacggaccgtgggctctggtaaggtgtatccgaccgtgcatacaagtcctcccccagaaacactcaaggagaaggctctggtcgaggtagctgcaagcagtggcccacccaccttgaccagcctaaacatccccccaggcccttatagttcgatgcataaactgctggagacgcagagtaccggtgcatgtcagtcttcctgtaaaatcagttctccctgcctgaaagctgatagtggggcatgcggacccgatagctgtccatactgtgctagggccggagctggagaggttgagcttgctgatagggaaatgcccgactccgattctgaggcggtgtatgaatttacccaagatgcccagcattccgaccttcgggacccgcattctaggaggcaacgatctctcggaccggatgcagagcccagttcggtgctggccttctggcggctaatatgcgacacatttcgaaagatcgtcgatagtaagtattttgggaggggaataatgatcgctattctggtgaataccctcagtatggggatcgaatatcatgaacagcctgaggagttgacgaacgccctggaaattagtaatatagtatttacaagcctttttgctctggagatgctgctgaagttattggtgtacggacccttcggatacatcaagaatccttacaacatcttcgatggcgtcattgtggtgatcagtgtgtgggagatcgtgggtcagcagggcggaggactgtccgtcctgcgaacgtttcggctgatgagggtcctgaagctcgtgcggttcctgcccgctctccagcgccagcttgtggtcttgatgaagactatggacaacgtagccacattctgtatgctcttgatgctttttatttttattttttcaatcttggggatgcatctgttcggctgtaagttcgctagtgaaagggatggagacaccctgccagatcggaagaatttcgactcattattgtgggcaatcgtgaccgttttccaaatactcacccaggaagattggaacaaggtcctgtacaatggtatggcgtccacgtcaagctgggcggcactgtactttatcgcgctaatgacctttggaaactatgtgctcttcaacttgctcgttgcaatccttgtggagggatttcaagctgaggagatttctaaacgcgaagatgccagtggtcaactctcctgcatccagctgccagttgactcccagggcggtgacgccaacaagtcagagtctgagcccgactttttctcccccagtctcgatggcgacggagaccgcaagaagtgtctggcattggtctccctgggagagcatcctgagcttaggaaaagtctgctacccccactgattattcatactgccgctacccctatgtccctcccaaaatctactagcacaggattgggagaggcactaggcccagcatcccggcgaaccagtagctcagggagcgccgaaccgggagcagcacacgagatgaagtccccacccagcgcgcgttcttccccccattccccatggtccgcggcaagctcatggactagcaggaggagctcaaggaattcgctgggtagggcccctagccttaagcgcagatcaccctcaggagagcgtcgcagcctcctttctggcgaaggacaggaatcacaggatgaggaggaatcctccgaagaagagcgcgcatctccagcgggttccgatcacagacatcgcggatcccttgaacgtgaggcaaaatcaagcttcgacctccctgacaccttgcaggtacccggactgcaccggactgcctcagggcgagggagtgcctcagagcatcaggattgtaacggaaaatccgcctccggccgtttagccagagcattgagaccagacgacccaccgttagacggcgacgacgccgacgacgagggaaacctctctaagggggagcgggtgagggcctggattagagctcgactgcccgcatgctgtctggagcgcgatagttggagcgcctatatctttcccccacagtccagattccgcttgctgtgtcatcggataatcacccataaaatgttcgaccatgtcgtgctggtgattatattcttgaattgtatcactatagccatggagagacctaagatcgatccgcactcagccgaaaggatattcttgaccctcagcaactatattttcacagctgtgtttttggccgaaatgaccgtgaaagtggtcgccctgggatggtgttttggcgagcaggcataccttagaagtagctggaatgtgctcgacggactgctggtgcttattagtgttattgacattctagtctccatggtgtctgacagcggtaccaagatactcgggatgctgcgagttctccgcttgttacgcacactgcgaccattgcgcgtgatatccagggcccaggggctgaaactcgtggttgaaaccttgatgtcatcactaaaaccgatcggaaatatcgttgttatctgctgcgcatttttcatcatatttgggatcctgggcgttcagttattcaagggcaagttcttcgtctgtcagggtgaggacactaggaatattacaaacaagagtgactgtgcagaagcttcttaccggtgggttcggcataaatataattttgacaatctgggtcaggctctgatgagtctttttgtcttggctagtaaggacggatgggtagatattatgtacgacggcctggatgctgtgggagtcgaccagcagcccatcatgaaccataacccttggatgctcttgtacttcatcagctttctgctcattgtggccttttttgtgcttaatatgtttgtcggggttgtggtggagaatttccataagtgtagacagcaccaagaagaagaggaagctcggaggagagaggagaagaggctgaggcgactggagaaaaagcgacgctcaaaagagaagcaaatggctgaggcacagtgtaagccttactactccgactatagcagattccgactgctcgtgcaccacctctgcacctcgcactatctggatctgtttattaccggggtcattggcttgaacgtggtcaccatggccatggagcactaccaacagccccagattctcgatgaggcgctcaagatctgcaattatatctttactgtcatattcgtgctggagtctgtgttcaagctggtggctttcggctttcggcgtttcttccaggaccgatggaaccagttagacctcgccatagttcttctgagtataatgggaattacactggaggagattgaggtgaacgcaagtttaccaatcaatccgacaattatcagaatcatgagggttctgcggatcgcacgcgtattgaaattgctcaagatggcggtgggaatgagggcgctgctggacacggtcatgcaggctctgccacaagtggggaacctgggcctcctcttcatgctactgtttttcatcttcgcagccttgggagttgagttgtttggagatctggaatgcgacgagactcacccatgcgaaggactgggtcgccacgcaacattcaggaacttcggaatggcgtttctaactctgttccgggtgtctactggcgacaactggaacgggataatgaaggatactctacgggattgcgatcaggagagtacatgttacaatacagtcatatcccccatctactttgtctcctttgtcctcacggcgcaatttgtattagtcaacgttgtgattgcggtgcttatgaagcacctggaagaaagcaataaggaggctaaggaagaggccgagttggaggccgagctggagctagagatgaaaacactgtcacctcaaccacattcccctcttgggtcaccatttctctggcccggagtcgagggccctgactcacccgattctccaaaacccggagctttgcaccctgccgctcacgctcggtccgcctcgcactttagcctggaacatcctactgaccgacagttgtttgatacaatctcactactgatacagggcagtctcgaatgggagcttaagttaatggatgaattggctggcccagggggacagccatcagcctttccctcagccccatcgttaggcggatccgatccacagatgcagccccacccaactgagctgcctggcccagaccttctaaccgtgaggaagtccggagtctcgcggacccactcacttcctaatgatagctatatgtgtagacacggctccactgccgagggcccacttgggcaccggggttgggggctgcctaaggcccagtccggatctgtcttgagcgtgcattcccagcctgcagatacaagctacatcctgcagctgcccaaagacgccccacacctgttacagccccactctgcaccgacctggggcaccattcccaaactgcctccacctggacgtagccccttagcacagagaccactgcggaggcaggccgcaatacgcacggactcacttgatgtgcagggcctgggttctagagaggatctgttggcagaggtctccggccctagccctccgttagcccgtgcctattcattctggggccaatcctccactcaggctcagcaacacagtcggagtcattccaagatttccaagcatatgacgcctccagccccttgccccggacccgaacccaattggggaaaggggcctcctgaaacccgcagcagtttggaactggacacagaactttcctggattagcggcgatttactgcctccgggtggacaggaggagccaccgagtccaagggatttgaagaagtgctacagcgtcgaggcccaatcctgtcagaggaggccaacaagctggctggacgaacaacgccgtcactcaattgccgtgtcttgcctagactccgggagtcagccacatctggggaccgacccaagtaacctggggggtcagcctttaggcggaccaggatcccgtccaaaaaagaagctgtccccaccctccattactatcgaccctcctgagtctcagggccctcgcactccacccagccccggtatttgcctccggcgtcgtgcgccaagtagcgatagtaaggacccactcgccagcggccctcccgatagtatggccgctagtccatcccccaagaaagatgtgctttcgttgagtggcctgagcagcgacccagctgacctggacccata

SEQ ID NO: 48712 - DNA, 1035 bp, Artificial Sequence
  Description of Artificial Sequence: Synthetic coding sequence
atggataagttccgaatgctgttccagcatttccagtcatctagtgaaagcgtgatgaacgggatctgtctgcttcttgccgctgtgactgtgaagctgtacagttctttcgactttaactgcccttgcctcgtgcactacaacgcgctttatgggctcggattactgctgacaccccctctggccctctttctttgtggcctcctcgctaaccgccagagtgtggtgatggttgaggaatggcggaggcctgctggacaccggcgtaaggacccaggtatcatccgctacatgtgtagcagcgtcctgcagagagcattggcagcacccctggtctggattctgcttgctctcttagacggtaagtgtttcgtatgcgcattttcttcttccgtcgatcccgaaaagtttttagatttcgccaatatgactccctcacaagttcagttgttcctggccaaagtaccttgtaaggaagatgagttagtccgggactcccctgctcggaaagccgtcagtaggtatctgagatgcctttcccaggccatagggtggtccgtcacgctgctgttaattatcgctgctttcttggcgcgatgcctaagaccatgtttcgaccagactgtgttcctgcaaaggagatattggtctaattacgttgacctggagcagaagttatttgatgagacctgctgtgaacacgcgcgtgacttcgcccacaggtgtgttctacactttttcgcctccatgcgctctgaactgcaggcaagaggactgcgacgtggcaacgccggtaggaggctggaactgccggctgttcccgaacctcctgagggcctggactctggatctggaaaagcccatctcagggccatttcaagccgcgaacaggtcgacaggctcttgagcacatggtactcttctaaaccacccctggacctggcagcttctccgggtctgtgtggtgggggtttaagccacagggcccctaccctcgctctgggtaccagattatcgcagcacaccgacgtttag

SEQ ID NO: 48713 - DNA, 1431 bp, Artificial Sequence
  Description of Artificial Sequence: Synthetic coding sequence
atgggcagaaaagaggaagacgactgctctagttggaaaaagcagaccaccaatattcgaaagactttcatattcatggaggtgctgggcagcggagctttctccgaagtgttcctggtgaaacagaggctgaccggtaaactgtttgctctaaagtgtatcaaaaaatcccctgctttcagagatagtagtctagagaatgagattgccgtcctgaaaaagatcaagcatgagaatattgtcacccttgaagacatatatgagagtacaacacattattatctggtgatgcaattagtttcgggtggggagctgttcgacagaatcctggaaagaggggtatatactgagaaggacgcttcactcgtgatccagcaggttcttagcgccgttaagtatctgcatgagaacggaatagtgcatagggatctgaaacccgagaatcttctttacctgaccccagaagagaattccaagatcatgatcaccgacttcgggctttccaaaatggagcagaacgggattatgagtaccgcatgtggaaccccagggtacgtggcacccgaggtgttagcccaaaaaccatacagcaaggccgtagattgctggtctatcggagtcatcacatacattctcctgtgtgggtaccctcctttctacgaggaaaccgagagcaaattattcgagaaaattaaagagggatactacgagttcgaaagccctttttgggacgatatttctgagagtgccaaagatttcatctgccacttactggagaaagacccaaatgagaggtatacttgcgaaaaagccctgtcacatccttggattgacggcaacaccgctctgcacagggacatctatcccagtgtatcccttcaaatccaaaagaatttcgctaagagcaagtggaggcaggctttcaatgccgctgccgtggtgcatcatatgcggaagctgcatatgaatctccacagtccaggggttcgcccagaggtggaaaaccgcccaccagagactcaggcttccgaaacttcgagacccagttccccagaaataaccattactgaggctcctgtactcgaccattcagtggccctgcctgccctgacacaactgccctgccagcacgggcgaagacctaccgcacccggtggacgcagtctgaattgcctcgtcaacgggtcattgcacatctcttcctccctcgtccccatgcatcaagggagcttagcggcaggcccttgtggctgctgttcgtcttgcctgaacatagggagtaaagggaagtcctcatactgctcagagccaactcttcttaagaaagcgaacaaaaagcagaacttcaagtctgaggtcatggttcccgtgaaagccagtgggtccagccactgcagggctggacagactggagtttgtctgatcatgtag

SEQ ID NO: 48714 - DNA, 1431 bp, Artificial Sequence
  Description of Artificial Sequence: Synthetic coding sequence
atggggaggaaagaggaggacgactgcagctcttggaagaagcaaaccactaatattagaaagacattcattttcatggaagtccttggaagcggagcattctccgaggtgtttctcgtgaagcagcgactgacaggcaagctgtttgccctgaagtgtatcaagaaaagtccagcattcagagactctagccttgagaatgagatcgccgttctgaaaaagatcaagcacgaaaatatcgtaaccctagaagacatttacgaatcaaccacacactattatctggtcatgcagcttgtctcagggggagaactgttcgaccgtattctggagcgcggtgtatacacggaaaaagatgcctcactggtgattcagcaggtgttatcagcagttaaatatctacacgagaatggaattgtacatcgggacctgaagccagagaacctgctctatctgacacccgaggagaattcgaagatcatgatcacagactttggcctgtcgaagatggaacagaatggcatcatgagcacagcctgcggcactccaggatacgttgctcctgaagtgctggcccagaaaccctacagtaaagccgtcgattgctggtccataggagtgattacatacatccttctgtgcggttatccacccttctacgaggaaaccgaatcgaaactctttgagaagatcaaggaaggctactatgaatttgagtctcccttctgggatgatatatctgagtctgcaaaagattttatctgccatctgcttgagaaggatccaaacgagaggtatacatgcgaaaaagccctctctcacccgtggatcgatggaaacaccgctcttcaccgtgatatctatccctccgtgagcttgcaaatccagaaaaatttcgctaagagcaaatggaggcaagcatttaatgctgctgccgtagtgcaccacatgcgaaaacttcatatgaatctacatagccccggagtacgccctgaggtggaaaatagacctcccgaaacccaggccagcgagacaagtaggccctcatcgcccgaaattactattactgaggccccagtgctggaccacagtgtcgccctccccgctctgacccagctgccgtgtcagcatgggagaagaccaaccgctcctgggggacggagcctgaattgtctggttaatggatccctgcacattagctccagtctggtgcctatgcatcagggctccttggccgctggcccatgtggttgctgttccagctgcttgaatatcggttcaaaaggaaaatcaagctactgcagcgagccgacactgcttaagaaagccaataagaagcaaaacttcaaatccgaggttatggtgccggttaaagcttcagggtcttctcactgcagagctggtcagactggagtgtgtctgattatgtag

SEQ ID NO: 48715 - DNA, 654 bp, Artificial Sequence
  Description of Artificial Sequence: Synthetic coding sequence
atggttaagcttggttgctcattctcagggaaaccaggtaaggatccaggtgaccaggacggggctgccatggactccgttcctttaatatcccccttggacatttcgcaacttcagcctccattgcccgaccaggtagtgataaagactcagactgagtaccagctgtcttccccggatcagcagaactttccagacctcgagggccagaggcttaattgtagccatccagaggagggaagacggttacccactgccaggatgatcgccttcgctatggctctgctggggtgcgtgctcattatgtacaaggcgatttggtatgatcagtttacctgtcccgacggcttcctgctccgccataagatctgcacgcctttgacccttgagatgtactacacagaaatggacccggagaggcaccgctcgattttagctgccattggcgcataccccctgagcaggaagcacgggacggaaaccccagcagcatggggcgacgggtacagagctgccaaagaggagagaaagggccctacacaagccggagcagcggctgcggcaaccgagcccccaggcaagccgagcgcaaaggctgagaaagaagccgcaaggaaggccgcaggctccgccgcaccaccaccagcacagtag

SEQ ID NO: 48716 - DNA, 477 bp, Artificial Sequence
  Description of Artificial Sequence: Synthetic coding sequence
atggtgaagctggggtgttccttcagtggtaagcctggaaaagatccaggcgaccaggacggggcagccatggatagtgtcccgctaatctccccgctggatattagtcagttacagccacctctgcctgatcaggttgttattaaaacccagacagaatatcagctttcaagtccggaccaacagaatttccccgatctggaaggccaacgactcaactgcagccacccagaggagggacgacgcgtgacaacacccaccccacccaccgtgggaacgcaggaccgcaggcggaggtggaaggcagccggtggcgcttgggtccccagcaggcccgtgtggggacccctggcactgagagaggagagagtagcagtctcacaccctgctcagtcctggccccatagactgccatgcacccaccaggcccctagccgaggatgcaggtgcaggcttaccaagcagtggagaagctag

SEQ ID NO: 48717 - DNA, 375 bp, Artificial Sequence
  Description of Artificial Sequence: Synthetic coding sequence
atggtcaaactaggatgctctttctcaggcaaacccggaaaggaccctggagatcaagatggagcagctatggacagcgtccctctcatatcaccattagacatatctcagctccaacccccactgccagaccaagtggtgattaaaacacagacggaataccaactgtcctctcctgaccagcaaaacttcccagacctcgagggccagaggcttaattgctcccatcccgaagagggtagaagactgccgaccgcgaggatgatcgcctttgctatggcattgctagggtgcgtgctgatcatgtacaaagcgatttggtacgaccagttcacatgccctgacggattcctgttgagaggacccgaattctag

SEQ ID NO: 48718 - DNA, 375 bp, Artificial Sequence
  Description of Artificial Sequence: Synthetic coding sequence
atggttaagctggggtgcagctttagcggaaaacctggtaaagatcctggggatcaggacggagccgctatggactccgtgcccctgatatcaccattagacattagccagcttcaacctcctcttcccgaccaagtcgtcatcaagacccaaactgagtaccagctttcaagtccggatcagcagaactttcctgacctcgaaggccagagactgaactgctcacatcctgaagagggccgaagattgcctacagctagaatgatcgcatttgccatggccctgctaggatgtgttctgatcatgtacaaggccatctggtacgatcagtttacttgcccggacggatttttgttgcggggacccgagttctag

SEQ ID NO: 48719 - DNA, 1833 bp, Artificial Sequence
  Description of Artificial Sequence: Synthetic coding sequence
atgcatttccaagccttttggctgtgtctcggtctgctgttcatttcaataaatgccgagtttatggacgatgacgtggaaaccgaagattttgaggagaatagtgaagagatcgatgtgaatgaatcagagctctcaagtgagataaaatacaaaacccctcaaccaatcggcgaagtgtacttcgcagagacctttgactctggtaggctggctggatgggtcctgtccaaagctaaaaaggacgatatggatgaagaaatctcaatctacgatggaaggtgggagattgaagagctcaaagagaaccaagtgcctggtgataggggactcgtgctcaaatctagggcgaaacaccacgctatctcagccgtgctcgcaaagccatttatctttgccgacaaaccattaatcgtccagtatgaggttaacttccaggacgggatcgattgcggaggggcatatattaaactgctggctgataccgatgacctgattcttgagaatttctatgataaaacttcctacataattatgttcggacccgataagtgtggtgaggactataaactccactttatcttcaggcacaagcaccctaagacaggggtctttgaagagaagcacgctaagccccctgacgtggatctaaagaaattttttacagatcggaagacgcatctgtacactctggtaatgaaccccgacgacacttttgaagttctggtggaccagaccgttgtgaataagggttctttgctcgaggacgtagtgcctcccatcaagcctcccaaggagatagaggaccccaatgataagaagcccgaggagtgggacgagcgggcaaaaatacctgatccgtcagccgttaagccagaggactgggacgagagcgagcctgcccagatcgaggactcatcagtagtcaaacccgcagggtggctggatgacgaaccgaaattcattcccgatcccaatgctgaaaagccagatgactggaatgaggacacagatggcgagtgggaggctccccaaatactcaaccccgcttgtagaatcgggtgtggggagtggaaacccccaatgattgacaaccccaagtataaaggcgtctggagacctcctttggttgataaccctaactatcaggggatttggagccctcgaaaaattcccaaccctgactattttgaggacgaccaccccttcctgctgacgtcttttagtgccttggggctggagctgtggagcatgacaagcgacatctacttcgataacttcataatatgttcagagaaggaagtcgctgatcactgggcggctgatggttggaggtggaaaataatgattgctaacgcgaacaagccaggagttctgaagcaacttatggcggcagctgaaggacacccatggttatggctcatctaccttgtgaccgccggtgttcccatcgctctaattacgtctttttgctggccacgcaaggtaaaaaagaaacataaggacacggagtacaaaaagactgatatctgtattccgcaaaccaagggcgtgttggagcaggaggaaaaagaggaaaaagcagctctggaaaagccaatggatctggaggaggagaaaaaacagaacgacggggaaatgttggaaaaagaggaggaatcggagcctgaggaaaaaagcgaggaggagatcgagatcattgagggccaggaggaatccaaccaatccaataagtccgggagcgaggatgagatgaaagaagccgacgagtccaccgggtctggagatggtcccattaaaagtgtgagaaagagaagggttcgtaaagactag

SEQ ID NO: 48720 - DNA, 1833 bp, Artificial Sequence
  Description of Artificial Sequence: Synthetic coding sequence
atgcacttccaggcattctggctttgtctcgggctcctgttcatatcaataaacgcagagtttatggacgacgatgtggaaactgaagacttcgaggagaattctgaagaaatcgacgtaaatgagagcgaactgtcgagcgagattaaatacaagacccctcagcccataggtgaggtgtactttgcagaaacctttgacagcggcagactggccggatgggtactgtctaaggctaaaaaggacgatatggacgaggagatcagcatatacgacggccgatgggagattgaggagctgaaggagaaccaggtgcctggcgatagaggactagtgctgaagtctcgggcaaaacaccatgctatcagtgctgtcctggctaagccgttcatctttgctgataaacctctaatcgtgcaatatgaggtgaattttcaggacgggatagactgtggcggagcctatattaaactgctggccgacactgatgacttgatcctagagaacttctatgacaaaacttcctatatcataatgtttgggcctgacaagtgcggcgaggactacaagcttcatttcatctttaggcacaagcaccccaagaccggagttttcgaggagaagcacgccaaacctccggatgtagacttgaaaaagttttttacagatagaaagacgcacctgtataccctggtcatgaatccagacgacacctttgaggtcctggtggatcagaccgtggtgaacaaaggctcacttctagaggacgtcgtccccccaataaaacctccgaaagagatcgaggatccgaacgacaagaaacccgaagagtgggacgaacgtgccaaaatacccgacccttccgcagtgaaaccagaagattgggacgagagcgagccagctcagattgaagattcaagtgtagtaaagcctgccggatggctggacgacgagcccaagtttattcctgaccctaacgccgagaagcccgacgattggaatgaggataccgatggcgaatgggaggccccacagatcctgaacccggcatgcaggattggatgtggcgaatggaaacctcctatgattgataatcctaaatacaaaggggtctggagaccacccctggtcgacaatccaaactaccagggtatttggagcccacggaaaatcccgaatccagactatttcgaggacgaccacccctttctcctgactagtttttccgcactcggactggaattatggtctatgacctccgacatctactttgataatttcattatttgcagtgagaaagaagtcgcagatcattgggcagctgacggttggagatggaagataatgatagccaatgcaaacaaacctggcgttctgaaacaactgatggcggctgccgagggccatccttggctttggctgatctatcttgtgaccgcgggtgttccaatcgccctgattacttcattctgctggcccagaaaggtaaagaaaaagcacaaagacacggagtacaaaaaaactgatatttgtatcccacagaccaaaggggtgctggagcaggaagaaaaagaggaaaaagccgctctagaaaagccaatggatttggaggaggagaagaaacagaatgacggcgagatgctcgagaaagaggaagaaagtgaacccgaagaaaagtctgaagaggagatcgaaatcattgaggggcaggaggaaagtaaccagtcaaacaaatccggctccgaagatgagatgaaggaggccgacgaatcaactgggtctggagacgggcctattaagtctgtacggaaacgccgtgtgaggaaagattag

SEQ ID NO: 48721 - DNA, 540 bp, Artificial Sequence
  Description of Artificial Sequence: Synthetic coding sequence
atgcactttcaagcattttggctgtgtttaggccttctttttatcagcatcaatgccgagttcatggacgacgatgtggagaccgaagacttcgaagagaacagcgaagagattgacgtgaacgagtctgaattgtcctccgagataaagtacaaaacgcctcagccgatcggtgaggtctacttcgccgaaacttttgactcagggcgtctagccggatgggtgctctccaaagccaaaaaggacgatatggatgaggaaatatctatatatgatggcaggtgggagatcgaggagctgaaagaaaaccaggtccctggggataggggcctggtgctgaagagtagggctaaacatcacgcaatttccgctgtcctcgctaagccctttatttttgccgacaagcctctaatcgttcaatacgaagtgaacttccaggacggcattgactgcggtggagcctacatcaaactactggcagacactgacgacttaattctggagaatttctatgataagacctcctacatcatcatgtag

SEQ ID NO: 48722 - DNA, 1833 bp, Artificial Sequence
  Description of Artificial Sequence: Synthetic coding sequence
atgcactttcaggccttctggctttgtctcggcctacttttcattagtattaacgccgaattcatggacgatgacgtcgaaacagaggactttgaggagaattccgaggaaatcgatgtgaatgaatccgagctgtcctctgagataaaatataagaccccccaacctattggcgaagtctatttcgccgagacattcgacagcgggagactggctggctgggtgttatctaaggccaagaaagatgacatggacgaggagatctcaatttacgacgggcgatgggagattgaggagctgaaagaaaaccaggtacctggcgaccgtggacttgtccttaagagtcgcgctaagcatcacgctatctccgccgtgttggccaaacccttcattttcgcagacaagcctctgattgtccagtatgaagttaattttcaagacggaatagactgcgggggtgcatatatcaagcttcttgccgacacagatgacctgatcctggagaatttctacgacaagacatcctatattatcatgttcggcccagataagtgcggggaggattataaacttcactttatttttagacacaaacaccctaagactggagtgtttgaggaaaaacacgccaaaccgccagacgtggatttgaaaaagtttttcaccgatagaaaaacacatctttacacactggtcatgaatccagacgacacatttgaagtattagtggaccagacagtggtgaacaagggcagtttgttggaggacgtagttcctccaattaaacccccaaaggaaatagaggatcctaatgataaaaaacccgaagagtgggacgagcgcgcaaaaatccctgatccctctgcagtgaagccagaggattgggatgagagtgaacccgcacagattgaagactcttccgtagtgaagcctgcagggtggctggacgacgaacctaagtttattcccgacccaaacgcagaaaaaccagatgactggaacgaagatacagacggtgagtgggaggctccacaaattctgaatccagcctgccggattgggtgtggtgagtggaagccacccatgatcgacaatccaaagtataagggcgtatggaggcctcctctagttgacaatccaaactatcagggcatctggtcaccgagaaaaatccctaatccagattatttcgaggacgatcatccttttcttctcacctctttctcagcccttggcctggagctgtggtccatgacctcagacatttatttcgacaacttcatcatctgcagtgaaaaggaggtggccgatcattgggccgctgatgggtggagatggaaaattatgattgctaacgctaacaagccaggtgtgctgaagcagttaatggccgctgcggaaggccacccctggctctggctcatctaccttgtgaccgcaggcgtgccaatcgcacttataacgagcttttgttggcctcgtaaggttaaaaagaaacacaaggatacagagtacaagaagaccgatatttgtattccccagactaagggcgtattggagcaggaagaaaaagaggagaaagcagccttagagaagcctatggacttggaggaagagaagaaacagaacgatggcgagatgctcgaaaaagaagaggagtccgaaccggaggaaaaatctgaagaggaaatagagattattgaggggcaggaggagtcaaaccagagtaataagagtgggagcgaagacgaaatgaaggaagctgatgaatctaccgggagcggcgacgggcctattaaatccgtccgaaaaagaagagtgcgtaaggattag

SEQ ID NO: 48723 - DNA, 1584 bp, Artificial Sequence
  Description of Artificial Sequence: Synthetic coding sequence
atggatgaggagatttctatctacgatgggaggtgggagatcgaagaactgaaggagaaccaggtgccaggggatcgtggacttgttctgaaatcccgggcaaaacaccacgccatctcagctgtcctcgccaaaccttttatcttcgccgacaaaccattaatagttcaatatgaggtgaatttccaagatgggatcgactgcggaggagcatacattaagcttttagcagatacagatgatctcatacttgagaatttctacgacaagacaagttacattattatgttcgggcctgacaaatgcggggaagactacaagttgcacttcatatttcgtcataaacatcctaagactggggtgtttgaggaaaagcacgctaagcctcctgatgtggacctgaagaaatttttcaccgatcgaaagactcacttgtatacactggtcatgaatccagatgatacctttgaggttctggttgatcagacagtggtgaataaagggtccctccttgaagacgttgtcccaccgatcaaaccgccaaaggagatcgaggatcctaacgacaagaagccagaagaatgggatgagagagctaagatccctgatccttctgcagttaaacctgaagattgggacgaatctgagcctgcgcaaatcgaggacagctcggtggttaagccggctggctggctagacgacgagccgaagttcattccagaccccaacgctgaaaaacccgatgactggaacgaggacaccgacggggagtgggaggcccctcagattctgaacccggcatgtaggatcggctgcggagaatggaagccacctatgatcgacaatcccaagtacaagggggtgtggcggcctcccctcgtcgataacccaaattaccaagggatctggagcccacggaaaatcccaaacccagactactttgaagacgatcatccttttctgcttacatctttctccgcccttgggcttgagctgtggagtatgacaagtgacatctacttcgacaattttatcatctgtagtgagaaagaggtcgccgatcactgggcagccgacggctggcgttggaaaattatgattgccaatgccaacaaacccggagttctgaagcagttaatggccgctgctgaggggcatccctggctgtggttaatctacctagtgactgccggtgtccctattgccctgattacctcattttgttggccaagaaaggtgaaaaaaaagcacaaggatactgagtacaagaagactgacatctgtatcccacaaacaaaaggtgtgttagagcaggaagagaaagaggaaaaggcggcattagaaaagccgatggacctggaggaggaaaagaagcaaaacgatggagaaatgctcgaaaaggaagaagaatccgagcctgaagagaaatccgaagaagagatcgaaatcatcgaggggcaagaggagtccaaccagagtaataagtctggatctgaggatgagatgaaagaggccgatgagagcaccggatctggtgatgggcctattaaaagcgtgcgaaaacgcagagttcgtaaggactag

SEQ ID NO: 48724 - DNA, 3750 bp, Artificial Sequence
  Description of Artificial Sequence: Synthetic coding sequence
atggtcgaggccgcaccgcctggcccaggcccactgcgacggacttttttagtccccgaaattaagagtctcgatcaatacgacttttccagagctaaggcagctgcaagtctggcttgggttctccgcgcagccttcggcggagcagagcatgtcccacctgaactgtgggagcccttctacactgatcagtatgcacaggagcacgtcaagccacctgttaccaggctgctactgagtgccgaactctactgtagagcctggcgacaggctctgccacagttagaaacaccgccaaatccttccgcgctgttggcactcctggctagacgagggactgtccctgcactcccagaacgccctgtgagggaggcggacctgaggcaccagcccatattgatgggtgcccacttagcggtgatcgacgccctgatggcggcattcgcatttgaatggactaagacgctgcctggcccactagctctgacatctctcgagcataaactgttgttttgggtggacacaaccgtccgtcggctccaagagaaaactgagcaggaggctgcgcagagggcgtcacccgcagcccctgccgatggagccgctccggctcagccttctatccggtatcggaaggaccgagttgtggccagacgcgctccttgctttcctacggtcacatccctccaagatctagcttctggggctgccttagcagcaacaatccactgctactgtccccagctgctgcgcttggaagaagtctgtctgaaagacccaatgtccgtagccgactctttgtataatctgcaactggtgcaggacttttgtgcctcccgtctacctcgtggttgccccctgtccctggaagatctactctatgtgccccctccgctgaaggtaaatctcgtcgtcatgctcgcagaactttttatgtgctttgaagttctgaaacccgattttgtgcaggttaaagacctcccggatggtcacgccgctagcccgagggggacagaggccagtccacctcagaacaattcagggagcagcagccctgtgttcaccttccgccaccccctgctctcctcagggggaccacaaagcccattgaggggttcaacaggttccctgaagtcttctcccagcatgagccacatggaagccctgggaaaggcatggaatcgtcaactgtctcgacccctgagccaggctgtgtctttctccactccttttggcctcgactctgacgtcgacgtggtgatgggggacccagtcttactgcgcagtgtgtcctcagacagcctgggtccaccccgtccggctccggcaaggacgcctacacagcctccacctgaacctggagacctgcctactatcgaggaagctctccagattattcatagcgctgaacctagactccttcccgatggggctgccgacggatctttctacctccacagtcccgagggaccttctaaacccagcctggcgtccccttatctgccagagggcaccagcaagccactgagtgatcgccctactaaggcccctgtgtacatgcctcacccggaaactccctccaaacccagtccgtgcctcgtgggtgaagccagtaaacctccagccccatcagaaggatcgcccaaggcagtcgcttcttctcccgctgccacaaattctgaagtcaagatgacgtctttcgcggagaggaaaaagcagctggtaaaggctgaggcagaagccggagctggaagtcccacttctactcccgcacccccagaagcccttagctccgagatgagcgaactgtccgcgagacttgaggagaaaagacgcgctattgaggcccaaaagcggaggattgaagccatcttcgcaaaacatcggcagcgccttggtaaatcagcctttctacaggtgcagcctcgggaagcatcaggagaggcggaagccgaggcagaagaagccgacagtggacctgttccaggaggcgaacgtcccgcaggagagggtcaaggagagcccacgagccgacccaaggcagtgacattcagccctgacctgggtccagtcccccatgaaggactcggagagtacaatcgagctgtgagcaagctctctgcggctctttcaagcctgcagcgagacatgcagcggctgaccgaccagcagcagaggcttctggctccgcctgaagcacccggttcagcccctcctccagccgcttgggtgatccccggaccgacaacaggcccaaaagcagcgagtccctcgccggctaggagagtccccgcaacacggcgatcaccaggccctggccctagccaatcgcctagatctcctaaacacaccaggccagcagaattgcgcctggcccctctcaccagggttctgactcctccgcacgatgtggattcactccctcatctgcgaaagttttccccgtcacaggtacccgtacagacacgcagcagcatccttttggcagaggagacccctccagaggagccagccgcaagaccaggactcatagaaattcctctgggtagccttgctgaccctgccgctgaggatgagggcgacggctcccctgccggtgccgaagattccctcgaggaggaggctagctctgagggcgagccaagagtggggctcggctttttctacaaagacgaggataagcctgaagacgaaatggcccagaagagggcatctctcctggaacgccagcaacgccgagcagaagaagcccgaaggcgcaaacaatggcaggaagtcgagaaggagcaacggagagaagaagctgcacgtcttgcccaagaagaggctcccggtcctgccccattagtatccgcggtgcctatggcaacacctgcccctgcggctagagcccctgcggaagaagaggtgggtcccagaaagggcgattttactcgacaggagtatgagagacgcgctcagcttaagctcatggacgacctagataaagtcctcagaccaagggccgcaggtagcggaggccctgggagagggggtaggcgggctactcggcctagatcagggtgctgcgacgactccgcactcgcacggtctccggctcgaggcttacttggatcaagattgagcaaaatatatagccagtcgacgctgtccctgagcaccgtcgctaatgaggcccacaataatctcggtgttaaaaggcccaccagccgcgcaccctctccttcgggtttaatgagcccctcacgtcttcccggttcgcgggaaagggattgggagaacggttctaatgcgagtagccctgccagtgtgcccgaatacacaggaccccgtttgtataaggaacctagcgccaaatccaataaatttataatccacaacgctttatcccattgttgccttgcgggtaaagtcaatgaaccccagaaaaacagaatactggaagagatcgagaagtctaaagctaatcactttctgatcttattccgggactctagctgtcagtttcgtgcgctgtatactctttcaggtgagacagaggagcttagtcgactcgcaggttacggccctagaaccgtcactcctgctatggttgagggcatatataagtacaattcagataggaaacggttcacccagattccggctaaaactatgtctatgagtgttgacgcatttaccatccaaggacacctttggcagggcaagaaaccaacgaccccgaaaaagggcggtggcactcctaagtag

SEQ ID NO: 48725 - DNA, 3831 bp, Artificial Sequence
  Description of Artificial Sequence: Synthetic coding sequence
atggtggaggccgcaccgccaggcccagggccattgaggaggactttcttagtccccgagataaagtccctggaccagtacgatttctctagagccaaagctgccgctagccttgcatgggtattgcgcgcagctttcggtggtgccgagcacgtccctccagaactgtgggagcccttctacacagatcagtatgctcaagagcatgtgaagcctcccgtcacaaggctattgttatccgccgagctgtattgtagagcatggcgccaagcgctgccacagttggaaaccccacccaatccttccgccctgctggctctgctggccaggcgcggaaccgtgccagccttaccagaacgcccagtgagagaggcagacctgagacaccagcccattctcatgggggctcacctcgctgtgatcgatgcgctgatggccgcattcgctttcgagtggacaaagacgcttcccggacctttagccctcacctcccttgagcataaattattgttttgggtggataccaccgtgaggagactgcaggaaaaaacagaacaggaggcagcccagagggcatccccagccgcacccgcagatggtgcagccccagcccagccatcatgccctactcggtggtactggaaattagtaccccacgccatcgctttttgcttgaaagagtccggatccaaaccgccaatgatacgctatagaaaggatagagtggttgctaggcgtgcaccatgctttccaactgtgacctctttgcaggacctggccagcggggctgcccttgccgcaactattcattgttattgtccacagcttttgaggctggaagaggtgtgcctgaaggatcccatgtctgttgccgatagtctctacaatctacagctggtccaggatttctgcgcctctcgtctccccaggggctgtcctctctctttagaggacctcctgtacgtccctccccctctaaaagtcaacttagtcgtcatgctggccgaactctttatgtgctttgaagtactgaagccagacttcgtgcaggtaaaggacctgcctgatggccatgccgcttctcccagaggaactgaggcaagcccccctcagaacaatagtggcagcagttcacctgtgttcacgtttaggcatcctttattgagttccggcggtcctcagtcccctctcagaggcagcaccggttccctcaaatcatccccctccatgtcgcacatggaggctctgggcaaggcttggaaccgccagttaagtagaccactatctcaggccgtctccttttccaccccctttggactggattctgacgtggatgtcgtgatgggggatccggtgctcctgaggtccgtctctagcgacagcttaggtccgcctcgacctgcacccgcacggacacccacgcagcctccacccgagccaggcgatctgcccacaatcgaggaggccctgcagatcattcatagcgccgagccacgcctactgccagatggcgctgccgatggtagcttctatctccattctcctgagggcccttcaaaaccaagcctggcatcaccttaccttccagaagggacctcgaaaccactgtctgatagacccaccaaagccccagtgtatatgcctcatccggagacgccgtccaagcccagcccctgcttagttggcgaagcaagcaagccccctgccccttctgagggttcccctaaagcagtggcttctagtcccgctgctaccaactctgaggttaaaatgacaagctttgccgaaaggaagaaacagctcgtgaaagccgaggcagaggctggcgcaggatcccctacatccacgcctgcacctccagaagctctatcctcagagatgagtgagctgtcagcgaggctggaggaaaagcgcagagccatcgaggcacagaagcgaaggattgaagcgattttcgcgaagcaccgtcagagactggggaaatccgccttcttgcaggtgcagcctcgggaagccagcggcgaagcagaggcggaagcagaagaggcggacagtggaccagtcccgggaggcgagcggccagcaggtgaagggcagggagaacccaccagtcggccaaaagctgtgaccttttctcccgacctgggcccagtacctcatgaggggctgggcgaatataatagagccgtcagcaagctcagtgctgcactgagctcacttcagagggatatgcagaggctcaccgaccagcaacagaggctgctagccccacccgaagcacccggatctgccccacctcctgcagcatgggtgattcccggacctaccacaggccctaaggctgcttcaccttctccagctaggcgcgtgcccgctacccgcagatctccaggccctgggccttctcagtcaccaaggtccccgaaacacacaagacccgcagaactgaggctagcacccttaactagagtgctgacacctcctcacgatgtcgattccctgccacatctgcggaagttttctccctctcaggttcccgtccagacacggtcgtctatcttgcttgcagaggaaacacctcctgaagagcctgccgctcgcccaggattaatcgaaatacctctaggcagcctggccgaccccgcagcagaggatgaaggcgatggctcgccggctggcgcagaggatagccttgaagaggaggcctcttccgagggtgaaccgagagtcggcctcggatttttttataaggacgaggataaaccagaggatgagatggcccaaaagcgagcgtcacttctggaacggcagcaacggagggccgaggaggctcgtcgccgaaagcagtggcaggaagtcgaaaaagaacaaaggagagaggaggccgctcgcctggcccaggaggaagcccctggtcctgcgccactcgtttcagccgtgcctatggccacacctgctccagctgcacgagctccagctgaagaagaggtggggcctcgcaaaggcgacttcactagacaggagtacgagagaagagcacaacttaaactgatggatgatctggataaggtgctgagacctcgcgcagcgggttccggcggtccaggtcggggtggcagacgtgcgacaagaccaagatctggatgctgcgacgattctgcccttgctaggtcccctgcgcgtggacttctggggtcacgcctcagtaaaatatatagccagtccacgctgtcacttagtactgtcgcaaacgaagcccacaacaacctgggagtgaagcgacccaccagtcgagcccctagcccttccggccttatgtcacctagtcggctgccagggagccgcgaacgcgactgggagaatggcagcaatgcgagttctcctgcgagcgtacctgaatatacggggcctaggctgtacaaggagccatctgcgaaatctaataaattcataatccataatgctctcagccattgctgtctggcaggaaaagtgaacgagccccagaagaataggatactcgaggagatcgagaagtctaaagcaaaccatttcctgattttgttccgggactctagctgtcagttccgcgctctatacacactgagtggtgaaacagaagaactgagccgcctggccggatatggccctagaactgtgacacccgcaatggtggaggggatctacaaatataacagcgaccgcaaacgattcacacagatccccgctaagacaatgtctatgtccgtagacgcctttacgatacaaggacacctctggcagggcaagaagccgactactcccaaaaagggaggtggcaccccaaaatag

SEQ ID NO: 48726 - DNA, 660 bp, Artificial Sequence
  Description of Artificial Sequence: Synthetic coding sequence
atgcccttccaccacgtcacagccggtctgttgtataagggcaattatttgaatcgtagcctgtccgcgggtagcgattcagaacagctagcaaacattagcgttgaagaactggacgaaataagggaagcattccgcgtattggaccgcgatggaaatggcttcatcagtaaacaggagctaggaatggccatgaggagtctgggctacatgcctagcgaggtcgaactggccataatcatgcagcgcctagatatggacggcgatgggcaagttgatttcgacgaatttatgacaattctggggcctaagctggtgagcagtgaggggagagacggttttctcggcaatacgatcgactcaattttttggcagttcgacatgcagcgaataaccctcgaagagctcaaacacatcctgtaccatgcgtttagagatcatctaaccatgaaggacatcgaaaacatcataataaacgaggaggagagcctgaacgaaaccagtgggaactgccagactgagtttgagggagtgcacagccagaagcaaaacaggcaaacctgtgttcgaaagtccctgatctgcgcctttgccatggcttttataatatctgttatgcttatcgccgctaaccaaattctgagatccggcatggagtag

SEQ ID NO: 48727 - DNA, 786 bp, Artificial Sequence
  Description of Artificial Sequence: Synthetic coding sequence
atgaggctgcccgagcagccaggcgaaggtaagcccgagaatgaaaaaaagggtgacggcggagctctgggcggaggcgaggaaccaccacgctcccaggcgcctgatttccccacgtgggagaaaatgcctttccaccacgtgactgccggtcttctgtataaaggtaactacctcaatcgtagcttgagtgcaggctccgactcagagcagctggctaacatcagtgtcgaagagctagatgaaatcagggaggcgtttagagtgctggatcgtgatggtaacggctttattagtaagcaagaactggggatggctatgagatcattagggtatatgccaagtgaagtcgagctggccatcatcatgcagcgcctggacatggatggcgatggacaggttgatttcgatgagttcatgaccatattggggcctaaacttgttagcagcgaggggagggacggtttcctgggtaacaccattgattcaatcttctggcagtttgacatgcaacggatcaccctcgaggagctcaaacatatcctgtaccatgcttttcgagaccacctcacaatgaaggacatagagaacatcataattaacgaggaggagtccctgaacgaaacctcgggtaattgtcagaccgaattcgaaggcgttcattctcagaagcagaatcggcaaacgtgcgttcggaagagtctgatttgcgcttttgctatggcttttatcatttcagttatgttaatcgctgcgaaccagattctgcggagcggaatggagtag

SEQ ID NO: 48728 - DNA, 660 bp, Artificial Sequence
  Description of Artificial Sequence: Synthetic coding sequence
atgcccttccatcatgtgacagcaggcctactttacaaaggcaattaccttaacagaagccttagcgccggatctgattctgaacagctcgcaaacatatcggtggaggaattggatgagattcgagaggccttcagagtcctggacagggatgggaacggctttattagtaagcaagaacttgggatggctatgcgctcattgggatatatgcccagcgaggtggagttagcaataataatgcagagactagatatggacggcgatggccaggtggactttgatgagttcatgaccattctgggtccaaaactcgtcagttccgagggccgtgacggtttcctagggaacacaattgacagtatcttctggcagtttgacatgcagcgcatcaccctggaggagctgaaacacattctttatcatgcattcagggatcatctcacgatgaaagacatcgagaatattattatcaatgaggaagagtcactgaacgaaacgtcagggaactgtcagacagagttcgagggggtgcactcccagaagcaaaatagacagacatgcgtccgcaagtcccttatttgcgcctttgccatggcttttataatcagtgtgatgttgatcgccgctaatcagattctgagatccgggatggaatag

SEQ ID NO: 48729 - DNA, 660 bp, Artificial Sequence
  Description of Artificial Sequence: Synthetic coding sequence
atgccttttcaccacgtgactgccggtctactgtataagggcaactatttgaacaggagcctgagtgctggatcagattcagagcaattggcaaacatttcagtcgaggagctggatgagattagagaggccttcagggttctcgatcgggacggcaacggatttattagcaaacaagagttggggatggccatgcggtccctcggctatatgccctcagaggtcgagttggcaatcattatgcaaaggttagacatggatggtgatggtcaggtggacttcgacgaattcatgaccatactgggacctaaactggtcagttcagagggacgtgatggctttctcggtaacaccattgactccatcttctggcagtttgatatgcaacgtataaccctggaagagctaaaacatatcctgtatcacgcctttagagaccatcttactatgaaagacatagaaaacatcatcattaatgaggaggagagcttgaacgagacatctggcaactgccagactgagtttgagggtgtccattcccagaagcagaaccgtcagacctgtgtgaggaagagcttgatctgtgcctttgccatggcttttatcatatcagtgatgctcatcgctgctaaccagatccttagatctggcatggaatag

SEQ ID NO: 48730 - DNA, 786 bp, Artificial Sequence
  Description of Artificial Sequence: Synthetic coding sequence
atgcgcctccccgagcagcctggcgagggaaagcccgagaatgaaaagaaaggagatggaggggctctggggggtggcgaagaaccaccaaggagtcaagctcccgattttccaacgtgggaaaagatgccgtttcaccacgttactgcaggcctgctctataagggaaattatctgaatagatcattaagtgccggaagcgattcagaacagttagctaacatctctgttgaggagttagatgagattagagaagcctttcgggtcctggaccgcgacggcaacggattcatctcgaagcaggagttaggtatggccatgcggagcctgggatatatgccgtccgaagttgagctggccatcatcatgcagcgcctggatatggatggcgatggtcaagtggattttgacgagtttatgacaattctcggtccaaaactggtgtcttcagagggtcgcgatgggtttctcgggaataccatagattctatcttttggcagtttgacatgcaaaggattaccctggaagagctcaagcatattctctaccacgcttttagggatcatcttactatgaaggatatcgagaacataatcattaacgaagaagagtccctgaatgagacttcagggaactgccagactgagttcgagggcgtgcactcacaaaagcagaatagacagacttgtgtgcgaaagtccctcatatgtgcttttgcgatggcgtttatcatttcagtcatgcttatcgcagctaaccaaatccttaggagtggaatggagtag

SEQ ID NO: 48731 - DNA, 660 bp, Artificial Sequence
  Description of Artificial Sequence: Synthetic coding sequence
atgcctttccaccacgtgacagctggcttgctgtacaaagggaactacctgaaccggtccctgagcgccggttccgattctgagcagctggcaaatatctctgtggaagagttggacgagatcagagaagcatttagggtactggacagggatggcaatgggttcatttccaagcaagagctagggatggcaatgcgctctctcggctacatgccctctgaggtggagctcgccatcatcatgcagcgtttggacatggacggcgacggccaagtggatttcgacgaattcatgactatactcggaccaaagctggtgtccagtgaagggagggacggatttctgggcaacactattgactcgattttctggcagtttgacatgcaacgtatcacattggaggaactgaagcacattctctatcacgcttttagggaccacctgaccatgaaagatatcgagaatattatcattaacgaagaagagtctctgaacgagacgtctggcaactgccagactgagttcgagggcgttcactcccagaaacaaaatcgacaaacttgcgtgcgtaagagcctgatctgtgcatttgcaatggccttcattatctccgtgatgttgatagccgctaatcaaattctgaggtccggtatggagtag

SEQ ID NO: 48732 - DNA, 378 bp, Artificial Sequence
  Description of Artificial Sequence: Synthetic coding sequence
atgccttttcatcacgttactgccggactgctctataagggcaactatctcaaccggtccctgtctgccggaagcgacagtgaacagctggcaaatatttccgtggaagaattggatgagatccgtgaggccttccgggtgctggatagggacggcaacggcttcatttcaaagcaggagctgggtatggccatgcgcagcctggggtacatgcccagcgaagtagagctggccattatcatgcaacgtctagatatggatggggatggacaggtagacttcgacgagttcatgaccattttgggccctaaactggtcagtagcgaaggcagagacggatttctcggcaatacaattgacagcattttttggcagtag

SEQ ID NO: 48733 - DNA, 747 bp, Artificial Sequence
  Description of Artificial Sequence: Synthetic coding sequence
atgtttctggcgaaggcattactcgagggggctgacaggggactgggggaggccttgggagggctcttcggtggtgggggtcagcgacgggaaggaggcggaaggaatattggcggtatagtggggggaatagtgaacttcatctctgaggcagccgctgcacagtacacaccggaacctccacctacccagcagcactttactagcgtggaggcctccgagtcagaggaggttcggcgattcagacagcagtttacacagctggctggcccagacatggaggtaggggctactgatttgatgaacatattgaataaagtcctgagtaaacataaggacctaaaaacagacggctttagtcttgatacctgtaggagcatagtctctgtgatggactccgacacaactggtaagcttgggtttgaggaattcaagtacctatggaacaatattaaaaagtggcagtgtgtttacaagcagtatgaccgcgatcacagtgggtcccttgggagttcacagcttcgcggagcactccaggctgcgggatttcagctgaacgagcagctgtaccagatgattgttcgcagatatgcgaatgaggacggtgacatggacttcaacaactttatatcgtgtctagtgaggttggatgcaatgttccgcgcattcaaatctctggacagagacagggatggcctcattcaagtctctataaaggaatggctccaacttactatgtacagctag

SEQ ID NO: 48734 - DNA, 2868 bp, Artificial Sequence
  Description of Artificial Sequence: Synthetic coding sequence
atgcttcccggtcgcctgtgttgggtccccttactgctcgctctaggggtgggatcaggttctgggggtggcggagattcccgccaacgtcgtttactcgcggcaaaggtgaacaagcacaaaccatggattgagacaagctatcatggcgtgatcacagaaaacaacgacactgtcatcctggacccccctctggtcgccctggacaaagatgcaccagtaccattcgcaggtgagatatgtgcttttaagattcacggacaggagctaccttttgaggctgtggttctgaataagacaagtggcgagggaagactgcgtgctaaatcgcctatcgattgtgaactccaaaaggagtataccttcataattcaggcttacgattgcggcgctggcccacatgaaaccgcatggaagaagagccataaagctgtggttcatattcaggtcaaagacgtgaatgagttcgccccaacttttaaggagcccgcttacaaggctgtggtgacggaagggaagatttacgatagtatactacaagtggaggccatcgacgaagactgcagtcctcaatattcacagatttgcaattacgagattgtgaccacagacgtgccttttgcaattgatagaaatgggaacatccgcaacactgaaaaactctcatacgacaagcagcatcagtacgagatcctcgttacagcctatgactgcggccaaaagccagccgcacaggacactctcgtccaggtcgacgtcaaacctgtctgtaagccaggctggcaggactggactaaacgaattgagtaccagcctggctccggtagtatgcctctttttcctagcatccatcttgagacctgtgacggcgcagtgagctccttgcagattgtcaccgagctgcaaacgaactacatcggcaaaggatgtgatcgagagacatattccgaaaaatccctccaaaagctgtgcggagcctccagcggcatcattgatctcctcccttctccaagcgcagctactaattggacggcaggactgctcgtggacagtagtgaaatgattttcaagttcgatggccgacagggcgctaaggtgccggatggaattgttccgaaaaatctcacagatcagtttactataactatgtggatgaaacatgggcctagccctggggtgagggccgaaaaggaaactatcctctgtaacagtgataaaaccgaaatgaatcgccaccactacgctttatacgtgcataactgtaggcttgtgtttttactgcggaaggacttcgatcaggctgatacgtttcggcctgcagagtttcattggaagctggaccagatatgcgacaaggagtggcactattacgttatcaacgttgagtttcctgtcgtgaccctttatatggatggggcaacctacgagccttaccttgtcacaaatgactggcctatccatccatcacacattgcaatgcaactcactgtgggcgcttgctggcaggggggtgaagttacgaagcctcagttcgctcaattctttcacggcagtttggcctctcttaccatacggcctggaaaaatggaaagccagaaagtcataagttgcctacaggcctgcaaggaggggttagatataaatagtttagagtccctcggacagggaataaaataccacttcaatccatctcagtcaattttggtgatggagggcgacgacatcggaaatattaaccgagcactgcagaaggtgtcttacatcaattcacgacagttccctacagcgggtgtgaggcggctcaaagtttcctccaaagtgcagtgctttggtgaggacgtatgtatttccattcccgaggtggacgcatatgtaatggtgctacaggcgatagagccgcgtatcacattgcggggtacagaccatttttggaggcctgcggcacagttcgagagtgcgaggggtgtgacactcttccccgatatcaagatcgttagcacatttgcaaagaccgaggcaccaggagatgtgaagacaaccgaccctaagtccgaagtcttagaggaaatgctccacaacctcgatttttgtgatatcctggtgatcggaggggatttagaccccagacaggagtgcctggagctaaaccatagcgagctccatcaacggcatctggacgcaacaaactcaactgctgggtatagcatctatggtgtggggtccatgagtcgctatgagcaggtgctacatcatatcaggtatagaaattggcgcccagcatcactcgaggcaaggagatttcggattaagtgctccgagttgaacgggaggtacaccagcaatgaatttaatctagaagtatcgattctccatgaggaccaggtttccgacaaggagcatgtgaaccatctaatcgttcagcccccattcttacaaagcgtacatcacccggagtctcggtcttctatccagcacagctcggtggtcccatccattgctactgtcgtaataatcatttccgtatgtatgctagttttcgttgtagcaatgggcgtgtacagagtcaggattgctcaccaacattttatccaggagacagaggccgctaaagaatccgaaatggactgggacgacagtgcccttacaattacggtcaaccctatggaaaaacacgagggcccagggcacggagaagatgagacagagggggaagaggaagaggaggccgaggaggagatgtcatcttcttcaggctccgatgatagtgaggaagaggaggaggaggagggcatgggaagggggcgtcacggacagaatggcgcacggcaggcccagctggaatgggacgatagcacactgccctactag

SEQ ID NO: 48735 - DNA, 2871 bp, Artificial Sequence
  Description of Artificial Sequence: Synthetic coding sequence
atgactctgttgctgctgcctctgctgctcgcctcactattggcatcttgctcatgcaacaaggcaaataagcacaagccatggattgaagccgagtaccagggcatagtgatggaaaatgacaacacagtgctcctaaaccccccactgtttgctctggacaaggacgcccctctgcgctatgcaggcgaaatttgtggcttccgcctgcatggctctggcgtgccttttgaagccgtgatcctggataaggccaccggcgagggcctcatccgggcaaaagagccggtggactgtgaggcgcagaaagagcacacttttaccatccaggcctatgactgtggagagggcccagatggagcaaatacaaagaaaagccataaggccaccgtccatgtgcgggtgaatgatgtgaacgagtttgcccctgtcttcgtggaacgtctgtaccgcgcagcagtgaccgaggggaagttgtacgaccggattctcagggtggaagccattgacggcgactgctccccacaatacagccaaatctgttactacgagatcttgactccaaatacaccttttttgattgataatgacggcaacatcgagaacacggaaaagcttcagtacagcggcgaacggctgtataaatttaccgtcaccgcatatgactgtggaaagaagcgcgctgctgacgacgctgaagtcgaaatccaggtgaagccgacctgcaagcccagctggcagggttggaataagagaattgagtatgcacccggagccggaagcttggccttgtttccgggtatacggctcgagacctgcgatgaaccgctgtggaatatccaggccaccatcgaactccagactagtcacgtcgcgaaggggtgtgacagggacaactactcagagcgggcactcagaaaactgtgcggcgcagccacgggggaggttgacctgctaccaatgcctggacccaacgccaactggactgccggtctcagcgtccattacagtcaggactcttccctgatctactggttcaatggcactcaggccgtccaggtgccactgggcggaccttccggtctaggaagcggtccccaggattcattgagtgatcacttcacattgtccttttggatgaaacacggggtgacacccaacaagggtaagaaggaggaggaaacaatcgtttgtaacacagtgcagaacgaggatggctttagccactactcgctaaccgttcatgggtgccgcattgctttcctgtactggcctctgctagaaagcgcacggccagtgaaattcctgtggaaactggaacaggtttgtgatgacgaatggcatcactacgctctgaatctcgagttcccaactgtgacgttgtacacagacgggatcagcttcgacccagcccttattcacgataacgggttgattcatcccccaagacgcgagccggctttgatgatcggcgcatgctggacagaggagaagaacaaggagaaggaaaaaggagacaacagcactgatactactcagggtgatccactctctattcatcattacttccatggttatctggcaggtttttctgtgcgaagcggtcggttagagtctcgggaagttattgagtgcctgtatgcatgcagggaaggcctggactatagggactttgagagtttagggaaggggatgaaagtccacgtgaaccctagccaaagcttgctaaccttggagggggacgacgtcgagacatttaaccatgcactgcaacacgtagcgtacatgaacaccctgaggtttgcaaccccaggggtaagaccattacgacttacgacagcagtgaagtgtttttcagaagagtcttgcgtttccataccagaggttgaaggctacgtcgtcgtgctgcagccagacgctcctcaaattctacttagtggaacagctcacttcgccaggccagcagttgattttgagggcactaacggtgttcccctgtttcccgatctacaaatcacctgcagcataagtcatcaggtcgaggccaagaaggacgagagctggcagggaacagtgacagacactagaatgagcgatgagatagtacataacctcgacggttgtgaaataagcctggttggcgatgatctggatccggagcgggaatcacttttgttggacaccacatcgctccagcagcggggattagaactcaccaacacgtcggcttatttgactattgccggagtggagtccatcacagtttacgaggagatactaaggcaagccagatacagattaaggcatggggcagcactctacactaggaaattccggctgagctgttccgagatgaacggcaggtatagttccaatgagttcatcgtggaggtgaacgtgctccattctatgaatcgggtcgctcaccctagccatgtgctgtcgtcccagcaattcctgcatcgagggcaccagcctcctccagagatggccggtcactctttagcttcttcacaccgcaacagtatgatcccatctgccgctaccctgataatcgtagtatgtgttggctttctggtcctgatggtggtcctgggactggttaggatccactcactccaccgacgagtgagtggcgcagggggtcccccaggggcttcatcggatcctaaggatcccgacctgttctgggacgactcggcccttactatcatcgtgaatcctatggaatcttaccaaaaccggcagtcatgtgtgacaggcgctgtgggcggtcagcaggaggatgaagatagttctgacagcgaagtggctgatagcccttcaagcgatgaacgcaggattattgagacccccccacacagatattag

SEQ ID NO: 48736 - DNA, 2907 bp, Artificial Sequence
  Description of Artificial Sequence: Synthetic coding sequence
atggtgcttggctgcgagctgagcgggtctaccagagtcgtggtgggagtggaggctcttctgactggcgcatcatctccactccctggagtgggtccagcaaataagcataaaccatggatcgaggcagaatatcagggcatcgtcatggagaacgacaacaccgtgttgcttaaccccccactgtttgcgctggacaaagacgcgccattgcgttacgcgggtgagatttgcggcttcagactccacggtagcggcgtgcctttcgaggcagtgatccttgacaaagccacaggggaaggcctaattcgggcaaaagaaccagtggattgtgaggcacagaaagagcacaccttcacgattcaggcttacgattgcggcgaaggtcctgacggggctaacacgaaaaaatcccacaaggccacagtccacgtgcgggtgaatgacgtcaacgagttcgcgcctgtgttcgtggagagactctatcgcgctgccgtgacggagggaaaactgtatgaccgcattttgcgagtggaagccattgacggcgattgcagtccccagtactcgcagatttgttactacgaaatcttgacccctaacacgccttttctcatcgacaatgatgggaacatcgagaatactgaaaaactgcagtactcaggcgaacgcctttacaagtttactgttacagcttacgactgcggcaaaaagagagccgctgatgatgcggaggtcgaaattcaagtcaaacctacgtgtaagcctagttggcagggttggaacaagcgcattgaatacgcgccaggcgcaggtagtctggctctcttcccaggaattcgcctagagacgtgcgatgaacctctgtggaatatacaagcaacaatcgagcttcagacttcccatgtggctaaaggatgtgacagagataactactcagagcgcgctttgagaaaactctgcggcgcagctacaggggaggtggatcttctgcccatgccaggaccgaatgcgaattggacagccggattgagcgtgcattattctcaggattccagccttatctactggttcaacggaacccaggctgtccaggtccctcttggaggcccatcaggactcggctccggtccccaggactcactgtcagaccactttacgctctctttctggatgaaacatggcgttacgccaaataagggcaagaaggaggaagagactattgtgtgtaataccgtgcagaatgaagatggctttagccattactccctcactgtgcacggatgtagaatcgcctttctttattggcccttactagagagcgctaggcctgtgaagttcctttggaagcttgagcaggtgtgcgatgatgagtggcaccattacgcgctgaaccttgagtttcccacggtgactctgtacactgatggtatcagttttgatccggctctgattcacgataacggactcatccacccccctcgaagggaacctgccctcatgattggggcatgttggaccgaggagaagaacaaagaaaaggagaagggggataactctaccgataccacccagggggaccctcttagcatccaccactactttcacggttatctggcaggattctctgtgagatccggtagacttgagagccgtgaggtgatcgagtgtctgtatgcctgccgggaaggtctagattatagagactttgagtctctgggaaaagggatgaaggtacatgtaaacccctcccagagcctactgaccctcgaaggggacgacgtcgagaccttcaatcacgccctgcagcacgtcgcttatatgaacactttgagattcgcgacacccggagttcggccactgcgactcacaactgccgtgaagtgcttctccgaggagagttgtgttagcatccctgaagttgaaggatacgtggtcgtcttgcaaccagacgcccctcagatcctgttgagtggcaccgcgcacttcgcacgccctgctgtggactttgagggcacgaatggagtaccactgtttccggatctgcagattacttgcagcatttctcaccaggtggaggctaagaaggacgagtcctggcaggggacagtcaccgacacgcggatgagtgatgagatcgttcataacctggacgggtgtgaaattagtctggtcggggacgatctggacccggagagagagagtctcttgttggacacgacaagtttgcagcagaggggcctggagctgacaaacacgagtgcgtacctgaccatcgctggtgtggaaagcatcactgtgtacgaggagattctgcgacaggcaagatacagactccggcacggagctgccttgtacactcgcaagtttcgtctgtcttgctcagaaatgaatggtcgctactcctctaatgagtttatagtggaagtgaacgtgttgcacagcatgaaccgcgttgcacacccctcccacgtcctgtcttcgcagcaatttctgcaccggggacaccagccacctcccgaaatggccggtcattccttggcctcctctcaccggaattctatgatcccctcggctgctacactcataatcgtggtgtgtgtcggatttctagtgctcatggtggttctcgggcttgtccggatccactcgcttcacagaagggtgtcgggagccggtgggccacctggagcttcctcagacccaaaggaccctgatctgttttgggacgactccgccttaactattattgtcaaccctatggagtcttatcagaacagacagtcttgcgtcaccggcgctgttggaggacagcaggaggacgaggactccagtgactccgaggttgccgactctccgtcgtccgacgagagacgaatcattgaaactccacctcatcgctactag

SEQ ID NO: 48737 - DNA, 405 bp, Artificial Sequence
  Description of Artificial Sequence: Synthetic coding sequence
atgacattgctcctgcttccactgctgctggctagtcttctcgcctcctgctcctgcaataaggccaacaaacataagccctggattgaggccgaatatcagggaatagttatggagaacgacaacaccgttttactgaaccccccactgttcgcacttgacaaagacgctcctctgcgctatgccggagaaatctgcggctttcgccttcacggttcaggcgtgcccttcgaagccgttattctggacaaagccaccggggagggcctcattcgtgcgaaagagccagtggactgcgaggcccaaaaggagcacacctttactatacaagcttatgactgtggtgagggccctgacggagccaatacgaaaaagagccataaagcaacagttcacgttcgttag

SEQ ID NO: 48738 - DNA, 1422 bp, Artificial Sequence
  Description of Artificial Sequence: Synthetic coding sequence
atgccctttggatgcgtgacccttggggataagaagaactacaaccagccttcagaagttaccgatcgatatgacctagggcaggtgatcaaaacggaggagttctgtgagatattcagggccaaggataagacgacagggaaattacatacgtgtaaaaagtttcagaaacgcgatggcagaaaggtccggaaggcggcaaagaatgaaatcggtattttaaaaatggtaaagcaccccaacattctgcagctagtggatgtgttcgtgacacgtaaggagtactttatctttctcgagctggcaactggacgcgaggtctttgattggatcctcgatcagggatactatagcgagcgggacacatccaacgttgtgagacaggtgttggaagcagtggcctacttacattcactgaaaatcgtccacagaaacctcaaactggagaacctagtgtattacaaccggctcaaaaactccaagatcgttatttctgatttccatctggcaaagctggagaacggcctcatcaaagaaccttgtgggactcccgagtatctcggcaatcctcctttctacgaggaggttgaggaggatgattacgaaaatcacgacaagaacctcttcagaaagatcctggccggagattacgagttcgattcaccatactgggatgacataagtcaggcagcaaaggatctggtcacaagattaatggaggtggaacaagatcagcgcataacggccgaggaagcaatttcccacgagtggatttccggcaacgcagcaagcgacaagaacataaaggatggggtatgcgctcaaattgagaaaaactttgccagggcaaaatggaaaaaagccgtgcgtgtgacaacactgatgaaaaggctccgagctcctgaacaaagttctaccgctgccgctcagtctgccagtgcaaccgataccgccacacccggagcagctggcggagccacggcagctgcggcaagcggggcaacaagtgcaccagagggagatgccgcacgagcagccaagtcagacaacgtggctcccgctgatagaagcgccacgcccgctactgatggttccgccactccggctactgacggatcggtgacccccgcaaccgacggaagcataaccccagctacagatggatcggtcacccctgccaccgaccgttccgccacgccagccacggacggcagggcaacacctgcaaccgaggagtccacagtacctactacccagagcagtgcgatgctcgcaacaaaggctgccgcaactcccgagccagcgatggcgcagcccgatagcacagccccagagggagcgacgggccaggcccctccttcctcaaaaggtgaagaagccgctggttacgcacaagaatcccagcgggaggaggcttcatag

SEQ ID NO: 48739 - DNA, 1506 bp, Artificial Sequence
  Description of Artificial Sequence: Synthetic coding sequence
atgcccttcggctgcgtgacgctgggcgataaaaagaactacaatcagccctccgaagtgaccgaccggtacgacttgggacaggtgatcaagacagaggagttctgcgagatcttccgggcaaaagataagactactggcaagcttcatacttgtaagaaattccaaaaacgagacggccgaaaggtccggaaggcggcaaagaacgagatcggcatcctgaagatggttaagcaccccaacattctacagttagtcgatgtgtttgtgacacgcaaagaatacttcatttttctggaactggctacagggcgtgaggtgtttgactggatcctggaccagggttactactcagagcgggatacaagcaacgtcgtgcgtcaagtgctggaagccgtagcttacctacattcactcaaaattgtgcacaggaatctaaaactggaaaacctcgtgtactacaataggctgaaaaactcaaagattgtaatatcagatttccacctggctaaactcgagaacgggctgatcaaagagccatgcggcacaccggaatatctcgcccctgaggttgtgggacggcagcggtatggcagaccggtcgattgctgggcaataggcgtgatcatgtatatcctgctgtcaggaaacccaccattctacgaggaagtcgaggaagacgactacgaaaaccacgacaagaatctgttccgaaaaatactggccggagattatgagttcgacagtccatactgggacgatatcagccaggctgcaaaggatttagttaccagactgatggaagttgaacaggatcagcgcattaccgctgaggaggcaatctctcacgagtggataagcgggaatgctgctagcgacaagaatatcaaggatggcgtgtgtgcgcagatcgagaagaatttcgctcgagctaagtggaagaaggcagtgcgtgttacaactctgatgaaacgcttgcgcgctcctgagcaatctagcactgccgcagctcagagtgcatccgccaccgataccgctactcctggagccgctggcggtgccactgctgccgcagcctctggagctacatccgcccctgagggtgatgcagcacgcgctgctaagtccgataacgtagcccctgccgacaggagcgccaccccagcaacagacggttccgctacccccgcaacagacggcagcgttacgcccgctaccgatggaagtataacacccgcaaccgatgggagcgttacccctgccacagacaggtccgctacgccagccactgacgggcgagccactcccgctacggaggagtccaccgtgcccaccacacagtcttctgctatgctggccacaaaagcagcagctacaccggaacctgctatggctcaacccgactccactgctcccgaaggcgctacggggcaagctcctccgtcatctaaaggcgaggaagcagccggttatgctcaggaaagccagcgggaagaggcctcctag

SEQ ID NO: 48740 - DNA, 1413 bp, Artificial Sequence
  Description of Artificial Sequence: Synthetic coding sequence
atgcccttcggatgcgtcaccctgggtgataagaagaactacaaccagcccagcgaagtgaccgacaggtatgatctggggcaggttatcaaaaccgaagaattttgtgaaatcttccgagctaaggacaagacaactggaaagctccacacctgcaagaaattccagaagcgggatggtagaaaagtgaggaaagcggctaaaaatgaaatcgggatcctcaagatggtcaaacacccgaacattttacaactggtggacgtgtttgtcacgcgaaaggaatattttattttcctggagctggctacaggtcgagaggtgtttgactggatactggaccagggctattactcggaacgggacaccagcaacgtcgttcgacaggtgctggaggcggtcgcttacttacactcgctcaagatagtccaccgtaatctgaaattggaaaatctggtgtattacaaccggttgaagaattctaaaattgtgatttcagatttccatcttgccaaactagagaacggactgattaaagaaccatgcggtacacctgaatacctcgcaccagaggttgtcggtagacagcgttacggtcgcccagtagattgctgggccattggggtcattatgtatatcctgctgtccggaaatccccctttctatgaggaggtggaggaggacgactacgaaaaccacgataaaaacctctttcggaaaattctggccggagactatgaattcgacagcccttattgggacgatatcagtcaggccgcaaaggacttagtgactcgccttatggaggtggagcaagaccagagaattacggcagaggaggccatcagtcacgagtggatttcaggtaacgcagcaagcgacaagaatatcaaagacggcgtttgtgcacagatcgagaagaactttgcacgggcaaaatggaaaaaggctgtccgggtcaccactctaatgaagcgcctgagggctcccgaacaatctagtacggcagccgcacaatccgcttctgctacggacacagcaactccgggagccgcagaccggagcgccacaccggctaccgatggctccgccacacccgcaactgacggtagtgtcactcccgcaacagatggatccatcactcctgctacagacggtagtgtcacacctgctacagaccgctccgcgacccctgcgacggatgggagagcgacccctgccactgaggaaagcacagtgccgaccactcaatctagcgcaatgcttgccacaaaggctgcagccacacccgagccggcaatggcacaacccgatagtaccgctcctgagggggcaaccgggcaggcaccaccatcaagcaagggagaggaggccgcagggtacgcgcaggagtcacagcgcgaagaagcatcctag

SEQ ID NO: 48741 - DNA, 1560 bp, Artificial Sequence
  Description of Artificial Sequence: Synthetic coding sequence
atggacgcagtgctggaacctttcccagctgataggttgtttcccggaagctctttcctcgatctcggcgacttgaacgagtctgatttcctgaacaacgctcactttcccgaacacctcgaccacttcaccgaaaatatggaagacttcagcaacgacttgttttcctctttttttgacgatcccgtgctagacgagaaatcccccctgcttgacatggaactagactccccgaccccaggcattcaagcagaacatagctattcactaagcggagattccgcaccccagtccccattagttcctatcaagatggaagacacaacacaggatgctgagcacggggcttgggcactgggacacaagctttgttccatcatggtcaagcaagagcagtccccagagctgcctgtcgacccccttgcagcgcctagtgcgatggcggcagctgccgcaatggcaacaacccccttgctgggcctgagcccacttagccgcctgcccatcccccaccaagccccaggtgagatgactcagttacctgtcatcaaagccgaacctctggaggtcaatcagtttctgaaggttactcccgaagaccttgtgcagatgcctcctactccccctagcagccatggcagcgattccgatggatcccagtccccgagatcgctgccgccatcctcaccagtgaggcctatggcccgatccagcacagccattagcacttccccactgctgaccgcgcctcataagctgcaaggaacatccggtcctctcttactcacggaagaagagaaacgcaccctgatcgccgaaggctaccctatcccaaccaaactgccactcactaaagccgaagagaaggccctaaagcgagtgcgtagaaagatcaagaataagatcagcgcacaagaatcccgcaggaagaagaaagagtacgttgaatgcttggagaagaaagtggagacatttacaagtgagaacaatgagctctggaagaaggtggaaaccctggaaaatgctaaccggactttgcttcagcagttgcaaaagctacagacactggtgactaacaaaatcagtaggccatataagatggcggctacacaaactggcacttgcctgatggtagcagcactgtgtttcgtgctcgtgttgggttcactggttccctgcctgcctgagttcagctcagggtctcagaccgttaaggaagaccccctggctgctgacggcgtgtataccgccagccagatgccctctcgctccctgctcttctatgatgatggcgcaggattatgggaggatgggcgatcaactctattgcccatggagccaccagatggatgggagatcaatcctggcggtccagccgagcagcggccacgcgaccacctccagcacgaccatctagacagcacccatgaaacgacaaaatatctgtccgaagcctggcccaaggacggaggtaatggaacatctcccgatttctcccactcaaaggaatggttccatgacagagatctgggtccaaataccaccatcaagctctcttag

SEQ ID NO: 48742 - DNA, 1296 bp, Artificial Sequence
  Description of Artificial Sequence: Synthetic coding sequence
atggatgctgtgcttgagcccttccccgctgaccgactcttcccaggtagttccttcctggatctgggagacctaaatgaatcggactttctgaacaatgcgcactttcccgagcacttagatcattttaccgagaacatggaggatttttcaaatgacctcttctcttcatttttcgatgatccggtgctcgatgagaagtcaccactgctggatatggagctagattcgccaacccctggtatccaagcagaacacagctattctttaagcggtgactccgcccctcagtctccgcttgttcctatcaaaatggaagacaccacgcaagaggatctcgttcaaatgccgcctacccctcctagcagccacggatctgattctgatggatcccagtccccccgttctttaccaccatcttcccccgtcaggcccatggccagatcctctacagcgatctccacctcgcctctgttaaccgcgccacacaaactacaaggtacctccggacccctcctccttaccgaggaagaaaaaaggactctcattgccgaaggatacccaataccaaccaagctgcctttgaccaaagccgaggagaaggccctcaaaagggttagacgcaaaattaagaacaagataagtgcccaggagtcaaggaggaaaaagaaggaatacgtggaatgtcttgaaaaaaaggtcgagactttcacaagtgaaaataatgaattgtggaaaaaggtcgaaaccctagagaatgcgaatcggacgcttctccagcagctgcagaagctccaaacactggtgactaacaaaataagccgcccatacaagatggcagcaactcagaccggaacttgcctgatggtggctgctctgtgtttcgttctggtgctgggctcgcttgttccgtgtttacctgaattcagcagcggcagccagaccgtgaaggaggatccgctcgccgctgatggcgtgtataccgcatctcagatgcccagcaggagcctccttttttacgatgatggggcaggtttgtgggaggacggacggtcgacactgctgcccatggaaccaccggacgggtgggagattaatccaggaggcccagccgaacaaaggcctcgggatcacttacaacacgaccacctcgactcaacccacgagaccactaaatatctttctgaggcctggccaaaggatgggggaaacgggacctctcccgacttctctcactcaaaggagtggttccacgatagggatctcggcccaaacacaaccattaagctgtcctag

SEQ ID NO: 48743 - DNA, 1560 bp, Artificial Sequence
  Description of Artificial Sequence: Synthetic coding sequence
atggatgcagtcctggagccttttccagccgaccgactgttccctggaagctcatttctggacctgggagaccttaacgagagcgacttcttaaacaatgcgcattttccggagcatctggatcatttcaccgagaacatggaggacttctccaatgatctgtttagctccttctttgacgatccagtgctggatgaaaaaagccccctgctggatatggagctcgacagccccactccgggtatccaggcggaacatagttacagtctcagcggcgacagcgcccctcagtcacctctcgtgcccattaagatggaggataccacccaggacgccgagcacggcgcatgggccttgggtcacaagttatgctcgattatggtgaagcaagagcagtcgccagagttgcccgtggatcctcttgccgcaccatctgcaatggcagcagctgctgccatggccacaaccccactgcttggcttatctcctttgagccggctccccatcccgcatcaggccccaggtgagatgacacagctgcccgtgattaaagcagaaccactggaggtgaatcagttcctcaaagtgactccagaggacctcgtccagatgccccctaccccaccatctagccacggttccgattcagatggttcccagtcacctcgcagtctccctccatcttcccctgtaagacccatggccaggagctcaactgccatatctacctctccactgttgacggctccacataagctacagggtacttctggcccactgctgctcaccgaagaagaaaagcgaaccctgatcgccgaaggctacccgatacccacaaaactgcccttaacaaaggccgaagaaaaggccttaaagcgggtcaggaggaaaattaagaacaaaatttccgctcaggagtcgaggcgcaagaaaaaggagtacgtggagtgtttggagaagaaggttgagactttcaccagcgagaataacgagctttggaagaaggtggagactctagagaacgccaaccgcacactgctgcaacagttgcagaagttacagactctcgtcacaaataagattagtcgaccttataaaatggcggctacacagaccggtacatgtctgatggtcgcggcactctgctttgtacttgtgctggggtctcttgtgccttgcctgccagagttttccagcggatcccagacagtgaaggaagaccccctcgcagctgatggtgtgtacaccgcgagccagatgccctcccgctcactgttattctacgacgatggcgctggactctgggaagatgggaggtctacccttctacccatggaaccacccgacggttgggagataaaccctggcggtccagcagagcaacgtcccagggatcacctgcaacatgatcacctcgattcaacacatgagactacgaagtacctatccgaagcctggcccaaagatggcggtaacggaacgagccccgattttagccactccaaggagtggtttcacgaccgcgatttaggaccaaacacgaccattaagctcagttag

SEQ ID NO: 48744 - DNA, 1563 bp, Artificial Sequence
  Description of Artificial Sequence: Synthetic coding sequence
atggaggtgttggaatccggggagcagggcgtgctgcagtgggacagaaagctgtctgagctgagcgaaccaggcgatggtgaagctctgatgtaccacacccacttcagcgagctgctggatgagttcagtcagaatgtgcttggccaacttctgaacgaccctttcctgtctgagaaatcggtgagcatggaagtcgagcctagccccacgtcaccagcaccactcattcaagctgagcactcatattccctgtgcgaggagcccagagcccagtcaccattcacacacataaccacaagtgacagcttcaatgacgacgaggtggaatctgagaaatggtacttgtccactgacttccctagtacttctataaagacagagccggtgactgacgagccaccccctggtctggtcccctcagttaccctgactattacagccatttcgacaccgcttgaaaaagaggagccacctctggaaatgaatacgggggtggactcatcttgccagactataatccctaaaatcaagctcgaaccccacgaggttgatcagtttctcaacttcagtccaaaagaggctccagtggaccatcttcatttacctcctaccccacctagctctcacggcagcgactccgagggaagtctcagcccaaatccccgtttgcaccctttctccttgcctcagacccatagcccttcgcgggctgctccccgtgcaccctctgccctctccagctcacccttactcacggcccctcacaagctgcaggggtccgggcctctagtgctgaccgaggaggagaagaggacgctaattgccgaaggataccctattccgacaaaattgcccctttccaagagcgaggagaaggcgttgaagaaaatcagaaggaaaataaagaacaagatcagcgcccaggagtccagacgtaaaaagaaagaatacatggactcattggaaaagaaagtcgagtcatgctctacagagaatttggagctccgaaaaaaagtcgaagtgctcgaaaacacaaacaggacgcttctccaacagttacagaagttgcaaacattggtcatgggcaaagtatcacggacctgcaagctggccggtacacagaccggcacatgtctcatggtggtcgttctgtgttttgctgtcgccttcgggtcctttttccagggctacggtccgtatccctcggccaccaagatggctctgccatctcagcattccctgcaagagccctacacagcatcagtggtgcgcagtcggaatctcttaatctatgaggagcatagtcctcccgaggaaagttcttctcctggctccgcgggagaacttggcggatgggacagaggatcttctctgttgcgggtctccggcctggagagtagaccagatgtcgatcttccacacttcatcatcagcaacgagacctcccttgagaagtctgtgttgcttgagctccagcaacacctagtctcagccaagctcgaaggtaatgagactctcaaggttgtcgaactagatagacgcgtcaatacaaccttttag

SEQ ID NO: 48745 - DNA, 528 bp, Artificial Sequence
  Description of Artificial Sequence: Synthetic coding sequence
atggaagtcctggagtcaggcgaacagggcgtgctacagtgggaccgcaagttgagtgaactgtcggaacccggagatggagaggccctaatgtaccatactcacttctctgagctgttggatgaattctcacaaaacgtgctgggccaactgctgaatgatcctttcctcagcgagaaatcggtgagtatggaggttgagcccagtccgacaagccccgctccgctgattcaggccgaacacagttacagcctgtgtgaggagccaagagcccaaagtccttttacccacatcacaacgagcgactcctttaacgatgatgaggtcgagtccgagaaatggtacctcagtaccgattttcctagcacctctatcaaaacagagccagtgaccgacgagcccccacccggactggttccttccgttacccttactatcacagctataagtacaccgctggagaaggaggagcctccgctagagatgaatacaggagttgactcgtcgtgtcagaccaacaccacatag

SEQ ID NO: 48746 - DNA, 747 bp, Artificial Sequence
  Description of Artificial Sequence: Synthetic coding sequence
atggaagtcttggaatcaggggaacagggcgtgttacagtgggatcgcaaactgtccgagctttccgaacccggagatggggaggctcttatgtaccatacccacttctcagaactcctggacgaattctctcagaacgtgcttggccagttgcttaatgacccatttctgtctgagaaaagcgtgtccatggaggtggagccgtcgccaacgtcacctgctcccctgattcaggctgagcactcgtactccctttgtgaggagccgagagcccagtcccccttcacacatatcacgacatccgatagctttaacgacgatgaagtagagtccgagaaatggtacctgtcaacggatttccctagcacctctatcaagacggagcccgttaccgacgagcctcctcctggcttggtgcccagcgtaacgttgactataacggccatctctactccattagagaaggaggaaccacccctagagatgaacacaggggtcgacagtagctgtcagaccattatacctaagatcaagctcgaaccacatgaagtagaccagtttctgaacttttccccaaaagaaggcctttcagctttacctgtgtccctttgggtgatggatatggtgtccggttccacagaaagagagtatggcgagcgggcaggcatgagcctgtaccacagatgttgttcttggctgtacgagatagcgctgtttttgaagaacaagaatttcgctagcaagtag

SEQ ID NO: 48747 - DNA, 1383 bp, Artificial Sequence
  Description of Artificial Sequence: Synthetic coding sequence
atggaggtgctggaaagtggcgagcagggtgtgctgcaatgggaccggaaattgtctgagttatccgagcctggcgacggtgaagccctgatgtatcacacccacttcagtgagctgctagacgaatttagccaaaatgtccttggccaacttcttaacgatccttttctgtccgaaaagagtgtgtctatggaagtggaacctagtcccacttctcccgctccactcattcaggccgagcacagctattctttgtgtgaggagccccgagcacagtctccttttacacacatcactactagtgacagctttaacgatgatgaagtggagtctgagaagtggtacttgtcgaccgattttccctccactagcataaagaccgagccagtcaccgacgaaccacccccagggcttgtgcctagtgtgaccctgacaataaccgccatttcaacaccgctcgaaaaagaggaaccaccactggaaatgaacaccggagtcgattcttcctgtcaaacgatcattccgaagataaagcttgaaccccacgaagttgatcagtttctaaatttttccccgaaggaggcccctgtcgatcacctgcacctcccgccaacaccaccttccagccacggatcagatagcgagggttccctgtctcctaacccgcgtctgcatccctttagcttacctcagacccacagcccctctcgggcagcacctagggctccttccgcacttagttcttccccacttctgacagcccctcacaagctgcagggaagcggccctctcgttctgacagaggaggaaaaaagaactctgatcgctgaaggctatcctattccgacaaagttgcctctgagcaagtccgaagaaaaagccttgaaaaagatccggagaaagatcaaaaataagatttctgctcaggaaagccgcagaaaaaagaaagagtacatggactcactcgagaagaaggtggaatcctgttccactgaaaacctggagttacgcaaaaaagtcgaggtgttggaaaatactaatagaaccttactgcaacagctccaaaagctgcagacactcgtcatgggcaaggtgagccgaacttgcaagttggcaggaacacaaactggaacatgcctgatggtggttgtgctgtgcttcgctgtcgctttcggttcttttttccagggatatgggccatatccttccgctactaagatggcactgccatcgcagcatagtcttcaggagccatatacagcttcagtgggcaagacggcttgtggcaagctggggagagtgcttttctacttccctcgcgctggctttctctccctccccaagggcattttctgtgagtctccgatgttcaaaaaatggtag

SEQ ID NO: 48748 - DNA, 453 bp, Artificial Sequence
  Description of Artificial Sequence: Synthetic coding sequence
atggaggtcctggagtcaggcgagcagggggttcttcagtgggatcgcaagttgtccgaactgagtgagcctggggatggggaggcactcatgtatcacacacactttagcgagctcctagacgaattctcccagaatgtgttaggccaattgctaaacgaccctttcctgagtgagaaatccgtgtctatggaagtggaaccttctccgacatctccagccccactgattcaggccgagcattcatatagcctctgcgaagagccccgagctcagtctcctttcacgcacattaccacctccgactcgttcaatgatgatgaagtggaatccgagaaatggtacctgtctacagacttccctagcacctctatatgccacagcgaccaccactcacaccttcatcctgtagggaagggagggaccagctccgggaacgagcactggggttag

SEQ ID NO: 48749 - DNA, 1311 bp, Artificial Sequence
  Description of Artificial Sequence: Synthetic coding sequence
atggttggcttcggcgctaatagaagagcaggacgcttgccttccctggtccttgtcgttctcctcgtggttatcgtagtcttggcattcaactattggtccatctctagtcggcacgtcttgctgcaagaggaagtggcagagctgcaggggcaggtgcagaggacggaggtggcacggggtcggcttgaaaaacggaatagtgatctgctcctgttggtcgatactcataaaaagcaaatagaccagaaggaggccgactatggtcggctgagcagcagactgcaggctagagaaggcttagggaaacggtgtgaggatgacaaagtgaagttgcagaacaatatctcctatcagatggctgatatccaccatctgaaggagcagctcgcggaactgcgtcaggagtttttgcgacaagaagaccagcttcaggattataggaagaacaacacatatcttgtcaaaagactggagtacgagagctttcaatgtggccagcagatgaaagagctccgggcacaacacgaagaaaacattaaaaaacttgccgatcagtttctggaggagcagaaacaggagacacagaagatccaaagcaatgatggcaaagaactcgatatcaacaatcaggtggtgcctaaaaacatccccaaagtagcagaaaatgtggccgacaagaacgaggagccctcctccaaccacatcccccacggcaaagaacagatcaagcgcggtggcgacgctgggatgccaggcatagaggaaaacgaccttgccaaagtagacgatctgccaccagccttaagaaaaccacctatttctgtgagccagcacgagagccaccaggcaatttcccacttgcccaccggacagccactcagccctaatatgcctccagactcccacattaatcacaacgggaacccgggaactagcaagcagaacccctcttcccctcttcagcggctgatcccaggatccaacctggactcagaacctcggatacagacagacatcttgaaacaggctaccaaggacagagtgagcgatttccacaaactgaaacagtcaagatttttcgacgagaacgaatcgccagtcgacccccagcacggctccaaactagccgactataatggtgacgacggtaatgtaggggaatatgaagccgacaagcaagcggagctcgcttataacgaggaagaggacggcgacgggggagaggaggacgtccaagacgatgaggagagggagctccaaatggaccctgccgactacggaaaacagcatttcaatgacgtgttgtag

SEQ ID NO: 48750 - DNA, 1143 bp, Artificial Sequence
  Description of Artificial Sequence: Synthetic coding sequence
atggtgggattcggagccaatcgacgcgctggcaggctgccatcactggtcttagtcgttctactcgtggttattgttgttctcgcctttaactactggtcaatctcaagccgccatgtcttactgcaggaagaggtggctgaattgcagggccaagtccagagaactgaggtggccagaggcagactggaaaaaaggaatagcgatctacttcttctcgtggatacccataaaaagcagatcgatcaaaaagaggctgactacggacgactgagctcccggctccaggctcgggagggcctgggtaaacgttgcgaagacgataaggtcaaacttcagaataatatctcataccagatggctgacattcaccatctgaaggagcagctcgctgagttacggcaggagtttctgagacaggaggaccaacttcaggattaccgcaaaaataatacttacctcgtgaaacggcttgaatatgaaagcttccagtgtggacagcagatgaaggaactgcgagcccaacacgaggaaaacatcaagaaactcgccgaccagttcttagaagaacagaaacaagagacccagaagatccagtccaacgatggtaaagagttagatatcaataaccaagtcgtgcccaagaatataccgaaggtggcagaaaatgtggctgataaaaacgaggagcccagcagcaatcacattcctcatggaaaagaacagataaagcgaggcggtgacgccggaatgccgggaatagaagagaacgatttggccaaggtcgacgatctgccaccagcactccggaaaccacccataagcgtgtcccagcatgagtcacaccaggcaatttcccacctccctactggccaacccctgagtccaaatatgcctcccgattcccacattaatcacaatggcaaccccggtacttcaaagcaaaatccatcttcccccctgcaaaggctaattccagggtctaaccttgatagcgagccacgtatacagacggacattttaaagcaggcaaccaaagatcgagtttccgacttccataaactgaagcagaacgatgaagaaagggaattgcagatggatcccgctgactatgggaagcagcatttcaatgacgtcttgtag

SEQ ID NO: 48751 - DNA, 534 bp, Artificial Sequence
  Description of Artificial Sequence: Synthetic coding sequence
atggttggcttcggcgctaataggcgggctggcaggctcccctcattggtgttggtggttctgttagtggtgatcgtggttctcgcgttcaactattggtccatcagcagccgccatgttctgctgcaggaggaagtcgccgagctgcagggccaagtgcagcgaacggaggtggcaagaggacggctcgaaaagcgcaatagcgacctgctgctattggttgatacacataaaaaacaaatcgaccagaaggaggctgactatggacggctatcttcaaggttgcaggcgcgagaaggactcggcaagagatgcgaagacgataaggttaagctccagaacaacatttcttatcagatggccgatattcaccacctgaaggagcagttagcagaactgcgccaagaatttctgcggcaggaagaccagttgcaagactatcggaagaacaatacttacttggtgaaacgactcgagtacgagagcaaacgaccaaagagatttaatcagatgatggaaaggaactggatttag

SEQ ID NO: 48752 - DNA, 1248 bp, Artificial Sequence
  Description of Artificial Sequence: Synthetic coding sequence
atggtagtgatcgtggtactggccttcaattattggtccatctccagtcggcacgtcctgctacaggaggaggtcgcagagttgcagggtcaggtgcagcggacagaggtggcgagagggagactggagaaaaggaactctgatcttctgcttcttgtagacactcacaaaaaacagattgaccagaaggaggcagattatggccgtctgagctctaggctccaagccagagaggggctcgggaagcgctgtgaagatgataaagtcaaactccagaacaacattagctatcagatggcagacatccatcatctgaaagagcaactggccgagctgcgtcaggagttcttgcggcaggaagatcaactccaggattatcgcaagaacaatacttacctcgtgaaacgattggagtacgaaagctttcagtgtggacagcagatgaaagaactccgggctcaacatgaggagaacataaagaaactggccgaccaattcctggaagaacaaaagcaggagacccagaagatccagtctaacgacgggaaggagctagatattaacaaccaagttgttcccaagaacattccaaaggtggcagaaaatgtggcggataagaatgaggaaccctcttctaatcatatcccccacggaaaggagcagatcaagcgaggcggagacgccggaatgcctggaattgaagaaaacgatcttgcaaaggtagatgacctcccaccagccctgcgcaaaccccctatcagcgtttctcaacacgaaagccaccaagctatctcacatttacccaccggccaaccattaagtccgaacatgcctcccgactctcacattaatcacaatgggaacccaggaacatctaaacagaatcccagttcccctcttcagcggctgataccaggcagcaatctcgactcagagccaagaattcagaccgatattctaaaacaggctacaaaagatcgagtatctgatttccacaaacttaagcagtccagattctttgacgaaaacgaaagcccagtcgacccacagcacgggtcaaaattggcagattacaacggggacgatgggaacgtgggagaatacgaagcggacaaacaggctgagcttgcgtacaacgaggaggaggatggtgatggcggagaggaggatgttcaggatgacgaggagcgtgaactgcaaatggatccagccgactacggcaagcaacatttcaatgatgtgctgtag

SEQ ID NO: 48753 - DNA, 75 bp, Artificial Sequence
  Description of Artificial Sequence: Synthetic coding sequence
caggatgatgaagaacgggaactgcagatggaccctgccgactacgggaagcagcatttcaatgatgtactgtag

SEQ ID NO: 48754 - DNA, 1302 bp, Artificial Sequence
  Description of Artificial Sequence: Synthetic coding sequence
atggtggggttcggcgctaataggcgggctggacgcttgccctcactggtgttagtggtgctgttagttgttatcgtggtgctggcattcaattactggtctatctcgtcgagacacgtgctgttgcaggaagaagttgccgagcttcaggggcaggtgcaaaggacagaggtcgccagaggaaggctggaaaagcggaactcagatcttctgctcttagtcgatacgcataagaagcagattgaccagaaagaagctgattacggcaggctaagctctcggctacaagctagagaaggtttgggaaaacgctgcgaagacgacaaggtgaagctgcagaacaacatatcctatcagatggcggacatacaccatctgaaggagcagcttgcggaactgaggcaggagttcttgcgccaagaagaccaactccaggattatcgaaagaacaacacatatctggttaaacgtctcgagtacgaatcctttcagtgcggacagcagatgaaagagctgcgagcccagcacgaagagaatattaagaaactggcagatcagttcctggaggaacaaaaacaagaaactcagaagatacagtccaacgacggaaaagagctcgacatcaataaccaggtggtgccaaaaaacatcccaaaggttgccgaaaacgtggctgataaaaacgaagaaccttcatccaatcacattccccacggaaaagagcaaataaagcgcggaggggacgcaggtatgcccggaatcgaagagaacgacttagccaaagtcgatgacctcccacctgccctgaggaaaccccctattagcgttagccagcatgagtctcatcaggctatctcccacctgcctaccggccaacccttatcgcccaatatgccgcctgactctcacattaaccataacggaaaccccggtacctcaaagcagaatccaagttcacccctgcaaaggctaatacccggatccaacctggactctgaaccacggatccagacagatattctgaagcaggctaccaaagacagagtctcggacttccacaagctgaaacagtcacgctttttcgacgagaatgagagccccgtcgatccacagcatggcagcaagcttgctgactataacggcgatgatgggaatgtgggcgagtacgaggcagacaaacaagctgagttggcttacaatgaggaagaagacggtgatggaggggaggaagacgtccagggcgaacgagggcctggtctccacgccattacgatgaagccaacatcaaaatttttcggctag

SEQ ID NO: 48755 - DNA, 549 bp, Artificial Sequence
  Description of Artificial Sequence: Synthetic coding sequence
atgaagggttggggatggctggctcttttactcggagcgctcctgggcacagcctgggccaggcggtcacaagatctccattgtggagcgtgtcgggcactggtggatgagctagagtgggagattgcgcaggtggaccccaagaaaacaattcagatgggctcttttcggatcaatccagacggcagtcagtccgtggtcgaggttccctatgcccgatccgaagcccacttgaccgagctgctggaggagatctgcgatagaatgaaggagtacggcgagcagattgacccatcgacgcacaggaaaaactatgtgcgcgtggtgggtcggaatggggaaagttcagagctggacctccaggggattagaatcgattcagacatctcggggactcttaagtttgcatgcgagtctatagttgaagaatacgaggacgagctgatagaatttttttccagggaagcagataatgtgaaggataaactctgttctaaacggacagacctgtgcgatcatgctcttcacatttcacacgatgaattgtag

SEQ ID NO: 48756 - DNA, 507 bp, Artificial Sequence
  Description of Artificial Sequence: Synthetic coding sequence
atgaaagggtggggctggcttgcactgctccttggagctctcctcgggaccgcatgggctagaagatcccaggacctacattgcggagcttgcagggcattggtagacgagctagagtgggaaattgcacaggtagacccaaagaagaccatccagatgggttcattccgcatcaatccggacgggtcacaaagtgtggttgaggtgccatacgctcgcagtgaagcccacctgacggagttgctcgaagaaatctgtgatagaatgaaagagtacggcgaacagattgaccctagcacccatcgtaagaactacgtgagagtagtcggcagaaacggcgagtctagtgagctcgacttgcagggcattagaatagacagcgacatatctggaacactgaaatttgcgtgcgaatcaatagttgaagaatacgaggatgaactcatcgagtttttttctcgcgaggctgataacgtcaaagacaagctgtgctccaaacgaacatag

SEQ ID NO: 48757 - DNA, 1644 bp, Artificial Sequence
  Description of Artificial Sequence: Synthetic coding sequence
atgaccaagacagaccctgcccctatggctccgccacctagaggcgaggaagaagaggaagaagaagaggacgagcccgtgccggaagctccctccccaacacaagaacggagacagaagccagtcgtccatcccagtgccccagctccattgcccaaggactacgctttcaccttttttgaccccaacgatccagcctgtcaggagatcttattcgaccctcaaactactatcccggaattattcgctattgtccgacaatgggtgccccaagtccaacataaaatcgacgtgataggcaacgagatactgcggcgaggctgtcacgttaacgatcgggacggccttacagacatgactctcttgcattatgcgtgcaaggccggtgcccacggggttggggatcctgctgccgcagtgagactcagtcagcagctgctcgccctgggtgcagacgtgacgctgaggtctcggtggaccaatatgaatgcattacactacgccgcttactttgacgttcccgacctggtcagggtcctgctcaagggtgcacgtcctcgagtcgtcaattcgacatgtagcgatttcaaccatggcagcgctcttcacattgctgcctcttccctttgtcttggagctgccaaatgcctgctggagcacggtgcgaatcccgcacttcggaacagaaaaggacaggtgcctgctgaagtggtgcccgatccgatggacatgtccctcgacaaagccgaagccgctctggttgcaaaagaattgcggactctgctcgaggaggcagttcctctgagctgcgcgctgccgaaggtaaccctccccaattatgataatgtcccaggaaaccttatgctctccgcacttggacttcgcttgggggacagagttctgcttgatgggcaaaagacagggaccctgcgcttctgcggtacaacggagttcgccagcgggcagtgggtcggggtggagctcgacgaacccgagggaaaaaacgacgggagtgttgggggagttcggtacttcatatgtccacctaaacagggacttttcgcctctgtatctaaaatctccaaagctgttgacgctcctccttcctcggttactagcactccccgtacaccacggatggacttttctagagtgacaggaaaaggccgaagggagcacaaggggaaaaagaaaacaccaagtagtccaagcctgggctcactccagcagagagatggcgcaaaggccgaggtgggcgatcaggtcctggtggctggtcaaaagcagggcatcgtccgattttacgggaaaacagactttgcgcctggatactggtatgggattgagctggaccagcctactggtaaacacgatgggtctgtgttcggggtgcgctattttacgtgccccccaagacatggtgtctttgctcccgcatctaggatccaacgcatcggaggatccactgattctcctggggactccgtgggggcaaaaaaagttcaccaggtaacaatgactcagcctaagaggacctttaccaccgtcagaacacccaaagatattgcttcggaaaatagcattagtcggctgctcttctgttgttggttcccatggatgctgcgagcagagatgcagtcttag

SEQ ID NO: 48758 - DNA, 1572 bp, Artificial Sequence
  Description of Artificial Sequence: Synthetic coding sequence
atgaacccaagtcccagaccccctgctccccctcgcagtgctggcagaagcttactgtgcacgcctaggcacctaccgccttcattgcgaacaaccctgacctttttcgaccccaatgaccccgcatgtcaggagattctgttcgaccctcagaccaccatccccgaactgtttgccatagtgcgacagtgggtccctcaggtgcagcacaagattgatgtgattggaaatgaaatcctccgccgaggatgccacgtcaacgatcgggatggtctgaccgacatgacgctcctccactacgcttgtaaggcaggcgcacacggcgtgggtgatccagccgcagctgttaggttatcccagcagcttctggcactgggagcagacgtgactttgcggagtcgatggacaaacatgaacgctttgcactacgccgcatactttgatgtgcccgacttggttagggtcttgctcaagggcgcaaggcctcgcgtcgtgaatagtacctgttcagactttaatcacggcagcgccttgcacattgccgcttcttctttatgcctgggcgcagccaaatgcctgctggagcacggggcaaatcctgcactgcgaaaccgcaaagggcaggtgccagccgaggtggtacccgaccccatggacatgtctctggacaaggcggaggcagcccttgtcgccaaagagctgagaacactgctggaggaagctgtgcctctgtcatgtgccctgcctaaagttacattgcctaattatgacaatgttccgggtaacctcatgctatcagcactggggctccgcttaggagatcgagtactgctggatggccagaaaacaggtacactgcgattctgtggcaccactgagtttgcttcaggtcagtgggtgggggtagagctggatgagcccgaagggaagaacgacggaagcgtaggcggagtccgctattttatttgtccacctaagcagggcctttttgcttctgtcagcaagatttctaaggcagtggacgccccaccttcttccgtgacgagcacccctcggactcctcgcatggatttttctcgcgtgaccggcaagggaaggcgagagcataaaggtaaaaaaaagacgccgtcatcaccgtcgcttggctcactacagcaacgggacggggcaaaggctgaagtgggcgaccaggtcttggtagctgggcagaagcaggggatagttaggttctacggcaagaccgacttcgcgccaggttattggtacgggatcgaactggatcagcctacagggaaacatgatgggagcgtgttcggagtcagatacttcacatgtccaccacgtcacggagtgttcgctcctgcatcaagaatacaacgtataggtggctccacagactctcctggtgactccgtgggagccaagaaagtgcaccaagtgactatgacccagccgaagcgaacatttaccacagttcggactcctaaggatatcgctagcgaaaactcgataagcagacttctcttctgttgctggttcccctggatgttgcgagccgagatgcagtcatag

SEQ ID NO: 48759 - DNA, 1290 bp, Artificial Sequence
  Description of Artificial Sequence: Synthetic coding sequence
atgacactcctgcactacgcctgcaaagctggagcccacggtgttggagatccggctgccgcagtgagattatcgcagcagttactggcattaggcgctgacgtgacattacggtccagatggaccaatatgaacgcactccactatgccgcttatttcgacgtgcccgatctggtacgcgtgctcctgaaaggagcaagaccgagagtggtgaatagcacctgcagcgactttaaccatggctccgctctgcacatagccgcttcctcactgtgtctaggcgcagcaaagtgtctcctcgagcacggcgctaatcccgctttacgaaatcggaagggccaggtgccagccgaggtggtccctgaccctatggacatgagtctggacaaagccgaggctgcactggttgctaaggagctaagaactctcctcgaagaggcagtgcctctgtcctgtgcactcccaaaggtgactctgcccaactatgacaatgtacctggaaatctcatgctttctgccctaggtctgcggctgggagatcgggtactgctggatggacagaagacagggactcttaggttttgcggcactaccgagttcgccagcgggcagtgggttggtgtggaattagatgagccggaaggcaaaaacgatggctctgtgggaggagtgagatacttcatctgccctccaaaacaaggcctatttgcttctgtttctaaaatctctaaagccgttgatgccccaccatcatcagttacttctactcctaggacaccaaggatggatttctccagagttacgggcaaaggccgtcgagagcataaaggtaaaaaaaagacgcccagcagcccgtcactcggtagcctgcaacagagagatggtgcgaaagctgaagtcggcgaccaggtactcgttgctggccagaaacaggggattgtcaggttctacgggaagacagattttgctcctggctactggtatgggatcgaacttgatcagcctaccggaaaacatgacgggtccgtgtttggcgtgaggtactttacttgtcccccacgccatggagtctttgcgccagcttctcgaattcagcggattggaggcagcaccgactcccctggggacagcgtaggtgccaagaaggtccaccaggtcaccatgactcagccgaagaggaccttcacaacagttcgcactcccaaggatattgctagcgaaaatagcattagccggctgctgttttgctgctggttcccctggatgctgcgcgcagagatgcagtcctag

SEQ ID NO: 48760 - DNA, 1059 bp, Artificial Sequence
  Description of Artificial Sequence: Synthetic coding sequence
atgaagccagctcttttagaagtgatgcgcatgaatcgcatatgtcggatggtgcttgccacttgcttgggttcttttattttggtgatcttctacttccagagcatgttgcaccccgtgatgagaaggaacccattcggtgttgacatttgttgtcgcaaaggaagtcgtagtcctttacaggagctgtacaatccaattcaacttgaactttctaatactgcggttctccatcagatgcgccgtgatcaagtgacggatacctgtcgtgccaactctgccacctctagaaagagacgcgtgttgacccctaacgatctgaaacacctggtcgtggatgaggatcacgagctcatttattgttatgttcctaaggtagcttgtactaactggaagcggctcatgatggtactaacgggcagaggcaagtactcggatcctatggagatccctgcaaacgaggcacacgtgtcggcgaatctcaaaactcttaatcaatattccatacctgagatcaatcaccggctcaaatcttatatgaaatttcttttcgtgagagagccatttgaaagattggtttccgcatacaggaacaaattcacccagaaatataacatctctttccacaaacggtatggtaccaaaatcattaagaggcaaaggaagaatgcaacccaggaggcattaaggaaaggtgatgacgtgaagtttgaggaattcgtcgcttatttgattgaccctcacactcagcgcgaggagccttttaatgaacactggcagaccgtgtactcactgtgccatccctgtcacatccactatgacttggtaggaaaatatgagactttggaggaggactccaactatgtcctgcaactggctggagtggggagctatctgaaatttcctacttatgcgaaaagcacccggacgacagacgagatgacaacggagttttttcagaatattagttcagagcatcagactcagctgtatgaggtttacaagctcgacttcctgatgtttaactactcagtgcccagttatctaaagctcgaatag

SEQ ID NO: 48761 - DNA, 1044 bp, Artificial Sequence
  Description of Artificial Sequence: Synthetic coding sequence
atgaagcccgctctcttggaggtgatgcgcatgaatagaatttgtcgtatggtcctggcaacttgtcttggcagcttcattctcgtaatcttttactttcaaatcatgcgccgaaatccctttggggtcgacatctgctgccgcaagggcagccgcagtcccttgcaggaactttacaatccgattcagctcgagctgagcaacaccgcagtactgcatcagatgcgaagagaccaggttacagacacctgcagagccaattccgctacaagtcgtaagcgaagagtgcttactcctaatgacctaaaacatctggtcgttgacgaagatcacgagcttatctattgttatgtgcccaaggtagcatgtaccaactggaaaagactgatgatggtgctgacagggagggggaaatattccgatccaatggagatccctgctaacgaggcccacgtgtccgcgaatctcaagacactgaatcagtactccatcccagagatcaaccacaggctgaaatcctatatgaaatttctatttgttagagaaccatttgaacggttggtgtccgcctacagaaataagttcacccagaaatataacatatcattccacaaacgatacggtactaaaataatcaaacgtcaacgaaaaaatgcaacccaagaagcactgaggaagggcgacgacgtcaaatttgaggaatttgttgcatacttgatcgatcctcacacacaacgcgaagagccatttaacgagcactggcaaactgtgtacagcctgtgtcatccatgccacattcactatgatctggttggaaagtatgaaaccctcgaggaggacagcaattacgtgcttcagctcgccggagtcggttcatacctgaagttccctacatacgccaaatcaacaagaactacagacgaaatgacaacagagttttttcaaaatatctctagcgagcatcagacccagctttacgaagtgtataaactggacttcctcatgtttaactacagcgtgccctcgtacctcaagctggagtag

SEQ ID NO: 48762 - DNA, 1245 bp, Artificial Sequence
  Description of Artificial Sequence: Synthetic coding sequence
atgacgaaggctagacttttcaggctgtggctcgttcttggaagtgttttcatgattctcttaataatcgtctactgggatagtgccggtgcagcacatttctacctgcacacctccttctcccggcctcacacaggacccccactacctaccccagggcctgaccgcgatcgtgagctgaccgcagactctgacgtcgacgaattcctggataaattcctgagcgcaggggtaaaacagtctgaccttccgcgaaaagagactgagcaacctcccgcaccaggatcaatggaggaatcggttcgagggtacgattggagtcccagggatgccaggagatcaccagaccagggcagacaacaagccgagcgtaggtccgttcttagggggttctgcgccaactcctccctggcctttcccaccaaagagagagcctttgatgatattcctaattcagagctgagccatcttattgttgacgataggcacggcgcaatctactgttatgtccccaaggtggcgtgcacaaattggaagagggtgatgatcgtgttatccggcagcctcctgcatcgaggggcaccctacagagatcccctccgcatacccagagagcacgtgcacaacgcctccgcccacctaaccttcaacaagttctggaggagatacggaaagctgtcacggcacctgatgaaggtgaagcttaagaagtataccaaatttctgttcgtgagggacccattcgtcaggttgattagcgcattccggtctaaattcgagctggaaaacgaggaattctatagaaagtttgcagtgcctatgctccgtctttatgctaaccacacaagcctgcccgcatcagccagagaagctttcagagccggtctaaaggtcagctttgccaacttcatccagtatttgctcgacccgcacaccgaaaaacttgctccatttaatgagcattggaggcaggtctatcgcctgtgccacccctgtcagattgactacgacttcgtggggaagttggagacccttgacgaggatgcagctcagctgctccagctgttgcaagttgataggcagttacgctttccgccttcctaccgcaatcggactgccagcagttgggaagaggactggttcgccaagattcccctggcctggcgtcagcaactctacaaactctatgaagccgacttcgtgctcttcggataccctaaacccgaaaatttgttgcgggattag

SEQ ID NO: 48763 - DNA, 738 bp, Artificial Sequence
  Description of Artificial Sequence: Synthetic coding sequence
atgacaaaggctagattgtttcgactctggttggttttaggcagcgtgttcatgatcctgctgatcatcgtgtactgggactctgcgggagctgcccacttctatctgcatacttcattcagccggccacacaccgggcctcccctgcctactccaggtcccgacagggatagggaactgactgcggactcagatgtggacgagtttctcgataagttcctgagcgccggagtaaaacagtcagatctgccgagaaaggagacagaacagcctccggctcccggatctatggaagagtccgttcgtggctacgattggagccccagagacgccaggaggagcccagatcagggcagacagcaggcagaaaggcgaagcgtgctgcgcggtttttgcgctaatagcagcttagccttcccaactaaggagagagcattcgatgacattcctaactcagagctttcccatttgattgtggatgatcgccatggagcaatttattgttatgtgcctaaggttgcatgcaccaattggaaaagagttatgatagtgttatcaggatccctcttacatcggggtgcaccctaccgagatccattgcggatcccaagagaacacgtgcacaatgcttccgctcacctgaccttcaacaaattttggcgtagatacggaaaactcagtcggcatctcatgaaggtcaagcttaagaaatacacaaaatttctgttcgtgagatag
